United States Patent 10,463,751 (MODIFIED POLYNUCLEOTIDES FOR THE PRODUCTION OF CYTOPLASMIC AND CYTOSKELETAL PROTEINS) - sequence listing, part 6

SEQ ID NO: 8067 - protein, 216 aa, Homo sapiens
MNNQKQQKPTLSGQRFKTRKRDEKERFDPTQFQDCIIQGLTETGTDLEAVAKFLDASGAKLDYRRYAETLFDILVAGGMLAPGGTLADDMMRTDVCVFAAQEDLETMQAFAQVFNKLIRRYKYLEKGFEDEVKKLLLFLKGFSESERNKLAMLTGVLLANGTLNASILNSLYNENLVKEGVSAAFAVKLFKSWINEKDINAVAASLRKVSMDNRLM

SEQ ID NO: 8068 - protein, 142 aa, Homo sapiens; identical to SEQ ID NO: 7587

SEQ ID NO: 8069 - protein, 148 aa, Homo sapiens
AIHILDVLVLNGTDVREQHFNQRIQLAEKFVKAVSKPSRPDMNPIRVKEVYRLEEMEKIFVRLEMKIIKGSSGTPKLSYTGRDDRHFVPMGLYIVRTVNEPWTMGFSKSFKKKFFYNKKTKDSTFDLPYYPFPSFFFPNRRYNLLLFV

SEQ ID NO: 8070 - protein, 99 aa, Homo sapiens
MEEIPAQEAAGSPRVQFQSLETQSECLSPEPQFVQDTDMEQGLTGGILLRLPTTRIHSVNSCPALSHTQASAFSGETLAVLTAGISKRWPKYRLPIDIA

SEQ ID NO: 8071 - protein, 830 aa, Homo sapiens
MKRGRLPSSSEDSDDNGSLSTTWSQNSRSQHRRSSCSRHEDRKPSEVFRTDLITAMKLHDSYQLNPDEYYVLADPWRQEWEKGVQVPVSPGTIPQPVARPKKYIVSSGSEPPELGYVDIRTLADSVCRYDLNDMDAAWLELTNEEFKEMGMPELDEYTMERVLEEFEQRCYDNMNHAIETEEGLGIEYDEDVVCDVCQSPDGEDGNEMVFCDKCNICVHQACYGILKVPEGSWLCRTCALGVQPKCLLCPKKGGAMKPTRSGTKWVHVSCALWIPEVSIGSPEKMEPITKVSHIPSSRWALVCSLCNEKFGASIQCSVKNCRTAFHVTCAFDRGLEMKTILAENDEVKFKSYCPKHSSHRKPEESLGKGAAQENGAPECSPRNPLEPFASLEQNREEAHRVSVRKQKLQQLEDEFYTFVNLLDVARALRLPEEVVDFLYQYWKLKRKVNFNKPLITPKKDEEDNLAKREQDVLFRRLQLFTHLRQDLERVRNLTYMVTRREKIKRSVCKVQEQIFNLYTKLLEQERVSGVPSSCSSSSLENMLLFNSPSVGPDAPKIEDLKWHSAFFRKQMGTSLVHSLKKPHKRDPLQNSPGSEGKTLLKQPDLCGRREGMVVPESFLGLEKTFAEARLISAQQKNGVVMPDHGKRRDNRFHCDLIKGDLKDKSFKQSHKPLRSTDVSQRHLDNTRAATSPGVGQSAPGTRKEIVPKCNGSLIKVNYNQTAVKVPTTPASPVKNWGGFRIPKKGERQQQGEAHDGACHQHSDYPYLGLGRVPAKERAKSKLKSDNENDGYVPDVEMSDSESEASEKKCIHTSSTISRRTDIIRRSILAS

SEQ ID NO: 8072 - protein, 133 aa, Homo sapiens
MASEDIAKLAETLAKTQVAGGQLSFKGKSLKLNTAEDAKDVIKEIEDFDSLEALRLEGNTVGVEAARVIAKALEKKSELKRCHWSDMFTGRLRTEIPPALISLGEGLITAGAQLVELDLSDNAFGPDGVQGFE

SEQ ID NO: 8073 - protein, 129 aa, Homo sapiens
MSPGSGVKSEYMKRYQEPRWEEYGPCYRELLHYRLGRRLLEQAHAPWLWDDWGPAGSSEDSASSESSGAGGPAPRCAPPSPPPPVEPATQEEAERRARGAPEEQDAEAGDAEAEDAEDAALPGNAWLRT

SEQ ID NO: 8074 - protein, 129 aa, Homo sapiens; identical to SEQ ID NO: 6440

SEQ ID NO: 8075 - protein, 133 aa, Homo sapiens
MAEKLITQTFSHHNQLAQKTRREKRARQEAERREKAERAARLAKEAKSETSGPQIKELTDEEAERLQLEIDQKKDAENHEAQLKNGSLDSPGKQDTEEDEEEDEKDKGKLKPNLGNGADLPNYRWTQTLSELD

SEQ ID NO: 8076 - protein, 790 aa, Homo sapiens; identical to SEQ ID NO: 4974

SEQ ID NO: 8077 - protein, 451 aa, Homo sapiens
MYGAPGAPAQSASVTVVRSLRRPPPQATGVSFMNNQKQQKPTLSGQRFKTRKRDEKERFDPTQFQDCIIQGLTETGTDLEAVAKFLDASGAKLDYRRYAETLFDILVAGGMLAPGGTLADDMMRTDVCVFAAQEDLETMQAFAQVFNKLIRRYKYLEKGFEDEVKKLLLFLKGFSESERNKLAMLTGVLLANGTLNASILNSLYNENLVKEGVSAAFAVKLFKSWINEKDINAVAASLRKVSMDNRLMELFPANKQSVEHFTKYFTEAGLKELSEYVRNQQTIGARKELQKELQEQMSRGDPFKDIILYVKEEMKKNNIPEPVVIGIVWSSVMSTVEWNKKEELVAEQAIKHLKQYSPLLAAFTTQGQSELTLLLKIQEYCYDNIHFMKAFQKIVVLFYKAEVLSEEPILKWYKDAHVAKGKSVFLEQMKKFVEWLKNAEEESESEAEEGD

SEQ ID NO: 8078 - protein, 315 aa, Homo sapiens
MAGGAREVLTLQLGHFAGFVGAHWWNQQDAALGRATDSKEPPGELCPDVLYRTGRTLHGQETYTPRLILMDLKGSLSSLKEEGGLYRDKQLDAAIAWQGKLTTHKEELYPKNPYLQDFLSAEGVLSSDGVWRVKSIPNGKGSSPLPTATTPKPLIPTEASIRVWSDFLRVHLHPRSICMIQKYNHDGEAGRLEAFGQGESVLKEPKYQEELEDRLHFYVEECDYLQVVAWQCALQGGSSSHPANYLSSLTPAQGFQILCDLHDGFSGVGAKAAELLQDEYSGRGIITWGLLPGPYHRGVSGTWRSKHSNPIGRVA

SEQ ID NO: 8079 - protein, 94 aa, Homo sapiens
CTSSCTPSCCQQSSCQPACCTSSPCQQACCVPVCCKTVCCKPSSCQPACCISSPCQQSCCVPVCCKPICCVPPACCTTSCCRPSSSVSLLCRPV

SEQ ID NO: 8080 - protein, 406 aa, Homo sapiens
MAANLSRNGPALQEAYVRVVTEKSPTDWALFTYEGNSNDIRVAGTGEGGLEEMVEELNSGKVMYAFCRVKDPNSGLPKFVLINWGAHVTINARAEEDVEPECIMEKVAKASGANYSFHKESGRFQDVGPQAPVGSVYQKTNAVSEIKRVGKDSFWAKAEKEEENRRLEEKRRAEEAQRQLEQERRERELREAARREQRYQEQGGEASPQSRTWEQQQEVVSRNRNEQESAVHPREIFKQKERAMSTTSISSPQPGKLRSPFLQKQLTQPETHFGREPAAAISRPRADLPAEEPAPSTPPCLVQAEEEAVYEEPPEQETFYEQPPLVQQQGAGSEHIDHHIQGQGLSGQGLCARALYDYQAADDTEISFDPENLITGIEVIDEGWWRGYGPDGHFGMFPANYVELIE

SEQ ID NO: 8081 - protein, 326 aa, Homo sapiens; identical to SEQ ID NO: 7218

SEQ ID NO: 8082 - protein, 227 aa, Homo sapiens
MLCWGYWSLGQPGISTNLQGIVAEPQVCGFISDRSVKEVACGGNHSVFLLEDGEVYTCGLNTKGQLGHEREGNKPEQIGALADQHIIHVACGESHSLALSDRGQLFSWGAGSDGQLGLMTTEDSVAVPRLIQKLNQQTILQVSCGNWHCLALAADGQFFTWGKNSHGQLGLGKEFPSQASPQRVRSLEGIPLAQVAAGGAHSFALSLSGAVFGWGMNNAGQLGLSDE

SEQ ID NO: 8083 - protein, 207 aa, Homo sapiens
MSSPLASLSKTRKVPLPSEPMNPGRRGIRIYGDVPASHDSELMAFMTRKLWDLEQQVKAQTDEILSKDQKIAALEDLVQTLRPHPAEATLQRQEELETMCVQLQRQVREMERFLSDYGLQWVGEPMDQEDSESKTVSEHGERDWMTAKKFWKPGDSLAPPEVDFDRLLASLQDLSELVVEGDTQVTPVPGGARLRTLEPIPLKLYRN

SEQ ID NO: 8084 - protein, 238 aa, Homo sapiens; identical to SEQ ID NO: 8028

SEQ ID NO: 8085 - protein, 122 aa, Homo sapiens
VRELEAELDAEQKKHAEALKGVRKHERRVKELAYQAEEDRKNLARMQDLVDKLQSKVKSYKRQFEEAEQQANTNLAKYRKAQHELDDAEERADMAETQANKLRARTRDALGPKLSLSPQHKE

SEQ ID NO: 8086 - protein, 160 aa, Homo sapiens
  MOD_RES (1)..(1): Any amino acid
XESLVGLQEGKSTEQGNHDQLKELYSAGNLTVLATDPLLHQDPVQLDFHFRLTSQTSAHWHGLLCDRRLFLDIPYQALDQGNRESLTATLEYVEEKTNVDSVFVNFQNDRNDRGALLRAFSYMGFEVVRPDHPALPPLDNVIFMVYPLERDVGHLPSEPP

SEQ ID NO: 8087 - protein, 33 aa, Homo sapiens
MSVTYDDSVGVEVSSDSFWEVGNYKRTVKRIDD

SEQ ID NO: 8088 - protein, 133 aa, Homo sapiens
MWSLTASEGESTTAHFFLGAGDEGLGTRGIGMRPEESDSELLEDEEDEVPPEPQIIVGICAMTKKSKSKPMTQILERLCRFDYLTVVILGEDVILNEPVENWPSCHCLISFHSKGFPLDKAVAYSKLRNPFLI

SEQ ID NO: 8089 - protein, 312 aa, Homo sapiens; identical to SEQ ID NO: 7297

SEQ ID NO: 8090 - protein, 435 aa, Homo sapiens
  MOD_RES (1)..(1): Any amino acid
XSILNSNEHLLKEKELLIDKQRKHISQLEQKVRESELQVHSALLGRPAPFGDVCLLRLQELQRENTFLRAQFAQKTEALSREKIDLEKKLSASEVEVQLIRESLKVALQKHSEEVKKQEERVKGRDKHINNLKKKCQKESEQNREKQQRIETLERYLADLPTLEDHQKQSQQLKDSELKSTELQEKVTELESLLEETQAICREKEIQLESLRQREAEFSSAGHSLQDKQSVEETSGEGPEVEMESWQKRYDSLQKIVEKQQQKMDQLRSQVQSLEQEVAQEEGTSQALREEAQRRDSALQQLRTAVKELSVQNQDLIEKNLTLQEHLRQAQPGSPPSPDTAQLALELHQELASCLQDLQAVCSIVTQRAQGHDPNLSLLLGIHSQHPETQLDLQKPDVIKRKLEEVQQLRRDIEDLRTTMSDRYAQDMGENCVTQ

SEQ ID NO: 8091 - protein, 157 aa, Homo sapiens
MELRCGGLLFSSRFDSGNLAHVEKVESLSSDGEGVGGGASALTSGIASSPDYEFNVWTRPDCAETEFENGNRSWFYFSVRGGMPGKLIKINIMNMNKQSKLYSQGMAPFVRTLPTRPRWERIRDRPTFEMTETQFVLSFVHRFVEGRGATTFFAFCY

SEQ ID NO: 8092 - protein, 539 aa, Homo sapiens; identical to SEQ ID NO: 5502

SEQ ID NO: 8093 - protein, 2046 aa, Homo sapiens
MDEVEQDQHEARLKELFDSFDTTGTGSLGQEELTDLCHMLSLEEVAPVLQQTLLQDNLLGRVHFDQFKEALILILSRTLSNEEHFQEPDCSLEAQPKYVRGGKRYGRRSLPEFQESVEEFPEVTVIEPLDEEARPSHIPAGDCSEHWKTQRSEEYEAEGQLRFWNPDDLNASQSGSSPPQDWIEEKLQEVCEDLGITRDGHLNRKKLVSICEQYGLQNVDGEMLEEVFHNLDPDGTMSVEDFFYGLFKNGKSLTPSASTPYRQLKRHLSMQSFDESGRRTTTSSAMTSTIGFRVFSCLDDGMGHASVERILDTWQEEGIENSQEILKALDFSLDGNINLTELTLALENELLVTKNSIHQAALASFKAEIRHLLERVDQVVREKEKLRSDLDKAEKLKSLMASEVDDHHAAIERRNEYNLRKLDEEYKERIAALKNELRKEREQILQQAGKQRLELEQEIEKAKTEENYIRDRLALSLKENSRLENELLENAEKLAEYENLTNKLQRNLENVLAEKFGDLDPSSAEFFLQEERLTQMRNEYERQCRVLQDQVDELQSELEEYRAQGRVLRLPLKNSPSEEVEANSGGIEPEHGLGSEECNPLNMSIEAELVIEQMKEQHHRDICCLRLELEDKVRHYEKQLDETVVSCKKAQENMKQRHENETHTLEKQISDLKNEIAELQGQAAVLKEAHHEATCRHEEEKKQLQVKLEEEKTHLQEKLRLQHEMELKARLTQAQASFEREREGLQSSAWTEEKVRGLTQELEQFHQEQLTSLVEKHTLEKEELRKELLEKHQRELQEGREKMETECNRRTSQIEAQFQSDCQKVTERCESALQSLEGRYRQELKDLQEQQREEKSQWEFEKDELTQECAEAQELLKETLKREKTTSLVLTQEREMLEKTYKEHLNSMVVERQQLLQDLEDLRNVSETQQSLLSDQILELKSSHKRELREREEVLCQAGASEQLASQRLERLEMEHDQERQEMMSKLLAMENIHKATCETADRERAEMSTEISRLQSKIKEMQQATSPLSMLQSGCQVIGEEEVEGDGALSLLQQGEQLLEENGDVLLSLQRAHEQAVKENVKMATEISRLQQRLQKLEPGLVMSSCLDEPATEFFGNTAEQTEQFLQQNRTKQVEGVTRRHVLSDLEDDEVRDLGSTGTSSVQRQEVKIEESEASVEGFSELENSEETRTESWELKNQISQLQEQLMMLCADCDRASEKKQDLLFDVSVLKKKLKMLERIPEASPKYKLLYEDVSRENDCLQEELRMMETRYDEALENNKELTAEVFRLQDELKKMEEVTETFLSLEKSYDEVKIENEGLNVLVLRLQGKIEKLQESVVQRCDCCLWEASLENLEIEPDGNILQLNQTLEECVPRVRSVHHVIEECKQENQYLEGNTQLLEKVKAHEIAWLHGTIQTHQERPRVQNQVILEENTTLLGFQDKHFQHQATIAELELEKTKLQELTRKLKERVTILVKQKDVLSHGEKEEELKAMMHDLQITCSEMQQKVELLRYESEKLQQENSILRNEITTLNEEDSISNLKLGTLNGSQEEMWQKTETVKQENAAVQKMVENLKKQISELKIKNQQLDLENTELSQKNSQNQEKLQELNQRLTEMLCQKEKEPGNSALEEREQEKFNLKEELERCKVQSSTLVSSLEAELSEVKIQTHIVQQENHLLKDELEKMKQLHRCPDLSDFQQKISSVLSYNEKLLKEKEALSEELNSCVDKLAKSSLLEHRIATMKQEQKSWEHQSASLKSQLVASQEKVQNLEDTVQNVNLQMSRMKSDLRVTQQEKEALKQEVMSLHKQLQNAGGKSWAPEIATHPSGLHNQQKRLSWDKLDHLMNEEQQLLWQENERLQTMVQNTKAELTHSREKVRQLESNLLPKHQKHLNPSGTMNPTEQEKLSLKRECDQFQKEQSPANRKVSQMNSLEQELETIHLENEGLKKKQVKLDEQLMEMQHLRSTATPSPSPHAWDLQLLQQQACPMVPREQFLQLQRQLLQAERINQHLQEELENRTSETNTPQALLPEQRAVHADSYRRIGHL

SEQ ID NO: 8094 - protein, 400 aa, Homo sapiens
MAGENHQWQGSILYNMLMSAKQTRAAPEAPETRLVDQCWGCSCGDEPGVGREGLLGGRNVALLYRCCFCGKDHPRQGSILYSMLTSAKQTYAAPKAPEATLGPCWGCSCGSDPGVGRAGLPGGRPVALLYRCCFCGEDHPRQGSILYSLLTSSKQTHVAPAAPEARPGGAWWDRSYFAQRPGGKEALPGGRATALLYRCCFCGEDHPQQGSTLYCVPTSTNQAQAAPEERPRAPWWDTSSGALRPVALKSPQVVCEAASAGLLKTLRFVKYLPCFQVLPLDQQLVLVRNCWASLLMLELAQDRLQFETVEVSEPSMLQKILTTRRRETGGNEPLPVPTLQHHLAPPAEARKVPSASQVQAIKCFLSKCWSLNISTKEYAYLKGTVLFNPGKGKENDCNHH

SEQ ID NO: 8095 - protein, 208 aa, Homo sapiens
MKQLEDHEAFETSSLIGHSARVYALYYKDGLLCTGSDDLSAKLWDVSTGQCVYGIQTHTCAAVKFDEQKLVTGSFDNTVACWEWSSGARTQHFRGHTGAVFSVDYNDELDILVSGSADFTVKVWALSAGTCLNTLTGHTEWVTKVVLQKCKVKSLLHSPGDYILLSADKYEIKIWPIGREINCKCLKTLSVSEDRSICLQPRLHFDGK

SEQ ID NO: 8096 - protein, 212 aa, Homo sapiens
MFGVTKFGDNIEDEWFIVYVIKQITKEFPELVARIEDNDGEFLLIEAADFLPKWLDPENSTNRVFFCHGELCIIPAPRKSGAESWLPTTPPTIPQALNIITAHSEKILASESIRAAVNRRIRGYPEKIQASLHRAHCFLPAGIVAVLKQRPRLVAAAVQAFYLRDPIDLRACRVFKTFLPETRIMTSVTFTKCLYAQLVQQRFVPDRRSGYR

SEQ ID NO: 8097 - protein, 157 aa, Homo sapiens; identical to SEQ ID NO: 7296

SEQ ID NO: 8098 - protein, 1590 aa, Homo sapiens [sequence omitted]

SEQ ID NO: 8099 - protein, 483 aa, Homo sapiens; identical to SEQ ID NO: 4727

SEQ ID NO: 8100 - protein, 462 aa, Homo sapiens
MGGAEAEPWGRAPGPAIGGRRAGDSCPGWRRRSRSRGRGQRLSHGPRRRPQLLTAAPPLQARGAFRSFPHSWGEDFLASLMFKIQLEPLKLRAWTLNGFVKFRNKETSAGPVAVMGKDYYKILGIPSGANEDEIKKAYRKMALKYHPDKNKEPNAEEKFKEIAEAYDVLSDPKKRGLYDQYGEEGLKTGGGTSGGSSGSFHYTFHGDPHATFASFFGGSNPFDIFFASSRSTRPFSGFDPDDMDVDEDEDPFGAFGRFGFNGLSRGPRRAPEPLYPRRKVQDPPVVHELRVSLEEIYHGSTKRMKITRRRLNPDGRTVRTEDKILHIVIKRGWKEGTKITFPKEGDATPDNIPADIVFVLKDKPHAHFRRDGTNVLYSALISLKEALCGCTVNIPTIDGRVIPLPCNDVIKPGTVKRLRGEGLPFPKVPTQRGDLIVEFKVRFPDRLTPQTRQILKQHLPCS

SEQ ID NO: 8101 - protein, 92 aa, Homo sapiens
VYGAKDIELSPEAQAKIDRYTQQGFGNLPICMAKTHLSLSHQPDKKGVPRDFILPISDVRASIGAGFIYPLVGTRSSPLALVGESQPKQVHP

SEQ ID NO: 8102 - protein, 155 aa, Homo sapiens
MSVTYDDSVGVEVSSDSFWEVGNYKRTVKRIDDGHRLCSDLMNCLHERARIEKAYAQQLTEWARRWRQLVEKGPQYGTVEKAWMAFMSEAERVSELHLEVKASLMNDDFEKIKNWQKEAFHKQMMGGFKETKEAEDGFRKAQKPWAKKLKEVHLS

SEQ ID NO: 8103 - protein, 160 aa, Homo sapiens; identical to SEQ ID NO: 6461

SEQ ID NO: 8104 - protein, 219 aa, Homo sapiens; identical to SEQ ID NO: 7631

SEQ ID NO: 8105 - protein, 105 aa, Homo sapiens
MNMIWRNSISCLRLGKVPHRYQSGYHPVAPLGSRILTDPAKVFEHNMWDHMQWSKEEEAAARKKVKENSAVRVLLEEQVKYEREASKYWDTFYKIHKNKFFKDRN

SEQ ID NO: 8106 - protein, 121 aa, Homo sapiens
  MOD_RES (1)..(1): Any amino acid
XEGESPTASPHSSATDDLHHSDRYQTFLRVRANRQTRLNARIGKMKRRKQDEGQVCPLCNRPLAGSEQEMSRHVEHCLSKREGSCMAEDDAVDIEHENNNRFEEYEWCGQKRIRATTLLEG

SEQ ID NO: 8107 - protein, 566 aa, Homo sapiens; identical to SEQ ID NO: 5875

SEQ ID NO: 8108 - protein, 1572 aa, Homo sapiens
MLLHLCSVKNLYQNRFLGLAAMASPSRNSQSRRRCKEPLRYSYNPDQFHNMDLRGGPHDGVTIPRSTSDTDLVTSDSRSTLMVSSSYYSIGHSQDLVIHWDIKEEVDAGDWIGMYLIDEVLSENFLDYKNRGVNGSHRGQIIWKIDASSYFVEPETKICFKYYHGVSGALRATTPSVTVKNSAAPIFKSIGADETVQGQGSRRLISFSLSDFQAMGLKKGMFFNPDPYLKISIQPGKHSIFPALPHHGQERRSKIIGNTVNPIWQAEQFSFVSLPTDVLEIEVKDKFAKSRPIIKRFLGKLSMPVQRLLERHAIGDRVVSYTLGRRLPTDHVSGQLQFRFEITSSIHPDDEEISLSTEPESAQIQDSPMNNLMESGSGEPRSEAPESSESWKPEQLGEGSVPDGPGNQSIELSRPAEEAAVITEAGDQGMVSVGPEGAGELLAQVQKDIQPAPSAEELAEQLDLGEEASALLLEDGEAPASTKEEPLEEEATTQSRAGREEEEKEQEEEGDVSTLEQGEGRLQLRASVKRKSRPCSLPVSELETVIASACGDPETPRTHYIRIHTLLHSMPSAQGGSAAEEEDGAEEESTLKDSSEKDGLSEVDTVAADPSALEEDREEPEGATPGTAHPGHSGGHFPSLANGAAQDGDTHPSTGSESDSSPRQGGDHSCEGCDASCCSPSCYSSSCYSTSCYSSSCYSASCYSPSCYNGNRFASHTRFSSVDSAKISESTVFSSQDDEEEENSAFESVPDSMQSPELDPESTNGAGPWQDELAAPSGHVERSPEGLESPVAGPSNRREDWEARIDSHGRVFYVDHVNRTTTWQRPTAAATPDGMRRSGSIQQMEQLNRRYQNIQRTIATERSEEDSGSQSCEQAPAGGGGGGGSDSEAESSQSSLDLRREGSLSPVNSQKITLLLQSPAVKFITNPEFFTVLHANYSAYRVFTSSTCLKHMILKVRRDARNFERYQHNRDLVNFINMFADTRLELPRGWEIKTDQQGKSFFVDHNSRATTFIDPRIPLQNGRLPNHLTHRQHLQRLRSYSAGEASEVSRNRGASLLARPGHSLVAAIRSQHQHESLPLAYNDKIVAFLRQPNIFEMLQERQPSLARNHTLREKIHYIRTEGNHGLEKLSCDADLVILLSLFEEEIMSYVPLQAAFHPGYSFSPRCSPCSSPQNSPGLQRASARAPSPYRRDFEAKLRNFYRKLEAKGFGQGPGKIKLIIRRDHLLEGTFNQVMAYSRKELQRNKLYVTFVGEEGLDYSGPSREFFFLLSQELFNPYYGLFEYSANDTYTVQISPMSAFVENHLEWFRFSGRILGLALIHQYLLDAFFTRPFYKALLRLPCDLSDLEYLDEEFHQSLQWMKDNNITDILDLTFTVNEEVFGQVTERELKSGGANTQVTEKNKKEYIERMVKWRVERGVVQQTEALVRGFYEVVDSRLVSVFDARELELVIAGTAEIDLNDWRNNTEYRGGYHDGHLVIRWFWAAVERFNNEQRLRLLQFVTGTSSVPYEGFAALRGSNGLRRFCIEKWGKITSLPRAHTCFNRLDLPPYPSYSMLYEKLLTAVEETSTFGLE

SEQ ID NO: 8109 - protein, 542 aa, Homo sapiens
MSGLVLGQRDEPAGHRLSQEEILGSTRLVSQGLEALRSEHQAVLQSLSQTIECLQQGGHEEGLVHEKARQLRRSMENIELGLSEAQEEKEGDATKDSLDDLFPNEEEEDPSNGLSRGQGATAAQQGGYEIPARLRTLHNLVIQYAAQGRYEVAVPLCKQALEDLERTSGRGHPDVATMLNILALVYRDQNKYKEAAHLLNDALSIRESTLGPDHPAVAATLNNLAVLYGKRGKYKEAEPLCQRALEIREKVLGTNHPDVAKQLNNLALLCQNQGKYEAVERYYQRALAIYEGQLGPDNPNVARTKNNLASCYLKQGKYAEAETLYKEILTRAHVQEFGSVDDDHKPIWMHAEEREEMSKSRHHEGGTPYAEYGGWYKACKVSSPTVNTTLRNLGALYRRQGKLEAAETLEECALRSRRQGTDPISQTKVAELLGESDGRRTSQEGPGDSVKFEGGEDASVAVEWSGDGSGTLQRSGSLGKIRDVLRRSSELLVRKLQGTEPRPSSSNMKRAASLNYLNQPSAAPLQVSRGLSASTMDLSSSS

SEQ ID NO: 8110 - protein, 515 aa, Homo sapiens
MCQVGEDYGEPAPEEPPPAPRPSREQKCVKCKEAQPVVVIRAGDAFCRDCFKAFYVHKFRAMLGKNRLIFPGEKVLLAWSGGPSSSSMVWQVLEGLSQDSAKRLRFVAGVIFVDEGAACGQSLEERSKTLAEVKPILQATGFPWHVVALEEVFSLPPSVLWCSAQELVGSEGAYKAAVDSFLQQQHVLGAGGGPGPTQGEEQPPQPPLDPQNLARPPAPAQTEALSQLFCSVRTLTAKEELLQTLRTHLILHMARAHGYSKVMTGDSCTRLAIKLMTNLALGRGAFLAWDTGFSDERHGDVVVVRPMRDHTLKEVAFYNRLFSVPSVFTPAVDTKAPEKASIHRLMEAFILRLQTQFPSTVSTVYRTSEKLVKGPRDGPAAGDSGPRCLLCMCALDVDAADSATAFGAQTSSRLSQMQSPIPLTETRTPPGPCCSPGVGWAQRCGQGACRREDPQACIEEQLCYSCRVNMKDLPSLDPLPPYILAEAQLRTQRAWGLQEIRDCLIEDSDDEAGQS

SEQ ID NO: 8111 - protein, 420 aa, Homo sapiens
MFKRTVLSCPPPAAPPLQARGAFRSFPHSWGEDFLASLMFKIQLEPLKLRAWTLNGFVKFRNKETSAGPVAVMGKDYYKILGIPSGANEDEIKKAYRKMALKYHPDKNKEPNAEEKFKEIAEAYDVLSDPKKRGLYDQYGEEGLKTGGGTSGGSSGSFHYTFHGDPHATFASFFGGSNPFDIFFASSRSTRPFSGFDPDDMDVDEDEDPFGAFGRFGFNGLSRGPRRAPEPLYPRRKVQDPPVVHELRVSLEEIYHGSTKRMKITRRRLNPDGRTVRTEDKILHIVIKRGWKEGTKITFPKEGDATPDNIPADIVFVLKDKPHAHFRRDGTNVLYSALISLKEALCGCTVNIPTIDGRVIPLPCNDVIKPGTVKRLRGEGLPFPKVPTQRGDLIVEFKVRFPDRLTPQTRQILKQHLPCS

SEQ ID NO: 8112 - protein, 992 aa, Homo sapiens
MYGSARSVGKVEPSSQSPGRSPRLPRSPRLGHRRTNSTGGSSGSSVGGGSGKTLSMENIQSLNAAYATSGPMYLSDHENVGSETPKSTMTLGRSGGRLPYGVRMTAMGSSPNIASSGVASDTIAFGEHHLPPVSMASTVPHSLRQARDNTIMDLQTQLKEVLRENDLLRKDVEVKESKLSSSMNSIKTFWSPELKKERALRKDEASKITIWKEQYRVVQEENQHMQMTIQALQDELRIQRDLNQLFQQDSSSRTGEPCVAELTEENFQRLHAEHERQAKELFLLRKTLEEMELRIETQKQTLNARDESIKKLLEMLQSKGLSAKATEEDHERTRRLAEAEMHVHHLESLLEQKEKENSMLREEMHRRFENAPDSAKTKALQTVIEMKDSKISSMERGLRDLEEEIQMLKSNGALSTEEREEEMKQMEVYRSHSKFMKNKIGQVKQELSRKDTELLALQTKLETLTNQFSDSKQHIEVLKESLTAKEQRAAILQTEVDALRLRLEEKETMLNKKTKQIQDMAEEKGTQAGEIHDLKDMLDVKERKVNVLQKKIENLQEQLRDKEKQMSSLKERVKSLQADTTNTDTALTTLEEALAEKERTIERLKEQRDRDEREKQEEIDNYKKDLKDLKEKVSLLQGDLSEKEASLLDLKEHASSLASSGLKKDSRLKTLEIALEQKKEECLKMESQLKKAHEAALEARASPEMSDRIQHLEREITRYKDESSKAQAEVDRLLEILKEVENEKNDKDKKIAELESLFSRQVKDQNKKVANLKHKEQVEKKKSAQMLEEARRREDNLNDSSQQLQDSLRKKDDRIEELEEALRESVQITAEREMVLAQEESARTNAEKQVEELLMAMEKVKQELESMKAKLSSTQQSLAEKETHLTNLRAERRKHLEEVLEMKQEALLAAISEKDANIALLELSSSKKKTQEEVAALKREKDRLVQQLKQQTQNRMKLMADNYEDDHFKSSHSNQTNHKPSPDQDEEEGIWA

SEQ ID NO: 8113 - protein, 59 aa, Homo sapiens
MEPSAQQLQLAASLPANLSNFCQGSEMPTTSRPALDVKGGTSPAKEDANQEMSSVAYSN

SEQ ID NO: 8114 - protein, 2325 aa, Homo sapiens
MKKGSQQKIFSKAKIPSSSHSPIPSSMSNMRSRSLSPLIGSETLPFHSGGQWCEQVEIADENNMLLDYQDHKGADSHAGVRYITEALIKKLTKQDNLALIKSLNLSLSKDGGKKFKYIENLEKCVKLEVLNLSYNLIGKIEKLDKLLKLRELNLSYNKISKIEGIENMCNLQKLNLAGNEIEHIPVWLGKKLKSLRVLNLKGNKISSLQDISKLKPLQDLISLILVENPVVTLPHYLQFTIFHLRSLESLEGQPVTTQDRQEAFERFSLEEVERLERDLEKKMIETEELKSKQTRFLEEIKNQDKLNKSLKEEAMLQKQSCEELKSDLNTKNELLKQKTIELTRACQKQYELEQELAFYKIDAKFEPLNYYPSEYAEIDKAPDESPYIGKSRYKRNMFATESYIIDSAQAVQIKKMEPDEQLRNDHMNLRGHTPLDTQLEDKEKKISAAQTRLSELHDEIEKAEQQILRATEEFKQLEEAIQLKKISEAGKDLLYKQLSGRLQLVNKLRQEALDLELQMEKQKQEIAGKQKEIKDLQIAIDSLDSKDPKHSHMKAQKSGKEQQLDIMNKQYQQLESRLDEILSRIAKETEEIKDLEEQLTEGQIAANEALKKDLEGVISGLQEYLGTIKGQATQAQNECRKLRDEKETLLQRLTEVEQERDQLEIVAMDAENMRKELAELESALQEQHEVNASLQQTQGDLSAYEAELEARLNLRDAEANQLKEELEKVTRLTQLEQSALQAELEKERQALKNALGKAQFSEEKEQENSELHAKLKHLQDDNNLLKQQLKDFQNHLNHVVDGLVRPEEVAARVDELRRKLKLGTGEMNIHSPSDVLGKSLADLQKQFSEILARSKWERDEAQVRERKLQEEMALQQEKLATGQEEFRQACERALEARMNFDKRQHEARIQQMENEIHYLQENLKSMEEIQGLTDLQLQEADEEKERILAQLRELEKKKKLEDAKSQEQVFGLDKELKKLKKAVATSDKLATAELTIAKDQLKSLHGTVMKINQERAEELQEAERFSRKAAQAARDLTRAEAEIELLQNLLRQKGEQFRLEMEKTGVGTGANSQVLEIEKLNETMERQRTEIARLQNVLDLTGSDNKGGFENVLEEIAELRREVSYQNDYISSMADPFKRRGYWYFMPPPPSSKVSSHSSQATKDSGVGLKYSASTPVRKPRPGQQDGKEGSQPPPASGYWVYSPIRSGLHKLFPSRDADSGGDSQEESELDDQEEPPFVPPPGYMMYTVLPDGSPVPQGMALYAPPPPLPNNSRPLTPGTVVYGPPPAGAPMVYGPPPPNFSIPFIPMGVLHCNVPEHHNLENEVSRLEDIMQHLKSKKREERWMRASKRQSEKEMEELHHNIDDLLQEKKSLECEVEELHRTVQKRQQQKDFIDGNVESLMTELEIEKSLKHHEDIVDEIECIEKTLLKRRSELREADRLLAEAESELSCTKEKTKNAVEKFTDAKRSLLQTESDAEELERRAQETAVNLVKADQQLRSLQADAKDLEQHKIKQEEILKEINKIVAAKDSDFQCLSKKKEKLTEELQKLQKDIEMAERNEDHHLQVLKESEVLLQAKRAELEKLKSQVTSQQQEMAVLDRQLGHKKEELHLLQGSMVQAKADLQEALRLGETEVTEKCNHIREVKSLLEELSFQKGELNVQISERKTQLTLIKQEIEKEEENLQVVLRQMSKHKTELKNILDMLQLENHELQGLKLQHDQRVSELEKTQVAVLEEKLELENLQQISQQQKGEIEWQKQLLERDKREIERMTAESRALQSCVECLSKEKEDLQEKCDIWEKKLAQTKRVLAAAEENSKMEQSNLEKLELNVRKLQQELDQLNRDKLSLHNDISAMQQQLQEKREAVNSLQEELANVQDHLNLAKQDLLHTTKHQDVLLSEQTRLQKDISEWANRFEDCQKEEETKQQQLQVLQNEIEENKLKLVQQEMMFQRLQKERESEESKLETSKVTLKEQQHQLEKELTDQKSKLDQVLSKVLAAEERVRTLQEEERWCESLEKTLSQTKRQLSEREQQLVEKSGELLALQKEADSMRADFSLLRNQFLTERKKAEKQVASLKEALKIQRSQLEKNLLEQKQENSCIQKEMATIELVAQDNHERARRLMKELNQMQYEYTELKKQMANQKDLERRQMEISDAMRTLKSEVKDEIRTSLKNLNQFLPELPADLEAILERNENLEGELESLKENLPFTMNEGPFEEKLNFSQVHIMDEHWRGEALREKLRHREDRLKAQLRHCMSKQAEVLIKGKRQTEGTLHSLRRQVDALGELVTSTSADSASSPSLSQLESSLTEDSQLGQNQKQNNSLR

SEQ ID NO: 8115 - protein, 218 aa, Homo sapiens
MDELVTLEEADGGSDILLVVPKATVLQNQLDESQQERNDLMQLKLQLEGQVTELRSRVQELERALATARQEHTELMEQYKGISRSHGEITEERDILSRQQGDHVARILELEDDIQTISEKVLTKEVELDRLRDTVKALTREQEKLLGQLKEVQADKEQSEAELQVAQQENHHLNLDLKEAKSWQEEQSAQAQRLKDKVAQMKDTLGQAQQRVRPSWSP

SEQ ID NO: 8116 - protein, 230 aa, Homo sapiens
MKKPRPAAAAPSPRPPACSRGAHPGTASELRVPALRRGGCGDRRLREEAAPEQAAAGPRRSTVGALLASELGWKFYDADDYHPEENRRKMGKGIPLNDQDRIPWLCNLHDILLRDVASGQRVVLACSALKKTYRDILTQGKDGVALKCEESGKEAKQAEMQLLVVHLSGSFEVISGRLLKREGHFMPPELLQSQFETLEPPAAPENFIQISVDKNVSEIIATIMETLKMK

SEQ ID NO: 8117 - protein, 318 aa, Homo sapiens
MCRTALGVTTLQDLGVCWRKEHDPAEMLRVGRAELGGWKPSWEAIVKEVAAATGHTVVLVDQTEDILAKSKKGIEESLRKVAKKKFAENLKAGDEFVEKTLSTIATSTDAASVVHSTDLVVEAIVENLKVKNELFKRLDKFAAEHTIFASNTSSLQITSIANATTRQDRFAGLHFFNPVPVMKLVEVIKTPMTSQKTFESLVDFSKALGKHPVSCKDTPGFIVNRLLVPYLMEAIRLYERGDASKEDIDTAMKLGAGYPMGPFELLDYVGLDTTKFIVDGWHEMDAENPLHQPSPSLNKLVAENKFGKKTGEGFYKYK

SEQ ID NO: 8118 - protein, 221 aa, Homo sapiens
MAIVQTLPVPLEPAPEAATAPQAPVMGSVSSLISGRPCPGGPAPPRHHGPPGPTFFRQQDGLLRGGYEAQEPLCPAVPPRKAVPVTSFTYINEDFRTESPPSPSSDVEDAREQRAHNAHLRGPPPKLIPVSGKLEKNMEKILIRPTAFKPVLPKPRGAPSLPSFMGPRATGLSGSQGSLTQLFGGPASSSSSSSSSSAADKPLAFSGWASGCPSGTLSDSG

SEQ ID NO: 8119 - protein, 194 aa, Homo sapiens
MRELAAVVSRDIYLHNPNIKWNDIIGLDAAKQLVKEAVVYPIRYPQLFTGILSPWKGLLLYGPPGTGKTLLAKAVATECKTTFFNISASTIVSKWRGDSEKLVRVLFELARYHAPSTIFLDELESVMSQRGTASGGEHEGSLRMKTELLVQMDGLARSEDLVFVLAASNLPCLKAIALQPGDRARLRLKKKKCT

SEQ ID NO: 8120 - protein, 184 aa, Homo sapiens
MTFQFNFTIEDHLENELTPIRDGALTLDSSKELSVSESQKGEERDRKCSAEQFDLPQDHLWEHKSMENAAPSQDTDSPLSAASSSRNLEPHGKQPSLRAAKEHAMPKDLKKMLENKVIETLPGFQHVKLSVVKTILLKENFPGENIVSKSFSSHSDLITGVYEGGLKIWECTFDLLAYFTKAKV

SEQ ID NO: 8121 - protein, 117 aa, Homo sapiens
MVLILGRRLNREDLGVRDSPATKRKVFEMDPKSLTGHEFFDFSSGSSHAENILQIFNEFRDSRLFTDVIICVEGKEFPCHRAVLSACSSYFRAMFCNDHRESREMLVEINGILAEAM

SEQ ID NO: 8122 - protein, 165 aa, Homo sapiens
MILNVLEYGSQQVADLTLNLDDYIDAEHLGDFHRTYKNSEELRSRIVSGIITPIHEQWEKANVSSPHREFPPATAREVDPLRIPPHHPHTSRQPPWPRRGGMIVDPLRSGFPRALIDPSSGLPNRLPPGAVPPGARFDPFGPIGTSPPGPNPDHLPPPGYDDMYL

SEQ ID NO: 8123 - protein, 122 aa, Homo sapiens
ALTFSLRAGAASAQDGRCPCGARRPDSRLLQLHITMPFSSPMEAELVRRILSRDAAPLPRPGAVLKDFTVSGNLLFIRLTAADHRQLQLSISSCLQQLSLLMWITQCFLPVFLAQAPSGQRR

SEQ ID NO: 8124 - protein, 804 aa, Homo sapiens
MKSIGVKTVKVCGSKSSVRIEGQPCSLGQSRRKVKLMGERSYTLSIGNGDYFWANKEMLWDYVQTLSDQGAEKHEGTGQSSGITDQEKELSTNAFQAFTSGNYDACLQHLACLQDINKDDYKIILNTAVAEFFKSNQTTTDNLRQTLNQLKNQVHSAVEEMDGLDDVENSMLYYNQAVILYHLRQYTEAISVGEKLYQFIEPFEEKFAQAVCFLLVDLYILTYQAEKALHLLAVLEKMISQGNNNKNGKNETGNNNNKDGSNHKAESGALIEAAKSKIHQYKVRAYIQMKSLKACKREIKSVMNTAGNSAPSLFLKSNFEYLRGNYRKAVKLLNSSNIAEHPGFMKTGECLRCMFWNNLGCIHFAMSKHNLGIFYFKKALQENDNVCAQLSAGSTDPGKKFSGRPMCTLLTNKRYELLYNCGIQLLHIGRPLAAFECLIEAVQVYHANPRLWLRLAECCIAANKGTSEQETKGLPSKKGIVQSIVGQGYHRKIVLASQSIQNTVYNDGQSSAIPVASMEFAAICLRNALLLLPEEQQDPKQENGAKNSNQLGGNTESSESSETCSSKSHDGDKFIPAPPSSPLRKQELENLKCSILACSAYVALALGDNLMALNHADKLLQQPKLSGSLKFLGHLYAAEALISLDRISDAITHLNPENVTDVSLGISSNEQDQGSDKGENEAMESSGKRAPQCYPSSVNSARTVMLFNLGSAYCLRSEYDKARKCLHQAASMIHPKEVPPEAILLAVYLELQNGNTQLALQIIKRNQLLPAVKTHSEVRKKPVFQPVHPIQPIQMPAFTTVQRK

SEQ ID NO: 8125 - protein, 632 aa, Homo sapiens; identical to SEQ ID NO: 5339

SEQ ID NO: 8126 - protein, 194 aa, Homo sapiens
MEDLFETFQDEMGFSNMEDDGPEEEERVAEPQANFNTPQALRFEELLANLLNEQHQIAKELFEQLKMKKPSAKQQKEVEKVKPQCKEVHQTLILDPAQRKRLQQQMQQHVQLLTQIHLLATCNPNLNPEASSTRICLKELGTFAQSSIALHHQYNPKFQTLFQPCNLMGAMQLIEDFSTHVSIDCSPHKTVKKT

SEQ ID NO: 8127 - protein, 600 aa, Homo sapiens; identical to SEQ ID NO: 4782

SEQ ID NO: 8128 - protein, 539 aa, Homo sapiens; identical to SEQ ID NO: 5502

SEQ ID NO: 8129 - protein, 188 aa, Homo sapiens
  MOD_RES (1)..(1): Any amino acid
XYVNAVDSRWSSYGNEATSSAHYVERDRFIVTDLSGHRKHSSTGDLLSLELQQAKSNSLLLQREANALAMQQKWNSLDEGRHLTLNLLSKEIELRNGELQSDYTEDATDTKPDRDIELELSALDTDEPDGQSEPIEEILDIQLGISSQNDQLLNGMAVENGHPVQQHQKEPPKQKKQSLGRSKKQFCR

SEQ ID NO: 8130 - protein, 601 aa, Homo sapiens
MEETMKLATMEDTVEYCLFLIPDESRDSDKHKEILQKYIERIITRFAPMLVPYIWQNQPFNLKYKPGKGGVPAHMFGVTKFGDNIEDEWFIVYVIKQITKEFPELVARIEDNDGEFLLIEAADFLPKWLDPENSTNRVFFCHGELCIIPAPRKSGAESWLPTTPPTIPQALNIITAHSEKILASESIRAAVNRRIRGYPEKIQASLHRAHCFLPAGIVAVLKQRPRLVAAAVQAFYLRDPIDLRACRVFKTFLPETRIMTSAHGFEILCSKCSPHFSDCKKSLVTASPLWASFLESLKKNDYFKGLIEGSAQYRERLEMAENYFQLSVDWPESSLAMSPGEEILTLLQTIPFDIEDLKKEAANLPPEDDDQWLDLSPDQLDQLLQEAVGKKESESVSKEEKEQNYDLTEVSESMKAFISKVSTHKGAELPREPSEAPITFDADSFLNYFDKILGPRPNESDSDDLDDEDFECLDSDDDLDFETHEPGEEASLKGTLDNLKSYMAQMDQELAHTCISKSFTTRNQVEPVSQTTDNNSDEEDSGTGESVMAPVDVDLNLVSNILESYSSQAGLAGPASNLLQSMGVQLPDNTDHRPTSKPTKN

SEQ ID NO: 8131 - protein, 134 aa, Homo sapiens
MKKKHDGIVYETKEVLNPSPKVTHCCKSLWLKYSFQKAYMTQLVSSQPVPAMSRNPDHNLLSQPKEHSIVQKHHQEEIIHKLAMQLRHIGDNIDHRMVREDLQQDGRDALDHFVFFFFRRVQVLLHFFWNNHLL

SEQ ID NO: 8132 - protein, 596 aa, Homo sapiens
MEDAPQRLRWQAHLEFTHNHDVGDLTWDKIAVSLPRSEKLRSLVLAGIPHGMRPQLWMRLSGALQKKRNSELSYREIVKNSSNDETIAAKQIEKDLLRTMPSNACFASMGSIGVPRLRRVLRALAWLYPEIGYCQGTGMVAACLLLFLEEEDAFWMMSAIIEDLLPASYFSTTLLGVQTDQRVLRHLIVQYLPRLDKLLQEHDIELSLITLHWFLTAFASVVDIKLLLRIWDLFFYEGSRVLFQLTLGMLHLKEEELIQSENSASIFNTLSDIPSQMEDAELLLGVAMRLAGSLTDVAVETQRRKHLAYLIADQGQLLGAGTLTNLSQVVRRRTQRRKSTITALLFGEDDLEALKAKNIKQTELVADLREAILRVARHFQCTDPKNCSVELTPDYSMESHQRDHENYVACSRSHRRRAKALLDFERHDDDELGFRKNDIITIVSQKDEHCWVGELNGLRGWFPAKFVEVLDERSKEYSIAGDDSVTEGVTDLVRGTLCPALKALFEHGLKKPSLLGGACHPWLFIEEAAGREVERDFASVYSRLVLCKTFRLDEDGKVLTPEELLYRAVQSVNVTHDAVHAQMDVKLRSLICVGLK

SEQ ID NO: 8133 - protein, 132 aa, Homo sapiens
MESRVADAGTGETARAAGGSPAVGCTTRGPVVSAPLGAARWKLLRQVLKQKHLDDCLRHVSVRRFESFNLFSVTEGKERETEEEVGAWVQYTSIFCPEYSISLRHNSGSLNVEDVLTSFDNTGNVWSFSRGK

SEQ ID NO: 8134 - protein, 539 aa, Homo sapiens; identical to SEQ ID NO: 5502

SEQ ID NO: 8135 - protein, 730 aa, Homo sapiens
MNNSSSETRGHPHSASSPSERVFPMPLPRKAPLNIPGTPVLEDFPQNDDEKERLQRRRSRVFDLQFSTDSPRLLASPSSRSIDISATIPKFTNTQITEHYSTCIKLSTENKITTKNAFGLHLIDFMSEILKQKDTEPTNFKVAAGTLDASTKIYAVRVDAVHADVYRVLGGLGKDAPSLEEVEGHVADGSATEMGTTKKAVKPKKKHLHRTIEQNINNLNVSEADRKCEIDPMFQKTAASFDECSTAGVFLSTLHCQDYRSELLFPSDVQTLSTGEPLELPELGCVEMTDLKAPLQQCAEDRQICPSLAGFQFTQWDSETHNESVSALVDKFKKNDQVFDINAEVDESDCGDFPDGSLGDDFDANDEPDHTAVGDHEEFRSWKEPCQVQSCQEEMISLGDGDIRTMCPLLSMKPGEYSYFSPRTMSMWAGPDHWRFRPRRKQDAPSQSENKKKSTKKDFEIDFEDDIDFDVYFRKTKAATILTKSTLENQNWRATTLPTDFNYNVDTLVQLHLKPGTRLLKMAQGHRVETEHYEEIEDYDYNNPNDTSNFCPGLQAADSDDEDLDDLFVGPVGNSDLSPYPCHPPKTAQQNGDTPEAQGLDITTYGESNLVAEPQKVNKIEIHYAKTAKKMDMKKLKQSMWSLLTALSGKEADAEANHREAGKEAALAEVADEKMLSGLTKDLQRSLPPVMAQNLSIPLAFACLLHLANEKNLKLEGTEDLSDVLVRQGD

SEQ ID NO: 8136 - protein, 299 aa, Homo sapiens
METQFPVSEGKVDPYRSCGFSYEQDPTLRDPEAVARRWPWMVSVRANGTHICAGTIIASQWVLTVAHCLIWRDVIYSVRVGSPWIDQMTQTASDVPVLQVIMHSRYRAQRFWSWVGQANDIGLLKLKQELKYSNYVRPICLPGTDYVLKDHSRCTVTGWGLSKADGMWPQFRTIQEKEVIILNNKECDNFYHNFTKIPTLVQIIKSQMMCAEDTHREKFCYELTGEPLVCSMEGTWYLVGLVSWGAGCQKSEAPPIYLQVSSYQHWIWDCLNGQALALPAPSRTLLLALPLPLSLLAAL

SEQ ID NO: 8137 - protein, 362 aa, Homo sapiens
MLVPGSTRPYSKKRQNSKSAQGLAGLRNLGNTCFMNSILQCLSNTRELRDYCLQRLYMRDLHHGSNAHTALVEEFAKLIQTIWTSSPNDVVSPSEFKTQIQRYAPRFVGYNQQDAQEFLRFLLDGLHNEVNRVTLRPKSNPENLDHLPDDEKGRQMWRKYLEREDSRIGDLFVGQLKSSLTCTDCGYCSTVFDPFWDLSLPIAKRGYPEVTLMDCMRLFTKEDVLDGDEKPTCCRCRGRKRCIKKFSIQRFPKILVLHLKRFSESRIRTSKLTTFVNFPLRDLDLREFASENTNHAVYNLYAVSNHSGTTMGGHYTAYCRSPGTGEWHTFNDSSVTPMSSSQVRTSDAYLLFYELASPPSRM

SEQ ID NO: 8138 - protein, 599 aa, Homo sapiens
MDPGDAAILESSLRILYRLFESVLPPLPAALQSRMNVIDHVRDMAAAGLHSNVRLLSSLLLTMSNNNPELFSPPQKYQLLVYHADSLFHDKEYRNAVSKYTMALQQKKALSKTSKVRPSTGNSASTPQSQCLPSEIEVKYKMAECYTMLKQDKDAIAILDGIPSRQRTPKINMMLANLYKKAGQERPSVTSYKEVLRQCPLALDAILGLLSLSVKGAEVASMTMNVIQTVPNLDWLSVWIKAYAFVHTGDNSRAISTICSLEKKSLLRDNVDLLGSLADLYFRAGDNKNSVLKFEQAQMLDPYLIKGMDVYGYLLAREGRLEDVENLGCRLFNISDQHAEPWVVSGCHSFYSKRYSRALYLGAKAIQLNSNSVQALLLKGAALRNMGRVQEAIIHFREAIRLAPCRLDCYEGLIECYLASNSIREAMVMANNVYKTLGANAQTLTLLATVCLEDPVTQEKAKTLLDKALTQRPDYIKAVVKKAELLSREQKYEDGIALLRNALANQSDCVLHRILGDFLVAVNEYQEAMDQYSIALSLDPNDQKSLEGMQKMEKEESPTDATQEEDVDDMEGSGEEGDLEGSDSEAAQWADQEQWFGMQ

SEQ ID NO: 8139 - protein, 168 aa, Homo sapiens
MPATRKPMRYGHTEGHTEVCFDDSGSFIVTCGSDGDVRIWEDLDDDDPKFINVGEKAYSCALKSGKLVTAVSNNTIQVHTFPEGVPDGILTRFTTNANHVVFNGDGTKIAAGSSDFLVKIVDVMDSSQQKTFRGHDAPVLSLSFDPKDIFLASASCDGSVRVWQISDQ

SEQ ID NO: 8140 - protein, 46 aa, Homo sapiens
MVNSCCGSVCSDQGCGLENCCRPSCCQTTCCRTTCCRPLCCASSCC

SEQ ID NO: 8141 - protein, 222 aa, Homo sapiens
MASVVEYKGLRAGYHCGYCDSKEGKASCGMWAHSMTVQDYQDLIDRGWRRSGKYVYKPVMNQTCCPQYTIRCRPLQFQPSKSHKKVLKKMLKFLAKGEVPKGSCEDEPMDSTMDDAVAGDFALINKLDIQCDLKTLSDDIKESLESEGKNSKKEEPQELLQSQDFVGEKLGSGEPSHSVKVHTVPKPGKGADLSKPPCRKAKEIRKERKRLKLMQQNPAGEL

SEQ ID NO: 8142 - protein, 164 aa, Homo sapiens
MLKAVILIGGPQKGTRFRPLSFEVPKPLFPVAGVPMIQHHIEACAQVPGMQEILLIGFYQPDEPLTQFLEAAQQEFNLPVRYLQEFAPLGTGGGLYHFRDQILAGSPEAFFVLNADVCSDFPLSAMLEAHRRQRHPFLLLGTTANRTQSLNYGCIVENPQTHEV

SEQ ID NO: 8143 - protein, 112 aa, Homo sapiens
MFVSDFRKEFYEVVQSQRVLLFVASDVDALCACKILQALFQCDHVQYTLVPVSGWQELETAFLEHKEQFHYFILINCGANVDLLDILQPDEDTIFFVCDTHRPVNVVNVYND

SEQ ID NO: 8144 - protein, 313 aa, Homo sapiens
TLVVSGRDDPPTHSQPDSDDEAEEIQWSDDENTATLTAPEFPEFATKVQEAINSLGGSVFPKLNWSAPRDAYWIAMNSSLKCKTLSDIFLLFKSSDFITRDFTQPFIHCTDDSPDPCIEYELVLRKWCELIPGAEFRCFVKENKLIGISQRDYTQYYDHISKQKEEIRRCIQDFFKKHIQYKFLDEDFVFDIYRDSRDSPAFRCTNSEVTVQPSPYLSYRLPKDFVDLSTGEDAHKLIDKSAGGRLMSVLELEKRRPRPTAPGAAHQPQLPADPDAGGPSSVDISHFLYSCTFTWGKKRRDFATCKNNIINRS

SEQ ID NO: 8145 - protein, 338 aa, Homo sapiens; identical to SEQ ID NO: 4756

SEQ ID NO: 8146 - protein, 372 aa, Homo sapiens; identical to SEQ ID NO: 6355

SEQ ID NO: 8147 - protein, 135 aa, Homo sapiens
  MOD_RES (1)..(1): Any amino acid
XQLASMVWNNPSQQQFMQFGGSSGSQLPQIQTDVVLPSCKKKAPAETPVKERLFIVFNPHPLPLDVLEDIFCRFGNLIEVYLVSGKNVGYAKYADRISANDAIATLHGKILNGVRLKVMLADSPREESNKRQRTY

SEQ ID NO: 8148 - protein, 587 aa, Homo sapiens; identical to SEQ ID NO: 5895

SEQ ID NO: 8149 - protein, 613 aa, Homo sapiens; identical to SEQ ID NO: 5032

SEQ ID NO: 8150 - protein, 158 aa, Homo sapiens
MTHCCSPCCQPTCCRTTCCRTTCWKPTTVTTCSSTPCCQPACCVSSCCQPCCRPTCCQNTCCRTTCCQPTCPTCCGSSCCGQTSCGSSCGQSSSCAPVYCRRTCYYPTTVCLPGCLNQSCGSNCCQPCCRPACCETTCCRTTCFQPTCVSSCCQPSCC

SEQ ID NO: 8151 - protein, 539 aa, Homo sapiens; identical to SEQ ID NO: 5502

SEQ ID NO: 8152 - protein, 836 aa, Homo sapiens
MAAALGPPEVIAQLENAAKVLMQTLACSILTALLSEFSSSSKTSNIGLSMEFHGNCKRVFQEEDLRQIFMLTVEVLQEFSRRENLNAQMSSVFQRYLALANQVLSWNFLPPKLGRHYIAMFESSQNVLLKPTESWRETLLDSRVMELFFTVHRKIREDSDMAQDSLQCLAQLASLHGPIFPDEGSQVDYLAHFIEGLLNTINGIEIEDSEAVGISSIISNLITVFPRNVLTAIPSELFSSFVNCLTHLTCSFGRSAALEEVLDKDDMVYMEAYDKLLESWLTLVQDDKHFHKGFFTQHAVQVFNSYIQCHLAAPDGTRNLTANGVASREEEEISELQEDDRDQFSDQLASVGMLGRIAAEHCIPLLTSLLEERVTRLHGQLQRHQQQLLASPGSSTVDNKMLDDLYEDIHWLILVTGYLLADDTQGETPLIPPEIMEYSIKHSSEVDINTTLQILGSPGEKASSIPGYNRTDSVIRLLSAILRVSEVESRAIRADLTHLLSPQMGKDIVWFLKRWAKTYLLVDEKLYDQISLPFSTAFGADTEGSQWIIGYLLQKVISNLSVWSSEQDLANDTVQLLVTLVERRERANLVIQCENWWNLAKQFASRSPPLNFLSSPVQRTLMKALVLGGFAHMDTETKQQYWTEVLQPLQQRFLRVINQENFQQMCQQEEVKQEITATLEALCGIAEATQIDNVAILFNFLMDFLTNCIGLMEVYKNTPETVNLIIEVFVEVAHKQICYLGESKAMNLYEACLTLLQVYSKNNLGRQRIDVTAEEEQYQDLLLIMELLTNLLSKEFIDFSDTDEVFRGHEPGQAANRSVSAADVVLYGVNLILPLM

SEQ ID NO: 8153 - protein, 335 aa, Homo sapiens
MDFLLGNPFSSPVGQRIEKATDGSLQSEDWALNMEICDIINETEEGPKDALRAVKKRIVGNKNFHEVLETCVKNCGHRFHVLVASQDFVESVLVRTILPKNNPPTIVHDKVLNLIQSWADAFRSSPDLTGVVTIYEDLRRKGLEFPMTDLDMLSPIHTPQRTVFNSETQSGQDSVGTDSSQQEDSGQHAAPLPAPPILSGDTPIAPTPEQIGKLRSELEMVSGNVRVMSEMLTELVPTQAEPADLELLQELNRTCRAMQQRVLELIPQIANEQLTEELLIVNDNLNNVFLRHERFERFRTGQTTKAPSEAEPAADLIDMGPDPAATGNLSSQLAG

SEQ ID NO: 8154 - protein, 1730 aa, Homo sapiens
MGNSDSQYTLQGSKNHSNTITGAKQIPCSLKIRGIHAKEEKSLHGWGHGSNGAGYKSRSLARSCLSHFKSNQPYASRLGGPTCKVSRGVAYSTHRTNAPGKDFQGISAAFSTENGFHSVGHELADNHITSRDCNGHLLNCYGRNESIASTPPGEDRKSPRVLIKTLGKLDGCLRVEFHNGGNPSKVPAEDCSEPVQLLRYSPTLASETSPVPEARRGSSADSLPSHRPSPTDSRLRSSKGSSLSSESSWYDSPWGNAGELSEAEGSFLAPGMPDPSLHASFPPGDAKKPFNQSSSLSSLRELYKDANLGSLSPSGIRLSDEYMGTHASLSNRVSFASDIDVPSRVAHGDPIQYSSFTLPCRKPKAFVEDTAKKDSLKARMRRISDWTGSLSRKKRKLQEPRSKEGSDYFDSRSDGLNTDVQGSSQASAFLWSGGSTQILSQRSESTHAIGSDPLRQNIYENFMRELEMSRTNTENIETSTETAESSSESLSSLEQLDLLFEKEQGVVRKAGWLFFKPLVTVQKERKLELVARRKWKQYWVTLKGCTLLFYETYGKNSMDQSSAPRCALFAEDSIVQSVPEHPKKENVFCLSNSFGDVYLFQATSQTDLENWVTAVHSACASLFAKKHGKEDTLRLLKNQTKNLLQKIDMDSKMKKMAELQLSVVSDPKNRKAIENQIQQWEQNLEKFHMDLFRMRCYLASLQGGELPNPKSLLAAASRPSKLALGRLGILSVSSFHALVCSRDDSALRKRTLSLTQRGRNKKGIFSSLKGLDTLARKGKEKRPSITQVDELLHIYGSTVDGVPRDNAWEIQTYVHFQDNHGVTVGIKPEHRVEDILTLACKMRQLEPSHYGLQLRKLVDDNVEYCIPAPYEYMQQQVYDEIEVFPLNVYDVQLTKTGSVCDFGFAVTAQVDERQHLSRIFISDVLPDGLAYGEGLRKGNEIMTLNGEAVSDLDLKQMEALFSEKSVGLTLIARPPDTKATLCTSWSDSDLFSRDQKSLLPPPNQSQLLEEFLDNFKKNTANDFSNVPDITTGLKRSQTDGTLDQVSHREKMEQTFRSAEQITALCRSFNDSQANGMEGPRENQDPPPRSLARHLSDADRLRKVIQELVDTEKSYVKDLSCLFELYLEPLQNETFLTQDEMESLFGSLPEMLEFQKVFLETLEDGISASSDFNTLETPSQFRKLLFSLGGSFLYYADHFKLYSGFCANHIKVQKVLERAKTDKAFKAFLDARNPTKQHSSTLESYLIKPVQRVLKYPLLLKELVSLTDQESEEHYHLTEALKAMEKVASHINEMQKIYEDYGTVFDQLVAEQSGTEKEQPEWSSEVMDVLDPRGKLTKGTLEEPRTLVTELSMGELLMHSTVSWLNPFLSLGKARKDLELTVFVFKRAVILVYKENCKLKKKLPSNSRPAHNSTDLDPFKFRWLIPISALQVRLGNPAGTENNSIWELIHTKSEIEGRPETIFQLCCSDSESKTNIVKVIRSILRENFRRHIKCELPLEKTCKDRLVPLKNRVPVSAKLASSRSLKVLKNSSSNEWTGETGKGTLLDSDEGSLSSGTQSSGCPTAEGRQDSKSTSPGKYPHPGLADFADNLIKESDILSDEDDDHRQTVKQGSPTKDIEIQFQRLRISEDPDVHPEAEQQPGPESGEGQKGGEQPKLVRGHFCPIKRKANSTKRDRGTLLKAQIRHQSLDSQSENATIDLNSVLEREFSVQSLTSVVSEECFYETESHGKS

SEQ ID NO: 8155 - protein, 115 aa, Homo sapiens
MAPAKKGGEKKKGRSAINEVVTREYTINIHKRIHGVGFKKRAPRALKEIRKFAMKEMGTPDVRIDTRLNKAVWAKGIRNVPYRIRVRLSRKRNEDEDSPNKLYTLVTYVPVTTFK

SEQ ID NO: 8156 - protein, 248 aa, Homo sapiens
MALEVGDMEDGQLSDSDSDMTVAPSDRPLQLPKVLGGDSAMRAFQNTATACAPVSHYRAVESVDSSEESFSDSDDDSCLWKRKRQKCFNPPPKPEPFQFGQSSQKPPVAGGKKINNIWGAVLQKLRKESQEHTKDLDKELDEYMHGGKKMGSKEEENGQGHLKRKRPVKDRLGNRPEMNYKGRYEITAEDSQEKVADEISFRLQEPKKDLIARVVRNKLRTFSTLKTKRNMKIKKLLGRGEHKCWGKR

SEQ ID NO: 8157 - protein, 25 aa, Homo sapiens
MAMAPSPSLVQVYTSPAAVAVWEWQ

SEQ ID NO: 8158 - protein, 56 aa, Homo sapiens
MSYYQRPFSPSAYSLPASLNSSIVMQHGTSLDSTDTYPQHAQSLDGTTSSSIPLYR

SEQ ID NO: 8159 - protein, 149 aa, Homo sapiens
VRELEAELDAEQKKHAEALKGVRKHERRVKELAYQAEEDRKNLARMQDLVDKLQSKVKSYKRQFEEAEQQANTNLAKYRKAQHELDDAEERADMAETQANKLRARTRDALGPKVRSGRGIALCAGGLWGLTGSTAHSAIPFSSAQGVTA

SEQ ID NO: 8160 - protein, 155 aa, Homo sapiens
SNVMEANAARQATPAEWSQDDSNDMWEDQEEEEEEEEDGLAGQLLSDILATSKYEEDYYEDDEEDDPDALKDPLYQIDLQATLMTMRGEFYRPSASKKGSLSTFAPSGPAANHFAALTGLEMHFLLNLKWHLDPWPLASAVTLMTIQTRLTGAVT

SEQ ID NO: 8161 - protein, 539 aa, Homo sapiens; identical to SEQ ID NO: 5502

SEQ ID NO: 8162 - protein, 214 aa, Homo sapiens
MPSPWGWFAVTACGAQRNNFEEPVALQEMDTSNGVLLPFYDPDSSIVYLCGKGDSSIRYFEITDEPPFVHYLNTFSSKEPQRGMGFMPKRGLDVSKCEIARFYKLHERKCEPIIMTVPRKSDLFQDAEPVLISLRDGYVPPKHRELRVTKRNILDVRPPSGPRRSQSASDAPLSQHTLETLLEEIKALRERVQAQEQRITALENMLCELVDGTD

SEQ ID NO: 8163 - protein, 229 aa, Homo sapiens
MLQLRDSVDSAGTSPTAVLAAGEEPGSIEQAVEEIRVVVRPVEDGEIQGVWLLTEVDHWNNEKERLVLVTEQSLLICKYDFISLQCQQVVRIALNAVDTISYGEFQFPPKSLNKREGFGIRIQWDKQSRPSFINRWNPWSTNVPYATFTEHPMAGADEKTASLCQLESFKALLIQAVKKAQKESPLPGQANGVLILERPLLIETYVGLMSFINNEAKLGYSMTRGKIGF

SEQ ID NO: 8164 - protein, 129 aa, Homo sapiens
MCEVSRGWKPCTEGILKVRPTRKISYEGNITPTVELNALCMKLGKKPMYKPVDPYSRMQSTYNYNMRGGAYPPRYFYPFPVPPLLYQVELSVGGQQFNGKGKTRQAAKHDAAAKALRILQNEPLPERLE

SEQ ID NO: 8165 - protein, 1013 aa, Homo sapiens
MDLFRMRCYLASLQGGELPNPKSLLAAASRPSKLALGRLGILSVSSFHALVCSRDDSALRKRTLSLTQRGRNKKGIFSSLKGLDTLARKGKEKRPSITQVDELLHIYGSTVDGVPRDNAWEIQTYVHFQDNHGVTVGIKPEHRVEDILTLACKMRQLEPSHYGLQLRKLVDDNVEYCIPAPYEYMQQQVYDEIEVFPLNVYDVQLTKTGSVCDFGFAVTAQVDERQHLSRIFISDVLPDGLAYGEGLRKGNEIMTLNGEAVSDLDLKQMEALFSEKSVGLTLIARPPDTKATLCTSWSDSDLFSRDQKSLLPPPNQSQLLEEFLDNFKKNTANDFSNVPDITTGLKRSQTDGTLDQVSHREKMEQTFRSAEQITALCRSFNDSQANGMEGPRENQDPPPRSLARHLSDADRLRKVIQELVDTEKSYVKDLSCLFELYLEPLQNETFLTQDEMESLFGSLPEMLEFQKVFLETLEDGISASSDFNTLETPSQFRKLLFSLGGSFLYYADHFKLYSGFCANHIKVQKVLERAKTDKAFKAFLDARNPTKQHSSTLESYLIKPVQRVLKYPLLLKELVSLTDQESEEHYHLTEALKAMEKVASHINEMQKIYEDYGTVFDQLVAEQSGTEKEVTELSMGELLMHSTVSWLNPFLSLGKARKDLELTVFVFKRAVILVYKENCKLKKKLPSNSRPAHNSTDLDPFKFRWLIPISALQVRLGNPAGTENNSIWELIHTKSEIEGRPETIFQLCCSDSESKTNIVKVIRSILRENFRRHIKCELPLEKTCKDRLVPLKNRVPVSAKLASSRSLKVLKNSSSNEWTGETGKGTLLDSDEGSLSSGTQSSGCPTAEGRQDSKSTSPGKYPHPGLADFADNLIKESDILSDEDDDHRQTVKQGSPTKDIEIQFQRLRISEDPDVHPEAEQQPGPESGEGQKGGEQPKLVRGHFCPIKRKANSTKRDRGTLLKAQIRHQSLDSQSENATIDLNSVLEREFSVQSLTSVVSEECFYETESHGKS

SEQ ID NO: 8166 - protein, 382 aa, Homo sapiens
MAANLSRNGPALQEAYVRVVTEKSPTDWALFTYEGNSNDIRVAGTGEGGLEEMVEELNSGKVMYAFCRVKDPNSGLPKFVLINWTGEGVNDVRKGACASHVSTMASFLKGSVYQKTNAVSEIKRVGKDSFWAKAEKEEENRRLEEKRRAEEAQRQLEQERRERELREAARREQRYQEQGGEASPQSRTWEQQQEVVSRNRNEQESAVHPREIFKQKERAMSTTSISSPQPGKLRSPFLQKQLTQPETHFGREPAAAISRPRADLPAEEPAPSTPPCLVQAEEEAVYEEPPEQETFYEQPPLVQQQGAGSEHIDHHIQGQGLSGQGLCARALYDYQAADDTEISFDPENLITGIEVIDEGWWRGYGPDGHFGMFPANYVELIE

SEQ ID NO: 8167 - protein, 219 aa, Homo sapiens
MVVLSVPAEVTVILLDIEGTTTPIAFVKDILFPYIEENVKEYLQTHWEEEECQQDVSLLRKQAEEDAHLDGAVPIPAASGNGVDDLQQMIQAVVDNVCWQMSLDRKTTALKQLQGHMWRAAFTAGRMKAEFFADVVPAVRKWREAGMKVYIYSSGSVEAQKLLFGHSTEGDILELVDGHFDTKIGHKVESESYKDCRQHWVLNQQHFVSDRCYSRGQCC

SEQ ID NO: 8168 - protein, 481 aa, Homo sapiens; identical to SEQ ID NO: 7546

SEQ ID NO: 8169 - protein, 547 aa, Homo sapiens; identical to SEQ ID NO: 6039

SEQ ID NO: 8170 - protein, 628 aa, Homo sapiens; identical to SEQ ID NO: 7958

SEQ ID NO: 8171 - protein, 157 aa, Homo sapiens
MRSGFRCDEPAEAVAPERQTVSGAVALASFTSPHTHPVDDGGRHYSWGSPKRILGLGPGDAAKEAGLVRPLQGQSEKILLRTRNRQPMEPPMEPSGGEQEPGAVRFLDLPWEDVLLPHVLNRVPLRQLLRLQRVSRAFRSLVQLHLAGLRRFDAAQV

SEQ ID NO: 8172 - protein, 160 aa, Homo sapiens; identical to SEQ ID NO: 6461

SEQ ID NO: 8173 - protein, 133 aa, Homo sapiens
MAALRPLVKPKIVKKRTKKFIRHQSDRYVKIKRNWRKPRGIDNRVRRRFKGQILMPNIGYGSNKKTKHMLPSGFRKFLVHNVKELEVLLMCNKSYCAEIAHNVSSKNRKAIVERAAQLAIRVTNPNARLRSEE

SEQ ID NO: 8174 - protein, 212 aa, Homo sapiens
MDLFGDLPEPERSPRPAAGKEAQKGPLLFDDLPPASSTDSGSGGPLLFDDLPPASSGDSGSLATSISQMVKTEGKGAKRKTSEEEKNGSEELVEKKVSSSVIFGLKGYVAERKGEREEMQDAHVILNDITEECRPPSSLITRVSYFAVFDGHGGIRASKFAAQNLHQNLIRKFPKGDVISVEKTVKRCLLDTFKHTDEEFLKQASSQKPAWK

SEQ ID NO: 8175 - protein, 376 aa, Homo sapiens; identical to SEQ ID NO: 5815

SEQ ID NO: 8176 - protein, 494 aa, Homo sapiens
MAAAAECDVVMAATEPELLDDQEAKREAETFKEQGNAYYAKKDYNEAYNYYTKAIDMCPKNASYYGNRAATLMMLGRFREALGDAQQSVRLDDSFVRGHLREGKCHLSLGNAMAACRSFQRALELDHKNAQAQQEFKNANAVMEYEKIAETDFEKRDFRKVVFCMDRALEFAPACHRFKILKAECLAMLGRYPEAQSVASDILRMDSTNADALYVRGLCLYYEDCIEKAVQFFVQALRMAPDHEKACIACRNAKALKAKKEDGNKAFKEGNYKLAYELYTEALGIDPNNIKTNAKLYCNRGTVNSKLRKLDDAIEDCTNAVKLDDTYIKAYLRRAQCYMDTEQYEEAVRDYEKVYQTEKTKEHKQLLKNAQLELKKSKRKDYYKILGVDKNASEDEIKKAYRKRALMHHPDRHSGASAEVQKEEEKKFKEVGEAFTILSDPKKKTRYDSGQDLDEEGMNMGDFDPNNIFKAFFGGPGGFSFEASGPGNFFFQFG

SEQ ID NO: 8177 - protein, 442 aa, Homo sapiens
NEVYNLTQEFFRHDKPVNAESQNSVGVFTREEVRNRIRNDPDDPEATKRLKLAMIQQYLKVESCESSSHSMDEVSLSAFGEWTEIPGAHHIIPSGFMRVVELLAEGIPAHVIQLGKPVRCIHWDQASARPRGPEIEPRGEGDHNHDTGEGGQGGEEPRGGRWDEDEQWSVVVECEDCELIPADHVIVTVSLGVLKRQYTSFFRPGLPTEKVAAIHRLGIGTTDKIFLEFEEPFWGPECNSLQFVWEDEAESHTLTYPPELWYRKICGFDVLYPPERYGHVLSGWICGEEALVMEKCDDEAVAEICTEMLRQFTGNPNIPKPRRILRSAWGSNPYFRGSYSYTQVGSSGADVEKLAKPLPYTESSKTAHGSSTKQQPGHLFSSKCPEQPLDANRGAVKPMQVLFSGEATHRKYYSTTHGALLSGQREAARLIEMYRDLFQQGT

SEQ ID NO: 8178 - protein, 59 aa, Homo sapiens
MSYYQRPFSPSAYSLPASLNSSIVMQHGTSLDSTDTYPQHAQSLDGTTSSSIPLYRSSE

SEQ ID NO: 8179 - protein, 278 aa, Homo sapiens
MKCEHCTRKECSKKTKTDDQENVSADAPSPAQENGEKGEFHKLADAKIFLSDCLACDSCMTAEEGVQLSQQNAKDFFRVLNLNKKCDTSKHKVLVVSVCPQSLPYFAAKFNLSVTDASRRLCGFLKSLGWVRYAERVLGRPITAHLCTAKSPQQVMGSLVKDYFARQQNLSPEKIFHVIVAPCYDKKLEALQESLPPALHGSRGADCVLTSGTGSLWECTPVITATQEAAARESLEPGRQRLQRDKIAPLDSSLGGGGEIAQIMEQGDLSVRDAAVDT

SEQ ID NO: 8180 - protein, 156 aa, Homo sapiens
  MOD_RES (1)..(1): Any amino acid
XGKAQRKISAIHILDVLVLNGTDVREQHFNQRIQLAEKFVKAVSKPSRPDMNPIRVKEVYRLEEMEKIFVRLEMKIIKGSSGTPKLSYTGRDDRHFVPMGLYIVRTVNEPWTMGFSKSFKKKFFYNKKTKDSTFDLPADSIAPFHLPSLACLSKMD

SEQ ID NO: 8181 - protein, 399 aa, Homo sapiens; identical to SEQ ID NO: 7529

SEQ ID NO: 8182 - protein, 272 aa, Homo sapiens
MASLLQDQLTTDQDLLLMQEGMPMRKVRSKSWKKLRYFRLQNDGMTVWHARQARGSAKPSFSISDVETIRNGHDSELLRSLAEELPLEQGFTIVFHGRRSNLDLMANSVEEAQIWMRGLQLLVDLVTSMDHQERLDRWLSDWFQRGDKNQDGKMSFQEVQRLLHLMNVEMDQEYAFSLFQAADTSQSGTLEGEEFVQFYKALTKRAEVQELFESFSADGQKLTLLEFLDFLQEEQKERDCTSELALELIDRYEPSDSGASEEDPGEGEEVNT

SEQ ID NO: 8183 - protein, 119 aa, Homo sapiens; identical to SEQ ID NO: 7107

SEQ ID NO: 8184 - protein, 626 aa, Homo sapiens; identical to SEQ ID NO: 6327

SEQ ID NO: 8185 - protein, 62 aa, Homo sapiens
MAMAPSPSLVQVYTSPAAVAVWEWQDGLGTWHPYSATVCSFIEQQFVQQKGQRFGLGSLAHS

SEQ ID NO: 8186 - protein, 75 aa, Homo sapiens
MRLSLPLLLLLLGAWAIPGGLGDRAPLTATAPQLDDEEMYSAHMPAHLRCDACRAVAYQRLCSYPPHLPLTEQQS

SEQ ID NO: 8187 - protein, 872 aa, Homo sapiens
MGDSDDEYDRRRRDKFRRERSDYDRSRERDERRRGDDWNDREWDRGRERRSRGEYRDYDRNRRERFSPPRHELSPPQKRMRRDWDEHSSDPYHSGYEMPYAGGGGGPTYGPPQPWGHPDVHIMQHHVLPIQARLGSIAEIDLGVPPPVMKTFKEFLLSLDDSVDETEAVKRYNDYKLDFRRQQMQDFFLAHKDEEWFRSKYHPDEVGKRRQEARGALQNRLRVFLSLMETGWFDNLLLDIDKADAIVKMLDAAVIKMEGGTENDLRILEQEEEEEQAGKPGEPSKKEEGRAGAGLGDGERKTNDKDEKKEDGKQAENDSSNDDKTKKSEGDGDKEEKKEDSEKEAKKSSKKRNRKHSGDDSFDEGSVSESESESESGQAEEEKEEAEEALKEKEKPKEEEWEKPKDAAGLECKPRPLHKTCSLFMRNIAPNISRAEIISLCKRYPGFMRVALSEPQPERRFFRRGWVTFDRSVNIKEICWNLQNIRLRECELSPGVNRDLTRRVRNINGITQHKQIVRNDIKLAAKLIHTLDDRTQLWASEPGTPPLPTSLPSQNPILKNITDYLIEEVSAEEEELLGSSGGAPPEEPPKEGNPAEINVERDEKLIKVLDKLLLYLRIVHSLDYYNTCEYPNEDEMPNRCGIIHVRGPMPPNRISHGEVLEWQKTFEEKLTPLLSVRESLSEEEAQKMGRKDPEQEVEKFVTSNTQELGKDKWLCPLSGKKFKGPEFVRKHIFNKHAEKIEEVKKEVAFFNNFLTDAKRPALPEIKPAQPPGPAQSLTPGLPYPHQTPQGLMPYGQPRPPILGYGAGAVRPAVPTGGPPYPHAPYGAGRGNYDAFRGQGGYPGKPRNRMVRGDPRAIVEYRDLDAPDDVDFF

SEQ ID NO: 8188 - protein, 160 aa, Homo sapiens
  MOD_RES (1)..(1): Any amino acid
XPEDVQALVSGKLALRYAGRQTEALKCVAQASKNRSLADFEKALTDYRAELRDDPIISTHLAKLYDNLLEQNLIRVIEPFSRVQIEHISSLIKLSKADVERKLSQMILDKKFHGILDQGEGVLIIFDEPPVDKTYEAALETIQNMSKVVDSLYNKAKKLT

SEQ ID NO: 8189 - protein, 1301 aa, Homo sapiens
MWRRKHPRTSGGTRGVLSGNRGVEYGSGRGHLGTFEGRWRKLPKMPEAVGTDPSTSRKMAELEEVTLDGKPLQALRVTDLKAALEQRGLAKSGQKSALVKRLKGALMLENLQKHSTPHAAFQPNSQIGEEMSQNSFIKQYLEKQQELLRQRLEREAREAAELEGKSSSISEEKGDSDDEKPRKGERRSSRVRQARAAKLSEGSQPAEEEEDQETPSRNLRVRADRNLKTEEEEEEEEEEEEDDEEEEGDDEGQKSREAPILKEFKEEGEEIPRVKPEEMMDERPKTRSQEQEVLERGGRFTRSQEEARKSHLARQQQEKEMKTTSPLEEEEREIKSSQGLKEKSKSPSPPRLTEDRKKASLVALPEQTASEEETPPPLLTKEASSPPPHPQLHSEEEIEPMEGPAPAVLIQLSPPNTDADTRELLVSQHTVQLVGGLSPLSSPSDTKAESPAEKVPEESVLPLVQKSTLADYSAQKDLEPESDRSAQPLPLKIEELALAKGITEECLKQPSLEQKEGRRASHTLLPSHRLKQSADSSSSRSSSSSSSSSRSRSRSPDSSGSRSHSPLRSKQRDVAQARTHANPRGRPKMGSRSTSESRSRSRSRSRSASSNSRKSLSPGVSRDSSTSYTETKDPSSGQEVATPPVPQLQVCEPKERTSTSSSSVQARRLSQPESAEKHVTQRLQPERGSPKKCEAEEAEPPAATQPQTSETQTSHLPESERIHHTVEEKEEVTMDTSENRPENDVPEPPMPIADQVSNDDRPEGSVEDEEKKESSLPKSFKRKISVVSATKGVPAGNSDTEGGQPGRKRRWGASTATTQKKPSISITTESLKSLIPDIKPLAGQEAVVDLHADDSRISEDETERNGDDGTHDKGLKICRTVTQVVPAEGQENGQREEEEEEKEPEAEPPVPPQVSVEVALPPPAEHEVKKVTLGDTLTRRSISQQKSGVSITIDDPVRTAQVPSPPRGKISNIVHISNLVRPFTLGQLKELLGRTGTLVEEAFWIDKIKSHCFVTYSTVEEAVATRTALHGVKWPQSNPKFLCADYAEQDELDYHRGLLVDRPSETKTEEQGIPRPLHPPPPPPVQPPQHPRAEQREQERAVREQWAEREREMERRERTRSEREWDRDKVREGPRSRSRSRDRRRKERAKSKEKKSEKKEKAQEEPPAKLLDDLFRKTKAAPCIYWLPLTDSQIVQKEAERAERAKEREKRRKEQEEEEQKEREKEAERERNRQLEREKRREHSRERDRERERERERDRGDRDRDRERDRERGRERDRRDTKRHSRSRSRSTPVRDRGGRR

SEQ ID NO: 8190 - protein, 76 aa, Homo sapiens
MLLENLTDNESENTNLKKKVFEKEAHIQELSCLFQSEKSLETKIAKWNLQSRMNKNEAIVMKEASRQKTVALKKAS

SEQ ID NO: 8191 - protein, 582 aa, Homo sapiens
MEVRASLQKVSGSSDSVATMNSEEFVLVPQYADDNSTKHEEKPQLKIVSNGDEQLEKAMEEILRDSEKRPSSLLVDCQSSSEISDHSFGDIPASQTNKPSLQLILDPSNTEISTPRPSSPGGLPEEDSVLFNKLTYLGCMKVSSPRNEVEALRAMATMKSSSQYPFPVTLYVPNVPEGSVRIIDQSSNVEIASFPIYKVLFCARGHDGTTESNCFAFTESSHGSEEFQIHVFSCEIKEAVSRILYSFCTAFKRSSRQVSDVKDSVIPTPDSDVFTFSVSLEVKEDDGKGNFRLLVIPIPFEYFSPVPKDRDKFYFKLKQGIEKKVVITVQQLSNKELAIERCFGMLLSPGRNVKNSDMHLLDMESMGKSYDGRAYVITGMWNPNAPVFLALNEETPKDKQVYMTVAVDMVVTEVVEPVRFLLETVVRVYPANERFWYFSRKTFTETFFMRLKQSEGKGHTNAGDAIYEVVSLQRESDKEEPVTPTSGGGPMSPQDDEAEEESDNELSSGTGDVSKDCPEKILYSWGELLGKWHSNLGARPKGLSTLVKSGVPEALRAEVWQLLAGCHDNQAMLDRYRILITK

SEQ ID NO: 8192 - protein, 45 aa, Homo sapiens
MDADSDVALDILITNVVCVFRTRCHLNLRKIALEGANVIYKRDVG

SEQ ID NO: 8193 - protein, 253 aa, Homo sapiens
MEDAPQRLRWQAHLEFTHNHDVGDLTWDKIAVSLPRSEKLRSLVLAGIPHGMRPQLWMRLSGALQKKRNSELSYREIVKNSSNDETIAAKQIEKDLLRTMPSNACFASMGSIGVPRLRRVLRALAWLYPEIGYCQGTGMVAACLLLFLEEEDAFWMMSAIIEDLLPASYFSTTLLGVQTDQRVLRHLIVQYLPRLDKLLQEHDIELSLITLHWFLTAFASVVDIKLLLRIWDLFFYEGSRVLFQLTLGMLHLK

SEQ ID NO: 8194 - protein, 111 aa, Homo sapiens
  MOD_RES (1)..(1): Any amino acid
XPLVKVQIFGVRLDTARQETNYVENNGFNPYWGQTLCFRVLVPELAMLRFVVMDYDWKSRNDFIGQYTLPWTCMQQGYRHIHLLSKDGISLRPASIFVYICIQEGLEGDES

SEQ ID NO: 8195 - protein, 183 aa, Homo sapiens; identical to SEQ ID NO: 5652

SEQ ID NO: 8196 - protein, 404 aa, Homo sapiens
MMLSTEGREGFVVKVRGLPWSCSADEVMRFFSDCKIQNGTSGIRFIYTREGRPSGEAFVELESEEEVKLALKKDRETMGHRYVEVFKSNSVEMDWMTLPVDFQGRSTGEAFVQFASQEIAEKALKKHKERIGHRYIEIFKSSRAEVRTHYDPPRKLMAMQRPGPYDRPGAGRGYNSIGRGAGFERMRRGAYGGGYGGYDDYGGYNDGYGFGSDRFGRDLNYCFSGMSDHRYGDGGSSFQSTTGHCVHMRGLPYRATENDIYNFFSPLNPMRVHIEIGPDGRVTGEADVEFATHEDAVAAMAKDKANMQHRYVELFLNSTAGTSGGAYDHSYVELFLNSTAGASGGAYGSQMMGGMGLSNQSSYGGPASQQLSGGYGGGYGGQSSMSGYDQVLQENSSDYQSNLA

SEQ ID NO: 8197 - protein, 514 aa, Homo sapiens; identical to SEQ ID NO: 7611

SEQ ID NO: 8198 - protein, 975 aa, Homo sapiens
MKFVSEDLHRCALLTADSFGDPFFPRTTQILLEYQLGRWVPRLREPRDLYGVSSSGPLSPTRWPYHCEVIDEKVQHIDWTPSCPEPVYIPTGLETEPLYPDSKEATVVYLAEDAYKEPCFVYSRVGGNRTPLKQPVDYRDNTLMFEARFESGNLQKVVKVAEYEYQLTVRPDLFTNKHTQWYYFQVTNMRAGIVYRFTIVNFTKPASLYSRGMRPLFYSEKEAKAHHIGWQRIGDQIKYYRNNPGQDGRHYFSLTWTFQFPHNKDTCYFAHCYPYTYTNLQEYLSGINNDPVRSKFCKIRVLCHTLARNMVYILTITTPLKNSDSRKRKAVILTARVHPGETNSSWIMKGFLDYILGNSSDAQLLRDTFVFKVVPMLNPDGVIVGNYRCSLAGRDLNRNYTSLLKESFPSVWYTRNMVHRLMEKREVILYCDLHGHSRKENIFMYGCDGSDRSKTLYLQQRIFPLMLSKNCPDKFSFSACKFNVQKSKEGTGRVVMWKMGIRNSFTMEATFCGSTLGNKRGTHFSTKDLESMGYHFCDSLLDYCDPDRTKYYRCLKELEEMERHITLEKVFEDSDTPVIDITLDVESSSRGSDSSESIDSLTYLLKLTSQKKHLKTKKERNSTIASHQNARGQEVYDRGHLLQRHTQSNSDVKDTRPNEPDDYMVDYFRRQLPNQGLAHCKLRLPGSRHSPASASRVAGTTGTRHHTWLIFVFLVEMGKKIPLKGTDLYGNCFKVTSLQSPMGKQTSTWTEKTRIPTEDLHHNLKSKIKECISFQSKKTGINWTDDEKRSYKDKGIVQTQEILQYLLPIVHSTKNMQTTQIKQLFNPRTNFQIQHQLNPATCRNIKKYSTSWTAPRNHPFVIQGDVMANSSEWVQSKPHRSLESLSPLKGPKKNKHSQIWAIKNEDIKPLSSKWETASSSFGMDANVLKYKSLQAEETNQQSSKHTALHLTKNKDEQANKNDGQPTLYLKFQRES

SEQ ID NO: 8199 - protein, 541 aa, Homo sapiens
MSSSGYPPNQGAFSTEQSRYPPHSVQYTFPNTRHQQEFAVPDYRSSHLEVSQASQLLQQQQQQQLRRRPSLLSEFHPGSDRPQERRTSYEPFHPGPSPVDHDSLESKRPRLEQVSDSHFQRVSAAVLPLVHPLPEGLRASADAKKDPAFGGKHEAPSSPISGQPCGDDQNASPSKLSKEELIQSMDRVDREIAKVEQQILKLKKKQQQLEEEAAKPPEPEKPVSPPPVEQKHRSIVQIIYDENRKKAEEAHKIFEGLGPKVELPLYNQPSDTKVYHENIKTGVPARRMMKNQVMRKKLILFFKRRNHARKQREQKICQRYDQLMEAWEKKVDRIENNPRRKAKESKTREYYEKQFPEIRKQREQQERFQRVGQRGAGLSATIARSEHEISEIIDGLSEQENNEKQMRQLSVIPPMMFDAEQRRVKFINMNGLMEDPMKVYKDRQFMNVWTDHEKEIFKDKFIQHPKNFGLIASYLERKSVPDCVLYYYLTKKNENYKALVRRNYGKRRGRNQQIARPSQEEKVEEKEEDKAEKTEKKEEEK

SEQ ID NO: 8200 - protein, 279 aa, Homo sapiens
MKFPFLPILVMKFIEKAQNMSKYVLIDTPGQIEVFTWSASGTIITEALASSFPTVVIYVMDTSRSTNPVTFMSNMLYACSILYKTKLPFIVVMNKTDIIDHSFAVEWMQDFEAFQDALNQETTYVSNLTRSMSLVLDEFYSSLRVVGVSAVLGTGLDELFVQVTSAAEEYEREYRPEYERLKKSLANAESQQQREQLERLRKDMGSVALDAGTAKDSLSPVLHPSDLILTRGTLDEEDEEADSDTDDIDHRVTEESHEEPAFQNFMQESMAQYWKRNNK

SEQ ID NO: 8201 - protein, 409 aa, Homo sapiens
MKDTQDIQEASKAMQNKVHEQEDKNEKQKQREDKLGVYSLVHFSPKMLGSVATTLPLSSSNSSGMPLGYYLSSPQISRVTISTTGQLTSKATVGSCSRVENSLDASPFSVPKKQDESPMIGDGEDYFLSLFGDSKKLTAHSNYTQKTLKYFSMILEEVGQFTSSSLGDVEIAEVNVKGLFVKLINSSLDKEMAIGDHILQQNVNGQTISLYRFLPNIVMQANSTVTVWAAASEAKHQPPSDFLWKEQDKFRASPDCITILCKPNGQAIAWYTPIHWKQAWEKLDADVEFNRCSVVSPTFRKRVFQWTASTATITKEKQDQPKKDISNYQVEQAQVLLKREKEIPPTVFPNRSPWCQNPYVSAHPYCPLIEPHNTSTAGGRLDRQPRTRSTRPNRASGSKKKKTSESQKQ

SEQ ID NO: 8202 - protein, 813 aa, Homo sapiens; identical to SEQ ID NO: 7347

SEQ ID NO: 8203 - protein, 590 aa, Homo sapiens
MPSPQLLVLFGSQTGTAQDVSERLGREARRRRLGCRVQALDSYPVVNLINEPLVIFVCATTGQGDPPDNMKNFWRFIFRKNLPSTALCQMDFAVLGLGDSSYAKFNFVAKKLHRRLLQLGGSALLPVCLGDDQHELGPDAAVDPWLRDLWDRVLGLYPPPPGLTEIPPGVPLPSKFTLLFLQEAPSTGSEGQRVAHPGSQEPPSESKPFLAPMISNQRVTGPSHFQDVRLIEFDILGSGISFAAGDVVLIQPSNSAAHVQRFCQVLGLDPDQLFMLQPREPDVSSPTRLPQPCSMRHLVSHYLDIASVPRRSFFELLACLSLHELEREKLLEFSSAQGQEELFEYCNRPRRTILEVLCDFPHTAAAIPPDYLLDLIPVIRPRAFSIASSLLILVAVVQFQTRLKEPRRGLCSSWLASLDPGQGPVRVPLWVRPGSLAFPETPDTPVIMVGPGTGVAPFRAAIQERVAQGQTGNFLFFGCRWRDQDFYWEAEWQELEKRDCLTLIPAFSREQEQKVYVQHRLRELGSLVWELLDRQGAYFYLAGNAKSMPADVSEALMSIFQEEGGLCSPDAAAYLARLQQTRRFQTETWA

SEQ ID NO: 8204 - protein, 811 aa, Homo sapiens; identical to SEQ ID NO: 5487

SEQ ID NO: 8205 - protein, 62 aa, Homo sapiens
MPEIRVTPLGACPVLSWNLVLPPGRGSRAPSSTDTRTGFHVLPHGVSASSEGAPRPGVDTVL

SEQ ID NO: 8206 - protein, 315 aa, Homo sapiens
MSGLVLGQRDEPAGHRLSQEEILGSTRLVSQGLEALRSEHQAVLQSLSQTIECLQQGGHEEGLVHEKARQLRRSMENIELGLSEAQVMLALASHLSTVESEKQKLRAQVRRLCQENQWLRDELAGTQQRLQRSEQAVAQLEEEKKHLEFLGQLRQYDEDGHTSEEKEGDATKDSLDDLFPNEEEEDPSNGLSRGQGATAAQQGGYEIPARLRTLHNLVIQYAAQGRYEVAVPLCKQALEDLERTSGRGHPDVATMLNILALVYRDQNKYKEAAHLLNDALSIRESTLGPDHPAVSIPCPPHPTPRTPHHCCFGLS

SEQ ID NO: 8207 - protein, 684 aa, Homo sapiens; identical to SEQ ID NO: 4869

SEQ ID NO: 8208 - protein, 1349 aa, Homo sapiens
MEENESQKCEPCLPYSADRRQMQEQGKGNLHVTSPEDAECRRTKERLSNGNSRGSVSKSSRNIPRRHTLGGPRSSKEILGMQTSEMDRKREAFLEHLKQKYPHHASAIMGHQERLRDQTRSPKLSHSPQPPSLGDPVEHLSETSADSLEAMSEGDAPTPFSRGSRTRASLPVVRSTNQTKERSLGVLYLQYGDETKQLRMPNEITSADTIRALFVSAFPQQLTMKMLESPSVAIYIKDESRNVYYELNDVRNIQDRSLLKVYNKDPAHAFNHTPKTMNGDMRMQRELVYARGDGPGAPRPGSTAHPPHAIPNSPPSTPVPHSMPPSPSRIPYGGTRSMVVPGNATIPRDRISSLPVSRPISPSPSAILERRDVKPDEDMSGKNIAMYRNEGFYADPYLYHEGRMSIASSHGGHPLDVPDHIIAYHRTAIRSASAYCNPSMQAEMHMEQSLYRQKSRKYPDSHLPTLGSKTPPASPHRVSDLRMIDMHAHYNAHGPPHTMQPDRASPSRQAFKKEPGTLVYIEKPRSAAGLSSLVDLGPPLMEKQVFAYSTATIPKDRETSEKMMKTTANRNHTDSAGTPHVSGGKMLSALESTVPPSQPPPVGTSAIHMSLLEMRRSVAELRLQLQQMRQLQLQNQELLRAMMKKAELEISGKVMETMKRLEDPVQRQRVLVEQERQKYLHEEEKIVKKLCELEDFVEDLKKDSTAASRLVTLKDVEDGAFLLRQVGEAVATLKGEFPTLQNKMRAILRIEVEAVRFLKEEPHKLDSLLKRVRSMTDVLTMLRRHVTDGLLKGTDAAQAAQYMAMEKATAAEVLKSQEEAAHTSGQPFHSTGAPGDAKSEVVPLSGMMVRHAQSSPVVIQPSQHSVALLNPAQNLPHVASSPAVPQEATSTLQMSQAPQSPQIPMNGSAMQSLFIEEIHSVSAKNRAVSIEKAEKKWEEKRQNLDHYNGKEFEKLLEEAQANIMKSIPNLEMPPATGPLPRGDAPVDKVELSEDSPNSEQDLEKLGGKSPPPPPPPPRRSYLPGSGLTTTRSGDVVYTGRKENITAKASSEDAGPSPQTRATKYPAEEPASAWTPSPPPVTTSSSKDEEEEEEEGDKIMAELQAFQKCSFMDVNSNSHAEPSRADSHVKDTRSGATVPPKEKKGSSGAPQTSRMPVPMSAKNRPGTLDKPGKQSKLQDPRQYRQANGSAKKSGGDFKPTSPSLPASKIPALSPSSGKSSSLPSSSGDSSNLPNPPATKPSIASNPLSPQTGPPAHSASLIPSVSNGSLKFQSLTHTGKGHHLSFSPQSQNGRAPPPLSFSSSPPSPASSVSLNQGAKGTRTIHTPSLTSYKAQNGSSSKATPSTAKETS

SEQ ID NO: 8209 - protein, 58 aa, Homo sapiens
  MOD_RES (1)..(1): Any amino acid
XIIHKLAMQLRHIGDNIDHRMVREDLQQDGRDALDHFVFFFFRRVQVLLHFFWNNHLL

SEQ ID NO: 8210 - protein, 142 aa, Homo sapiens
MPEDQVGKLEATENTISAMAAAAAEQQQFYLLLGNLLSPDNVVRKQAEETYENIPGQSKITFLLQAIRNTTAAEEARQMAAVLLRRLLSSAFDEVYPALPSDVQTAIKSELLMIIQMETQSSMRKKVCDIAAELARNLIGVY

SEQ ID NO: 8211 - protein, 30 aa, Homo sapiens
MGSRKKEIALQVNISTQELWEEMLSSKGLT

SEQ ID NO: 8212 - protein, 214 aa, Homo sapiens; identical to SEQ ID NO: 5233

SEQ ID NO: 8213 - protein, 385 aa, Homo sapiens; identical to SEQ ID NO: 5364

SEQ ID NO: 8214 - protein, 84 aa, Homo sapiens
MSGLVLGQRDEPAGHRLSQEEILGSTRLVSQGLEALRSEHQAVLQSLSQTIECLQQGGHEEGLVHEKARQLRRSMENIELGLSE

SEQ ID NO: 8215 - protein, 160 aa, Homo sapiens [sequence omitted]

SEQ ID NO: 8216 - protein, 21 aa, Homo sapiens
MNPASAPPPLPPPGQQVIHVT

SEQ ID NO: 8217 - protein, 403 aa, Homo sapiens; identical to SEQ ID NO: 5446

SEQ ID NO: 8218 - protein, 1701 aa, Homo sapiens; identical to SEQ ID NO: 5407

SEQ ID NO: 8219 - protein, 135 aa, Homo sapiens
MGKSCKVVVCGQASVGKTSILEQLLYGNHVVGSEMIETQEDIYVGSIETDRGVREQVTIVVLGNKCDLQEQRRVDPDVAQHWAKSEKVKLWEVSVADRRSLLEPFVYLASKMTQPQSKSAFPLSRKNKGSGSLDG

SEQ ID NO: 8220 - protein, 1230 aa, Homo sapiens; identical to SEQ ID NO: 5996

SEQ ID NO: 8221 - protein, 88 aa, Homo sapiens
MPEDQVGKLEATENTISAMAAAAAEQQQFYLLLGNLLSPDNVVRKQAEETYENIPGQSKITFLLQAIRNTTAAEEARQMAAVLLRRLL

SEQ ID NO: 8222 - protein, 1208 aa, Homo sapiens; identical to SEQ ID NO: 6051

SEQ ID NO: 8223 - protein, 580 aa, Homo sapiens
MVLVGTQDAISAANPRVIDDSRARKLSTDLKRCTYYETCATYGLNVERVFQDVAQKVVALRKKQQLAIGPCKSLPNSPSHSAVSAASIPAVHINQATNGGGSAFSDYSSSVPSTPSISQRELRIETIAASSTPTPIRKQSKRRSNIFTSRKGADLDREKKAAECKVDSIGSGRAIPIKQGILLKRSGKSLNKEWKKKYVTLCDNGLLTYHPSLHDYMQNIHGKEIDLLRTTVKVPGKRLPRATPATAPGTSPRANGLSVERSNTQLGGGTEAEESFEFVVVSLTGQTWHFEASTAEERELWVQSVQAQILASLQGCRSAKDKTRLGNQNAALAVQAVRTVRGNSFCIDCDAPNPDWASLNLGALMCIECSGIHRHLGAHLSRVRSLDLDDWPPELLAVMTAMGNALANSVWEGALGGYSKPGPDACREEKERWIRAKYEQKLFLAPLPSSDVPLGQQLLRAVVEDDLRLLVMLLAHGSKEEVNETYGDGDGRTALHLSSAMANVVFTQLLIWYGVDVRSRDARGLTPLAYARRAGSQECADILIQHGCPGEGCGLAPTPNREPANGTNPSAELHRSPSLL

SEQ ID NO: 8224 - protein, 103 aa, Homo sapiens
MAELIQKKLQGEVEKYQQLQKDLSKSMSGRQKLEAQLTENNIVKEELALLDGSNVVFKLLGPVLVKQELGEARATVGKRLDYITAEIFLRTIPDPGDVPDSFF

SEQ ID NO: 8225 - protein, 150 aa, Homo sapiens
MTSRKKVLLKVIILGDSGVGKTSLMNQYVNKKFSNQYKATIGADFLTKEVMVDDRLVTMQIWDTAGQERFQSLGVAFYRGADCCVLVFDVTAPNTFKTLDSWRDEFLIQASPRDPENFPFVVLGNKIDLENRQVATKRAQAWCYSKNNIP

SEQ ID NO: 8226 - protein, 179 aa, Homo sapiens; identical to SEQ ID NO: 6811

SEQ ID NO: 8227 - protein, 56 aa, Homo sapiens
MDSSIHLSSLISRHDDEATRTSTSEGLEEGEVEGETLLIVESEDQASVDLSHDQSG

SEQ ID NO: 8228 - protein, 50 aa, Homo sapiens
MCSTSGCDLEEIPLDDDDLNTIEFKILAYYTRHHVFKSTPALFSPKLLRT

SEQ ID NO: 8229 - protein, 400 aa, Homo sapiens; identical to SEQ ID NO: 6020

SEQ ID NO: 8230 - protein, 170 aa, Homo sapiens
MPRKGTQPSTARRREEGPPPPSPDGASSDAEPEPPSGRTESPATAAETASEELDNRSLEEILNSIPPPPPPAMTNEAGAPRLMITHIVNQNFKSYAGEKILGPFHKRFSCIIGPNGSGKSNVIDSMLFVFGYRAQKIRSKKLSVLIHNSDEHKDIQSCTVEVHFQKIIDK

SEQ ID NO: 8231 - protein, 167 aa, Homo sapiens
MEKAVNDGSHSEELFCHLKTISEKEDLPRCTSESHLSCLKQDILNEKTELEATLKEAELVTHSVELLLPLFKDTIEKINFENANLSALNLKISEQKEILIKELDTFKSVKLALEHLLRKRDYKQTGDNLSSMLLENLTDNESENTNLKKKVFEKEAHIQELSCLFQS

SEQ ID NO: 8232 - protein, 791 aa, Homo sapiens; identical to SEQ ID NO: 5479

SEQ ID NO: 8233 - protein, 228 aa, Homo sapiens
MTDQTYCDRLVQDTPFLTGHGRLSEQQVDRIILQLNRYYPQILTNKEAEKFRNPKASLRVRLCDLLSHLQRSGERDCQEFYRALYIHAQPLHSRLPSRHALRKFHITNHACLVLARGGHPSLPLMAWMSSMTTQVCCSPGLASPLASAPPQRPPSGPEGRVWQAQAVQMLVSVSHFLPLPPSLSHGSFHTAWGILYVHSCPSFSNLIPRGSLHVCVDSNLVPTAAWRS

SEQ ID NO: 8234 - protein, 315 aa, Homo sapiens; identical to SEQ ID NO: 4846

SEQ ID NO: 8235 - protein, 400 aa, Homo sapiens; identical to SEQ ID NO: 6020

SEQ ID NO: 8236 - protein, 126 aa, Homo sapiens
MVLILGRRLNREDLGVRDSPATKRKVFEMDPKSLTGHEFFDFSSGSSHAENILQIFNEFRDSRLFTDVIICVEGKEFPCHRAVLSACSSYFRAMFCNDHRESREMLVEINGILAEAMECFLQYVYT

SEQ ID NO: 8237 - protein, 103 aa, Homo sapiens; identical to SEQ ID NO: 8224

SEQ ID NO: 8238 - protein, 78 aa, Homo sapiens
MVLILGRRLNREDLGVRDSPATKRKVFEMDPKSLTGHEFFDFSSGSSHAENILQIFNEFRDSRLFTDVIICVEGKEFP

SEQ ID NO: 8239 - protein, 439 aa, Homo sapiens
MAANLSRNGPALQEAYVRVVTEKSPTDWALFTYEGNSNDIRVAGTGEGGLEEMVEELNSGKVMYAFCRVKDPNSGLPKFVLINWTGEGVNDVRKGACASHVSTMASFLKGAHVTINARAEEDVEPECIMEKVAKASGANYSFHKESGRFQDVGPQAPVGSVYQKTNAVSEIKRVGKDSFWAKAEKEEENRRLEEKRRAEEAQRQLEQERRERELREAARREQRYQEQGGEASPQSRTWEQQQEVVSRNRNEQGSTCASLQESAVHPREIFKQKERAMSTTSISSPQPGKLRSPFLQKQLTQPETHFGREPAAAISRPRADLPAEEPAPSTPPCLVQAEEEAVYEEPPEQETFYEQPPLVQQQGAGSEHIDHHIQGQGLSGQGLCARALYDYQAADDTEISFDPENLITGIEVIDEGWWRGYGPDGHFGMFPANYVELIE

SEQ ID NO: 8240 - protein, 72 aa, Homo sapiens
MSYQQQQCKQPCQPPPVCPAPKCPEPCPPPKCPEPCPPSKCPQSCPPQQCQQKCPPVTPSPPCQPKCPPKSK

SEQ ID NO: 8241 - protein, 113 aa, Homo sapiens
MSAIQNLHSFDPFADASKGDDLLPAGTEDYIHIRIQQRNGRKTLTTVQGIADDYDKKKLVKAFKKKFACNGTVIEHPEYGEVIQLQGDQRKNICQFLVEIGLAKDDQLKVHGF

SEQ ID NO: 8242 - protein, 308 aa, Homo sapiens; identical to SEQ ID NO: 5445

SEQ ID NO: 8243 - protein, 602 aa, Homo sapiens
MIEKMQGSRMDEQRCSFPPPLKTEEDYIPYPSVHEVLGREGPFPLILLPQFGGYWIEGTNHEITSIPETEPLQSPTTKVKLECNPTARIYRKHFLGKEHFNYYSLDAALGHLVFSLKYDVIGDQEHLRLLLRTKCRTYHDVIPISCLTEFPNVVQMAKLVCEDVNVDRFYPVLYPKASRLIVTFDEHVISNNFKFGVIYQKLGQTSEEELFSTNEESPAFVEFLEFLGQKVKLQDFKGFRGGLDVTHGQTGTESVYCNFRNKEIMFHVSTKLPYTEGDAQQLQRKRHIGNDIVAVVFQDENTPFVPDMIASNFLHAYVVVQAEGGGPDGPLYKVSVTARDDVPFFGPPLPDPAVFRKGPEFQEFLLTKLINAEYACYKAEKFAKLEERTRAALLETLYEELHIHSQSMMGLGGDEDKMENGSGGGGFFESFKRVIRSRSQSMDAMGLSNKKPNTVSTSHSGSFAPNNPDLAKAAGISLIVPGKSPTRKKSGPFGSRRSSAIGIENIQEVQEKRESPPAGQKTPDSGHVSQEPKSENSSTQSSPEMPTTKNRAETAAQRAEALKDFSRSSSSASSFASVVEETEGVDGEDTGLHVAGGQCQHH

SEQ ID NO: 8244 - protein, 58 aa, Homo sapiens
MGRVWDLPGVLKVEGFRATMAQRLVRVLQICAGHVPGVSALNLLSLLRSSEGPSLEDL

SEQ ID NO: 8245 - protein, 732 aa, Homo sapiens
MLPCAAGARGRGAMVVLRAGKKTFLPPLCRAFACRGCQLAPERGAERRDTAPSGVSRFCPPRKSCHDWIGPPDKYSNLRPVHFYIPENESPLEQKLRKLRQETQEWNQQFWANQNLTFSKEKEEFIHSRLKTKGLGLRTESGQKATLNAEEMADFYKEFLSKNFQKHMYYNRMYDNMSTMVYIKEDKLEKLTQDEIISKTKQVIQGLEALKNEHNSILQSLLETLKCLKKDDESNLVEEKSNMIRKSLEMLELGLSEAQVMMALSNHLNAVESEKQKLRAQVRRLCQENQWLRDELANTQQKLQKSEQSVAQLEEEKKHLEFMNQLKKYDDDISPSEDKDTDSTKEPLDDLFPNDEDDPGQGIQQQHSSAAAAAQQGGYEIPARLRTLHNLVIQYASQGRYEVAVPLCKQALEDLEKTSGHDHPDVATMLNILALVYRDQNKYKDAANLLNDALAIREKTLGKDHPAVAATLNNLAVLYGKRGKYKEAEPLCKRALEIREKVLGKDHPDVAKQLNNLALLCQNQGKYEEVEYYYQRALEIYQTKLGPDDPNVAKTKNNLASCYLKQGKFKQAETLYKEILTRAHEREFGSVDDENKPIWMHAEEREECKGKQKDGTSFGEYGGWYKACKVDSPTVTTTLKNLGALYRRQGKFEAAETLEEAAMRSRKQGLDNVHKQRVAEVLNDPENMEKRRSRESLNVDVVKYESGPDGGEEVSMSVEWNGMRKMKLGLVN

SEQ ID NO: 8246 - protein, 82 aa, Homo sapiens
MSGLVLGQRDEPAGHRLSQEEILGSTRLVSQGLEALRSEHQAVLQSLSQTIECLQQGGHEEGLVHEKARQLRRSMENIELGL

SEQ ID NO: 8247 - protein, 73 aa, Homo sapiens
MVLILGRRLNREDLGVRDSPATKRKVFEMDPKSLTGHEFFDFSSGSSHAENILQIFNEFRDSRLFTDVIICVE

SEQ ID NO: 8248 - protein, 396 aa, Homo sapiens
MNFQAGGGQSPQQQQSLAAPGGGGAAAQQLVCGGQFGGAGPGAGGGGGPSQQLAGGPPQQFALSNSAAIRAEIQRFESVHPNIYAIYDLIERIEDLALQNQIREHVISIEDSFVNSQEWTLSRSVPELKVGIVGNLSSGKSALVHRYLTGTYVQEESPEGGRFKKEIVVDGQSYLLLIRDEGGPPELQFAAWVDAVVFVFSLEDEISFQTVYNYFLRLCSFRNASEVPMVLVGTQDAISAANPRVIDDSRARKLSTDLKRCTYYETCATYGLNVERVFQDVAQKVVALRKKQQLAIGPCKSLPNSPSHSAVSAASIPAVHINQATNGGGSAFSDYSSSVPSTPSISQRELRIETIAASSTPTPIRKQSKRRSNIFTICATVSNFSSTKRPFQLLPN

SEQ ID NO: 8249 - protein, 369 aa, Homo sapiens
MDSCLMVWHMKPQSRAYRFTGHKDAVTCVNFSPSGHLLASGSRDKTVRIWVPNVKGESTVFRAHTATVRSVHFCSDGQSFVTASDDKTVKVWATHRQKFLFSLSQHINWVRCAKFSPDGRLIVSASDDKTVKLWDKSSRECVHSYCEHGGFVTYVDFHPSGTCIAAAGMDNTVKVWDVRTHRLLQHYQLHSAAVNGLSFHPSGNYLITASSDSTLKILDLMEGRLLYTLHGHQGPATTVAFSRTGEYFASGGSDEQVMVWKSNFDIVDHGEVTKVPRPPATLASSMGNLPEVDFPVPPGRGRSVESVQSQPQEPVSVPQTLTSTLEHIVGQLDVLTQTVSILEQRLTLTEDKLKQCLENQQLIMQRATP

SEQ ID NO: 8250 - protein, 103 aa, Homo sapiens; identical to SEQ ID NO: 8224

SEQ ID NO: 8251 - protein, 89 aa, Homo sapiens; identical to SEQ ID NO: 6950

SEQ ID NO: 8252 - protein, 379 aa, Homo sapiens
MWHLDFGLHTGKTFQPLPFIIVVYPGAGRRWGLVLSLASHRRRTEAGGGTGPTSDTGWGCMLRCGQMIFAQALVCRHLGRDWRWTQRKRQPDSYFSVLNAFIDRKDSYYSIHQIAQMGVGEGKSIGQWYGPNTVAQVLKKLAVFDTWSSLAVHIAMDNTVVMEEIRRLCRTSVPCAGATAFPADSDRHCNGFPAGAEVTNRPSPWRPLVLLIPLRLGLTDINEAYVETLKHCFMMPQSLGVIGGKPNSAHYFIGYVGEELIYLDPHTTQPAVEPTDGCFIPDESFHCQHPPCRMSIAELDPSIAVGFFCKTEDDFNDWCQQVKKLSLLGGALPMFELVELQPSHLACPDVLNLSLDSSDVERLERFFDSEDEDFEILSL

SEQ ID NO: 8253 - protein, 560 aa, Homo sapiens; identical to SEQ ID NO: 7400

SEQ ID NO: 8254 - protein, 109 aa, Homo sapiens
MNPASAPPPLPPPGQQVIHVTQDLDTDLEALFNSVMNPKPSSWRKKILPESFFKEPDSGSHSRQSSTDSSGGHPGPRLAGGAQHVRSHSSPASLQLGTGAGAAGSPAQQ

SEQ ID NO: 8255 - protein, 202 aa, Homo sapiens
MGSRKKEIALQVNISTQELWEEMLSSKGLTVVDVYQGWCGPCKPVVSLFQKMRIEVGLDLLHFALAEADRLDVLEKYRGKCEPTFLFYAGGELVAVVRGANAPLLQKTILDQLEAEKKVLAEGRERKVIKDEALSDEDECVSHGKNNGEDEDMVSSERTCTLAIIKPDAVAHGKTDEIIMKIQEAGFEILTNEERTMTEAEV

SEQ ID NO: 8256 - protein, 64 aa, Homo sapiens
MAPQKDRKPKRSTWRFNLDLTHPVEDGIFDSGNFGTFPSEYLGFSSLVLHFFCFKIGAISTGEG

SEQ ID NO: 8257 - protein, 123 aa, Homo sapiens
MENLQTNFSLVQGSTKKLNGMGDDGSPPAKKMITDIHANGKTINKVPTVKKEHLDDYGEAPVETDGEHVKRTCTSVPETLHLNPSLKHTLAQFHLSSQSSLGGPAAFSARHSQESMSPTVFLP

SEQ ID NO: 8258 - protein, 66 aa, Homo sapiens
MNPSMKQKQEEIKENIKNSSVPRRTLKMIQPSASGSLVGRENELSAGLSKRKHRNDHLTSTTSSPG

SEQ ID NO: 8259 - protein, 537 aa, Homo sapiens
MVLILGRRLNREDLGVRDSPATKRKVFEMDPKSLTGHEFFDFSSGSSHAENILQIFNEFRDSRLFTDVIICVEGKEFPCHRAVLSACSSYFRAMFCNDHRESREMLVEINGILAEAMECFLQYVYTGKVKITTENVQYLFETSSLFQISVLRDACAKFLEEQLDPCNCLGIQRFADTHSLKTLFTKCKNFALQTFEDVSQHEEFLELDKDELIDYICSDELVIGKEEMVFEAVMRWVYRAVDLRRPLLHELLTHVRLPLLHPNYFVQTVEVDQLIQNSPECYQLLHEARRYHILGNEMMSPRTRPRRSTGYSEVIVVVGGCERVGGFNLPYTECYDPVTGEWKSLAKLPEFTKSEYAVCALRNDILVSGGRINSRDVWIYNSQLNIWIRVASLNKGRWRHKMAVLLGKVYVVGGYDGQNRLSSVECYDSFSNRWTEVAPLKEAVSSPAVTSCVGKLFVIGGGPDDNTCSDKVQSYDPETNSWLLRAAIPIAKRCITAVSLNNLIYVAGGLTKAIYCYDPVEDYWMHVQNTFSRQVIT

SEQ ID NO: 8260 - protein, 536 aa, Homo sapiens
MRLEELKRLQNPLEQVNDGKYSFENIQRAWREYLQRQEPLGKRSPSPPSVSSEKLSSSVSMNTFSDSSTPDYREDGMDLGSDAGSSSSSSRASSQSNSTKVTPCSECKSSSSPGGSLDLVSALEDYEEPFPVYQKKVIDEWAPEEDGEEEEEEDERDQRGYRDDRSPAREPGDVSARTRSGGGGGRSATTAMPPPVPNGNLHQHDPQDLRHNGNVVVAGRPSCSRGPRRAIQKPQPAGGRRSGRGPAAGGLCLQPPDGGTCVPEEPPVPPMDWEALEKHLAGLQFREQEVRNQGQARTNSTSAQKNERESIRQKLALGSFFDDGPGIYTSCSKSGKPSLSSRLQSGMNLQICFVNDSGSDKDSDADDSKTETSLDTPLSPMSKQSSSYSDRDTTEEESESLDDMDFLTRQKKLQAEAKMALAMAKPMAKMQVEVEKQNRKKSPVADLLPHMPHISECLMKRSLKPTDLRDMTIGQLQVIVNDLHSQIESLNEELVQLLLIRDELHTEQDAMLVDIEDLTRHAESQQKHMAEKMPAK

SEQ ID NO: 8261 - protein, 209 aa, Homo sapiens
MSENAAPGLISELKLAVPWGHIAAKAWGSLQGPPVLCLHGWLDNASSFDRLIPLLPQDFYYVAMDFGGHGLSSHYSPGVPYYLQTFVSEIRRVVAALKWNRFSILGHSFGGVVGGMFFCTFPEMVDKLILLDTPLFLLESDEMENLLTYKRRAIEHVLQVEASQEPSHVFSLKQLLQRLLKSNSHLSEECGELLLQRGTTKVATGREQH

SEQ ID NO: 8262 - protein, 66 aa, Homo sapiens
MPEDQVGKLEATENTISAMAAAAAEQQQFYLLLGNLLSPDNVVRKQAEETYENIPGQSKITFLLQA

SEQ ID NO: 8263 - protein, 686 aa, Homo sapiens
MAISQHQFYLDRKQSKAKIPSARSLDEIAMDLTETGTQRASKLVTLETKSQFIMASNGSLISSGSQDSEVSEEQKREKILELKKKEKLLQEKLLKKVEELKKICLREAELTGKMPKEYPLNIGEKPPQVRRRVGTAFKLDDNLLPSEEDPALQELESNFLIQQKLVEAAKKLANEPDLCKTVKKKRKQDYTDAMKKLQEIENAINEYRIRCGKKPSQKATVLPEDIIPSESSSLSDTTTYDDPSDAFTFPGQRSSSVPHSPRILPPKSLGIERIHFRKSSINEQFVDTRQSREMLSTHSSPYKTLERRPQGGRSMPTTPVLTRNAYSSSHLEPESSSQHCRQRSGSLESQSHLLSEMDSDKPFFSLSKSQRSSSTEILDDGSSYTSQSSTEYYCVTPVTGPYYTTQTLDTRTRGRRRSKKQNVSTSNSGSMPNLAQKDSLRNGVYSKSQEPPSSSYYIAGYTPYAECDFYYSGGYVYENDTEGQYSVNPSYRSSAHYGYERQRDYSRSFHEDEVDRVPHNPYATLRLPRKAAAKSEHITKNIHKALVAEHLRGWYQRASGQKDQGHSPQTSFDSDRGSQRCLGFAGLQVPCSPSSRASSYSSVSSTNASGNWRTQLTIGLSDYETPAHSSYTSCYGNVYNPLPSPSRQYTEISQLDGTDGNQLEDNLESSEQRLFWHEDSKPGTLV

SEQ ID NO: 8264 - protein, 72 aa, Homo sapiens
MMEEISIMVAYDAHVFSQLHDEDFLTSLVAISKPRSMVPTKKLKKYEKEYQTMRESQLQQEDPMDRYKFVYL

SEQ ID NO: 8265 - protein, 654 aa, Homo sapiens
MDSLPDEFFVRHPAVEDQRKEETENKLEKSSGQLNKQENDIPTDLVPVNLLLEVKKLLNAINTLPKGVVPHIKKFLQEDFSFQTMQREVAANSQNGEEIVPALTLRFLITQLEAALRNIQAGNYTAHQINIGYYLTLLFLYGVALTERGKKEDYTEAENKFLVMKMMIQENEICENFMSLVYFGRGLLRCAQKRYNGGLLEFHKSLQEIGDKNDHWFDIDPTEDEDLPTTFKDLLNNFIKTTESNIMKQTICSYLDCERSCEADILKNTSYKGFFQLMCSKSCCVYFHKICWKKFKNLKYPGENDQSFSGKKCLKEGCTGDMVRMLQCDVPGIVKILFEVVRKDEYITIENLGASYRKLISLKITDTDIRPKISLKFNTKDEMPIFKLDYNYFYHLLHIIIISGTDIVRQIFDEAMPPPLLKKELLIHKNVLESYYNHLWTNHPLGGSWHLLYPPNKELPQSKQFDLCLLLALIKHLNVFPAPKKGWNMEPPSSDISKSADILRLCKYRDILLSEILMNGLTESQFNSIWKKVSDILLRLGMMQEDIDKVKENPIENISLDYHQLSVYLGIPVPEIIQRMLSCYQQGIALQSITGSQRIEIEELQNEEEELSPPLMEYNINVKSHPEIQFAEINKDGTSIPSESSTESLKDLQE

SEQ ID NO: 8266 - protein, 189 aa, Homo sapiens
MNPASAPPPLPPPGQQVIHVTQDLDTDLEALFNSVMNPKPSSWRKKILPESFFKEPDSGSHSRQSSTDSSGGHPGPRLAGGAQHVRSHSSPASLQLGTGAGAAGSPAQQHAHLRQQSYDVTDELPLPPGWEMTFTATGQRYFLNHIEKITTWQDPRKAMNQPLNHMNLHPAVSSTPVPQRSMAVSQPNL

SEQ ID NO: 8267 - protein, 282 aa, Homo sapiens
MGPLPRTVELFYDVLSPYSWLGFEILCRYQNIWNINLQLRPSLITGIMKDSGNKPPGLLPRKGLYMANDLKLLRHHLQIPIHFPKDFLSVMLEKGSLSAMRFLTAVNLEHPEMLEKASRELWMRVWSRVSVGLWESSGRTLDDFLTFPRHVFRVMILPPPGGSTVLPVTPLSPHRLPAVFSSSQNEDITEPQSILAAAEKAGMSAEQAQGLLEKIATPKVKNQLKETTEAACRYGAFGLPITVAHVDGQTHMLFGSDRMELLAHLLGEKWMGPIPPAVNARL

SEQ ID NO: 8268 - protein, 406 aa, Homo sapiens
MDQLENAKMEHTNASFDTFFCETRAGKHVPRALFVDLEPTVIDGIRTGQHRSLFHPEQLLSGKEDAANNYARGRYSVGSEVIDLVLERTRKLAEQCGGLQGFLIFRSFGGGTGSGFTSLLMERLTGEYSRKTKLEFSVYPAPRISTAVVEPYNSVLTTHSTTEHTDCTFMVDNEAVYDICHRKLGVECPSHASINRLVVQVVSSITASLRFEGPLNVDLIEFQTNLVPYPRIHFPMTAFAPIVSADKAYHEQFSVSDITTACFESSNQLVKCDPRLGKYMACCLLYRGDVVPKEVNAAIAATKSRHSVQFVDWCPTGFKVGINNRPPTVMPGGDLAKVHRSICMLSNTTAIVEAWARLDHKFDLMYAKRAFLHWYLREGMEEAEFLEAREDLAALERDYEEVAQSF

SEQ ID NO: 8269 - protein, 619 aa, Homo sapiens; identical to SEQ ID NO: 5804

SEQ ID NO: 8270 - protein, 97 aa, Homo sapiens; identical to SEQ ID NO: 8007

SEQ ID NO: 8271 - protein, 128 aa, Homo sapiens
MTDLVAVWDVALSDGVHKIEFEHGTTSGKRVVYVDGKEEIRKEWMFKLVGKETFYVGAAKTKATINIDAISGFAYEYTLEINGKSLKKYMEDRSKTTNTWVLHMDGENFRIVLEKDAMDVWCNGKKLE

SEQ ID NO: 8272 - protein, 292 aa, Homo sapiens
MTVSKFMAIQKALQPDWFQCLSDGEVSCKEATSIKRVRKSVDRSLLFLDNCLRLQEESEVLQKSVIIGVIEGGDVMEERLRSARETAKRPVGGFLLDGFQGNPTTLEARLRLLSSVTAELPEDKPRLISGVSRPDEVLECIERGVDLFESFFPYQVTERGCALTFSFDYQPNPEETLLQQNGTQEEIKCMDQIKKIETTGCNQEITSFEINLKEKKYQEDFNPLVRGCSCYCCKNHTRAYIHHLLVTNELLAGVLLMMHNFEHYFGFFHYIREALKSDKLAQLKELIHRQAS

SEQ ID NO: 8273 - protein, 199 aa, Homo sapiens; identical to SEQ ID NO: 4994

SEQ ID NO: 8274 - protein, 117 aa, Homo sapiens
MPEDQVGKLEATENTISAMAAAAAEQQQFYLLLGNLLSPDNVVRKQAEETYENIPGQSKITFLLQAIRNTTAAEEARQMAAVLLRRLLSSAFDEVYPALPSDVQTAIKSELLMIIQM

SEQ ID NO: 8275 - protein, 295 aa, Homo sapiens
  MOD_RES (1)..(1): Any amino acid
XTKLATGSKDTTVIIWQVDPDTHLLKLLKTLEGHAYGVSYIAWSPDDNYLVACGPDDCSELWLWNVQTGELRTKMSQSHEDSLTSVAWNPDGKRFVTGGQRGQFYQCDLDGNLLDSWEGVRVQCLWCLSDGKTVLASDTHQRIRGYNFEDLTDRNIVQEDHPIMSFTISKNGRLALLNVATQGVHLWDLQDRVLVRKYQGVTQGFYTIHSCFGGHNEDFIASGSEDHKVYIWHKRSELPIAELTGHTRTVNCVSWNPQIPSMMASASDDGTVRIWGPAPFIDHQNIEEECSSMDS

SEQ ID NO: 8276 - protein, 350 aa, Homo sapiens
MARWIPTKRQKYGVAIYNYNASQDVELSLQIGDTVHILEMYEGWYRGYTLQNKSKKGIFPETYIHLKEATVEDLGQHETVIPGELPLVQELTSTLREWAVIWRKLYVNNKLTLFRQLQQMTYSLIEWRSQILSGTLPKDELAELKKKVTAKIDHGNRMLGLDLVVRDDNGNILDPDETSTIALFKAHEVASKRIEEKIQEEKSILQNLDLRGQSIFSTIHTYGLYVNFKNFVCNIGEDAELFMALYDPDQSTFISENYLIRWGSNGMPKEIEKLNNLQAVFTDLSSMDLIRPRVSLVCQIVRVGHMELKEGKKHTCGLRRPFGVAVMDITDIIHGKVDDEEKQHFIPFQQ

SEQ ID NO: 8277 - protein, 119 aa, Homo sapiens
MPEDQVGKLEATENTISAMAAAAAEQQQFYLLLGNLLSPDNVVRKQAEETYENIPGQSKITFLLQAIRNTTAAEEARQMAAVLLRRLLSSAFDEVYPALPSDVQTAIKSELLMIIQMET

SEQ ID NO: 8278 - protein, 92 aa, Homo sapiens
MSGLVLGQRDEPAGHRLSQEEILGSTRLVSQGLEALRSEHQAVLQSLSQTIECLQQGGHEEGLVHEKARQLRRSMENIELGLSEAQVMLALA

SEQ ID NO: 8279 - protein, 134 aa, Homo sapiens
MVLILGRRLNREDLGVRDSPATKRKVFEMDPKSLTGHEFFDFSSGSSHAENILQIFNEFRDSRLFTDVIICVEGKEFPCHRAVLSACSSYFRAMFCNDHRESREMLVEINGILAEAMECFLQYVYTGKVKITTE

SEQ ID NO: 8280 - protein, 103 aa, Homo sapiens; identical to SEQ ID NO: 8224

SEQ ID NO: 8281 - protein, 640 aa, Homo sapiens
MGRRSGLLGLRPGPEPVALERVINKVHLKANHVVKRDVDEHLRIKTVYDKSVEELLPEKKNLVKNKLFPQAISYLEKTFQVRRPAGTILLSRQCATNQYLRKENDPHRYCTGECAAHTKCGPVIVPEEHLQQCRVYRGGKWPHGAVGVPDQEGISDADFVLYVGALATERCSHENIISYAAYCQQEANMDRPIAGYANLCPNMISTQPQEFVGMLSTVKHEVIHALGFSAGLFAFYHDKDGNPLTSRFADGLPPFNYSLGLYQWSDKVVRKVERLWDVRDNKIVRHTVYLLVTPRVVEEARKHFDCPVLEGMELENQGGVGTELNHWEKRLLENEAMTGSHTQNRVLSRITLALMEDTGWYKANYSMAEKLDWGRGMGCDFVRKSCKFWIDQQRQKRQMLSPYCDTLRSNPLQLTCRQDQRAVAVCNLQKFPKPLPQEYQYFDELSGIPAEDLPYYGGSVEIADYCPFSQEFSWHLSGEYQRSSDCRILENQPEIFKNYGAEKYGPHSVCLIQKSAFVMEKCERKLSYPDWGSGCYQVSCSPQGLKVWVQDTSYLCSRAGQVLPVSIQMNGWIHDGNLLCPSCWDFCELCPPETDPPATNLTRALPLDLCSCSSSLVVTLWLLLGNLFPLLAGFLLCIWH

SEQ ID NO: 8282 - protein, 260 aa, Homo sapiens
MNLDSDGMDDIISQESSLDMEGNYKKAQKNERESIRQKLALGSFFDDGPGIYTSCSKSGKPSLSSRLQSGMNLQICFVNDSGSDKDSDADDSKTETSLDTPLSPMSKQSSSYSDRDTTEEESESLDDMDFLTRQKKLQAEAKMALAMAKPMAKMQVEVEKQNRKKSPVADLLPHMPHISECLMKRSLKPTDLRDMTIGQLQVIVNDLHSQIESLNEELVQLLLIRDELHTEQDAMLVDIEDLTRHAESQQKHMAEKMPAK

SEQ ID NO: 8283 - protein, 210 aa, Homo sapiens; identical to SEQ ID NO: 6033

SEQ ID NO: 8284 - protein, 126 aa, Homo sapiens
MNQRSHLGTTYLDTAKGAVETFMKLRARDPASRGDRYMLVTFEEPPYAIKAGWKENHATFMNELKNLQAEGLTTLGQSLRTAFDLLNLNRLVTGIDNYGQGRNPFFLEPAIIITITDGSKLTTTSG

SEQ ID NO: 8285 - protein, 395 aa, Homo sapiens
MANDPLEGFHEVNLASPTSPDLLGVYESGTQEQTTSPSVIYRPHPSALSSVPIQANALDVSELPTQPVYSSPRRLNCAEISSISFHVTDPAPCSTSGVTAGLTKLTTRKDNYNAEREFLQGATITEACDGSDDIFGLSTDSLSRLRSPSVLEVREKGYERLKEELAKAQRELKLKDEECERLSKVRDQLGQELEELTASLFEEAHKMVREANIKQATAEKQLKEAQGKIDVLQAEVAALKTLVLSSSPTSPTQEPLPGGKTPFKKGHTRNKSTSSAMSGSHQDLSVIQPIVKDCKEADLSLYNEFRLWKDEPTMDRTCPFLDKIYQEDIFPCLTFSKSELASAVLEAVENNTLSIEPVGLQPIRFVKASAVECGGPKSLLYVTFLHTFDTFSRDS

SEQ ID NO: 8286 - protein, 261 aa, Homo sapiens; identical to SEQ ID NO: 5727

SEQ ID NO: 8287 - protein, 427 aa, Homo sapiens
MVCWQDLEESLRMKLSLTKVVNGCRLGKIKNLGKTGDHTMDIPGCLLYTKTGSAPHLTHHTLHNIHGVPAMAQLTLSSLAEHHEVLTEYKEGVGKFIGMPESLLYCSLHDPVSPCPAGYVTNKSVSVWSVAGRVEMTVSKFMAIQKALQPDWFQCLSDGEVSCKEATSIKRVRKSVDRSLLFLDNCLRLQEESEVLQKSVIIGVIEGGDVMEERLRSARETAKRPVGGFLLDGFQGNPTTLEARLRLLSSVTAELPEDKPRLISGVSRPDEVLECIERGVDLFESFFPYQVTERGCALTFSFDYQPNPEETLLQQNGTQEEIKCMDQIKKIETTGCNQEITSFEINLKEKKYQEDFNPLVRGCSCYCCKNHTRAYIHHLLVTNELLAGVLLMMHNFEHYFGFFHYIREALKSDKLAQLKELIHRQAS

SEQ ID NO: 8288 - protein, 130 aa, Homo sapiens
MNQRSHLGTTYLDTAKGAVETFMKLRARDPASRGDRYMLVTFEEPPYAIKAGWKENHATFMNELKNLQAEGLTTLGQSLRTAFDLLNLNRLVTGIDNYGQGRNPFFLEPAIIITITDGSKLTTTSGVQDE

SEQ ID NO: 8289 - protein, 138 aa, Homo sapiens
MNPASAPPPLPPPGQQVIHVTQDLDTDLEALFNSVMNPKPSSWRKKILPESFFKEPDSGSHSRQSSTDSSGGHPGPRLAGGAQHVRSHSSPASLQLGTGAGAAGSPAQQHAHLRQQSYDVTDELPLPPGWEMTFTATG

SEQ ID NO: 8290 - protein, 563 aa, Homo sapiens
MRLEELKRLQNPLEQVNDGKYSFENHQLAMDAENNIEKYPLNLQPLESKVKIIQRAWREYLQRQEPLGKRSPSPPSVSSEKLSSSVSMNTFSDSSTPDYREDGMDLGSDAGSSSSSSRASSQSNSTKVTPCSECKSSSSPGGSLDLVSALEDYEEPFPVYQKKVIDEWAPEEDGEEEEEEDERDQRGYRDDRSPAREPGDVSARTRSGGGGGRSATTAMPPPVPNGNLHQHDPQDLRHNGNVVVAGRPSCSRGPRRAIQKPQPAGGRRSGRGPAAGGLCLQPPDGGTCVPEEPPVPPMDWEALEKHLAGLQFREQEVRNQGQARTNSTSAQKNERESIRQKLALGSFFDDGPGIYTSCSKSGKPSLSSRLQSGMNLQICFVNDSGSDKDSDADDSKTETSLDTPLSPMSKQSSSYSDRDTTEEESESLDDMDFLTRQKKLQAEAKMALAMAKPMAKMQVEVEKQNRKKSPVADLLPHMPHISECLMKRSLKPTDLRDMTIGQLQVIVNDLHSQIESLNEELVQLLLIRDELHTEQDAMLVDIEDLTRHAESQQKHMAEKMPAK

SEQ ID NO: 8291 - protein, 75 aa, Homo sapiens
MPEDQVGKLEATENTISAMAAAAAEQQQFYLLLGNLLSPDNVVRKQAEETYENIPGQSKITFLLQAIRNTTAAEE

SEQ ID NO: 8292 - protein, 903 aa, Homo sapiens; identical to SEQ ID NO: 5646

SEQ ID NO: 8293 - protein, 173 aa, Homo sapiens
MPRKGTQPSTARRREEGPPPPSPDGASSDAEPEPPSGRTESPATAAETASEELDNRSLEEILNSIPPPPPPAMTNEAGAPRLMITHIVNQNFKSYAGEKILGPFHKRFSCIIGPNGSGKSNVIDSMLFVFGYRAQKIRSKKLSVLIHNSDEHKDIQSCTVEVHFQKIIDKEGD

SEQ ID NO: 8294 - protein, 753 aa, Homo sapiens
MYSPIIYQALCEHVQTQMSLMNDLTSKNIPNGIPAVPCHAPSHSESQATPHSSYGLCTSTPVWSLQRPPCPPKVHSEVQTDGNSQFASQGKTVSATCTDVLRNSFNTSPGVPCSLPKTDISAIPTLQQLGLVNGILPQQGIHKETDLLKCIQTYLSLFRSHGKETHLDSQTHRSPTQSQPAFLATNEEKCAREQIREATSERKDLNIHVRDTKTVKDVQKAKNVNKTAEKVRIIKYLLGELKALVAEQEDSEIQRLITEMEACISVLPTVSGNTDIQVEIALAMQPLRSENAQLRRQLRILNQQLREQQKTQKPSGAVDCNLELFSLQSLNMSLQNQLEESLKSQELLQSKNEELLKVIENQKDENKKFSSIFKDKDQTILENKQQYDIEITRIKIELEEALVNVKSSQFKLETAEKENQILGITLRQRDAEVTRLRELTRTLQTSMAKLLSDLSVDSARCKPGNNLTKSLLNIHDKQLQHDPAPAHTSIMSYLNKLETNYSFTHSEPLSTIKNEETIEPDKTYENVLSSRGPQNSNTRGMEEASAPGIISALSKQDSDEGSETMALIEDEHNLDNTIYIPFARSTPEKKSPLSKRLSPQPQIRAATTQLVSNSGLAVSGKENKLCTPVICSSSTKEAEDAPEKLSRASDMKDTQLLKKIKEAIGKIPAATKEPEEQTACHGPSGCLSNSLQVKGNTVCDGSVFTSDLMSDWSISSFSTFTSRDEQDFRNGLAALDANIARLQKSLRTGLLEK

SEQ ID NO: 8295 - protein, 72 aa, Homo sapiens; identical to SEQ ID NO: 8264

SEQ ID NO: 8296 - protein, 195 aa, Homo sapiens
MWHMTRNWPLVGKTSLITRFMYDSFDNTYQATIGIDFLSKTMYLEDRTVRLQLWDTAGQERFRSLIPSYIRDSTVAVVVYDITNLNSFQQTSKWIDDVRTERGSDVIIMLVGNKTDLADKRQITIEEGEQRAKELSVMFIETSAKTGYNVKQLFRRVASALPGMENVQEKSKEGMIDIKLDKPQEPPASEGGCSC

SEQ ID NO: 8297 - protein, 348 aa, Homo sapiens; identical to SEQ ID NO: 6454

SEQ ID NO: 8298 - protein, 953 aa, Homo sapiens
MKRGIRRDPFRKRKLGGRAKKVREPTAVNSFYREASLPSVWASLRRREMVRSGARPGQVLSSGRHTGPAKLTNGKKATYLRKIPRFNADSGYSIHSDSESQAETVHGLDGCASLLRDILRNEDSGSETAYLENRSNSRPLESKRYGSKKKRHEKHTIPLVVQKETSSSDNKKQIPNEASARSERDTSDLEQNWSLQDHYRMYSPIIYQALCEHVQTQMSLMNDLTSKNIPNGIPAVPCHAPSHSESQATPHSSYGLCTSTPVWSLQRPPCPPKVHSEVQTDGNSQFASQGKTVSATCTDVLRNSFNTSPGVPCSLPKTDISAIPTLQQLGLVNGILPQQGIHKETDLLKCIQTYLSLFRSHGKETHLDSQTHRSPTQSQPAFLATNEEKCAREQIREATSERKDLNIHVRDTKTVKDVQKAKNVNKTAEKVRIIKYLLGELKALVAEQEDSEIQRLITEMEACISVLPTVSGNTDIQVEIALAMQPLRSENAQLRRQLRILNQQLREQQKTQKPSGAVDCNLELFSLQSLNMSLQNQLEESLKSQELLQSKNEELLKVIENQKDENKKFSSIFKDKDQTILENKQQYDIEITRIKIELEEALVNVKSSQFKLETAEKENQILGITLRQRDAEVTRLRELTRTLQTSMAKLLSDLSVDSARCKPGNNLTKSLLNIHDKQLQHDPAPAHTSIMSYLNKLETNYSFTHSEPLSTIKNEETIEPDKTYENVLSSRGPQNSNTRGMEEASAPGIISALSKQDSDEGSETMALIEDEHNLDNTIYIPFARSTPEKKSPLSKRLSPQPQIRAATTQLVSNSGLAVSGKENKLCTPVICSSSTKEAEDAPEKLSRASDMKDTQLLKKIKEAIGKIPAATKEPEEQTACHGPSGCLSNSLQVKGNTVCDGSVFTSDLMSDWSISSFSTFTSRDEQDFRNGLAALDANIARLQKSLRTGLLEK

SEQ ID NO: 8299 - protein, 560 aa, Homo sapiens; identical to SEQ ID NO: 7400

SEQ ID NO: 8300 - protein, 50 aa, Homo sapiens
MPEDQVGKLEATENTISAMAAAAAEQQQFYLLLGNLLSPDNVVRKQAEVT

SEQ ID NO: 8301 - protein, 95 aa, Homo sapiens
MAIGKRLATLPTKEQKTQRLISELSLLNHKLPARVWLPTAGFDHHVVRVPHTQAVVLNSKDKAPYLIYVEVLECENFDTTSVPARIPENRIRSTR

SEQ ID NO: 8302 - protein, 419 aa, Homo sapiens
MAGSGCAWGAEPPRFLEAFGRLWQVQSRLGSGSSASVYRVRCCGNPGSPPGALKQFLPPGTTGAAASAAEYGFRKERAALEQLQGHRNIVTLYGVFTIHFSPNVPSRCLLLELLDVSVSELLLYSSHQGCSMWMIQHCARDVLEALAFLHHEGYVHADLKPRNILWSAENECFKLIDFGLSFKEGNQDVKYIQTDGYRAPEAELQNCLAQAGLQSDTECTSAVDLWSLGIILLEMFSGMKLKHTVRSQEWKANSSAIIDHIFASKAVVNAAIPAYHLRDLIKSMLHDDPSRRIPAEMALCSPFFSIPFAPHIEDLVMLPTPVLRLLNVLDDDYLENEEEYEDVVEDVKEECQKYGPVVSLLVPKENPGRGQVFVEYANAGDSKAAQKLLTGRMFDGKFVVATFYPLSAYKRGYLYQTLL

SEQ ID NO: 8303 - protein, 423 aa, Homo sapiens
MPRKGTQPSTARRREEGPPPPSPDGASSDAEPEPPSGRTESPATAAETASEELDNRSLEEILNSIPPPPPPAMTNEAGAPRLMITHIVNQNFKSYAGEKILGPFHKRFSCIIGPNGSGKSNVIDSMLFVFGYRAQKIRSKKLSVLIHNSDEHKDIQSCTVEVHFQKIIDKEGDDYEVIPNSNFYVSRTACRDNTSVYHISGKKKTFKDVGNLLRSHGIDLDHNRFLILQGEVEQIAMMKPKGQTEHDEGMLEYLEDIIGCGRLNEPIKVLCRRVEILNEHRGEKLNRVKMVEKEKDALEGEKNIAIEFLTLENEIFRKKNHVCQYYIYELQKRIAEMETQKEKIHEDTKEINEKSNILSNEMKAKNKDVKDTEKKLNKITKFIEENKEKFTQLDLEDVQVREKLKHATSKAKKLEKQLQKDKE

SEQ ID NO: 8304 - protein, 370 aa, Homo sapiens
MEEGVPCPAPAAKLTPPVKKSQDMHDERSKLVNEYACRVLELLGMGHRLFVPRLLATSKEDLLQADFEGALKFFRVQLPKRYRAEENARRLMEQACNIKVPTKKLKKYEKEYQTMRESQLQQEDPMDRYKRENRRLQEASMRLEQENDDLAHELVTSKIALRNDLDQAEDKADVLNKELLLTKQRLVETEEEKRKQEEETAQLKEVFRKQLEKAEYEIKKTTAIIAEYKQICSQLSTRLEKQQAASKEELEVVKGKMMACKHCSDIFSKEGALKLAATGREDQGIETDDEKDSLKKQLREMELELAQTKLQLVEAKCKIQELEHQRGALMNEIQAAKNSWFSKTLNSIKTATGTQPLQPAPVTQPPKEST

SEQ ID NO: 8305 - protein, 753 aa, Homo sapiens; identical to SEQ ID NO: 8294

SEQ ID NO: 8306 - protein, 688 aa, Homo sapiens; identical to SEQ ID NO: 5926

SEQ ID NO: 8307 - protein, 180 aa, Homo sapiens
MPRKGTQPSTARRREEGPPPPSPDGASSDAEPEPPSGRTESPATAAETASEELDNRSLEEILNSIPPPPPPAMTNEAGAPRLMITHIVNQNFKSYAGEKILGPFHKRFSCIIGPNGSGKSNVIDSMLFVFGYRAQKIRSKKLSVLIHNSDEHKDIQSCTVEVHFQKIIDKEGDDYEVIPN

SEQ ID NO: 8308 - protein, 1562 aa, Homo sapiens
MPGEAARAELLLPEADRPGPRTDLSCDAAAATTILGGDRREPCALTPGPSHLALTFLPSKPGARPQPEGASWDAGPGGAPSAWADPGEGGPSPMLLPEGLSSQALSTEAPLPATLEPRIVMGEETCQALLSPRAARTALRDQEGGHASPDPPPELCSQGDLSVPSPPPDPDSFFTPPSTPTKTTYALLPACGPHGDARDSEAELRDELLDSPPASPSGSYITADGDSWASSPSCSLSLLAPAEGLDFPSGWGLSPQGSMVDERELHPAGTPEPPSSESSLSADSSSSWGQEGHFFDLDFLANDPMIPAALLPFQGSLIFQVEAVEVTPLSPEEEEEEAVADPDPGGDLAGEGEEDSTSASFLQSLSDLSITEGMDEAFAFRDDTSAASSDSDSASYAEADDERLYSGEPHAQATLLQDSVQKTEEESGGGAKGLQAQDGTVSWAVEAAPQTSDRGAYLSQRQELISEVTEEGLALGQESTATVTPHTLQVAPGLQVEVATRVTPQAGEEETDSTAGQESAAMAMPQPSQEGISEILGQESVTAEKLPTPQEETSLTLCPDSPQNLKEEGGLDLPSGRKPVAAATIVPRQAKEDLTLPQDSAMTPPLPLQDTDLSSAPKPVAAATIVSQQAEEGLTLPQDSVMTPPLPLQDTELSSAPKPVAAATLVSQQAEEGLTLPQDSAMTPPLPLQDTDLSSAPKPVAAATLVSQQAEEGLTLPQDSAMTPPLPLQDTDLSSAPKPVAAATLVSQQAEEGLTLPQDSAMTPPLPLQDTDLSSAPKPVAAATIVSQQAEEGLTLPQDSAMTPPLPLQDTDLSSAPKPVAAATIVSQQAEEGLTLPQDSAMTPPLPLQDTDLSSAPKPVAAATPVSQQAEEGLTLPQDSAMTPPLPLQDTDLSSAPKPVAAATPVSQQAEEGLTLPQDSAMTAPLPLQDTGPTSGPEPLAVATPQTLQAEAGCAPGTEPVATMAQQEVGEALGPRPAPEEKNAALPTVPEPAALDQVQQDDPQPAAEAGTPWAAQEDADSTLGMEALSLPEPASGAGEEIAEALSRPGREACLEARAHTGDGAKPDSPQKETLEVENQQEGGLKPLAQEHGPRSALGGAREVPDAPPAACPEVSQARLLSPAREERGLSGKSTPEPTLPSAVATEASLDSCPESSVGAVSSLDRGCPDAPAPTSAPTSQQPEPVLGLGSVEQPHEVPSVLGTPLLQPPENLAKGQPSTPVDRPLGPDPSAPGTLAGAALPPLEPPAPCLCQDPQEDSVEDEEPPGSLGLPPPQAGVQPAAAAVSGTTQPLGTGPRVSLSPHSPLLSPKVASMDAKDLALQILPPCQVPPPSGPQSPAGPQGLSAPEQQEDEDSLEEDSPRALGSGQHSDSHGESSAELDEQDILAPQTVQCPAQAPAGGSEETIAKAKQSRSEKKARKAMSKLGLRQIQGVTRITIQKSKNILFVIAKPDVFKSPASDTYVVFGEAKIEDLSQQVHKAAAEKFKVPSEPSALVPESAPRPRVRLECKEEEEEEEEEVDEAGLELRDIELVMAQANVSRAKAVRALRDNHSDIVNAIMELTM

SEQ ID NO: 8309 - protein, 1097 aa, Homo sapiens; identical to SEQ ID NO: 5938

SEQ ID NO: 8310 - protein, 336 aa, Homo sapiens
MKATAMTSAWLAQGGAHVTINARAEEDVEPECIMEKVAKASGANYSFHKESGRFQDVGPQAPVGSVYQKTNAVSEIKRVGKDSFWAKAEKEEENRRLEEKRRAEEAQRQLEQERRERELREAARREQRYQEQGGEASPQSRTWEQQQEVVSRNRNEQESAVHPREIFKQKERAMSTTSISSPQPGKLRSPFLQKQLTQPETHFGREPAAAISRPRADLPAEEPAPSTPPCLVQAEEEAVYEEPPEQETFYEQPPLVQQQGAGSEHIDHHIQGQGLSGQGLCARALYDYQAADDTEISFDPENLITGIEVIDEGWWRGYGPDGHFGMFPANYVELIE

SEQ ID NO: 8311 - protein, 25 aa, Homo sapiens
MWMHVAKVHPKGGEMVGAIRNAAFL

SEQ ID NO: 8312 - protein, 103 aa, Homo sapiens; identical to SEQ ID NO: 8224

SEQ ID NO: 8313 - protein, 1366 aa, Homo sapiens
MADTDLFMECEEEELEPWQKISDVIEDSVVEDYNSVDKTTTAGNPLVQQGGQPLILTQNPAPGLGTMVTQPVLRPVQVMQNANHVTSSPVASQPIFITTQGFPVRNVRPVQNAMNQVGIVLNVQQGQTVRPITLVPAPGTQFVKPTVGVPQVFSQMTPVRPGSTMPVRPTTNTFTTVIPATLTIRSTVPQSQSQQTKSTPSTSTTPTATQPTSLGQLAVQSPGQSNQTTNPKLAPSFPSPPAVSIASFVTVKRPGVTGENSNEVAKLVNTLNTIPSLGQSPGPVVVSNNSSAHGSQRTSGPESSMKVTSSIPVFDLQDGGRKICPRCNAQFRVTEALRGHMCYCCPEMVEYQKKGKSLDSEPSVPSAAKPPSPEKTAPVASTPSSTPIPALSPPTKVPEPNENVGDAVQTKLIMLVDDFYYGRDGGKVAQLTNFPKVATSFRCPHCTKRLKNNIRFMNHMKHHVELDQQNGEVDGHTICQHCYRQFSTPFQLQCHLENVHSPYESTTKCKICEWAFESEPLFLQHMKDTHKPGEMPYVCQPYFPSYVTQVCQYRSSLYSEVDVHFRMIHEDTRHLLCPYCLKVFKNGNAFQQHYMRHQKRNVYHCNKCRLQFLFAKDKIEHKLQHHKTFRKPKQLEGLKPGTKVTIRASRGQPRTVPVSSNDTPPSALQEAAPLTSSMDPLPVFLYPPVQRSIQKRAVRKMSVMGRQTCLECSFEIPDFPNHFPTYVHCSLCRYSTCCSRAYANHMINNHVPRKSPKYLALFKNSVSGIKLACTSCTFVTSVGDAMAKHLVFNPSHRSSSILPRGLTWIAHSRHGQTRDRVHDRNVKNMYPPPSFPTNKAATVKSAGATPAEPEELLTPLAPALPSPASTATPPPTPTHPQALALPPLATEGAECLNVDDQDEGSPVTQEPELASGGGGSGGVGKKEQLSVKKLRVVLFALCCNTEQAAEHFRNPQRRIRRWLRRFQASQGENLEGKYLSFEAEEKLAEWVLTQREQQLPVNEETLFQKATKIGRSLEGGFKISYEWAVRFMLRHHLTPHARRAVAHTLPKDVAENAGLFIDFVQRQIHNQDLPLSMIVAIDEISLFLDTEVLSSDDRKENALQTVGTGEPWCDVVLAILADGTVLPTLVFYRGQMDQPANMPDSILLEAKESGYSDDEIMELWSTRVWQKHTACQRSKGMLVMDCHRTHLSEEVLAMLSASSTLPAVVPAGCSSKIQPLDVCIKRTVKNFLHKKWKEQAREMADTACDSDVLLQLVLVWLGEVLGVIGDCPELVQRSFLVASVLPGPDGNINSPTRNADMQEELIASLEEQLKLSGEHSESSTPRPRSSPEETIEPESLHQLFEGESETESFYGFEEADLDLMEI

SEQ ID NO: 8314 - protein, 187 aa, Homo sapiens
MDISKGLPGMQGGLHIWISENRKMVPVPEGAYGNFFEEHCYVILHVPQSPKATQGASSDLHYWVGKQAGAEAQGAAEAFQQRLQDELGGQTVLHREAQGHESDCFCSYFRPGIIYRKGGLASDLKHVETNLFNIQRLLHIKGRKHVSATEVELSWNSFNKGDIFLLDLGKMMIQWNGPKTSISEKAR

SEQ ID NO: 8315 - protein, 442 aa, Homo sapiens
MPLENLEEEGLPKNPDLRIAQLRFLLSLPEHRGDAAVRDELMAAVRDNNFWNRIRQEQTEDCPPSSPSRGWHCQDWPSRKPPTSIRLCFAKPIIKRHRMPSYMAPYYEALCKSLDWQIDVDLLNKMKKANEDELKRLDEELEDAEKNLGESEIRDAMMAKAEYLCRIGDKEGALTAFRKTYDKTVALGHRLDIVFYLLRIGLFYMDNDLITRNTEKAKSLIEEGGDWDRRNRLKVYQGLYCVAIRDFKQAAELFLDTVSTFTSYELMDYKTFVTYTVYVSMIALERPDLREKVIKGAEILEVLHSLPAVRQYLFSLYECRYSVFFQSLAVVEQEMKKDWLFAPHYRYYVREMRIHAYSQLLESYRSLTLGYMAEAFGVGVEFIDQELSRFIAAGRLHCKIDKVNEIVETNRPDSKNWQYQETIKKGDLLLNRVQKLSRVINM

SEQ ID NO: 8316 - protein, 110 aa, Homo sapiens
MLCWGNASFGQLGLGGIDEEIVLEPRKSDFFINKRVRDVGCGLRHTVFVLDDGTVYTCGCNDLGQLGHEKSRKKPEFRSCFPGRSAMAPSRLTATSASQVQAILLPQPPE

SEQ ID NO: 8317 - protein, 309 aa, Homo sapiens
MVCWQSVSVWSVAGRVEMTVSKFMAIQKALQPDWFQCLSDGEVSCKEATSIKRVRKSVDRSLLFLDNCLRLQEESEVLQKSVIIGVIEGGDVMEERLRSARETAKRPVGGFLLDGFQGNPTTLEARLRLLSSVTAELPEDKPRLISGVSRPDEVLECIERGVDLFESFFPYQVTERGCALTFSFDYQPNPEETLLQQNGTQEEIKCMDQIKKIETTGCNQEITSFEINLKEKKYQEDFNPLVRGCSCYCCKNHTRAYIHHLLVTNELLAGVLLMMHNFEHYFGFFHYIREALKSDKLAQLKELIHRQAS

SEQ ID NO: 8318 - protein, 127 aa, Homo sapiens
MVLILGRRLNREDLGVRDSPATKRKVFEMDPKSLTGHEFFDFSSGSSHAENILQIFNEFRDSRLFTDVIICVEGKEFPCHRAVLSACSSYFRAMFCNDHRESREMLVEINGILAEAMECFLQYVYTG

SEQ ID NO: 8319 - protein, 526 aa, Homo sapiens; identical to SEQ ID NO: 7502

SEQ ID NO: 8320 - protein, 64 aa, Homo sapiens
MPEDQVGKLEATENTISAMAAAAAEQQQFYLLLGNLLSPDNVVRKQAEETYENIPGQSKITFLL

SEQ ID NO: 8321 - protein, 246 aa, Homo sapiens; identical to SEQ ID NO: 5244

SEQ ID NO: 8322 - protein, 431 aa, Homo sapiens
MAANLSRNGPALQEAYVRVVTEKSPTDWALFTYEGNSNDIRVAGTGEGGLEEMVEELNSGKVMYAFCRVKDPNSGLPKFVLINWTGEGVNDVRKGACASHVSTMASFLKGAHVTINARAEEDVEPECIMEKVAKASGANYSFHKESGRFQDVGPQAPVGSVYQKTNAVSEIKRVGKDSFWAKAEKEEENRRLEEKRRAEEAQRQLEQERRERELREAARREQRYQEQGGEASPQSRTWEQQQEVVSRNRNEQESAVHPREIFKQKERAMSTTSISSPQPGKLRSPFLQKQLTQPETHFGREPAAAISRPRADLPAEEPAPSTPPCLVQAEEEAVYEEPPEQETFYEQPPLVQQQGAGSEHIDHHIQGQGLSGQGLCARALYDYQAADDTEISFDPENLITGIEVIDEGWWRGYGPDGHFGMFPANYVELIE

SEQ ID NO: 8323 - protein, 617 aa, Homo sapiens
MIEKMQGSRMDEQRCSFPPPLKTEEDYIPYPSVHEVLGREGPFPLILLPQFGGYWIEGTNHEITSIPETEPLQSPTTKVKLECNPTARIYRKHFLGKEHFNYYSLDAALGHLVFSLKYDVIGDQEHLRLLLRTKCRTYHDVIPISCLTEFPNVVQMAKLVCEDVNVDRFYPVLYPKASRLIVTFDEHVISNNFKFGVIYQKLGQTSEEELFSTNEESPAFVEFLEFLGQKVKLQDFKGFRGGLDVTHGQTGTESVYCNFRNKEIMFHVSTKLPYTEGDAQQLQRKRHIGNDIVAVVFQDENTPFVPDMIASNFLHAYVVVQAEGGGPDGPLYKVSVTARDDVPFFGPPLPDPAVFRKGPEFQEFLLTKLINAEYACYKAEKFAKLEERTRAALLETLYEELHIHSQSMMGLGGDEDKMENGSGGGGFFESFKRVIRSRSQSMDAMGLSNKKPNTVSTSHSGSFAPNNPDLAKAAGISLLIPGKSASRFGRRGSAIGIGTVEEVVVRGAAGSGGCLHALFSARSQDGGHIGDVAPLPPGQAPGRAGWSGGSSDGTQHLLWGLVPVPEPVPLTRGFWPCLGPWDPGPVPARIRYPKALHPAARPPISPVCMERHPSPLP

SEQ ID NO: 8324 - protein, 407 aa, Homo sapiens
MGNTSFNEVMEAQLPSHGGPKPSAESDMGTRRDYIMAKYVEHRFARRCTPEPQRLWTAICNRDLLSVLEAFANGQDFGQPLPGPDAQAPEELVLHLAVKVANQASLPLVDFIIQNGGHLDAKAADGNTALHYAALYNQPDCLKLLLKGRALVGTVNEAGETALDIARKKHHKECEELLEQAQAGTFAFPLHVDYSWVISTEPGSDSEEDEEEKRCLLKLPAQAHWASGRLDISNKTYETVASLGAATPQGESEDCPPPLPVKNSSRTLVQGCARHASGDRSEVSSLSSEAPETPESLGSPASSSSLMSPLEPGDPSQAPPNSEEGLREPPGTSRPSLTSGTTPSEMYLPVRFSSESTRSYRRGARSPEDGPSARQPLPRRNVPVGITEGDGSRTGSLPASSVQLLQD

SEQ ID NO: 8325 - protein, 270 aa, Homo sapiens
MAMEMRLPVARKPLSERLGRDTKKHLVVPGDTITTDTGFMRGHGTYMGEEKLIASVAGSVERVNKLICVKALKTRYIGEVGDIVVGRITEVQQKRWKVETNSRLDSVLLLSSMNLPGGELRRRSAEDELAMRGFLQEGDLISLGQGVLVQVSPSLVKRQKTHFHDLPCGASVILGNNGFIWIYPTPEHKEEEAGGFIANLEPVSLADREVISRLRNCIISLVTQRMMLYDTSILYCYEASLPHQIKDILKPEIMEEIVMETRQRLLEQEG

SEQ ID NO: 8326 - protein, 98 aa, Homo sapiens
MPEDQVGKLEATENTISAMAAAAAEQQQFYLLLGNLLSPDNVVRKQAEETYENIPGQSKITFLLQAIRNTTAAEEARQMAAVLLRRLLSSAFDEVYPA

SEQ ID NO: 8327 - protein, 101 aa, Homo sapiens
MDEVEQDQHEARLKELFDSFDTTGTGSLGQEELTDLCHMLSLEEVAPVLQQTLLQDNLLGRVHFDQFKEALILILSRTLSNEEHFQEPDCSLEAQPKYVRG

SEQ ID NO: 8328 - protein, 354 aa, Homo sapiens
MAHSPVAVQVPGMQNNIADPEELFTKLERIGKGSFGEVFKGIDNRTQQVVAIKIIDLEEAEDEIEDIQQEITVLSQCDSSYVTKYYGSYLKGSKLWIIMEYLGGGSALDLLRAGPFDEFQIATMLKEILKGLDYLHSEKKIHRDIKAANVLLSEQGDVKLADFGVAGQLTDTQIKRNTFVGTPFWMAPEVIQQSAYDSKRPTAKELLKHKFIVKNSKKTSYLTELIDRFKRWKAEGHSDDESDSEGSDSESTSRENNTHPEWSFTTVRKKPDPKKVQNGAEQDLVQTLSCLSMIITPAFAELKQQDENNASRNQAIEELEKSIAVAEAACPGITDKMVKKLIEKFQKCSADESP

SEQ ID NO: 8329 - protein, 173 aa, Homo sapiens; identical to SEQ ID NO: 8293

SEQ ID NO: 8330 - protein, 266 aa, Homo sapiens
  MOD_RES (1)..(1): Any amino acid
XPRAAARVRAAGEALERRRRWLGRLSPSAPRPRRARPSLRRASAWVRDRVAGRPGALPGFQASGVAGEAQKAPGHPAAPAPAASCLTEADGRVFLHAFRLALIQLQISSIKSDNVTRACSFIREAATQGAKIVSLPECFNSPYGAKYFPEYAEKIPGESTQKLSEVAKECSIYLIGGSIPEEDAGKLYNTCAVFGPDGTLLAKYRKIHLFDIDVPGKITFQESKTLSPGDSFSTFDTPYCRVGLGICYDMRFAELAQIYAQRGEAV

SEQ ID NO: 8331 - protein, 71 aa, Homo sapiens
MDSLPDEFFVRHPAVEDQRKEETENKLEKSSGQLNKQENDIPTDLVPVNLLLEVKKLLNAINTLPKGVVPH

SEQ ID NO: 8332 - protein, 709 aa, Homo sapiens
MSVESEQLTGVPLDDSAITPMCEVTGGRSYSVCSPRMLNQCLESLVQKVQSGVVINFEKAGPDPSPVEDGQPDISRPFGSQPWHSCHKLIYVRPNPKTGVPIGHWPVPESFWPDQNSPTLPPRTSHPVVKFSCTDCEPMVIDKLPFDKYELEPSPLTQFILERKSPQTCWQVYVSNSAKYSELGHPFGYLKASTALNCVNLFVMPYNYPVLLPLLDDLFKVHKAKPTLKWRQSFESYLKTMPPYYLGPLKKAVRMMGAPNLIADSMEYGLSYSVISYLKKLSQQAKIESDRVIGSVGKKVVQETGIKVRSRSHGLSMAYRKDFQQLLQGISEDVPHRLLDLNMKEYTGFQVALLNKDLKPQTFRNAYDIPRRNLLDHLTRMRSNLLKSTRRFLKGQDEDQVHSVPIAQMGNYQEYLKQVPSPLRELDPDQPRRLHTFGNPFKLDKKGMMIDEADEFVAGPQNKHKRPGEPNMQGIPKRRRCMSPLLRGRQQNPVVNNHIGGKGPPAPTTQAQPDLIKPLPLHKISETTNDSIIHDVVENHVADQLSSDITPNAMDTEFSASSPASLLERPTNHMEALGHDHLGTNDLTVGGFLENHEEPRDKEQCAEENIPASSLNKGKKLMHCRSHEEVNTELKAQIMKEIRKPGRKYERIFTLLKHVQGSLQTRLIFLQNVIKEASRFKKRMLIEQLENFLDEIHRRANQINHINSN

SEQ ID NO: 8333 - protein, 128 aa, Homo sapiens
MASSNTVLMRLVASAYSIAQKAGMIVRRVIAEGDLGIVEKTCATDLQTKADRLAQMSICSSLARKFPKLTIIGEEDLPSEEVDQELIEDSQWEEILKQPCPSQYSAIKEEDLVVWVDPLDGTKEYTEG

SEQ ID NO: 8334 - protein, 78 aa, Homo sapiens; identical to SEQ ID NO: 5107

SEQ ID NO: 8335 - protein, 56 aa, Homo sapiens
MVMEKPSPLLVGREFVRQYYTLLNKAPEYLHRFYGRNSSYVHGGVDASGKPQEAVY

SEQ ID NO: 8336 - protein, 118 aa, Homo sapiens
MKIFVGNVDGADTTPEELAALFAPYGTVMSCAVMKQFAFVHMRENAGALRAIEALHGHELRPGRALVVEMSRPRPLNTWKIFVGNVSAACTSQELRSLFERRGRVIECDVVKGGMCVG

SEQ ID NO: 8337 - protein, 145 aa, Homo sapiens
MSSPRDFRAEPVNDYEGNDSEAEDLNFRETLPSSSQENTPRSKVFENKVNSEKVKLSLRNFPHNDYEDVFEEPSESGSDPSMWTARGPFRRDRWSSEDEEAAGPSQALSPLLSVQHHGYSGPNERTTFWHGSNEGAVSLLLRYCA

SEQ ID NO: 8338 - protein, 145 aa, Homo sapiens; identical to SEQ ID NO: 6912

SEQ ID NO: 8339 - protein, 147 aa, Homo sapiens; identical to SEQ ID NO: 5687

SEQ ID NO: 8340 - protein, 99 aa, Homo sapiens
MDESALLDLLECPVCLERLDASAKVLPCQHTFCKRCLLGIVGSRNELRCPECRTLVGSGVEELPSNILLVRLLDGIKQRPWKPGPGGGSGTNCTNALRS

SEQ ID NO: 8341 - protein, 1224 aa, Homo sapiens
MALRPGAGSGGGGAAGAGAGSAGGGGFMFPVAGGIRPPQAGLMPMQQQGFPMVSVMQPNMQGIMGMNYSSQMSQGPIAMQAGIPMGPMPAAGMPYLGQAPFLGMRPPGPQYTPDMQKQFAEEQQKRFEQQQKLLEEERKRRQFEEQKQKLRLLSSVKPKTGEKSRDDALEAIKGNLDGFSRDAKMHPTPASHPKKPGVGVFPSQDPAQPRMPPWIYNESLVPDAYKKILETTMTPTGIDTAKLYPILMSSGLPRETLGQIWALANRTTPGKLTKEELYTVLAMIAVTQRGVPAMSPDALNQFPAAPIPTLSGFSMTLPTPVSQPTVIPSGPAGSMPLSLGQPVMGINLVGPVGGAAAQASSGFIPTYPANQVVKPEEDDFQDFQDASKSGSLDDSFSDFQELPASSKTSNSQHGNSAPSLLMPLPGTKALPSMDKYAVFKGIAADKSSENTVPPGDPGDKYSAFRELEQTAENKPLGESFAEFRSAGTDDGFTDFKTADSVSPLEPPTKDKTFPPSFPSGTIQQKQQTQVKNPLNLADLDMFSSVNCSSEKPLSFSAVFSTSKSVSTPQSTGSAATMTALAATKTSSLADDFGEFSLFGEYSGLAPVGEQDDFADFMAFSNSSISSEQKPDDKYDALKEEASPVPLTSNVGSTVKGGQNSTAASTKYDVFRQLSLEGSGLGVEDLKDNTPSGKSDDDFADFHSSKFSSINSDKSLGEKAVAFRHTKEDSASVKSLDLPSIGGSSVGKEDSEDALSVQFDMKLADVGGDLKHVMSDSSLDLPTVSGQHPPAADIEDLKYAAFGSYSSNFAVSTLTSYDWSDRDDATQGRKLSPFVLSAGSGSPSATSILQKKETSFGSSENITMTSLSKVTTFVSEDALPETTFPALASFKDTIPQTSEQKEYENRDYKDFTKQDLPTAERSQEATCPSPASSGASQETPNECSDDFGEFQSEKPKISKFDFLVATSQSKMKSSEEMIKSELATFDLSVQGSHKRSLSLGDKEISRSSPSPALEQPFRDRSNTLNEKPALPVIRDKYKDLTGEVEENERYAYEWQRCLGSALNVIKKANDTLNGISSSSVCTEVIQSAQGMEYLLGVVEVYRVTKRVELGIKATAVCSEKLQQLLKDIDKVWNNLIGFMSLATLTPDENSLDFSSCMLRPGIKNAQELACGVCLLNVDSRSRAFNSETDSFKLAYGGHQYHASCANFWINCVEPKPPGLVLPDLL

SEQ ID NO: 8342 - protein, 117 aa, Homo sapiens [sequence omitted]

SEQ ID NO: 8343 - protein, 206 aa, Homo sapiens; identical to SEQ ID NO: 6911

SEQ ID NO: 8344 - protein, 193 aa, Homo sapiens
MEETIKDPPTSAVLLDHCHFSQVIFNSVEKFYIPGGDVTCHYTFTQHFIPRRKDWIGIFRVGWKTTREYYTFMWVTLPIDLNNKSAKQQEVQFKAYYLPKDDEYYQFCYVDEDGVVRGASIPFQFRPENEEDILVVTTQGEVEEIEQHNKELCKENQELKDSCISLQKQNSDMQAELQKKQEELETLQSINKK

SEQ ID NO: 8345 - protein, 51 aa, Homo sapiens
MDFFSSHLLADSSSPATNSSHTDAHEILVSDFLVSDENLQKMENVLDLWSS

SEQ ID NO: 8346 - protein, 170 aa, Homo sapiens
MSSNECFKCGRSGHWARECPTGGGRGRGMRSRGRGFQFVSSSLPDICYRCGESGHLAKDCDLQEDACYNCGRGGHIAKDCKEPKREREQCCYNCGKPGHLARDCDHADEQKCYSCGEFGHIQKDCTKVKCYRCGETGHVAINCSKTSEVNCYRCGESGHLARECTIEATA

SEQ ID NO: 8347 - protein, 132 aa, Homo sapiens
MNQEDLDPDSTTDVGDVTNTEEELIRECEEMWKDMEECQNKLSLIGTETLTDSNAQLSLLIMQVKCLTAELSQWQKKTPETIPLTEDVLITLGKEEFQKLRQDLEMVLSTKESKNEKLKEDLEREQRWLDEQ

SEQ ID NO: 8348 - protein, 364 aa, Homo sapiens
MVKLFIGNLPREATEQEIRSLFEQYGKVLECDIIKNYGFVHIEDKTAAEDAIRNLHHYKLHGVNINVEASKNKSKTSTKLHVGNISPTCTNKELRAKFEEYGPVIECDIVKDYAFVHMERAEDAVEAIRGLDNTEFQGKRMHVQLSTSRLRTAPGMGDQSGCYRCGKEGHWSKECPIDRSGRVADLTEQYNEQYGAVRTPYTMSYGDSLYYNNAYGALDAYYKRCRAARSYEAVAAAAASVYNYAEQTLSQLPQVQNTAMASHLTSTSLDPYDRHLLPTSGAAATAAAAAAAAAAVTAASTSYYGRDRSPLRRATAPVPTVGEGYGYGHESELSQASAAARNSLYDMARYEREQYADRARYSAF

SEQ ID NO: 8349 - protein, 139 aa, Homo sapiens
MATGDLKRSLRNLEQVLRLLNYPEEVDCVGLIKGDPAASLPIISYSFTSYSPYVTELIMESNVELIAKNDLRFIDAVYKLLRDQFNYKPILTKKQFIQCGFAEWKIQIVCDILNCVMKKHKELSSLQKIPSQQRKKISS

SEQ ID NO: 8350 - protein, 149 aa, Homo sapiens
MANIAVQRIKREFKEVLKSEEVRFITKIWHPNISSVTGAICLDILKDQWAAAMTLRTVLLSLQALLAAAEPDDPQDAVVANQYKQNPEMFKQTARLWAHVYAGAPVSSPEYTKKIENLCAMGFDRNAVIVALSSKSWDVETATELLLSN

SEQ ID NO: 8351 - protein, 198 aa, Homo sapiens
MVMEKPSPLLVGREFVRQYYTLLNKAPEYLHRFYGRNSSYVHGGVDASGKPQEAVYGQNDIHHKVLSLNFSECHTKIRHVDAHATLSDGVVVQVMGLLSNSGQPERKFMQTFVLAPEGSVPNKFYVHNDMFRYEDEVFGDSEPELDEESEDEVEEEQEERQPSPEPVQENANSGYYEAHPVTNGIEEPLEESSHEPEP

SEQ ID NO: 8352 - protein, 49 aa, Homo sapiens
MMLGTEGGEGFVVKVRGLPWSCSADEVQRFFSDCKIQNGAQGIRFIYTR

SEQ ID NO: 8353 - protein, 421 aa, Homo sapiens; identical to SEQ ID NO: 7438

SEQ ID NO: 8354 - protein, 390 aa, Homo sapiens; identical to SEQ ID NO: 5166

SEQ ID NO: 8355 - protein, 129 aa, Homo sapiens
MKRGRLPSSSEDSDDNGSLSTTWSQNSRSQHRRSSCSRHEDRKPSEVFRTDLITAMKLHDSYQLNPDEYYVLADPWRQEWEKGVQVPVSPGTIPQPVARVVSEEKSLMFIRPKKYIVSSGSEPPELGYV

SEQ ID NO: 8356 - protein, 162 aa, Homo sapiens
MDFFSSHLLADSSSPATNSSHTDAHEILVSDFLVSDENLQKMENVLDLWSSGLKTNIISELSKWRLNFIDWHRMEMRKEKEKHAAHLKQLCNQINELKELQKTFEISIGRKDEVISSLSHAIGKQKEKIELMRTFFHWRIGHVRARQDVYEGKLADQYYQRT

SEQ ID NO: 8357 - protein, 136 aa, Homo sapiens
MIVNDYEGNDSEAEDLNFRETLPSSSQENTPRSKVFENKVNSEKVKLSLRNFPHNDYEDVFEEPSESGSDPSMWTARGPFRRDRWSSEDEEAAGPSQALSPLLSVQHHGYSGPNERTTFWHGSNEGAVSLLLRYCA

SEQ ID NO: 8358 - protein, 106 aa, Homo sapiens
MASQLQVFSPPSVSSSAFCSAKKLKIEPSGWDVSGQSSNDKYYTHSKTLPATQGQANSSHQVANFNIPAYDQGLLLPAPAVEHIVVTAADSSGSAATSTFQSSQTL

SEQ ID NO: 8359 - protein, 136 aa, Homo sapiens
MKRGRLPSSSEDSDDNGSLSTTWSQNSRSQHRRSSCSRHEDRKPSEVFRTDLITAMKLHDSYQLNPDEYYVLADPWRQEWEKGVQVPVSPGTIPQPVARVVSEEKSLMFIRPKKYIVSSGSEPPELGYVDIRTLAD

SEQ ID NO: 8360 - protein, 131 aa, Homo sapiens
MEDGTPKHIIQMTGFKMEEKEALVKLLLKLDCTFIKSEKYKNCTHLIAERLCKSEKFLAACAAGKWILTKDYIIHSAKSGRWLDETTYEWGYKIEKDSRYSPQMQSAPKRWREELKRTGAPGAFHRWKVVL

SEQ ID NO: 8361 - protein, 555 aa, Homo sapiens; identical to SEQ ID NO: 4960

SEQ ID NO: 8362 - protein, 544 aa, Homo sapiens; identical to SEQ ID NO: 5904

SEQ ID NO: 8363 - protein, 130 aa, Homo sapiens
MGRLDGKVIILTAAAQGIGQAAALAFAREGAKVIATDINESKLQELEKYPGIQTRVLDVTKKKQIDQFANEVERLDVLFNVAGFVHHGTVLDCEEKDWDFSMNLNVRSMYLMIKAFLPKMLAQKSGNIIN

SEQ ID NO: 8364 - protein, 372 aa, Homo sapiens
MQGPAGNASRGLPGGPPSTVASGAGRCESGALMHSFGIFLQGLLGVVAFSTLMLKRFREPKHERRPWRIWFLDTSKQAIGMLFIHFANVYLADLTEEDPCSLYLINFLLDATVGMLLIYVGVRAVSVLVEWQQWESLRFGEYGDPLQCGAWVGQCALYIVIMIFEKSVVFIVLLILQWKKVALLNPIENPDLKLAIVMLIVPFFVNALMFWVVDNFLMRKGKTKAKLEERGANQDSRNGSKVRYRRAASHEESESEILISADDEMEESDVEEDLRRLTPLKPVKKKKHRFGLPAGAQEAPIKKKRPPVKDEDLKGARGNLTKNQEIKSKTYQVMRECEQAGSAAPSVFSRTRTGTETVFEKPKAGPTKSVFG

SEQ ID NO: 8365 - protein, 168 aa, Homo sapiens
MMLGTEGGEGFVVKVRGLPWSCSADEVQRFFSDCKIQNGAQGIRFIYTREGRPSGEAFVELESEDEVKLALKKDRETMGHRYVEVFKSNNVEMDWVLKHTGPNSPDTANDGFVRLRGLPFGCSKEEIVQFFSGLEIVPNGITLPVDFQGRSTGEAFVQFASQEIAEKA

SEQ ID NO: 8366 - protein, 2 aa, Homo sapiens
MA

SEQ ID NO: 8367 - protein, 376 aa, Homo sapiens
MTTVVVHVDSKAELTTLLEQWEKEHGSGQDMVPILTRMSQLIEKETEEYRKGDPDPFDDRHPGRADPECMLGHLLRILFKNDDFMNALVNAYVMTSREPPLNTAACRLLLDIMPGLETAVVFQEKEGIVENLFKWAREADQPLRTYSTGLLGGAMENQDIAANYRDENSQLVAIVLRRLRELQLQEVALRQENKRPSPRKLSSEPLLPLDEEAVDMDYGDMAVDVVDGDQEEASGDMEISFHLDSGHKTSSRVNSTTKPEDGGLKKNKSAKQGDRENFRKAKQKLGFSSSDPDRMFVELSNSSWSEMSPWVIGTNYTLYPMTPAIEQRLILQYLTPLGEYQELLPIFMQLGSRELMMFYIDLKQTNDVLLTFEALK

SEQ ID NO: 8368 - protein, 167 aa, Homo sapiens
MSSNECFKCGRSGHWARECPTGGGRGRGMRSRGRGGFTSDRDICYRCGESGHLAKDCDLQEDACYNCGRGGHIAKDCKEPKREREQCCYNCGKPGHLARDCDHADEQKCYSCGEFGHIQKDCTKVKCYRCGETGHVAINCSKTSEVNCYRCGESGHLARECTIEATA

SEQ ID NO: 8369 - protein, 332 aa, Homo sapiens; identical to SEQ ID NO: 5952

SEQ ID NO: 8370 - protein, 204 aa, Homo sapiens
MSDLRITEAFLYMDYLCFRALCCKGPPPARPEYDLVCIGLTGSGKTSLLSKLCSESPDNVVSTTGFSIKAVPFQNAILNVKELGGADNIRKYWSRYYQGSQGVIFVLDSASSEDDLEAARNELHSALQHPQLCTLPFLILANHQDKPAARSVQEIKKYFELEPLARGKRWILQPCSLDDMDALKDSFSQLINLLEEKDHEAVRM

SEQ ID NO: 8371 - protein, 2104 aa, Homo sapiens
MESQEFIVLYTHQKMKKSKVWQDGILKITHLGNKAILYDDKGACLESLFLKCLEVKPGDDLESDRYLITVEEVKVAGAIGIVKQNVNKEAPELNSRTFISSGRSLGCQPSGLKRKFTGFQGPRQVPKKMVIMESGESAASHEAKKTGPTIFSPFCSMPPLFPTVGKKDVNNILADPENIVTYKNRERNAMDFSSVFSPSFQINPEVLCEENYFCSPVNSGNKLSDSLLTNEPVKRDSLASHYSGVSQNIRSKAQILALLKSESSSSCEELNSEMTEHFPQKQPQGSLKIATKPKYLIQQEECAEMKSTENLYYQHQSENTMRNKSRWAMYLSSQSSPIHSSTVDGNDTERKPKAQEDDVNSNLKDLSLQKIIQFVETYAEERKKYNVDQSVGNNDPSWNQEVKLEIPSFNESSSLQVTCSSAENDGILSESDIQEDNKIPFNQNDKGCIKGSVLIKENAQEVNTCGTLEKEYEQSESSLPELKHLQIESSNNSRISDDITDMISESKMDNESLNSIHESLSNVTQPFLEVTFNLNNFETSDTEEESQESNKISQDSESWVKDILVNDGNSCFQKRSENTNCEEIEGEHLPFLTSVSDKPTVTFPVKETLPSQFCDKTYVGFDMGICKTENTGKEIEEYSDTLSNFESFKWTDAVYGDNKEDANKPIQEVRINYDFALPPNKSKGINMNLHIPHIQNQIAENSNLFSEDAQPQPFILGSDLDKNDEHVLPSTSSSDNSVQLLNTNQNHYECIALDKSNTHISNSLFYPLGKKHLISKDTEAHISEPEDLGKIRSPPPDHVEVETAREGKQYWNPRNSSELSGLVNTISILKSLCEHSTALDSLEILKKKNTVFQQGTQQTYEPDSPPEVRKPFITVVSPKSPHLHKDSQQILKEDEVELSEPLQSVQFSSSGSKEETAFQAVIPKQIERKTCDPKPVEFQGHQVKGSATSGVMVRGHSSQLGCSQFPDSTEYENFMTETPELPSTCMQIDFLQVTSPEENISTLSPVSTFSLNSRDEDFMVEFSETSLKARTLPDDLHFLNLEGMKKSRSLENENLQRLSLLSRTQVPLITLPRTDGPPDLDSHSYMINSNTYESSGSPMLNLCEKSAVLSFSIEPEDQNETFFSEESREVNPGDVSLNNISTQSKWLKYQNTSQCNVATPNRVDKRITDGFFAEAVSGMHFRDTSERQSDAVNESSLDSVHLQMIKGMLYQQRQDFSSQDSVSRKKVLSLNLKQTSKTEEIKNVLGGSTCYNYSVKDLQEISGSELCFPSGQKIKSAYLPQRQIHIPAVFQSPAHYKQTFTSCLIEHLNILLFGLAQNLQKALSKVDISFYTSLKGEKLKNAENNVPSCHHSQPAKLVMVKKEGPNKGRLFYTCDGPKADRCKFFKWLEDVTPGYSTQEGARPGMVLSDIKSIGLYLRSQKIPLYEECQLLVRKGFDFQRKQYGKLKKFTTVNPEFYNEPKTKLYLKLSRKERSSAYSKNDLWVVSKTLDFELDTFIACSAFFGPSSINEIEILPLKGYFPSNWPTNMVVHALLVCNASTELTTLKNIQDYFNPATLPLTQYLLTTSSPTIVSNKRVSKRKFIPPAFTNVSTKFELLSLGATLKLASELIQVHKLNKDQATALIQIAQMMASHESIEEVKELQTHTFPITIIHGVFGAGKSYLLAVVILFFVQLFEKSEAPTIGNARPWKLLISSSTNVAVDRVLLGLLSLGFENFIRVGSVRKIAKPILPYSLHAGSENESEQLKELHALMKEDLTPTERVYVRKSIEQHKLGTNRTLLKQVRVVGVTCAACPFPCMNDLKFPVVVLDECSQITEPASLLPIARFECEKLILVGDPKQLPPTIQGSDAAHENGLEQTLFDRLCLMGHKPILLRTQYRCHPAISAIANDLFYKGALMNGVTEIERSPLLEWLPTLCFYNVKGLEQIERDNSFHNVAEATFTLKLIQSLIASGIAGSMIGVITLYKSQMYKLCHLLSAVDFHHPDIKTVQVSTVDAFQGAEKEIIILSCVRTRQVGFIDSEKRMNVALTRGKRHLLIVGNLACLRKNQLWGRVIQHCEGREDGLQHANQYEPQLNHLLKDYFEKQVEEKQKKKSEKEKSKDKSHS

SEQ ID NO: 8372 - protein, 188 aa, Homo sapiens
MAATAREDGASGQERGQRGCEHYDRGCLLKAPCCDKLYTCRLCHDNNEDHQLDRFKVKEVQCINCEKIQHAQQTCEECSTLFGEYYCDICHLFDKDKKQYHCENCGICRIGPKEDFFHCLKCNLCLAMNLQGRHKCIENVSRQNCPICLEDIHTSRVVAHVLPCGHLLHRTCYEEMLKEYDQVLETAG

SEQ ID NO: 8373 - protein, 112 aa, Homo sapiens
MATGDLKRSLRNLEQVLRLLNYPEEVDCVGLIKGDPAASLPIISYSFTSYSPYVTELIMESNVELIAKNDLRFIDAVYKLLRDQFNYKPILTKKQFIQCGFAEWKIQIVCDI

SEQ ID NO: 8374 - protein, 120 aa, Homo sapiens
MWKVVNLPTDLFNSVMNVGRFTEEIEWLKFLALACSALGVTITKTLKIVCEVLSCDHNGGLPRIPFSTFQFLYTYIAEVDGEICASHVSRMLNYIEQEVIGPDGLITVNDFTQNPRVWLE

SEQ ID NO: 8375 - protein, 829 aa, Homo sapiens
MAKYNTGGNPTEDVSVNSRPFRVTGPNSSSGIQARKNLFNNQGNASPPAGPSNVPKFGSPKPPVAVKPSSEEKPDKEPKPPFLKPTGAGQRFGTPASLTTRDPEAKVGFLKPVGPKPINLPKEDSKPTFPWPPGNKPSLHSVNQDHDLKPLGPKSGPTPPTSENEQKQAFPKLTGVKGKFMSASQDLEPKPLFPKPAFGQKPPLSTENSHEDESPMKNVSSSKGSPAPLGVRSKSGPLKPAREDSENKDHAGEISSLPFPGVVLKPAASRGGPGLSKNGEEKKEDRKIDAAKNTFQSKINQEELASGTPPARFPKAPSKLTVGGPWGQSQEKEKGDKNSATPKQKPLPPLFTLGPPPPKPNRPPNVDLTKFHKTSSGNSTSKGQTSYSTTSLPPPPPSHPASQPPLPASHPSQPPVPSLPPRNIKPPFDLKSPVNEDNQDGVTHSDGAGNLDEEQDSEGETYEDIEASKEREKKREKEEKKRLELEKKEQKEKEKKEQEIKKKFKLTGPIQVIHLAKACCDVKGGKNELSFKQGEQIEIIRITDNPEGKWLGRTARGSYGYIKTTAVEIDYDSLKLKKDSLGAPSRPIEDDQEVYDDVAEQDDISSHSQSGSGGIFPPPPDDDIYDGIEEEDADDGSTLQVQEKSNTWSWGILKMLKGKDDRKKSIREKPKVSDSDNNEGSSFPAPPKQLDMGDEVYDDVDTSDFPVSSAEMSQGTNVGKAKTEEKDLKKLKKQEKEEKDFRKKFKYDGEIRVLYSTKVTTSITSKKWGTRDLQVKPGESLEVIQTTDDTKVLCRNEEGKYGYVLRSYLADNDGEIYDDIADGCIYDND

SEQ ID NO: 8376 - protein, 264 aa, Homo sapiens
MPDSAPAMADKMDMSLDDIIKLNRSQRGGRGGGRGRGRAGSQGGRGGGAQAAARVNRGGGPIRNRPAIARGAAGGGGRNRPAPYSRPKQLPDKWQHDLFDSGFGGGAGVETGGKLLVSNLDFGVSDADIQELFAEFGTLKKAAVHYDRSGRSLGTADVHFERKADALKAMKQYNGVPLDGRPMNIQLVTSQIDAQRRPAQSVNRGGMTRNRGAGGFGGGGGTRRGTRGGARGRGRGAGRNSKQQLSAEELDAQLDAYNARMDTS

SEQ ID NO: 8377 - protein, 103 aa, Homo sapiens
MAKHGADEPSSRSGSPDREGRASEDRSLLHQRLAVRELIDTEVSYLHMLQLCASDIRSRLQQLPQGDLDVLFSNIDDIIKVNSRFLHDLQETASKEEEQVQLV

SEQ ID NO: 8378 - protein, 212 aa, Homo sapiens
MMLGTEGGEGFVVKVRGLPWSCSADEVQRFFSDCKIQNGAQGIRFIYTREGRPSGEAFVELESEDEVKLALKKDRETMGHRYVEVFKSNNVEMDWVLKHTGPNSPDTANDGFVRLRGLPFGCSKEEIVQFFSGLEIVPNGITLPVDFQGRSTGEAFVQFASQEIAEKALKKHKERIGHRYIEIFKSSRAEVRTHYDPPRKLMAMQRPGPYDR

SEQ ID NO: 8379 - protein, 339 aa, Homo sapiens; identical to SEQ ID NO: 5550

SEQ ID NO: 8380 - protein, 1070 aa, Homo sapiens
MAGALRRGRALGSRPSGPTVSSRRSPQCPVAQEGLGARSRPRVAPRSLARCGPSSRLMGWKPSEARGQSQSFQASGLQPRSLKAARRATGRPDRSRAARPTMDPSAHRSRAAPPNMDPDPQAGVQVGMRVVRGVDWKWGQQDGGEGGVGTVVELGRHGSPSTPDRTVVVQWDQGTRTNYRAGYQGAHDLLLYDNAQIGVRHPNIICDCCKKHGLRGMRWKCRVCLDYDLCTQCYMHNKHELAHAFDRYETAHSRPVTLSPRQGLPRIPLRGIFQGAKVVRGPDWEWGSQDGGEGKPGRVVDIRGWDVETGRSVASVTWADGTTNVYRVGHKGKVDLKCVGEAAGGFYYKDHLPRLGKPAELQRRVSADSQPFQHGDKVKCLLDTDVLREMQEGHGGWNPRMAEFIGQTGTVHRITDRGDVRVQFNHETRWTFHPGALTKHHSFWVGDVVRVIGDLDTVKRLQAGHGEWTDDMAPALGRVGKVVKVFGDGNLRVAVAGQRWTFSPSCLVAYRPEEDANLDVAERARENKSSLSVALDKLRAQKSDPEHPGRLVVEVALGNAARALDLLRRRPEQVDTKNQGRTALQVAAYLGQVELIRLLLQARAGVDLPDDEGNTALHYAALGNQPEATRVLLSAGCRADAINSTQSTALHVAVQRGFLEVVRALCERGCDVNLPDAHSDTPLHSAISAGTGASGIVEVLTEVPNIDVTATNSQGFTLLHHASLKGHALAVRKILARARQLVDAKKEDGFTALHLAALNNHREVAQILIREGRCDVNVRNRKLQSPLHLAVQQAHVGLVPLLVDAGCSVNAEDEEGDTALHVALQRHQLLPLVADGAGGDPGPLQLLSRLQASGLPGSAELTVGAAVACFLALEGADVSYTNHRGRSPLDLAAEGRVLKALQGCAQRFRERQAGGGAAPGPRQTLGTPNTVTNLHVGAAPGPEAAECLVCSELALLVLFSPCQHRTVCEECARRMKKCIRCQVVVSKKLRPDGSEVASAAPAPGPPRQLVEELQSRYRQMEERITCPICIDSHIRLVFQCGHGACAPCGSALSACPICRQPIRDRIQIFV

SEQ ID NO: 8381 - protein, 318 aa, Homo sapiens; identical to SEQ ID NO: 8117

SEQ ID NO: 8382 - protein, 347 aa, Homo sapiens; identical to SEQ ID NO: 5517

SEQ ID NO: 8383 - protein, 35 aa, Homo sapiens
MPQTFSGGRGFELDSGSDDMDPGRPRPPRDPDELH

SEQ ID NO: 8384 - protein, 392 aa, Homo sapiens; identical to SEQ ID NO: 6910

SEQ ID NO: 8385 - protein, 683 aa, Homo sapiens; identical to SEQ ID NO: 5305

SEQ ID NO: 8386 - protein, 32 aa, Homo sapiens
MDFFSSHLLADSSSPATNSSHTDAHEILVSDF

SEQ ID NO: 8387 - protein, 285 aa, Homo sapiens; identical to SEQ ID NO: 5885

SEQ ID NO: 8388 - protein, 117 aa, Homo sapiens [sequence omitted]

SEQ ID NO: 8389 - protein, 2537 aa, Homo sapiens
MEDFRGIAEESFPSFLTNSLFGNSGILENVTLSSNLGLPVAVSTLARDRSSTDNRYPDIQASYLVEGRFSVPSGSSPGSQSDAEPRERLQLSFQDDDSISRKKSYVESQRLSNALSKQSALQMETAGPEEEPAGATESLQGQDLFNRASPLEQAQDSPIDFHLQSWMNNKEPKIVVLDAGKHFEDKTLKSDLSHTSLLENEKLILPTSLEDSSDDDIDDEMFYDDHLEAYFEQLAIPGMIYEDLEGPEPPEKGFKLPTNGLRQANENGSLNCKFQSENNSSLISLDSHSSETTHKESEESQVICLPGTSNSIGTGDSRRYTDGMLPFSSGTWGTEKEIENLKGIVPDLNSECASKDVLVKTLRAIDVKLNSDNFHDANANRGGFDLTDPVKQGAECPHQNKTVLHMDGCLDTETPTVSIQENVDVASLKPISDSGINFTDAIWSPTCERRTCECHESIEKNKDKTDLPQSVVYQNEEGRWVTDLAYYTSFNSKQNLNVSLSDEMNEDFRSGSEAFDLIAQDEEEFNKEHQFIQEENIDAHNTSVALGDTSWGATINYSLLRKSRSTSDLDKDDASYLRLSLGEFFAQRSEALGCLGGGNNVKRPSFGYFIRSPEKREPIALIRKSDVSRGNLEKEMAHLNHDLYSGDLNEQSQAQLSEGSITLQVEAVESTSQVDENDVTLTADKGKTEDTFFMSNKPQRYKDKLPDSGDSMLRISTIASAIAEASVNTDPSQLAAMIKALSNKTRDKTFQEDEKQKDYSHVRHFLPNDLEKSNGSNALDMEKYLKKTEVSRYESALENFSRASMSDTWDLSLPKEQTTQDIHPVDLSATSVSVRAPEENTAAIVYVENGESENQESFRTINSSNSVTNRENNSAVVDVKTCSIDNKLQDVGNDEKATSISTPSDSYSSVRNPRITSLCLLKDCEEIRDNRENQRQNECVSEISNSEKHVTFENHRIVSPKNSDLKNTSPEHGGRGSEDEQESFRPSTSPLSHSSPSEISGTSSSGCALESFGSAAQQQQPPCEQELSPLVCSPAGVSRLTYVSEPESSYPTTATDDALEDRKSDITSELSTTIIQGSPAALEERAMEKLREKVPFQNRGKGTLSSIIQNNSDTRKATETTSLSSKPEYVKPDFRWSKDPSSKSGNLLETSEVGWTSNPEELDPIRLALLGKSGLSCQVGSATSHPVSCQEPIDEDQRISPKDKSTAGREFSGQVSHQTTSENQCTPIPSSTVHSSVADMQNMPAAVHALLTQPSLSAAPFAQRYLGTLPSTGSTTLPQCHAGNATVCGFSGGLPYPAVAGEPVQNSVAVGICLGSNIGSGWMGTSSLCNPYSNTLNQNLLSTTKPFPVPSVGTNCGIEPWDSGVTSGLGSVRVPEELKLPHACCVGIASQTLLSVLNPTDRWLQVSIGVLSISVNGEKVDLSTYRCLVFKNKAIIRPHATEEIKVLFIPSSPGVFRCTFSVASWPCSTDAETIVQAEALASTVTLTAIAESPVIEVETEKKDVLDFGDLTYGGWKALPLKLINRTHATVPIRLIINANAVAWRCFTFSKESVRAPVEVAPCADVVTRLAGPSVVNHMMPASYDGQDPEFLMIWVLFHSPKKQISSSDILDSAEEFSAKVDIEVDSPNPTPVLRSVSLRARAGIARIHAPRDLQTMHFLAKVASSRKQHLPLKNAGNIEVYLDIKVPEQGSHFSVDPKNLLLKPGEEHEVIVSFTPKDPEACEERILKIFVQPFGPQYEVVLKGEVISSGSKPLSPGPCLDIPSILSNKQFLAWGGVPLGRTQLQKLALRNNSASTTQHLRLLIRGQDQDCFQLQNTFGSEQRLTSNCEIRIHPKEDIFISVLFAPTRLSCMLARLEIKQLGNRSQPGIKFTIPLSGYGGTSNLILEGVKKLSDSYMVTVNGLVPGKESKIVFSVRNTGSRAAFVKAVGFKDSQKKVLLDPKVLRIFPDKFVLKERTQENVTLIYNPSDRGINNKTATELSTVYLFGGDEISRQQYRRALLHKPEMIKQILPEHSVLQNINFVEAFQDELLVTEVYDLPQRPNDVQLFYGSMCKIILSVIGEFRDCISSREFLQPSSKASLESTSDLGASGKHGGNVSLDVLPVKGPQGSPLLSRAARPPLDQLASEEPWTVLPEHLILVAPSPCDMAKTGRFQIVNNSVRLLRFELCWPAHCLTVTPQHGCVAPESKLQILVSPNSSLSTKQSMFPWSGLIYIHCDDGQKKIVKVQIREDLTQVELLTRLTSKPFGILSPVSEPSVSHLVKPMTKPPSTKVEIRNKSITFPTTEPGETSESCLELENHGTTDVKWHLSSLAPPYVKGVDESGDVFRATYAAFRCSPISGLLESHGIQKVSITFLPRGRGDYAQFWDVECHPLKEPHMKHTLRFQLSGQSIEAENEPENACLSTDSLIKIDHLVKPRRQAVSEASARIPEQLDVTARGVYAPEDVYRFRPTSVGESRTLKVNLRNNSFITHSLKFLSPREPFYVKHSKYSLRAQHYINMPVQFKPKSAGKFEALLVIQTDEGKSIAIRLIGEALGKN

SEQ ID NO: 8390 - protein, 29 aa, Homo sapiens
MLCWGNASFGQLGLGGIDEEIVLEPRKSD

SEQ ID NO: 8391 - protein, 21 aa, Homo sapiens
MAKYNTGGNPTEDVSVNSRPF

SEQ ID NO: 8392 - protein, 86 aa, Homo sapiens
MEADIITNLRCRLKEAEEERLKAAQYGLQLVESQNELQNQLDKCRNEMMTMTESYEQEKYTLQREVELKSRMLESLSCECEAIKQQ

SEQ ID NO: 8393 - protein, 660 aa, Homo sapiens
MVTSLNEDNESVTVEWIENGDTKGKEIDLESIFSLNPDLVPDEEIEPSPETPPPPASSAKVNKIVKNRRTVASIKNDPPSRDNRVVGSARARPSQFPEQSSSAQQNARRKSNCVKEVEKLQEKREKRRLQQQELREKRAQDVDATNPNYEIMCMIRDFRGSLDYRPLTTADPIDEHRICVCVRKRPLNKKETQMKDLDVITIPSKDVVMVHEPKQKVDLTRYLENQTFRFDYAFDDSAPNEMVYRFTARPLVETIFERGMATCFAYGQTGSGKTHTMGGDFSGKNQDCSKGIYALAARDVFLMLKKPNYKKLELQVYATFFEIYSGKVFDLLNRKTKLRVLEDGKQQVQVVGLQEREVKCVEDVLKLIDIGNSCRTSGQTSANAHSSRSHAVFQIILRRKGKLHGKFSLIDLAGNERGADTSSADRQTRLEGAEINKSLLALKECIRALGRNKPHTPFRASKLTQVLRDSFIGENSRTCMIATISPGMASCENTLNTLRYANRVKELTVDPTAAGDVRPIMHHPPNQIDDLETQWGVGSSPQRDDLKLLCEQNEEEVSPQLFTFHEAVSQMVEMEEQVVEDHRAVFQESIRWLEDEKALLEMTEEVDYDVDSYATQLEAILEQKIDILTELRDKVKSFRAALQEEEQASKQINPKRPRAL

SEQ ID NO: 8394 - protein, 68 aa, Homo sapiens
MSSPRDFRAEPVNDYEGNDSEAEDLNFRETLPSSSQENTPRSKVFENKVNSEKVKLSLRNFPHNDYED

SEQ ID NO: 8395 - protein, 97 aa, Homo sapiens
MNGRADFREPNAEVPRPIPHIGPDYIPTEEERRVFAECNDESFWFRSVPLAATSMLITQGLISKGILSSHPKYGSIPKLILACIMGYFAGKLSYVKT

SEQ ID NO: 8396 - protein, 102 aa, Homo sapiens
MVMEKPSPLLVGREFVRQYYTLLNKAPEYLHRFYGRNSSYVHGGVDASGKPQEAVYGQNDIHHKVLSLNFSECHTKIRHVDAHATLSDGVVVQVMGLLSNSG

SEQ ID NO: 8397 - protein, 198 aa, Homo sapiens
MGTTCLHLGTLEQSLVFENKVNSEKVKLSLRNFPHNDYEDVFEEPSESGSDPSMWTARGPFRRDRWSSEDEEAAGPSQALSPLLSDTRKIVSEGELDQLAQIRPLIFNFHEQTAIKDCLKILEEKTAAYDIMQEFMALELKNLPGEFNSGNQPSNREKNRYRDILPFQHHGYSGPNERTTFWHGSNEGAVSLLLRYCA

SEQ ID NO: 8398 - protein, 127 aa, Homo sapiens; identical to SEQ ID NO: 5428

SEQ ID NO: 8399 - protein, 141 aa, Homo sapiens
MVMEKPSPLLVGREFVRQYYTLLNKAPEYLHRFYGRNSSYVHGGVDASGKPQEAVYGQNDIHHKVLSLNFSECHTKIRHVDAHATLSDGVVVQVMGLLSNSGQPERKFMQTFVLAPEGSVPNKFYVHNDMFRYEDEVFGDS

SEQ ID NO: 8400 - protein, 44 aa, Homo sapiens
MLLLDCNPEVDGLKHLLETGASVNAPPDPCKQSPVHLAAGSGLA

SEQ ID NO: 8401 - protein, 132 aa, Homo sapiens
MKRGRLPSSSEDSDDNGSLSTTWSQNSRSQHRRSSCSRHEDRKPSEVFRTDLITAMKLHDSYQLNPDEYYVLADPWRQEWEKGVQVPVSPGTIPQPVARVVSEEKSLMFIRPKKYIVSSGSEPPELGYVDIR

SEQ ID NO: 8402 - protein, 323 aa, Homo sapiens; identical to SEQ ID NO: 7049

SEQ ID NO: 8403 - protein, 103 aa, Homo sapiens
MAQTDKPTCIPPELPKMLKEFAKAAIRAQPQDLIQWGADYFEALSRGETPPVRERSERVALCNWAELTPELLKILHSQVAGRLIIRAEELAQMWKVVNLPTDL

SEQ ID NO: 8404 - protein, 179 aa, Homo sapiens
MEDGTPKHIIQMTGFKMEEKEALVKLLLKLDCTFIKSEKYKNCTHLIAERLCKSEKFLAACAAGKWILTKDYIIHSAKSGRWLDETTYEWGYKIEKDSRYSPQMQSAPKRWREELKRTGAPGAFHRWKVVLLVRTDKRSDSLIRKKFRMMKIPKPILFGLNIAMKKQTKISGKMQDFLK

SEQ ID NO: 8405 - protein, 150 aa, Homo sapiens
MEADIITNLRCRLKEAEEERLKAAQYGLQLVESQNELQNQLDKCRNEMMTMTESYEQEKYTLQREVELKSRMLESLSCECEAIKQQQKMHLEKLEEQLSRSHGQEVNELKTKIEKLKVELDEARLSEKQLKHQVDHQKELLSCKSEELRV

SEQ ID NO: 8406 - protein, 245 aa, Homo sapiens; identical to SEQ ID NO: 4951

SEQ ID NO: 8407 - protein, 59 aa, Homo sapiens
MVMEKPSPLLVGREFVRQYYTLLNKAPEYLHRFYGRNSSYVHGGVDASGKPQEAVYGQN

SEQ ID NO: 8408 - protein, 198 aa, Homo sapiens; identical to SEQ ID NO: 8397

SEQ ID NO: 8409 - protein, 154 aa, Homo sapiens
MASASARGNQDKDAHFPPPSKQSLLFCPKSKLHIHRAEISKIMRECQEESFWKRALPFSLVSMLVTQGLVYQGYLAANSRFGSLPKVALAGLLGFGLGKVSYIGVCQSKFHFFEDQLRGAGFGPQHNRHCLLTCEECKIKHGLSEKGDSQPSAS

SEQ ID NO: 8410 - protein, 839 aa, Homo sapiens; identical to SEQ ID NO: 5164

SEQ ID NO: 8411 - protein, 17 aa, Homo sapiens
MDEGMEISSEGNSLIKA

SEQ ID NO: 8412 - protein, 797 aa, Homo sapiens
MGVSRLMDLLADSREVIRNDGVLLLQALTRSNGAIQKIVAFENAFERLLDIISEEGNSDGGIVVEDCLILLQNLLKNNNSNQNFFKEGSYIQRMKPWFEVGDENSGWSAQKVTNLHLMLQLVRVLVSPTNPPGATSSCQKAMFQCGLLQQLCTILMATGVPADILTETINTVSEVIRGCQVNQDYFASVNAPSNPPRPAIVVLLMSMVNERQPFVLRCAVLYCFQCFLYKNQKGQGEIVSTLLPSTIDATGNSVSAGQLLCGGLFSTDSLSNWCAAVALAHALQENATQKEQLLRVQLATSIGNPPVSLLQQCTNILSQGSKIQTRVGLLMLLCTWLSNCPIAVTHFLHNSANVPFLTGQIAENLGEEEQLVQGLCALLLGISIYFNDNSLESYMKEKLKQLIEKRIGKENFIEKLGFISKHELYSRASQKPQPNFPSPEYMIFDHEFTKLVKELEGVITKAIYKSSEEDKKEEEVKKTLEQHDNIVTHYKNMIREQDLQLEELRQQVSTLKCQNEQLQTAVTQQVSQIQQHKDQYNLLKIQLGKDNQHQGSYSEGAQMNGIQPEEIGRLREEIEELKRNQELLQSQLTEKDSMIENMKSSQTSGTNEQSSAIVSARDSEQVAELKQELATLKSQLNSQSVEITKLQTEKQELLQKTEAFAKSVEVQGETETIIATKTTDVEGRLSALLQETKELKNEIKALSEERTAIKEQLDSSNSTIAILQTEKDKLELEITDSKKEQDDLLVLLADQDQKILSLKNKLKDLGHPVEEEDELESGDQEDEDDESEDPGKDLDHI

SEQ ID NO: 8413 - protein, 146 aa, Homo sapiens
  MOD_RES (1)..(1): Any amino acid
XRHLRATPNTRGSARLLCAEMPKKAGATTKGKSQSKEPERPLPPLGPVAVDPKGCVTIAIHAKPGSKQNAVTDLTAEAVNVAIAAPPSEGEANAELCRYLSKVLELRKSDVVLDKKLRDLLKIVPCKLATRTQILGLLVECSFSRL

SEQ ID NO: 8414 - protein, 80 aa, Homo sapiens
MNGRADFREPNAEVPRPIPHIGPDYIPTEEERRVFAECNDESFWFRSVPLAATSMLITQGLISKGILSSHPKYGSIPKLI

SEQ ID NO: 8415 - protein, 119 aa, Homo sapiens
MKRGRLPSSSEDSDDNGSLSTTWSQNSRSQHRRSSCSRHEDRKPSEVFRTDLITAMKLHDSYQLNPDEYYVLADPWRQEWEKGVQVPVSPGTIPQPVARVVSEEKSLMFIRPKKYIVSS

SEQ ID NO: 8416 - protein, 22 aa, Homo sapiens
MAKYNTGGNPTEDVSVNSRPFR

SEQ ID NO: 8417 - protein, 352 aa, Homo sapiens
MAAAVRQDLAQLMNSSGSHKDLAGKYRQILEKAIQLSGAEQLEALKAFVEAMVNENVSLVISRQLLTDFCTHLPNLPDSTAKEIYHFTLEKIQPRVISFEEQVASIRQHLASIYEKEEDWRNAAQVLVGIPLETGQKQYNVDYKLETYLKIARLYLEDDDPVQAEAYINRASLLQNESTNEQLQIHYKVCYARVLDYRRKFIEAAQRYNELSYKTIVHESERLEALKHALHCTILASAGQQRSRMLATLFKDERCQQLAAYGILEKMYLDRIIRGNQLQEFAAMLMPHQKATTADGSSILDRAVIEHNLLSASKLYNNITFEELGALLEIPAAKHEKPCQRGISRSNHFVSK

SEQ ID NO: 8418 - protein, 125 aa, Homo sapiens
MVMEKPSPLLVGREFVRQYYTLLNKAPEYLHRFYGRNSSYVHGGVDASGKPQEAVYGQNDIHHKVLSLNFSECHTKIRHVDAHATLSDGVVVQVMGLLSNSGQPERKFMQTFVLAPEGSVPNKFY

SEQ ID NO: 8419 - protein, 218 aa, Homo sapiens
MNGRADFREPNAEVPRPIPPVPLAATSMLITQGLISKGILSSHPKYGSIPKLILACIMGYFAGKLSYVKTCQEKFKKLENSPLGEALRSGQARRSSPPGHYYQKSKYDSSVSGQSSFVTSPAADNIEMLPHYEPIPFSSSMNESAPTGITDHIVQGPDPNLEESPKRKNITYEELRNKNRESYEVSLTQKTDPSVRPMHERVPKKEVKVNKYGDTWDE

SEQ ID NO: 8420 - protein, 80 aa, Homo sapiens; identical to SEQ ID NO: 8414

SEQ ID NO: 8421 - protein, 217 aa, Homo sapiens
MIVNDYEGNDSEAEDLNFRETLPSSSQENTPRSKVFENKVNSEKVKLSLRNFPHNDYEDVFEEPSESGSDPSMWTARGPFRRDRWSSEDEEAAGPSQALSPLLSDTRKIVSEGELDQLAQIRPLIFNFHEQTAIKDCLKILEEKTAAYDIMQEFMALELKNLPGEFNSGNQPSNREKNRYRDILPFQHHGYSGPNERTTFWHGSNEGAVSLLLRYCA

SEQ ID NO: 8422 - protein, 116 aa, Homo sapiens
MGRLDGKVIILTAAAQGIGQAAALAFAREGAKVIATDINESKLQELEKYPGIQTRVLDVTKKKQIDQFANEVERLDVLFNVAGFVHHGTVLDCEEKDWDFSMNLNVRSMYLMIKAF

SEQ ID NO: 8423 - protein, 167 aa, Homo sapiens
MKAIKKSLTEEEYLYLDFSHQTEGCIFPLHTSVTLFLLSYCDCKIFKICLVVTKEVSRDSSLLRDDLIQDVEIQIISRQELPPIVQNCCLPAVVERSDNFCRAGLAVVLRHIIQKSYEADPLKKELLELLGFKKTCLKACAEVSQWTRLCELTIPLAIENFLRESSD

SEQ ID NO: 8424 - protein, 310 aa, Homo sapiens; identical to SEQ ID NO: 5495

SEQ ID NO: 8425 - protein, 78 aa, Homo sapiens
MVMEKPSPLLVGREFVRQYYTLLNKAPEYLHRFYGRNSSYVHGGVDASGKPQEAVYGQNDIHHKVLSLNFSECHTKIR

SEQ ID NO: 8426 - protein, 226 aa, Homo sapiens; identical to SEQ ID NO: 6419

SEQ ID NO: 8427 - protein, 339 aa, Homo sapiens; identical to SEQ ID NO: 5550

SEQ ID NO: 8428 - protein, 392 aa, Homo sapiens; identical to SEQ ID NO: 6910

SEQ ID NO: 8429 - protein, 217 aa, Homo sapiens; identical to SEQ ID NO: 8421

SEQ ID NO: 8430 - protein, 145 aa, Homo sapiens; identical to SEQ ID NO: 6912

SEQ ID NO: 8431 - protein, 68 aa, Homo sapiens; identical to SEQ ID NO: 8394

SEQ ID NO: 8432 - protein, 174 aa, Homo sapiens
MAKYNTGGNPTEDVSVNSRPFRVTGPNSSSGIQARKNLFNNQGNASPPAGPSNVPKFGSPKPPVAVKPSSEEKPDKEPKPPFLKPTGAGQRFGTPASLTTRDPEAKVGFLKPVGPKPINLPKEDSKPTFPWPPGNKPSLHSVNQDHDLKPLGPKSGPTPPTSENEQKQAFPKLT

SEQ ID NO: 8433 - protein, 134 aa, Homo sapiens
MSDDAGDTLATGDKAEVTEMPNSDSLPEDAEVHCDSAAVSHEPTPADPRGEGHENAAVQGAGAAAIGPPVQPQDANALEPPLNGDVTEDTLAECIDSVSLEAEPRSEIPLQEQNYLAVDSPPSGGGWAGWGSWG

SEQ ID NO: 8434 - protein, 143 aa, Homo sapiens
MKRGRLPSSSEDSDDNGSLSTTWSQNSRSQHRRSSCSRHEDRKPSEVFRTDLITAMKLHDSYQLNPDEYYVLADPWRQEWEKGVQVPVSPGTIPQPVARVVSEEKSLMFIRPKKYIVSSGSEPPELGYVDIRTLADSVCRYDL

SEQ ID NO: 8435 - protein, 399 aa, Homo sapiens; identical to SEQ ID NO: 6631

SEQ ID NO: 8436 - protein, 79 aa, Homo sapiens
MDESALLDLLECPVCLERLDASAKVLPCQHTFCKRCLLGIVGSRNELRCPECRTLVGSGVEELPSNILLVRLLDGIKQR

SEQ ID NO: 8437 - protein, 206 aa, Homo sapiens; identical to SEQ ID NO: 6911

SEQ ID NO: 8438 - protein, 166 aa, Homo sapiens
MKAIKKSLTEEEYLYLDFSHQTEGCIFPLHTSVTLFLLSYCDCKIFKICLVVTKEVSRDSSLLRDDLIQDVEIQIISRQELPPIVQNCCLPAVVERSDNFCRAGLAVVLRHIIQKSYEADPLKKELLELLGFKKTCLKACAEVSQWTRLCELTIPLAIENFLRESS

SEQ ID NO: 8439 - protein, 120 aa, Homo sapiens; identical to SEQ ID NO: 8374

SEQ ID NO: 8440 - protein, 116 aa, Homo sapiens
MVMEKPSPLLVGREFVRQYYTLLNKAPEYLHRFYGRNSSYVHGGVDASGKPQEAVYGQNDIHHKVLSLNFSECHTKIRHVDAHATLSDGVVVQVMGLLSNSGQPERKFMQTFVLAP

SEQ ID NO: 8441 - protein, 159 aa, Homo sapiens
MSDHRYGDGGSTFQSTTGHCVHMRGLPYRATENDIYNFFSPLNPVRVHIEIGPDGRVTGEADVEFATHEDAVAAMSKDKANMQHRYVELFLNSTAGASGGAYGSQMLGGMGLSNQSSYGGPASQQLSGGYGGGYGGQSSMSGYDQVLQENSSDFQSNIA

SEQ ID NO: 8442 - protein, 136 aa, Homo sapiens; identical to SEQ ID NO: 8357

SEQ ID NO: 8443 - protein, 153 aa, Homo sapiens
MKLTSEKLPKNPFYASVSQYAAKNQKFFQWKKEKTDYTHANLVDKALQLLKERILKGDTLAYFLRGQLYFEEGWYEEALEQFEEIKEKDHQATYQLGVMYYDGLGTTLDAEKGVDYMKKILDSPCPKARHLKFAAAYNLGRAYYEGKGVKRSN

SEQ ID NO: 8444 - protein, 162 aa, Homo sapiens
MEALLEGIQNRGHGGGFLTSCEAELQELMKQIDIMVAHKKSEWEGRTHALETCLKIREQELKSLRSQLDVTHKEVGMLHQQVEEHEKIKQEMTMEYKQELKKLHEELCILKRSYEKLQKKQMREFRGNTKNHREDRSEIERLTAKIEEFRQKSLDWEKQRLI

SEQ ID NO: 8445 - protein, 509 aa, Homo sapiens; identical to SEQ ID NO: 7262

SEQ ID NO: 8446 - protein, 29 aa, Homo sapiens
MNGRADFREPNAEVPRPIPHIGPDYIPTE

SEQ ID NO: 8447 - protein, 411 aa, Homo sapiens
MIVNDYEGNDSEAEDLNFRETLPSSSQENTPRSKVFENKVNSEKVKLSLRNFPHNDYEDVFEEPSESGSDPSMWTARGPFRRDRWSSEDEEAAGPSQALSPLLSDTRKIVSEGELDQLAQIRPLIFNFHEQTAIKDCLKILEEKTAAYDIMQEFMALELKNLPGEFNSGNQPSNREKNRYRDILPYDSTRVPLGKSKDYINASYIRIVNCGEEYFYIATQGPLLSTIDDFWQMVLENNSNVIAMITREIEGGIIKCYHYWPISLKKPLELKHFRVFLENYQILQYFIIRMFQVVEKSTGTSHSVKQLQFTKWPDHGTPASADSFIKYIRYARKSHLTGPMVVHCSAGIGRTGVFLCVDVVFCAIVKNCSFNIMDIVAQMREQRSGMVQTKEQYHFCYDIVLEVLRKLLTLD

SEQ ID NO: 8448 - protein, 99 aa, Homo sapiens
MVMEKPSPLLVGREFVRQYYTLLNKAPEYLHRFYGRNSSYVHGGVDASGKPQEAVYGQNDIHHKVLSLNFSECHTKIRHVDAHATLSDGVVVQVMGLLS

SEQ ID NO: 8449 - protein, 234 aa, Homo sapiens
MASSAKSAEMPTISKTVNPTPDPHQEYLDPRITIALFEIGSHSPSSWGSLPFLKNSSHQVTEQQTAQKFNNLLKEIKDILKNMAGFEEKITEAKELFEETNITEDVSAHKENIRGLDKINEMLSTNLPVSLAPEKEDNEKKQEMILETNITEDVSAHKENIRGLDKINEMLSTNLPVSLAPEKEDNEKKQQMIMENQNSENTAQVFARDLVNRLEEKKVLNETQQSQEKAKNRL

SEQ ID NO: 8450 - protein, 364 aa, Homo sapiens
MYFCWGADSRELQRRRTAGSPGAELLQAASGERHSLLLLTNHRVLSCGDNSRGQLGRRGAQRGELPEPIQALETLIVDLVSCGKEHSLAVCHKGRVFAWGAGSEGQLGIGEFKEISFTPKKIMTLNDIKIIQVSCGHYHSLALSKDSQVFSWGKNSHGQLGLGKEFPSQASPQRVRSLEGIPLAQVAAGGAHSFALSLCGTSFGWGSNSAGQLALSGRNVPVQSNKPLSVGALKNLGVVYISCGDAHTAVLTQDGKVFTFGDNRSGQLGYSPTPEKRGPQLVERIDGLVSQIDCGSYHTLAYVHTTGQVVSFGHGPSDTSKPTHPEALTENFDISCLISAEDFVDVQVKHIFAGTYANFVTTHQ

SEQ ID NO: 8451 - protein, 115 aa, Homo sapiens
MAKYNTGGNPTEDVSVNSRPFRVTGPNSSSGIQARKNLFNNQGNASPPAGPSNVPKFGSPKPPVAVKPSSEEKPDKEPKPPFLKPTGAGQRFGTPASLTTRDPEAKVGFLKPVGP

SEQ ID NO: 8452 - protein, 161 aa, Homo sapiens
MAGILRLVVQWPPGRLQTVTKGVESLICTDWIRHKFTRSRIPEKVFQASPEDHEKYGGDPQNPHKLHIVTRIKSTRRRPYWEKDIIKMLGLEKAHTPQVHKNIPSVNAKLKVVKHLIRIKPLKLPQGLPAEENMSNTCLKSTGELVVQWHLKPVEQKAHES

SEQ ID NO: 8453 - protein, 171 aa, Homo sapiens
MNGRADFREPNAEVPRPIPHIGPDYIPTEEERRVFAECNDESFWFRSVPLAATSMLITQGLISKGILSSHPKYGSIPKLILACIMGYFAGKLSYVKTCQEKFKKLENSPLGEALRSGQARRSSPPGHYYQKSKYDSSVSGQSSFVTSPAADNIEMLPHYEPIPFSSSMNES

SEQ ID NO: 8454 - protein, 145 aa, Homo sapiens; identical to SEQ ID NO: 8337

SEQ ID NO: 8455 - protein, 80 aa, Homo sapiens
MVTSLNEDNESVTVEWIENGDTKGKEIDLESIFSLNPDLVPDEEIEPSPETPPPPASSAKVNKIVKNRRTVASIKNDPPS

SEQ ID NO: 8456 - protein, 40 aa, Homo sapiens
MKAIKKSLTEEEYLYLDFSHQTEGCIFPLHTSVTLFLLSY

SEQ ID NO: 8457 - protein, 63 aa, Homo sapiens
MEALLEGIQNRGHGGGFLTSCEAELQELMKQIDIMVAHKKSEWEGRTHALETCLKIREQELKS

SEQ ID NO: 8458 - protein, 197 aa, Homo sapiens
MWTARGPFRRDRWSSEDEEAAGPSQALSPLLSDTRKIVSEGELDQLAQIRPLIFNFHEQTAIKDCLKILEEKTAAYDIMQEFMTGTSHSVKQLQFTKWPDHGTPASADSFIKYIRYARKSHLTGPMVVHCSAGIGRTGVFLCVDVVFCAIVKNCSFNIMDIVAQMREQRSGMVQTKEQYHFCYDIVLEVLRKLLTLD

SEQ ID NO: 8459 - protein, 842 aa, Homo sapiens; identical to SEQ ID NO: 4738

SEQ ID NO: 8460 - protein, 829 aa, Homo sapiens; identical to SEQ ID NO: 8375

SEQ ID NO: 8461 - protein, 269 aa, Homo sapiens
MIVNDYEGNDSEAEDLNFRETLPSSSQENTPRSKVFENKVNSEKVKLSLRNFPHNDYEDVFEEPSESGSDPSMWTARGPFRRDRWSSEDEEAAGPSQALSPLLSDTRKIVSEGELDQLAQIRPLIFNFHEQTAIKDCLKILEEKTAAYDIMQEFMTGTSHSVKQLQFTKWPDHGTPASADSFIKYIRYARKSHLTGPMVVHCSAGIGRTGVFLCVDVVFCAIVKNCSFNIMDIVAQMREQRSGMVQTKEQYHFCYDIVLEVLRKLLTLD

SEQ ID NO: 8462 - protein, 163 aa, Homo sapiens
MMLGTEGGEGFVVKVRGLPWSCSADEVQRFFSDCKIQNGAQGIRFIYTREGRPSGEAFVELESEDEVKLALKKDRETMGHRYVEVFKSNNVEMDWVLKHTGPNSPDTANDGFVRLRGLPFGCSKEEIVQFFSGLEIVPNGITLPVDFQGRSTGEAFVQFASQE

SEQ ID NO: 8463 - protein, 252 aa, Homo sapiens
MAATAREDGASGQERGQRGCEHYDRGCLLKAPCCDKLYTCRLCHDNNEDHQLDRFKVKEVQCINCEKIQHAQQTCEECSTLFGEYYCDICHLFDKDKKQYHCENCGICRIGPKEDFFHCLKCNLCLAMNLQGRHKCIENVSRQNCPICLEDIHTSRVVAHVLPCGHLLHRGYRCPLCMHSALDMTRYWRQLDDEVAQTPMPSEYQNMTVDILCNDCNGRSTVQFHILGMKCKICESYNTAQAGGRRISLDQQ

SEQ ID NO: 8464 - protein, 197 aa, Homo sapiens; identical to SEQ ID NO: 8458

SEQ ID NO: 8465 - protein, 1400 aa, Homo sapiens
  MOD_RES (1)..(1): Any amino acid
XPPPPPPPMWNPMIPAFDLFQGNHGFVAPVVTTAAHWRSVNYTFPPSVISHTSPTKVWRNKDGTSAYQVQETPVSQVVRKKTSYVGLVLVLLRGLPGSGKSFLARTLQEDNPSGVILSTDDYFYINGQYQFDVKYLGEAHEWNQNRAKEAFEKKISPIIIDNTNLQAWEMKPYVALSQKHKYKVLFREPDTWWKFKPKELARRNIHGVSKEKITRMLEHYQRFVSVPIIMSSSVPEKIERIELCAYSCEDRSTSPRDDEDIISEKEENILSLSLKHLEFTEEKNLDVTKETMLPENVAYLSNADLNKRRKEISDMNPSIQSALILETPHMYFSDSESKLQATDKSENEQIEMVAVKGYSKTDTDSSMERVSPSTCCSENNQEDCDLANSGPLQNEKSSPGEIVEERATVTKKAFGKQKSKSTLEKFPRHELSNFVGDWPVDKTIGQRTKRNRKTEKTSSVQSDKKYNYPQSHKLVNSVSVNTDCVQQRGSPHESVEDGRKSQCDDASEPLNSYKYDAYKNIDKNSFNIMGDWPSSDSLAQREHRSRMPKTGLSEPNLEIGTNDKMNEISLSTAHEACWGTSSQKLKTLGSSNLGSSEMLLSEMTCESQTCLSKKSHGQHTSLPLTFTNSAPTVSGVVEPQTLAECQEQMPKRDPGKEVGMCTQTEPQDFALLWKIEKNKISISDSIKVLTGRLDGFKPKVFNINTKSDVQEAIPYRVMYDKSTFVEESELTSADESENLNILCKLFGSFSLEALKDLYERCNKDIIWATSLLLDSETKLCEDTEFENFQKSCDGSQIGPFSLGLNLKEIISQRGTLENSNSPVPEFSHGIGISNADSQSTCDAERGNSEQAEMRAVTPENHESMTSIFPSAAVGLKNNNDILPNSQEELLYSSKQSFPGILKATTPKDMSETEKNLVVTETGDNIHSPSHFSDIFNFVSSTSNLELNEEIYFTDSLEIKRNENFPKDYVKFSDEEEFMNEDEKEMKEILMAGSSLSAGVSGEDKTEILNPTPAMAKSLTIDCLELALPPELAFQLNELFGPVGIDSGSLTVEDCVVHIDLNLAKVIHEKWKESVMERQRQEEVSCGKFMQDPSLVGHTGLDNPEQKSSQRTGKKLLKTLTASEMLPLLDHWNTQTKKVSLREIMSEEIALQEKHNLKRETLMFEKDCATKLKEKQLFKIFPAINQNFLVDIFKDHNYSLEHTVQFLNCVLEGDPVKTVVAQEFVHQNENVTSHTGQKSKEKKDFEYPDYDDYRAEAFLHQQKRMECYSKAKEAYRIGKKNVATFYAQQGTLHEQKMKEANHLAAIEIFEKVNASLLPQNVLDLHGLHVDEALEHLMRVLEKKTEEFKQNGGKPYLSVITGRGNHSQGGVARIKPAVIKYLISHSFRFSEIKPGCLKVMLK

SEQ ID NO: 8466 - protein, 78 aa, Homo sapiens
MLCWGYWSLGQPGISTNLQGIVAEPQVCGFISDRSVKEVACGGNHSVFLLEDGEVYTCGLNTKGQLGHEREGNKPEQI

SEQ ID NO: 8467 - protein, 245 aa, Homo sapiens; identical to SEQ ID NO: 4951

SEQ ID NO: 8468 - protein, 703 aa, Homo sapiens; identical to SEQ ID NO: 5656

SEQ ID NO: 8469 - protein, 190 aa, Homo sapiens
MAGTARHDREMAIQAKKKLTTATDPIERLRLQCLARGSAGIKGLGRVFRIMDDDNNRTLDFKEFMKGLNDYAVVMEKEEVEELFRRFDKDGNGTIDFNEFLLTLRPPMSRARKEVIMQAFRKLDKTGDGVITIEDLREVYNAKHHPKYQNGEWSEEQVFRKFLDNFDSPYDKDGLVTPEEFMNYYAGVSA

SEQ ID NO: 8470 - protein, 76 aa, Homo sapiens
MTPPQQPPPLRSEPGTLGSAASSYSPLGLNGVPGSIWDFVSGSFSPSPSPILSAGPPSSSSASPNGAELARVRRQL

SEQ ID NO: 8471 - protein, 35 aa, Homo sapiens
MATLVVNKLGAGVDSGRQGSRGTAVVKVLECGVCE

SEQ ID NO: 8472 - protein, 158 aa, Homo sapiens
MEADIITNLRCRLKEAEEERLKAAQYGLQLVESQNELQNQLDKCRNEMMTMTESYEQEKYTLQREVELKSRMLESLSCECEAIKQQQKMHLEKLEEQLSRSHGQEVNELKTKIEKLKVELDEARLSEKQLKHQVDHQKELLSCKSEELRVMSERVQES

SEQ ID NO: 8473 - protein, 130 aa, Homo sapiens
MAQTDKPTCIPPELPKMLKEFAKAAIRAQPQDLIQWGADYFEALSRGETPPVRERSERVALCNWAELTPELLKILHSQVAGRLIIRAEELAQMWKVVNLPTDLFNSVMNVGRFTEEIEWLKFLALACSAL

SEQ ID NO: 8474 - protein, 230 aa, Homo sapiens
MEADIITNLRCRLKEAEEERLKAAQYGLQLVESQNELQNQLDKCRNEMMTMTESYEQEKYTLQREVELKSRMLESLSCECEAIKQQQKMHLEKLEEQLSRSHGQEVNELKTKIEKLKVELDEARLSEKQLKHQVDHQKELLSCKSEELRVMSERVQESMSSEMLALQIELTEMESMKTTLKEEVNELQYRQEQLELLITNLMRQVDRLKEEKEEREKEAVSYYNALEKAR

SEQ ID NO: 8475 - protein, 212 aa, Homo sapiens; identical to SEQ ID NO: 4821

SEQ ID NO: 8476 - protein, 947 aa, Homo sapiens
MNFLRGVMGGQSAGPQHTEAETVRGAADPKVTSSCGLKFRHSFRLVKHILYHVTINVYSDSEIIGYALDTLYNIISNEEEEEVEENSTRQSEDLGSQFTEIFIKQQENVTLLLSLLEEFDFHVRWPGVKLLTSLLKQLGPQVQQIILVSPMGVSRLMDLLADSREVIRNDGVLLLQALTRSNGAIQKIVAFENAFERLLDIISEEGNSDGGIVVEDCLILLQNLLKNNNSNQNFFKEGSYIQRMKPWFEVGDENSGWSAQKVTNLHLMLQLVRVLVSPTNPPGATSSCQKAMFQCGLLQQLCTILMATGVPADILTETINTVSEVIRGCQVNQDYFASVNAPSNPPRPAIVVLLMSMVNERQPFVLRCAVLYCFQCFLYKNQKGQGEIVSTLLPSTIDATGNSVSAGQLLCGGLFSTDSLSNWCAAVALAHALQENATQKEQLLRVQLATSIGNPPVSLLQQCTNILSQGSKIQTRVGLLMLLCTWLSNCPIAVTHFLHNSANVPFLTGQIAENLGEEEQLVQGLCALLLGISIYFNDNSLESYMKEKLKQLIEKRIGKENFIEKLGFISKHELYSRASQKPQPNFPSPEYMIFDHEFTKLVKELEGVITKAIYKSSEEDKKEEEVKKTLEQHDNIVTHYKNMIREQDLQLEELRQQVSTLKCQNEQLQTAVTQQVSQIQQHKDQYNLLKIQLGKDNQHQGSYSEGAQMNGIQPEEIGRLREEIEELKRNQELLQSQLTEKDSMIENMKSSQTSGTNEQSSAIVSARDSEQVAELKQELATLKSQLNSQSVEITKLQTEKQELLQKTEAFAKSVEVQGETETIIATKTTDVEGRLSALLQETKELKNEIKALSEERTAIKEQLDSSNSTIAILQTEKDKLELEITDSKKEQDDLLVLLADQDQKILSLKNKLKDLGHPVEEEDELESGDQEDEDDESEDPGKDLDHI

SEQ ID NO: 8477 - protein, 364 aa, Homo sapiens; identical to SEQ ID NO: 8348

SEQ ID NO: 8478 - protein, 411 aa, Homo sapiens; identical to SEQ ID NO: 8447

SEQ ID NO: 8479 - protein, 269 aa, Homo sapiens; identical to SEQ ID NO: 8461

SEQ ID NO: 8480 - protein, 119 aa, Homo sapiens
MASQLQVFSPPSVSSSAFCSAKKLKIEPSGWDVSGQSSNDKYYTHSKTLPATQGQANSSHQVANFNIPAYDQGLLLPAPAVEHIVVTAADSSGSAATSTFQSSQTLTHRSNVSLLEPYQ

SEQ ID NO: 8481 - protein, 112 aa, Homo sapiens; identical to SEQ ID NO: 8373

SEQ ID NO: 8482 - protein, 17 aa, Homo sapiens
MKRGRLPSSSEDSDDNG

SEQ ID NO: 8483 - protein, 269 aa, Homo sapiens; identical to SEQ ID NO: 4783

SEQ ID NO: 8484 - protein, 112 aa, Homo sapiens
MNGRADFREPNAEVPRPIPHIGPDYIPTEEERRVFAECNDESFWFRSVPLAATSMLITQGLISKGILSSHPKYGSIPKLILACIMGYFAGKLSYVKTCQEKFKKLENSPLGE

SEQ ID NO: 8485 - protein, 228 aa, Homo sapiens
MEEQPQMQDADEPADSGGEGRAGGPPQVAGAQAACSEDRMTLLLRLRAQTKQQLLEYKSMVDASEEKTPEQIMQEKQIEAKIEDLENEIEEVKVAFEIKKLALDSVLMDNMKHLLELNKLIMKSQQESWDLEEKLLDIRKKRLQLKQASESKLLEIQTEKNKQKIDLDSMENSERIKIIRQNLQMEIKITTVIQHVFQNLILGSKVNWAEDPALKEIVLQLEKNVDMM

SEQ ID NO: 8486 - protein, 783 aa, Homo sapiens; identical to SEQ ID NO: 5830

SEQ ID NO: 8487 - protein, 130 aa, Homo sapiens
MMLGTEGGEGFVVKVRGLPWSCSADEVQRFFSDCKIQNGAQGIRFIYTREGRPSGEAFVELESEDEVKLALKKDRETMGHRYVEVFKSNNVEMDWVLKHTGPNSPDTANDGFVRLRGLPFGCSKEEIVQF

SEQ ID NO: 8488 - protein, 88 aa, Homo sapiens
MEADIITNLRCRLKEAEEERLKAAQYGLQLVESQNELQNQLDKCRNEMMTMTESYEQEKYTLQREVELKSRMLESLSCECEAIKQQQK

SEQ ID NO: 8489 - protein, 633 aa, Homo sapiens; identical to SEQ ID NO: 6010

SEQ ID NO: 8490 - protein, 198 aa, Homo sapiens
MATGDLKRSLRNLEQVLRLLNYPEEVDCVGLIKGDPAASLPIISYSFTSYSPYVTELIMESNVELIAKNDLRFIDAVYKLLRDQFNYKPILTKKQFIQCGFAEWKIQIVCDILNCVMKKHKELSSLQKIPSQQRKKISSGKSEPPLGNEKISAEAVGVDISGRFMTSGKKKAVVIRHLYNEDNVDISEDTLSPITDVN

SEQ ID NO: 8491 - protein, 111 aa, Homo sapiens
MVMEKPSPLLVGREFVRQYYTLLNKAPEYLHRFYGRNSSYVHGGVDASGKPQEAVYGQNDIHHKVLSLNFSECHTKIRHVDAHATLSDGVVVQVMGLLSNSGQPERKFMQT

SEQ ID NO: 8492 - protein, 226 aa, Homo sapiens; identical to SEQ ID NO: 6419

SEQ ID NO: 8493 - protein, 623 aa, Homo sapiens
MSDEVFSTTLAYTKSPKVTKRTTFQDELIRAITARSARQRSSEYSDDFDSDEIVSLGDFSDTSADENSVNKKMNDFHISDDEEKNPSKLLFLKTNKSNGNITKDEPVCAIKNEEEMAPDGCEDIVVKSFSESQNKDEEFEKDKIKMKPKPRILSIKSTSSAENNSLDTDDHFKPSPRPRSMLKKKSHMEEKDGLEDKETALSEELELHSAPSSLPTPNGIQLEAEKKAFSENLDPEDSCLTSLASSSLKQILGDSFSPGSEGNASGKADHVTTAVEKSKESQVTADDLEEEKAKAELIMDDDRTVDPLLSKSQSILISTSATASSKKTIEDRNIKNKKSTNNRASSASARLMTSEFLKKSSSKRRTPSTTTSSHYLGTLKVLDQKPSQKQSIEPDRADNIRAAVYQEWLEKKNVYLHEMHRIKRIESENLRIQNEQKKAAKREEALASFEAWKAMKEKEAKKIAAKKRLEEKNKKKTEEENAARKGEALQAFEKWKEKKMEYLKEKNRKEREYERAKKQKEEETVAEKKKDNLTAVEKWNEKKEAFFKQKEKEKINEKRKEELKRAEKKDKDKQAINEYEKWLENKEKQERIERKQKKRHSFLESEALPPWSPPSRTVFAKVF

SEQ ID NO: 8494 - protein, 84 aa, Homo sapiens
MMLGTEGGEGFVVKVRGLPWSCSADEVQRFFSDCKIQNGAQGIRFIYTREGRPSGEAFVELESEDEVKLALKKDRETMGHRYVE

SEQ ID NO: 8495 - protein, 330 aa, Homo sapiens
MDQGDTPTLEEDLKKLQLSEFFDIFEKEKVDKEALALCTDRDLQEIGIPLGPRKKILNYFSTRKNSMGIKRPAPQPASGANIPKESEFCSSSNTRNGDYLDVGIGQVSVKYPRLIYKPEIFFAFGSPIGMFLTVRGLKRIDPNYRFPTCKGFFNIYHPFDPVAYRIEPMVVPGVEFEPMLIPHHKGRKRMHLELREGLTRMSMDLKNNLLGSLRMAWKSFTRAPYPALQASETPEETEAEPESTSEKPSDVNTEETSVAVKEEVLPINVGMLNGGQRIDYVLQEKPIESFNEYLFALQSHLCYWESEDTVLLVLKEIYQTQGIFLDQPLQ

SEQ ID NO: 8496 - protein, 460 aa, Homo sapiens; identical to SEQ ID NO: 5990

SEQ ID NO: 8497 - protein, 355 aa, Homo sapiens
MTGSAADTHRCPHPKGAKGTRSRSSHARPVSLATSGGSEEEDKDGGVLFHVNKSGFPIDSHTWERMWMHVAKVHPKGGEMVGAIRNAAFLAKPSIPQVPNYRLSMTIPDWLQAIQNYMKTLQYNHTGTQFFEIRKMRPLSGLMETAKEMTRESLPIKCLEAVILGIYLTNGQPSIERFPISFKTYFSGNYFHHVVLGIYCNGRYGSLGMSRRAELMDKPLTFRTLSDLIFDFEDSYKKYLHTVKKVKIGLYVPHEPHSFQPIEWKQLVLNVSKMLRADIRKELEKYARDMRMKILKPASAHSPTQVRSRGKSLSPRRRQASPPRRLGRREKSPALPEKKVADLSTLNEVGYQIRI

SEQ ID NO: 8498 - protein, 127 aa, Homo sapiens
MASNHKSSAARPVSRGGVGLTGRPPSGIRPLSGNIRVATAMPPGTARPGSRGCPIGTGGVLSSQIKVAHRPVTQQGLTGMKTGTKGPQRQILDKSYYLGLLRSKISELTTEVNKLQKGIEMYNQENS

SEQ ID NO: 8499 - protein, 169 aa, Homo sapiens
MHKLQSGIGRLILKEEMKARSSSYADPWTPPRSSTSSREALHTAGYEMSLNGSPRSHYLADSDPLISKSASLPAYRRNGLHRTPSADLFHYDSMNAVNWGMREYKIYPYELLLVTTRGRNRLPKDVDRTRLERHLSQEEFYQVFGMTISEFDRLALWKRNELKKQARLF

SEQ ID NO: 8500 - protein, 47 aa, Homo sapiens
MASVLSRRLGKRSLLGARVLGPSASEGPSAAPPSEPLLEGAAPQPFT

SEQ ID NO: 8501 - protein, 185 aa, Homo sapiens
MDDSINNRFSYVTHEDICNCFNGDTLLAIQAPSGTQLEVPIPEMGQNGQKKYQINLKSHSGPIHVLLINKESSSSKPVVFPVPPPDDLTQPSSQSLTPVTPQKSSMATQNLPEQHVSERSQALQQTSATDISSAGSISGDIIDELMSSDVFPLLRLSPTPADDYNFNLDDNEGVCDLFDVQILNY

SEQ ID NO: 8502 - protein, 163 aa, Homo sapiens; identical to SEQ ID NO: 5841

SEQ ID NO: 8503 - protein, 304 aa, Homo sapiens
MSKRRRLKQGEPIMTGKTQTSNVTNKNDPKSINSRVFIGNLNTAIVKKVDIEAIFSKYGKIVGCSVHKGYAFVQYMSERHARAAVAGENARVIAGQPLDINMAGEPKPYRPKPGNKRPLSALYRLESKEPFLSVGGYVFDYDYYRDDFYNRLFDYHGRVPPPPRAVIPLKRPRVAVTTTRRGKGVFSMKGGSRSTASGSTGSKLKSDELQTIKKELTQIKTKIDSLLGRLEKIEKQQKAEAEAQKKQLEESLVLIQEECVSEIADHSTEEPAEGGPDADGEEMTDGIEEDFDEDGGHELFLQIK

SEQ ID NO: 8504 - protein, 134 aa, Homo sapiens
MPSAEAKLKKNRCANCFDCPGCMHTLSTRATSISTQLPDDPAKTTMKKAYYLACGFCRWTSRDVGMADKSVASGGWQEPENPHTQRMNKLIEYYQQLAQKEKVERDRKKLARRRNYMPLAFSDKYGLGTRLQRP

SEQ ID NO: 8505 - protein, 409 aa, Homo sapiens
MWRVIEPPCPGAPSTENGKSVHWKLGADKEVWVWVMGEHHLDKPYDVLCNEIIAERARLKAEQEAEEPRKTHSEEFTNSLKTKSQYHDLQAPDNQQTKDIWKKVAEKEELEQGSRPAPTLEEEKIRSLSSSSRNIQQMLADSINRMKAYAFHQKKESMKKKQDEEINQIEEERTKQICKSWKEDSEWQASLRKSKAADEKRRSLAKQAREDYKRLSLGAQKGRGGERLQSPLRVPQKPERPPLPPKPQFLNSGAYPQKPLRNQGVVRTLSSSAQEDIIRWFKEEQLPLRAGYQKTSDTIAPWFHGILTLKKANELLLSTGMPGSFLIRVSERIKGYALSYLSEDGCKHFLIDASADAYSFLGVDQLQHATLADLVEYHKEEPITSLGKELLLYPCGQQDQLPDYLELFE

SEQ ID NO: 8506 - protein, 129 aa, Homo sapiens [sequence omitted]

SEQ ID NO: 8507 - protein, 259 aa, Homo sapiens
MVGREKELSIHFVPGSCRLVEEEVNIPNRRVLVTGATGLLGRAVHKEFQQNNWHAVGCGFRRARPKFEQVNLLDSNAVHHIIHDFQPHVIVHCAAERRPDVVENQPDAASQLNVDASGNLAKEAAAVGAFLIYISSDYVFDGTNPPYREEDIPAPLNLYGKTKLDGEKAVLENNLGAAVLRIPILYGEVEKLEESAVTVMFDKVQFSNKSANMDHWQQRFPTHVKDVATVCRQLAEKRMLVRRIPESCLSEGPLCLFHA

SEQ ID NO: 8508 - protein, 182 aa, Homo sapiens
SYDSTFSYVTHEDICNCFNGDTLLAIQAPSGTQLEVPIPEMGQNGQKKYQINLKSHSGPIHVLLINKESSSSKPVVFPVPPPDDLTQPSSQSLTPVTPQKSSMATQNLPEQHVSERSQALQQTSATDISSAGSISGDIIDELMSSDVFPLLRLSPTPADDYNFNLDDNEGVCDLFDVQILNY

SEQ ID NO: 8509 - protein, 53 aa, Homo sapiens
MDSELMHSIVGSYHKPPERVFVPSFTQNEPSQNCHPANLEVTSPKILHSPNSQ

SEQ ID NO: 8510 - protein, 1005 aa, Homo sapiens
MAGALRRGRALGSRPSGPTVSSRRSPQCPVAQEGLGARSRPRVAPRSLARCGPSSRLMGWKPSEARGQSQSFQASGLQPRSLKAARRATGRPDRSRAARPTMDPSAHRSRAAPPNMDPDPQAGVQVGMRVVRGVDWKWGQQDGGEGGVGTVVELGRHGSPSTPDRTVVVQWDQGTRTNYRAGYQGAHDLLLYDNAQIGVRHPNIICDCCKKHGLRGMRWKCRVCLDYDLCTQCYMHNKHELAHAFDRYETAHSRPVTLSPRQGLPRIPLRGIFQGAKVVRGPDWEWGSQDGKPAELQRRVSADSQPFQHGDKVKCLLDTDVLREMQEGHGGWNPRMAEFIGQTGTVHRITDRGDVRVQFNHETRWTFHPGALTKHHSFWVGDVVRVIGDLDTVKRLQAGHGEWTDDMAPALGRVGKVVKVFGDGNLRVAVAGQRWTFSPSCLVAYRPEEDANLDVAERARENKSSLSVALDKLRAQKSDPEHPGRLVVEVALGNAARALDLLRRRPEQVDTKNQGRTALQVAAYLGQVELIRLLLQARAGVDLPDDEGNTALHYAALGNQPEATRVLLSAGCRADAINSTQSTALHVAVQRGFLEVVRALCERGCDVNLPDAHSDTPLHSAISAGTGASGIVEVLTEVPNIDVTATNSQGFTLLHHASLKGHALAVRKILARARQLVDAKKEDGFTALHLAALNNHREVAQILIREGRCDVNVRNRKLQSPLHLAVQQAHVGLVPLLVDAGCSVNAEDEEGDTALHVALQRHQLLPLVADGAGGDPGPLQLLSRLQASGLPGSAELTVGAAVACFLALEGADVSYTNHRGRSPLDLAAEGRVLKALQGCAQRFRERQAGGGAAPGPRQTLGTPNTVTNLHVGAAPGPEAAECLVCSELALLVLFSPCQHRTVCEECARRMKKCIRCQVVVSKKLRPDGSEVASAAPAPGPPRQLVEELQSRYRQMEERITCPICIDSHIRLVFQCGHGACAPCGSALSACPICRQPIRDRIQIFV

SEQ ID NO: 8511 - protein, 97 aa, Homo sapiens
MASSAELDFNLQALLEQLSQDELSKFKSLIRTISLGKELQTVPQTEVDKANGKQLVEIFTSHSCSYWAGMAAIQVFEKMNQTHLSGRADEHCVMPPP

SEQ ID NO: 8512 - protein, 230 aa, Homo sapiens
MDSELMHSIVGSYHKPPERVFVPSFTQNEPSQNCHPANLEVTSPKILHSPNSQALILALKTLQEKIHRLELERTQAEDNLNILSREAAQYKKALENETNERNLAHQELIKQKKDISIQLSSAQSRCTLLEKQLEYTKRMVLNVEREKNMILEQQAQLQREKEQDQMKLYAKLEKLDVLEKECFRLTTTQKTAEDKIKHLEEKLKEEEHQRKLFQDKASELQTGLEISKII

SEQ ID NO: 8513 - protein, 207 aa, Homo sapiens
MDRGEQGLLRTDPVPEEGEDVAATISATETLSEEEQEELRRELAKVEEEIQTLSQVLAAKEKHLAEIKRKLGINSLQELKQNIAKGWQDVTATSAYKKTSETLSQAGQKASAAFSSVGSVITKKLEDVKLQAFSHSFSIRSIQHSISMPAMRNSPTFKSFEEKVENLKSKVGGTKPAGGDFGEVLNSAANASATTTEPLPEKTQESL

SEQ ID NO: 8514 - protein, 128 aa, Homo sapiens
MKFNPFVTSDRSKNRKRHFNAPSHVRRKIMSSPLSKELRQKYNVRSMPIRKDDEVQVVRGHYKGQQIGKVVQVYRKKYVIYIERVQREKANGTTVHVGIHPSKVVITRLKLDKDRKKILERKAKSRQV

SEQ ID NO: 8515 - protein, 41 aa, Homo sapiens
  MOD_RES (40)..(40): Selenocysteine
GLTKQLLDDTIGIHPTCGEVFTTLEITKSSGLDITQKGCCG

SEQ ID NO: 8516 - protein, 454 aa, Homo sapiens; identical to SEQ ID NO: 4978

SEQ ID NO: 8517 - protein, 145 aa, Homo sapiens; identical to SEQ ID NO: 4967

SEQ ID NO: 8518 - protein, 206 aa, Homo sapiens
MDSELMHSIVGSYHKPPERVFVPSFTQNEPSQNCHPANLEVTSPKILHSPNSQALILALKTLQEKIHRLELERTQAEDNLNILSREAAQYKKALENETNERNLAHQELIKQKKDISIQLSSAQSRCTLLEKQLEYTKRMVLNVEREKNMILEQQAQLQREKEQDQMKLYAKLEKLDVLEKECFRLTTTQKTAEDKIKHLEEKLKEE

SEQ ID NO: 8519 - protein, 349 aa, Homo sapiens; identical to SEQ ID NO: 4816

SEQ ID NO: 8520 - protein, 142 aa, Homo sapiens
MPSIKLQSSDGEIFEVDVEIAKQSVTIKTMLEDLGMDDEGDDDPVPLPNVNAAILKKVIQWCTHHKDDPPPPEDDENKEKRTDDIPVWDQEFLKVDQGTLFELILAANYLDIKGLLDVTCKTVANMIKGKTPEEIRKTFNIK

SEQ ID NO: 8521 - protein, 124 aa, Homo sapiens
MSATVVDAVNAAPLSGSKEMSLEEPKKMTREDWRKKKELEEQRKLGNAPAEVDEEGKDINPHIPQYISSVPWYIDPSKRPTLKHQRPQPEKQKQFSSSGEWYKRGVKENSIITKYRKGACENCG

SEQ ID NO: 8522 - protein, 249 aa, Homo sapiens; identical to SEQ ID NO: 5365

SEQ ID NO: 8523 - protein, 39 aa, Homo sapiens
MKFNPFVTSDRSKNRKRHFNAPSHVRRKIMSSPLSKELR

SEQ ID NO: 8524 - protein, 466 aa, Homo sapiens; identical to SEQ ID NO: 4815

SEQ ID NO: 8525 - protein, 175 aa, Homo sapiens
MASNHKSSAARPVSRGGVGLTGRPPSGIRPLSGNIRVATAMPPGTARPGSRGCPIGTGGVLSSQIKVAHRPVTQQGLTGMKTGTKGPQRQILDKSYYLGLLRSKISELTTEVNKLQKGIEMYNQENSVYLSYEKRAETLAVEIKELQGQLADYNMLVDKLNTNTEMEEVMNDYNM

SEQ ID NO: 8526 - protein, 145 aa, Homo sapiens; identical to SEQ ID NO: 4967

SEQ ID NO: 8527 - protein, 711 aa, Homo sapiens; identical to SEQ ID NO: 6976

SEQ ID NO: 8528 - protein, 156 aa, Homo sapiens
MASVLSRRLGKRSLLGARVLGPSASEGPSAAPPSEPLLEGAAPQPFTTSDDTPCQEQPKEVLKAPSTSGLQQVAFQPGQKVYVWYGGQECTGLVEQHSWMEGQVTVWLLEQKLQVCCRVEEVWLAELQGPCPQAPPLEPGAQALAYRPVSRNIDVP

SEQ ID NO: 8529 - protein, 102 aa, Homo sapiens
MPSIKLQSSDGEIFEVDVEIAKQSVTIKTMLEDLGMDDEGDDDPVPLPNVNAAILKKVIQWCTHHKDDPPPPEDDENKEKRTDDIPVWDQEFLKVDQGTLFE

SEQ ID NO: 8530 - protein, 154 aa, Homo sapiens
MADDLDFETGDAGASATFPMQCSALRKNGFVVLKGWPCKIVEMSASKTGKHGHAKVHLVGIDIFTGKKYEDICPSTHNMDVPNIKRNDFQLIGIQDGYLSLLQDSGEVPEDLRLPEGDLGKEIEQKYDCGEEILITVLSAMTEEAAVAIKAMAK

SEQ ID NO: 8531 - protein, 101 aa, Homo sapiens
MSATVVDAVNAAPLSGSKEMSLEEPKKMTREDWRKKKELEEQRKLGNAPAEVDEEGKDINPHIPQYISSVPWYIDPSKRPTLKHQRPQPEKQKQFSSSGEW

SEQ ID NO: 8532 - protein, 1066 aa, Homo sapiens
MAGALRRGRALGSRPSGPTVSSRRSPQCPVAQEGLGARSRPRVAPRSLARCGPSSRLMGWKPSEARGQSQSFQASGLQPRSLKAARRATGRPDRSRAARPTMDPSAHRSRAAPPNMDPDPQAGVQVGMRVVRGVDWKWGQQDGGEGGVGTVVELGRHGSPSTPDRTVVVQWDQGTRTNYRAGYQGAHDLLLYDNAQIGVRHPNIICDCCKKHGLRGMRWKCRVCLDYDLCTQCYMHNKHELAHAFDRYETAHSRPVTLSPRQGLPRIPLRGIFQGAKVVRGPDWEWGSQDGGEGKPGRVVDIRGWDVETGRSVASVTWADGTTNVYRVGHKGKVDLKCVGEAAGGFYYKDHLPRLGKPAELQRRVSADSQPFQHGDKVKCLLDTDVLREMQEGHGGWNPRMAETGTVHRITDRGDVRVQFNHETRWTFHPGALTKHHSFWVGDVVRVIGDLDTVKRLQAGHGEWTDDMAPALGRVGKVVKVFGDGNLRVAVAGQRWTFSPSCLVAYRPEEDANLDVAERARENKSSLSVALDKLRAQKSDPEHPGRLVVEVALGNAARALDLLRRRPEQVDTKNQGRTALQVAAYLGQVELIRLLLQARAGVDLPDDEGNTALHYAALGNQPEATRVLLSAGCRADAINSTQSTALHVAVQRGFLEVVRALCERGCDVNLPDAHSDTPLHSAISAGTGASGIVEVLTEVPNIDVTATNSQGFTLLHHASLKGHALAVRKILARARQLVDAKKEDGFTALHLAALNNHREVAQILIREGRCDVNVRNRKLQSPLHLAVQQAHVGLVPLLVDAGCSVNAEDEEGDTALHVALQRHQLLPLVADGAGGDPGPLQLLSRLQASGLPGSAELTVGAAVACFLALEGADVSYTNHRGRSPLDLAAEGRVLKALQGCAQRFRERQAGGGAAPGPRQTLGTPNTVTNLHVGAAPGPEAAECLVCSELALLVLFSPCQHRTVCEECARRMKKCIRCQVVVSKKLRPDGSEVASAAPAPGPPRQLVEELQSRYRQMEERITCPICIDSHIRLVFQCGHGACAPCGSALSACPICRQPIRDRIQIFV

SEQ ID NO: 8533 - protein, 115 aa, Homo sapiens
MMLGTEGGEGFVVKVRGLPWSCSADEVQRFFSDCKIQNGAQGIRFIYTREGRPSGEAFVELESEDEVKLALKKDRETMGHRYVEVFKSNNVEMDWVLKHTGPNSPDTANDGFVRL

SEQ ID NO: 8534 - protein, 124 aa, Homo sapiens
MASVLSRRLGKRSLLGARVLGPSASEGPSAAPPSEPLLEGAAPQPFTTSDDTPCQEQPKEVLKAPSTSGLQQVAFQPGQKVYVWYGGQECTGLVEQHSWMEGQVTVWLLEQKLQVCCRVEEVWL

SEQ ID NO: 8535 - protein, 145 aa, Homo sapiens; identical to SEQ ID NO: 4967

SEQ ID NO: 8536 - protein, 112 aa, Homo sapiens
MDSELMHSIVGSYHKPPERVFVPSFTQNEPSQNCHPANLEVTSPKILHSPNSQALILALKTLQEKIHRLELERTQAEDNLNILSREAAQYKKALENETNERNLAHQELIKQK

SEQ ID NO: 8537 - protein, 114 aa, Homo sapiens
MPSAEAKLKKNRCANCFDCPGCMHTLSTRATSISTQLPDDPAKTTMKKAYYLACGFCRWTSRDVGMADKSVASGGWQEPENPHTQRMNKLIEYYQQLAQKEKVERDRKKLARRR

SEQ ID NO: 8538 - protein, 215 aa, Homo sapiens
MPGEATETVPATEQELPQSQAETGSGTASDSGESVPGIEEQDSTQTTTQKAWLVAAAEIDEEPVGKAKQSRSEKRARKAMSKLGLLQVTGVTRVTIWKSKNILFVITKLDVYKSPASDAYIVFGEAKIQDLSQQAQLAAAEKFRVQGEAVGNIQENTQTPTVQEESEEEEVDETGVEVKDVKLVMSQANVSRAKAVRALKNNSNDIVNAIMELTV

SEQ ID NO: 8539 - protein, 143 aa, Homo sapiens
MSATVVDAVNAAPLSGSKEMSLEEPKKMTREDWRKKKELEEQRKLGNAPAEVDEEGKDINPHIPQYISSVPWYIDPSKRPTLKHQRPQPEKQKQFSSSGEWYKRGVKENSIITKYRKGACENCGAMTHKKKDCFERPRRVGAK

SEQ ID NO: 8540 - protein, 188 aa, Homo sapiens
MASVLSRRLGKRSLLGARVLGPSASEGPSAAPPSEPLLEGAAPQPFTTSDDTPCQEQPKEVLKAPSTSGLQQVAFQPGQKVYVWYGGQECTGLVEQHSWMEGQVTVWLLEQKLQVCCRVEEVWLAELQGPCPQAPPLEPGAQALAYRPVSRNIDVPKRKSDAVEMDEMMAAMVLTSLSCSPVVQSPPG

SEQ ID NO: 8541 - protein, 28 aa, Homo sapiens
MMLGTEGGEGFVVKVRGLPWSCSADEVQ

SEQ ID NO: 8542 - protein, 28 aa, Homo sapiens
MDSELMHSIVGSYHKPPERVFVPSFTQN

SEQ ID NO: 8543 - protein, 357 aa, Homo sapiens; identical to SEQ ID NO: 6013

SEQ ID NO: 8544 - protein, 160 aa, Homo sapiens
MPSIKLQSSDGEIFEVDVEIAKQSVTIKTMLEDLGMDDEGDDDPVPLPNVNAAILKKVIQWCTHHKDDPPPPEDDENKEKRTDDIPVWDQEFLKVDQGTLFELILAANYLDIKGLLDVTCKTVANMIKGKTPEEIRKTFNIKNDFTEEEEAQVGSTQFCL

SEQ ID NO: 8545 - protein, 113 aa, Homo sapiens
MDSELMHSIVGSYHKPPERVFVPSFTQNEPSQNCHPANLEVTSPKILHSPNSQALILALKTLQEKIHRLELERTQAEDNLNILSREAAQYKKALENETNERNLAHQELIKQKK

SEQ ID NO: 8546 - protein, 102 aa, Homo sapiens
MASVLSRRLGKRSLLGARVLGPSASEGPSAAPPSEPLLEGAAPQPFTTSDDTPCQEQPKEVLKAPSTSGLQQVAFQPGQKVYVWYGGQECTGLVEQHSWMEG

SEQ ID NO: 8547 - protein, 163 aa, Homo sapiens; identical to SEQ ID NO: 5841

SEQ ID NO: 8548 - protein, 146 aa, Homo sapiens
MCPGNWLWASMTFMARFSRSSSRSPVRTRGTLEEMPTVQHPFLNVFELERLLYTGKTACNHADEVWPGLYLGDQDMANNRRELRRLGITHVLNASHSRWRGTPEAYEGLGIRYLGVEAHDSPAFDMSIHFQTAADFIHRALSQPGG

SEQ ID NO: 8549 - protein, 513 aa, Homo sapiens; identical to SEQ ID NO: 5771

SEQ ID NO: 8550 - protein, 145 aa, Homo sapiens
MAVSTGVKVPRNFRLLEELEEGQKGVGDGTVSWGLEDDEDMTLTRWTGMIIGPPRTNYENRIYSLKVECGPKYPEAPPSVRFVTKINMNGINNSSGMVDARSIPVLAKWQNSYSIKVVLQELRRLMMSKENMKLPQPPEGQTYNN

SEQ ID NO: 8551 - protein, 513 aa, Homo sapiens; identical to SEQ ID NO: 5771

SEQ ID NO: 8552 - protein, 18 aa, Homo sapiens
MPSIKLQSSDGEIFEVDV

SEQ ID NO: 8553 - protein, 644 aa, Homo sapiens
  MOD_RES (643)..(643): Selenocysteine
VASEGSVRRPSGPVPAPQPPAFRFVSRPGRARSESETLERSPPQSPGPGKAGDAPNRRSGHVRGARVLSPPGRRARLSSPGPSRSSEAREELRRHLVGLIERSRVVIFSKSYCPHSTRVKELFSSLGVECNVLELDQVDDGARVQEVLSEITNQKTVPNIFVNKVHVGGCDQTFQAYQSGLLQKLLQEDLAYDYDLIIIGGGSGGLSCAKEAAILGKKVMVLDFVVPSPQGTSWGLGGTCVNVGCIPKKLMHQAALLGQALCDSRKFGWEYNQQVRHNWETMTKAIQNHISSLNWGYRLSLREKAVAYVNSYGEFVEHHKIKATNKKGQETYYTAAQFVIATGERPRYLGIQGDKEYCITSDDLFSLPYCPGKTLVVGASYVALECAGFLAGFGLDVTVMVRSILLRGFDQEMAEKVGSYMEQHGVKFLRKFIPVMVQQLEKGSPGKLKVLAKSTEGTETIEGVYNTVLLAIGRDSCTRKIGLEKIGVKINEKSGKIPVNDVEQTNVPYVYAVGDILEDKPELTPVAIQSGKLLAQRLFGASLEKIYHTLFWPLEWTVAGRENNTCYAKIICNKFDHDRVIGFHILGPNAGEVTQGFAAAMKCGLTKQLLDDTIGIHPTCGEVFTTLEITKSSGLDITQKGCCG

SEQ ID NO: 8554 - protein, 445 aa, Homo sapiens
MNKGISSIPINLRVYSPHVLNLTLIDLPGITKVPVGDQPPDIEYQIREMIMQFITRENCLILAVTPANTDLANSDALKLAKEVDPQGLRTIGVITKLDLMDEGTDARDVLENKLLPLRRGYVGVVNRSQKDIDGKKDIKAAMLAERKFFLSHPAYRHIADRMGTPHLQKVLNQQLTNHIRDTLPNFRNKLQGQLLSIEHEVEAYKNFKPEDPTRKTKALLQMVQQFAVDFEKRIEGSGDQVDTLELSGGAKINRIFHERFPFEIVKMEFNEKELRREISYAIKNIHGIRTGLFTPDMAFEAIVKKQIVKLKGPSLKSVDLVIQELINTVKKCTKKLANFPRLCEETERIVANHIREREGKTKDQVLLLIDIQVSYINTNHEDFIGFANAQQRSSQVHKKTTVGNQVIRKGWLTISNIGIMKGGSKGYWFVLTAESLSWYKDDEEK

SEQ ID NO: 8555 - protein, 519 aa, Homo sapiens
MLQLMDSGITICLRNGAASVFKKKEWSTQGEENKQDSKLKKLSEDSLTKQPEEVFDVLEKLGEGSYGSVFKAIHKESGQVVAIKQVPVESDLQEIIKEISIMQQCDSPYVVKYYGSYFKNTDLWIVMEYCGAGSVSDIIRLRNKTLIEDEIATILKSTLKGLEYLHFMRKIHRDIKAGNILLNTEGHAKLADFGVAGQLTDTMAKRNTVIGTPFWMAPEVIQEIGYNCVADIWSLGITSIEMAEGKPPYADIHPMRAIFMIPTNPPPTFRKPELWSDDFTDFVKKCLVKNPEQRATATQLLQHPFIKNAKPVSILRDLITEAMEIKAKRHEEQQRELEEEEENSDEDELDSHTMVKTSVESVGTMRATSTMSEGAQTMIEHNSTMLESDLGTMVINSEDEEEEDGTMKRNATSPQVQRPSFMDYFDKQDFKNKSHENCNQNMHEPFPMSKNVFPDNWKVPQDGDFDFLKNLSLEELQMRLKALDPMMEREIEELRQRYTAKRQPILDAMDAKKRRQQNF

SEQ ID NO: 8556 - protein, 463 aa, Homo sapiens
MKIMDSELMHSIVGSYHKPPERVFVPSFTQNEPSQNCHPANLEVTSPKILHSPNSQALILALKTLQEKIHRLELERTQAEDNLNILSREAAQYKKALENETNERNLAHQELIKQKKDISIQLSSAQSRCTLLEKQLEYTKRMVLNVEREKNMILEQQAQLQREKEQDQMKLYAKLEKLDVLEKECFRLTTTQKTAEDKIKHLEEKLKEEEHQRKLFQDKASELQTGLEISKIIMSSVSNLKHSKEKKKSSKKTKCIKRRPPWQICSKFGALPFVAEKMRQHRDPHILQKPFNVTETRCLPKPSRTTSWCKAIPPDSEKSISICDNLSELLMAMQDELDQMSMEHQELLKQMKETESHSVCDDIECELECLLKKMEIKGEQISKLKKHQDSVCKLQQKVQNSKMSEASGIQQEDSYPKGSKNIKNSPRKCLTDTNLFQKNSSFHPIRVHNLQMKLRRDDIMWEQ

SEQ ID NO: 8557 - protein, 349 aa, Homo sapiens; identical to SEQ ID NO: 4816

SEQ ID NO: 8558 - protein, 211 aa, Homo sapiens; identical to SEQ ID NO: 4845

SEQ ID NO: 8559 - protein, 145 aa, Homo sapiens
MIPIWKQQARPGDGPVIWDYHVVLLHVSSGGQNFIYDLDTVLPFPCLFDTYVEDAFKSDDDIHPQFRRKFRVIRADSYLKNFASDRSHMKDSSGNWREPPPPYPCIETGDSKMNLNDFISMDPKVGWGAVYTLSEFTHRFGSKNC

SEQ ID NO: 8560 - protein, 85 aa, Homo sapiens
MSDKSDLKAELERKKQRLAQIREEKKRKEEERKKKEADMQQKKEPVQDDSDLDRKRRETEALLQSIGISPEPPLVPTPMSPSSKS

SEQ ID NO: 8561 - protein, 195 aa, Homo sapiens
MDSELMHSIVGSYHKPPERVFVPSFTQNEPSQNCHPANLEVTSPKILHSPNSQALILALKTLQEKIHRLELERTQAEDNLNILSREAAQYKKALENETNERNLAHQELIKQKKDISIQLSSAQSRCTLLEKQLEYTKRMVLNVEREKNMILEQQAQLQREKEQDQMKLYAKLEKLDVLEKECFRLTTTQKTAEDK

SEQ ID NO: 8562 - protein, 423 aa, Homo sapiens; identical to SEQ ID NO: 6251

SEQ ID NO: 8563 - protein, 698 aa, Homo sapiens
  MOD_RES (697)..(697): Selenocysteine
GVGGRGERLPRGFARVVRVASEGSVRRPSGPVPAPQPPAFRFVSRPGRARSESETLERSPPQSPGPGKAGDAPNRRSGHVRGARVLSPPGRRARLSSPGPSRSSEAREELRRHLVGLIERSRVVIFSKSYCPHSTRVKELFSSLGVECNVLELDQVDDGARVQEVLSEITNQKTVPNIFVNKVHVGGCDQTFQAYQSGLLQKLLQEDLAYDYDLIIIGGGSGGLSCAKEAAILGKKVMVLDFVVPSPQGTSWGLGGTCVNVGCIPKKLMHQAALLGQALCDSRKFGWEYNQQVRHNWETMTKAIQNHISSLNWGYRLSLREKAVAYVNSYGEFVEHHKIKATNKKGQETYYTAAQFVIATGERPRYLGIQGDKEYCITSDDLFSLPYCPGKTLVVGASYVALECAGFLAGFGLDVTVMVRSILLRGFDQEMAEKVGSYMEQHGVKFLRKFIPVMVQQLEKGSPGKLKVLAKSTEGTETIEGVYNTVLLAIGRDSCTRKIGLEKIGVKINEKSGKIPVNDVEQTNVPYVYAVGDILEDKPELTPVAIQSGKLLAQRLFGASLEKCDYINVPTTVFTPLEYGCCGLSEEKAIEVYKKENLEIYHTLFWPLEWTVAGRENNTCYAKIICNKFDHDRVIGFHILGPNAGEVTQGFAAAMKCGLTKQLLDDTIGIHPTCGEVFTTLEITKSSGLDITQKGCCG

SEQ ID NO: 8564 - protein, 202 aa, Homo sapiens
MTGSNSHITILTLKVLPHFESLGKQEKIPNKMSAFRNHCPHLDSVGEITKEDLIQKSLGTCQDCKVQGPNLWACLENRCSYVGCGESQVDHSTIHSQETKHYLTVNLTTLRVWCYACSKEVFLDRKLGTQPSLPHVRQPHQIQENSVQDFKIPSNTTLKTPLVAVFDDLDIEADEEDELRARGLTGLKNIGNTCYMNAALQA

SEQ ID NO: 8565 - protein, 480 aa, Homo sapiens; identical to SEQ ID NO: 8061

SEQ ID NO: 8566 - protein, 102 aa, Homo sapiens; identical to SEQ ID NO: 6784

SEQ ID NO: 8567 - protein, 105 aa, Homo sapiens
MSQSGAVSCCPGATNGSLGRSDGVAKMSPKDLFEQRKKYSNSNVIMHETSQYHVQHLATFIMDKSEAITSVDDAIRKLVQLSSKEKIWTQEMLLQVNDQSLRLLD

SEQ ID NO: 8568 - protein, 73 aa, Homo sapiens
MSAFRNHCPHLDSVGEITKEDLIQKSLGTCQDCKVQGPNLWACLENRCSYVGCGESQVDHSTIHSQETKHYLT

SEQ ID NO: 8569 - protein, 91 aa, Homo sapiens
MAMTVVTKEKNKKVPTIFLSKKPREKEVDSKSQVIEGISRLICSAKQQQTMLRVSIDGVEWSDIKFFQLAAQWPTHVKHFPVGLFSGSKAT

SEQ ID NO: 8570 - protein, 844 aa, Homo sapiens
MFWKFDLHSSSHIDTLLEREDVTLKELMDEEDVLQECKAQNRKLIEFLLKAECLEDLVSFIIEEPPQDMDEKIRYKYPNISCELLTSDVSQMNDRLGEDESLLMKLYSFLLNDSPLNPLLASFFSKVLSILISRKPEQIVDFLKKKHDFVDLIIKHIGTSAIMDLLLRLLTCIEPPQPRQDVLNWLNEEKIIQRLVEIVHPSQEEDRHSNASQSLCEIVRLSRDQMLQIQNSTEPDPLLATLEKQEIIEQLLSNIFHKEKNESAIVSAIQILLTLLETRRPTFEGHIEICPPGMSHSACSVNKSVLEAIRGRLGSFHELLLEPPKKSVMKTTWGVLDPPVGNTRLNVIRLISSLLQTNTSSINGDLMELNSIGVILNMFFKYTWNNFLHTQVEICIALILASPFENTENATITDQDSTGDNLLLKHLFQKCQLIERILEAWEMNEKKQAEGGRRHGYMGHLTRIANCIVHSTDKGPNSALVQQLIKDLPDEVRERWETFCTSSLGETNKRNTVDLAFSDYQMQQMTSNFIDQFGFNDEKFADQDDIGNVSFDRVSDINFTLNTNESGNIALFEACCKERIQQFDDGGSDEEDIWEEKHIAFTPESQRRSSSGSTDSEESTDSEEEDGAKQDLFEPSSANTEDKMEVDLSEPPNWSANFDVPMETTHGAPLDSVGSDVWSTEEPMPTKETGWASFSEFTSSLSTKDSLRSNSPVEMETSTEPMDPLTPSAAALAVQPEAAGSVAMEASSDGEEDAESTDKVTETVMNGGMKETLSLTVDAKTETAVFKSEEGKLSTSQDAACKDAEECPETAEAKCAAPRPPSSSPEQRTGQPSAPGDTSVNGPV

SEQ ID NO: 8571 - protein, 867 aa, Homo sapiens
MFWKFDLHSSSHIDTLLEREDVTLKELMDEEDVLQECKAQNRKLIEFLLKAECLEDLVSFIIEEPPQDMDEKIRYKYPNISCELLTSDVSQMNDRLGEDESLLMKLYSFLLNDSPLNPLLASFFSKVLSILISRKPEQIVDFLKKKHDFVDLIIKHIGTSAIMDLLLRLLTCIEPPQPRQDVLNWLNEEKIIQRLVEIVHPSQEEDRHSNASQSLCEIVRLSRDQMLQIQNSTEPDPLLATLEKQEIIEQLLSNIFHKEKNESAIVSAIQILLTLLETRRPTFEGHIEICPPGMSHSACSVNKSVLEAIRGRLGSFHELLLEPPKKSVMKTTWGVLDPPVGNTRLNVIRLISSLLQTNTSSINGDLMELNSIGVILNMFFKYTWNNFLHTQVEICIALILASPFENTENATITDQDSTGDNLLLKHLFQKCQLIERILEAWEMNEKKQAEGGRRHGYMGHLTRIANCIVHSTDKGPNSALVQQLIKDLPDEVRERWETFCTSSLGETNKRNTVDLVTTCHIHSSSDDEIDFKETGFSQDSSLQQMQQMTSNFIDQFGFNDEKFADQDDIGNVSFDRVSDINFTLNTNESGNIALFEACCKERIQQFDDGGSDEEDIWEEKHIAFTPESQRRSSSGSTDSEESTDSEEEDGAKQDLFEPSSANTEDKMEVDLSEPPNWSANFDVPMETTHGAPLDSVGSDVWSTEEPMPTKETGWASFSEFTSSLSTKDSLRSNSPVEMETSTEPMDPLTPSAAALAVQPEAAGSVAMEASSDGEEDAESTDKVTETVMNGGMKETLSLTVDAKTETAVFKSEEGKLSTSQDAACKDAEECPETAEAKCAAPRPPSSSPEQRTGQPSAPGDTSVNGPV

SEQ ID NO: 8572 - protein, 57 aa, Homo sapiens
MTSKKLVNSVAGCADDALAGLVACNPNLQLLQGHRVALRSDLDSLKGRVALLSGGGS

SEQ ID NO: 8573 - protein, 902 aa, Homo sapiens; identical to SEQ ID NO: 5184

SEQ ID NO: 8574 - protein, 178 aa, Homo sapiens
MNRRRKFLLASVLALQNSSFIYPSCQKCFSRIILVSKRSNCPKCGSTGESGNANYRYKLSLKVAESNKLFVITVFGSCLDTFFGLTATGLHRYIQDPNKIPETLDNDTTQNLLTKAVETCFVGQSFIFGVTNFENQPGQGSDASNFLQQCSDHKRKAKALVACQIVLPDPATQDAKTK

SEQ ID NO: 8575 - protein, 146 aa, Homo sapiens
MVAMAEAEAGVAVEVRGLPPAVPDELLTLYFENRRRSGGGPVLSWQRLGCGGVLTFREPADAERVLAQADHELHGAQLSLRPAPPRAPARLLLQGLPPGTTPQRLEQHVQALLRASGLPVQPCCALASPRPDRALVQLPKPLSEAG

SEQ ID NO: 8576 - protein, 115 aa, Homo sapiens
MAGRPLRIGDQLVLEEDYDETYIPSEQEILEFAREIGIDPIKEPELMWLAREGIVAPLPGEWKPCQDITGDIYYFNFANGQSMWDHPCDEHYRSLVIQERAKLSTSGAIKKKKKK

SEQ ID NO: 8577 - protein, 396 aa, Homo sapiens
MRTSYTVTLPEDPPAAPFPALAKELRPRSPLSPSLLLSTFVGLLLNKAKNSKSAQGLAGLRNLGNTCFMNSILQCLSNTRELRDYCLQRLYMRDLHHGSNAHTALVEEFAKLIQTIWTSSPNDVVSPSEFKTQIQRYAPRFVGYNQQDAQEFLRFLLDGLHNEVNRVTLRPKSNPENLDHLPDDEKGRQMWRKYLEREDSRIGDLFVGQLKSSLTCTDCGYCSTVFDPFWDLSLPIAKRGYPEVTLMDCMRLFTKEDVLDGDEKPTCCRCRGRKRCIKKFSIQRFPKILVLHLKRFSESRIRTSKLTTFVNFPLRDLDLREFASENTNHAVYNLYAVSNHSGTTMGGHYTAYCRSPGTGEWHTFNDSSVTPMSSSQVRTSDAYLLFYELASPPSRM

SEQ ID NO: 8578 - protein, 210 aa, Homo sapiens; identical to SEQ ID NO: 6033

SEQ ID NO: 8579 - protein, 475 aa, Homo sapiens
MELWQAALSTLNPNPTDSCPLYLNYATVAALPCRVSRHNSPSAAHFITRLVRTCLPPGAHRCIVMVCEQPEVFASACALARAFPLFTHRSGASRRLEKKTVTVEFFLVGQDNGPVEVSTLQCLANATDGVRLAARIVDTPCNEMNTDTFLEEINKVGKELGIIPTIIRDEELKTRGFGGIYGVGKAALHPPALAVLSHTPDGATQTIAWVGKGIVYDTGGLSIKGKTTMPGMKRDCGGAAAVLGAFRAAIKQGFKDNLHAVFCLAENSVGPNATRPDDIHLLYSGKTVEINNTDAEGRLVLADGVSYACKDLGADIILDMATLTGAQGIATGKYHAAVLTNSAEWEAACVKAGRKCGDLVHPLVYCPELHFSEFTSAVADMKNSVADRDNSPSSCAGLFIASHIGFDWPGVWVHLDIAAPVHAGERATGFGVALLLALFGRASEDPLLNLVSPLGCEVDVEEGDLGRDSKRRRLV

SEQ ID NO: 8580 - protein, 178 aa, Homo sapiens
MVAMAEAEAGVAVEVRGLPPAVPDELLTLYFENRRRSGGGPVLSWQRLGCGGVLTFREPADAERVLAQADHELHGAQLSLRPAPPRAPARLLLQGLPPGTTPQRLEQHVQALLRASGLPVQPCCALASPRPDRALVQLPKPLSEADVRVLEEQAQNLGLEGTLVSLARVPQARAVRVV

SEQ ID NO: 8581 - protein, 630 aa, Homo sapiens
MEKVLGCELLKGLNVLDLGLNMEILEEQMLHEILCREYPELETRWQDLKIRALDTCKAVEAAEERLLTMLLFQNPKRQKPAKFLRNIVRAQGKLCQLRAHCEELEGQKLQEMVLWAPYRPVVWHGMAMVKALSQLQNLLPLFCMSPENWLAVTKQALDSMKPREINHGEDLASHLLQLRAHLTRQLLGSTVTALGLTQVPLVGALGALALLQATGKASELERLALWPGLAASPSTVHSKPVSDVARPAWLGPKAWHECEMLELLPPFVGLCASLAGHSSAWQAYLSLSSTVLGPAPGPGPEPLSLLQKLILWRVLRPECLAGALADFTTSLLGRPLDENTYAPTMPFKHSQATQPMLILLPPPGHPSATLHPLTVIQKLAAKYQQGQKQLQVIALGSEAWDPVSVVVSTLSQAMYEGHWLVLDNCHLMPHWPKELLQLLLELLGRAKVVADLESEQLLDQPESRNVSTVHRDFRLWLIVPAESSASLPAVLTQHSMPVFWNQSLELGHVLIDSVELAQQVLYMQPPTQALPLLLLHGLLLHRQLYGTRLQAHRGRWSQVTLTQVLQTQDQLWASLSNPRAAMQELAGETLPLPLGVISPQESLEEGGGGIQFTALVLAVVETEGTGTERL

SEQ ID NO: 8582 - protein, 495 aa, Homo sapiens
MELHGGNRGGYQPKALEQSGCWLWQAALSTLNPNPTDSCPLYLNYATVAALPCRVSRHNSPSAAHFITRLVRTCLPPGAHRCIVMVCEQPEVFASACALARAFPLFTHRSGASRRLEKKTVTVEFFLVGQDNGPVEVSTLQCLANATDGVRLAARIVDTPCNEMNTDTFLEEINKVGKELGIIPTIIRDEELKTRGFGGIYGVGKAALHPPALAVLSHTPDGATQTIAWVGKGIVYDTGGLSIKGKTTMPGMKRDCGGAAAVLGAFRAAIKQGFKDNLHAVFCLAENSVGPNATRPDDIHLLYSGKTVEINNTDAEGRLVLADGVSYACKDLGADIILDMATLTGAQGIATGKYHAAVLTNSAEWEAACVKAGRKCGDLVHPLVYCPELHFSEFTSAVADMKNSVADRDNSPSSCAGLFIASHIGFDWPGVWVHLDIAAPVHAGERATGFGVALLLALFGRASEDPLLNLVSPLGCEVDVEEGDLGRDSKRRRLV

SEQ ID NO: 8583 - protein, 205 aa, Homo sapiens
METDLNSQDRKDLDKFIKFFALKTVQVIVQARLGEKICTRSSSSPTGSDWFNLAIKDIPEVTHEAKKALAGQLPAVGRSMCVEISLKTSEGDSMELEIWCLEMNEKCDKEIKVSYTVYNRLSLLLKSLLAITRVTPAYRLSRKQGHEYVILYRIYFGEVQLSGLGEGFQTVRVGTVGTPVGTITLSCAYRINLAFMSTRQFERTP

SEQ ID NO: 8584 - protein, 38 aa, Homo sapiens
MAAFKLDFLPEMMVDHCSLNSSPVSKKMNGTLDHPDQP

SEQ ID NO: 8585 - protein, 517 aa, Homo sapiens; identical to SEQ ID NO: 5333

SEQ ID NO: 8586 - protein, 255 aa, Homo sapiens
MERSGQRVTTWDCDQGKHSDSAQKNERESIRQKLALGSFFDDGPGIYTSCSKSGKPSLSSRLQSGMNLQICFVNDSGSDKDSDADDSKTETSLDTPLSPMSKQSSSYSDRDTTEEESESLDDMDFLTRQKKLQAEAKMALAMAKPMAKMQVEVEKQNRKKSPVADLLPHMPHISECLMKRSLKPTDLRDMTIGQLQVIVNDLHSQIESLNEELVQLLLIRDELHTEQDAMLVDIEDLTRHAESQQKHMAEKMPAK

SEQ ID NO: 8587 - protein, 25 aa, Homo sapiens
MSQSGAVSCCPGATNGSLGRSDGVA

SEQ ID NO: 8588 - protein, 119 aa, Homo sapiens
MVLEGNPEVGSPRTSDLQHRGNKGSCVLSSPGEDAQPGEEPIKYGELIVLGCCEEGGEETEAQRGEVTGPRAHSCYNGCLASGDKGRRRSRLALSRRSHANGVKPDVMHHISTPLVSKA

SEQ ID NO: 8589 - protein, 115 aa, Homo sapiens; identical to SEQ ID NO: 8576

SEQ ID NO: 8590 - protein, 156 aa, Homo sapiens
MSSVQSQQEQLSQSDPSPSPNSCSSFELIDMDAGSLYEPVSPHWFYCKIIDSKETWIPFNSEDSQQLEEAYSSGKGCNGRVVPTDGGRYDVHLGERMRYAVYWDELASEVRRCTWFYKGDKDNKYVPYSESFSQVLEETYMLAVTLDEWKKKLESP

SEQ ID NO: 8591 - protein, 4753 aa, Homo sapiens; identical to SEQ ID NO: 4835

SEQ ID NO: 8592 - protein, 129 aa, Homo sapiens
MVAMAEAEAGVAVEVRGLPPAVPDELLTLYFENRRRSGGGPVLSWQRLGCGGVLTFREPADAERVLAQADHELHGAQLSLRPAPPRAPARLLLQGLPPGTTPQRLEQHVQALLRASGLPVQPCCALASP

SEQ ID NO: 8593 - protein, 288 aa, Homo sapiens
MEREPSASEAAPAAAALFAWGANSYGQLGLGHKEDVLLPQQLNDFCKPRSVRRITGGGGHSAVVTDGGDLFVCGLNKDGQLGLGHTEDIPYFTPCKSLFGCPIQQVACGWDFTIMLTENGQVLSCGSNSFGQLGVPHGPRRCVVPQAIELHKEKVVCIAAGLRHAVAATASGIVFQWGTGLASCGRRLCPGQTLPLFFTAKEPSRVTGLENSKAMCVLAGSDHSASLTDAGEVYVWGSNKHGQLANEAAFLPVPQKIEAHCFQNEKVTAIWSGWTHLVAQTGLLWLRA

SEQ ID NO: 8594 - protein, 123 aa, Homo sapiens
MNRRRKFLLASVLALQNSSFIYPSCQKCFSRIILVSKRSNCPKCGSTGESGNANYRYKLSLKVAESNKLFVITVFGSCLDTFFGLTATGLHRYIQDPNKIPETLDNDTTQNLLTKAVETCFVG

SEQ ID NO: 8595 - protein, 107 aa, Homo sapiens
MLRLYPGPMVTEAEGKGGPEMASLSSSVVPVSFISTLRESVLDPGVGGEGASDKQRSKLSLSHSMIPAAKIHTELCLPAFFSPAGTQRRFQQPQHHLTLSIIHTAAR

SEQ ID NO: 8596 - protein, 550 aa, Homo sapiens
METDLNSQDRKDLDKFIKFFALKTVQVIVQARLGEKICTRSSSSPTGSDWFNLAIKDIPEVTHEAKKALAGQLPAVGRSMCVEISLKTSEGDSMELEIWCLEMNEKCDKEIKVSYTVYNRLSLLLKSLLAITRVTPAYRLSRKQGHEYVILYRIYFGEVQLSGLGEGFQTVRVGTVGTPVGTITLSCAYRINLAFMSTRQFERTPPIMGIIIDHFVDRPYPSSSPMHPCNYRTAGEDTGVIYPSVEDSQEVCTTSFSTSPPSQCVFTVTKAHFQTPTPVVTDTLRVPMAGLAFSHQLSSSRLSYQPAALGVGSADLAYPVVFAAGLNATHPHQLMVPGKEGGVPLAPNQPVHGTQADQERLATCTPSDRTHCAATPSSSEDTETVSNSSEGRASPHDVLETIFVRKVGAFVNKPINQVTLTSLDIPFAMFAPKNLELEDTDPMVNPPDSPETESPLQGSLHSDGSSGGSSGNTHDDFVMIDFKPAFSKDDILPMDLGTFYREFQNPPQLSSLSIDIGAQSMAEDLDSLPEKLAVHEKNVREFDAFVETLQ

SEQ ID NO: 8597 - protein, 1367 aa, Homo sapiens
MGNSDSQYTLQGSKNHSNTITGAKQIPCSLKIRGIHAKEEKSLHGWGHGSNGAGYKSRSLARSCLSHFKSNQPYASRLGGPTCKVSRGVAYSTHRTNAPGKDFQGISAAFSTENGFHSVGHELADNHITSRDCNGHLLNCYGRNESIASTPPGEDRKSPRVLIKTLGKLDGCLRVEFHNGGNPSKVPAEDCSEPVQLLRYSPTLASETSPVPEARRGSSADSLPSHRPSPTDSRLRSSKGSSLSSESSWYDSPWGNAGELSEAEGSFLAPGMPDPSLHASFPPGDAKKPFNQSSSLSSLRELYKDANLGSLSPSGIRLSDEYMGTHASLSNRVSFASDIDVPSRVAHGDPIQYSSFTLPCRKPKAFVEDTAKKDSLKARMRRISDWTGSLSRKKRKLQEPRSKEGSDYFDSRSDGLNTDVQGSSQASAFLWSGGSTQILSQRSESTHAIGSDPLRQNIYENFMRELEMSRTNTENIETSTETAESSSESLSSLEQLDLLFEKEQGVVRKAGWLFFKPLVTVQKERKLELVARRKWKQYWVTLKGCTLLFYETYGKNSMDQSSAPRCALFAEDSIVQSVPEHPKKENVFCLSNSFGDVYLFQATSQTDLENWVTAVHSACASLFAKKHGKEDTLRLLKNQTKNLLQKIDMDSKMKKMAELQLSVVSDPKNRKAIENQIQQWEQNLEKFHMDLFRMRCYLASLQGGELPNPKSLLAAASRPSKLALGRLGILSVSSFHALVCSRDDSALRKRTLSLTQRGRNKKGIFSSLKGLDTLARKGKEKRPSITQVDELLHIYGSTVDGVPRDNAWEIQTYVHFQDNHGVTVGIKPEHRVEDILTLACKMRQLEPSHYGLQLRKLVDDNVEYCIPAPYEYMQQQVYDEIEVFPLNVYDVQLTKTGSVCDFGFAVTAQVDERQHLSRIFISDVLPDGLAYGEGLRKGNEIMTLNGEAVSDLDLKQMEALFSEKSVGLTLIARPPDTKATLCTSWSDSDLFSRDQKSLLPPPNQSQLLEEFLDNFKKNTANDFSNVPDITTGLKRSQTDGTLDQVSHREKMEQTFRSAEQITALCRSFNDSQANGMEGPRENQDPPPRSLARHLSDADRLRKVIQELVDTEKSYVKDLSCLFELYLEPLQNETFLTQDEMESLFGSLPEMLEFQKVFLETLEDGISASSDFNTLETPSQFRKLLFSLGGSFLYYADHFKLYSGFCANHIKVQKVLERAKTDKAFKAFLDARNPTKQHSSTLESYLIKPVQRVLKYPLLLKELVSLTDQESEEHYHLTEALKAMEKVASHINEMQKIYEDYGTVFDQLVAEQSGTEKEVTELSMGELLMHSTVSWLNPFLSLGKARKDLELTVFVFKRAVILVYKENC

SEQ ID NO: 8598 - protein, 14 aa, Homo sapiens
MNGTLDHPDQPDLD

SEQ ID NO: 8599 - protein, 172 aa, Homo sapiens
MVAMAEAEAGVAVEVRGLPPAVPDELLTLYFENRRRSGGGPVLSWQRLGCGGVLTFREPADAERVLAQADHELHGAQLSLRPAPPRAPARLLLQGLPPGTTPQRLEQHVQALLRASGLPVQPCCALASPRPDRALVQLPKPLSEADVRVLEEQAQNLGLEGTLVSLARVPQA

SEQ ID NO: 8600 - protein, 8 aa, Homo sapiens
MFWKFDLH

SEQ ID NO: 8601 - protein, 136 aa, Homo sapiens
MVAMAEAEAGVAVEVRGLPPAVPDELLTLYFENRRRSGGGPVLSWQRLGCGGVLTFREPADAERVLAQADHELHGAQLSLRPAPPRAPARLLLQGLPPGTTPQRLEQHVQALLRASGLPVQPCCALASPRPDRALV

SEQ ID NO: 8602 - protein, 1947 aa, Homo sapiens
GRPIDPREGPGRPPLDGRDHFGRPPVDIRENLVRPGIDHLGRRDHFGFNPEKPWGHRGDFDEREHRVLPVYGGPKGLHEERGRFRSGNYRFDPRSGPWNRGFGQEVHRDFDDRRRPWERQRDRDDRDFDFCREMNGNRLGRDRIQNTWVPPPHARVFDYFEGATSQRKGDNVPQVNGENTERHAQPPPIPVQNDPELYEKLTSSNEINKEKSDTVADIESEPVVESTETEGTPLTSLTAETRRQVKMGNSDSQYTLQGSKNHSNTITGAKQIPCSLKIRGIHAKEEKSLHGWGHGSNGAGYKSRSLARSCLSHFKSNQPYASRLGGPTCKVSRGVAYSTHRTNAPGKDFQGISAAFSTENGFHSVGHELADNHITSRDCNGHLLNCYGRNESIASTPPGEDRKSPRVLIKTLGKLDGCLRVEFHNGGNPSKVPAEDCSEPVQLLRYSPTLASETSPVPEARRGSSADSLPSHRPSPTDSRLRSSKGSSLSSESSWYDSPWGNAGELSEAEGSFLAPGMPDPSLHASFPPGDAKKPFNQSSSLSSLRELYKDANLGSLSPSGIRLSDEYMGTHASLSNRVSFASDIDVPSRVAHGDPIQYSSFTLPCRKPKAFVEDTAKKDSLKARMRRISDWTGSLSRKKRKLQEPRSKEGSDYFDSRSDGLNTDVQGSSQASAFLWSGGSTQILSQRSESTHAIGSDPLRQNIYENFMRELEMSRTNTENIETSTETAESSSESLSSLEQLDLLFEKEQGVVRKAGWLFFKPLVTVQKERKLELVARRKWKQYWVTLKGCTLLFYETYGKNSMDQSSAPRCALFAEDSIVQSVPEHPKKENVFCLSNSFGDVYLFQATSQTDLENWVTAVHSACASLFAKKHGKEDTLRLLKNQTKNLLQKIDMDSKMKKMAELQLSVVSDPKNRKAIENQIQQWEQNLEKFHMDLFRMRCYLASLQGGELPNPKSLLAAASRPSKLALGRLGILSVSSFHALVCSRDDSALRKRTLSLTQRGRNKKGIFSSLKGLDTLARKGKEKRPSITQVDELLHIYGSTVDGVPRDNAWEIQTYVHFQDNHGVTVGIKPEHRVEDILTLACKMRQLEPSHYGLQLRKLVDDNVEYCIPAPYEYMQQQVYDEIEVFPLNVYDVQLTKTGSVCDFGFAVTAQVDERQHLSRIFISDVLPDGLAYGEGLRKGNEIMTLNGEAVSDLDLKQMEALFSEKSVGLTLIARPPDTKATLCTSWSDSDLFSRDQKSLLPPPNQSQLLEEFLDNFKKNTANDFSNVPDITTGLKRSQTDGTLDQVSHREKMEQTFRSAEQITALCRSFNDSQANGMEGPRENQDPPPRSLARHLSDADRLRKVIQELVDTEKSYVKDLSCLFELYLEPLQNETFLTQDEMESLFGSLPEMLEFQKVFLETLEDGISASSDFNTLETPSQFRKLLFSLGGSFLYYADHFKLYSGFCANHIKVQKVLERAKTDKAFKAFLDARNPTKQHSSTLESYLIKPVQRVLKYPLLLKELVSLTDQESEEHYHLTEALKAMEKVASHINEMQKIYEDYGTVFDQLVAEQSGTEKEVTELSMGELLMHSTVSWLNPFLSLGKARKDLELTVFVFKRAVILVYKENCKLKKKLPSNSRPAHNSTDLDPFKFRWLIPISALQVRLGNPAGTENNSIWELIHTKSEIEGRPETIFQLCCSDSESKTNIVKVIRSILRENFRRHIKCELPLEKTCKDRLVPLKNRVPVSAKLASSRSLKVLKNSSSNEWTGETGKGTLLDSDEGSLSSGTQSSGCPTAEGRQDSKSTSPGKYPHPGLADFADNLIKESDILSDEDDDHRQTVKQGSPTKDIEIQFQRLRISEDPDVHPEAEQQPGPESGEGQKGGEQPKLVRGHFCPIKRKANSTKRDRGTLLKAQIRHQSLDSQSENATIDLNSVLEREFSVQSLTSVVSEECFYETESHGKS

SEQ ID NO: 8603 - protein, 97 aa, Homo sapiens
MEAADASRSNGSSPEARDARSPSGPSGSLENGTKADGKDAKTTNGHGGEAAEGKSLGSALKPGEGRSALFAGNEWRRPIIQFVESGDDKNSNYFSMD

SEQ ID NO: 8604 - protein, 38 aa, Homo sapiens
MEAADASRSNGSSPEARDARSPSGPSGSLENGTKADGK

SEQ ID NO: 8605 - protein, 484 aa, Homo sapiens
MAIGKRLATLPTKEQKTQRLISELSLLNHKLPARVWLPTAGFDHHVVRVPHTQAVVLNSKDKAPYLIYVEVLECENFDTTSVPARIPENRIRSTRSVENLPECGITHEQRAGSFSTVPNYDNDDEAWSVDDIGELQVELPEVHTNSCDNISQFSVDSITSQESKEPVFIAAGDIRRRLSEQLAHTPTAFKRDPEDPSAVALKEPWQEKVRRIREGSPYGHLPNWRLLSVIVKCGDDLRQELLAFQVLKQLQSIWEQERVPLWIKPYKILVISADSGMIEPVVNAVSIHQVKKQSQLSLLDYFLQEHGSYTTEAFLSAQRNFVQSCAGYCLVCYLLQVKDRHNGNILLDAEGHIIHIDFGFILSSSPRNLGFETSAFKLTTEFVDVMGGLDGDMFNYYKMLMLQGLIAARKHMDKVVQIVEIMQQGSQLPCFHGSSTIRNLKERFHMSMTEEQLQLLVEQMVDGSMRSITTKLYDGFQYLTNGIM

SEQ ID NO: 8606 - protein, 75 aa, Homo sapiens
MAIPITVLDCDLLLYGRGHRTLDRFKLDDVTDEYLMSMYGFPRQFIYYLVELLGANLSRPTQRSRAISPETQVLA

SEQ ID NO: 8607 - protein, 917 aa, Homo sapiens
MDGAAGPGDGPAREALQSLSQRLRVQEQEMELVKAALAEALRLLRLQVPPSSLQGSGTPAPPGDSLAAPPGLPPTCTPSLVSRGTQTETEVELKSSPGPPGLSNGPPAPQGASEEPSGTQSEGGGSSSSGAGSPGPPGILRPLQPPQRADTPRRNSSSSSSPSERPRQKLSRKAISSANLLVRSGSTESRGGKDPLSSPGGPGSRRSNYNLEGISVKMFLRGRPITMYIPSGIRSLEELPSGPPPETLSLDWVYGYRGRDSRSNLFVLRSGEVVYFIACVVVLYRPGGGPGGPGGGGQRHYRGHTDCVRCLAVHPDGVRVASGQTAGVDKDGKPLQPVVHIWDSETLLKLQEIGLGAFERGVGALAFSAADQGAFLCVVDDSNEHMLSVWDCSRGMKLAEIKSTNDSVLAVGFNPRDSSCIVTSGKSHVHFWNWSGGVGVPGNGTLTRKQGVFGKYKKPKFIPCFVFLPDGDILTGDSEGNILTWGRSPSDSKTPGRGGAKETYGIVAQAHAHEGSIFALCLRRDGTVLSGGGRDRRLVQWGPGLVALQEAEIPEHFGAVRAIAEGLGSELLVGTTKNALLRGDLAQGFSPVIQGHTDELWGLCTHPSQNRFLTCGHDRQLCLWDGESHALAWSIDLKETGLCADFHPSGAVVAVGLNTGRWLVLDTETREIVSDVIDGNEQLSVVRYSPDGLYLAIGSHDNVIYIYSVSSDGAKSSRFGRCMGHSSFITHLDWSKDGNFIMSNSGDYEILYWDVAGGCKQLKNRYESRDREWATYTCVLGFHVYVPVRSCQGAEPHVRGPRQPRDQRPIHARRLAPRLAGRQGRQHLPVASAGRWGRGAGARHALSNPLPVPRLLPRRLIAAWRDRLARRRGPAPPCPSLAQSPTTRGRLFPGLTSRHSRSRIFLEGANGAPAHTV

SEQ ID NO: 8608 - protein, 106 aa, Homo sapiens
MVAMAEAEAGVAVEVRGLPPAVPDELLTLYFENRRRSGGGPVLSWQRLGCGGVLTFREPADAERVLAQADHELHGAQLSLRPAPPRAPARLLLQGLPPGTTPQRLE

SEQ ID NO: 8609 - protein, 75 aa, Homo sapiens
MFWKFDLHSSSHIDTLLEREDVTLKELMDEEDVLQECKAQNRKLIEFLLKAECLEDLVSFIIEEPPQDMDEKIRY

SEQ ID NO: 8610 - protein, 424 aa, Homo sapiens; identical to SEQ ID NO: 7427

SEQ ID NO: 8611 - protein, 95 aa, Homo sapiens
MEAADASRSNGSSPEARDARSPSGPSGSLENGTKADGKDAKTTNGHGGEAAEGKSLGSALKPGEGRSALFAGNEWRRPIIQFVESGDDKNSNYFS

SEQ ID NO: 8612 - protein, 1047 aa, Homo sapiens
MAPRLQLEKAAWRWAETVRPEEVSQEHIETAYRIWLEPCIRGVCRRNCKGNPNCLVGIGEHIWLGEIDENSFHNIDDPNCERRKKNSFVGLTNLGATCYVNTFLQVWFLNLELRQALYLCPSTCSDYMLGDGIQEEKDYEPQTICEHLQYLFALLQNSNRRYIDPSGFVKALGLDTGQQQDAQEFSKLFMSLLEDTLSKQKNPDVRNIVQQQFCGEYAYVTVCNQCGRESKLLSKFYELELNIQGHKQLTDCISEFLKEEKLEGDNRYFCENCQSKQNATRKIRLLSLPCTLNLQLMRFVFDRQTGHKKKLNTYIGFSEILDMEPYVEHKGGSYVYELSAVLIHRGVSAYSGHYIAHVKDPQSGEWYKFNDEDIEKMEGKKLQLGIEEDLEPSKSQTRKPKCGKGTHCSRNAYMLVYRLQTQEKPNTTVQVPAFLQELVDRDNSKFEEWCIEMAEMRKQSVDKGKAKHEEVKELYQRLPAGAEPYEFVSLEWLQKWLDESTPTKPIDNHACLCSHDKLHPDKISIMKRISEYAADIFYSRYGGGPRLTVKALCKECVVERCRILRLKNQLNEDYKTVNNLLKAAVKGSDGFWVGKSSLRSWRQLALEQLDEQDGDAEQSNGKMNGSTLNKDESKEERKEEEELNFNEDILCPHAVFFFSKYIFLNSGELCISENERRLVSKEAWSKLQQYFPKAPEFPSYKECCSQCKILEREGEENEALHKMIANEQKTSLPNLFQDKNRPCLSNWPEDTDVLYIVSQFFVEEWRKFVRKPTRCSPVSSVGNSALLCPHGGLMFTFASMTKEDSKLIALIWPSEWQMIQKLFVVDHVIKITRIEVGDVNPSETQYISEPKLCPECREGLLCQQQRDLREYTQATIYVHKVVDNKKVMKDSAPELNVSSSETEEDKEEAKPDGEKDPDFNQSNGGTKRQKISHQNYIAYQKQVIRRSMRHRKVRGEKALLVSANQTLKELKIQIMHAFSVAPFDQNLSIDGKILSDDCATLGTLGVIPESVILLKADEPIADYAAMDDVMQVCMPEEGFKGTGLLGH

SEQ ID NO: 8613 - protein, 480 aa, Homo sapiens; identical to SEQ ID NO: 8061

SEQ ID NO: 8614 - protein, 791 aa, Homo sapiens
MFWKFDLHSSSHIDTLLEREDVTLKELMDEEDVLQECKAQNRKLIEFLLKAECLEDLVSFIIEEPPQDMDEKIRYKYPNISCELLTSDVSQMNDRLGEDESLLMKLYSFLLNDSPLNPLLASFFSKVLSILISRKPEQIVDFLKKKHDFVDLIIKHIGTSAIMDLLLRLLTCIEPPQPRQDVLNWLNEEKIIQRLVEIVHPSQEEDRHSNASQSLCEIVRLSRDQMLQIQNSTEPDPLLATLEKQEIIEQLLSNIFHKEKNESAIVSAIQILLTLLETRRPTFEGHIEICPPGMSHSACSVNKSVLEAIRGRLGSFHELLLEPPKNMFFKYTWNNFLHTQVEICIALILASPFENTENATITDQDSTGDNLLLKHLFQKCQLIERILEAWEMNEKKQAEGGRRHGYMGHLTRIANCIVHSTDKGPNSALVQQLIKDLPDEVRERWETFCTSSLGETNKRNTVDLAFSDYQMQQMTSNFIDQFGFNDEKFADQDDIGNVSFDRVSDINFTLNTNESGNIALFEACCKERIQQFDDGGSDEEDIWEEKHIAFTPESQRRSSSGSTDSEESTDSEEEDGAKQDLFEPSSANTEDKMEVDLSEPPNWSANFDVPMETTHGAPLDSVGSDVWSTEEPMPTKETGWASFSEFTSSLSTKDSLRSNSPVEMETSTEPMDPLTPSAAALAVQPEAAGSVAMEASSDGEEDAESTDKVTETVMNGGMKETLSLTVDAKTETAVFKSEEGKLSTSQDAACKDAEECPETAEAKCAAPRPPSSSPEQSGVEIPALPGQWSQQ

SEQ ID NO: 8615 - protein, 499 aa, Homo sapiens
MFGDASTSLVVPEKVKTPMKSSKTDLQGSASPSKVEGVHTPRQKRSTPLKERQLSKPLSERTNSSDSERSPDLGHSTQIPRKVVYDQLNQILVSDAALPENVILVNTTDWQGQYVAELLQDQRKPVVCTCSTVEVQAVLSALLTRIQRYCNCNSSMPRPVKVAAVGGQSYLSSILRFFVKSLANKTSDWLGYMRFLIIPLGSHPVAKYLGSVDSKYSSSFLDSGWRDLFSRSEPPVSEQLDVAGRVMQYVNGAATTHQLPVAEAMLTCRHKFPDEDSYQKFIPFIGVVKVGLVEDSPSTAGDGDDSPVVSLTVPSTSPPSSSGLSRDATATPPSSPSMSSALAIVGSPNSPYGDVIGLQVDYWLGHPGERRREGDKRDASSKNTLKSVFRSVQVSRLPHSGEAQLSGTMAMTVVTKEKNKKVPTIFLSKKPREKEVDSKSQVIEGISRLICSAKQQQTMLRVSIDGVEWSDIKFFQLAAQWPTHVKHFPVGLFSGSKAT

SEQ ID NO: 8616 - protein, 144 aa, Homo sapiens
MVAMAEAEAGVAVEVRGLPPAVPDELLTLYFENRRRSGGGPVLSWQRLGCGGVLTFREPADAERVLAQADHELHGAQLSLRPAPPRAPARLLLQGLPPGTTPQRLEQHVQALLRASGLPVQPCCALASPRPDRALVQLPKPLSE

SEQ ID NO: 8617 - protein, 170 aa, Homo sapiens; identical to SEQ ID NO: 5442

SEQ ID NO: 8618 - protein, 89 aa, Homo sapiens
MVAMAEAEAGVAVEVRGLPPAVPDELLTLYFENRRRSGGGPVLSWQRLGCGGVLTFREPADAERVLAQADHELHGAQLSLRPAPPRAPA

SEQ ID NO: 8619 - protein, 401 aa, Homo sapiens
MCVEISLKTSEGDSMELEIWCLEMNEKCDKEIKVSYTVYNRLSLLLKSLLAITRVTPAYRLSRKQGHEYVILYRIYFGEVQLSGLGEGFQTVRVGTVGTPVGTITLSCAYRINLAFMSTRQFERTPPIMGIIIDHFVDRPYPSSSPMHPCNYRTAGEDTGVIYPSVEDSQEVCTTSFSTSPPSQLMVPGKEGGVPLAPNQPVHGTQADQERLATCTPSDRTHCAATPSSSEDTETVSNSSEGRASPHDVLETIFVRKVGAFVNKPINQVTLTSLDIPFAMFAPKNLELEDTDPMVNPPDSPETESPLQGSLHSDGSSGGSSGNTHDDFVMIDFKPAFSKDDILPMDLGTFYREFQNPPQLSSLSIDIGAQSMAEDLDSLPEKLAVHEKNVREFDAFVETLQ

SEQ ID NO: 8620 - protein, 715 aa, Homo sapiens; identical to SEQ ID NO: 5405

SEQ ID NO: 8621 - protein, 111 aa, Homo sapiens
MTGSNSHITILTLKVLPHFESLGKQEKIPNKMSAFRNHCPHLDSVGEITKEDLIQKSLGTCQDCKVQGPNLWACLENRCSYVGCGESQVDHSTIHSQETKHYLTVNLTTLR

SEQ ID NO: 8622 - protein, 75 aa, Homo sapiens
MAGQEDPVQREIHQDWANREYIEIITSSIKKIADFLNSFDMSCRSRLATLNEKLTALERRIEYIEARVTKGETLT

SEQ ID NO: 8623 - protein, 115 aa, Homo sapiens; identical to SEQ ID NO: 5430

SEQ ID NO: 8624 - protein, 358 aa, Homo sapiens; identical to SEQ ID NO: 7035

SEQ ID NO: 8625 - protein, 1348 aa, Homo sapiens
MADTDLFMECEEEELEPWQKISDVIEDSVVEDYNSVDKTTTAGNPLVQQGGQPLILTQNPAPGLGTMVTQPVLRPVQVMQNANHVTSSPVASQPIFITTQGFPVRNVRPVQNAMNQVGIVLNVQQGQTVRPITLVPAPGTQFVKPTVGVPQVFSQMTPVRPGSTMPVRPTTNTFTTVIPATLTIRSTVPQSQSQQTKSTPSTSTTPTATQPTSLGQLAVQSPGQSNQTTNPKLVSIASFVTVKRPGVTGENSNEVAKLVNTLNTIPSLGQSPGPVVVSNNSSAHGSQRTSGPESSMKVTSSIPVFDLQDGGRKICPRCNAQFRVTEALRGHMCYCCPEMVEYQKKGKSLDSEPSVPSAAKPPSPEKTAPVASTPSSTPIPALSPPTKVPEPNENVGDAVQTKLIMLVDDFYYGRDGGKVAQLTNFPKVATSFRCPHCTKRLKNNIRFMNHMKHHVELDQQNGEVDGHTICQHCYRQFSTPFQLQCHLENVHSPYESTTKCKICEWAFESEPLFLQHMKDTHKPGEMPYVCQVCQYRSSLYSEVDVHFRMIHEDTRHLLCPYCLKVFKNGNAFQQHYMRHQKRNVYHCNKCRLQFLFAKDKIEHKLQHHKTFRKPKQLEGLKPGTKVTIRASRGQPRTVPVSSNDTPPSALQEAAPLTSSMDPLPVFLYPPVQRSIQKRAVRKMSVMGRQTCLECSFEIPDFPNHFPTYVHCSLCRYSTCCSRAYANHMINNHVPRKSPKYLALFKNSVSGIKLACTSCTFVTSVGDAMAKHLVFNPSHRSSSILPRGLTWIAHSRHGQTRDRVHDRNVKNMYPPPSFPTNKAATVKSAGATPAEPEELLTPLAPALPSPASTATPPPTPTHPQALALPPLATEGAECLNVDDQDEGSPVTQEPELASGGGGSGGVGKKEQLSVKKLRVVLFALCCNTEQAAEHFRNPQRRIRRWLRRFQASQGENLEGKYLSFEAEEKLAEWVLTQREQQLPVNEETLFQKATKIGRSLEGGFKISYEWAVRFMLRHHLTPHARRAVAHTLPKDVAENAGLFIDFVQRQIHNQDLPLSMIVAIDEISLFLDTEVLSSDDRKENALQTVGTGEPWCDVVLAILADGTVLPTLVFYRGQMDQPANMPDSILLEAKESGYSDDEIMELWSTRVWQKHTACQRSKGMLVMDCHRTHLSEEVLAMLSASSTLPAVVPAGCSSKIQPLDVCIKRTVKNFLHKKWKEQAREMADTACDSDVLLQLVLVWLGEVLGVIGDCPELVQRSFLVASVLPGPDGNINSPTRNADMQEELIASLEEQLKLSGEHSESSTPRPRSSPEETIEPESLHQLFEGESETESFYGFEEADLDLMEI

SEQ ID NO: 8626 - protein, 186 aa, Homo sapiens
MFWKFDLHSSSHIDTLLEREDVTLKELMDEEDVLQECKAQNRKLIEFLLKAECLEDLVSFIIEEPPQDMDEKIRYKYPNISCELLTSDVSQMNDRLGEDESLLMKLYSFLLNDSPLNPLLASFFSKVLSILISRKPEQIVDFLKKKHDFVDLIIKHIGTSAIMDLLLRLLTCIEPPQPRQDVLNWL

SEQ ID NO: 8627 - protein, 95 aa, Homo sapiens
MSQSGAVSCCPGATNGSLGRSDGVAKMSPKDLFEQRKKYSNSNVIMHETSQYHVQHLATFIMDKSEAITSVDDAIRKLVQLSSKEKIWTQEMLLQ

SEQ ID NO: 8628 - protein, 579 aa, Homo sapiens
MDDSKQESTTSKEEETNIISSIVPSTQDIYQRQNSSDVHKSLLPAVDETTCGHTHFQQMIDKYINEANLIPEKTDLQELEHIFPNLHHQLFKPLEPHPDFDLSSSSSGISPDNRDFYQRSDSSSESHCATGLSKSTVYFTALRRTSMHSSLNTSPNQQPDTNLAHVGAHSFATENIIGGSEQCFEQLQPEYSSQEESQHADLPSIFSIEARDSSQGMKNQNYPSEEHTEILQNKKKIVHFQLSIGNLSSVYSSSDEANVFDQLNVQHSTPCGSNSSECSTKHQLESRKESMGFEELSKRGVVTMLQSQGLIEDNKNETCRVLDINPQVEETDSRLCVRTVEMGTSIQAPYSLTTQNEKYFENSAETDIPKITKKLSQLGESELFASSGSFSLQSSIPVWETETGHGIMEEPELTLISTTDTSIAEMDFANLTLEEKSENEAKCFFQVSEFLPLVSATEASDYPAVSELSIEKPRTASTAETPRRLTPVPGSLQEAFIKRKKSFMERSHQRQKEIRNKIHVSENSQIKTVKEKPSISSSVSRLKGVNKVRASFPEDRKTTQALRHQRGLRLYNQLAEVKQ

SEQ ID NO: 8629 - protein, 144 aa, Homo sapiens; identical to SEQ ID NO: 8616

SEQ ID NO: 8630 - protein, 81 aa, Homo sapiens
MVAMAEAEAGVAVEVRGLPPAVPDELLTLYFENRRRSGGGPVLSWQRLGCGGVLTFREPADAERVLAQADHELHGAQLSLR

SEQ ID NO: 8631 - protein, 512 aa, Homo sapiens
MAAFKLDFLPEMMVDHCSLNSSPVSKKMNGTLDHPDQPDLDAIKMFVGQVPRTWSEKDLRELFEQYGAVYEINVLRDRSQNPPQSKGCCFVTFYTRKAALEAQNALHNMKVLPGMHHPIQMKPADSEKNNVEDRKLFIGMISKKCTENDIRVMFSSFGQIEECRILRGPDGLSRGCAFVTFTTRAMAQTAIKAMHQAQTMEGCSSPMVVKFADTQKDKEQKRMAQQLQQQMQQISAASVWGNLAGLNTLGPQYLALYLQLLQQTASSGNLNTLSSLHPMGGLNAMQLQNLAALAAAASAAQNTPSGTNALTTSSSPLSVLTSSGSSPSSSSSNSVNPIASLGALQTLAGATAGLNVGSLAGMAALNGGLGSSGLSNGTGSTMEALTQAYSGIQQYAAAALPTLYNQNLLTQQSIGAAGSQKEGPEGANLFIYHLPQEFGDQDLLQMFMPFGNVVSAKVFIDKQTNLSKCFGFVSYDNPVSAQAAIQSMNGFQIGMKRLKVQLKRSKNDSKPY

SEQ ID NO: 8632 - protein, 376 aa, Homo sapiens
MKDVPGFLQQSQNSGPGQPAVWHRLEELYTKKLWHQLTLQVLDFVQDPCFAQGDGLIKLYENFISEFEHRVNPLSLVEIILHVVRQMTDPNVALTFLEKTREKVKSSDEAVILCKTAIGALKLNIGDLQVTKETIEDVEEMLNNLPGVTSVHSRFYDLSSKYYQTIGNHASYYKDALRFLGCVDIKDLPVSEQQERAFTLGLAGLLGEGVFNFGELLMHPVLESLRNTDRQWLIDTLYAFNSGNVERFQTLKTAWGQQPDLAANEAQLLRKIQLLCLMEMTFTRPANHRQLTFEEIAKSAKITVNEVELLVMKALSVGLVKGSIDEVDKRVHMTWVQPRVLDLQQIKGMKDRLEFWCTDVKSMEMLVEHQAHDILT

SEQ ID NO: 8633 - protein, 162 aa, Homo sapiens
MTSKKLVNSVAGCADDALAGLVACNPNLQLLQGHRVALRSDLDSLKGRVALLSGGGSGHEPAHAGFIGKGMLTGVIAGAVFTSPAVGSILAAIRAVAQAGTVGTLLIVKNYTGDRLNFGLAREQARAEGIPVEMVVIGDDSAFTVLKKAGRRGLCGTVLIHK

SEQ ID NO: 8634 - protein, 2617 aa, Homo sapiens
MLTDSGGGGTSFEEDLDSVAPRSAPAGASEPPPPGGVGLGIRTVRLFGEAGPASGVGSSGGGGSGSGTGGGDAALDFKLAAAVLRTGGGGGASGSDEDEVSEVESFILDQEDLDNPVLKTTSEIFLSSTAEGADLRTVDPETQARLEALLEAAGIGKLSTADGKAFADPEVLRRLTSSVSCALDEAAAALTRMKAENSHNAGQVDTRSLAEACSDGDVNAVRKLLDEGRSVNEHTEEGESLLCLACSAGYYELAQVLLAMHANVEDRGNKGDITPLMAASSGGYLDIVKLLLLHDADVNSQSATGNTALTYACAGGFVDIVKVLLNEGANIEDHNENGHTPLMEAASAGHVEVARVLLDHGAGINTHSNEFKESALTLACYKGHLDMVRFLLEAGADQEHKTDEMHTALMEACMDGHVEVARLLLDSGAQVNMPADSFESPLTLAACGGHVELAALLIERGANLEEVNDEGYTPLMEAAREGHEEMVALLLAQGANINAQTEETQETALTLACCGGFSEVADFLIKAGADIELGCSTPLMEASQEGHLELVKYLLASGANVHATTATGDTALTYACENGHTDVADVLLQAGADLEHESEGGRTPLMKAARAGHLCTVQFLISKGANVNRATANNDHTVVSLACAGGHLAVVELLLAHGADPTHRLKDGSTMLIEAAKGGHTNVVSYLLDYPNNVLSVPTTDVSQLPPPSQDQSQVPRVPTHTLAMVVPPQEPDRTSQENSPALLGVQKGTSKQKSSSLQVADQDLLPSFHPYQPLECIVEETEGKLNELGQRISAIEKAQLKSLELIQGEPLNKDKIEELKKNREEQVQKKKKILKELQKVERQLQMKTQQQFTKEYLETKGQKDTVSLHQQCSHRGVFPEGEGDGSLPEDHFSELPQVDTILFKDNDVDDEQQSPPSAEQIDFVPVQPLSSPQCNFSSDLGSNGTNSLELQKVSGNQQIVGQPQIAITGHDQGLLVQEPDGLMVATPAQTLTDTLDDLIAAVSTRVPTGSNSSSQTTECLTPESCSQTTSNVASQSMPPVYPSVDIDAHTESNHDTALTLACAGGHEELVSVLIARDAKIEHRDKKGFTPLILAATAGHVGVVEILLDKGGDIEAQSERTKDTPLSLACSGGRQEVVDLLLARGANKEHRNVSDYTPLSLAASGGYVNIIKILLNAGAEINSRTGSKLGISPLMLAAMNGHVPAVKLLLDMGSDINAQIETNRNTALTLACFQGRAEVVSLLLDRKANVEHRAKTGLTPLMEAASGGYAEVGRVLLDKGADVNAPPVPSSRDTALTIAADKGHYKFCELLIHRGAHIDVRNKKGNTPLWLASNGGHFDVVQLLVQAGADVDAADNRKITPLMSAFRKGHVKVVQYLVKEVNQFPSDIECMRYIATITDKELLKKCHQCVETIVKAKDQQAAEANKNASILLKELDLEKSREESRKQALAAKREKRKEKRKKKKEEQKRKQEEDEENKPKENSELPEDEDEEENDEDVEQEVPIEPPSATTTTTIGISATSATFTNVFGKKRANVVTTPSTNRKNKKNKTKETPPTAHLILPEQHMSLAQQKADKNKINGEPRGGGAGGNSDSDNLDSTDCNSESSSGGKSQELNFVMDVNSSKYPSLLLHSQEEKTSTATSKTQTRLEGEVTPNSLSTSYKTVSLPLSSPNIKLNLTSPKRGQKREEGWKEVVRRSKKLSVPASVVSRIMGRGGCNITAIQDVTGAHIDVDKQKDKNGERMITIRGGTESTRYAVQLINALIQDPAKELEDLIPKNHIRTPASTKSIHANFSSGVGTTAASSKNAFPLGAPTLVTSQATTLSTFQPANKLNKNVPTNVRSSFPVSLPLAYPHPHFALLAAQTMQQIRHPRLPMAQFGGTFSPSPNTWGPFPVRPVNPGNTNSSPKHNNTSRLPNQNGTVLPSESAGLATASCPITVSSVVAASQQLCVTNTRTPSSVRKQLFACVPKTSPPATVISSVTSTCSSLPSVSSAPITSGQAPTTFLPASTSQAQLSSQKMESFSAVPPTKEKVSTQDQPMANLCTPSSTANSCSSSASNTPGAPETHPSSSPTPTSSNTQEEAQPSSVSDLSPMSMPFASNSEPAPLTLTSPRMVAADNQDTSNLPQLAVPAPRVSHRMQPRGSFYSMVPNATIHQDPQSIFVTNPVTLTPPQGPPAAVQLSSAVNIMNGSQMHINPANKSLPPTFGPATLFNHFSSLFDSSQVPANQGWGDGPLSSRVATDASFTVQSAFLGNSVLGHLENMHPDNSKAPGFRPPSQRVSTSPVGLPSIDPSGSSPSSSSAPLASFSGIPGTRVFLQGPAPVGTPSFNRQHFSPHPWTSASNSSTSAPPTLGQPKGVSASQDRKIPPPIGTERLARIRQGGSVAQAPAGTSFVAPVGHSGIWSFGVNAVSEGLSGWSQSVMGNHPMHQQLSDPSTFSQHQPMERDDSGMVAPSNIFHQPMASGFVDFSKGLPISMYGGTIIPSHPQLADVPGGPLFNGLHNPDPAWNPMIKVIQNSTECTDAQQASLLPSVPALKGEIPSPQLTRPKKRIGRPMVASPNQRHQDHLRPKVPAGVQELTHCPDTPLLPPSDSRGHNSSNSPSLQAGGAEGAGDRGRDTR

SEQ ID NO: 8635 - protein, 250 aa, Homo sapiens
MGDIPAVGLSSWKASPGKVTEAVKEAIDAGYRHFDCAYFYHNEREVGAGIRCKIKEGAVRREDLFIATKLWCTCHKKSLVETACRKSLKALKLNYLDLYLIHWPMGFKPPHPEWIMSCSELSFCLSHPRVQDLPLDESNMVIPSDTDFLDTWEAMEDLVITGLVKNIGVSNFNHEQLERLLNKPGLRFKPLTNQILIRFQIQRNVIVIPGSITPSHIKENIQVFDFELTQHDMDNILSLNRNLRLAMFPM

SEQ ID NO: 8636 - protein, 174 aa, Homo sapiens
MLTENGQVLSCGSNSFGQLGVPHGPRRCVVPQAIELHKEKVVCIAAGLRHAVAATASGIVFQWGTGLASCGRRLCPGQTLPLFFTAKEPSRVTGLENSKAMCVLAGSDHSASLTDAGEVYVWGSNKHGQLANEAAFLPVPQKIEAHCFQNEKVTAIWSGWTHLVAQTGLLWLRA

SEQ ID NO: 8637 - protein, 75 aa, Homo sapiens
MNRRRKFLLASVLALQNSSFIYPSCQKCFSRIILVSKRSNCPKCGSTGESGNANYRYKLSLKVAESNKLFVITVF

SEQ ID NO: 8638 - protein, 83 aa, Homo sapiens
MVAMAEAEAGVAVEVRGLPPAVPDELLTLYFENRRRSGGGPVLSWQRLGCGGVLTFREPADAERVLAQADHELHGAQLSLRPA

SEQ ID NO: 8639 - protein, 175 aa, Homo sapiens
MLSEEEKEELKAELVQLEDEITTLRQVLSAKERHLVEIKQKLGMNLMNELKQNFSKSWHDMQTTTAYKKTHETLSHAGQKATAAFSNVGTAISKKFGDMSYSIRHSISMPAMRNSPTFKSFEERVETTVTSLKTKVGGTNPNGGSFEEVLSSTAHASAQSLAGGSRRTKEEELQC

SEQ ID NO: 8640 - protein, 76 aa, Homo sapiens
MNRRRKFLLASVLALQNSSFIYPSCQKCFSRIILVSKRSNCPKCGSTGESGNANYRYKLSLKVAESNKLFVITVFG

SEQ ID NO: 8641 - protein, 151 aa, Homo sapiens; identical to SEQ ID NO: 4740

SEQ ID NO: 8642 - protein, 89 aa, Homo sapiens
MEAADASRSNGSSPEARDARSPSGPSGSLENGTKADGKDAKTTNGHGGEAAEGKSLGSALKPGEGRSALFAGNEWRRPIIQFVESGDDK

SEQ ID NO: 8643 - protein, 513 aa, Homo sapiens
MEVGITIQHAYEKQHPWIDLTSIGFSYVIDFNTMGQINRQTQRQRRVRRRLDLIYPMVTGTLPKAQSWPVSPGPATSPPMSPCSCPQCVLVMSVKAAVVNGSTGPLQLPVTRKNMPPPGVVKLPPLPGSGAKPLDSTGTIRGPLKTAPSQVIRRQASSMPTGTTMGSPASPPGPNSKTGRVALATLNRTNLQRLAIAQSRVLIASGVPTVPVKNLNGSSPVNPALAGITGILMSAAGLPVCLTRPPKLVLHPPPVSKSEIKSIPGVSNTSRKTTKKQAKKGKTPEEVLKKYLQKVRHPPDEDCTICMERLTAPSGYKGPQPTVKPDLVGKLSRCGHVYHIYCLVAMYNNGNKDGSLQCPTCKTIYGVKTGTQPPGKMEYHLIPHSLPGHPDCKTIRIIYSIPPGIQGPEHPNPGKSFSARGFPRHCYLPDSEKGRKVLKLLLVAWDRRLIFAIGTSSTTGESDTVIWNEVHHKTEFGSNLTGHGYPDANYLDNVLAELAAQGISEDSTAQEKD

SEQ ID NO: 8644 - protein, 137 aa, Homo sapiens
MSSVQSQQEQLSQSDPSPSPNSCSSFELIDMDAGSLYEPVSPHWFYCKIIDSKETWIPFNSEDSQQLEEAYSSGKGCNGRVVPTDGGRYDVHLGERMRYAVYWDELASEVRRCTWFYKGDKDNKYVPYSESFSQVLE

SEQ ID NO: 8645 - protein, 39 aa, Homo sapiens
MFWKFDLHSSSHIDTLLEREDVTLKELMDEEDVLQECKA

SEQ ID NO: 8646 - protein, 718 aa, Homo sapiens
MLMTLEMTELTDPHHTMGDYKVAHPQDPHHPSEKPVIHCHKCGEPCKGEVLRVQTKHFHIKCFTCKVCGCDLAQGGFFIKNGEYLCTLDYQRMYGTRCHGCGEFVEGEVVTALGKTYHPNCFACTICKRPFPPGDRVTFNGRDCLCQLCAQPMSSSPKETTFSSNCAGCGRDIKNGQALLALDKQWHLGCFKCKSCGKVLTGEYISKDGAPYCEKDYQGLFGVKCEACHQFITGKVLEAGDKHYHPSCARCSRCNQMFTEGEEMYLQGSTVWHPDCKQSTKTEEKLRPTRTSSESIYSRPGSSIPGSPGHTIYAKVDNEILDYKDLAAIPKVKAIYDIERPDLITYEPFYTSGYDDKQERQSLGESPRTLSPTPSAEGYQDVRDRMIHRSTSQGSINSPVYSRHSYTPTTSRSPQHFHRPGNEPSSGRNSPLPYRPDSRPLTPTYAQAPKHFHVPDQGINIYRKPPIYKQHAALAAQSKSSEDIIKFSKFPAAQAPDPSETPKIETDHWPGPPSFAVVGPDMKRRSSGREEDDEELLRRRQLQEEQLMKLNSGLGQLILKEEMEKESRERSSLLASRYDSPINSASHIPSSKTASLPGYGRNGLHRPVSTDFAQYNSYGDVSGGVRDFQTLPDGHMPAMRMDRGVSMPNMLEPKIFPYEMLMVTNRGRNKILREVDRTRLERHLAPEVFREIFGMSIQEFDRLPLWRRNDMKKKAKLF

SEQ ID NO: 8647 - protein, 715 aa, Homo sapiens; identical to SEQ ID NO: 5405

SEQ ID NO: 8648 - protein, 119 aa, Homo sapiens
METDLNSQDRKDLDKFIKFFALKTVQVIVQARLGEKICTRSSSSPTGSDWFNLAIKDIPEVTHEAKKALAGQLPAVGRSMCVEISLKTSEGDSMELEIWCLEMNEKCDKEIKVSYTVYN

SEQ ID NO: 8649 - protein, 139 aa, Homo sapiens
MADTDLFMECEEEELEPWQKISDVIEDSVVEDYNSVDKTTTVSVSQQPVSAPVPIAAHASVAGHLSTSTTVSSSGAQNSDSTKKTLVTLIANNNAGNPLVQQGGQPLILTQNPAPGLGTMVTQPVLRPVQVMQNANHVT

SEQ ID NO: 8650 - protein, 163 aa, Homo sapiens
MHDKGITTAAVCVYPARVCDAVKALKAAGCNIPVASVAAGFPAGQTHLKTRLEEIRLAVEDGATEIDVVINRSLVLTGQWEALYDEIRQFRKACGEAHLKTILATGELGTLTNVYKASMIAMMAGSDFIKTSTGKETVNATFPVAIVMLRAIRDFFWKTGNKV

SEQ ID NO: 8651 - protein, 151 aa, Homo sapiens
MADTDLFMECEEEELEPWQKISDVIEDSVVEDYNSVDKTTTVSVSQQPVSAPVPIAAHASVAGHLSTSTTVSSSGAQNSDSTKKTLVTLIANNNAGNPLVQQGGQPLILTQNPAPGLGTMVTQPVLRPVQVMQNANHVTSSPVASQPIFIT

SEQ ID NO: 8652 - protein, 83 aa, Homo sapiens
MSQSGAVSCCPGATNGSLGRSDGVAKMSPKDLFEQRKKYSNSNVIMHETSQYHVQHLATFIMDKSEAITSVDDAIRKLVQLSS

SEQ ID NO: 8653 - protein, 121 aa, Homo sapiens
MAGRPLRIGDQLVLEEDYDETYIPSEQEILEFAREIGIDPIKEPELMWLAREGIVAPLPGEWKPCQDITGDIYYFNFANGQSMWDHPCDEHYRSLVIQERAKLSTSGAIKKKKKKKEKKDK

SEQ ID NO: 8654 - protein, 998 aa, Homo sapiens; identical to SEQ ID NO: 7614

SEQ ID NO: 8655 - protein, 167 aa, Homo sapiens
MGTTAPGPIHLLELCDQKLMEFLCNMDNKDLVWLEEIQEEAERMFTREFSKEPELMPKTPSQKNRRKKRRISYVQDENRDPIRRRLSRRKSRSSQLSSRRLRSKDSVEKLATVVGENGSVLRRVTRAAAAAAAATMALAAPSSPTPESPTMLTKKPEDNHTQCQLVP

SEQ ID NO: 8656 - protein, 204 aa, Homo sapiens
MEAQAQGLLETEPLQGTDEDAVASADFSSMLSEEEKEELKAELVQLEDEITTLRQVLSAKERHLVEIKQKLGMNLMNELKQNFSKSWHDMQTTTAYKKTHETLSHAGQKATAAFSNVGTAISKKFGDMSYSIRHSISMPAMRNSPTFKSFEERVETTVTSLKTKVGGTNPNGGSFEEVLSSTAHASAQSLAGGSRRTKEEELQC

SEQ ID NO: 8657 - protein, 340 aa, Homo sapiens
MAAARDPPEVSLREATQRKLRRFSELRGKLVARGEFWDIVAITAADEKQELAYNQQLSEKLKRKELPLGVQYHVFVDPAGAKIGNGGSTLCALQCLEKLYGDKWNSFTILLIHSGGYSQRLPNASALGKIFTALPLDIPECSGKTSCIIQSILDSRCSVAPGSVVEYSRLGPDVSVGENCIISGSYILTKAALPAHSFVCSLSLKMNRCLKYATMAFGVQDNLKKSVKTLSDIKLLQFFGVCFLSCLDVWNLKVTEELFSGNKTCLSLWTARIFPVCSSLSDSVITSLKMLNAVKNKSAFSLNSYKLLSIEEMLIYKDVEDMITYREQIFLEISLKSSLM

SEQ ID NO: 8658 - protein, 290 aa, Homo sapiens
MAELTALESLIEMGFPRGRAEKALALTGNQGIEAAMDWLMEHEDDPDVDEPLETPLGHILGREPTSSEQGGLEGSGSAAGEGKPALSEEERQEQTKRMLELVAQKQREREEREEREALERERQRRRQGQELSAARQRLQEDEMRRAAEERRREKAEELAARQRVREKIERDKAERAKKYGGSVGSQPPPVAPEPGPVPSSPSQEPPTKREYDQCRIQVRLPDGTSLTQTFRAREQLAAVRLYVELHRGEELGGGQDPVQLLSGFPRRAFSEADMERPLQELGLVPSAVLI

SEQ ID NO: 8659 - protein, 102 aa, Homo sapiens; identical to SEQ ID NO: 6784

SEQ ID NO: 8660 - protein, 92 aa, Homo sapiens
MLSEEEKEELKAELVQLEDEITTLRQVLSAKERHLVEIKQKLGMNLMNELKQNFSKSWHDMQTTTAYKKTHETLSHAGQKATAAFSNVGTAI

SEQ ID NO: 8661 - protein, 1244 aa, Homo sapiens; identical to SEQ ID NO: 5898

SEQ ID NO: 8662 - protein, 891 aa, Homo sapiens
MDQPEAPCSSTGPRLAVARELLLAALEELSQEQLKRFRHKLRDVGPDGRSIPWGRLERADAVDLAEQLAQFYGPEPALEVARKTLKRADARDVAAQLQERRLQRLGLGSGTLLSVSEYKKKYREHVLQLHARVKERNARSVKITKRFTKLLIAPESAAPEEAMGPAEEPEPGRARRSDTHTFNRLFRRDEEGRRPLTVVLQGPAGIGKTMAAKKILYDWAAGKLYQGQVDFAFFMPCGELLERPGTRSLADLILDQCPDRGAPVPQMLAQPQRLLFILDGADELPALGGPEAAPCTDPFEAASGARVLGGLLSKALLPTALLLVTTRAAAPGRLQGRLCSPQCAEVRGFSDKDKKKYFYKYFRDERRAERAYRFVKENETLFALCFVPFVCWIVCTVLRQQLELGRDLSRTSKTTTSVYLLFITSVLSSAPVADGPRLQGDLRNLCRLAREGVLGRRAQFAEKELEQLELRGSKVQTLFLSKKELPGVLETEVTYQFIDQSFQEFLAALSYLLEDGGVPRTAAGGVGTLLRGDAQPHSHLVLTTRFLFGLLSAERMRDIERHFGCMVSERVKQEALRWVQGQGQGCPGVAPEVTEGAKGLEDTEEPEEEEEGEEPNYPLELLYCLYETQEDAFVRQALCRFPELALQRVRFCRMDVAVLSYCVRCCPAGQALRLISCRLVAAQEKKKKSLGKRLQASLGGGSSQGTTKQLPASLLHPLFQAMTDPLCHLSSLTLSHCKLPDAVCRDLSEALRAAPALTELGLLHNRLSEAGLRMLSEGLAWPQCRVQTVRVQLPDPQRGLQYLVGMLRQSPALTTLDLSGCQLPAPMVTYLCAVLQHQGCGLQTLSLASVELSEQSLQELQAVKRAKPDLVITHPALDGHPQPPKELISTF

SEQ ID NO: 8663 - protein, 79 aa, Homo sapiens
MSQSGAVSCCPGATNGSLGRSDGVAKMSPKDLFEQRKKYSNSNVIMHETSQYHVQHLATFIMDKSEAITSVDDAIRKLV

SEQ ID NO: 8664 - protein, 180 aa, Homo sapiens
MGDKKSPTRPKRQPKPSSDEGYWDCSVCTFRNSAEAFKCMMCDVRKGTSTRKPRPVSQLVAQQVTQQFVPPTQSKKEKKDKVEKEKSEKETTSKKNSHKKTRPRLKNVDRSSAQHLEVTVGDLTVIITDFKEKTKSPPASSAASADQHSQSGSSSDNTERGMSRSSSPRGEASSLNGESH

SEQ ID NO: 8665 - protein, 731 aa, Homo sapiens
MGSGEEPGQSGASLRTGPMVQGRGIMTTGSGQEPGQSGTSLRTGPMGSLGQAEQVSSMPMGSLEHEGLVSLRPVGLQEQEGPMSLGPVGSAGPVETSKGLLGQEGLVEIAMDSPEQEGLVGPMEITMGSLEKAGPVSPGCVKLAGQEGLVEMVLLMEPGAMRFLQLYHEDLLAGLGDVALLPLEGPDMTGFRLCGAQASCQAAEEFLRSLLGSISCHVLCLEHPGSARFLLGPEGQHLLQGLEAQFQCVFGTERLATATLDTGLEEVDPTEALPVLPGNAHTLWTPDSTGGDQEDVSLEEVRELLATLEGLDLDGEDWLPRELEEEGPQEQPEEEVTPGHEEEEPVAPSTVAPRWLEEEAALQLALHRSLEPQGQVAEQEEAAALRQALTLSLLEQPPLEAEEPPDGGTDGKAQLVVHSAFEQDVEELDRALRAALEVHVQEETVGPWRRTLPAELRARLERCHGVSVALRGDCTILRGFGAHPARAARHLVALLAGPWDQSLAFPLAASGPTLAGQTLKGPWNNLERLAENTGEFQEVVRAFYDTLDAARSSIRVVRVERVSHPLLQQQYELYRERLLQRCERRPVEQVLYHGTTAPAVPDICAHGFNRSFCGRNATVYGKGVYFARRASLSVQDRYSPPNADGHKAVFVARVLTGDYGQGRRGLRAPPLRGPGHVLLRYDSAVDCICQPSIFVIFHDTQALPTHLITCEHVPRASPDDPSGLPGRSPDT

SEQ ID NO: 8666 - protein, 360 aa, Homo sapiens
MQVYEGLDIITNKVSAQEQRICRHHMISFVDPLVTNYTVVDFRNRATALIYLPETKFLLLWEEPIITLNLCSGKFLSIPRSLQVFEETGISHSEFLHRQHTEEGGGPLGGPLKFSNPCILWLHADQAVLDERLDKRVDDMLAAGLLEELRDFHRRYNQKNVSENSQDYQHGIFQSIGFKEFHEYLITEGKCTLETSNQLLKKGIEALKQVTKRYARKQNRWVKNRFLSRPGPIVPPVYGLEVSDVSKWEESVLEPALEIVQSFIQGHKPTATPIKMPYNEAENKRSYHLCDLCDRIIIGDREWAAHIKSKSHLNQLKKRRRLDSDAVNTIESQSVSPDHNKEPKEKGSPGQNDQELKCSV

SEQ ID NO: 8667 - protein, 275 aa, Homo sapiens; identical to SEQ ID NO: 4746

SEQ ID NO: 8668 - protein, 563 aa, Homo sapiens
METAKQKALEVANRLYQKDLRAPDVVIGADTIVTVGGLILEKPVDKQDAYRMLSRLSGREHSVFTGVAIVHCSSKDHQLDTRVSEFYEETKVKFSELSEELLWEYVHSGEPMDKAGGYGIQALGGMLVESVHGDFLNVVGFPLNHFCKQLVKLYYPPRPEDLRRSVKHDSIPAADTFEDLSDVEGGGSEPTQRDAGSRDEKAEAGEAGQATAEAECHRTRETLPPFPTRLLELIEGFMLSKGLLTACKLKVFDLLKDEAPQKAADIASKVDASACGMERLLDICAAMGLLEKTEQGYSNTETANVYLASDGEYSLHGFIMHNNDLTWNLFTYLEFAIREGTNQHHRALGKKAEDLFQDAYYQSPETRLRFMRAMHGMTKLTACQVATAFNLSRFSSACDVGGCTGALARELAREYPRMQVTVFDLPDIIELAAHFQPPGPQAVQIHFAAGDFFRDPLPSAELYVLCRILHDWPDDKVHKLLSRVAESCKPGAGLLLVETLLDEEKRVAQRALMQSLNMLVQTEGKERSLGEYQCLLELHGFHQVQVVHLGGVLDAILATKVAP

SEQ ID NO: 8669 - protein, 275 aa, Homo sapiens; identical to SEQ ID NO: 4746

SEQ ID NO: 8670 - protein, 332 aa, Homo sapiens
MEYLGGGSALDLLKPGPLEETYIATILREILKGLDYLHSERKIHRDIKAANVLLSEQGDVKLADFGVAGQLTDTQIKRNTFVGTPFWMAPEVIKQSAYDFKADIWSLGITAIELAKGEPPNSDLHPMRVLFLIPKNSPPTLEGQHSKPFKEFVEACLNKDPRFRPTAKELLKHKFITRYTKKTSFLTELIDRYKRWKSEGHGEESSSEDSDIDGEAEDGEQGPIWTFPPTIRPSPHSKLHKGTALHSSQKPAEPVKRQPRSQCLSTLVRPVFGELKEKHKQSGGSVGALEELENAFSLAEESCPGISDKLMVHLVERVQRFSHNRNHLTSTR

SEQ ID NO: 8671 - protein, 92 aa, Homo sapiens
MNFTPTHTPVCRKRTVVSKRGVAVSGPTKRRGMADSLESTPLPSPEDRLAKLHPSKELLEYYQKKMAECEAENEDLLKKLELYKEACEGQHK

SEQ ID NO: 8672 - protein, 142 aa, Homo sapiens
MAQKENSYPWPYGRQTAPSGLSTLPQRVLRKEPVTPSALVLMSRSNVQPTAAPGQKVMENSSGTPDILTRRHFTIDDFEIGRPLGKGKFGNVYLAREKKSHFIVALKVLFKSQIEKEGVEHQLRREIEIQAHLQSWRSWQML

SEQ ID NO: 8673 - protein, 166 aa, Homo sapiens
MDQEDSESKTVSEHGERDWMTAKKFWKPGDSLAPPEVDFDRLLASLQDLSELVVEGDTQVTPVPGGARLRTLEPIPLKLYRNGIMMFDGPFQPFYDPSTQRCLRDILDGFFPSELQRLYPNGVPFKVISCSSNHTFGDFEGSGDTQPPQTPPILRGSRCTPWGTPV

SEQ ID NO: 8674 - protein, 490 aa, Homo sapiens
MQSLDDATKQLDFTRKTLAEKKQELDKLRNEWASHTAALTNKHSQELTNEKEKALQAQVQYQQQHEQQKKDLEILHQQNIHQLQNRLSELEAANKDLTERKYKGDSTIRELKAKLSGVEEELQRTKQEVLSLRRENSTLDVECHEKEKHVNQLQTKVAVLEQEIKDKDQLVLRTKEAFDTIQEQKVVLEENGEKNQVQLGKLEATIKSLSAELLKANEIIKKLQGDLKTLMGKLKLKNTVTIQQEKLLAEKEEKLQKEQKELQDVGQSLRIKEQEVCKLQEQLEATVKKLEESKQLLKNNEKLITWLNKELNENQLVRKQDVLGPSTTPPAHSSSNTIRSGISPNLNVVDGRLTYPTCGIGYPVSSAFAFQNTFPHSISAKNTSHPGSGTKVQFNLQFTKPNASLGDVQSGATISMPCSTDKENGENVGLESKYLKKREDSIPLRGLSQNLFSNSDHQRDGTLGALHTSSKPTALPSASSAYFPGQLPNS

SEQ ID NO: 8675 - protein, 1004 aa, Homo sapiens
MLRTAGRDGLCRLSTYLEELEAVELKKFKLYLGTATELGEGKIPWGSMEKAGPLEMAQLLITHFGPEEAWRLALSTFERINRKDLWERGQREDLVRDTPPGGPSSLGNQSTCLLEVSLVTPRKDPQETYRDYVRRKFRLMEDRNARLGECVNLSHRYTRLLLVKEHSNPMQVQQQLLDTGRGHARTVGHQASPIKIETLFEPDEERPEPPRTVVMQGAAGIGKSMLAHKVMLDWADGKLFQGRFDYLFYINCREMNQSATECSMQDLIFSCWPEPSAPLQELIRVPERLLFIIDGFDELKPSFHDPQGPWCLCWEEKRPTELLLNSLIRKKLLPELSLLITTRPTALEKLHRLLEHPRHVEILGFSEAERKEYFYKYFHNAEQAGQVFNYVRDNEPLFTMCFVPLVCWVVCTCLQQQLEGGGLLRQTSRTTTAVYMLYLLSLMQPKPGAPRLQPPPNQRGLCSLAADGLWNQKILFEEQDLRKHGLDGEDVSAFLNMNIFQKDINCERYYSFIHLSFQEFFAAMYYILDEGEGGAGPDQDVTRLLTEYAFSERSFLALTSRFLFGLLNEETRSHLEKSLCWKVSPHIKMDLLQWIQSKAQSDGSTLQQGSLEFFSCLYEIQEEEFIQQALSHFQVIVVSNIASKMEHMVSSFCLKRCRSAQVLHLYGATYSADGEDRARCSAGAHTLLVQLPERTVLLDAYSEHLAAALCTNPNLIELSLYRNALGSRGVKLLCQGLRHPNCKLQNLRLKRCRISSSACEDLSAALIANKNLTRMDLSGNGVGFPGMMLLCEGLRHPQCRLQMIQLRKCQLESGACQEMASVLGTNPHLVELDLTGNALEDLGLRLLCQGLRHPVCRLRTLWLKICRLTAAACDELASTLSVNQSLRELDLSLNELGDLGVLLLCEGLRHPTCKLQTLRLGICRLGSAACEGLSVVLQANHNLRELDLSFNDLGDWGLWLLAEGLQHPACRLQKLWLFGMDLNKMTHSRLAALRVTKPYLDIGC

SEQ ID NO: 8676 - protein, 838 aa, Homo sapiens; identical to SEQ ID NO: 5559

SEQ ID NO: 8677 - protein, 54 aa, Homo sapiens
MGNSDSQYTLQGSKNHSNTITGAKQIPCSLKIRGIHAKEEKSLHGWGHGSNGAG

SEQ ID NO: 8678 - protein, 422 aa, Homo sapiens
MASLSRALRVAAAHPRQSPTRGMGPCNLSSAAGPTAEKSVPYQRTLKEGQGTSVVAQGPSRPLPSTANVVVIGGGSLGCQTLYHLAKLGMSGAVLLERERLTSGTTWHTAGLLWQLRPSDVEVELLAHTRRVVSRELEEETGLHTGWIQNGGLFIASNRQRLDEYKRLMSLGKAYGVESHVLSPAETKTLYPLMNVDDLYGTLYVPHDGTMDPAGTCTTLARAASARGAQVIENCPVTGIRVWTDDFGVRRVAGVETQHGSIQTPCVVNCAGVWASAVGRMAGVKVPLVAMHHAYVVTERIEGIQNMPNVRDHDASVYLRLQGDALSVGGYEANPIFWEEVSDKFAFGLFDLDWEVFTQHIEGAINRVPVLEKTGIKSTVCGPESFTPDHKPLMGEAPELRGFFLGCGFNSAGESGQALLAP

SEQ ID NO: 8679 - protein, 108 aa, Homo sapiens
MSMLKPSGLKAPTKILKPGSTALKTPTAVVAPVEKTISSEKASSTPSSETQEEFVDDFRVGERVWVNGNKPGFIQFLGETQFAPGQWAGIVLDEPIGKNDGSVAGVRY

SEQ ID NO: 8680 - protein, 715 aa, Homo sapiens
MKRGRLPSSSEDSDDNGSLSTTWSQNSRSQHRRSSCSRHEDRKPSEVFRTDLITAMKLHDSYQLNPDEYYVLADPWRQEWEKGVQVPVSPGTIPQPVARVVSEEKSLMFIRPKKYIVSSGSEPPELGYVDIRTLADSVCRYDLNDMDAAWLELTNEEFKEMGMPELDEYTMERVLEEFEQRCYDNMNHAIETEEGLGIEYDEDVVCDVCQSPDGEDGNEMVFCDKCNICVHQACYGILKVPEGSWLCRTCALGVQPKCLLCPKKGGAMKPTRSGTKWVHVSCALWIPEVSIGSPEKMEPITKVSHIPSSRWALVCSLCNEKFGASIQCSVKNCRTAFHVTCAFDRGLEMKTILAENDEVKFKSYCPKHSSHRKPEESLGKGAAQENGAPECSPRNPLEPFASLEQNREEAHRVSVRKQKLQQLEDEFYTFVNLLDVARALRLPEEVVDFLYQYWKLKRKVNFNKPLITPKKDEEDNLAKREQDVLFRRLQLFTHLRQDLERVRNLTYMVTRREKIKRSVCKVQEQIFNLYTKLLEQERVSGVPSSCSSSSLENMLLFNSPSVGPDAPKIEDLKWHSAFFRKQMGTSLVHSLKKPHKRDPLQNSPGSEGKTLLKQPDLCGRREGMVVPESFLGLEKTFAEARLISAQQKNGVVMPDHGKRRDNRFHCDLIKGDLKDKSFKQSHKPLRSTDVSQRHLDNTRAAAIWRFRVIWQGPAA

SEQ ID NO: 8681 - protein, 53 aa, Homo sapiens
MGRRSTSSTKSGKFMNPTDQARKEARKRELKKNKKQRMMVRAAVLKMKDPKQI

SEQ ID NO: 8682 - protein, 344 aa, Homo sapiens
MTTRSVLDVETFVADILKGENLSKKAKEKRESLIKKIKDVKSIYLQEFQDKGDAEDGEEYDDPFAGPPDTISLASERYDKDDEAPSDGAQFPPIAAQDLPFVLKAGYLEKRRKDHSFLGFEWQKRWCALSKTVFYYYGSDKDKQQKGEFAIDGYSVRMNNTLRKDGKKDCCFEISAPDKRIYQFTAASPKDAEEWVQQLKFVLQDMESDIIPEDYDERGELYDDVDHPLPISNPLTSSQPIDDEIYEELPEEEEDSAPVKVEEQRKMSQDSVHHTSGDKSTDYANFYQGLWDCTGAFSDELSFKRGDVIYILSKEYNRYGWWVGEMKGAIGLVPKAYIMEMYDI

SEQ ID NO: 8683 - protein, 955 aa, Homo sapiens; identical to SEQ ID NO: 6801

SEQ ID NO: 8684 - protein, 277 aa, Homo sapiens
MLSQKEVAVADAKKSLELNPNNSTAMLRKGICEYHEKNYAAALETFTEGQKLDSADANFSVWIKRCQEAQNGSESEVWTHQSKIKYDWYQTESQVVITLMIKNVQKNDVNVEFSEKELSALVKLPSGEDYNLKLELLHPIIPEQSTFKVLSTKIEIKLKKPEAVRWEKLEGQGDVPTPKQFVADVKNLYPSSSPYTRNWDKLVGEIKEEEKNEKLEGDAALNRLFQQIYSDGSDEVKRAMNKSFMESGGTVLSTNWSDVGKRKVEINPPDDMEWKKY

SEQ ID NO: 8685 - protein, 268 aa, Homo sapiens
MGSAKSVPVTPARPPPHNKHLARVADPRSPSAGILRTPIQVESSPQPGLPAGEQLEGLKHAQDSDPRSPTLGIARTPMKTSSGDPPSPLVKQLSEVFETEDSKSNLPPEPVLPPEAPLSSELDLPLGTQLSVEEQMPPWNQTEFPSKQVFSKEEARQPTETPVASQSSDKPSRDPETPRSSGSMRNRWKPNSSKVLGRSPLTILQDDNSPGTLTLRQGKRPSPLSENVSELKEGAILGTGRLLKTGGRAWEQGQDHDKENQHFPLVES

SEQ ID NO: 8686 - protein, 379 aa, Homo sapiens
MVFKLKTKEEQHSMLGSGFKAERLRVNLRLVINRLKLLEKKKTELAQKARKEIADYLAAGKDERARIRVEHIIREDYLVEAMEILELYCDLLLARFGLIQSMKELDSGLAESVSTLIWAAPRLQSEVAELKIVADQLCAKYSKEYGKLCRTNQIGTVNDRLMHKLSVEAPPKILVERYLIEIAKNYNVPYEPDSVVMAEAPPGVETDLIDVGFTDDVKKGGPGRGGSGGFTAPVGGPDGTVPMPMPMPMPMPSANTPFSYPLPKGPSDFNGLPMGTYQAFPNIHPPQIPATPPSYESVDDINADKNISSAQIVGPGPKPEASAKLPSRPADNYDNFVLPELPSVPDTLPTASAGASTSASEDIDFDDLSRRFEELKKKT

SEQ ID NO: 8687 - protein, 300 aa, Homo sapiens
MARPLSTPSSSQMQARKKHRGIIEKRRRDRINSSLSELRRLVPTAFEKQGSSKLEKAEVLQMTVDHLKMLHATGGTGFFDARALAVDFRSIGFRECLTEVIRYLGVLEGPSSRADPVRIRLLSHLNSYAAEMEPSPTPTGPLAFPAWPWSFFHSCPGLPALSNQLAILGRVPSPVLPGVSSPAYPIPALRTAPLRRATGIILPARRNVLPSRGASSTRRARPLERPATPVPVAPSSRAARSSHIAPLLQSSSPTPPGPTGSAAYVAVPTPNSSSPGPAGRPAGAMLYHSWVSEITEIGAF

SEQ ID NO: 8688 - protein, 105 aa, Homo sapiens [sequence omitted]

SEQ ID NO: 8689 - protein, 195 aa, Homo sapiens
MGNSDSQYTLQGSKNHSNTITGAKQIPCSLKIRGIHAKEEKSLHGWGHGSNGAGYKSRSLARSCLSHFKSNQPYASRLGGPTCKVSRGVAYSTHRTNAPGKDFQGISAAFSTENGFHSVGHELADNHITSRDCNGHLLNCYGRNESIASTPPGEDRKSPRVLIKTLGKLDGCLRVEFHNGGNPSKVPAEDCSEPV

SEQ ID NO: 8690 - protein, 526 aa, Homo sapiens
MVPGEENQLVPKEDVFWRCRQNIFDEMKKKFLQIENAAEEPRVLCIIQDTTNSKTVNERITLNLPASTPVRKLFEDVANKVGYINGTFDLVWGNGINTADMAPLDHTSDKSLLDANFEPGKKNFLHLTDKDGEQPQILLEDSSAGEDSVHDRFIGPLPREGSGGSTSDYVSQSYSYSSILNKSETGYVGLVNQAMTCYLNSLLQTLFMTPEFRNALYKWEFEESEEDPVTSIPYQLQRLFVLLQTSKKRAIETTDVTRSFGWDSSEAWQQHDVQELCRVMFDALEQKWKQTEQADLINELYQGKLKDYVRCLECGYEGWRIDTYLDIPLVIRPYGSSQAFASVEEALHAFIQPEILDGPNQYFCERCKKKCDARKGLRFLHFPYLLTLQLKRFDFDYTTMHRIKLNDRMTFPEELDMSTFIDVEDEKSPQTESCTDSGAENEGSCHSDQMSNDFSNDDGVDEGICLETNSGTEKISKSGLEKNSLIYELFSVMVHSGSAAGGHYYACIKSSVMSSGTASMINMSAG

SEQ ID NO: 8691 - protein, 320 aa, Homo sapiens
MGKEQELLEAARTGHLPAVEKLLSGKRLSSGFGGGGGGGSGGGGGGSGGGGGGLGSSSHPLSSLLSMWRGPNVNCVDSTGYTPLHHAALNGHKDVVEVLLRNDALTNVADSKGCYPLHLAAWKGDAQIVRLLIHQGPSHTRVNEQNNDNETALHCAAQYGHTEVVKVLLEELTDPTMRNNKFETPLDLAALYGRLEVVKMLLNAHPNLLSCNTKKHTPLHLAARNGHKAVVQVLLDAGMDSNYQTEMGSALHEAALFGKTDVVQILLAAGTDVNIKDNHGLTALDTVRELPSQKSQQIAALIEDLDTLQFYFISCPFQGL

SEQ ID NO: 8692 - protein, 219 aa, Homo sapiens
MVIHKNPPDTPTESQFTRFLCSSPLEAETPPNGPDCGYGSFHQQYWLDGKIIAVGVIDILPNCVSSVYLYYDPDYSFLSLGVYSALREIAFTRQLHEKTSQLSYYYMGFYIHSCPKMKYKGQYRPSDLLCPETYVWVPIEQCLPSLENSKYCRFNQDPEAVDEDRSTEPDRLQVFHKRAIMPYGVYKKQQKDPSEEAAVLQYASLVGQKCSERMLLFRN

SEQ ID NO: 8693 - protein, 596 aa, Homo sapiens
MQQKELGTFAQSSIALHHQYNPKFQTLFQPCNLMGAMQLIEDFSTHVSIDCSPHKTVKKTANEFPCLPKQVAWILATSKVFMYPELLPVCSLKAKNPQDKILFTKAEDNKYLLTCKTARQLTVRIKNLNMNRAPDNIIKFYKKTKQLPVLGKCCEEIQPHQWKPPIEREEHRLPFWLKASLPSIQEELRHMADGAREVGNMTGTTEINSDQGLEKDNSELGSETRYPLLLPKGVVLKLKPVADRFPKKAWRQKRSSVLKPLLIQPSPSLQPSFNPGKTPAQSTHSEAPPSKMVLRIPHPIQPATVLQTVPGVPPLGVSGGESFESPAALPAMPPEARTSFPLSESQTLLSSAPVPKVMMPSPASSMFRKPYVRRRPSKRRGARAFRCIKPAPVIHPASVIFTVPATTVKIVSLGGGCNMIQPVNAAVAQSPQTIPIATLLVNPTSFPCPLNQPLVASSVSPLIVSGNSVNLPIPSTPEDKAHMNVDIACAVADGENAFQGLEPKLEPQELSPLSATVFPKVEHSPGPPPVDKQCQEGLSENSAYRWTVVKTEEGRQALEPLPQGIQESLNNSSPGDLEEVVKMEPEDATEEISGFL

SEQ ID NO: 8694 - protein, 303 aa, Homo sapiens
MADKSKFIEYIDEALEKSKETALSHLFFTYQGIPYPITMCTSETFQALDTFEARHDDIVLASYPKCGSNWILHIVSELIYAVSKKKYKYPEFPVLECGDSEKYQRMKGFPSPRILATHLHYDKLPGSIFENKAKILVIFRNPKDTAVSFLHFHNDVPDIPSYGSWDEFFRQFMKGQVSWGRYFDFAINWNKHLDGDNVKFILYEDLKENLAAGIKQIAEFLGFFLTGEQIQTISVQSTFQAMRAKSQDTHGAVGPFLFRKGEVGDWKNLFSEIQNQEMDEKFKECLAGTSLGAKLKYESYCQG

SEQ ID NO: 8695 - protein, 121 aa, Homo sapiens
MGVPEIPGEKLVTERNKKRLEKEKHEKGAQKTDCQKNLGTVGAVALDCKGNVAYATSTGGIVNKMVGRVGDSPCLGRTKGCLLPLPLFSRPQAFLTLYSLPLSVSCCVPFLLLVQLQDVWE

SEQ ID NO: 8696 - protein, 192 aa, Homo sapiens
MTLGSKSQQPPEDIKALSWNRQAQHILSSAHPSGKAVVWDLRKNEPIIKVSDHSNRMHCSGLAWHPDIATQLVLCSEDDRLPVIQLWDLRFASSPLKVLESHSRGILSVSWSQADAELLLTSAKDSQILCRNLGSSEVVYKLPTQSSWCFDVQWCPRDPSVFSAASFNGWISLYSVMGRSWEVQHMRQADKV

SEQ ID NO: 8697 - protein, 206 aa, Homo sapiens
MKDVDNLKSIKEEWVCETGSDNQPLGNNQQSNCEYFVDSLFEEAQKVSSKCVSPAEQKKQVDVNIKLWKNGFTVNDDFRSYSDGASQQFLNSIKKGELPSELQGIFDKEEVDVKVEDKKNEICLSTKPVFQPFSGQGHRLGRVSHIKDFIEKYQGSQRSPPFSLATALPVLRLLDETLTLEEADLQNAVIIQRLQKTASFRELSEH

SEQ ID NO: 8698 - protein, 452 aa, Homo sapiens [sequence omitted]

SEQ ID NO: 8699 - protein, 149 aa, Homo sapiens
MERIEGASVGRCAASPYLRPLTLHYRQNGAQKSWDFMKTHDSVTVLLFNSSRRSLVLVKQFRPAVYAGEVERRFPGSLAAVDQDGPRELQPALPGSAGVTVELCAGLVDQPGLSLEEVACKEAWEECGYHLAPSDLRRVATYWDATMGS

SEQ ID NO: 8700 - protein, 162 aa, Homo sapiens
MNSNASEHTGMLRTCWSHSHWDPFSSGSVTAMWATHSPTSKAWAGIQGRGRWALGFPWRGQGVLHVIASQKAAVTEAVDLRTGAASQAMSEAFVRSGMFYLRPAFVLLCYKWGKLRHSEVSNLLGVAWPVSEEACMGTWGSLAVAVTLPAQGLGTWGRDEGE

SEQ ID NO: 8701 - protein, 439 aa, Homo sapiens; identical to SEQ ID NO: 6489

SEQ ID NO: 8702 - protein, 288 aa, Homo sapiens
MAKWGEGDPRWIVEERADATNVNNWHWTERDASNWSTDKLKTLFLAVQVQNEEGKCEVTEVSKLDGEASINNRKGKLIFFYEWSVKLNWTGTSKSGVQYKGHVEIPNLSDENSVDEVEISVSLAKDEPDTNLVALMKEEGVKLLREAMGIYISTLKTEFTQGMILPTMNGESVDPVGQPALKTEERKAKPAPSKTQARPVGVKIPTCKITLKETFLTSPEELYRVFTTQELVQAFTHAPATLEADRGGKFHMVDGNVSGEFTDLVPEKHIVMKWRFKSWPEGSHCHSG

SEQ ID NO: 8703 - protein, 350 aa, Homo sapiens
MPSFIRHGPTIPRRTDICLPDSSPNAFSTSGDVVSRNQSFLRTPIQRTPHEIMRRESNRLSAPSYLARSLADVPREYGSSQSFVTEVSFAVENGDSGSRYYYSDNFFDGQRKRPLGDRAHEDYRYYEYNHDLFQRMPQNQGRHASGIGRVAATSLGNLTNHGSEDLPLPPGWSVDWTMRGRKYYIDHNTNTTHWSHPLEREGLPPGWERVESSEFGTYYVDHTNKKAQYRHPCAPSVPRYDQPPPVTYQPQQTERNQSLLVPANPYHTAEIPDWLQVYARAPVKYDHILKWELFQLADLDTYQGMLKLLFMKELEQIVKMYEAYRQALLTELENRKQRQQWYAQQHGKNF

SEQ ID NO: 8704 - protein, 178 aa, Homo sapiens
MTFREGHQWEKIPLSGSNQEIRRQKERITEQPLKEEEDEDRKNKGHQAAEIEWLGFRKPSQADMLHSKHDEEQKVWDEEIDDDDDDNCNNDEDEVRVIEFKKKHEEVSQFKEEGDASEDSPLSSASSQAVTPDEQPTLGKKSDISRNAYSRYNTISYRKIRKGNTKQRIDEFESMMHL

SEQ ID NO: 8705 - protein, 103 aa, Homo sapiens
MAAFKLDFLPEMMVDHCSLNSSPVSKKMNGTLDHPDQPDLDAIKMFVGQVPRTWSEKDLRELFEQYGAVYEINVLRDRSQNPPQSKGCCFVTFYTRKAALEAQ

SEQ ID NO: 8706 - protein, 638 aa, Homo sapiens
MPPINLQEKQVICLSGDDSSTCIGILAKEVEIVASSDSSISSKARGSNKVKIQPVAKYDWEQKYYYGNLIAVSNSFLAYAIRAANNGSAMVRVISVSTSERTLLKGFTGSVADLAFAHLNSPQLACLDEAGNLFVWRLALVNGKIQEEILVHIRQPEGTPLNHFRRIIWCPFIPEESEDCCEESSPTVALLHEDRAEVWDLDMLRSSHSTWPVDVSQIKQGFIVVKGHSTCLSEGALSPDGTVLATASHDGYVKFWQIYIEGQDEPRCLHEWKPHDGRPLSCLLFCDNHKKQDPDVPFWRFLITGADQNRELKMWCTVSWTCLQTIRFSPDIFSSVSVPPSLKVCLDLSAEYLILSDVQRKVLYVMELLQNQEEGHACFSSISEFLLTHPVLSFGIQVVSRCRLRHTEVLPAEEENDSLGADGTHGAGAMESAAGVLIKLFCVHTKALQDVQIRFQPQLNPDVVAPLPTHTAHEDFTFGESRPELGSEGLGSAAHGSQPDLRRIVELPAPADFLSLSSETKPKLMTPDAFMTPSASLQQITASPSSSSSGSSSSSSSSSSSLTAVSAMSSTSAVDPSLTRPPEELTLSPKLQLDGSLTMSSSGSLQASPRGLLPGLLPAPADKLTPKGPGQVCDWVCV

SEQ ID NO: 8707 - protein, 164 aa, Homo sapiens
MRILILGLDGAGKTTILYRLQVGEVVTTIPTIGFNVETVTYKNLKFQVWDLGGQTSIRPYWRCYYSNTDAVIYVVDSCDRDRIGISKSELVAMLEEEELRKAILVVFANKQDMEQAMTSSEMANSLGLPALKDRKWQIFKTSATKGTGLDEAMEWLVETLKSRQ

SEQ ID NO: 8708 - protein, 647 aa, Homo sapiens
MAQGSVSFNDVTVDFTQEEWQHLDHAQKTLYMDVMLENYCHLISVGCHMTKPDVILKLERGEEPWTSFAGHTCLEENWKAEDFLVKFKEHQEKYSRSVVSINHKKLVKEKSKIYEKTFTLGKNPVNSKNLPPEYDTHGRILKNVSELIISNLNPARKRLSEYNGYGKSLLSTKQETTHPEVKSHNQSARAFSHNEVLMQYQKTETPAQSFGYNDCEKSFLQRGGLITHSRPYKGENPSVYNKKRRATNIEKKHTCNECGKSFCRKSVLILHQGIHSEEKPYQCHQCGNAFRRKSYLIDHQRTHTGEKPFVCNECGKSFRLKTALTDHQRTHTGEKSYECLQCRNAFRLKSHLIRHQRTHTGEKPYECNDCGKSFRQKTTLSLHQRIHTGEKPYICKECGKSFHQKANLTVHQRTHTGEKPYICNECGKSFSQKTTLALHEKTHNEEKPYICSECGKSFRQKTTLVAHQRTHTGEKSYECPHCGKAFRMKSYLIDHHRTHTGEKPYECNECGKSFSQKTNLNLHQRIHTGEKPYVCNECGKSFRQKATLTVHQKIHTGQKSYECPQCGKAFSRKSYLIHHQRTHTGEKPYKCSECGKCFRQKTNLIVHQRTHTGEKPYVCNECGKSFSYKRNLIVHQRTHKGENIEMQ

SEQ ID NO: 8709 - protein, 1189 aa, Homo sapiens [sequence omitted]

SEQ ID NO: 8710 - protein, 196 aa, Homo sapiens
MWSVLQDGPISRVIVFSLSAAKETKDRPLQDEYSVLVASMLEPAVVYRDLLNRGLEDQLLLPGSDQFDSVLCSLVTDVDLDGRPEVLVATYGQELLCYKYRGPESGLPEAQHGFHLLWQRSFSSPLLAMAHVDLTGDGLQELAVVSLKGVHILQHSLIQASELVLTRLRHQVEQRRRRLQGLEDGAGAGPAENAAS

SEQ ID NO: 8711 - protein, 351 aa, Homo sapiens
MVSHTFHMRTEESDASQEGDDLPKSSANTSHPKQDDSPKSSEETIQPKEGDIPKAPEETIQSKKEDLPKSSEKAIQPKESNIPKSSAKPIQPKLGNIPKTSVKPSQPKESDIPKSPEEAIQPKEGDIPKSLEEAIQPKEGDIPKSPEETIQPKKGDIPKSPEEAIQPKEGDIPKSPKQAIQPKEGDIPKSLEEAIPPKEIDIPKSPEETIQPKEDDSPKSLEEATPSKEGDILKPEEETMEFPEGDKVKVILSKEDFEASLKEAGERLVAVDFSATWCGPCRTIRPFFHALSVKHEDVVFLEVDADNCEEVVRECAIMCVPTFQFYKKEEKVDELCGALKEKLEAVIAELK

SEQ ID NO: 8712 - protein, 490 aa, Homo sapiens
MPDGKIQKLIITEETAKIRPFAVAAVLRNIKFTKDRYDSFIELQEKLHQNICRKRALVAIGTHDLDTLSGPFTYTAKRPSDIKFKPLNKTKEYTACELMNIYKTDNHLKHYLHIIENKPLYPVIYDSNGVVLSMPPIINGDHSRITVNTRNIFIECTGTDFTKAKIVLDIIVTMFSEYCENQFTVEAAEVVFPNGKSHTFPELAYRKEMVRADLINKKVGIRETPENLAKLLTRMYLKSEVIGDGNQIEIEIPPTRADIIHACDIVEDAAIAYGYNNIQMTLPKTYTIANQFPLNKLTELLRHDMAAAGFTEALTFALCSQEDIADKLGVDISATKAVHISNPKTAEFQVARTTLLPGLLKTIAANRKMPLPLKLFEISDIVIKDSNTDVGAKNYRHLCAVYYNKNPGFEIIHGLLDRIMQLLDVPPGEDKGGYVIKASEGPAFFPGRCAEIFARGQSVGKLGVLHPDVITKFELTMPCSSLEINVGPFL

SEQ ID NO: 8713 - protein, 485 aa, Homo sapiens; identical to SEQ ID NO: 6789

SEQ ID NO: 8714 - protein, 67 aa, Homo sapiens
MALLAEHLLKPLPADKQIETGPFLEAVSHLPPFFDCLGSPVFTPIKADISGNITMRKLRLRGVEGLA

SEQ ID NO: 8715 - protein, 271 aa, Homo sapiens
ICERIRSTVDEKEQKQLLMDLDVVMRSSDCPYIVQFYGALFREGDCWICMELMSTSFDKFYKYVYSVLDDVIPEEILGKITLATVKALNHLKENLKIIHRDIKPSNILLDRSGNIKLCDFGISGQLVDSIAKTRDAGCRPYMAPERIDPSASRQGYDVRSDVWSLGITLYELATGRFPYPKWNSVFDQLTQVVKGDPPQLSNSEEREFSPSFINFVNLCLTKDESKRPKYKELLKHPFILMYEERAVEVACYVCKILDQMPATPSSPMYVD

SEQ ID NO: 8716 - protein, 96 aa, Homo sapiens
MSEKVDWLQSQNGVCKVDVYSPGDNQAQDWKMDTSTDPVRVLSWLRRDLEKSTAEFQDVRFKPGESFGGETSNSGDPHKGFSVDYYNTTTKGTPER

SEQ ID NO: 8717 - protein, 263 aa, Homo sapiens; identical to SEQ ID NO: 5395

SEQ ID NO: 8718 - protein, 288 aa, Homo sapiens; identical to SEQ ID NO: 5393

SEQ ID NO: 8719 - protein, 182 aa, Homo sapiens; identical to SEQ ID NO: 6850

SEQ ID NO: 8720 - protein, 332 aa, Homo sapiens
MDQPAGLQVDYVFRGVEHAVRVMVSGQVLELEVEDRMTADQWRGEFDAGFIEDLTHKTGNFKQFNIFCHMLESALTQSSESVTLDLLTYTDLESLRNRKMGGRPGSLAPRSAQLNSKRYLILIYSVEFDRIHYPLPLPYQGKPDPVVLQGIIRSLKEELGRLQGLDGQNTRDTRENEIWHLREQQQQRNRLGSGGSGDGPSVSWSRQTQPPAALTGRGDAPNRSRNRSSSVDSFRSRCSSASSCSDLEDFSESLSRGGHRRRGKPPSPTPWSGSNMKSPPVERSHHQKSLANSGGWVPIKEYSSEHQAADMAEIDARLKALQEYMNRLDMRS

SEQ ID NO: 8721 - protein, 171 aa, Homo sapiens; identical to SEQ ID NO: 4714

SEQ ID NO: 8722 - protein, 796 aa, Homo sapiens
MSLDDNLSGTSGMEVDDRVSALEQRLQLQEDELAVLKAALADALRRLRACEEQGAALRARGTPKGRAPPRLGTTASVCQLLKGLPTRTPLNGSGPPRRVGGYATSPSSPKKEATSGRSSVRRYLSPERLASVRREDPRSRTTSSSSNCSAKKEGKTKEVIFSVEDGSVKMFLRGRPVPMMIPDELAPTYSLDTRSELPSCRLKLEWVYGYRGRDCRANLYLLPTGEIVYFVASVAVLYSVEEQRQRHYLGHNDDIKCLAIHPDMVTIATGQVAGTTKEGKPLPPHVRIWDSVSLSTLHVLGLGVFDRAVCCVGFSKSNGGNLLCAVDESNDHMLSVWDWAKETKVVDVKCSNEAVLVATFHPTDPTVLITCGKSHIYFWTLEGGSLSKRQGLFEKHEKPKYVLCVTFLEGGDVVTGDSGGNLYVWGKGGNRITQAVLGAHDGGVFGLCALRDGTLVSGGGRDRRVVLWGSDYSKLQEVEVPEDFGPVRTVAEGHGDTLYVGTTRNSILQGSVHTGFSLLVQGHVEELWGLATHPSRAQFVTCGQDKLVHLWSSDSHQPLWSRIIEDPARSAGFHPSGSVLAVGTVTGRWLLLDTETHDLVAIHTDGNEQISVVSFSPDGAYLAVGSHDNLVYVYTVDQGGRKVSRLGKCSGHSSFITHLDWAQDSSCFVTNSGDYEILYWDPATCKQITSADAVRNMEWATATCVLGFGVFGIWSEGADGTDINAVARSHDGKLLASADDFGKVHLFSYPCCQPRALSHKYGGHSSHVTNVAFLWDDSMALTTGGKDTSVLQWRVV

SEQ ID NO: 8723 - protein, 352 aa, Homo sapiens
MALLGQALKWQQHQGLLPPGMTIDLFRGKAAVKDVEEEKFPTQLSRHIKFGQKSHVECARFSPDGQYLVTGSVDGFIEVWNFTTGKIRKDLKYQAQDNFMMMDDAVLCMCFSRDTEMLATGAQDGKIKVWKIQSGQCLRRFERAHSKGVTCLSFSKDSSQILSASFDQTIRIHGLKSGKTLKEFRGHSSFVNEATFTQDGHYIISASSDGTVKIWNMKTTECSNTFKSLGSTAGTDITVNSVILLPKNPEHFVVCNRSNTVVIMNMQGQIVRSFSSGKREGGDFVCCALSPRGEWIYCVGEDFVLYCFSTVTGKLERTLTVHEKDVIGIAHHPHQNLIATYSEDGLLKLWKP

SEQ ID NO: 8724 - protein, 316 aa, Homo sapiens
MQSWVLISKELISLLHLSLLHLEEDKTTVSQESRRAETLVCCCFDLLKKLRAKLQSLKAEREEARHREEMALRGKDAAEIVLEAFCAHASQRISQLEQDLASMREFRGLLKDAQTQLVGLHAKQEELVQQTVSLTSTLQQDWRSMQLDYTTWTALLSRSRQLTEKLTVKSQQALQERDVAIEEKQEVSRVLEQVSAQLEECKGQTEQLELENSRLATDLRAQLQILANMDSQLKELQSQHTHCAQDLAMKDELLCQLTQSNEEQAAQWQKEEMALKHMQAELQQQQAVLAKEVRDLKETLEFADQENQVAHLELAW

SEQ ID NO: 8725 - protein, 198 aa, Homo sapiens; identical to SEQ ID NO: 5709

SEQ ID NO: 8726 - protein, 196 aa, Homo sapiens
MVPRPWSGSPGPGECLHSLLSERLWICRDISAQRRSAPGSPRPSDCQQLSFLPGNQPTFLCLQALAALVPGVTQVDNKSGFLQKRPHRQHPGILKLPHVRLPQALANGAQLLLLGSAGPTMENQVQTLTSYLWSRHLPVEPEELQRRARHLEKKFLENPGPDFQSLFSPQTYLRQRRNFVEQCYTHYVKLPTIGKN

SEQ ID NO: 8727 - protein, 376 aa, Homo sapiens
MPDVVQTRQQAYRDKLAQQQAAAAAAAAAAASQQGSAKNGENTANGEENGAHTIARIWNLSENSTSGSTQLVLRHCIREGGQDVPSNKDVTSLDWNSEGTLLATGSYDGFARIWTKDGNLASTLGQHKGPIFALKWNKKGNFILSAGVDKTTIIWDAHTGEAKQQFPFHSAPALDVDWQSNNTFASCSTDMCIHVCKLGQDRPIKTFQGHTNEVNAIKWDPTGNLLASCSDDMTLKIWSMKQDNCVHDLQAHNKEIYTIKWSPTGPGTNNPNANLMLASASFDSTVRLWDVDRGICIHTLTKHQEPVYSVAFSPDGRYLASGSFDKCVHIWNTQTGALVHSYRGTGGIFEVCWNAAGDKVGASASDGSVCVLDLRK

SEQ ID NO: 8728 - protein, 371 aa, Homo sapiens
MHIKSIILEGFKSYAQRTEVNGFDPLFNAITGLNGSGKSNILDSICFLLGISNLSQVRASNLQDLVYKNGQAGITKASVSITFDNSDKKQSPLGFEVHDEITVTRQVVIGGRNKYLINGVNANNTRVQDLFCSVGLNVNNPHFLIMQGRITKVLNMKPPEILSMIEEAAGTRMYEYKKIAAQKTIEKKEAKLKEIKTILEEEITPTIQKLKEERSSYLEYQKVMREIEHLSRLYIAYQFLLAEDTKVRSAEELKEMQDKVIKLQEELSENDKKIKALNHEIEELEKRKDKETGGILRSLEDALAEAQRVNTKSQSAFDLKKKNLACEESKRKELEKNMVEDSKTLAAKEKEKIKRKAFWKSAGSCLVILVD

SEQ ID NO: 8729 - protein, 168 aa, Homo sapiens
HKLQSGIGRLILKEEMKARSSSYADPWTPPRSSTSSREALHTAGYEMSLNGSPRSHYLADSDPLISKSASLPAYRRNGLHRTPSADLFHYDSMNAVNWGMREYKIYPYELLLVTTRGRNRLPKDVDRTRLERHLSQEEFYQVFGMTISEFDRLALWKRNELKKQARLF

SEQ ID NO: 8730 - protein, 589 aa, Homo sapiens; identical to SEQ ID NO: 5669

SEQ ID NO: 8731 - protein, 428 aa, Homo sapiens
MSMLKPSGLKAPTKILKPGSTALKTPTAVVAPVEKTISSEKASSTPSSETQEEFVDDFRVGERVWVNGNKPGFIQFLGETQFAPGQWAGIVLDEPIGKNDGSVAGVRYFQCEPLKGIFTRPSKLTRKVQAEDEANGLQTTPASRATSPLCTSTASMVSSSPSTPSNIPQKPSQPAAKEPSATPPISNLTKTASESISNLSEAGSIKKGERELKIGDRVLVGGTKAGVVRFLGETDFAKGEWCGVELDEPLGKNDGAVAGTRYFQCQPKYGLFAPVHKVTKIGFPSTTPAKAKANAVRRVMATTSASLKRSPSASSLSSMSSVASSVSSRPSRTGLHVLELEAKMDQLRTMVEAADREKVELLNQLEEEKRKVEDLQFRVEEESITKGDLEQKSQISEDPENVRGHLTVWIFPLLTKIDHRLKCLLIYS

SEQ ID NO: 8732 - protein, 1160 aa, Homo sapiens
MVVTLGPGPDCLILEASRQPQLVPKPERMASDGASALPGPDMSMKPSAAPSPSPALPFLPPTSDPPDHPPREPPPQPIMPSVFSPDNPLMLSAFPSSLLVTGDGGPCLSGAGAGKVIVKVKTEGGSAEPSQTQNFILTQTALNSTAPGTPCGGLEGPAPPFVTASNVKTILPSKAVGVSQEGPPGLPPQPPPPVAQLVPIVPLEKAWPGPHGTTGEGGPVATLSKPSLGDRSKISKDVYENFRQWQRYKALARRHLSQSPDTEALSCFLIPVLRSLARLKPTMTLEEGLPLAVQEWEHTSNFDRMIFYEMAERFMEFEAEEMQIQNTQLMNGSQGLSPATPLKLDPLGPLASEVCQQPVYIPKKAASKTRAPRRRQRKAQRPPAPEAPKEIPPEAVKEYVDIMEWLVGTHLATGESDGKQEEEGQQQEEEGMYPDPGLLSYINELCSQKVFVSKVEAVIHPQFLADLLSPEKQRDPLALIEELEQEEGLTLAQLVQKRLMALEEEEDAEAPPSFSGAQLDSSPSGSVEDEDGDGRLRPSPGLQGAGGAACLGKVSSSGKRAREVHGGQEQALDSPRGMHRDGNTLPSPSSWDLQPELAAPQGTPGPLGVERRGSGKVINQVSLHQDGHLGGAGPPGHCLVADRTSEALPLCWQGGFQPESTPSLDAGLAELAPLQGQGLEKQVLGLQKGQQTGGRGVLPQGKEPLAVPWEGSSGAMWGDDRGTPMAQSYDQNPSPRAAGERDDVCLSPGVWLSSEMDAVGLELPVQIEEVIESFQVEKCVTEYQEGCQGLGSRGNISLGPGETLVPGDTESSVIPCGGTVAAAALEKRNYCSLPGPLRANSPPLRSKENQEQSCETVGHPSDLWAEGCFPLLESGDSTLGSSKETLPPTCQGNLLIMGTEDASSLPEASQEAGSRGNSFSPLLETIEPVNILDVKDDCGLQLRVSEDTCPLNVHSYDPQGEGRVDPDLSKPKNLAPLQESQESYTTGTPKATSSHQGLGSTLPRRGTRNAIVPRETSVSKTHRSADRAKGKEKKKKEAEEEDEELSNFAYLLASKLSLSPREHPLSPHHASGGQGSQRASHLLPAGAKGPSKLPYPVAKSGKRALAGGPAPTEKTPHSGAQLGVPREKPLALGVVRPSQPRKRRCDSFVTGRRKKRRRSQ

SEQ ID NO: 8733 - protein, 515 aa, Homo sapiens
LNSQCRNKNPFAAGPRPPHHQFFQRPQIQPPRATIPNSSPSIRPGAQTPTAVYQANQHIMMVNHLPMPYPVPQGPQYCIPQYRHSGPPYVGPPQQYPVQPPGPGPFYPGPGPGDFPNAYGTPFYPSQPVYQSAPIIVPTQQQPPPAKREKKTIRIRDPNQGGKDITEEIMSGGGSRNPTPPIGRPTSTPTPPQQLPSQVPEHSPVVYGTVESAHLAASTPVTAASDQKQEEKPKPDPVLKSPSPVLRLVLSGEKKEQEGQTSETTAIVSIAELPLPPSPTTVSSVARSTIAAPTSSALSSQPIFTTAIDDRCELSSPREDTIPIPSLTSCTETSDPLPTNENDDDICKKPCSVAPNDIPLVSSTNLINEINGVSEKLSATESIVEIVKQEVLPLTLELEILENPPEEMKLECIPAPITPSTVPSFPPTPPTPPASPPHTPVIVPAAATTVSSPSAAITVQRVLEEDESIRTCLSEDAKEIQNKIEVEADGQTEEILDSQNLNSRRSPVPETSNEC

SEQ ID NO: 8734 - protein, 67 aa, Homo sapiens; identical to SEQ ID NO: 8714

SEQ ID NO: 8735 - protein, 805 aa, Homo sapiens
MMQNVHLAPETDEDDLYSGYNDYNPIYDIEELENDAAFQQAVRTSHGRRPPSKTSLASSIGRPMTGAIQDGVTRPMTAVRAAGFTKAALRGSAFDPLSQSRGPASPLEAKKKDSPEEKIKQLEKEVNELVEESCIANSCGDLKLALEKAKDAGRKERVLVRQREQVTTPENINLDLTYSVLFNLASQYSVNEMYAEALNTYQVIVKNKMFSNAGILKMNMGNIYLKQRNYSKAIKFYRMALDQVPSVNKQMRIKIMQNIGVTFIQAGQYSDAINSYEHIMSMAPNLKAGYNLTICYFAIGDREKMKKAFQKLITVPLEIDEDKYISPSDDPHTNLVTEAIKNDHLRQMERERKAMAEKYIMTSAKLIAPVIETSFAAGYDWCVEVVKASQYVELANDLEINKAVTYLRQKDYNQAVEILKVLEKKDSRVKSAAATNLSALYYMGKDFAQASSYADIAVNSDRYNPAALTNKGNTVFANGDYEKAAEFYKEALRNDSSCTEALYNIGLTYEKLNRLDEALDCFLKLHAILRNSAEVLYQIANIYELMENPSQAIEWLMQVVSVIPTDPQVLSKLGELYDREGDKSQAFQYYYESYRYFPCNIEVIEWLGAYYIDTQFWEKAIQYFERASLIQPTQVKWQLMVASCFRRSGNYQKALDTYKDTHRKFPENVECLRFLVRLCTDLGLKDAQEYARKLKRLEKMKEIREQRIKSGRDGSGGSRGKREGSASGDSGQNYSASSKGERLSARLRALPGTNEPYESSSNKEIDASYVDPLGPQIERPKTAAKKRIDEDDFADEELGDDLLPE

SEQ ID NO: 8736 - protein, 254 aa, Homo sapiens
MAPGSFAEYTVVPASIATPVPSVKPEYLTLLVSGTTAYISLKELGGLSEGKKVLVTAAAGGTGQFAMQLSKKAKCHVIGTCSSDEKSAFLKSLGCDRPINYKTEPVGTVLKQEYPEGVDVVYESVGGAMFDLAVDALATKGRLIVIGFISGYQTPTGLSPVKAGTLPAKLLKKSASVQGFFLNHYLSKYQAAMSHLLEMCVSGDLVCEVDLGDLSPEGRFTGLESIFRAVNYMYMGKNTGKIVVELPHSVNSKL

SEQ ID NO: 8737 - protein, 403 aa, Homo sapiens
MHHPIQMKPADSEKSNAVEDRKLFIGMVSKKCNENDIRVMFSPFGQIEECRILRGPDGLSRGCAFVTFSTRAMAQNAIKAMHQSQTMEGCSSPIVVKFADTQKDKEQRRLQQQLAQQMQQLNTATWGNLTGLGGLTPQYLALLQQATSSSNLGAFSGIQQMAGMNALQLQNLATLAAAAAAAQTSATSTNANPLSTTSSALGALTSPVAASTPNSTAGAAMNSLTSLGTLQGLAGATVGLNNINALAVAQMLSGMAALNGGLGATGLTNGTAGTMDALTQAYSGIQQYAAAALPTLYSQSLLQQQSAAGSQKEGPEGANLFIYHLPQEFGDQDILQMFMPFGNVISAKVFIDKQTNLSKCFGFVSYDNPVSAQAAIQAMNGFQIGMKRLKVQLKRSKNDSKPY

SEQ ID NO: 8738 - protein, 443 aa, Homo sapiens
MAEFLKQVKPYVEEGLHPQIIIRAFRTATQLAVNKIKEIAVTVKKADKVEQRKLLEKCAMTALSSKLISQQKAFFAKMVVDAVMMLDDLLQLKMIGIKKVQGGALEDSQLVAGVAFKKTFSYAGFEMQPKKYHNPKIALLNVELELKAEKDNAEIRVHTVEDYQAIVDAEWNILYDKLEKIHHSGAKVVLSKLPIGDVATQYFADRDMFCAGRVPEEDLKRTMMACGGSIQTSVNALSADVLGRCQVFEETQIGGERYNFFTGCPKAKTCTFILRGGAEQFMEETERSLHDAIMIVRRAIKNDSVVAGGGAIEMELSKYLRDYSRTIPGKQQLLIGAYAKALEIIPRQLCDNAGFDATNILNKLRARHAQGGTWYGVDINNEDIADNFEAFVWEPAMVRINALTAASEAACLIVSVDETIKNPRSTVDAPTAAGRGRGRGRPH

SEQ ID NO: 8739 - protein, 730 aa, Homo sapiens
MQLFEQPCPGEDPRPGGQIGEVELSSYTPPAGVPGKPAAPHFLPVLCSVSPSGSRVPHDLLGGSGGFTLEDALFGLLFGADATLLQSPVVLCGLPDGQLCCVILKALVTSRSAPGDPNALVKILHHLEEPVIFIGALKTEPQAAEAAENFLPDEDVHCDCLVAFGHHGRMLAIKASWDESGKLVPELREYCLPGPVLCAACGGGGRVYHSTPSDLCVVDLSRGSTPLGPEQPEEGPGGLPPMLCPASLNICSVVSLSASPRTHEGGTKLLALSAKGRLMTCSLDLDSEMPGPARMTTESAGQKIKELLSGIGNISERVSFLKKAVDQRNKALTSLNEAMNVSCALLSSGTGPRPISCTTSTTWSRLQTQDVLMATCVLENSSSFSLDQGWTLCIQVLTSSCALDLDSACSAITYTIPVDQLGPGARREVTLPLGPGENGGLDLPVTVSCTLFYSLREVVGGALAPSDSEDPFLDECPSDVLPEQEGVCLPLSRHTVDMLQCLRFPGLAPPHTRAPSPLGPTRDPVATFLETCREPGSQPAGPASLRAEYLPPSVASIKVSAELLRAALKDGHSGVPLCCATLQWLLAENAAVDVVRARALSSIQGVAPDGANVHLIVREVAMTDLCPAGPIQAVEIQVESSSLADICRAHHAVVGRMQTMVTEQATQGSSAPDLRVQYLRQIHANHETLLREVQTLRDRLCTEDEASSCATAQRLLQVYRQLRHPSLILL

SEQ ID NO: 8740 - protein, 1392 aa, Homo sapiens
MSMLKPSGLKAPTKILKPGSTALKTPTAVVAPVEKTISSEKASSTPSSETQEEFVDDFRVGERVWVNGNKPGFIQFLGETQFAPGQWAGIVLDEPIGKNDGSVAGVRYFQCEPLKGIFTRPSKLTRKVQAEDEANGLQTTPASRATSPLCTSTASMVSSSPSTPSNIPQKPSQPAAKEPSATPPISNLTKTASESISNLSEAGSIKKGERELKIGDRVLVGGTKAGVVRFLGETDFAKGEWCGVELDEPLGKNDGAVAGTRYFQCQPKYGLFAPVHKVTKIGFPSTTPAKAKANAVRRVMATTSASLKRSPSASSLSSMSSVASSVSSRPSRTGLLTETSSRYARKISGTTALQEALKEKQQHIEQLLAERDLERAEVAKATSHVGEIEQELALARDGHDQHVLELEAKMDQLRTMVEAADREKVELLNQLEEEKRKVEDLQFRVEEESITKGDLEVATVSEKSRIMELEKDLALRVQEVAELRRRLESNKPAGDVDMSLSLLQEISSLQEKLEVTRTDHQREITSLKEHFGAREETHQKEIKALYTATEKLSKENESLKSKLEHANKENSDVIALWKSKLETAIASHQQAMEELKVSFSKGLGTETAEFAELKTQIEKMRLDYQHEIENLQNQQDSERAAHAKEMEALRAKLMKVIKEKENSLEAIRSKLDKAEDQHLVEMEDTLNKLQEAEIKVKELEVLQAKCNEQTKVIDNFTSQLKATEEKLLDLDALRKASSEGKSEMKKLRQQLEAAEKQIKHLEIEKNAESSKASSITRELQGRELKLTNLQENLSEVSQVKETLEKELQILKEKFAEASEEAVSVQRSMQETVNKLHQKEEQFNMLSSDLEKLRENLADMEAKFREKDEREEQLIKAKEKLENDIAEIMKMSGDNSSQLTKMNDELRLKERDVEELQLKLTKANENASFLQKSIEDMTVKAEQSQQEAAKKHEEEKKELERKLSDLEKKMETSHNQCQELKARYERATSETKTKHEEILQNLQKTLLDTEDKLKGAREENSGLLQELEELRKQADKAKAAQTAEDAMQIMEQMTKEKTETLASLEDTKQTNAKLQNELDTLKENNLKNVEELNKSKELLTVENQKMEEFRKEIETLKQAAAQKSQQLSALQEENVKLAEELGRSRDEVTSHQKLEEERSVLNNQLLEMKKRESKFIKDADEEKASLQKSISITSALLTEKDAELEKLRNEVTVLRGENASAKSLHSVVQTLESDKVKLELKVKNLELQLKENKRQLSSSSGNTDTQADEDERAQESQIDFLNSVIVDLQRKNQDLKMKVEMMSEAALNGNGDDLNNYDSDDQEKQSKKKPRLFCDICDCFDLHDTEDCPTQAQMSEDPPHSTHHGSRGEERPYCEICEMFGHWATNCNDDETF

SEQ ID NO: 8741 - protein, 163 aa, Homo sapiens
MFRKIGIEALKQVTKRYARKQNRWVKNRFLSRPGPIVPPVYGLEVSDVSKWEESVLEPALEIVQSFIQGHKPTATPIKMPYNEAENKRSYHLCDLCDRIIIGDREWAAHIKSKSHLNQLKKRRRLDSDAVNTIESQSVSPDHNKEPKEKGSPGQNDQELKCSV

SEQ ID NO: 8742 - protein, 533 aa, Homo sapiens
MASPGKDNYRMKSYKNNALNPEEMRRRREEEGIQLRKQKREQQLFKRRNVELINEEAAMFDSLLMDSYVSSTTGESVITREMVEMLFSDDSDLQLATTQKFRKLLSKEPSPPIDEVINTPRVVDRFVEFLKRNENCTLQFEAAWALTNIASGTSQQTKIVIEAGAVPIFIELLNSDFEDVQEQAVWALGNIAGDSSVCRDYVLNCSILNPLLTLLTKSTRLTMTRNAVWALSNLCRGKNPPPEFAKVSPCLPVLSRLLFSSDSDLLADACWALSYLSDGPNEKIQAVIDSGVCRRLVELLMHNDYKVASPALRAVGNIVTGDDIQTQVILNCSALPCLLHLLSSPKESIRKEACWTISNITAGNRAQIQAVIDANIFPVLIEILQKAEFRTRKEAAWAITNATSGGTPEQIRYLVSLGCIKPLCDLLTVMDSKIVQVALNGLENILRLGEQEGKRSGSGVNPYCGLIEEAYGLDKIEFLQSHENQEIYQKAFDLIEHYFGVEDDDSSLAPQVDETQQQFIFQQPEAPMEGFQL

SEQ ID NO: 8743 - protein, 330 aa, Homo sapiens; identical to SEQ ID NO: 6983

SEQ ID NO: 8744 - protein, 191 aa, Homo sapiens
MSRERGSRSEEPGAGNRESGSREPGLAAAAMSTVDLARVGACILKHAVTGEAVELRSLWREHACVVAGLRRFGCVVCRWIAQDLSSLAGLLDQHGVRLVGVGPEALGLQEFLDGDYFAGELYLDESKQLYKELGFKRYNSLSILPAALGKPVRDVAAKSPGDYVPKEHILQVLGISAEVCASDPPQCDREV

SEQ ID NO: 8745 - protein, 349 aa, Homo sapiens
NTIHDVLDVEAAVVNLDNSVVDLETLQALYENRAQSDELEKIEKHGRSSKDKENAKSLDKPEQFLYELSLIPNFSERVFCILFQSTFSESICSIRRKLELLQKLCETLKNGPGVMQVLGLVLAFGNYMNGGNKTRGQADGFGLDILPKLKDVKSSDNSRSLLSYIVSYYLRNFDEDAGKEQCLFPLPEPQDLFQASQMKFEDFQKDLRKLKKDLKACEVEAGKVYQVSSKEHMQPFKENMEQFIIQAKIDQEAEENSLTETHKCFLETTAYFFMKPKLGEKEVSPNAFFSIWHEFSSDFKDFWKKENKLLLQERVKEAEEVCRQKKGKSLYKIKPRHDSGIKNNNSMHT

SEQ ID NO: 8746 - protein, 189 aa, Homo sapiens
MTASASSFSSSQGVQQPSIYSFSQITRSLFLSNGVAANDKLLLSSNRITAIVNASVEGQRILRGIQYIKVPVTDARDSRLYDFFDPIADLIHTIDMRQGRTLLHCMAGVSRSASLCLAYLMKYHSMSLLDAHTWTKSRRPIIRPNNGFWEQLINYEFKLFNNNTVRMINSPVGNIPDIYEKDLRMMISM

SEQ ID NO: 8747 - protein, 182 aa, Homo sapiens; identical to SEQ ID NO: 5239

SEQ ID NO: 8748 - protein, 128 aa, Homo sapiens [sequence omitted]

SEQ ID NO: 8749 - protein, 163 aa, Homo sapiens; identical to SEQ ID NO: 8741

SEQ ID NO: 8750 - protein, 407 aa, Homo sapiens
MAAELYAPASAAAADLANSNAGAAVGRKAGPRSPPSAPAPAPPPPAPAPPTLGNNHQESPGWRCCRPTLRERNALMFNNELMADVHFVVGPPGATRTVPAHKYVLAVGSSVFYAMFYGDLAEVKSEIHIPDVEPAAFLILLKYMYSDEIDLEADTVLATLYAAKKYIVPALAKACVNFLETSLEAKNACVLLSQSRLFEEPELTQRCWEVIDAQAEMALRSEGFCEIDRQTLEIIVTREALNTKEAVVFEAVLNWAEAECKRQGLPITPRNKRHVLGRALYLVRIPTMTLEEFANGAAQSDILTLEETHSIFLWYTATNKPRLDFPLTKRKGLAPQRCHRFQSSAYRSNQWRYRGRCDSIQFAVDRRVFIAGLGLYGSSSGKAEYSVKIELKRLGVVLAQNLTKFMS

SEQ ID NO: 8751 - protein, 200 aa, Homo sapiens
MLELVAQKQREREEREEREALERERQRRRQGQELSAARQRLQEDEMRRAAEERRREKAEELAARQRVREKIERDKAERAKKYGGSVGSQPPPVAPEPGPVPSSPSQEPPTKREYDQCRIQVRLPDGTSLTQTFRAREQLAAVRLYVELHRGEELGGGQDPVQLLSGFPRRAFSEADMERPLQELGLVPSAVLIVAKKCPS

SEQ ID NO: 8752 - protein, 294 aa, Homo sapiens
MGLASWSQLASTPRAPGSRDARWERREPALRGAKDRLTIGKHLDMGSPQLRTRDRGWPSPRPEREKRTSQSARRPTCTESRWKSEEEVESDDEYLALPARLTQVSSLVSYLGSISTLVTLPTGDIKGQSPLEVSDSDGPASFPSSSSQSQLPPGAALQGSGDPEGQNPCFLRSFVRAHDSAGEGSLGSSQALGVSSGLLKTRPSLPARLDRWPFSDPDVEGQLPRKGGEQGKESLVQCVKVMTLNVRKLCVQVSCLFPQSTNIIIKHVHVDQALFMCQALCCTLSYSVLTTFTR

SEQ ID NO: 8753 - protein, 117 aa, Homo sapiens
MVRKITLVSAAPGKVICEMKVEEEHTNAIGTLHGGLTATLVDNISTMALLCTERGAPGVSVDMNITYMSPAKLGEDIVITAHVLKQGKTLAFTSVDLTNKATGKLIAQGRHTKHLGN

SEQ ID NO: 8754 - protein, 279 aa, Homo sapiens
MTSGKIKKFIQENIFGICPHMTEDNKDLIQGKDLLIAYYDVDYEKNAKGSNYWRNRVMMVAKKFLDAGHKLNFAVASRKTFSHELSDFGLESTAGEIPVVAIRTAKGEKFVMQEEFSRDGKALERFLQDYFDGNLKRYLKSEPIPESNDGPVKVVVAENFDEIVNNENKDVLIEFYAPWCGHCKNLEPKYKELGEKLSKDPNIVIAKMDATANDVPSPYEVRGFPTIYFSPANKKLNPKKYEGGRELSDFISYLQREATNPPVIQEEKPKKKKKAQEDL

SEQ ID NO: 8755 - protein, 1075 aa, Homo sapiens
MSQGFHPERDPSDLKKVKAVEENGEEAEPVRNGAESVSEGEGIDANSGSTDSSGDGVTFPFKPESWKPTDTEGKKQYDREFLLDFQFMPACIQKPEGLPPISDVVLDKINQPKLPMRTLDPRILPRGPDFTPAFADFGRQTPGGRGVPICKVQSRHGLPILEQSKAPTCPPLVMSHPPMKSLPLGLLNVGSRRSQPGQRREPRKIITVSVKEDVHLKKAENAWKPSQKRDSQADDPENIKTQELFRKVRSILNKLTPQMFNQLMKQVSGLTVDTEERLKGVIDLVFEKAIDEPSFSVAYANMCRCLVTLKVPMADKPGNTVNFRKLLLNRCQKEFEKDKADDDVFEKKQKELEAASAPEERTRLHDELEEAKDKARRRSIGNIKFIGELFKLKMLTEAIMHDCVVKLLKNHDEESLECLCRLLTTIGKDLDFEKAKPRMDQYFNQMEKIVKERKTSSRIRFMLQDVIDLRLCNWVSRRADQGPKTIEQIHKEAKIEEQEEQRKVQQLMTKEKRRPGVQRVDEGGWNTVQGAKNSRVLDPSKFLKITKPTIDEKIQLVPKAQLGSWGKGSSGGAKASETDALRSSASSLNRFSALQPPAPSGSTPSTPVEFDSRRTLTSRGSMGREKNDKPLPSATARPNTFMRGGSSKDLLDNQSQEEQRREMLETVKQLTGGVDVERNSTEAERNKTRESAKPEISAMSAHDKAALSEEELERKSKSIIDEFLHINDFKEAMQCVEELNAQGLLHVFVRVGVESTLERSQITRDHMGQLLYQLVQSEKLSKQDFFKGFSETLELADDMAIDIPHIWLYLAELVTPMLKEGGISMRELTIEFSKPLLPVGRAGVLLSEILHLLCKQMSHKKVGALWREADLSWKDFLPEGEDVHNFLLEQKLDFIESDSPCSSEALSKKELSAEELYKRLEKLIIEDKANDEQIFDWVEANLDEIQMSSPTFLRALMTAVCKAAIIADSSTFRVDTAVIKQRVPILLKYLDSDTEKELQALYALQASIVKLDQPANLLRMFFDCLYDEEVISEDAFYKWESSKDPAEQNGKGVALKSVTAFFTWLREAEEESEDN

SEQ ID NO: 8756 - protein, 157 aa, Homo sapiens
MKCIPYSVLLKDLEMRNLRELEDLIIEAVYTDIIQGKLDQRNQLLEVDFCIGRDIRKKDINNIVKTLHEWCDGCEAVLLGIEQQVLRANQYKENHNRTQQQVEAEVTNIKKTLKATASSSAQEMEQQLAERECPPHAEQRQPTKKMSKVKGLVSSRH

SEQ ID NO: 8757 - protein, 278 aa, Homo sapiens
MDCREMDLYEDYQSPFDFDAGVNKSYLYLSPSGNSSPPGSPTLQKFGLLRTDPVPEEGEDVAATISATETLSEEEQEELRRELAKVEEEIQTLSQVLAAKEKHLAEIKRKLGINSLQELKQNIAKGWQDVTATSAYKKTSETLSQAGQKASAAFSSVGSVITKKLEDVKNSPTFKSFEEKVENLKGSPKNVESFASMLRHSPLTQMGPAKDKLVIGRIFHIVENDLYIDFGGKFHCVCRRPEVDGESPISWYAVWRRFSQVMITCFSSNSDFGKHRKR

SEQ ID NO: 8758 - protein, 1040 aa, Homo sapiens; identical to SEQ ID NO: 5697

SEQ ID NO: 8759 - protein, 602 aa, Homo sapiens
MSDKSDLKAELERKKQRLAQIREEKKRKEEERKKKEADMQQKKEPVQDDSDLDRKRRETEALLQSIGISPEPPLVPTPMSPSSKSVSTPSEAGSQDSGDLGPLTRRRLHKLGVSKVTQVDFLPREVVSYSKETQTPLATHQSEEDEEDEEMVESKVGQDSELENQDKKQEVKEAPPRELTEEEKQQILHSEEFLIFFDRTIRVIERALAEDSDIFFDYSGRELEEKDGDVQAGANLSFNRQFYDEHWSKHRVVTCMDWSLQYPELMVASYNNNEDAPHEPDGVALVWNMKFKKTTPEYVFHCQSSVMSVCFARFHPNLVVGGTYSGQIVLWDNRSHRRTPVQRTPLSAAAHTHPVYCVNVVGTQNAHNLITVSTDGKMCSWSLDMLSTPQESMELVYNKSKPVAVTGMAFPTGDVNNFVVGSEEGTVYTACRHGSKAGIGEVFEGHQGPVTGINCHMAVGPIDFSHLFVTSSFDWTVKLWTTKHNKPLYSFEDNADYVYDVMWSPVHPALFACVDGMGRLDLWNLNNDTEVPTASVAIEGASALNRVRWAQAGKEVAVGDSEGRIWVYDVGEGLAMLPGWSQNSWTQAILLCWPPKVLGLQT

SEQ ID NO: 8760 - protein, 948 aa, Homo sapiens
MYGSARSVGKVEPSSQSPGRSPRLPRSPRLGHRRTNSTGGSSGSSVGGGSGKTLSMENIQSLNAAYATSGPMYLSDHENVGSETPKSTMTLGRSGGRLPYGVRMTAMGSSPNIASSGVASDTIAFGEHHLPPVSMASTVPHSLRQARDNTIMDLQTQLKEVLRENDLLRKDVEVKESKLSSSMNSIKTFWSPELKKERALRKDEASKITIWKEQYRVVQEENQHMQMTIQALQDELRIQRDLNQLFQQDSSSRTGEPCVAELTEENFQRLHAEHERQAKELFLLRKTLEEMELRIETQKQTLNARDESIKKLLEMLQSKGLSAKATEEDHERTRRLAEAEMHVHHLESLLEQKEKENSMLREEMHRRFENAPDSAKTKALQTVIEMKDSKISSMERGLRDLEEEIQMLKSNGALSTEEREEEMKQMEVYRSHSKFMKNKIGQVKQELSRKDTELLALQTKLETLTNQFSDSKQHIEVLKESLTAKEQRAAILQTEVDALRLRLEEKETMLNKKTKQIQDMAEEKGTQAGEIHDLKDMLDVKERKVNVLQKKIENLQEQLRDKEKQMSSLKERVKSLQADTTNTDTALTTLEEALAEKERTIERLKEQRDRDEREKQEEIDNYKKDLKDLKEKVSLLQGDLSEKEASLLDLKEHASSLASSGLKKDSRLKTLEIALEQKKEECLKMESQLKKAHEAALEARASPEMSDRIQHLEREITRYKDESSKAQAEVDRLLEILKEVENEKNDKDKKIAELESLFSRQVKDQNKKVANLKHKEQVEKKKSAQMLEEARRREDNLNDSSQQLQVEELLMAMEKVKQELESMKAKLSSTQQSLAEKETHLTNLRAERRKHLEEVLEMKQEALLAAISEKDANIALLELSSSKKKTQEEVAALKREKDRLVQQLKQQTQNRMKLMADNYEDDHFKSSHSNQTNHKPSPDQDEEEGIWA

SEQ ID NO: 8761 - protein, 913 aa, Homo sapiens
MEVGSEEEKWEKLDAEFDHFVVDMKPFVLKLPHRTERQRCALWIRKLCEPSGTGAGIMGRKNRNLYAKLLLHMLKRGALEGPFTHRPEPGTLKILPSYMSIYFDEPNPARAKGSSPEGLPAWVLGELETSEHKLNESWKLSSGEDNTLVQSPTDVYSREQYTGKLRVRSHSLSPTHREDGQNITPKICEVYSKKSPVSLDDSDIEARLNSWNLGLDMKTKMMEAKFHEEKLKLQQKHDADVQKILERKNNEIEELKTLYRSKQHETEETIRKLEKKVQTLIRDCQVIRETKEDQIAELKKICEQSTESLNNDWEKKLHNAVAEMEQEKFDLQKQHTENIQELLEDTNVRLNKMESEYMAQTQSTNHMIKELEARVQQLTGEAENSNLQRQKLIQEKAELERCYQITCSELQEVKARRNTLHKEKDHLVNDYEQNMKLLQTKYDADINLLKQEHALSASKASSMIEELEQNVCQLKQQLQESELQRKQQLRDQENKFQMEKSHLKHIYEKKAHDLQSELDKGKEDTQKKIHKFEEALKEKEEQLTRVTEVQRLQAQQADAALEEFKRQVELNSEKVYAEMKEQMEKVEADLTRSKSLREKQSKEFLWQLEDIRQRYEQQIVELKLEHEQEKTHLLQQHNAEKDSLVRDHEREIENLEKQLRAANMEHENQIQEFKKRDAQVIADMEAQVHKLREELINVNSQRKQQLVELGLLREEEKQRATREHEIVVNKLKAESEKMKIELKKTHAAETEMTLEKANSKLKQIEKEYTQKLAKSSQIIAELQTTISSLKEENSQQQLAAERRLQDVRQKFEDEKKQLIRDNDQAIKVLQDELENRSNQVRCAEKKLQHKELESQEQITYIRQEYETKLKGLMPASLRQELEDTISSLKSQVNFLQKRASILQEELTTYQGRR

SEQ ID NO: 8762 - protein, 274 aa, Homo sapiens
MQDEKLRDETEQPVSKVIERNRLRTVLKNLSLLKLLKSSNRRIQELHKLAKRCWHSLLSVPKILRISSGENSACNKTKQNNEEFQEIGCSEKELKSKKLESTGDPKKKEYKEWKSQVQSGMRNKEKTSLAAMPRKEKHIEPEVPRTSRDDSLNPGVQGRQPLTEGPRVIFIKPYRNRTPMGHMKQLDVADQWIWFEGLPTRIHLPAPRVMCRSSTLRWVKRRCTRFCSASLEMPMWHPYKVDVTWTRARGASRGWRSRHQLKGRNGWRNSRVYK

SEQ ID NO: 8763 - protein, 51 aa, Homo sapiens
MQLRHIGDNIDHRMVREDLQQDGRDALDHFVFFFFRRVQVLLHFFWNNHLL

SEQ ID NO: 8764 - protein, 147 aa, Homo sapiens
MAGGAREVLTLQLGHFAGFVGAHWWNQQDAALGRATDSKEPPGELCPDVLYRTGRTLHGQETYTPRLILMDLKGSLSSLKEEGGLYRDKQLDAAIAWQGKLTTHKEELYPKNPYLQDFLSAEVRASVLNFLTRCHNLRVSIGAGSAE

SEQ ID NO: 8765 - protein, 558 aa, Homo sapiens
MSVSVHETRKSRSSTGSMNVTLFHKASHPDCVLAASSRYFEAMFSHGLRESRDDTVNFQDNLHPEVLELLLDFAYSSRIAINEENAESLLEAGDMLQFHDVRDAAAEFLEKNLFPSNCLGMMLLSDAHQCRRLYEFSWRMCLVHFETVRQSEDFNSLSKDTLLDLISSDELETEDERVVFEAILQWVKHDLEPRKVHLPELLRSVRLALLPSDCLQEAVSSEALLMADERTKLIMDEALRCKTRILQNDGVVTSPCARPRKAGHTLLILGGQTFMCDKIYQVDHKAKEIIPKADLPSPRKEFSASAIGCKVYVTGGRGSENGVSKDVWVYDTVHEEWSKAAPMLIARFGHGSAELENCLYVVGGHTSLAGVFPASPSVSLKQVEKYDPGANKWMMVAPLRDGVSNAAVVSAKLKLFVFGGTSIHRDMVSKVQCYDPSENRWTIKAECPQPWRYTAAAVLGSQIFIMGGDTEFTAASAYRFDCETNQWTRIGDMTAKRMSCHALASGNKLYVVGGYFGTQRCKTLDCYDPTSDTWNCITTVPYSLIPTAFVSTWKHLPA

SEQ ID NO: 8766 - protein, 971 aa, Homo sapiens
MNFLRGVMGGQSAGPQHTEAETVRGAAGLGLGKGSGQGRGRSTRRPEECGLKFRHSFRLVKHILYHVTINVSDSEIIGYALDTLYNIISNEEEEEVGGSQEENSTRQSEDLGSQFTEIFIKQQENVTLLLSLLEEFDFHVRWPGVKLLTSLLKQLGPQVQQIILVSPMGVSRLMDLLADSREVIRNDGVLLLQALTRSNGAIQKIVAFENAFERLLDIISEEGNSDGGIVVEDCLILLQNLLKNNNSNQNFFKEGSYIQRMKPWFEVGDENSGWSAQKVTNLHLMLQLVRVLVSPTNPPGATSSCQKAMFQCGLLQQLCTILMATGVPADILTETINTVSEVIRGCQVNQDYFASVNAPSNPPRPAIVVLLMSMVNERQPFVLRCAVLYCFQCFLYKNQKGQGEIVSTLLPSTIDATGNSVSAGQLLCGGLFSTDSLSNWCAAVALAHALQENATQKEQLLRVQLATSIGNPPVSLLQQCTNILSQGDKIDRRGSKIQTRVGLLMLLCTWLSNCPIAVTHFLHNSANVPFLTGQIAENLGEEEQLVQGLCALLLGISIYFNDNSLESYMKEKLKQLIEKRIGKENFIEKLGFISKHELYSRASQKPQPNFPSPEYMIFDHEFTKLVKELEGVITKAIYKSSEEDKKEEEVKKTLEQHDNIVTHYKNMIREQDLQLEELRQQVSTLKCQNEQLQTAVTQQVSQIQQHKDQYNLLKIQLGKDNQHQGSYSEGAQMNGIQPEEIGRLREEIEELKRNQELLQSQLTEKDSMIENMKSSQTSGTNEQSSAIVSARDSEQVAELKQELATLKSQLNSQSVEITKLQTEKQELLQKTEAFAKSVEVQGETETIIATKTTDVEGRLSALLQETKELKNEIKALSEERTAIKEQLDSSNSTIAILQTEKDKLELEITDSKKEQDDLLVLLADQDQKILSLKNKLKDLGHPVEEEDELESGDQEDEDDESEDPGKDLDHI

SEQ ID NO: 8767 - protein, 85 aa, Homo sapiens
MGNSDSQYTLQGSKNHSNTITGAKQIPCSLKIRGIHAKEEKSLHGWGHGSNGAGYKSRSLARSCLSHFKSNQPYASRLGGPTCKV

SEQ ID NO: 8768 - protein, 57 aa, Homo sapiens
  MOD_RES (1)..(1): Any amino acid
XGRAPGPAIGGRRAGDSCPGWRRRSRSRGRGQRLSHGPRRRPQLLTETRRPVLVQWL

SEQ ID NO: 8769 - protein, 311 aa, Homo sapiens
MVSLRVNPLSLVEIILHVVRQMTDPNVALTFLEKTREKVKSSDEAVILCKTAIGALKLNIGDLQVTKETIEDVEEMLNNLPGVTSVHSRFYDLSSKYYQTIGNHASYYKDALRFLGCVDIKDLPVSEQQERAFTLGLAGLLGEGVFNFGELLMHPVLESLRNTDRQWLIDTLYAFNSGNVERFQTLKTAWGQQPDLAANEAQLLRKIQLLCLMEMTFTRPANHRQLTFEEIAKSAKITVNEVELLVMKALSVGLVKGSIDEVDKRVHMTWVQPRVLDLQQIKGMKDRLEFWCTDVKSMEMLVEHQAHDILT

SEQ ID NO: 8770 - protein, 386 aa, Homo sapiens
MKSLKACKREIKSVMNTAGNSAPSLFLKSNFEYLRGNYRKAVKLLNSSNIAEHPGFMKTGECLRCMFWNNLGCIHFAMSKHNLGIFYFKKALQENDNVCAQLSAGSTDPGKKFSGRPMCTLLTNKRYELLYNCGIQLLHIGRPLAAFECLIEAVQVYHANPRLWLRLAECCIAANKGTSEQETKGLPSKKGIVQSIVGQGYHRKIVLASQSIQNTVYNDGQSSAIPVASMEFAAICLRNALLLLPEEQQDPKQENGAKNSNQLGGNTESSESSETCSSKSHDGDKFIPAPPSSPLRKQELENLKCSILACSAYVALALGDNLMALNHADKLLQQPKLSGSLKFLGHLYAAEALISLDRISDAITHLNPENVTDVSLGISSNEQDQG

SEQ ID NO: 8771 - protein, 531 aa, Homo sapiens
MLQELNFGAYLGLPAFLLPLNQEDNTNLARVLTNHIHTGHHSSMFWMRVPLVAPEDLRDDIIENAPTTHTEEYSGEEKTWMWWHNFRTLCDYSKRIAVALEIGADLPSNHVIDRWLGEPIKAAILPTSIFLTNKKGFPVLSKMHQRLIFRLLKLEVQFIITGTNHHSEKEFCSYLQYLEYLSQNRPPPNAYELFAKGYEDYLQSPLQPLMDNLESQTYEVFEKDPIKYSQYQQAIYKCLLDRVPEEEKDTNVQVLMVLGAGRGPLVNASLRAAKQADRRIKLYAVEKNPNAVVTLENWQFEEWGSQVTVVSSDMREWVAPEKADIIVSELLGSFADNELSPECLDGAQHFLKDDGVSIPGEYTSFLAPISSSKLYNEVRACREKDRDPEAQFEMPYVVRLHNFHQLSAPQPCFTFSHPNRDPMIDNNRYCTLEFPVEVNTVLHGFAGYFETVLYQDITLSIRPETHSPGMFSWFPILFPIKQPITVREGQTICVRFWRCSNSKKVWYEWAVTAPVCSAIHNPTGRSYTIGL

SEQ ID NO: 8772 - protein, 262 aa, Homo sapiens; identical to SEQ ID NO: 5940

SEQ ID NO: 8773 - protein, 376 aa, Homo sapiens [sequence omitted]

SEQ ID NO: 8774 - protein, 344 aa, Homo sapiens
MAGSGCAWGAEPPRFLEAFGRLWQVQSRLGSGSSASVYRVRCCGNPGSPPGALKQFLPPGTTGAAASAAEYGFRKERAALEQLQGHRNIVTLYGVFTIHFSPNVPSRCLLLELLDVSVSELLLYSSHQGCSMWMIQHCARDVLEALAFLHHEGYVHADLKPRNILWSAENECFKLIDFGLSFKEGNQDVKYIQTDGYRAPEAELQNCLAQAGLQSDTECTSAVDLWSLGIILLEMFSGMKLKHTVRSQEWKANSSAIIDHIFASKAVVNAAIPAYHLRDLIKSMLHDDPSRRIPAEMALCSPFFSIPFAPHIEDLVMLPTPVLRLLNVLDDDYLENEEEYEGLC

SEQ ID NO: 8775 - protein, 488 aa, Homo sapiens
MALKMNTLSSNRANMLKEVQLMNRLSHPNILRFMGVCVHQGQLHALTEYINSGNLEQLLDSNLHLPWTVRVKLAYDIAVGLSYLHFKGIFHRDLTSKNCLIKRDENGYSAVVADFGLAEKIPDVSMGSEKLAVVGSPFWMAPEVLRDEPYNEKADVFSYGIILCEIIARIQADPDYLPRTENFGLDYDAFQHMVGDCPPDFLQLTFNCCNMDPKLRPSFVEIGKTLEEILSRLQEEEQERDRKLQPTARGLLEKAPGVKRLSSLDDKIPHKSPCPRRTIWLSRSQSDIFSRKPPRTVSVLDPYYRPRDGAARTPKVNPFSARQDLMGGKIKFFDLPSKSVISLVFDLDAPGPGTMPLADWQEPLAPPIRRWRSLPGSPEFLHQEACPFVGREESLSDGPPPRLSSLKYRVKEIPPFRASALPAAQAHEAMDCSILQEENGFGSRPQGTSPCPAGASEEMEVEERPAGSTPATFSTSGIGLQTQGKQDG

SEQ ID NO: 8776 - protein, 485 aa, Homo sapiens
MTLWILPKFKAVDFSPSLAAYTHTWLLPRFLEILIQCGHCKRLAPEYEAAATRLKGIVPLAKVDCTANTNTCNKYGVSGYPTLKIFRDGEEAGAYDGPRTADGIVSHLKKQAGPASVPLRTEEEFKKFISDKDASIVGFFDDSFSEAHSEFLKAASNLRDNYRFAHTNVESLVNEYDDNGEGIILFRPSHLTNKFEDKTVAYTEQKMTSGKIKKFIQENIFGICPHMTEDNKDLIQGKDLLIAYYDVDYEKNAKGSNYWRNRVMMVAKKFLDAGHKLNFAVASRKTFSHELSDFGLESTAGEIPVVAIRTAKGEKFVMQEEFSRDGKALERFLQDYFDGNLKRYLKSEPIPESNDGPVKVVVAENFDEIVNNENKDVLIEFYAPWCGHCKNLEPKYKELGEKLSKDPNIVIAKMDATANDVPSPYEVRGFPTIYFSPANKKLNPKKYEGGRELSDFISYLQREATNPPVIQEEKPKKKKKAQEDL

SEQ ID NO: 8777 - protein, 294 aa, Homo sapiens
MSAQHFVSTEQVELPGPGQWVVAECPARVDFSGGWSDTPPLAYELGGAVLGLAVRVDGRRPIGARARRIPEPELWLAVGPRQDEMTVKIVCRCLADLRDYCQPHAPGALLKAAFICAGIVHVHSELQLSEQLLRTFGGGFELHTWSELPHGSGLGTSSILAGTALAALQRAAGRVVGTEALIHAVLHLEQVLTTGGGWQDQVGGLMPGIKVGRSRAQLPLKVEVEEVTVPEGFVQKLNDHLLLVYTGKTRLARNLLQDVLRSWYARLPAVVQNAHSLVRQTEECAEGFRQGSHI

SEQ ID NO: 8778 - protein, 314 aa, Homo sapiens
VGRMEGCSSPIVVKFADTQKDKEQRRLQQQLAQQMQQLNTATWGNLTGLGGLTPQYLALLQQATSSSNLGAFSGIQQMAGMNALQLQNLATLAAAAAAAQTSATSTNANPLSTTSSALGALTSPVAASTPNSTAGAAMNSLTSLGTLQGLAGATVGLNNINALAGMAALNGGLGATGLTNGTAGTMDALTQAYSGIQQYAAAALPTLYSQSLLQQQSAAGSQKEGPEGANLFIYHLPQEFGDQDILQMFMPFGNVISAKVFIDKQTNLSKCFGFVSYDNPVSAQAAIQAMNGFQIGMKRLKVQLKRSKNDSKPY

SEQ ID NO: 8779 - protein, 360 aa, Homo sapiens
SMEKTYTSTSNNSISGSLKRLEDTTARFTNANFQEVSAHTSSGKDVSETRGSEGKGKKSSAHSSGQRGRKPGGGRNPGTTVSAASPFPQAGYKRAQTSGIEEETVKEKKRKGNKQSKHGPGRPKGNKNQENVSHLSVSSASPTSSVASAAGSITSSSLQKSPTLLRNGSLQSLSVGSSPVGSEISMQYRHDGACPTTTFSELLNAIHNDRGDSSTLTKQELKFIGIYNSNDVAVSFPNVVSGSGSSTPVSSSHLPQQSSGHLQQVGALSPSAVSSAAPAVATTQANTLSGSSLSQAPSHMYGNRSNSSMAALIAQSENNQTDQDLGDNSRNLVGRGSSPRGSLSPRSPVSSLQIRYDQPG

SEQ ID NO: 8780 - protein, 307 aa, Homo sapiens
MQSLTLDLLGPSELLLALNMGNTSFNEVMEAQLPSHGGPKPSAESDMGTRRDYIMAKYVEHRFARRCTPEPQRLWTAICNRDLLSVLEAFANGQDFGQPLPGPDAQAPEELVLHLAVKVANQASLPLVDFIIQNGGHLDAKAADGNTALHYAALYNQPDCLKLLLKGRALVGTVNEAGETALDIARKKHHKECEELLEQAQAGTFAFPLHVDYSWVISTEPGSDSEEDEEEKRCLLKLPAQAHWASGRLDISNKTYETVASLGAATPQGESEDCPPPLPVKNSSRTLVQGCARHASGGRREERARRE

SEQ ID NO: 8781 - protein, 498 aa, Homo sapiens
MSSCVSSQPSSNRAAPQDELGGRGSSSSESQKPCEALRGLSSLSIHLGMESFIVVTECEPGCAVDLGLARDRPLEADGQEVPLDTSGSQARPHLSGRKLSLQERSQGGLAAGGSLDMNGRCICPSLPYSPVSSPQSSPRLPRRPTVESHHVSITGMQDCVQLNQYTLKDEIGKGSYGVVKLAYNENDNTYYAMKVLSKKKLIRQAGFPRRPPPRGTRPAPGGCIQPRGPIEQVYQEIAILKKLDHPNVVKLVEVLDDPNEDHLYMVFELVNQGPVMEVPTLKPLSEDQARFYFQDLIKGIEYLHYQKIIHRDIKPSNLLVGEDGHIKIADFGVSNEFKGSDALLSNTVGTPAFMAPESLSETRKIFSGKALDVWAMGVTLYCFVFGQCPFMDERIMCLHSKIKSQALEFPDQPDIAEDLKDLITRMLDKNPESRIVVPEIKILVKTMIRKRSFGNPFEGSRREERSLSAPGNLLTKQGSEDNLQGTDPPPVGEEEVLL

SEQ ID NO: 8782 - protein, 199 aa, Homo sapiens; identical to SEQ ID NO: 5747

SEQ ID NO: 8783 - protein, 415 aa, Homo sapiens
MWRKVYTPRSSFELSAQPPSWEQRKLLEKCAMTALSSKLISQQKAFFAKMVVDAVMMLDDLLQLKMIGIKKVQGGALEDSQLVAGVAFKKTFSYAGFEMQPKKYHNPKIALLNVELELKAEKDNAEIRVHTVEDYQAIVDAEWNILYDKLEKIHHSGAKVVLSKLPIGDVATQYFADRDMFCAGRVPEEDLKRTMMACGGSIQTSVNALSADVLGRCQVFEETQIGGERYNFFTGCPKAKTCTFILRGGAEQFMEETERSLHDAIMIVRRAIKNDSVVAGGGAIEMELSKYLRDYSRTIPGKQQLLIGAYAKALEIIPRQLCDNAGFDATNILNKLRARHAQGGTWYGVDINNEDIADNFEAFVWEPAMVRINALTAASEAACLIVSVDETIKNPRSTVDAPTAAGRGRGRGRPH

SEQ ID NO: 8784 - protein, 1038 aa, Homo sapiens; identical to SEQ ID NO: 6752

SEQ ID NO: 8785 - protein, 480 aa, Homo sapiens
MRLRRLALFPGVALLLAAARLAAASEFFAPWCGHCKRLAPEYEAAATRLKGIVPLAKVDCTANTNTCNKYGVSGYPTLKIFRDGEEAGAYDGPRTADGIVSHLKKQAGPASVPLRTEEEFKKFISDKDASIVGFFDDSFSEAHSEFLKAASNLRDNYRFAHTNVESLVNEYDDNGEGIILFRPSHLTNKFEDKTVAYTEQKMTSGKIKKFIQENIFGICPHMTEDNKDLIQGKDLLIAYYDVDYEKNAKGSNYWRNRVMMVAKKFLDAGHKLNFAVASRKTFSHELSDFGLESTAGEIPVVAIRTAKGEKFVMQEEFSRDGKALERFLQDYFDGNLKRYLKSEPIPESNDGPVKVVVAENFDEIVNNENKDVLIEFYAPWCGHCKNLEPKYKELGEKLSKDPNIVIAKMDATANDVPSPYEVRGFPTIYFSPANKKLNPKKYEGGRELSDFISYLQREATNPPVIQEEKPKKKKKAQEDL

SEQ ID NO: 8786 - protein, 75 aa, Homo sapiens
MGVKLEIFRMIIYLTFPVAMFWVSNQAEWFEDDVIQRKRELWPPEKLQELEEFKERLRKRKRREEKLLRDAQQNS

SEQ ID NO: 8787 - protein, 268 aa, Homo sapiens; identical to SEQ ID NO: 8685

SEQ ID NO: 8788 - protein, 116 aa, Homo sapiens
MLLECGMQEEGLFRVAPSASKLKKLKAALDCCVVDVQEYSADPHAIAGALKSYLRELPEPLMTFELYDEWIQASNVQEQDKKLQALWNACEKLPKANHNNIRYLIKFYPSCQNIKM

SEQ ID NO: 8789 - protein, 301 aa, Homo sapiens
MVRTKTWTLKKHFVGYPTNSDFELKTAELPPLKNGEVLLEALFLTVDPYMRVAAKRLKEGDTMMGQQVAKVVESKNVALPKGTIVLASPGWTTHSISDGKDLEKLLTEWPDTIPLSLALGTVGMPGLTAYFGLLEICGVKGGETVMVNAAAGAVGSVVGQIAKLKGCKVVGAVGSDEKVAYLQKLGFDVVFNYKTVESLEETLKKASPDGYDCYFDNVGGEFSNTVIGQMKKFGRIAICGAISTYNRTGPLPPGPPPEIVIYQELRMEAFVVYRWQGDARQKALKDLLKWVLEIKRENEED

SEQ ID NO: 8790 - protein, 355 aa, Homo sapiens
MLGSGFKAERLRVNLRLVINRLKLLEKKKTELAQKARKEIADYLAAGKDERARIRVEHIIREDYLVEAMEILELYCDLLLARFGLIQSMKELDSGLAESVSTLAELKIVADQLCAKYSKEYGKLCRTNQIGTVNDRLMHKLSVEAPPKILVERYLIEIAKNYNVPYEPDSVVMAEAPPGVETDLIDVGFTDDVKKGGPGRGGSGGFTAPVGGPDGTVPMPMPMPMPMPSANTPFSYPLPKGPSDFNGLPMGTYQAFPNIHPPQIPATPPSYESVDDINADKNISSAQIVGPGPKPEASAKLPSRPADNYDNFVLPELPSVPDTLPTASAGASTSASEDIDFDDLSRRFEELKKKT

SEQ ID NO: 8791 - protein, 724 aa, Homo sapiens
MQMTIQALQDELRIQRDLNQLFQQDSSSRTGEPCVAELTEENFQRLHAEHERQAKELFLLRKTLEEMELRIETQKQTLNARDESIKKLLEMLQSKGLSAKATEEDHERTRRLAEAEMHVHHLESLLEQKEKENSMLREEMHRRFENAPDSAKTKALQTVIEMKDSKISSMERGLRDLEEEIQMLKSNGALSTEEREEEMKQMEVYRSHSKFMKNKIGQVKQELSRKDTELLALQTKLETLTNQFSDSKQHIEVLKESLTAKEQRAAILQTEVDALRLRLEEKETMLNKKTKQIQDMAEEKGTQAGEIHDLKDMLDVKERKVNVLQKKIENLQEQLRDKEKQMSSLKERVKSLQADTTNTDTALTTLEEALAEKERTIERLKEQRDRDEREKQEEIDNYKKDLKDLKEKVSLLQGDLSEKEASLLDLKEHASSLASSGLKKDSRLKTLEIALEQKKEECLKMESQLKKAHEAALEARASPEMSDRIQHLEREITRYKDESSKAQAEVDRLLEILKEVENEKNDKDKKIAELESLTSRQVKDQNKKVANLKHKEQVEKKKSAQMLEEARRREDNLNDSSQQLQVEELLMAMEKVKQELESMKAKLSSTQQSLAEKETHLTNLRAERRKHLEEVLEMKQEALLAAISEKDANIALLELSSSKKKTQEEVAALKREKDRLVQQLKQQTQNRMKLMADNYEDDHFKSSHSNQTNHKPSPDQDEEEGIWA

SEQ ID NO: 8792 - protein, 135 aa, Homo sapiens
MAIGFNVETVTYKNLKFQVWDLGGQTSIRPYWRCYYSNTDAVIYVVDSCDRDRIGISKSELVAMLEEEELRKAILVVFANKQDMEQAMTSSEMANSLGLPALKDRKWQIFKTSATKGTGLDEAMEWLVETLKSRQ

SEQ ID NO: 8793 - protein, 227 aa, Homo sapiens
RRQILKELALCLRRQEMYGPRAASRNKETSAGPVAVMGKDYYKILGIPSGANEDEIKKAYRKMALKYHPDKNKEPNAEEKFKEIAEAYDVLSDPKKRGLYDQYGEEGLKTGGGTSGGSSGSFHYTFHGDPHATFASFFGGSNPFDIFFASSRSTRPFSGFDPDDMDVDEDEDPFGAFGRFGFNGLSRGPRRAPEPLYPRRKVQDPPVVHELRVSLEEIYHGSTKRMK

SEQ ID NO: 8794 - protein, 83 aa, Homo sapiens
MSMLKPSGLKAPTKILKPGSTALKTPTAVVAPVEKTISSEKASSTPSSETQEEFVDDFRVGERVWVNGNKPGFIQFLGETQFA

SEQ ID NO: 8795 - protein, 213 aa, Homo sapiens
MDMLGGPGIESQCRKVDIIADAAYSIFQKPKSFTGNFVIDENILKEEGIENFDVYAIKPGHPLQPDFFLDEYPEAVSKKVESTGAVPEFKEEKLQLQPKPRSGAVEETFRIVKDSLSDDVVKATQAIYLFELSGEDGGTWFLDLKSKGGNVGYGEPSDQADVVMSMTTDDFVKMFSGKLKPTMAFMSGKLKIKGNMALAIKLEKLMNQMNARL

SEQ ID NO: 8796 - protein, 409 aa, Homo sapiens
MNRTWPRRIWGSSQDEPEFASSVRRPHLTSDAVALLRDNVTPRENELWTSLGDSWTRPGLELSPEEGPPYRPEFFSGWEPPVTDPQSRAWEDPVEKQLQHERRRRQVTQATQQGRGWEVRGRGRSAWPRLTRLSYFLQQSAPQVAVNGHRDLEPESEPQLESETAGKWVLCNYDFQARNSSELSVKQRDVLEVLDDSRKWWKVRDPAGQEGYVPYNILTPYPGPRLHHSQSPARSLNSTPPPPPAPAPAPPPALARPRWDRPRWDSCDSLNGLDPSEKEKFSQMLIVNEELQARLAQGRSGPSRAVPGPRAPEPQLSPGSDASEVRAWLQAKGFSSGTVDALGVLTGAQLFSLQKEELRAVSPEEGARVYSQVTVQRSLLEDKEKVSELEAVMEKQKKKVEGEVEMEVI

SEQ ID NO: 8797 - protein, 474 aa, Homo sapiens
MASLSRALRVAAAHPRQSPTRGMGPCNLSSAAGPTAEKSVPYQRTLKEGQGTSVVAQGPSRPLPSTANVVVIGGGSLGCQTLYHLAKLGMSGAVLLERERLTSGTTWHTAGLLWQLRPSDVEVELLAHTRRVVSRELEEETGLHTGWIQNGGLFIASNRQRLDEYKRLMSLGKAYGVESHVLSPAETKTLYPLMNVDDLYGTLYVPHDGTMDPAGTCTTLARAASARGAQVIENCPVTGIRVWTDDFGVRRVAGVETQHGSIQTPCVVNCAGVWASAVGRMAGVKVPLVAMHHAYVVTERIEGIQNMPNVRDHDASVYLRLQGDALSVGGYEANPIFWEEVSDKFAFGLFDLDWEVFTQHIEGAINRVPVLEKTGIKSTVCGPESFTPDHKPLMGEAPELRGFFLGCGFNSAGMMLGGGCGQELAHWIIHGRPEKDMHGYDIRRFHHSLTDHPRWIRERSHESYQELLRRLPPR

SEQ ID NO: 8798 - protein, 630 aa, Homo sapiens
MSIELQSVSNPVHRKDLVIRLTDDTDPFFLYNLVISEEDFQSLKFQQGLLVDFLAFPQKFIDLLQQCTQEHAKEIPRFLLQLVSPAAILDNSPAFLNVVETNPFKHLTHLSLKLLPGNDVEIKKFLAGCLKCSKEEKLSLMQSLDDATKQLDFTRKTLAEKKQELDKLRNEWASHTAALTNKHSQELTNEKEKALQAQVQYQQQHEQQKKDLEILHQQNIHQLQNRLSELEAANKDLTERKYKGDSTIRELKAKLSGVEEELQRTKQEVLSLRRENSTLDVECHEKEKHVNQLQTKVAVLEQEIKDKDQLVLRTKEAFDTIQEQKVVLEENGEKNQVQLGKLEATIKSLSAELLKANEIIKKLQGDLKTLMGKLKLKNTVTIQQEKLLAEKEEKLQKEQKELQDVGQSLRIKEQEVCKLQEQLEATVKKLEESKQLLKNNEKLITWLNKELNENQLVRKQDVLGPSTTPPAHSSSNTIRSGISPNLNVVDGRLTYPTCGIGYPVSSAFAFQNTFPHSISAKNTSHPGSGTKVQFNLQFTKPNASLGDVQSGATISMPCSTDKENGENVGLESKYLKKREDSIPLRGLSQNLFSNSDHQRDGTLGALHTSSKPTALPSASSAYFPGQLPNS

SEQ ID NO: 8799 - protein, 389 aa, Homo sapiens
MDRETLIDVARTSLRTKVHAELADVLTEAVVDSILAIKKQDEPIDLFMIEIMEMKHKSETDTSLIRGLVLDHGARHPDMKKRVEDAYILTCNVSLEYEKTEVNSGFFYKSAEEREKLVKAERKFIEDRVKKIIELKRKVCGDSDKGFVVINQKGIDPFSLDALSKEGIVALRRAKRRNMERLTLACGGVALNSFDDLSPDCLGHAGLVYEYTLGEEKFTFIEKCNNPRSVTLLIKGPNKHTLTQIKDAVRDGLRAVKNAIDDGCVVPGAGAVEVAMAEALIKHKPSVKGRAQLGVQAFADALLIIPKVLAQNSGFDLQETLVKIQAEHSESGQLVGVDLNTGEPMVAAEVGVWDNYCVKKQLLHSCTVIATNILLVDEIMRAGMSSLKG

SEQ ID NO: 8800 - protein, 146 aa, Homo sapiens
MTVNEAKEKLKEAPEGTFLIRDSSHSDYLLTISVKTSAGPTNLRIEYQDGKFRLDSIICVKSKLKQFDSVVHLIDYYVQMCKDKRTGPEAPRNGTVHLYLTKPLYTSAPSLQHLCRLTINKCTGAIWGLPLPTRLKDYLEEYKFQV

SEQ ID NO: 8801 - protein, 634 aa, Homo sapiens
MLEYALKQERAKYHKLKFGTDLNQGEKKADVSEQVSNGPVESVTLENSPLVWKEGRQLLRQYLEEVGYTDTILDMRSKRVRSLLGRSLELNGAVEPSEGAPRAPPGPAGLSGGESLLVKQIEEQIKRNAAGKDGKERLGGSVLGQIPFLQNCEDEDSDEDDELDSVQHKKQRVKLPSKALVPEMEDEDEEDDSEDAINEFDFLGSGEDGEGAPDPRRCTVDGSPHELESRRVKLQGILADLRDVDGLPPKVTGPPPGTPQPRPHEDVFIMDTIGGGEVSLGDLADLTVTNDNDLSCDLSDSKDAFKKTWNPKFTLRSHYDGIRSLAFHHSQSALLTASEDGTLKLWNLQKAVTAKKNAALDVEPIHAFRAHRGPVLAVAMGSNSEYCYSGGADACIHSWKIPDLSMDPYDGYDPSVLSHVLEGHGDAVWGLAFSPTSQRLASCSADGTVRIWDPSSSSPACLCTFPTASEHGVPTSVAFTSTEPAHIVASFRSGDTVLYDMEVGSALLTLESRGSSGPTQINQVVSHPNQPLTITAHDDRGIRFLDNRTGKPVHSMVAHLDAVTCLAVDPNGAFLMSGSHDCSLRLWSLDNKTCVQEITAHRKKHEEAIHAVACHPSKALIASAGADALAKVFV

SEQ ID NO: 8802 - protein, 455 aa, Homo sapiens; identical to SEQ ID NO: 5679

SEQ ID NO: 8803 - protein, 157 aa, Homo sapiens
MKSMSQLAVLSRRWKPSEMKLDPFQEVVLESSSVDELREKLSEISGIPLDDIEFAKGRGTFPCDISVLDIHQDLDWNPKVSTLNVWPLYICDDGAVIFYRDKTEELMELTDEQRNELMKKESSRLQKTGHRVTYSPRKEKALKIYLDGAPNKDLTQD

SEQ ID NO: 8804 - protein, 360 aa, Homo sapiens
MKATAMTSAWLAQGTGEGVNDVRKGACASHVSTMASFLKGAHVTINARAEEDVEPECIMEKVAKASGANYSFHKESGRFQDVGPQAPVGSVYQKTNAVSEIKRVGKDSFWAKAEKEEENRRLEEKRRAEEAQRQLEQERRERELREAARREQRYQEQGGEASPQRTWEQQQEVVSRNRNEQESAVHPREIFKQKERAMSTTSISSPQPGKLRSPFLQKQLTQPETHFGREPAAAISRPRADLPAEEPAPSTPPCLVQAEEEAVYEEPPEQETFYEQPPLVQQQGAGSEHIDHHIQGQGLSGQGLCARALYDYQAADDTEISFDPENLITGIEVIDEGWWRGYGPDGHFGMFPANYVELIE

SEQ ID NO: 8805 - protein, 96 aa, Homo sapiens
MCHTSCSSGCQPACCAPSPCQPACCVPVSCQSSVCVPVSCRPIVCAAPSCQSSLCVPVSCRPVVYAAPSCQSSGCCQPSCTSVLCRPISYSISSCC

SEQ ID NO: 8806 - protein, 8 aa, Homo sapiens
MPLSSPNA

SEQ ID NO: 8807 - protein, 127 aa, Homo sapiens
MSSSMWYIMQSIQSKYSLSERLIRTIAAIRSFPHDNVEDLIRGGADVNCTHGTLKPLHCACMVSDADCVELLLEKGAEVNALDGYNRTALHYAAEKDEACVEVLLEYGANPNALDGNRDTPLHWAAF

SEQ ID NO: 8808 - protein, 105 aa, Homo sapiens
QWTASTATITKEKQDQPKKDISNYQVEQAQVLLKREKEIPPTVFPNRSPWCQNPYVSAHPYCPLIEPHNTSTAGGRLDRQPRTRSTRPNRASGSKKKKTSESQKQ

SEQ ID NO: 8809 - protein, 371 aa, Homo sapiens
MEEEGLADEEVRLVQKKDTGHIYAMKILRKSDMLEKEQVAHIRAERDILVEADGAWVVKMFYSFQDKRNLYLIMEFLPGGDMMTLLMKKDTLTEEETQFYISETVLAIDAIHQLGFIHRDIKPDNLLLDAKGHVKLSDFGLCTGLKKAHRTEFYRNLTHNPPSDFSFQNMNSKRKAETWKKNRRQLAYSTVGTPDYIAPEVFMQTGYNKLCDWWSLGVIMYEMLIGYPPFCSETPQETYRKVMNWKETLVFPPEVPISEKAKDLILRFCIDSENRIGNSGVEEIKGHPFFEGVDWEHIRERPAAIPIEIKSIDDTSNFDDFPESDILQPVPNTTEPDYKSKDWVFLNYTYKRFEGLTQRGSIPTYMKAGKL

SEQ ID NO: 8810 - protein, 187 aa, Homo sapiens
MNNTLRKDGKKDCCFEISAPDKRIYQFTAASPKDAEEWVQQLKFVLQDMESDIIPEDYDERGELYDDVDHPLPISNPLTSSQPIDDEIYEELPEEEEDSAPVKVEEQRKMSQDSVHHTSGDKSTDYANFYQGLWDCTGAFSDELSFKRGDVIYILSKEYNRYGWWVGEMKGAIGLVPKAYIMEMYDI

SEQ ID NO: 8811 - protein, 72 aa, Homo sapiens
MALSLGWKAHRNHCGLLLQALRSSGLLLFPCGQCPWRGAGSFLDPEIKAFLEENTEVTSSGSLTPEIQLRLL

SEQ ID NO: 8812 - protein, 972 aa, Homo sapiens
MAAAAAEQQQFYLLLGNLLSPDNVVRKQAEETYENIPGQSKITFLLQAIRNTTAAEEARQMAAVLLRRLLSSAFDEVYPALPSDVQTAIKNLLPGFLQAVNDSCYQNDDSVLKSLVEIADTVPKYLRPHLEATLQLSLKLCGDTSLNNMQRQLALEVIVTLSETAAAMLRKHTNIVAQTIPQMLAMMVDLEEDEDWANADELEDDDFDSNAVAGESALDRMACGLGGKLVLPMIKEHIMQMLQNPDWKYRHAGLMALSAIGEGCHQQMEGILNEIVNFVLLFLQDPHPRVRYAACNAVGQMATDFAPGFQKKFHEKVIAALLQTMEDQGNQRVQAHAAAALINFTEDCPKSLLIPYLDNLVKHLHSIMVLKLQELIQKGTKLVLEQVVTSIASVADTAEEKFVPYYDLFMPSLKHIVENAVQKELRLLRGKTIECISLIGLAVGKEKFMQDASDVMQLLLKTQTDFNDMEDDDPQISYMISAWARMCKILGKEFQQYLPVVMGPLMKTASIKPEVALLDTQDMENMSDDDGWEFVNLGDQQSFGIKTAGLEEKSTACQMLVCYAKELKEGFVEYTEQVVKLMVPLLKFYFHDGVRVAAAESMPLLLECARVRGPEYLTQMWHFMCDALIKAIGTEPDSDVLSEIMHSFAKCIEVMGDGCLNNEHFEELGGILKAKLEEHFKNQELRQVKRQDEDYDEQVEESLQDEDDNDVYILTKVSDILHSIFSSYKEKVLPWFEQLLPLIVNLICPHRPWPDRQWGLCIFDDVIEHCSPASFKYAEYFLRPMLQYVCDNSPEVRQAAAYGLGVMAQYGGDNYRPFCTEALPLLVRVIQSADSKTKENVNATENCISAVGKIMKFKPDCVNVEEVLPHWLSWLPLHEDKEEAVQTFNYLCDLIESNHPIVLGPNNTNLPKIFSIIAEGEMHEAIKHEDPCAKRLANVVRQVQTSGGLWTECIAQLSPEQQAAIQELLNSA

SEQ ID NO: 8813 - protein, 475 aa, Homo sapiens
MQVTFIYVCLKGLMLQDLVSAKLISDYTVTEIPDTINDLQGSTKVLQAVQWLVSHCPHSLDLCCQTLIQYVEDGIGHEFSGRFFHDRRERRLGGLASQEPGAIIELFNSVLQFLASVVSSEQLCDLSWPVTEFAEAGGSRLLPHLHWNAPEHLAWLKQAVLGFQLPQMDLPPLGAPWLPVCSMVVQYASQIPSSRQTQPVLQSQVENLLHRTYCRWKSKSPSPVHGAGPSVMEIPWDDLIALCINHKLRDWTPPRLPVTSEALSEDGQICVYFFKNDLKKYDVPLSWEQARLQTQKELQLREGRLAIKPFHPSANNFPIPLLHMHRNWKRSTECAQEGRIPSTEDLMRGASAEELLAQCLSSSLLLEKEENKRFEDQLQQWLSEDSGAFTDLTSLPLYLPQTLVSLSHTIEPVMKTSVTTSPQSDMMREQLQLSEATGTCLGERLKHLERLIRSSREEEVASELHLSALLDMVDI

SEQ ID NO: 8814 - protein, 110 aa, Homo sapiens
MSTALTHTTVAMRCPMGGGGGPTYGPPQPWGHPDVHIMQHHVLPIQARLGSIAEIDLGVPPPVMKTFKEFLLSLDDSVDETEAVKRYNDYKLDFRRQQMQDFFLAHKDEE

SEQ ID NO: 8815 - protein, 275 aa, Homo sapiens; identical to SEQ ID NO: 4746

SEQ ID NO: 8816 - protein, 291 aa, Homo sapiens
MIGDGEDYFLSLFGDSKKLTAHSNYTQKTLKYFSMILEEVGQFTSSSLGDVEIAEVNVKGLFVKLINSSLDKEMAIGDHILQQNVNGQTISLYRFLPNIVMQANSTVTVWAAASEAKHQPPSDFLWKEQDKFRASPDCITILCKPNGQAIAWYTPIHWKQAWEKLDADVEFNRCSVVSPTFRKRVFQWTASTATITKEKQDQPKKDISNYQVEQAQVLLKREKEIPPTVFPNRSPWCQNPYVSAHPYCPLIEPHNTSTAGGRLDRQPRTRSTRPNRASGSKKKKTSESQKQ

SEQ ID NO: 8817 - protein, 394 aa, Homo sapiens
MVPSQAPYLVPAFPLPAATSPGREYAAPGTAPEGLHGLPLSEGLQPYPAFPFPYLDTFMTVFLPDPPVCPLLSPSFLPCPFLGATASSAISPSMSSAMSPTLDPPPSVTSQRREEEKWEAQSEGHPFITSRSSSPLQLNLLQEEMPRPSESPDQMRRNTCPQTEYCVTGNNGSESSPATTGALSTGSPPRENPSHPTASALSTGSPPMKNPSHPTASTLSMGLPPSRTPSHPTATVLSTGSPPSESPSRTGSAASGSSDSSIYLTSSVYSSKISQNGQQSQDVQKKETFPNVAEEPIWRMIRQTPERILMTYQVPERVKEVVLKEDLEKLESMRQQQPQFSHGQKEELAKVYNWIQSQTVTQEIDIQACVTCENEDSADGAATSCGQVLVEDSC

SEQ ID NO: 8818 - protein, 807 aa, Homo sapiens
QGASFALAAAAALLFGSDMEDGPSNNASCFRRLTECFLSPSLTDEKVKAYLSLHPQVLDEFVSESVSAETVEKWLKRKNNKSEDESAPKEVSRYQDTNMQGVVYELNSYIEQRLDTGGDNQLLLYELSSIIKIATKADGFALYFLGECNNSLCIFTPPGIKEGKPRLIPAGPITQGTTVSAYVAKSRKTLLVEDILGDERFPRGTGLESGTRIQSVLCLPIVTAIGDLIGILELYRHWGKEAFCLSHQEVATANLAWASVAIHQVQVCRGLAKQTELNDFLLDVSKTYFDNIVAIDSLLEHIMIYAKNLVNADRCALFQVDHKNKELYSDLFDIGEEKEGKPVFKKTKEIRFSIEKGIAGQVARTGEVLNIPDAYADPRFNREVDLYTGYTTRNILCMPIVSRGSVIGVVQMVNKISGSAFSKTDENNFKMFAVFCALALHCANMYHRIRHSECIYRVTMEKLSYHSICTSEEWQGLMQFTLPVRLCKEIELFHFDIGPFENMWPGIFVYMVHRSCGTSCFELEKLCRFIMSVKKNYRRVPYHNWKHAVTVAHCMYAILQNNHTLFTDLERKGLLIACLCHDLDHRGFSNSYLQKFDHPLAALYSTSTMEQHHFSQTVSILQLEGHNIFSTLSSSEYEQVLEIIRKAIIATDLALYFGNRKQLEEMYQTGSLNLNNQSHRDRVIGLMMTACDLCSVTKLWPVTKLTANDIYAEFWAEGDEMKKLGIQPIPMMDRDKKDEVPQGQLGFYNAVAIPCYTTLTQILPPTEPLLKACRDNLSQWEKVIRGEETATWISSPSVAQKAAASED

SEQ ID NO: 8819 - protein, 558 aa, Homo sapiens
MASCPDSDNSWVLAGGELGISLNMCLLGALVLLGLGVLLFSGGLSESETGPMEEVERQVLPDPEVLEAVGDRQDGLREQLQAPVPPDSVPSLQNMGLLLDKLAKENQDIRLLQAQLQAQKEELQSLMHQPKGLEEENAQLRGALQQGEAFQRALESELQQLRARLQGLEADCVRGPDGVCLSGGRGPQGDKAIREQGPREQEPELSFLKQKEQLEAEAQALRQELERQRRLLGSVQQDLERSLQDASRGDPAHAGLAELGHRLAQKLQGLENWGQDPGVSANASKAWHQKSHFQNSREWSGKEKWWDGQRDRKAEHWKHKKEESGRERKKNWGGQEDREPAGRWKEGRPRVEESGSKKEGKRQGPKEPPRKSGSFHSSGEKQKQPRWREGTKDSHDPLPSWAELLRPKYRAPQGCSGVDECARQEGLTFFGTELAPVRQQELASLLRTYLARLPWAGQLTKELPLSPAFFGEDGIFRHDRLRFRDFVDALEDSLEEVAVQQTGDDDEVDDFEDFIFSHFFGDKALKKRSGKKDKHSQSPRAAGPREGHSHSHHHHHRG

SEQ ID NO: 8820 - protein, 626 aa, Homo sapiens
MGNAAGSAEQPAGPAAPPPKQHRFEKLMEYFRNEDSNIDFMVACMQFINIVVHSVENMNFRVFLQYEFTHLGLDLYLERLRLTESDKLQVQIQAYLDNIFDVGALLEDTETKNAVLEHMEELQEQVALLTERLRDAENESMAKIAELEKQLSQARKELETLRERFSESTAMGPSRRPPEPEKAPPAAPTRPSALELKVEELEEKGLIRILRGPGDAVSIEILPVAVATPSGGDAPTPGVPTGSPSPDLAPAAEPAPGAAPPPPPPPPGGPPDALGRRDSELGPGVKAKKPIQTKFRMPLLNWVALKPSQITGTVFTELNDEKVLQELDMSDFEEQFKTKSQGPSLDLSALKSKAAQKAPSKATLIEANRAKNLAITLRKGNLGAERICQAIEAYDLQALGLDFLELLMRFLPTEYERSLITRFEREQRPMEELSEEDRFMLCFSRIPRLPERMTTLTFLGNFPDTAQLLMPQLNAIIAASMSIKSSDKLRQILEIVLAFGNYMNSSKRGAAYGFRLQSLDALLEMKSTDRKQTLLHYLVKVIAEKYPQLTGFHSDLHFLDKAGSVSLDSVLADVRSLQRGLELTQREFVRQDDCMVLKEFLRANSPTMDKLLADSKTAQAVPTGGL

SEQ ID NO: 8821 - protein, 499 aa, Homo sapiens
MDKLIVDGRGKATISNDGATILKLLDVVHPAAKTLVDIAKSQDAEVGDGTTSVTLLAAEFLKQVKPYVEEGLHPQIIIRAFRTATQLAVNKIKEIAVTVKKADKVEQRKLLEKCAMTALSSKLISQQKAFFAKMVVDAVMMLDDLLQLKMIGIKKVQGGALEDSQLVAGVAFKKTFSYAGFEMQPKKYHNPKIALLNVELELKAEKDNAEIRVHTVEDYQAIVDAEWNILYDKLEKIHHSGAKVVLSKLPIGDVATQYFADRDMFCAGRVPEEDLKRTMMACGGSIQTSVNALSADVLGRCQVFEETQIGGERYNFFTGCPKAKTCTFILRGGAEQFMEETERSLHDAIMIVRRAIKNDSVVAGGGAIEMELSKYLRDYSRTIPGKQQLLIGAYAKALEIIPRQLCDNAGFDATNILNKLRARHAQGGTWYGVDINNEDIADNFEAFVWEPAMVRINALTAASEAACLIVSVDETIKNPRSTVDAPTAAGRGRGRGRPH

SEQ ID NO: 8822 - protein, 25 aa, Homo sapiens
MAHEMIGTQIVTERLVALLESGTEK

SEQ ID NO: 8823 - protein, 210 aa, Homo sapiens [sequence omitted]

SEQ ID NO: 8824 - protein, 166 aa, Homo sapiens
MDLMPFINKAGCECLNESDEHGFDNCLRKDTTFLESDCDEQLLITVAFNQPVKLYSMKFQGPDNGQGPKYVKIFINLPRSMDFEEAERSEPTQALELTEDDIKEDGIVPLRYVKFQNVNSVTIFVQSNQGEEETTRISYFTFIGTPVQATNMNDFKRVVGKKGESH

SEQ ID NO: 8825 - protein, 212 aa, Homo sapiens [sequence omitted]

SEQ ID NO: 8826 - protein, 456 aa, Homo sapiens; identical to SEQ ID NO: 7230

SEQ ID NO: 8827 - protein, 60 aa, Homo sapiens
MDEQALLGLNPNADSDFRQRALAYFEQLKISPDAWQVCAEALAQRTYSDDHVKFFCFQVL

SEQ ID NO: 8828 - protein, 112 aa, Homo sapiens
MSSSMWYIMQSIQSKYSLSERLIRTIAAIRSFPHDNVEDLIRGGADVNCTHGTLKPLHCACMVSDADCVELLLEKGAEVNALDGYNRTALHYAAEKDEACVEVLLEYGANPN

SEQ ID NO: 8829 - protein, 390 aa, Homo sapiens; identical to SEQ ID NO: 8012

SEQ ID NO: 8830 - protein, 444 aa, Homo sapiens; identical to SEQ ID NO: 4946

SEQ ID NO: 8831 - protein, 164 aa, Homo sapiens; identical to SEQ ID NO: 6206

SEQ ID NO: 8832 - protein, 1083 aa, Homo sapiens; identical to SEQ ID NO: 5042

SEQ ID NO: 8833 - protein, 500 aa, Homo sapiens [sequence omitted]

SEQ ID NO: 8834 - protein, 513 aa, Homo sapiens
MWDVCMERGHRDLEQFERVHRYISDQLFTNFKERTERLVISPLNQLLSMFTGPHKLVQKRFDKLLDFYNCTERAEKLKDKKTLEELQSARNNYEALNAQLLDELPKFHQYAQGLFTNCVHGYAEAHCDFVHQALEQLKPLLSLLKVAGREGNLIAIFHEEHSRVLQQLQVFTFFPESLPATKKPFERKTIDRQSARKPLLGLPSYMLQSEELRASLLARYPPEKLFQAERNFNAAQDLDVSLLEGDLVGVIKKKDPMGSQNRWLIDNGVTKGFVYSSFLKPYNPRRSHSDASVGSHSSTESEHGSSSPRFPRQNSGSTLTFNPSSMAVSFTSGSCQKQPQDASPPPKECDQGTLSASLNPSNSESSPSRCPSDPDSTSQPRSGDSADVARDVKQPTATPRSYRNFRHPEIVGYSVPGRNGQSQDLVKGCARTAQAPEDRSTEPDGSEAEGNQVYFAVYTFKARNPNELSVSANQKLKILEFKDVTGNTEWWLAEVNGKKGYVPSNYIRKTEYT

SEQ ID NO: 8835 - protein, 50 aa, Homo sapiens; identical to SEQ ID NO: 6722

SEQ ID NO: 8836 - protein, 1438 aa, Homo sapiens
MSMLKPSGLKAPTKILKPGSTALKTPTAVVAPVEKTISSEKASSTPSSETQEEFVDDFRVGERVWVNGNKPGFIQFLGETQFAPGQWAGIVLDEPIGKNDGSVAGVRYFQCEPLKGIFTRPSKLTRKVQAEDEANGLQTTPASRATSPLCTSTASMVSSSPSTPSNIPQKPSQPAAKEPSATPPISNLTKTASESISNLSEAGSIKKGERELKIGDRVLVGGTKAGVVRFLGETDFAKGEWCGVELDEPLGKNDGAVAGTRYFQCQPKYGLFAPVHKVTKIGFPSTTPAKAKANAVRRVMATTSASLKRSPSASSLSSMSSVASSVSSRPSRTGLLTETSSRYARKISGTTALQEALKEKQQHIEQLLAERDLERAEVAKATSHVGEIEQELALARDGHDQHVLELEAKMDQLRTMVEAADREKVELLNQLEEEKRKVEDLQFRVEEESITKGDLEQKSQISEDPENTQTKLEHARIKELEQSLLFEKTKADKLQRELEDTRVATVSEKSRIMELEKDLALRVQEVAELRRRLESNKPAGDVDMSLSLLQEISSLQEKLEVTRTDHQREITSLKEHFGAREETHQKEIKALYTATEKLSKENESLKSKLEHANKENSDVIALWKSKLETAIASHQQAMEELKVSFSKGLGTETAEFAELKTQIEKMRLDYQHEIENLQNQQDSERAAHAKEMEALRAKLMKVIKEKENSLEAIRSKLDKAEDQHLVEMEDTLNKLQEAEIKVKELEVLQAKCNEQTKVIDNFTSQLKATEEKLLDLDALRKASSEGKSEMKKLRQQLEAAEKQIKHLEIEKNAESSKASSITRELQGRELKLTNLQENLSEVSQVKETLEKELQILKEKFAEASEEAVSVQRSMQETVNKLHQKEEQFNMLSSDLEKLRENLADMEAKFREKDEREEQLIKAKEKLENDIAEIMKMSGDNSSQLTKMNDELRLKERDVEELQLKLTKANENASFLQKSIEDMTVKAEQSQQEAAKKHEEEKKELERKLSDLEKKMETSHNQCQELKARYERATSETKTKHEEILQNLQKTLLDTEDKLKGAREENSGLLQELEELRKQADKAKAAQTAEDAMQIMEQMTKEKTETLASLEDTKQTNAKLQNELDTLKENNLKNVEELNKSKELLTVENQKMEEFRKEIETLKQAAAQKSQQLSALQEENVKLAEELGRSRDEVTSHQKLEEERSVLNNQLLEMKKRESKFIKDADEEKASLQKSISITSALLTEKDAELEKLRNEVTVLRGENASAKSLHSVVQTLESDKVKLELKVKNLELQLKENKRQLSSSSGNTDTQADEDERAQESQIDFLNSVIVDLQRKNQDLKMKVEMMSEAALNGNGDDLNNYDSDDQEKQSKKKPRLFCDICDCFDLHDTEDCPTQAQMSEDPPHSTHHGSRGEERPYCEICEMFGHWATNCNDDETF

SEQ ID NO: 8837 - protein, 211 aa, Homo sapiens
MAFADSHLWKLLDRHANTIRLFVLLPEQSPVSYSKRTAYQKAGGDSGNVDDDCERVKGPVGSLKSVEAILEESTEKLKSLSLQQQQDGDNGDSSKSTETSDFENIESPLNERDSSASVDNRELEQHIQTSDPENFQSEERSDSDVNNDRSTSSVDSDILSSSHSSDTLCNADNAQIPLANGLDSHSITSSRRTKANREKRNMGYSRRRLWN

SEQ ID NO: 8838 - protein, 711 aa, Homo sapiens
MLASLKVKKQELANSSDATLPDRPLSPPLTAPPTMKSSEFFEMLEKMQGIKLEEQKPGPQKNKDDYIPYPSIDEVVEKGGPYPQVILPQFGGYWIEDPENVGTPTSLGSSICEEEEEDNLSPNTFGYKLECKGEARAYRRHFLGKDHLNFYCTGSSLGNLILSVKCEEAEGIEYLRVILRSKLKTVHERIPLAGLSKLPSVPQIAKAFCDDAVGLRFNPVLYPKASQMIVSYDEHEVNNTFKFGVIYQKARQTLEEELFGNNEESPAFKEFLDLLGDTITLQDFKGFRGGLDVTHGQTGVESVYTTFRDREIMFHVSTKLPFTDGDAQQLQRKRHIGNDIVAIIFQEENTPFVPDMIASNFLHAYIVVQVETPGTETPSYKVSVTAREDVPTFGPPLPSPPVFQKGPEFREFLLTKLTNAENACCKSDKFAKLEDRTRAALLDNLHDELHAHTQAMLGLGPEEDKFENGGHGGFLESFKRAIRVRSHSMETMVGGQKKSHSGGIPGSLSGGISHNSMEVTKTTFSPPVVAATVKNQSRSPIKRRSGLFPRLHTGSEGQGDSRARCDSTSSTPKTPDGGHSSQEIKSETSSNPSSPEICPNKEKPFMKLKENGRAISRSSSSTSSVSSTAGEGEAMEEGDSGGSQPSTTSPFKQEVFVYSPSPSSESPSLGAAATPIIMSRSPTDAKSRNSPRSNLKFRFDKLSHASSGAGH

SEQ ID NO: 8839 - protein, 362 aa, Homo sapiens [sequence omitted]

SEQ ID NO: 8840 - protein, 606 aa, Homo sapiens
MCGAGFGHFEWLAGGGAGQDVGRSCILVSIAGKNVMLDCGMHMGFNDDRRFPDFSYITQNGRLTDFLDCVIISHFHLDHCGALPYFSEMVGYDGPIYMTHPTQAICPILLEDYRKIAVDKKGEANFFTSQMIKDCMKKVVAVHLHQTVQVDDELEIKAYYAGHVLGAAMFQIKVGSESVVYTGDYNMTPDRHLGAAWIDKCRPNLLITESTYATTIRDSKRCRERDFLKKVHETVERGGKVLIPVFALGRAQELCILLETFWERMNLKVPIYFSTGLTEKANHYYKLFIPWTNQKIRKTFVQRNMFEFKHIKAFDRAFADNPGPMVVFATPGMLHAGQSLQIFRKWAGNEKNMVIMPGYCVQGTVGHKILSGQRKLEMEGRQVLEVKMQVEYMSFSAHADAKGIMQLVGQAEPESVLLVHGEAKKMEFLKQKIEQELRVNCYMPANGETVTLPTSPSIPVGISLGLLKREMAQGLLPEAKKPRLLHGTLIMKDSNFRLVSSEQALKELGLAEHQLRFTCRVHLHDTRKEQETALRVYSHLKSVLKDHCVQHLPDGSVTVESVLLQAAAPSEDPGTKVLLVSWTYQDEELGSFLTSLLKKGLPQAPS

SEQ ID NO: 8841 - protein, 132 aa, Homo sapiens
MKKVRLKELESRLQQVDGFEKPKLLLEQYPTRPHIAACMLYTIHNTYDDIENKVVADLGCGCGVLSIGTAMLGAGLCVGFDIDEDALEIFNRNAEEFELQILTWFNVMCAYYLTECPSHSIQNYESSLWDQK

SEQ ID NO: 8842 - protein, 456 aa, Homo sapiens
MMVGDGTTSVTLLAAEFLKQVKPYVEEGLHPQIIIRAFRTATQLAVNKIKEIAVTVKKADKVEQRKLLEKCAMTALSSKLISQQKAFFAKMVVDAVMMLDDLLQLKMIGIKKVQGGALEDSQLVAGVAFKKTFSYAGFEMQPKKYHNPKIALLNVELELKAEKDNAEIRVHTVEDYQAIVDAEWNILYDKLEKIHHSGAKVVLSKLPIGDVATQYFADRDMFCAGRVPEEDLKRTMMACGGSIQTSVNALSADVLGRCQVFEETQIGGERYNFFTGCPKAKTCTFILRGGAEQFMEETERSLHDAIMIVRRAIKNDSVVAGGGAIEMELSKYLRDYSRTIPGKQQLLIGAYAKALEIIPRQLCDNAGFDATNILNKLRARHAQGGTWYGVDINNEDIADNFEAFVWEPAMVRINALTAASEAACLIVSVDETIKNPRSTVDAPTAAGRGRGRGRPH

SEQ ID NO: 8843 - protein, 839 aa, Homo sapiens
MDGKADVKSLMAKYNTGGNPTEDVSVNSRPFRVTGPNSSSGIQARKNLFNNQGNASPPAGPSNVPKFGSPKPPVAVKPSSEEKPDKEPKPPFLKPTGAGQRFGTPASLTTRDPEAKVGFLKPVGPKPINLPKEDSKPTFPWPPGNKPSLHSVNQDHDLKPLGPKSGPTPPTSENEQKQAFPKLTGVKGKFMSASQDLEPKPLFPKPAFGQKPPLSTENSHEDESPMKNVSSSKGSPAPLGVRSKSGPLKPAREDSENKDHAGEISSLPFPGVVLKPAASRGGPGLSKNGEEKKEDRKIDAAKNTFQSKINQEELASGTPPARFPKAPSKLTVGGPWGQSQEKEKGDKNSATPKQKPLPPLFTLGPPPPKPNRPPNVDLTKFHKTSSGNSTSKGQTSYSTTSLPPPPPSHPASQPPLPASHPSQPPVPSLPPRNIKPPFDLKSPVNEDNQDGVTHSDGAGNLDEEQDSEGETYEDIEASKEREKKREKEEKKRLELEKKEQKEKEKKEQEIKKKFKLTGPIQVIHLAKACCDVKGGKNELSFKQGEQIEIIRITDNPEGKWLGRTARGSYGYIKTTAVEIDYDSLKLKKDSLGAPSRPIEDDQEVYDDVAEQDDISSHSQSGSGGIFPPPPDDDIYDGIEEEDADDGSTLQVQEKSNTWSWGILKMLKGKDDRKKSIREKPKVSDSDNNEGSSFPAPPKQLDMGDEVYDDVDTSDFPVSSAEMSQGTNVGKAKTEEKDLKKLKKQEKEEKDFRKKFKYDGEIRVLYSTKVTTSITSKKWGTRDLQVKPGESLEVIQTTDDTKVLCRNEEGKYGYVLRSYLADNDGEIYDDIADGCIYDND

SEQ ID NO: 8844 - protein, 338 aa, Homo sapiens
MGHRYIEVFKSHRTEMDWVLKHSGPNSADSANDGFVRLRGLPFGCTKEEIVQFFSGLEIVPNGITLPVDPEGKITGEAFVQFASQELAEKALGKHKERIGHRYIEVFKSSQEEVRSYSDPPLKFMSVQRPGPYDRPGTARRYIGIVKQAGLERMRPGAYSTGYGGYEEYSGLSDGYGFTTDLFGRDLSYCLSGMYDHRYGDSEFTVQSTTGHCVHMRGLPYKATENDIYNFFSPLNPVRVHIEIGPDGRVTGEADVEFATHEEAVAAMSKDRANMQHRYIELFLNSTTGASNGAYSSQVMQGMGVSAAQATYSGLESQSVSGCYGAGYSGQNSMGGYD

SEQ ID NO: 8845 - protein, 511 aa, Homo sapiens
MASVVEYKGLRAGYHCGYCDSKEGKASCGMWAHSMTVQDYQDLIDRGWRRSGKYVYKPVMNQTCCPQYTIRCRPLQFQPSKSHKKVLKKMLKFLAKGEVPKGSCEDEPMDSTMDDAVAGDFALINKLDIQCDLKTLSDDIKESLESEGKNSKKEEPQELLQSQDFVGEKLGSGEPSHSVKVHTVPKPGKGADLSKPPCRKAKEIRKERKRLKLMQQNPAGELEGFQAQGHPPSLFPPKAKSNQPKSLEDLIFESLPENASHKLEVRLVPVSFEDPEFKSSFSQSFSLYVKYQVAIHQDPPDECGKTEFTRFLCSSPLEAETPPNGPDCGYGSFHQQYWLDGKIIAVGVIDILPNCVSSVYLYYDPDYSFLSLGVYSALREIAFTRQLHEKTSQLSYYYMGFYIHSCPKMKYKGQYRPSDLLCPETYVWVPIEQCLPSLENSKYCRFNQDPEAVDEDRSTEPDRLQVFHKRAIMPYGVYKKQQKDPSEEAAVLQYASLVGQKCSERMLLFRN

SEQ ID NO: 8846 - protein, 1320 aa, Homo sapiens
MQDDSIEASTSISQLLRESYLAETRHRGNNERSRAEPSSNPCHFGSPSGAAEGGGGQDDLPDLSAFLSQEELDESVNLARLAINYDPLEKADETQARKRLSPDQMKHSPNLSFEPNFCQDNPRSPTSSKESPQEAKRPQYCSETQSKKVFLNKAADFIEELSSLFKSHSSKRIRPRACKNHKSKLESQNKVMQENSSSFSDLSERRERSSVPIPIPADTRDNEVNHALEQQEAKRREAEQAASEAAGGDTTPGSSPSSLYYEEPLGQPPRFTQKLRSREVPEGTRVQLDCIVVGIPPPQVRWYCEGKELENSPDIHIVQAGNLHSLTIAEAFEEDTGRYSCFASNIYGTDSTSAEIYIEGVSSSDSEGDPNKEEMNRIQKPNEVSSPPTTSAVIPPAVPQAQHLVAQPRVATIQQCQSPTNYLQGLDGKPIIAAPVFTKMLQNLSASEGQLVVFECRVKGAPSPKVEWYREGTLIEDSPDFRILQKRPVCMEHIEEICTLVIAEVFAEDSGCFTCTASNKYGTVSSIAQLHVRGNEDLSNNGSLHSANSTTNLAAIEPQPSPPHSEPPSVEQPPKPKLEGVLVNHNEPRSSSRIGLRVHFNLPEDDKGSEASSEAGVVTTRQTRPDSFQERFNGQATKTPEPSSPVKEPPPVLAKPKLDSTQLQQLHNQVLLEQHQLQNPPPSSPKEFPFSMTVLNSNAPPAVTTSSKQVKAPSSQTFSLARPKYFFPSTNTTAATVAPSSSPVFTLSSTPQTIQRTVSKESLLVSHPSVQTKSPGGLSIQNEPLPPGPTEPTPPPFTFSIPSGNQFQPRCVSPIPVSPTSRIQNPVAFLSSVLPSLPAIPPTNAMGLPRSAPSMPSQGLAKKNTKSPQPVNDDNIRETKNAVIRDLGKKITFSDVRPNQQEYKISSFEQRLMNEIEFRLERTPVDESDDEIQHDEIPTGKCIAPIFDKRLKHFRVTEGSPVTFTCKIVGIPVPKVYWFKDGKQISKRNEHCKMRREGDGTCSLHIESTTSDDDGNYTIMAANPQGRISCSGHLMVQSLPIRSRLTSAGQSHRGRSRVQERDKEPLQERFFRPHFLQAPGDMVAHEGRLCRLDCKVSGLPPPELTWLLNGQPVLPDASHKMLVRETGVHSLLIDPLTQRDAGTYKCIATNKTGQNSFSLELSVVAKEVKKAPVILEKLQNCGVPEGHPVRLECRVIGMPPPVFYWKKDNETIPCTRERISMHQDTTGYACLLIQPAKKSDAGWYTLSAKNEAGIVSCTARLDIYAQWHHQIPPPMSVRPSGSRYGSLTSKGLDIFSAFSSMESTMVYSCSSRSVVESDEL

SEQ ID NO: 8847 - protein, 763 aa, Homo sapiens
MQDLGDKLRMIVMGHRRVHISRQLEVEPEEPEAENKHKPRRKSKRGKKEAEDELSARHPAELAMEPTPELPAEVLMVEVENVVHEDFQVTEEVKALTAEIVKTIRDIIALNPLYRESVLQMMQAGQRVVDNPIYLSDMGAALTGAESHELQDVLEETNIPKRLYKALSLLKKEFELSKLQQRLGREVEEKIKQTHRKYLLQEQLKIIKKELGLEKDDKDAIEEKFRERLKELVVPKHVMDVVDEELSKLGLLDNHSSEFNVTRNYLDWLTSIPWGKYSNENLDLARAQAVLEEDHYGMEDVKKRILEFIAVSQLRGSTQGKILCFYGPPGVGKTSIARSIARALNREYFRFSVGGMTDVAEIKGHRRTYVGAMPGKIIQCLKKTKTENPLILIDEVDKIGRGYQGDPSSALLELLDPEQNANFLDHYLDVPVDLSKVLFICTANVTDTIPEPLRDRMEMINVSGYVAQEKLAIAERYLVPQARALCGLDESKAKLSSDVLTLLIKQYCRESGVRNLQKQVEKVLRKSAYKIVSGEAESVEVTPENLQDFVGKPVFTVERMYDVTPPGVVMGLAWTAMGGSTLFVETSLRRPQDKDAKGDKDGSLEVTGQLGEVMKESARIAYTFARAFLMQHAPANDYLVTSHIHLHVPEGATPKDGPSAGCTIVTALLSLAMGRPVRQNLAMTGEVSLTGKILPVGGIKEKTIAAKRAGVTCIVLPAENKKDFYDLAAFITEGLEVHFVEHYREIFDIAFPDEQAEALAVER

SEQ ID NO: 8848 - protein, 185 aa, Homo sapiens
MNNNQIVAKDLQDEKILYPEFNKLKERNRELKTLLSIGGWNFGTSRFTTMLSTFANREKFIASVISLLRTHDFDGLDLFFLYPGLRGSPMHDRWTFLFLIEELLFAFRKEALLTMRPRLLLSAAVSGVPHIVQTSYDVRFLGRFVPLSGERRSTGLITSMSRMPTRGKSGLAMTMPSASVTRHGL

SEQ ID NO: 8849 - protein, 422 aa, Homo sapiens
MSGGTPYIGSKISLISKAEIRYEGILYTIDTENSTVALAKVRSFGTEDRPTDRPIPPRDEVFEYIIFRGSDIKDLTVCEPPKPQCSLPQDPAIVQSSLGSSTSSFQSMGSYGPFGRMPTYSQFSPSSLVGQQFGAVGVGRSSPQLDPLRKSPTMEQAVQTASAHLPAPAAVGRRSPVSTRPLPSASQKAGENQEHRRAEVHKVSRPENEQLRNDNKRQVAPGAPSAPRRGRGGHRGGRGRFGIRRDGPMKFEKDFDFESANAQFNKEEIDREFHNKLKLKEDKLEKQEKPVNGEDKGDSGVDTQNSEGNADEEDPLGPNCYYDKTKSFFDNISCDDNRERRPTWAEERRLNAETFGIPLRPNRGRGGYRGRGGLGFRGGRGRGGGRGGTFTAPRGFRGGFRGGRGGREFADFEYRKTTAFGP

SEQ ID NO: 8850 - protein, 421 aa, Homo sapiens; identical to SEQ ID NO: 5867

SEQ ID NO: 8851 - protein, 251 aa, Homo sapiens
MDSELMHSIVGSYHKPPERVFVPSFTQNEPSQNCHPANLEVTSPKILHSPNSQALILALKTLQEKIHRLELERTQAEDNLNILSREAAQYKKALENETNERNLAHQELIKQKKDISIQLSSAQSRCTLLEKQLEYTKRMVLNVEREKNMILEQQAQLQREKEQDQMKLYAKLEKLDVLEKECFRLTTTQKTAEDKIKHLEEKLKEEEHQRKLFQDKASELQTGLEISKIIMSSVSNLKHSKEKKKSSKVCI

SEQ ID NO: 8852 - protein, 659 aa, Homo sapiens
MDSQGRVWAQEMLLRVSPDHVTLLDPASKEELESYPLGAIVRCDAVMPPGRSRSLLLLVCQEPERAQPDVHFFQGLRLGAELIREDIQGALHNYRSGRGERRAAALRATQEELQRDRSPAAETPPLQRRPSVRAVISTVERGAGRGRPQAKPIPEAEEAQRPEPVGTSSNADSASPDLGPRGPDLAVLQAEREVDILNHVFDDVESFVSRLQKSAEAARVLEHRERGRRSRRRAAGEGLLTLRAKPPSEAEYTDVLQKIKYAFSLLARLRGNIADPSSPELLHFLFGPLQMIVNTSGGPEFASSVRRPHLTSDAVALLRDNVTPRENELWTSLGDSWTRPGLELSPEEGPPYRPEFFSGWEPPVTDPQSRAWEDPVEKQLQHERRRRQQSAPQVAVNGHRDLEPESEPQLESETAGKWVLCNYDFQARNSSELSVKQRDVLEVLDDSRKWWKVRDPAGQEGYVPYNILTPYPGPRLHHSQSPARSLNSTPPPPPAPAPAPPPALARPRWDRPRWDSCDSLNGLDPSEKEKFSQMLIVNEELQARLAQGRSGPSRAVPGPRAPEPQLSPGSDASEVRAWLQAKGFSSGTVDALGVLTGAQLFSLQKEELRAVSPEEGARVYSQVTVQRSLLEDKEKVSELEAVMEKQKKKVEGEVEMEVI

SEQ ID NO: 8853 - protein, 1233 aa, Homo sapiens
MNTKKRGSPARTHSMMSLSVRPQRRLLSARVNRSQSFAGVLGSHERGPRSFPVFSPPGPPRKPPALSRVSRMFSVAHPAAKVPQPERLDLVYTALKRGLTAYLEVHQQEQEKLQGQIRESKRNSRLGFLYDLDKQVKSIERFLRRLEFHASKIDELYEAYCVQRRLRDGAYNMVRAYTTGSPGSREARDSLAEATRGHREYTESMCLLESELEAQLGEFHLRMKGLAGFARLCVGDQYEICMKYGRQRWKLRGRIEGSGKQVWDSEETIFLPLLTEFLSIKVTELKGLANHVVVGSVSCETKDLFAALPQVVAVDINDLGTIKLSLEVTWSPFDKDDQPSAASSVNKASTVTKRFSTYSQSPPDTPSLREQAFYNMLRRQEELENGTAWSLSSESSDDSSSPQLSGTARHSPAPRPLVQQPEPLPIQVAFRRPETPSSGPLDEEGAVAPVLANGHAPYSRTLSHISEASVDAALAEASVEAVGPESLAWGPSPPTHPAPTHGEHPSPVPPALDPGHSATSSTLGTTGSVPTSTDPAPSAHLDSVHKSTDSGPSELPGPTHTTTGSTYSAITTTHSAPSPLTHTTTGSTHKPIISTLTTTGPTLNIIGPVQTTTSPTHTMPSPTHTTASPTHTSTSPTHTPTSPTHKTSMSPPTTTSPTPSGMGLVQTATSPTHPTTSPTHPTTSPILINVSPSTSLELATLSSPSKHSDPTLPGTDSLPCSPPVSNSYTQADPMAPRTPHPSPAHSSRKPLTSPAPDPSESTVQSLSPTPSPPTPAPQHSDLCLAMAVQTPVPTAAGGSGDRSLEEALGALMAALDDYRGQFPELQGLEQEVTRLESLLMQRQGLTRSRASSLSITVEHALESFSFLNEDEDEDNDVPGDRPPSSPEAGAEDSIDSPSARPLSTGCPALDAALVRHLYHCSRLLLKLGTFGPLRCQEAWALERLLREARVLEAVCEFSRRWEIPASSAQEVVQFSASRPGFLTFWDQCTERLSCFLCPVERVLLTFCNQYGARLSLRQPGLAEAVCVKFLEDALGQKLPRRPQPGPGEQLTVFQFWSFVETLDSPTMEAYVTETAEEVLLVRNLNSDDQAVVLKALRLAPEGRLRRDGLRALSSLLVHGNNKVMAAVSTQLRSLSLGPTFRERALLCFLDQLEDEDVQTRVAGCLALGCIKAPEGIEPLVYLCQTDTEAVREAARQSLQQCGEEGQSAHRRLEESLDALPRIFGPGSMASTAF

SEQ ID NO: 8854 - protein, 475 aa, Homo sapiens
MDQMVQHPAAKMIVMASHMQEQEVGDGTNFVLVFAGALLELAEELLRIGLSVSEVIEGYEIACRKAHEILPNLVCCSAKNLRDIDEVSSLLRTSIMSKQYGNEVFLAKLIAQACVSIFPDSGHFNVDNIRVCKILGSGISSSSVLHGMVFKKETEGDVTSVKDAKIAVYSCPFDGMITETKGTVLIKTAEELMNFSKGEENLMDAQVKAIADTGANVVVTGGKVADMALHYANKYNIMLVRLNSKWDLRRLCKTVGATALPRLTPPVLEEMGHCDSVYLSEVGDTQVVVFKHEKEDGAISTIVLRGSTDNLMDDIERAVDDGVNTFKVLTRDKRLVPGGGATEIELAKQITSYGETCPGLEQYAIKKFAEAFEAIPRALAENSGVKANEVISKLYAVHQEGNKNVGLDIEAEVPAVKDMLEAGILDTYLGKYWAIKLATNAAVTVLRVDQIIMAKPAGGPKPPSGKKDWDDDQND

SEQ ID NO: 8855 - protein, 541 aa, Homo sapiens
MRALLHKPEMIKQILPEHSVLQNINFVEAFQDELLVTEVYDLPQRPNDVQLFYGSMCKIILSVIGEFRDCISSREFLQPSSKASLESTSDLGASGKHGGNVSLDVLPVKGPQGSPLLSRAARPPLDQLASEEPWTVLPEHLILVAPSPCDMAKTGRFQIVNNSVRLLRFELCWPAHCLTVTPQHGCVAPESKLQILVSPNSSLSTKQSMFPWSGLIYIHCDDGQKKIVKVQIREDLTQVELLTRLTSKPFGILSPVSEPSVSHLVKPMTKPPSTKVEIRNKSITFPTTEPGETSESCLELENHGTTDVKWHLSSLAPPYVKGVDESGDVFRATYAAFRCSPISGLLESHGIQKVSITFLPRGRGDYAQFWDVECHPLKEPHMKHTLRFQLSGQSIEAENEPENACLSTDSLIKIDHLVKPRRQAVSEASARIPEQLDVTARGVYAPEDVYRFRPTSVGESRTLKVNLRNNSFITHSLKFLSPREPFYVKHSKYSLRAQHYINMPVQFKPKSAGKFEALLVIQTDEGKSIAIRLIGEALGKN

SEQ ID NO: 8856 - protein, 578 aa, Homo sapiens
MSSKGSSTDGRTDLANGSLSSSPEEMSGAEEGRETSSGIEVEASDLSLSLTGDDGGPNRTSMEDTGHYSINDENRVHDRSEEEEEEEEEEEEEQPRRRVQRKRANRDQDSSDDERALEDWVSSETSALPRPRWQALPALRERELGSSARFVYEACGARVFVQRFRLQHGLEGHTGCVNTLHFNQRGTWLASGSDDLKVVVWDWVRRQPVLDFESGHKSNVFQAKFLPNSGDSTLAMCARDGQVRVAELSATQCCKNTKRVAQHKGASHKLALEPDSPCTFLSAGEDAVVFTIDLRQDRPASKLVVTKEKEKKVGLYTIYVNPANTHQFAVGGRDQFVRIYDQRKIDENENNGVLKKFCPHHLVNSESKANITCLVYSHDGTELLASYNDEDIYLFNSSHSDGAQYVKRYKGHRNNATVKGVNFYGPKSEFVVSGSDCGHIFLWEKSSCQIIQFMEGDKGGVVNCLEPHPHLPVLATSGLDHDVKIWAPTAEASTELTGLKDVIKKNKRERDEDSLHQTDLFDSHMLWFLMHHLRQRRHHRRWREPGVGATDADSDESPSSSDTSDEEEGPDRVQCMPS

SEQ ID NO: 8857 - protein, 141 aa, Homo sapiens
MGGKPRHSLYFIGYQDDFLLYLDPHYCQPTVDVSQADFPLESFHCTSPRKMAFAKMDPSCTVGFYAGDRKEFETLCSELTRVLSSSSATERYPMFTLAEGHAQDHSLDDLCSQLAQPTLRLPRTGRLLRAKRPSSEDFVFL

SEQ ID NO: 8858 - protein, 189 aa, Homo sapiens
MVLLHVKRGDESQFLLQAPGSTELEELTVQVARVYNGRLKVQRLCSAPNEKMKQVLKKTIEEAKAIISKKQVEAGVCVTMEMVKDALDQLRGAVMIVYPMGLPPYDPIRMEFENKEDLSGTQAGLNVIKEAEAQLWWAAKELRRTKKLSDYVGKNEKTKIIAKIQQVSTFCFNVSVVFVISLQTDKNVQ

SEQ ID NO: 8859 - protein, 676 aa, Homo sapiens
MAAIQHGHEAVVRLLMEWGADPNHAARTVGWSPLMLAALTGRLGVAQQLVEKGANPDHLSVLEKTAFEVALDCKHRDLVDYLDPLTTVRPKTDEEKRRPDIFHALKMGNFQLVKEIADEDPSHVNLVNGDGATPLMLAAVTGQLALVQLLVERHADVDKQDSVHGWTALMQATYHGNKEIVKYLLNQGADVTLRAKNGYTAFDLVMLLNDPDTELVRLLASVCMQVNKDKGRPSHQPPLPHSKVRQPWSIPVLPDDKGGLKSWWNRMSNRFRKLKLMQTLPRGLSSNQPLPFSDEPEPALDSTMRAAPQDKTSRSALPDAAPVTKDNGPGSTRGEKEDTLLTTMLRNGAPLTRLPSDKLKAVIPPFLPPSSFELWSSDRSRTRHNGKADPMKTALPQRASRGHPVGGGGTDTTPVRPVKFPSLPRSPASSANSGNFNHSPHSSGGSSGVGVSRHGGELLNRSGGSIDNVLSQIAAQRKKAAGLLEQKPSHRSSPVGPAPGSSPSELPASPAGGSAPVGKKLETSKRPPSGTSTTSKSTSPTLTPSPSPKGHTAESSVSSSSSHRQSKSSGGSSSGTITDEDELTGILKKLSLEKYQPIFEEQEVDMEAFLTLTDGDLKELGIKTDGSRQQILAAISELNAGKGRERQILQETIHNFHSSFESSASNTRAPGNSPCA

SEQ ID NO: 8860 - protein, 772 aa, Homo sapiens
MRHQKRNVYHCNKCRLQFLFAKDKIEHKLQHHKTFRKPKQLEGLKPGTKVTIRASRGQPRTVPVSSNDTPPSALQEAAPLTSSMDPLPVFLYPPVQRSIQKRAVRKMSVMGRQTCLECSFEIPDFPNHFPTYVHCSLCRYSTCCSRAYANHMINNHVPRKSPKYLALFKNSVSGIKLACTSCTFVTSVGDAMAKHLVFNPSHRSSSILPRGLTWIAHSRHGQTRDRVHDRNVKNMYPPPSFPTNKAATVKSAGATPAEPEELLTPLAPALPSPASTATPPPTPTHPQALALPPLATEGAECLNVDDQDEGSPVTQEPELASGGGGSGGVGKKEQLSVKKLRVVLFALCCNTEQAAEHFRNPQRRIRRWLRRFQASQGENLEGKYLSFEAEEKLAEWVLTQREQQLPVNEETLFQKATKIGRSLEGGFKISYEWAVRFMLRHHLTPHARRAVAHTLPKDVAENAGLFIDFVQRQIHNQDLPLSMIVAIDEISLFLDTEVLSSDDRKENALQTVGTGEPWCDVVLAILADGTVLPTLVFYRGQMDQPANMPDSILLEAKESGYSDDEIMELWSTRVWQKHTACQRSKGMLVMDCHRTHLSEEVLAMLSASSTLPAVVPAGCSSKIQPLDVCIKRTVKNFLHKKWKEQAREMADTACDSDVLLQLVLVWLGEVLGVIGDCPELVQRSFLVASVLPGPDGNINSPTRNADMQEELIASLEEQLKLSGEHSESSTPRPRSSPEETIEPESLHQLFEGESETESFYGFEEADLDLMEI

SEQ ID NO: 8861 - protein, 94 aa, Homo sapiens
MAMTAGTTTTFPMSNHTRERVTVAKLTLENFYSNLILQHEERETRQKKLEVAMEEEGLADEEKKLRRSQHARKETEFLRLKRTRLGLDDFESLK

SEQ ID NO: 8862 - protein, 348 aa, Homo sapiens; identical to SEQ ID NO: 5338

SEQ ID NO: 8863 - protein, 295 aa, Homo sapiens; identical to SEQ ID NO: 4796

SEQ ID NO: 8864 - protein, 85 aa, Homo sapiens
MPYNEAENKRSYHLCDLCDRIIIGDREWAAHIKSKSHLNQLKKRRRLDSDAVNTIESQSVSPDHNKEPKEKGSPGQNDQELKCSV

SEQ ID NO: 8865 - protein, 131 aa, Homo sapiens
MAMTAGTTTTFPMSNHTRERVTVAKLTLENFYSNLILQHEERETRQKKLEVAMEEEGLADEEKKLRRSQHARKETEFLRLKRTRLGLDDFESLKVIGRGAFGEVRLVQKKDTGHIYAMKILRKSDMLEKEQ

SEQ ID NO: 8866 - protein, 6 aa, Homo sapiens
MAHEMI

SEQ ID NO: 8867 - protein, 732 aa, Homo sapiens
MGFRDEAAGYFHKAVKLNPDFSDAKENFYRVANWLVERWHFIMLNDTKRNTIYNAAIQKAVCLGSKSVLDIGAGTGILSMFAKKAGAHSVYACELSKTMYELACDVVAANKMEAGIKLLHTKSLDIEIPKHIPERVSLVVTETVDAGLFGEGIVESLIHAWEHLLLQPKTKGESANCEKYGKVIPASAVIFGMAVECAEIRRHHRVGIKDIAGIHLPTNVKFQSPAYSSVDTEETIEPYTTEKMSRVPGGYLALTECFEIMTVDFNNLQELKSLATKKPDKIGIPVIKEGILDAIMVWFVLQLDDEHSLSTSPSEETCWEQAVYPVQDLADYWIKPGDHVMMEVSCQDCYLRIQSISVLGLECEMDVAKSFTQNKDLLSLGNEAELCSALANLQTSKPDAVEQTCILESTEIALLNNIPYHEGFKMAMSKVLSSLTPEKLYQTMDTHCQNEMSSGTGQSNTVQNILEPFYVLDVSEGFSVLPVIAGTLGQVKPYSSVEKDQHRIALDLISEANHFPKETLEFWLRHVEDESAMLQRPKSDKLWSIIILDVIEPSGLIQQEIMEKAAISRCLLQSGGKIFPQYVLMFGLLVESQTLLEENAVQGTERTLGLNIAPFINQFQVPIRVFLDLSSLPCIPLSKPVELLRLDLMTPYLNTSNREVKVYVCKSGRLTAIPFWYHMYLDEEIRLDTSSEASHWKQAAVVLDNPIQVEMGEELVLSIQHHKSNVSITVKQ

SEQ ID NO: 8868 - protein, 517 aa, Homo sapiens
MCSLASGATGGRGAVENEEDLPELSDSGDEAAWEDEDDADLPHGKQQTPCLFCNRLFTSAEETFSHCKSEHQFNIDSMVHKHGLEFYGYIKLINFIRLKNPTVEYMNSIYNPVPWEKEEYLKPVLEDDLLLQFDVEDLYEPVSVPFSYPNGLSENTSVVEKLKHMEARALSAEAALARAREDLQKMKQFAQDFVMHTDVRTCSSSTSVIADLQEDEDGVYFSSYGHYGIHEEMLKDKIRTESYRDFIYQNPHIFKDKVVLDVGCGTGILSMFAAKAGAKKVLGVDQSEILYQAMDIIRLNKLEDTITLIKGKIEEVHLPVEKVDVIISEWMGYFLLFESMLDSVLYAKNKYLAKGGSVYPDICTISLVAVSDVNKHADRIAFWDDVYGFKMSCMKKAVIPEAVVEVLDPKTLISEPCGIKHIDCHTTSISDLEFSSDFTLKITRTSMCTAIAGYFDIYFEKNCHNRVVFSTGPQSTKTHWKQTVFLLEKPFSVKAGEALKGKVTVHKNKREVLIVGI

SEQ ID NO: 8869 - protein, 519 aa, Homo sapiens
MEQEKFDLQKQHTENIQELLEDTNVRLNKMESEYMAQTQSTNHMIKELEARVQQLTGEAENSNLQRQKLIQEKAELERCYQITCSELQEVKARRNTLHKEKDHLVNDYEQNMKLLQTKYDADINLLKQEHALSASKASSMIEELEQNVCQLKQQLQESELQRKQQLRDQENKFQMEKSHLKHIYEKKAHDLQSELDKGKEDTQKKIHKFEEALKEKEEQLTRVTEVQRLQAQQADAALEEFKRQVELNSEKVYAEMKEQMEKVEADLTRSKSLREKQSKEFLWQLEDIRQRYEQQIVELKLEHEQEKTHLLQQHNAEKDSLVRDHEREIENLEKQLRAANMEHENQIQEFKKRDAQVIADMEAQVHKLREELINVNSQRKQQLVELGLLREEEKQRATREHEIVVNKLKAESEKMKIELKKTHAAETEMTLEKVLQDELENRSNQVRCAEKKLQHKELESQEQITYIRQEYETKLKGLMPASLRQELEDTISSLKSQVNFLQKRASILQEELTTYQGRR

SEQ ID NO: 8870 - protein, 580 aa, Homo sapiens
MNNIHVENESLDNFLKETNKENLLDILTEPERKPDPKLYTRSKPKTDSYNQTKNSLVPKQALGKSSVNSAVLKDRVNKQFVGETQSRTFPVKSQQLSRGADLARPGVKPSRTVPSHFIRTLSKVQSSKKPVVKNIKDIKVNRSQYERPNETKIRSYPVTEQRVKHTKPRTYPSLLQGEYNNRHPNIKQDQKSSQVCIPQTSCVLQKSKAISQRPNLTVGRFNSAIPSTPSIRPNGTSGNKHNNNGFQQKAQTLDSKLKKAVPQNHFLNKTAPKTQADVTTVNGTQTNPNIKKKATAEDRRKQLEEWQKSKGKTYKRPPMELKTKRKVIKEMNISFWKSIEKEEEEKKAQLELSSKINNTLTECLNLIEGGVPSNEILNILSSIPEAEKFAKFWICKAKLLASKGTFDVIGLYEEAIKNGATPIQELRKVVLNILQDSNRTTEGITSDSLVAETSITSVEELAKKMESVKSCLSPKEREQVTATPRIAKAEQHNYPGIKLQIGPIPRINGMPEVQDMKFITPVRRSSRIERAVSRYPEMLQEHDLVVASLDELLEVEETKCFIFRRNEALPVTLGFQTPES

SEQ ID NO: 8871 - protein, 234 aa, Homo sapiens
MYMDLVDGIFLNQIMLQIDPRPTNQRINKHVNNDVNLRIQNLTILVRNIKTYYQEVLQQLIVMNLPNVLMIGRDPLSGKSMEEIKKVLLLVLGCAVQCERKEEFIERIKQLDIETQAGIVAHIQEVTHNQENVFDLQWLELPDVAPEELEALSRSMVLHLRRLIDQRDECTELIVDLTQERDYLQAQHPPSPIKSSSADSTPSPTSSLSSEDKQHLAVELADTKARLRRVRQEL

SEQ ID NO: 8872 - protein, 386 aa, Homo sapiens
MTDIRKIRLGERLVEVFSAEKVYMVRLRNPLGRQEWSGPWSEISEEWQQLTASDRKNLGLVMSDDGEFWMSLEDFCRNFHKLNVCRNVNNPIFGRKELESVLGCWTVDDDPLMNRSGGCYNNRDTFLQNPQYIFTVPEDGHKVIMSLQQKDLRTYRRMGRPDNYIIGFELFKVEMNRKFRLHHLYIQERAGTSTYIDTRTVFLSKYLKKGNYVLVPTMFQHGRTSEFLLRIFSEVPVQLRELTLDMPKMSCWNLARGYPKVVTQITVHSAEDLEKKYANETVNPYLVIKCGKEEVRSPVQKNTVHAIFDTQAIFYRRTTDIPIIVQVWNSRKFCDQFLGQVTLDADPSDCRDLKSLYLRKKGGPTAKVKQGHISFKVISSDDLTEL

SEQ ID NO: 8873 - protein, 321 aa, Homo sapiens
MTELSLQKEQLQLKIIEIEDEAEKWQKEKDRIKSFTTNEKAILEQNFRDLVRDLEKQKEEVRAALEQREQDAVDQVKVIMDALDERAKVLHEDKQTREQLHSISDSVLFLQEFGALMSNYSLPPPLPTYHVLLEGEGLGQSLGNFKDDLLNVCMRHVEKMCKADLSRNFIERNHMENGGDHRYVNNYTNSFGGEWSAPDTMKRYSMYLTPKGGVRTSYQPSSPGRFTKETTQKNFNNLYGTKGNYTSRVWEYSSSIQNSDNDLPVVQGSSSFSLKGYPSLMRSQSPKAQPQTWKSGKQTMLSHYRPFYVNKGNGIGSNEAP

SEQ ID NO: 8874 - protein, 228 aa, Homo sapiens
MYRQRFLYSLYRHTHWVRCAKFSPDGRLIVSCSEDKTIKIWDTTNKQCVNNFSDSVGFANFVDFNPSGTCIASAGSDQTVKVWDVRVNKLLQHYQVHSGGVNCISFHPSGNYLITASSDGTLKILDLLEGRLIYTLQGHTGPVFTVSFSKGGELFASGGADTQVLLWRTNFDELHCKGLTKRNLKRLHFDSPPHLLDIYPRTPHPHEEKVETVEDFFLHLLRLIQSLR

SEQ ID NO: 8875 - protein, 561 aa, Homo sapiens
MRAVRRHLFPQHSAPGRGVVWEWLSDDGSWTAYEASVCDYLEQQVARGNQLVDLAPLGYNYTVNYTTHTQTNKTSSFCRSVRRQAGPPYPVTTIIAPPGHTGVACSCHQCLSGSRTGPVSGRYRHSMTNLPAYPVPQHPPHRTASVFGTHQAFAPYNKPSLSGARSAPRLNTTNAWGAAPPSLGSQPLYRSSLSHLGPQHLPPGSSTSGAVSASLPSGPSSSPGSVPATVPMQMPKPSRVQQALAGMTSVLMSAIGLPVCLSRAPQPTSPPASRLASKSHGSVKRLRKMSVKGATPKPEPEPEQVIKNYTEELKVPPDEDCIICMEKLSTASGYSDVTDSKAIGSLAVGHLTKCSHAFHLLCLLAMYCNGNKDGSLQCPSCKTIYGEKTGTQPQGKMEVLRFQMSLPGHEDCGTILIVYSIPHGIQGPEHPNPGKPFTARGFPRQCYLPDNAQGRKVLELLKVAWKRRLIFTVGTSSTTGETDTVVWNEIHHKTEMDRNITGHGYPDPNYLQNVLAELAAQGVTEDCLEQQHARLWWPPRCPMAGWVARQEVPSPRGWEVC

SEQ ID NO: 8876 - protein, 854 aa, Homo sapiens
MKVEACTWAGYSGLYEAIESWDFKKIEKLEEYRLLLKRLQPEFKTRIIPTDIISDLSECLINQECEEILQICSTKGMMAGAEKLVECLLRSDKENWPKTLKLALEKERNKFSELWIVEKGIKDVETEDLEDKMETSDIQIFYQEDPECQNLSENSCPPSEVSDTNLYSPFKPRNYQLELALPAMKGKNTIICAPTGCGKTFVSLLICEHHLKKFPQGQKGKVVFFANQIPVYEQQKSVFSKYFERHGYRVTGISGATAENVPVEQIVENNDIIILTPQILVNNLKKGTIPSLSIFTLMIFDECHNTSKQHPYNMIMFNYLDQKLGGSSGPLPQVIGLTASVGVGDAKNTDEALDYICKLCASLDASVIATVKHNLEELEQVVYKPQKFFRKVESRISDKFKYIIAQLMRDTESLAKRICKDLENLSQIQNREFGTQKYEQWIVTVQKACMVFQMPDKDEESRICKALFLYTSHLRKYNDALIISEHARMKDALDYLKDFFSNVRAAGFDEIEQDLTQRFEEKLQELESVSRDPSNENPKLEDLCFILQEEYHLNPETITILFVKTRALVDALKNWIEGNPKLSFLKPGILTGRGKTNQNTGMTLPAQKCILDAFKASGDHNILIATSVADEGIDIAQCNLVILYEYVGNVIKMIQTRGRGRARGSKCFLLTSNAGVIEKEQINMYKEKMMNDSILRLQTWDEAVFREKILHIQTHEKFIRDSQEKPKPVPDKENKKLLCRKCKALACYTADVRVIEECHYTVLGDAFKECFVSRPHPKPKQFSSFEKRAKIFCARQNCSHDWGIHVKYKTFEIPVIKIESFVVEDIATGVQTLYSKWKDFHFEKIPFDPAEMSK

SEQ ID NO: 8877 - protein, 270 aa, Homo sapiens
MQIEHIIENIVAVTKGLSEKLPEKWESVKLLFVKTEKSAALPIFSSFVSNWDEATKRSLLNKKKKEARRKRRERNFEKQKERKKKRQQARKTASVLSKDDVAPESGDTTVKKPESKKEQTPEHGKKKRGRGKAQVKATNESEDEIPQLVPIGKKTPANEKVEIQKHATGKKSPAKSPNPSTPRGKKRKALPASETPKAAESETPGKSPEKKPKIKEEAVKEKSPSLGKKDARQTPKKPEAKFFTTPSKSVRKASHTPKKWPKKPKVPQST

SEQ ID NO: 8878 - protein, 352 aa, Homo sapiens
MSSRKLSGPKGRRLSIHVVTWNVASAAPPLDLSDLLQLNNRNLNLDIYVIGLQELNSGIISLLSDAAFNDSWSSFLMDVLSPLSFIKVSHVRMQGILLLVFAKYQHLPYIQILSTKSTPTGLFGYWLSIAKKHDPLLREFQEGRLLFPPTYKFDRNSNDYDTSEKKRKPAWTDRILWRLKRQPCAGPDTPIPPASHFSLSLRGYSSHMTYGISDHKPVSGTFDLELKPLVSAPLIVLMPEDLWTVENDMMVSYSSTSDFPSSPWDWIGLYKVGLRDVNDYVSYAWVGDSKVSCSDNLNQVYIDISNIPTTEDEFLLCYYSNSLRSVVGISRPFQIPPGSLREDPLGEAQPQI

SEQ ID NO: 8879 - protein, 124 aa, Homo sapiens
MTGSCCGSTFSSLSYGGGCCQPCCCRDPCCCRPVTCQTTVCRPVTCVPRCTRPICEPCRRPVCCDPCSLQEGCCRPITCCPSSCTAVVCRPCCWATTCCQPPVSVQSPCGQPTPCSTTCRTSSC

SEQ ID NO: 8880 - protein, 308 aa, Homo sapiens; identical to SEQ ID NO: 5666

SEQ ID NO: 8881 - protein, 980 aa, Homo sapiens
MTEGRHCQVHLLDDRRLELLVQPKLLARELLDLVASHFNLKEKEYFGITFIDDTGQQNWLQLDHRVLDHDLPKKPGPTILHFAVRFYIESISFLKDKTTVELFFLNAKACVHKGQIEVESETIFKLAAFILQSPKVSLTHDENARKDLKTLPAFPTKTLQEHPSLAYCEDRVIEHYLKIKGLTRGQAVVQYMKIVEALPTYGVHYYAVKDKQGLPWWLGISYKGIGQYDIQDKVKPRKLFQWKQLENLYFREKKFAVEVHDPRRISVSRRTFGQSGLFVQTWYANSSLIKSIWVMAISQHQFYLDRKQSKAKIPSARSLDEIAMDLTETGTQRASKLVTLETKSQFIMASNGSLISSGSQDSEVSEEQKREKILELKKKEKLLQEKLLKKVEELKKICLREAELTGKMPKEYPLNIGEKPPQVRRRVGTAFKLDDNLLPSEEDPALQELESNFLIQQKLVEAAKKLANEPDLCKTVKKKRKQDYTDAMKKLQEIENAINEYRIRCGKKPSQKATVLPEDIIPSESSSLSDTTTYDDPSDAFTFPGQRSSSVPHSPRILPPKSLGIERIHFRKSSINEQFVDTRQSREMLSTHSSPYKTLERRPQGGRSMPTTPVLTRNAYSSSHLEPESSSQHCRQRSGSLESQSHLLSEMDSDKPFFSLSKSQRSSSTEILDDGSSYTSQSSTEYYCVTPVTGPYYTTQTLDTRTRGRRRSKKQNVSTSNSGSMPNLAQKDSLRNGVYSKSQEPPSSSYYIAGYTPYAECDFYYSGGYVYENDTEGQYSVNPSYRSSAHYGYERQRDYSRSFHEDEVDRVPHNPYATLRLPRKAAAKSEHITKNIHKALVAEHLRGWYQRASGQKDQGHSPQTSFDSDRGSQRCLGFAGLQVPCSPSSRASSYSSVSSTNASGNWRTQLTIGLSDYETPAHSSYTSCYGNVYNPLPSPSRQYTEISQLDGTDGNQLEDNLESSEQRLFWHEDSKPGTLV

SEQ ID NO: 8882 - protein, 992 aa, Homo sapiens
MYGSARSVGKVEPSSQSPGRSPRLPRSPRLGHRRTNSTGGSSGSSVGGGSGKTLSMENIQSLNAAYATSGPMYLSDHENVGSETPKSTMTLGRSGGRLPYGVRMTAMGSSPNIASSGVASDTIAFGEHHLPPVSMASTVPHSLRQARDNTIMDLQTQLKEVLRENDLLRKDVEVKESKLSSSMNSIKTFWSPELKKERALRKDEASKITIWKEQYRVVQEENQHMQMTIQALQDELRIQRDLNQLFQQDSSSRTGEPCVAELTEENFQRLHAEHERQAKELFLLRKTLEEMELRIETQKQTLNARDESIKKLLEMLQSKGLSAKATEEDHERTRRLAEAEMHVHHLESLLEQKEKENSMLREEMHRRFENAPDSAKTKALQTVIEMKDSKISSMERGLRDLEEEIQMLKSNGALSTEEREEEMKQMEVYRSHSKFMKNKIGQVKQELSRKDTELLALQTKLETLTNQFSDSKQHIEVLKESLTAKEQRAAILQTEVDALRLRLEEKETMLNKKTKQIQDMAEEKGTQAGEIHDLKDMLDVKERKVNVLQKKIENLQEQLRDKEKQMSSLKERVKSLQADTTNTDTALTTLEEALAEKERTIERLKEQRDRDEREKQEEIDNYKKDLKDLKEKVSLLQGDLSEKEASLLDLKEHASSLASSGLKKDSRLKTLEIALEQKKEECLKMESQLKKAHEAALEARASPEMSDRIQHLEREITRYKDESSKAQAEVDRLLEILKEVENEKNDKDKKIAELESLTSRQVKDQNKKVANLKHKEQVEKKKSAQMLEEARRREDNLNDSSQQLQDSLRKKDDRIEELEEALRESVQITAEREMVLAQEESARTNAEKQVEELLMAMEKVKQELESMKAKLSSTQQSLAEKETHLTNLRAERRKHLEEVLEMKQEALLAAISEKDANIALLELSSSKKKTQEEVAALKREKDRLVQQLKQQTQNRMKLMADNYEDDHFKSSHSNQTNHKPSPDQDEEEGIWA

SEQ ID NO: 8883 - protein, 1045 aa, Homo sapiens
MLTVQVKTSSAIELPDSLAFLWIIPMWYCEGKELENSPDIHIVQAGNLHSLTIAEAFEEDTGRYSCFASNIYGTDSTSAEIYIEGVSSSDSEGDPNKEEMNRIQKPNEVSSPPTTSAVIPPAVPQAQHLVAQPRVATIQQCQSPTNYLQGLDGKPIIAAPVFTKMLQNLSASEGQLVVFECRVKGAPSPKVEWYREGTLIEDSPDFRILQKRPVCMEHIEEICTLVIAEVFAEDSGCFTCTASNKYGTVSSIAQLHVRGNEDLSNNGSLHSANSTTNLAAIEPQPSPPHSEPPSVEQPPKPKLEGVLVNHNEPRSSSRIGLRVHFNLPEDDKGSEASSEAGVVTTRQTRPDSFQERFNGQATKTPEPSSPVKEPPPVLAKPKLDSTQLQQLHNQVLLEQHQLQNPPPSSPKEFPFSMTVLNSNAPPAVTTSSKQVKAPSSQTFSLARPKYFFPSTNTTAATVAPSSSPVFTLSSTPQTIQRTVSKESLLVSHPSVQTKSPGGLSIQNEPLPPGPTEPTPPPFTFSIPSGNQFQPRCVSPIPVSPTSRIQNPVAFLSSVLPSLPAIPPTNAMGLPRSAPSMPSQGLAKKNTKSPQPVNDDNIRETKNAVIRDLGKKITFSDVRPNQQEYKISSFEQRLMNEIEFRLERTPVDESDDEIQHDEIPTGKCIAPIFDKRLKHFRVTEGSPVTFTCKIVGIPVPKVYWFKDGKQISKRNEHCKMRREGDGTCSLHIESTTSDDDGNYTIMAANPQGRISCSGHLMVQSLPIRSRLTSAGQSHRGRSRVQERDKEPLQERFFRPHFLQAPGDMVAHEGRLCRLDCKVSGLPPPELTWLLNGQPVLPDASHKMLVRETGVHSLLIDPLTQRDAGTYKCIATNKTGQNSFSLELSVVAKEVKKAPVILEKLQNCGVPEGHPVRLECRVIGMPPPVFYWKKDNETIPCTRERISMHQDTTGYACLLIQPAKKSDAGWYTLSAKNEAGIVSCTARLDIYAQWHHQIPPPMSVRPSGSRYGSLTSKGLDIFSAFSSMESTMVYSCSSRSVVESDEL

SEQ ID NO: 8884 - protein, 23 aa, Homo sapiens
VRLAWGFVSALGSFHTADPEGAA

SEQ ID NO: 8885 - protein, 535 aa, Homo sapiens
MEAPTVETPPDPSPPSAPAPALVPLRAPDVARLREEQEKVVTNCQERIQHWKKVDNDYNALRERLSTLPDKLSYNIMVPFGPFAFMPGKLVHTNEVTVLLGDNWFAKCSAKQAVGLVEHRKEHVRKTIDDLKKVMKNFESRVEFTEDLQKMSDAAGDIVDIREEIKCDFEFKAKHRIAHKPHSKPKTSDIFEADIANDVKSKDLLADKELWARLEELERQEELLGELDSKPDTVIANGEDTTSSEEEKEDRNTNVNAMHQVTDSHTPCHKDVASSEPFSGQVNSQLNCSVNGSSSYHSDDDDDDDDDDDDDNIDDDDGDNDHEALGVGDNSIPTIYFSHTVEPKRVRINTGKNTTLKFSEKKEEAKRKRKNSTGSGHSAQELPTIRTPADIYRAFVDVVNGEYVPRKSILKSRSRENSVCSDTSESSAAEFDDRRGVLRSISCEEATCSDTSESILEEEPQENQKKLLPLSVTPEAFSGTVIEKEFVSPSLTPPPAIAHPALPTIPERKEVLLEASEETGKRVSKFKAARLQQKD

SEQ ID NO: 8886 - protein, 576 aa, Homo sapiens
MEGLRRRRGREAGPPQPMVPLAVENQAGGEGAGGELGISLNMCLLGALVLLGLGVLLFSGGLSESETGPMEEVERQVLPDPEVLEAVGDRQDGLREQLQAPVPPDSVPSLQNMGLLLDKLAKENQDIRLLQAQLQAQKEELQSLMHQPKGLEEENAQLRGALQQGEAFQRALESELQQLRARLQGLEADCVRGPDGVCLSGGRGPQGDKAIREQGPREQEPELSFLKQKEQLEAEAQALRQELERQRRLLGSVQQDLERSLQDASRGDPAHAGLAELGHRLAQKLQGLENWGQDPGVSANASKAWHQKSHFQNSREWSGKEKWWDGQRDRKAEHWKHKKEESGRERKKNWGGQEDREPAGRWKEGRPRVEESGSKKEGKRQGPKEPPRKSGSFHSSGEKQKQPRWREGTKDSHDPLPSWAELLRPKYRAPQGCSGVDECARQEGLTFFGTELAPVRQQELASLLRTYLARLPWAGQLTKELPLSPAFFGEDGIFRHDRLRFRDFVDALEDSLEEVAVQQTGDDDEVDDFEDFIFSHFFGDKALKKRSGKKDKHSQSPRAAGPREGHSHSHHHHHRG

SEQ ID NO: 8887 - protein, 747 aa, Homo sapiens
MAKYNTGGNPTEDVSVNSRPFRVTGPNSSSGIQARKNLFNNQGNASPPAGPSNVPKFGSPKPPVAVKPSSEEKPDKEPKPPFLKPTGAGQRFGTPASLTTRDPEAKVGFLKPVGPKPINLPKEDSKPTFPWPPGNKPSLHSVNQDHDLKPLGPKSGPTPPTSENEQKQAFPKLTGVKGKFMSASQDLEPKPLFPKPAFGQKPPLSTENSHEDESPMKNVSSSKGSPAPLGVRSKSGPLKPAREDSENKDHAGEISSLPFPGVVLKPAASRGGPGLSKNGEEKKEDRKIDAAKNTFQSKINQEELASGTPPARFPKAPSKLTVGGPWGQSQEKEKGDKNSATPKQKPLPPLFTLGPPPPKPNRPPNVDLTKFHKTSSGNSTSKGQTSYSTTSLPPPPPSHPASQPPLPASHPSQPPVPSLPPRNIKPPFDLKSPVNEDNQDGVTHSDVVIPLDHEQDSEGETYEDIEASKEREKKREKEEKKRLELEKKEQKEKEKKEQEIKKKFKLTGPIQVIHLAKACCDVKGGKNELSFKQGEQIEIIRITDNPEGKWLGRTARGSYGYIKTTAVEIDYDSLKLKKDSLGAPSRPIEDDQEVYDDVAEQDDISSHSQSGSGGIFPPPPDDDIYDGIEEEDADDGSTLQVQEKSNTWSWGILKMLKGKDDRKKSIREKPKVSDSDNNEGSSFPAPPKQLDMGDEVYDDVDTSDFPVSSAEMSQGTNVGKAKTEEKDLKKLKKQEKEEKDFRKKFKK

SEQ ID NO: 8888 - protein, 521 aa, Homo sapiens; identical to SEQ ID NO: 8023

SEQ ID NO: 8889 - protein, 569 aa, Homo sapiens
MLRDMTGLPHNRKCFDCDQRGPTYVNMTVGSFVCTSCSGSLRGLNPPHRVKSISMTTFTQQEIEFLQKHGNEVCKQIWLGLFDDRSSAIPDFRDPQKVKEFLQEKYEKKRWYVPPEQAKVVASVHASISGSSASSTSSTPEVKPLKSLLGDSAPTLHLNKGTPSQSPVVGRSQGQQQEKKQFDLLSDLGSDIFAAPAPQSTATANFANFAHFNSHAAQNSANADFANFDAFGQSSGSSNFGGFPTASHSPFQPQTTAFRMLSSSCSFGEFTSAFPLQATHSGSAASVNANFAHFDNFPKSSSADFGTFNTSQSHQTASAVSKVSTNKAGLQTADKYAALANLDNIFSAGQGGDQGSGFGTTGKAPVGSVVSVPSQSSASSDKYAALAELDSVFSSAATSSNAYTSTSNASSNVFGTVPVVASAQTQPASSSVPAPFGATPSTNPFVAAAGPSVASSTNPFQTNARGATAATFGTASMSMPTGFGTPAPYSLPTSFSGSFQQPAFPAQAAFPQQTAFSQQPNGFAAFGQTKPVVTPFGQVAAAGVSSNPFMTGAPTGQFPTGSSSTNPFL

SEQ ID NO: 8890 - protein, 668 aa, Homo sapiens
MSKLAAAHRGAIRALQMFVTQFTDRGEHPLPARCKELGSLIRQLSLCSVKLDADPSVPDVVIDILQQIEALESLLEKKLSPKKVKKCFSEIRSRFPIGSQKALERWPSTSPKGERRPLTAKDTFPQETSRPSVAKQLLADKYQPDTELPETQRLQSELDVLDADIVLEEGPFILDQSASFKDEVLAVAKTKAGKKKPVTENVPFRKKDTLAPARQQGLRKAERGRQSQPHSKSRVQQTTVSSRLKMNRQPVKDRKAPWIPPNPTSPPASPKCAAWLKVKTSPRDATKEPLQQEDPQEESHLTGAVEHEAARLAWLDAETSKRLKELEELKAKEIDSMQKQRLDWLDAETSRRTKELNELKAEEMYRLQQLSVSATHLADKVEEAVLDRLKPLLVKAQRVNSTTEANIHLKDGSSVNTAKAQPAQEVAAVDFESNNIRQLDDFLEDCASELWAVTHAKILGSETLATVEDSKDSPDLEIMMRRMEEMEKYQESVRQRYNKIAYADPRLWMQEENNDQKISAISEKPLSPHPIRITKTVDRKDPAVNIMLERPCNGNSLDESVGTEEGSEKREAPLLSLAEDSQQKEGRAPLFVPPGMQHSIGDYCSRFEQYLRIISHEAVGSFNPWLIAESFSEELVDEALGAVAAELQDMCEDYAEAVFTSEFLEAAT

SEQ ID NO: 8891 - protein, 1203 aa, Homo sapiens
MPARIGYYEIDRTIGKGNFAVVKRATHLVTKAKVAIKIIDKTQLDEENLKKIFREVQIMKMLCHPHIIRLYQVMETERMIYLVTEYASGGEIFDHLVAHGRMAEKEARRKFKQIVTAVYFCHCRNIVHRDLKAENLLLDANLNIKIADFGFSNLFTPGQLLKTWCGSPPYAAPELFEGKEYDGPKVDIWSLGVVLYVLVCGALPFDGSTLQNLRARVLSGKFRIPFFMSTECEHLIRHMLVLDPNKRLSMEQICKHKWMKLGDADPNFDRLIAECQQLKEERQVDPLNEDVLLAMEDMGLDKEQTLQAEQAGTAMNISVPQVQLINPENQIVEPDGTLNLDSDEGEEPSPEALVRYLSMRRHTVGVADPRTEVMEDLQKLLPGFPGVNPQAPFLQVAPNVNFMHNLLPMQNLQPTGQLEYKEQSLLQPPTLQLLNGMGPLGRRASDGGANIQLHAQQLLKRPRGPSPLVTMTPAVPAVTPVDEESSDGEPDQEAVQRYLANRSKRHTLAMTNPTAEIPPDLQRQLGQQPFRSRVWPPHLVPDQHRSTYKDSNTLHLPTERFSPVRRFSDGAASIQAFKAHLEKMGNNSSIKQLQQECEQLQKMYGGQIDERTLEKTQQQHMLYQQEQHHQILQQQIQDSICPPQPSPPLQAACENQPALLTHQLQRLRIQPSSPPPNHPNNHLFRQPSNSPPPMSSAMIQPHGAASSSQFQGLPSRSAIFQQQPENCSSPPNVALTCLGMQQPAQSQQVTIQVQEPVDMLSNMPGTAAGSSGRGISISPSAGQMQMQHRTNLMATLSYGHRPLSKQLSADSAEAHSAHQQPPHYTTSALQQALLSPTPPDYTRHQQVPHILQGLLSPRHSLTGHSDIRLPPTEFAQLIKRQQQQRQQQQQQQQQQEYQELFRHMNQGDAGSLAPSLGGQSMTERQALSYQNADSYHHHTSPQHLLQIRAQECVSQASSPTPPHGYAHQPALMHSESMEEDCSCEGAKDGFQDSKSSSTLTKGCHDSPLLLSTGGPGDPESLLGTVSHAQELGIHPYGHQPTAAFSKNKVPSREPVIGNCMDRSSPGQAVELPDHNGLGYPARPSVHEHHRPRALQRHHTIQNSDDAYVQLDNLPGMSLVAGKALSSARMSDAVLSQSSLMGSQQFQDGENEECGASLGGHEHPDLSDGSQHLNSSCYPSTCITDILLSYKHPEVSFSMEQAGV

SEQ ID NO: 8892 - protein, 681 aa, Homo sapiens
MIEKMQGSRMDEQRCSFPPPLKTEEDYIPYPSVHEVLGREGPFPLILLPQFGGYWIEGTNHEITSIPETEPLQSPTTKVKLECNPTARIYRKHFLGKEHFNYYSLDAALGHLVFSLKYDVIGDQEHLRLLLRTKCRTYHDVIPISCLTEFPNVVQMAKLVCEDVNVDRFYPVLYPKASRLIVTFDEHVISNNFKFGVIYQKLGQTSEEELFSTNEESPAFVEFLEFLGQKVKLQDFKGFRGGLDVTHGQTGTESVYCNFRNKEIMFHVSTKLPYTEGDAQQLQRKRHIGNDIVAVVFQDENTPFVPDMIASNFLHAYVVVQAEGGGPDGPLYKVSVTARDDVPFFGPPLPDPAVFRKGPEFQEFLLTKLINAEYACYKAEKFAKLEERTRAALLETLYEELHIHSQSMMGLGGDEDKMENGSGGGGFFESFKRVIRSRSQSMDAMGLSNKKPNTVSTSHSGSFAPNNPDLAKAAGISLLIPGKSASRFGRRGSAIGIGTVEESLIVPGKSPTRKKSGPFGSRRSSAIGIENIQEVQEKRESPPAGQKTPDSGHVSQEPKSENSSTQSSPEMPTTKNRAETAAQRAEALKDFSRSSSSASSFASVVEETEGVDGEDTGLESVSSSGTPHKRDSFIYSTWLEDSVSTTSGGSSPDAGKLGDPACPEIKIQLEASEQHMPQLGC

SEQ ID NO: 8893 - protein, 224 aa, Homo sapiens
MSVGYANGIRVMSMTHTGEPGFMLYIPIEYALHVYNEVMSVGQKYGIRNAGYYALRSLRIEKFFAFWGQDINNLTTPLECGRESRVKLEKGMDFIGRDALLQQKQNGVYKRLTMFILDDHDSDLDLWPWWGEPIYRNGQYVGKTTSSAYSYSLERHVCLGFVHNFSEDTGEEQVVTADFINRGEYEIDIAGYRFQAKAKLYPVASLFTQKRRKDDMELSDLHGK

SEQ ID NO: 8894 - protein, 529 aa, Homo sapiens
MHFSGLEEAVYRNIQACKELAQTTRTAYGPNGMNKMVINHLEKLFVTNDAATILRELEVQHPAAKMIVMASHMQEQEVGDGTNFVLVFAGALLELAEELLRIGLSVSEVIEGYEIACRKAHEILPNLVCCSAKNLRDIDEVSSLLRTSIMSKQYGNEVFLAKLIAQACVSIFPDSGHFNVDNIRVCKILGSGISSSSVLHGMVFKKETEGDVTSVKDAKIAVYSCPFDGMITETKGTVLIKTAEELMNFSKGEENLMDAQVKAIADTGANVVVTGGKVADMALHYANKYNIMLVRLNSKWDLRRLCKTVGATALPRLTPPVLEEMGHCDSVYLSEVGDTQVVVFKHEKEDGAISTIVLRGSTDNLMDDIERAVDDGVNTFKVLTRDKRLVPGGGATEIELAKQITSYGETCPGLEQYAIKKFAEAFEAIPRALAENSGVKANEVISKLYAVHQEGNKNVGLDIEAEVPAVKDMLEAGILDTYLGKYWAIKLATNAAVTVLRVDQIIMAKPAGGPKPPSGKKDWDDDQND

SEQ ID NO: 8895 - protein, 730 aa, Homo sapiens; identical to SEQ ID NO: 4837

SEQ ID NO: 8896 - protein, 756 aa, Homo sapiens
MVAPVLETSHVFCCPNRVRGVLNWSSGPRGLLAFGTSCSVVLYDPLKRVVVTNLNGHTARVNCIQWICKQDGSPSTELVSGGSDNQVIHWEIEDNQLLKAVHLQGHEGPVYAVHAVYQRRTSDPALCTLIVSAAADSAVRLWSKKGPEVPILACGNDDCRIHIFAQQNDQFQKVLSLCGHEDWIRGVEWAAFGRDLFLASCSQDCLIRIWKLYIKSTSLETQDDDNIRLKENTFTIENESVKIAFAVTLETVLAGHENWVNAVHWQPVFYKDGVLQQPVRLLSASMDKTMILWAPDEESGVWLEQREWTPEIVISGHFDGVQDLVWDPEGEFIITVGTDQTTRLFAPWKRKDQSQVTWHEIARPQIHGYDLKCLAMINRFQFVSGADEKVLRVFSAPRNFVENFCAITGQSLNHVLCNQDSDLPEGATVPALGLSNKAVFQGDIASQPSDEEELLTSTGFEYQQVAFQPSILTEPPTEDHLLQNTLWPEVQKLYGHGYEIFCVTCNSSKTLLASACKAAKKEHAAIILWNTTSWKQVQNLVFHSLTVTQMAFSPNEKFLLAVSRDRTWSLWKKQDTISPEFEPVFSLFAFTNKITSVHSRIIWSCDWSPDSKYFFTGSRDKKVVVWGECDSTDDCIEHNIGPCSSVLDVGGAVTAVSVCPVLHPSQRYVVAVGLECGKICLYTWKKTDQVPEINDWTHCVETSQSQSHTLAIRKLCWKNCSGKTEQKEAEGAEWLHFASCGEDHTVKIHRVNKCAL

SEQ ID NO: 8897 - protein, 423 aa, Homo sapiens
MNRQPVKDRKAPWIPPNPTSPPASPKCAAWLKVKTSPRDATKEPLQQEDPQEESHLTGAVEHEAARLAWLDAETSKRLKELEELKAKEIDSMQKQRLDWLDAETSRRTKELNELKAEEMYRLQQLSVSATHLADKVEEAVLDRLKPLLVKAQRVNSTTEANIHLKDGSSVNTAKAQPAQEVAAVDFESNNIRQLDDFLEDCASELWAVTHAKILGSETLATVEDSKDSPDLEIMMRRMEEMEKYQESVRQRYNKIAYADPRLWMQEENNDQKISAISEKPLSPHPIRITKTVDRKDPAVNIMLERPCNGNSLDESVGTEEGSEKREAPLLSLAEDSQQKEGRAPLFVPPGMQHSIGDYCSRFEQYLRIISHEAVGSFNPWLIAESFSEELVDEALGAVAAELQDMCEDYAEAVFTSEFLEAAT

SEQ ID NO: 8898 - protein, 258 aa, Homo sapiens
MARLQEEHGDQLLSIRCQHQEQVEDLTASHDAALLEMENNHTVAITILQDDHDHKVQELMSTHELEKKELEENFEKLRLSLQDQVDTLTFQSQSLRDRARRFEEALRKNTEEQLEIALAPYQHLEEDMKSLKQVLEMKNQQIHEQEKKILELEKLAEKNIILEEKIQVLQQQNEDLKARIDQNTVVTRQLSEENANLQEYVEKETQEKKRLSRTNEELLWKLQTGDPTSPIKLSPTSPVYRGSSSGPSSPARVSTTPR

SEQ ID NO: 8899 - protein, 350 aa, Homo sapiens
MCPTTTWPRGRRWSRNLRDTQAVRHYKIWRRAGGRLHLNEAVSFLSLPELVNYHRAQSLSHGLRLAAPCRKHEPEPLPHWDDWERPREEFTLCRKLGSGYFGEVFEGLWKDRVQVAIKVISRDNLLHQQMLQSEIQAMKKLRHKHILALYAVVSVGDPVYIITELMAKGSLLELLRDSDEKVLPVSELLDIAWQVAEGMCYLESQNYIHRDLAARNILVGENTLCKVGDFGLARLIKEDVYLSHDHNIPYKWTAPEALSRGHYSTKSDVWSFGILLHEMFSRGQVPYPGMSNHEAFLRVDAGYRMPCPLECPPSVHKLMLTCWCRDPEQRPCFKALRERLSSFTSYENPT

SEQ ID NO: 8900 - protein, 1159 aa, Homo sapiens
MVSSSPSTPSNIPQKPSQPAAKEPSATPPISNLTKTASESISNLSEAGSIKKGERELKIGDRVLVGGTKAGVVRFLGETDFAKGEWCGVELDEPLGKNDGAVAGTRYFQCQPKYGLFAPVHKVTKIGFPSTTPAKAKANAVRRVMATTSASLKRSPSASSLSSMSSVASSVSSRPSRTGLLTETSSRYARKISGTTALQEALKEKQQHIEQLLAERDLERAEVAKATSHVGEIEQELALARDGHDQHVLELEAKMDQLRTMVEAADREKVELLNQLEEEKRKVEDLQFRVEEESITKGDLETQTKLEHARIKELEQSLLFEKTKADKLQRELEDTRVATVSEKSRIMELEKDLALRVQEVAELRRRLESNKPAGDVDMSLSLLQEISSLQEKLEVTRTDHQREITSLKEHFGAREETHQKEIKALYTATEKLSKENESLKSKLEHANKENSDVIALWKSKLETAIASHQQAMEELKVSFSKGLGTETAEFAELKTQIEKMRLDYQHEIENLQNQQDSERAAHAKEMEALRAKLMKVIKEKENSLEAIRSKLDKAEDQHLVEMEDTLNKLQEAEIKKEKFAEASEEAVSVQRSMQETVNKLHQKEEQFNMLSSDLEKLRENLADMEAKFREKDEREEQLIKAKEKLENDIAEIMKMSGDNSSQLTKMNDELRLKERDVEELQLKLTKANENASFLQKSIEDMTVKAEQSQQEAAKKHEEEKKELERKLSDLEKKMETSHNQCQELKARYERATSETKTKHEEILQNLQKTLLDTEDKLKGAREENSGLLQELEELRKQADKAKAAQTAEDAMQIMEQMTKEKTETLASLEDTKQTNAKLQNELDTLKENNLKNVEELNKSKELLTVENQKMEEFRKEIETLKQAAAQKSQQLSALQEENVKLAEELGRSRDEVTSHQKLEEERSVLNNQLLEMKKRESKFIKDADEEKASLQKSISITSALLTEKDAELEKLRNEVTVLRGENASAKSLHSVVQTLESDKVKLELKVKNLELQLKENKRQLSSSSGNTDTQADEDERAQESQNQIDFLNSVIVDLQRKNQDLKMKVEMMSEAALNGNGDDLNNYDSDDQEKQSKKKPRLFCDICDCFDLHDTEDCPTQAQMSEDPPHSTHHGSRGEERPYCEICEMFGHWATNCNDDETF

SEQ ID NO: 8901 - protein, 251 aa, Homo sapiens
MTTEQRRSLQAFQDYIRKTLDPTYILSYMAPWFREEEVQYIQAEKNNKGPMEAATLFLKFLLELQEEGWFRGFLDALDHAGYSGLYEAIESWDFKKIEKLEEYRLLLKRLQPEFKTRIIPTDIISDLSECLINQECEEILQICSTKGMMAGAEKLVECLLRSDKENWPKTLKLALEKERNKFSELWIVEKGIKDVETEDLEDKMETSDIQIFYQEDPECQNLSENSCPPSEVSDTNLYSPFKPIKKKKKKK

SEQ ID NO: 8902 - protein, 1062 aa, Homo sapiens; identical to SEQ ID NO: 7983

SEQ ID NO: 8903 - protein, 120 aa, Homo sapiens [sequence omitted]

SEQ ID NO: 8904 - protein, 311 aa, Homo sapiens
MYHLDNHPEKQFSTDVLKQAIELSPDNQYVKVLLGLKLQKMNKEAEGEQFVEEALEKSPCQTDVLRSAAKFYRRKGDLDKAIELFQRVLESTPNNGYLYHQIGCCYKAKVRQMQNTGESEASGNKEMIEALKQYAMDYSNKALEKGLNPLNAYSDLAEFLETECYQTPFNKEVPDAEKQQSHQRYCNLQKYNGKSEDTAVQHGLEGLSISKKSTDKEEIKDQPQNVSENLLPQNAPNYWYLQGLIHKQNGDLLQAAKCYEKELGRLLRDAPSGIGSIFLSASELEDGSEEMGQGAVSSSPRELLSNSEQLN

SEQ ID NO: 8905 - protein, 1088 aa, Homo sapiens
MYGSARSVGKVEPSSQSPGRSPRLPRSPRLGHRRTNSTGGSSGSSVGGGSGKTLSMENIQSLNAAYATSGPMYLSDHENVGSETPKSTMTLGRSGGRLPYGVRMTAMGSSPNIASSGVASDTIAFGEHHLPPVSMASTVPHSLRQARDNTIMDLQTQLKEVLRENDLLRKDVEVKESKLSSSMNSIKTFWSPELKKERALRKDEASKITIWKEQYRVVQEENQHMQMTIQALQDELRIQRDLNQLFQQDSSSRTGEPCVAELTEENFQRLHAEHERQAKELFLLRKTLEEMELRIETQKQTLNARDESIKKLLEMLQSKGLSAKATEEDHERTRRLAEAEMHVHHLESLLEQKEKENSMLREEMHRRFENAPDSAKTKALQTVIEMKDSKISSMERGLRDLEEEIQMLKSNGALSTEEREEEMKQMEVYRSHSKFMKNKIGQVKQELSRKDTELLALQTKLETLTNQFSDSKQHIEVLKESLTAKEQRAAILQTEVDALRLRLEEKETMLNKKTKQIQDMAEEKGTQAGEIHDLKDMLDVKERKVNVLQKKIENLQEQLRDKEKQMSSLKERVKSLQADTTNTDTALTTLEEALAEKERTIERLKEQRDRDEREKQEEIDNYKKDLKDLKEKVSLLQGDLSEKEASLLDLKEHASSLASSGLKKDSRLKTLEIALEQKKEECLKMESQLKKAHEAALEARASPEMSDRIQHLEREITRYKDESSKAQAEVDRLLEILKEVENEKNDKDKKIAELERQVKDQNKKVANLKHKEQVEKKKSAQMLEEARRREDNLNDSSQQLQDSLRKKDDRIEELEEALRESVQITAEREMVLAQEESARTNAEKQVEELLMAMEKVKQELESMKAKLSSTQQSLAEKETHLTNLRAERRKHLEEVLEMKQEALLAAISEKDANIALLELSSSKKKTQEEVAALKREKDRLVQQLKQQTQNRMKLMADNYEDDHFKSSHSNQTNHKPSPDQIIQPLLELDQNRSKLKLYIGHLTTLCHDRDPLILRGLTPPASYNLDDDQAAWENELQKMTRGQLQDELEKGERDNAELQEFANAILQQIADHCPDILEQVVNALEESS

SEQ ID NO: 8906 - protein, 494 aa, Homo sapiens
MKLVNLYKGAVLYLLRGRKTFLIPVLFNNYITAALKLLEKLYKVNLKVKHVEYDTFYIPEISNLVDIQEDYLMWFLHQAGMKARPSIIQDTVTLCSYPFIFDAQAKTKMLQTDAELQMQVAVNGANLQNVFMLLTLEPLLARSPFLVLHVRRNNLVGDALRELSIHSDIDLKKPLKVIFDGEEAVDAGGVTKEFFLLLLKELLNPIYGMFTYYQDSNLLWFSDTCFVEHNWFHLIGITCGLAIYNSTVVDLHFPLALYKKLLNVKPGLEDLKELSPTEGRSLQELLDYPGEDVEETFCLNFTICRESYGVIEQKKLIPGGDNVTVCKDNRQEFVDAYVNYVFQISVHEWYTAFSSGFLKVCGGKVLELFQPSELRAMMVGNSNYNWEELEETAIYKGDYSATHPTVKLFWETFHEFPLEKKKKFLLFLTGSDRIPIYGMASLQIVIQSTASGEEYLPVAHTCYNLLDLPKYSSKEILSARLTQALDNYEGFSLA

SEQ ID NO: 8907 - protein, 789 aa, Homo sapiens
MCPSSQSPRPPLLRPPCSYREVPSSVQSPAQQQVPARPGAPSVQVPSPFLLQNQYEPVQPHWFYCKEVEYKQLWMPFSVFDSLNLEEIYNSVQPDPESVVLGTDGGRYDVYLYDRIRKAAYWEEEPAEVRRCTWFYKGDTDSRFIPYTEEFSEKLEAEYKKAVTTNQWHRRLEFPSGETIVMHNPKVIVQFQPSSVPDEWGTTQDGQTRPRVVKRGIDDNLDEIPDGEMPQVDHLVFVVHGIGPVCDLRFRSIIECVDDFRVVSLKLLRTHFKKSLDDGKVSRVEFLPVHWHSSLGGDATGVDRNIKKITLPSIGRFRHFTNETLLDILFYNSPTYCQTIVEKVGMEINHLHALFMSRNPDFKGGVSVAGHSLGSLILFDILSNQKDLNLSKCPGPLAVANGVVKQLHFQEKQMPEEPKLTLDESYDLVVENKEVLTLQETLEALSLSEYFSTFEKEKIDMESLLMCTVDDLKEMGIPLGPRKKIANFVEHKAAKLKKAASEKKAVAATSTKGQEQSAQKTKDMASLPSESNEPKRKLPVGACVSSVCVNYESFEVGAGQVSVAYNSLDFEPEIFFALGSPIAMFLTIRGVDRIDENYSLPTCKGFFNIYHPLDPVAYRLEPMIVPDLDLKAVLIPHHKGRKRLHLELKESLSRMGSDLKQGFISSLKSAWQTLNEFARAHTSSTQLQEELEKVANQIKEEEEKQVVEAEKVVESPDFSKDEDYLGKVGMLNGGRRIDYVLQEKPIESFNEYLFALQSHLCYWESEDTALLLLKEIYRTMNISPEQPQH

SEQ ID NO: 8908 - protein, 275 aa, Homo sapiens; identical to SEQ ID NO: 4746

SEQ ID NO: 8909 - protein, 79 aa, Homo sapiens
MNGTLDHPDQPDLDAIKMFVGQVPRTWSEKDLRELFEQYGAVYEINVLRDRSQNPPQSKGCCFVTFYTRKAALEAQNAL

SEQ ID NO: 8910 - protein, 245 aa, Homo sapiens
MVLLHVKRGDESQFLLQAPGSTELEELTVQVARVYNGRLKVQRLCSEMEELAEHGIFLPPNMQGLTDDQIEELKLKDEWGEKCVPSGGAVFKKDDIGRRNGQAPNEKMKQVLKKTIEEAKAIISKKQVEAGVCVTMEMVKDALDQLRGAVMIVYPMGLPPYDPIRMEFENKEDLSGTQAGLNVIKEAEAQLWWAAKELRRTKKLSDYVGKNEKTKIIAKIQQVSTFCFNVSVVFVISLQTDKNVQ

SEQ ID NO: 8911 - protein, 131 aa, Homo sapiens; identical to SEQ ID NO: 8865

SEQ ID NO: 8912 - protein, 838 aa, Homo sapiens; identical to SEQ ID NO: 5559

SEQ ID NO: 8913 - protein, 404 aa, Homo sapiens
MDFNMKKLASDAGIFFTRAVQFTEEKFGQAEKTELDAHFENLLARADSTKNWTEKILRQTEVLLQPNPSARVEEFLYEKLDRKVPSRVTNGELLAQYMADAASELGPTTPYGKTLIKVAEAEKQLGAAERDFIHTASISFLTPLRNFLEGDWKTISKERRLLQNRRLDLDACKARLKKAKAAEAKATAEGPTVPDFQETRPRNYILSASASALWNDEVDKAEQELRVAQTEFDRQAEVTRLLLEGISSTHVNHLRCLHEFVKSQTTYYAQCYRHMLDLQKQLGSSQGAIFPGTFVGTTEPASPPLSSTSPTTAAATMPVVPSVASLAPPGEASLCLEEVAPPASGTRKARVLYDYEAADSSELALLADELITVYSLPGMDPDWLIGERGNKKGKVPVTYLELLS

SEQ ID NO: 8914 - protein, 164 aa, Homo sapiens
MTCCQTSFCGYPSFSISGTCGSSCCQPSCCETSCCQPRSCQTSFCGFPSFSTSGTCSSSCCQPSCCETSCCQPSCCQISSCGTGCGIGGGISYGQEGSSGAVSTRIRWCRPDSRVEGTYLPPCCVVSCTPPSCCQLHHAQASCCRPSYCGQSCCRPVCCCEPTC

SEQ ID NO: 8915 - protein, 281 aa, Homo sapiens
MLTKLQIKQMMEAATRQIEERKKQLSFISPPTPQPKTPSSSQPERLPIGNTIQPSQAATFMNDAIEKARKAAELQARIQAQLALKPGLIGNANMVGLANLHAMGIAPPKVELKDQTKPTPLILDEQGRTVDATGKEIELTHRMPTLKANIRAVKREQFKQQLKEKPSEDMESNTFFDPRVSIAPSQRQRRTFKFHDKGKFEKIAQRLRTKAQLEKLQAEISQAARKTGIHTSTRLALIAPKKELKEGDIPEIEWWDSYIIPNGFDLGKSQERRLFWNHKSC

SEQ ID NO: 8916 - protein, 230 aa, Homo sapiens
MRGHESSVFSISVHASGKYAITTSSDTAQLWDLDTFQRKRKLNIRQSVGIQKVFFLPLSNTILSCFKDNSIFAWECDTLFCKYQLPAPPESSSILYKVFAVTRDGRILAAGGKSNHLHLWCLEARQLFRIIQMPTKVRAIRHLEFLPDSFDAGSNQVLGVLSQDGIMRFINMQTCKLLFEIGSLDEGISSSAISPHGRYIASIMENGSLNIYSVQALTQEINKEEVRAQN

SEQ ID NO: 8917 - protein, 403 aa, Homo sapiens
MDSTMDDAVAGDFALINKLDIQCDLKTLSDDIKESLESEGKNSKKEEPQELLQSQDFVGEKLGSGEPSHSVKVHTVPKPGKGADLSKPPCRKAKEIRKERKRLKLMQQNPAGELEGFQAQGHPPSLFPPKAKSNQPKSLEDLIFESLPENASHKLEVRVVRSSPPSSQFKATLLESYQVYKRYQMVIHKNPPDTPTESQFTRFLCSSPLEAETPPNGPDCGYGSFHQQYWLDGKIIAVGVIDILPNCVSSVYLYYDPDYSFLSLGVYSALREIAFTRQLHEKTSQLSYYYMGFYIHSCPKMKYKGQYRPSDLLCPETYVWVPIEQCLPSLENSKYCRFNQDPEAVDEDRSTEPDRLQVFHKRAIMPYGVYKKQQKDPSEEAAVLQYASLVGQKCSERMLLFRN

SEQ ID NO: 8918 - protein, 302 aa, Homo sapiens
MPLYEGLGSGGEKTAVVIDLGEAFTKCGFAGETGPRCIIPSVIKRAGMPKPVRVVQYNINTEELYSYLKEFIHILYFRHLLVNPRDRRVVIIESVLCPSHFRETLTRVLFKYFEVPSVLLAPSHLMALLTLGINSAMVLDCGYRESLVLPIYEGIPVLNCWGALPLGGKALHKELETQLLEQCTVDTSVAKEQSLPSVMGSVPEGVLEDIKARTCFVSDLKRGLKIQAAKFNIDGNNERPSPPPNVDYPLDGEKILHILGSIRDSVVEILFEQDNEEQSVATLILDSLIQCCSCCPGWSAMA

SEQ ID NO: 8919 - protein, 125 aa, Homo sapiens
MSSCVSSQPSSNRAAPQDELGGRGSSSSESQKPCEALRGLSSLSIHLGMESFIVVTECEPGCAVDLGLARDRPLEADGQEVPLDTSGSQARPHLSGRKLSLQERSQGGLAAGGSLDMNGRCICPS

SEQ ID NO: 8920 - protein, 386 aa, Homo sapiens
MADSLESTPLPSPEDRLAKLHPSKELLEYYQKKMAECEAENEDLLKKLELYKEACEGQHKLECDLQQREEEIAELQKALSDMQVCLFQEREHVLRLYSENDRLRIRELEDKKKIQNLLALVGTDAGEVTYFCKEPPHKVTILQKTIQAVGECEQSESSAFKADPKISKRRPSRERKESSEHYQRDIQTLILQVEALQAQLGEQTKLSREQIEGLIEDRRIHLEEIQVQHQRNQNKIKELTKNLHHTQELLYESTKDFLQLRSENQNKEKSWMLEKDNLMSKIKQYRVQCKKKEDKIGKVLPVMHESHHAQSEYIKSLKDKLVQEKKLSNMYQEQCISLEEELARIREEEGMRREIFKDRTNKMGKRLQIMTKRYEALERRRILEVE

SEQ ID NO: 8921 - protein, 332 aa, Homo sapiens; identical to SEQ ID NO: 8670

SEQ ID NO: 8922 - protein, 507 aa, Homo sapiens
MEEVERQVLPDPEVLEAVGDRQDGLREQLQAPVPPDSVPSLQNMGLLLDKLAKENQDIRLLQAQLQAQKEELQSLMHQPKGLEEENAQLRGALQQGEAFQRALESELQQLRARLQGLEADCVRGPDGVCLSGGRGPQGDKAIREQGPREQEPELSFLKQKEQLEAEAQALRQELERQRRLLGSVQQDLERSLQDASRGDPAHAGLAELGHRLAQKLQGLENWGQDPGVSANASKAWHQKSHFQNSREWSGKEKWWDGQRDRKAEHWKHKKEESGRERKKNWGGQEDREPAGRWKEGRPRVEESGSKKEGKRQGPKEPPRKSGSFHSSGEKQKQPRWREGTKDSHDPLPSWAELLRPKYRAPQGCSGVDECARQEGLTFFGTELAPVRQQELASLLRTYLARLPWAGQLTKELPLSPAFFGEDGIFRHDRLRFRDFVDALEDSLEEVAVQQTGDDDEVDDFEDFIFSHFFGDKALKKRSGKKDKHSQSPRAAGPREGHSHSHHHHHRG

SEQ ID NO: 8923 - protein, 823 aa, Homo sapiens
MTLLSSQSSSLVAPSGSVSAENPEQRMLEKRAKVIEELLQTERDYIRDLEMCIERIMVPMQQAQVPNIDFEGLFGNMQMVIKVSKQLLAALEISDAVGPVFLGHRDELEGTYKIYCQNHDEAIALLEIYEKDEKIQKHLQDSLADLKSLYNEWGCTNYINLGSFLIKPVQRVMRYPLLLMELLNSTPESHPDKVPLTNAVLAVKEINVNINEYKRRKDLVLKYRKGDEDSLMEKISKLNIHSIIKKSNRVSSHLKHLTGFAPQIKDEVFEETEKNFRMQERLIKSFIRDLSLYLQHIRESACVKVVAAVSMWDVCMERGHRDLEQFERVHRYISDQLFTNFKERTERLVISPLNQLLSMFTGPHKLVQKRFDKLLDFYNCTERAEKLKDKKTLEELQSARNNYEALNAQLLDELPKFHQYAQGLFTNCVHGYAEAHCDFVHQALEQLKPLLSLLKVAGREGNLIAIFHEEHSRVLQQLQVFTFFPESLPATKKPFERKTIDRQSARKPLLGLPSYMLQSEELRASLLARYPPEKLFQAERNFNAAQDLDVSLLEGDLVGVIKKKDPMGSQNRWLIDNGVTKGFVYSSFLKPYNPRRSHSDASVGSHSSTESEHGSSSPRFPRQNSGSTLTFNPSSMAVSFTSGSCQKQPQDASPPPKECDQGTLSASLNPSNSESSPSRCPSDPDSTSQPRSGDSADVARDVKQPTATPRSYRNFRHPEIVGYSVPGRNGQSQDLVKGCARTAQAPEDRSTEPDGSEAEGNQVYFAVYTFKARNPNELSVSANQKLKILEFKDVTGNTEWWLAEVNGKKGYVPSNYIRKTEYT

SEQ ID NO: 8924 - protein, 163 aa, Homo sapiens
  MOD_RES (1)..(1): Any amino acid
XDKFRASPDCITILCKPNGQAIAWYTPIHWKQAWEKLDADVEFNRCSVVSPTFRKRVFQWTASTATITKEKQDQPKKDISNYQVEQAQVLLKREKEIPPTVFPNRSPWCQNPYVSAHPYCPLIEPHNTSTAGGRLDRQPRTRSTRPNRASGSKKKKTSESQKQ

SEQ ID NO: 8925 - protein, 256 aa, Homo sapiens; identical to SEQ ID NO: 5641

SEQ ID NO: 8926 - protein, 930 aa, Homo sapiens
MSEFRIHHDVNELLSLLRVHGGDGAEVYIDLLQKNRTPYVTTTVSAHSAKVKIAEFSRTPEDFLKKYDELKSKNTRNLDPLVYLLSKLTEDKETLQYLQQNAKERAELAAAAVGSSTTSINVPAAASKISMQELEELRKQLGSVATGSTLQQSLELKRKMLRDKQNKKNSGQHLPIFPAWVYERPALIGDFLIGAGISTDTALPIVLLRWNLALSPRLKCSGVISAHCNLHLPGTLPLASQESAVVEDLLYVLVGVDGRYVSAQPLAGRQSRTFLVDPNLDLSIRELVHRILPVAASYSAVTRFIEEKSSFEYGQVNHALAAAMRTLVKEHLILVSQLEQLHRQGLLSLQKLWFYIQPAMRTMDILASLATSVDKGECLGGSTLSLLHDRSFSYTGDSQAQELCLYLTKAASAPYFEVLEKWIYRGIIHDPYSEFMVEEHELRKERIQEDYNDKYWDQRYTIVQQQIPSFLQKMADKILSTGKYLNVVRECGHDVTCPVAKEIIYTLKERAYVEQIEKAFNYASKVLLDFLMEEKELVAHLRSIKRYFLMDQGDFFVHFMDLAEEELRKPVEDITPPRLEALLELALRMSTANTDPFKDDLKIDLMPHDLITQLLRVLAIETKQEKAMAHADPTELALSGLEAFSFDYIVKWPLSLIINRKALTRYQMLFRHMFYCKHVERQLCSVWISNKTAKQHSLHSAQWFAGAFTLRQRMLNFVQNIQYYMMFEVMEPTWHILEKNLKSASNIDDVLGHHTGFLDTCLKDCMLTNPELLKVFSKLMSVCVMFTNCMQKFTQSMKLDGELGGQTLEHSTVLGLPAGAEERARKELARKHLAEHADTVQLVSGFEATINKFDKNFSAHLLDLLARLSIYSTSDCEHGMASVISRLDFNGFYTERLERLSAERSQKATPQVPVLRGPPAPAPRVAVTAQ

SEQ ID NO: 8927 - protein, 42 aa, Homo sapiens
MCLLPIRVKEAEEVCRQKKGKSLYKIKPRHDSGIKAKISMKT

SEQ ID NO: 8928 - protein, 151 aa, Homo sapiens
MDCREMDLYEDYQSPFDFDAGVNKSYLYLSPSGNSSPPGSPTLQKFGLLRTDPVPEEGEDVAATISATETLSEEEQEELRRELAKVEEEIQTLSQVLAAKEKHLAEIKRKLGINSLQELKQNIAKGWQDVTATSARSKLLAAETELLCLLY

SEQ ID NO: 8929 - protein, 208 aa, Homo sapiens; identical to SEQ ID NO: 5090

SEQ ID NO: 8930 - protein, 524 aa, Homo sapiens
MKRSSVSSGGAGRLSMQELRSQDVNKQGLYTPQTKEKPTFGKLSINKPTSERKVSLFGKRTSGHGSRNSQLGIFSSSEKIKDPRPLNDKAFIQQCIRQLCEFLTENGYAHNVSMKSLQAPSVKDFLKIFTFLYGFLCPSYELPDTKFEEEVPRIFKDLGYPFALSKSSMYTVGAPHTWPHIVAALVWLIDCIKIHTAMKESSPLFDDGQPWGEETEDGIMHNKLFLDYTIKCYESFMSGADSFDEMNAELQSKLKDLFNVDAFKLESLEAKNRALNEQIARLEQEREKEPNRLESLRKLKASLQGDVQKYQAYMSNLESHSAILDQKLNGLNEEIARVELECETIKQENTRLQNIIDNQKYSVADIERINHERNELQQTINKLTKDLEAEQQKLWNEELKYARGKEAIETQLAEYHKLARKLKLIPKGAENSKGYDFEIKFNPEAGANCLVKYRAQVYVPLKELLNETEEEINKALNKKMGLEDTLEQLNAMITESKRSVRTLKEEVQKLDDLYQQKIKKERKK

SEQ ID NO: 8931 - protein, 415 aa, Homo sapiens; identical to SEQ ID NO: 5668

SEQ ID NO: 8932 - protein, 503 aa, Homo sapiens
MASNHKSSAARPVSRGGVGLTGRPPSGIRPLSGNIRVATAMPPGTARPGSRGCPIGTGGVLSSQIKVAHRPVTQQGLTGMKTGTKGPQRQILDKSYYLGLLRSKISELTTEVNKLQKGIEMYNQENSVYLSYEKRAETLAVEIKELQGQLADYNMLVDKLNTNTEMEEVMNDYNMLKAQNDRETQSLDVIFTERQAKEKQIRSVEEEIEQEKQATDDIIKNMSFENQVKYLEMKTTNEKLLQELDTLQQQLDSQNMKKESLEAEIAHSQVKQEAVLLHEKLYELESHRDQMIAEDKSIGSPMEEREKLLKQIKDDNQEIASMERQLTDTKEKINQFIEEIRQLDMDLEEHQGEMNQKYKELKKREEHMDTFIETFEETKNQELKRKAQIEANIVALLEHCSRNINRIEQISSITNQELKMMQDDLNFKSTEVQKSQSTAQNLTSDIQRLQLDLQKMELLESKMTEEQHSLKSKIKQMTTDLEIYNDLPALKSSGEKKKKKKKK

SEQ ID NO: 8933 - protein, 486 aa, Homo sapiens; identical to SEQ ID NO: 5136

SEQ ID NO: 8934 - protein, 336 aa, Homo sapiens
MCTMHKDEKAKREVSSWTVEGDINTDPWAGYRYTGKLRPHYPLMPTRPVPSYIQRPDYADHPLGMSESEQALKGTSQIKLLSSEDIEGMRLVCRLAREVLDVAAGMIKPGVTTEEIDHAVHLACIARNCYPSPLNYYNFPKSCCTSVNEVICHGIPDRRPLQEGDIVNVDITLYRNGYHGDLNETFFVGEVDDGARKLVQTTYECLMQAIDAVKPGVRYRELGNIIQKHAQANGFSVVRSYCGHGIHKLFHTAPNVPHYAKNKAVGVMKSGHVFTIEPMICEGGWQDETWPDGWTAVTRDGKRSAQFEHTLLVTDTGCEILTRRLDSARPHFMSQF

SEQ ID NO: 8935 - protein, 1033 aa, Homo sapiens
MAGMIDRFSPANTGIRSWDVDPGVCNLDEQLKVFVSRHSATFSSIVKGQRSLHHRGDNLETLVLLNPSDKSLYDELRNLLLDPASHKLLVLAGPCLEETGELLLQTGGFSPHHFLQVLKDREIRDILATTPPPVQPPILTITCPTFGDWAQLAPAVPGLQGALRLQLRLNPPAQLPNSEGLCEFLEYVAESLEPPSPFELLEPPTSGGFLRLGRPCCYIFPGGLGDAAFFAVNGFTVLVNGGSNPKSSFWKLVRHLDRVDAVLVTHPGADSLPGLNSLLRRKLAERSEVAAGGGSWDDRLRRLISPNLGVVFFNACEAASRLARGEDEAELALSLLAQLGITPLPLSRGPVPAKPTVLFEKMGVGRLDMYVLHPPSAGAERTLASVCALLVWHPAGPGEKVVRVLFPGCTPPACLLDGLVRLQHLRFLREPVVTPQDLEGPGRAESKESVGSRDSSKREGLLATHPRPGQERPGVARKEPARAEAPRKTEKEAKTPRELKKDPKPSVSRTQPREVRRAASSVPNLKKTNAQAAPKPRKAPSTSHSGFPPVANGPRSPPSLRCGEASPPSAACGSPASQLVATPSLELGPIPAGEEKALELPLAASSIPRPRTPSPESHRSPAEGSERLSLSPLRGGEAGPDASPTVTTPTVTTPSLPAEVGSPHSTEVDESLSVSFEQVLPPSAPTSEAGLSLPLRGPRARRSASPHDVDLCLVSPCEFEHRKAVPMAPAPASPGSSNDSSARSQERAGGLGAEETPPTSVSESLPTLSDSDPVPLAPGAADSDEDTEGFGVPRHDPLPDPLKVPPPLPDPSSICMVDPEMLPPKTARQTENVSRTRKPLARPNSRAAAPKATPVAAAKTKGLAGGDRASRPLSARSEPSEKGGRAPLSRKSSTPKTATRGPSGSASSRPGVSATPPKSPVYLDLAYLPSGSSAHLVDEEFFQRVRALCYVISGQDQRKEEGMRAVLDALLASKQHWDRDLQVTLIPTFDSVAMHTWYAETHARHQALGITVLGSNSMVSMQDDAFPACKVEF

SEQ ID NO: 8936 - protein, 740 aa, Homo sapiens
MRDLEGYRETRYQLLQLRPAQRASWIGYAIAYHLLEDYEMAAKILEEFRKTQQTSPDKVDYEYSELLLYQNQVLREAGLYREALEHLCTYEKQICDKLAVEETKGELLLQLCRLEDAADVYRGLQERNPENWAYYKGLEKALKPANMLERLKIYEEAWTKYPRGLVPRRLPLNFLSGEKFKECLDKFLRMNFSKGCPPVFNTLRSLYKDKEKVAIIEELVVGYETSLKSCRLFNPNDDGKEEPPTTLLWVQYYLAQHYDKIGQPSIALEYINTAIESTPTLIELFLVKAKIYKHAGNIKEAARWMDEAQALDTADRFINSKCAKYMLKANLIKEAEEMCSKFTREGTSAVENLNEMQCMWFQTECAQAYKAMNKFGEALKKCHEIERHFIEITDDQFDFHTYCMRKITLRSYVDLLKLEDVLRQHPFYFKAARIAIEIYLKLHDNPLTDENKEHEADTANMSDKELKKLRNKQRRAQKKAQIEEEKKNAEKEKQQRNQKKKKDDDDEEIGGPKEELIPEKLAKVETPLEEAIKFLTPLKNLVKNKIETHLFAFEIYFRKEKFLLMLQSVKRAFAIDSSHPWLHECMIRLFNTAVCESKDLSDTVRTVLKQEMNRLFGATNPKNFNETFLKRNSDSLPHRLSAAKMVYYLDPSSQKRAIELATTLDESLTNRNLQTCMEVLEALYDGSLGDCKEAAEIYRANCHKLFPYALAFMPPGYEEDMKITVNGDSSAEAEELANEI

SEQ ID NO: 8937 - protein, 60 aa, Homo sapiens
MSCTIEKALADAKALVERLRDHDDAAESLIEQTTALNKRVEAMKQYQEEIQELNEVARHR

SEQ ID NO: 8938 - protein, 472 aa, Homo sapiens
MGKEQELLEAARTGHLPAVEKLLSGKRLSSGFGGGGGGGSGGGGGGSGGGGGGLGSSSHPLSSLLSMWRGPNVNCVDSTGYTPLHHAALNGHKDVVEVLLRNDALTNVADSKGCYPLHLAAWKGDAQIVRLLIHQGPSHTRVNEQNNDNETALHCAAQYGHTEVVKVLLEELTDPTMRNNKFETPLDLAALYGRLEVVKMLLNAHPNLLSCNTKKHTPLHLAARNGHKAVVQVLLDAGMDSNYQTEMGSALHEAALFGKTDVVQILLAAGTDVNIKDNHGLTALDTVRELPSQKSQQIAALIEDHMTGKRSTKEVDKTPPPQPPLISSMDSISQKSQGDVEKAVTELIIDFDANAEEEGPYEALYNAISCHSLDSMASGRSSDQDSTNKEAEAAGVKPAGVRPRERPPPPAKPPPDEEEEDHIDKKYFPLTASEVLSMRPRIHGSAAREEDEHPYELLLTAETKKKKKKKKK

SEQ ID NO: 8939 - protein, 463 aa, Homo sapiens
MSGGTPYIGSKISLISKAEIRYEGILYTIDTENSTVALAKVRSFGTEDRPTDRPIPPRDEVFEYIIFRGSDIKDLTVCEPPKPQCSLPQDPAIVQSSLGSSTSSFQSMGSYGPFGRMPTYSQFSPSSLVGQQFGAVGVAGSSLTSFGTETSNSGTLPQSSAVGSAFTQDTRSLKTQLSQGRSSPQLDPLRKSPTMEQAVQTASAHLPAPAAVGRRSPVSTRPLPSASQKAGENQEHRRAEVHKVSRPENEQLRNDNKRQVAPGAPSAPRRGRGGHRGGRGRFGIRRDGPMKFEKDFDFESANAQFNKEEIDREFHNKLKLKEDKLEKQEKPVNGEDKGDSGVDTQNSEGNADEEDPLGPNCYYDKTKSFFDNISCDDNRERRPTWAEERRLNAETFGIPLRPNRGRGGYRGRGGLGFRGGRGRGGGRGGTFTAPRGFRGGFRGGRGGREFADFEYRKDNKVAA

SEQ ID NO: 8940 - protein, 428 aa, Homo sapiens [sequence omitted]

SEQ ID NO: 8941 - protein, 218 aa, Homo sapiens
MDAEHPELRSYAQSQGWWTGEGEFNFSEVFSPVEDHLDCGAGKDSLEKQEESITVQTMMNTLRDKASGVCIDSEFFLTTASGVSVLPQNRSSPCIHYFTGTPDPSRSIFKPFIFVDDVKLVPKTQSPCFGDDDPAKKEPRFQEKPDRRHELYKAHEWARAIIESDQEQGRKLRSTMLELEKQGLEAMEEILTSSEPLDPAEVGDLFYDCVDTEIKFFK

SEQ ID NO: 8942 - protein, 190 aa, Homo sapiens
MALLAEHLLKPLPADKQIETGPFLEAVSHLPPFFDCLGSPVFTPIKADISGNITKIKAVYDTNPAKFRTLQNILEVEKEIGLRFIQVFLQSICDGERDENHPNLIRVNATKAYEMALKKYHGWIVQKIFQAALYAAPYKSDFLKALSKGQNVTEEECLEKIRLFLVNYTATIDVIYEMYTQMNAELNYKV

SEQ ID NO: 8943 - protein, 253 aa, Homo sapiens
MSICSSLARKFPKLTIIGEEDLPSEEVDQELIEDSQWEEILKQPCPSQYSAIKEEDLVVWVDPLDGTKEYTEGLLDNVTVLIGIAYEGKAIAGVINQPYYNYEAGPDAVLGRTIWGVLGLGAFGFQLKEVPAGKHIITTTRSHSNKLVTDCVAAMNPDAVLRVGGAGNKIIQLIEGKASAYVFASPGCKKWDTCAPEVILHAVGGKLTDIHGNVLQYHKDVKHMNSAGVLATLRNYDYYASRVPESIKNALVP

SEQ ID NO: 8944 - protein, 529 aa, Homo sapiens
MGAYLSQPNTVKCSGDGVGVSMEDAHNCIPELDSETAMFSVYDGHGGEEVALYCAKYLPDIIKDQKAYKEGKLQKALEDAFLAIDAKLTTEEVIKELAQIAGRPTEDEDEKEKVADEDDVDNEEAALLHEEATMTIEELLTRYGQNCHKGPPHSKSGGGTGEEPGSQGLNGEAGPEDSTRETPSQENGPTAKAYTGFSSNSERGTEAGQVGEPGIPTGEAGPSCSSASDKLPRVAKSKFFEDSEDESDEAEEEEEDSEECSEEEDGYSSEEAENEEDEDDTEEAEEDDEEEEEEMMVPGMEGKEEPGSDSGTTAVVALIRGKQLIVANAGDSRCVVSEAGKALDMSYDHKPEDEVELARIKNAGGKVTMDGRVNGGLNLSRAIGDHFYKRNKNLPPEEQMISALPDIKVLTLTDDHEFMVIACDGIWNVMSSQEVVDFIQSKISQRDENGELRLLSSIVEELLDQCLAPDTSGDGTGCDNMTCIIICFKPRNTAELQPESGKRKLEEVLSTEGAEENGNSDKKKKAKRD

SEQ ID NO: 8945 - protein, 430 aa, Homo sapiens
MTFELYDEWIQASNVQEQDKKLQALWNACEKLPKANHNNIRYLIKFLSKLSEYQDVNKMTPSNMAIVLGPNLLWPQAEGNITEMMTTVSLQIVGIIEPIIQHADWFFPGEIEFNITGNYGSPVHVNHNANYSSMPSPDMDPADRRQPEQARRPLSVATDNMMLEFYKKDGMGVRVMDTNWVARRGSSAGRKVSCAPPSMQPPAPPAELAAPLPSPLPEQPLDSPAAPALSPSGLGLQPGPERTSTTKSKELSPGSAQKGSPGSSQGTACAGTQPGAQPGAQPGASPSPSQPPADQSPHTLRKVSKKLAPIPPKVPFGQPGAMADQSAGQPSPVSLSPTPPSTPSPYGLSYPQGYSLASGQLSPAAAPPLASPSVFTSTLSKSRPTPKPRQRPTLPPPQPPTVNLSASSPQSTEAPMLDGMSPGESMSTAV

SEQ ID NO: 8946 - protein, 281 aa, Homo sapiens
MPGPRRLRSPGGSGCSSRGSGPRLSTRRWRPCCYCGGSGVWLLRTPPSPSAWPARRCPRHRFEFCEPAFVVGNCLQIASDSHQYDRIYCGAGVQKDHENYMKILLKVGGILVMPIEDQLTQIMRTGQNTWESKNILAVSFAPLVQPSKNDNGKPDSVGLPPCAVRNLQDLARIYIRRTLRNFINDEMQAKGIPQRAPPKRKRKRVKQRINTYVFVGNQLIPQPLDSEEDEKMEEDNKEEEEKDHNEAMKPEEPPQNLLREKIMKLPLPESLKAYLTYFRDK

SEQ ID NO: 8947 - protein, 416 aa, Homo sapiens
MSPAMLSVLVKMMLAQAQESVFEKISLPGIRNEFFMLVKVAQEAAKVGEVYQQLHAAMSQAPVKENIPYSWASLACVKAHHYAALAHYFTAILLIDHQVKPGTDLDHQEKCLSQLYDHMPEGLTPLATLKNDQQRRQLGKSHLRRAMAHHEESVREASLCKKLRSIEVLQKVLCAAQERSRLTYAQHQEEDDLLNLIDAPSVVAKTEQEVDIILPQFSKLTVTDFFQKLGPLSVFSANKRWTPPRSIRFTAEEGDLGFTLRGNAPVQVHFLDPYCSASVAGAREGDYIVSIQLVDCKWLTLSEVMKLLKSFGEDEIEMKVVSLLDSTSSMHNKSATYSVGMQKTYSMICLAIDDDDKTDKTKKISKKLSFLSWGTNKNRQKSASTLCLPSVGAARPQVKKKLPSPFSLLNSDSSWY

SEQ ID NO: 8948 - protein, 2066 aa, Homo sapiens
MCSTPGMPAPGASLALRVSFVDVHPDVIPVQLWGLVGERRGEYLRLSREIQEAAATRGQWALGSASASPGELCLVQVGLLWHRCRVVSRQAQESRVFLLDEGRTITAGAGSLAPGRREFFNLPSEVLGCVLAGLVPAGCGAGSGEPPQHWPADAVDFLSNLQGKEVHGCVLDVLLLHRLVLLEVPDVFQQMRELGLARRVPDSLFRSLLERYLTAATASVGSGVPVLSRVPLKQKQPGLDYFYPQLQLGVTEAVVITQVCHPHRIHCQLRSVSQEIHRLSESMAQVYRGSTGTGDENSTSATWEEREESPDKPGSPCASCGLDGHWYRALLLETFRPQRCAQVLHVDYGRKELVSCSSLRYLLPEYFRMPVVTYPCALYGLWDGGRGWSRSQVGDLKTLILGKAVNAKIEFYCSFEHVYYVSLYGEDGINLNRVFGVQSCCLADRVLQSQATEEEEPETSQSQSPAEEVDEEISLPALRSIRLKMNAFYDAQVEFVKNPSEFWIRLRKHNVTFSKLMRRMCGFYSSASKLDGVVLKPEPDDLCCVKWKENGYYRAIVTKLDDKSVDVFLVDRGNSENVDWYDVRMLLPQFRQLPILAVKCTLADIWPLGKTWSQEAVSFFKKTVLHKELVIHILDKQDHQYVIEILDESRTGEENISKVIAQAGYAKYQEFETKENILVNAHSPGHVSNHFTTESNKIPFAKTGEGEQKAKRENKTTSVSKALSDTTVVTNGSTELVVQEKVKRASVYFPLMQNCLEIKPGSSSKGELEVGSTVEVRVSYVENPGYFWCQLTRNIQGLKTLMSDIQYYCKNTAAPHQRNTLACLAKRTVNRQWSRALISGIQSVEHVNVTFVDYGDREMVSVKNIYSISEEFLKVKAQAFRCSLYNLIQPVGQNPFVWDVKAIQAFNEFIDNAWQKNLELKCTIFALASINEELFNIVDLLTPFQSACHFLVEKRLARPVKLQKPLESSVQLHSYFYSTHDMKIGSEELVYITHIDDPWTFYCQLARNANILEQLSCSITQLSKVLLNLKTSPLNPGTLCLAKYTDGNWYRGIVIEKEPKKVFFVDFGNIYVVTSDDLLPIPSDAYDVLLLPMQAVRCSLSDIPDHIPEEVVVWFQETILDKSLKALVVAKDPDGTLIIELYGDNIQISASINKKLGLLSYKDRIRKKESEVLCSTTETLEEKNENMKLPCTEYLSKSVGYKLPNKEILEESYKPQINSSYKELKLLQSLTKTNLVTQYQDSVGNKNSQVFPLTTEKKEEISAETPLKTARVEATLSERKIGDSCDKDLPLKFCEFPQKTIMPGFKTTVYVSHINDLSDFYVQLIEDEAEISHLSERLNSVKTRPEYYVGPPLQRGDMICAVFPEDNLWYRAVIKEQQPNDLLSVQFIDYGNVSVVHTNKIGRLDLVNAILPGLCIHCSLQGFEVPDNKNSKKMMHYFSQRTSEAAIRCEFVKFQDRWEVILADEHGIIADDMISRYALSEKSQVELSTQVIKSASSKSVNKSDIDTSVFLNWYNPEKKMIRAYATVIDGPEYFWCQFADTEKLQCLEVEVQTAGEQVADRRNCIPCPYIGDPCIVRYREDGHYYRALITNICEDYLVSVRLVDFGNIEDCVDPKALWAIPSELLSVPMQAFPCCLSGFNISEGLCSQEGNDYFYEIITEDVLEITILEIRRDVCDIPLAIVDLKSKGKSINEKMEKYSKTGIKSALPYENIDSEIKQTLGSYNLDVGLKKLSNKAVQNKIYMEQQTDELAEITEKDVNIIGTKPSNFRDPKTDNICEGFENPCKDKIDTEELEGELECHLVDKAEFDDKYLITGFNTLLPHANETKEILELNSLEVPLSPDDESKEFLELESIELQNSLVVDEEKGELSPVPPNVPLSQECVTKGAMELFTLQLPLSCEAEKQPELELPTAQLPLDDKMDPLSLGVSQKAQESMCTEDMRKSSCVESFDDQRRMSLHLHGADCDPKTQNEMNICEEEFVEYKNRDAISALMPLFSEEESSDGSKHNNGLPDHISAQLQNTYTLKAFTVGSKCVVWSSLRNTWSKCEILETAEEGTRKRGLEVMEI

SEQ ID NO: 8949 - protein, 87 aa, Homo sapiens
MSSCVSSQPSSNRAAPQDELGGRGSSSSESQKPCEALRGLSSLSIHLGMESFIVVTECEPGCAVDLGLARDRPLEADGQEVPLDTSG

SEQ ID NO: 8950 - protein, 822 aa, Homo sapiens
MAAEGDPEWGPTPPSTSATTAARRAVNKVVYDDHESEEEEEEEDMVSEEEEEEDGDAEETQDSEDDEEDEMEEDDDDSDYPEEMEDDDDDASYCTESSFRSHSTYSSTPGRRKPRVHRPRSPILEEKDIPPLEFPKSSEDLMVPNEHIMNVIAIYEVLRNFGTVLRLSPFRFEDFCAALVSQEQCTLMAEMHVVLLKAVLREEDTSNTTFGPADLKDSVNSTLYFIDGMTWPEVLRVYCESDKEYHHVLPYQEAEDYPYGPVENKIKVLQFLVDQFLTTNIAREELMSEGVIQYDDHCRVCHKLGDLLCCETCSAVYHLECVKPPLEEVPEDEWQCEVCVAHKVPGVTDCVAEIQKNKPYIRHEPIGYDRSRRKYWFLNRRLIIEEDTENENEKKIWYYSTKVQLAELIDCLDKDYWEAELCKILEEMREEIHRHMDITEDLTNKARGSNKSFLAAANEEILESIRAKKGDIDNVKSPEETEKDKNETENDSKDAEKNREEFEDQSLEKDSDDKTPDDDPEQGKSEEPTEVGDKGNSVSANLGDNTTNATSEETSPSEGRSPVGCLSETPDSSNMAEKKVASELPQDVPEEPNKTCESSNTSATTTSIQPNLENSNSSSELNSSQSESAKAADDPENGERESHTPVSIQEEIVGDFKSEKSNGELSESPGAGKGASGSTRIITRLRNPDSKLSQLKSQQVAAAAHEANKLFKEGKEVLVVNSQGEISRLSTKKEVIMKGNINNYFKLGQEGKYRVYHNQYSTNSFALNKHQHREDHDKRRHLAHKFCLTPAGEFKWNGSVHGSKVLTISTLRLTITQYGENL

SEQ ID NO: 8951 - protein, 183 aa, Homo sapiens
MLQQTWTSRCLMKFYAVVATSPASWESHKIAERIEQRILNSNPVMEAFGNACTLRNNNSSRFGKFIQLQLNRAQQMTGAAVQTYLLEKTRVACQASSERNFHIFYQICKGASEDERLQWHLPEGAAFSWLPNPERSLEEDCFEVTREAMLHLGIDTPTQNNIFKVRRKATPLKFGRDDGQPFA

SEQ ID NO: 8952 - protein, 247 aa, Homo sapiens; identical to SEQ ID NO: 6456

SEQ ID NO: 8953 - protein, 326 aa, Homo sapiens
MLGGVGEENEKLWSFTKKASHIQLDSLPEVPLLVDVPCLSAQLDDSILNIVKDHIFKHGTVASRPPVQIEELIEKPGGIIVRWCKVDDDFTAQDYRLQFRKCTSNHFEDVYVGSETEFIVLHIDPNVDYQFRVCARGDGRQEWSPWSVPQIGHSTLVPHEWTAGFEGYSLSSRRNIALRNDSESSGVLYSRAPTYFCGQTLTFRVETVGQPDRRDSIGVCAEKQDGYDSLQRDQAVCISTNGAVFVNGKEMTNQLPAVTSGSTVTFDIEAVTLGTTSNNEGGHFKLRVTISSNNREVVFDWLLDQSCGSLYFGCSFFYPGWKVLVF

SEQ ID NO: 8954 - protein, 811 aa, Homo sapiens
MVSEEEEEEDGDAEETQDSEDDEEDEMEEDDDDSDYPEEMEDDDDDASYCTESSFRSHSTYSSTPGRRKPRVHRPRSPILEEKDIPPLEFPKSSEDLMVPNEHIMNVIAIYEVLRNFGTVLRLSPFRFEDFCAALVSQEQCTLMAEMHVVLLKAVLREEDTSNTTFGPADLKDSVNSTLYFIDGMTWPEVLRVYCESDKEYHHVLPYQEAEDYPYGPVENKIKVLQFLVDQFLTTNIAREELMSEGVIQYDDHCRVCHKLGDLLCCETCSAVYHLECVKPPLEEVPEDEWQCEVCVAHKVPGVTDCVAEIQKNKPYIRHEPIGYDRSRRKYWFLNRRLIIEEDTENENEKKIWYYSTKVQLAELIDCLDKDYWEAELCKILEEMREEIHRHMDITEDLTNKARGSNKSFLAAANEEILESIRAKKGDIDNVKSPEETEKDKNETENDSKDAEKNREEFEDQSLEKDSDDKTPDDDPEQGKSEEPTEVGDKGNSVSANLGDNTTNATSEETSPSEGRSPVGCLSETPDSSNMAEKKVASELPQDVPVGDFKSEKSNGELSESPGAGKGASGSTRIITRLRNPDSKLSQLKSQQVAAAAHEANKLFKEGKEVLVVNSQGEISRLSTKKEVIMKGNINNYFKLGQEGKYRVYHNQYSTNSFALNKHQHREDHDKRRHLAHKFCLTPAGEFKWNGSVHGSKVLTISTLRLTITQLENNIPSSFLHPNWASHRANWIKAVQMCSKPREFALALAILECAVKPVVMLPIWRESLGHTRLHRMTSIEREEKEKVKKREETGRRRNDAASDMGKIHISS

SEQ ID NO: 8955 - protein, 583 aa, Homo sapiens
MAPELTPEEEQATKQFLEEINKWTVQYNVSPLSWNVAVKFLMARKFDVLRAIELFHSYRETRRKEGIVKLKPHEEPLRSEILSGKFTILNVRDPTGASIALFTARLHHPHKSVQHVVLQALFYLLDRAVDSFETQRNGLVFIYDMCGSNYANFELDLGKKVLNLLKGAFPARLKKVLIVGAPIWFRVPYSIISLLLKDKVRERIQILKTSEVTQHLPRECLPENLGGYVKIDLATWNFQFLPQVNGHPDPFDEIILFSLPPALDWDSVHVPGPHAMTIQELVDYVNARQKQGIYEEYEDIRRENPVGTFHCSMSPGNLEKNRYGDVPCLDQTRVKLTKRSGHTQTDYINASFMDGYKQKNAYIGTQGPLENTYRDFWLMVWEQKVLVIVMTTRFEEGGRRKCGQYWPLEKDSRIRFGFLTVTNLGVENMNHYKKTTLEIHNTEERQKRQVTHFQFLSWPDYGVPSSAASLIDFLRVVRNQQSLAVSNMGARSKGQCPEPPIVVHCSAGIGRTGTFCSLDICLAQLEELGTLNVFQTVSRMRTQRAFSIQTPEQYYFCYKAILEFAEKEGMVSSGQNLLAVESQ

SEQ ID NO: 8956 - protein, 131 aa, Homo sapiens; identical to SEQ ID NO: 8865

SEQ ID NO: 8957 - protein, 144 aa, Homo sapiens
MASVAAARAVPVGSGLRGLQRTLPLVVILGATGTGKSTLALQLGQRLGGEIVSADSMQVYEGLDIITNKVSAQEQRICRHHMISFVDPLVTNYTVVDFRNRATALIEDIFARDKIPIVVGGTNYYIESLLWKVLVNTKVSLVHS

SEQ ID NO: 8958 - protein, 461 aa, Homo sapiens
MAASSLEQKLSRLEAKLKQENREARRRIDLNLDISPQRPRPTLQLPLANDGGSRSPSSESSPQHPTPPARPRHMLGLPSTLFTPRSMESIEIDQKLQEIMKQTGYLTIGGQVPPSLWRGEGGGPARLDPSWERQWGAGGGGRPGTLQPSLSSQRYQAEINDLENLGEMGSGTCGQVWKMRFRKTGHVIAVKQMRRSGNKEENKRILMDLDVVLKSHDCPYIVQCFGTFITNTDVFIAMELMGTCAEKLKKRMQGPIPERILGKMTVAIVKALYYLKEKHGVIHRDVKPSNILLDERGQIKLCDFGISGRLVDSKAKTRSAGCAAYMAPERIDPPDPTKPDYDIRADVWSLGISLVELATGQFPYKNCKTDFEVLTKVLQEEPPLLPGHMGFSGDFQSFVKDCLTKDHRKRPKYNKLLEHSFIKRYETLEVDVASWFKDVMAKTESPRTSGVLSQPHLPFFR

SEQ ID NO: 8959 - protein, 536 aa, Homo sapiens
METSDIQIFYQEDPECQNLSENSCPPSEVSDTNLYSPFKPRNYQLELALPAMKGKNTIICAPTGCGKTFVSLLICEHHLKKFPQGQKGKVVFFANQIPVYEQQKSVFSKYFERHGYRVTGISGATAENVPVEQIVENNDIIILTPQILVNNLKKGTIPSLSIFTLMIFDECHNTSKQHPYNMIMFNYLDQKLGGSSGPLPQVIGLTASVGVGDAKNTDEALDYICKLCASLDASVIATVKHNLEELEQVVYKPQKFFRKVESRISDKFKYIIAQLMRDTESLAKRICKDLENLSQIQNREFGTQKYEQWIVTVQKACMVFQMPDKDEESRICKALFLYTSHLRKYNDALIISEHARMKDALDYLKDFFSNVRAAGFDEIEQDLTQRFEEKLQELESVSRDPSNENPKLEDLCFILQEEYHLNPETITILFVKTRALVDALKNWIEGNPKLSFLKPGILTGRGKTNQNTGMTLPAQKCILDAFKASGDHNILIATSVADEGIDIAQCNLVILYEYVGNVIKMIQTREEEQEVASASF

SEQ ID NO: 8960 - protein, 960 aa, Homo sapiens; identical to SEQ ID NO: 4904

SEQ ID NO: 8961 - protein, 221 aa, Homo sapiens
MLAAGLLEELRDFHRRYNQKNVSENSQDYQHGIFQSIGFKEFHEYLITEGKCTLETSNQLLKKGIEALKQVTKRYARKQNRWVKNRFLSRPGPIVPPVYGLEVSDVSKWEESVLEPALEIVQSFIQGHKPTATPIKMPYNEAENKRSYHLCDLCDRIIIGDREWAAHIKSKSHLNQLKKRRRLDSDAVNTIESQSVSPDHNKEPKEKGSPGQNDQELKCSV

SEQ ID NO: 8962 - protein, 882 aa, Homo sapiens
MPRVKPKLEKQLQKDKEKVEEFKSIPAKSNNIINETTTRNNALEKEKEKEEKKLKEVMDSLKQETQGLQKEKESREKELMGFSKSVNEARSKMDVAQSELDIYLSRHNTAVSQLTKAKEALIAASETLKERKAAIRDIEGKLPQTEQELKEKEKELQKLTQEETNFKSLVHDLFQKVEEAKSSLAMNRSRGKVLDAIIQEKKSGRIPGIYGRLGDLGAIDEKYDVAISSCCHALDYIVVDSIDIAQECVNFLKRQNIGVATFIGLDKMAVWAKKMTEIQTPENTPRLFDLVKVKDEKIRQAFYFALRDTLVADNLDQATRVAYQKDRRWRVVTLQGQIIEQSGTMTGGGSKVMKGRMGSSLVIEISEEEVNKMESQLQNDSKKAMQIQEQKVQLEERVVKLRHSEREMRNTLEKFTASIQRLIEQEEYLNVQVKELEANVLATAPDKKKQKLLEENVSAFKTEYDAVAEKAGKVEAEVKRLHNTIVEINNHKLKAQQDKLDKINKQLDECASAITKAQVAIKTADRNLQKAQDSVLRTEKEIKDTEKEVDDLTAELKSLEDKAAEVVKNTNAAEESLPEIQKEHRNLLQELKVIQENEHALQKDALSIKLKLEQIDGHIAEHNSKIKYWHKEISKISLHPIEDNPIEEISVLSPEDLEAIKNPDSITNQIALLEARCHEMKPNLGAIAEYKKKEELYLQRVAELDKITYERDSFRQAYEDLRKQRLNEFMAGFYIITNKLKENYQMLTLGGDAELELVDSLDPFSEGIMFSVRPPKKSWKKIFNLSGGEKTLSSLALVFALHHYKPTPLYFMDEIDAALDFKNVSIVAFYIYEQTKNAQFIIISLRNNMFEISDRLIGIYKTYNITKSVAVNPKEIASKGLC

SEQ ID NO: 8963 - protein, 345 aa, Homo sapiens
MFLTRPKVCVDLNRRVTLYGVFTIHFSPNVPSRCLLLELLDVSVSELLLYSSHQGCSMWMIQHCARDVLEALAFLHHEGYVHADLKPRNILWSAENECFKLIDFGLSFKEGNQDVKYIQTDGYRAPEAELQNCLAQAGLQSDTECTSAVDLWSLGIILLEMFSGMKLKHTVRSQEWKANSSAIIDHIFASKAVVNAAIPAYHLRDLIKSMLHDDPSRRIPAEMALCSPFFSIPFAPHIEDLVMLPTPVLRLLNVLDDDYLENEEEYEDVVEDVKEECQKYGPVVSLLVPKENPGRGQVFVEYANAGDSKAAQKLLTGRMFDGKFVVATFYPLSAYKRGYLYQTLL

SEQ ID NO: 8964 - protein, 317 aa, Homo sapiens
MWLAREGIVAPLPGEWKPCQDITGDIYYFNFANGQSMWDHPCDEHYRSLVIQERAKLSTSGAIKKKKKKKEKKDKKDRDPPKSSLETQPEEGLLPPSSFLCSLSPPSAPGLADLDLDQEMQAISEGSYNKGKSPGMLGDTPWRFMGALPRKLQPLSKGQPSQIHQVFADMEKILGRAPAQCRRELGDQQGLEKLQKATEKIYLGFSDPETEELEMRSRQQKLGTPAPQNTGLLQNMQDVVESRNQASVHSKLSEAIKGLPLKGEQHSHSLAKLSPTGPGGDKGQSPIPMWICCRLRASNCRNTSAAWRLKLKRSSTC

SEQ ID NO: 8965 - protein, 53 aa, Homo sapiens
MGNSDSQYTLQGSKNHSNTITGAKQIPCSLKIRGIHAKEEKSLHGWGHGSNGA

SEQ ID NO: 8966 - protein, 400 aa, Homo sapiens
AWLQSAGELPSDGGCSRLRWQAHLEFTHNHDVGDLTWDKIAVSLPRSEKLRSLVLAGIPHGMRPQLWMRLSGALQKKRNSELSYREIVKNSSNDETIAAKQIEKDLLRTMPSNACFASMGSIGVPRLRRVLRALAWLYPEIGYCQGTGMVAACLLLFLEEEDAFWMMSAIIEDLLPASYFSTTLLGVQTDQRVLRHLIVQYLPRLDKLLQEHDIELSLITLHWFLTAFASVVDIKLLLRIWDLFFYEGSRVLFQLTLGMLHLKEEELIQSENSASIFNTLSDIPSQMEDAELLLGVAMRLAGSLTDVAVETQRRKHLAYLIADQGQLLGAGTLTNLSQVAQDGGPHLDPQHTGRRGHLEVQSAGAAENKPALPALPPSLAQSDHSCGVIQASSGFVHLRF

SEQ ID NO: 8967 - protein, 97 aa, Homo sapiens
MLRGTKEMDNMSPRLRAFLSEPIGEKDVCWVDGISHELAINLVTKGINKAYILLGQFLLMHKNEAEFQRWLICCFGATECEAQQTSHCLKEWCACFL

SEQ ID NO: 8968 - protein, 336 aa, Homo sapiens
MEYLGGGSALDLLKPGPLEETYIATILREILKGLDYLHSERKIHRDIKAANVLLSEQGDVKLADFGVAGQLTDTQIKRNTFVGTPFWMAPEVIKQSAYDFKADIWSLGITAIELAKGEPPNSDLHPMRVLFLIPKNSPPTLEGQHSKPFKEFVEACLNKDPRFRPTAKELLKHKFITRYTKKTSFLTELIDRYKRWKSEGHGEESSSEDSDIDGEAEDGEQGPIWTFPPTIRPSPHSKLHKGTALHSSQKPAEPVKRQPRSQCLSTLVRPVFGEVFSQLKEKHKQSGGSVGALEELENAFSLAEESCPGISDKLMVHLVERVQRFSHNRNHLTSTR

SEQ ID NO: 8969 - protein, 484 aa, Homo sapiens
MVHETSYSAQFKGEASKPTTADNKVIDRRRIRSLYSEPFKEPPKVEKPSVQSSKPKKTSASHKPTRKAKDKQAVSGQAAKKKSAEGPSTTKPDDKEQSKEMNNKLAEAKESLAQPVSDSSKTQGPVATEPDKDQGSVVPGLLKGQGPMVQEPLKKQGSVVPGPPKDLGPMIPLPVKDQDHTVPEPLKNESPVISAPVKDQGPSVPVPPKNQSPMVPAKVKDQGSVVPESLKDQGPRIPEPVKNQAPMVPAPVKDEGPMVSASVKDQGPMVSAPVKDQGPIVPAPVKGEGPIVPAPVKDEGPMVSAPIKDQDPMVPEHPKDESAMATAPIKNQGSMVSEPVKNQGLVVSGPVKDQDVVVPEHAKVHDSAVVAPVKNQGPVVPESVKNQDPILPVLVKDQGPTVLQPPKNQGRIVPEPLKNQVPIVPVPLKDQDPLVPVPAKDQGPAVPEPLKTQGPRDPQLPTVSPLPRVMIPTAPHTEYIESSP

SEQ ID NO: 8970 - protein, 700 aa, Homo sapiens
MALGEEKAEAEASEDTKAQSYGRGSCREQPPRLEAEGGLISPVWGAEGIPAPTCWIGTDPGGPSRAHQPQASDANREPVAERSEPALSGLPPATMGSGDLLLSGESQVEKTKLSSSEEFPQTLSLPRTTTICSGHDADTEDDPSLADLPQALDLSQQPHSSGLSCLSQWKSVLSPGSAAQPSSCSISASSTGSSLQGHQERAEPRGGSLAKVSSSLEPVVPQEPSSVVGLGPRPQWSPQPVFSGGDASGLGRRRLSFQAEYWACVLPDSLPPSPDRHSPLWNPNKEYEDLLDYTYPLRPGPQLPKHLDSRVPADPVLQDSGVDLDSFSVSPASTLKSPTNVSPNCPPAEATALPFSGPREPSLKQWPSRVPQKQGGMGLASWSQLASTPRAPGSRDARWERREPALRGAKDRLTIGKHLDMGSPQLRTRDRGWPSPRPEREKRTSQSARRPTCTESRWKSEEEVESDDEYLALPARLTQVSSLVSYLGSISTLVTLPTGDIKGQSPLEVSDSDGPASFPSSSSQSQLPPGAALQGSGDPEGQNPCFLRSFVRAHDSAGEGSLGSSQALGVSSGLLKTRPSLPARLDRWPFSDPDVEGQLPRKGGEQGKESLVQCVKTFCCQLEELICWLYNVADVTDHGTAARSNLTSLKSSLQLYRVICGPGSGLFPHKSVAKLLDYKVKSQITNVWYVIAQLTIIPEI

SEQ ID NO: 8971 - protein, 541 aa, Homo sapiens
MKSYVSETMASPGKDNYRMKSYKNNALNPEEMRRRREEEGIQLRKQKREQQLFKRRNVELINEEAAMFDSLLMDSYVSSTTGESVITREMVEMLFSDDSDLQLATTQKFRKLLSKEPSPPIDEVINTPRVVDRFVEFLKRNENCTLQFEAAWALTNIASGTSQQTKIVIEAGAVPIFIELLNSDFEDVQEQAVWALGNIAGDSSVCRDYVLNCSILNPLLTLLTKSTRLTMTRNAVWALSNLCRGKNPPPEFAKVSPCLPVLSRLLFSSDSDLLADACWALSYLSDGPNEKIQAVIDSGVCRRLVELLMHNDYKVASPALRAVGNIVTGDDIQTQVILNCSALPCLLHLLSSPKESIRKEACWTISNITAGNRAQIQAVIDANIFPVLIEILQKAEFRTRKEAAWAITNATSGGTPEQIRYLVSLGCIKPLCDLLTVMDSKIVQVALNGLENILRLGEQEGKRSGSGVNPYCGLIEEAYGLDKIEFLQSHENQEIYQKAFDLIEHYFGVEDDDSSLAPQVDETQQQFIFQQPEAPMEGFQL

SEQ ID NO: 8972 - protein, 571 aa, Homo sapiens
MLDCGMHMGFNDDRRFPDFSYITQNGRLTDFLDCVIISHFHLDHCGALPYFSEMVGYDGPIYMTHPTQAICPILLEDYRKIAVDKKGEANFFTSQMIKDCMKKVVAVHLHQTVQVDDELEIKAYYAGHVLGAAMFQIKVGSESVVYTGDYNMTPDRHLGAAWIDKCRPNLLITESTYATTIRDSKRCRERDFLKKVHETVERGGKVLIPVFALGRAQELCILLETFWERMNLKVPIYFSTGLTEKANHYYKLFIPWTNQKIRKTFVQRNMFEFKHIKAFDRAFADNPGPMVVFATPGMLHAGQSLQIFRKWAGNEKNMVIMPGYCVQGTVGHKILSGQRKLEMEGRQVLEVKMQVEYMSFSAHADAKGIMQLVGQAEPESVLLVHGEAKKMEFLKQKIEQELRVNCYMPANGETVTLPTSPSIPVGISLGLLKREMAQGLLPEAKKPRLLHGTLIMKDSNFRLVSSEQALKELGLAEHQLRFTCRVHLHDTRKEQETALRVYSHLKSVLKDHCVQHLPDGSVTVESVLLQAAAPSEDPGTKVLLVSWTYQDEELGSFLTSLLKKGLPQAPS

SEQ ID NO: 8973 - protein, 743 aa, Homo sapiens
MEAAAVTVTRSATRRRRRQLQGLAAPEAGTQEEQEDQEPRPRRRRPGRSIKDEEEETVFREVVSFSPDPLPVRYYDKDTTKPISFYLSSLEELLAWKPRLEDGFNVALEPLACRQPPLSSQRPRTLLCHDMMGGYLDDRFIQGSVVQTPYAFYHWQCIDVFVYFSHHTVTIPPVGWTNTAHRHGVCVLGTFITEWNEGGRLCEAFLAGDERSYQAVADRLVQITQFFRFDGWLINIENSLSLAAVGNMPPFLRYLTTQLHRQVPGGLVLWYDSVVQSGQLKWQDELNQHNRVFFDSCDGFFTNYNWREEHLERMLGQAGERRADVYVGVDVFARGNVVGGRFDTDKSLELIRKHGFSVALFAPGWVYECLEKKDFFQNQDKFWGRLERYLPTHSICSLPFVTSFCLGMGARRVCYGQEEAVGPWYHLSAQEIQPLFGEHRLGGDGRGWVRTHCCLEDAWHGGSSLLVRGVIPPEVGNVAVRLFSLQAPVPPKIYLSMVYKLEGPTDVTVALELTTGDAGSCHIGGISVLNAETSSRHSLRPLRVPPTKLARWVGRCGRQLSGGWVQHCYEVSLRGCLLLDLLVCFSRPPGSREEESFTCRLGEIQVVDAASLLAPLPQVQAVTISHIRWQPSASEREGPPALLQLSCTLHWSFLLSQVRCFRIHCWGGMSDDSPGRELPRPEMPMFLGLAFATQYRIVDLLVEAAGPGQDRRMEFLVEPVPKEGFRVPQAEWGRAVLLYSAPA

SEQ ID NO: 8974 - protein, 131 aa, Homo sapiens
MELRVHMVSHTGEMPYKVRLGLSPGPGLGGPRILPAEPFTWGAVRHLPHSSCQGACLPCLPCLSSAPLSRQGLSAASPPRSLLGPCFFPWRTGLASSGQLSPEALLCTILHTRSGVLPESSHRGLPLVPAL

SEQ ID NO: 8975 - protein, 302 aa, Homo sapiens
MEHGIVKDWNDMERIWQYVYSKDQLQTFSEEHPVLLTEAPLNPRKNRERAAEVFFETFNVPALFISMQAVLSLYATGRTTGVVLDSGDGVTHAVPIYEGFAMPHSIMRIDIAGRDVSRFLRLYLRKEGYDFHSSSEFEIVKAIKERACYLSINPQKDETLETEKAQYYLPDGSTIEIGPSRFRAPELLFRPDLIGEESEGIHEVLVFAIQKSDMDLRRTLFSNIVLSGGSTLFKGFGDRLLSEVKKLAPKDVKIRISAPQERLYSTWIGGSILASLDTFKKMWVSKKEYEEDGARSIHRKTF

SEQ ID NO: 8976 - protein, 259 aa, Homo sapiens
MLRCGQMMLAQALICRHLGRDWSWEKQKEQPKEYQRILQCFLDRKDCCYSIHQMAQMGVGEGKSIGEWFGPNTVAQVLKKLALFDEWNSLAVYVSMDNTVVIEDIKKMCRVLPLSADTAGDRPPDSLTASNQSDELIFLDPHTTQTFVDTEENGTVNDQTFHCLQSPQRMNILNLDPSVALGFFCKEEKDFDNWCSLVQKEILKENLRMFELVQKHPSHWPPFVPPAKPEVTTTGAEFIDSTEQLEEFDLEEDFEILSV

SEQ ID NO: 8977 - protein, 318 aa, Homo sapiens
MRAQSDELEKIEKHGRSSKDKENAKSLDKPEQFLYELSLIPNFSERVFCILFQSTFSESICSIRRKLELLQKLCETLKNGPGVMQVLGLVLAFGNYMNGGNKTRGQADGFGLDILPKLKDVKSSDNSRSLLSYIVSYYLRNFDEDAGKEQCLFPLPEPQDLFQASQMKFEDFQKDLRKLKKDLKACEVEAGKVYQVSSKEHMQPFKENMEQFIIQAKIDQEAEENSLTETHKCFLETTAYFFMKPKLGEKEVSPNAFFSIWHEFSSDFKDFWKKENKLLLQERVKEAEEVCRQKKGKSLYKIKPRHDSGIKAKISMKT

SEQ ID NO: 8978 - protein, 114 aa, Homo sapiens
MSSSMWYIMQSIQSKYSLSERLIRTIAAIRSFPHDNVEDLIRGGADVNCTHGTLKPLHCACMVSDADCVELLLEKGAEVNALDGYNRTALHYAAEKDEACVEVLLEYGANPNAL

SEQ ID NO: 8979 - protein, 454 aa, Homo sapiens; identical to SEQ ID NO: 5206

SEQ ID NO: 8980 - protein, 348 aa, Homo sapiens; identical to SEQ ID NO: 5338

SEQ ID NO: 8981 - protein, 720 aa, Homo sapiens
MYGSARSVGKVEPSSQSPGRSPRLPRSPRLGHRRTNSTGGSSGSSVGGGSGKTLSMENIQSLNAAYATSGPMYLSDHENVGSETPKSTMTLGRSGGRLPYGVRMTAMGSSPNIASSGVASDTIAFGEHHLPPVSMASTVPHSLRQARDNTIMDLQTQLKEVLRENDLLRKDVEVKESKLSSSMNSIKTFWSPELKKERALRKDEASKITIWKEQYRVVQEENQVDALRLRLEEKETMLNKKTKQIQDMAEEKGTQAGEIHDLKDMLDVKERKVNVLQKKIENLQEQLRDKEKQMSSLKERVKSLQADTTNTDTALTTLEEALAEKERTIERLKEQRDRDEREKQEEIDNYKKDLKDLKEKVSLLQGDLSEKEASLLDLKEHASSLASSGLKKDSRLKTLEIALEQKKEECLKMESQLKKAHEAALEARASPEMSDRIQHLEREITRYKDESSKAQAEVDRLLEILKEVENEKNDKDKKIAELESLTSRQVKDQNKKVANLKHKEQVEKKKSAQMLEEARRREDNLNDSSQQLQDSLRKKDDRIEELEEALRESVQITAEREMVLAQEESARTNAEKQVEELLMAMEKVKQELESMKAKLSSTQQSLAEKETHLTNLRAERRKHLEEVLEMKQEALLAAISEKDANIALLELSSSKKKTQEEVAALKREKDRLVQQLKQQTQNRMKLMADNYEDDHFKSSHSNQTNHKPSPDQDEEEGIWA

SEQ ID NO: 8982 - protein, 255 aa, Homo sapiens
MAASTMSVCSSACSDSWQVDACPESCCEPHCCALSCCAPAPCLTLVCTPVSRVSSPCCQAACEPSPCQSGCTSSCTPSCCQQSSCQPACCTSSPCQQACCVPVCCKPVCCLPTCSKDSSSCCQQSSCQPTCCASSSSQQSCCVPVCCKPVCYVPTCSEDSSSCCQQSSCHPACCTSSPCQQACCVPVRCKPVCCKPICCVPVCSGASTSCCQQSSCQPACCTTSCCRPSSSVSLLCRPVCRPACCSLCSGQESSC

SEQ ID NO: 8983 - protein, 853 aa, Homo sapiens; identical to SEQ ID NO: 4744

SEQ ID NO: 8984 - protein, 420 aa, Homo sapiens
MVHGRKANAQVMESEEFMLLPANQLIDIISSDELNVRSEEQVFNAVMAWVKYSIQERRPQLPQVLQHVRLPLLSPKFLVGTVGSDPLIKSDEECRDLVDEAKNYLLLPQERPLMQGPRTRPRKPIRCGEVLFAVGGWCSGDAISSVERYDPQTNEWRMVASMSKRRCGVGVSVLDDLLYAVGGHDGSSYLNSVERYDPKTNQWSSDVAPTSTCRTSVGVAVLGGFLYAVGGQDGVSCLNIVERYDPKENKWTRVASMSTRRLGVAVAVLGGFLYAVGGSDGTSPLNTVERYNPQENRWHTIAPMGTRRKHLGCAVYQDMIYAVGGRDDTTELSSAERYNPRTNQWSPVVAMTSRRSGVGLAVVNGQLMAVGGFDGTTYLKTIEVFDPDANTWRLYGGMNYRRLGGGVGVIKMTHCESHIW

SEQ ID NO: 8985 - protein, 172 aa, Homo sapiens
MSCTIEKALADAKALVERLRDHDDAAESLIEQTTALNKRVEAMKQYQEEIQELNEVARHRPRSTLVMGIQQENRQIRELQQENKELRTSLEEHQSALELIMSKYREQMFRLLMASKKDDPGIIMKLKEQHSKIDMVHRNKSEGFFLDASRHILEAPQHGLERRHLEANQNVH

SEQ ID NO: 8986 - protein, 270 aa, Homo sapiens
MLFIFPLSLPWRPSCWKESCSTGQRQAGRSREDSVTPPPSSPWPTPPAGAMSTKQEARRDEGEARTRGQEAQLRDRAHLSLHKDSADLLPLDSLKRLGTSKDLQPRSVIQRRLVEGNPNWLQGEPPRMQDLIHGQESRRKTSRTEIPALLVNCKCQDQLLRVAVDTGTQYNRISAGCLSRLGLEKRVLKASAGDLAPGPPTQVEQLELQLGQETVVCSAQVVDAESPEFCLGLQTLLSLKCCIDLEHGVLRLKAPFSELPFLPLYQEPGQ

SEQ ID NO: 8987 - protein, 80 aa, Homo sapiens
TSCCRPSSSVSLLCHPVCSCSPACQPTCCIHSPCQASCYVPVSCQPIIYVTPSCQSSGCCQPPCTTALCRPISCSTPSCC

SEQ ID NO: 8988 - protein, 670 aa, Homo sapiens
MALGEEKAEAEASEDTKAQSYGRGSCRERELDIPGPMSGEQPPRLEAEGGLISPVWGAEGIPAPTCWIGTDPGGPSRAHQPQASDANREPVAERSEPALSGLPPATMGSGDLLLSGESQVEKTKLSSSEEFPQTLSLPRTTTICSGHDADTEDDPSLADLPQALDLSQQPHSSGLSCLSQWKSVLSPGSAAQPSSCSISASSTGSSLQGHQERAEPRGGSLAKVSSSLEPVVPQEPSSVVGLGPRPQWSPQPVFSGGDASGLGRRRLSFQAEYWACVLPDSLPPSPDRHSPLWNPNKEYEDLLDYTYPLRPGPQLPKHLDSRVPADPVLQDSGVDLDSFSVSPASTLKSPTNVSPNCPPAEATALPFSGPREPSLKQWPSRVPQKQGGMGLASWSQLASTPRAPGSRDARWERREPALRGAKDRLTIGKHLDMGSPQLRTRDRGWPSPRPEREKRTSQSARRPTCTESRWKSEEEVESDDEYLALPARLTQVSSLVSYLGSISTLVTLPTGDIKGQSPLEVSDSDGPASFPSSSSQSQLPPGAALQGSGDPEGQNPCFLRSFVRAHDSAGEGSLGSSQALGVSSGLLKTRPSLPARLDRWPFSDPDVEGQLPRKGGEQGKESLVQCVKTFCCQLEELICWLYNVADVTDHGTAARSNLTSLKSSLQLYRF

SEQ ID NO: 8989 - protein, 233 aa, Homo sapiens
MKQLIEDTEKNKVYVAMVTDYGAFIKIPGCRKQGLVHRTHMSSCRVDKPSEIVDVGDKVWVKLIGREMKNDRIKVSLSMKVVNQGTGKDLDPNNVIIEQEERRRRSFQDYTGQKITLEAVLNTTCKKCGCKGHFAKDCFMQPGGTKYSLIPDEEEEKEEAKSAEFEKPDPTRNPSRKRKKEKKKKKHRDRKSSDSDSSDSESDTGKRARHTSKDSKAAKKKKKKKKHKKKHKE

SEQ ID NO: 8990 - protein, 163 aa, Homo sapiens
MGWRLLTQDEGPALVPGGRLGDLWDYHQHRYLQGVPEGVRDLPPGVALPLESNLAFMNGVSFTKGCYIGQELTARTHHMGVIRKRLFPVRFLDPLPTSGITPGATVLTASGQTVGKFRAGQGNVGLALLWSEKIKGPLHIRASEGAQVALAASVPDWWPTVSK

SEQ ID NO: 8991 - protein, 267 aa, Homo sapiens
MAMEMRLPVARKPLSERLGRDTKKHLVVPGDTITTDTGFMRGHGTYMGEEKLIASVAGSVERVNKLICVKALKTRYIGEVGDIVVGRITEVQQKRWKVETNSRLDSVLLLSSMNLPGGELRRRSAEDELAMRGFLQEGDLISGVLVQVSPSLVKRQKTHFHDLPCGASVILGNNGFIWIYPTPEHKEEEAGGFIANLEPVSLADREVISRLRNCIISLVTQRMMLYDTSILYCYEASLPHQIKDILKPEIMEEIVMETRQRLLEQEG

SEQ ID NO: 8992 - protein, 1036 aa, Homo sapiens
MPVFKEVKVHLLEDAGIEKDAVTQETRISPSGIDSATTVAAATAAAIATAAPLIKVQSDLEAKVNSVTELLSKLQETDKHLQRVTEQQTSIQRKQEKLHCHDHEKQMNVFMEQHIRHLEKLQQQQIDIQTHFISAALKTSSFQPVSMPSSRAVEKYSVKPEHPNLGSCNPSLYNTFASKQAPLKEVEDTSFDKQKSPLETPAPRRFAPVPVSRDDELSKRENLLEEKENMEVSCHRGNVRLLEQILNNNDSLTRKSESSNTTSLTRSKIGWTPEKTNRFPSCEELETTKVTMQKSDDVLHDLGQKEKETNSMVQPKESLSMLKLPDLPQNSVKLQTTNTTRSVLKDAEKILRGVQNNKKVLEENLEAIIRAKDGAAMYSLINALSTNREMSEKIRIRKTVDEWIKTISAEIQDELSRTDYEQKRFDQKNQRTKKGQNMTKDIRTNTQDKTVNKSVIPRKHSQKQIEEHFRNLPMRGMPASSLQKERKEGLLKATTVIQDEDYMLQVYGKPVYQGHRSTLKKGPYLRFNSPSPKSRPQRPKVIERVKGTKVKSIRTQTDFYATKPKKMDSKMKHSVPVLPHGDQQYLFSPSREMPTFSGTLEGHLIPMAILLGQTQSNSDTMPPAGVIVSKPHPVTVTTSIPPSSRKVETGVKKPNIAIVEMKSEKKDPPQLTVQVLPSVDIDSISNSSADVLSPLSSPKEASLPPVQTWIKTPEIMKVDEEEVKFPGTNFDEIIDVIQEEEKCDEIPDSEPILEFNRSVKADSTKYNGPPFPPVASTFQPTADILDKVIERKETLENSLIQWVEQEIMSRIISGLFPVQQQIAPSISVSVSETSEPLTSDIVEGTSSGALQLFVDAGVPVNSNVIKHFVNEALAETIAVMLGDREAKKQGPVATGVSGDASTNETYLPARVCTPLPTPQPTPPCSPSSPAKECVLVKTPDSSPCDSDHDMAFPVKEICAEKGDDMPAIMLVNTPTVTPTTTPPPAAAVFTPTLSDISIDKLKVSSPELPKPWGDGDLPLEEENPNSPQEELHPRAM

SEQ ID NO: 8993 - protein, 1116 aa, Homo sapiens; identical to SEQ ID NO: 6025

SEQ ID NO: 8994 - protein, 271 aa, Homo sapiens
MRQLHPEAIAAIQSKALFSKAEEQLLSKVGSTSQPTLETFQDLLHRHPDAFYLARTAKALQAHWQLMKQYYLLEDQTVQPLPKGDQVLNFSDAEDLIDDSKLKDMRDEVLEHELMVADRRQKREIRQLEQELHKWQVLVDSITGMSSPDFDNQTLAVLRGRMVRYLMRSREITLGRATKDNQIDVDLSLEGPAWKISRKQGVIKLKNNGDFFIANEGRRPIYIDGRPVLCGSKWRLSNNSVVEIASLRFVFLINQDLIALIRAEAAKITPQ

SEQ ID NO: 8995 - protein, 916 aa, Homo sapiens
MEMPLPPDDQELRNVIDKLAQFVARNGPEFEKMTMEKQKDNPKFSFLFGGEFYSYYKCKLALEQQQLICKQQTPELEPAATMPPLPQPPLAPAAPIPPAQGAPSMDELIQQSQWNLQQQEQHLLALRQEQVTAAVAHAVEQQMQKLLEETQLDMNEFDNLLQPIIDTCTKDAISAGKNWMFSNAKSPPHCELMAGHLRNRITADGAHFELRLHLIYLINDVLHHCQRKQARELLAALQKVVVPIYCTSFLAVEEDKQQKIARLLQLWEKNGYFDDSIIQQLQSPALGLGQYQATLINEYSSVVQPVQLAFQQQIQTLKTQHEEFVTSLAQQQQQQQQQQQQLQMPQMEAEVKATPPPPAPPPAPAPAPAIPPTTQPDDSKPPIQMPGSSEYEAPGGVQDPAAAGPRGPGPHDQIPPNKPPWFDQPHPVAPWGQQQPPEQPPYPHHQGGPPHCPPWNNSHEGMWGEQRGDPGWNGQRDAPWNNQPDAAWNSQFEGPWNSQHEQPPWGGGQREPPFRMQRPPHFRGPFPPHQQHPQFNQPPHPHNFNRFPPRFMQDDFPPRHPFERPPYPHRFDYPQGDFPAEMGPPHHHPGHRMPHPGINEHPPWAGPQHPDFGPPPHGFNGQPPHMRRQGPPHINHDDPSLVPNVPYFDLPAGLMAPLVKLEDHEYKPLDPKDIRLPPPMPPSERLLAAVEAFYSPPSHDRPRNSEGWEQNGLYEFFRAKMRARRRKGQEKRNSGPSRSRSRSKSRGRSSSRSNSRSSKSSGSYSRSRSRSCSRSYSRSRSRSRSRSRSSRSRSRSQSRSRSKSYSPGRRRRSRSRSPTPPSSAGLGSNSAPPIPDSRLGEENKGHQMLVKMGWSGSGGLGAKEQGIQDPIKGGDVRDKWDQYKGVGVALDDPYENYRRNKSYSFIARMKARDECK

SEQ ID NO: 8996 - protein, 320 aa, Homo sapiens
MSKSESPKEPEQLRKLFIGGLSFETTDESLRSHFEQWGTLTDCVVMRDPNTKRSRGFGFVTYATVEEVDAAMNARPHKVDGRVVEPKRAVSREDSQRPGAHLTVKKIFVGGIKEDTEEHHLRDYFEQYGKIEVIEIMTDRGSGKKRGFAFVTFDDHDSVDKIVIQKYHTVNGHNCEVRKALSKQEMASASSSQRGRSGSGNFGGGRGGGFGGNDNFGRGGNFSGRGGFGGSRGGGGYGGSGDGYNGFGNDGSNFGGGGSYNDFGNYNNQSSNFGPMKGGNFGGRSSGPYGGGGQYFAKPRNQGGYGGSSSSSSYGSGRRF

SEQ ID NO: 8997 - protein, 244 aa, Homo sapiens; identical to SEQ ID NO: 5556

SEQ ID NO: 8998 - protein, 1374 aa, Homo sapiens
MTSAAEIKKPPVAPKPKFVVANNKPAPPPIAPKPDIVISSVPQSTKKMKPAIAPKPKVLKTSPVREIGQSPSRKIMLNLEGHKQELAESTDNFNCKYEGNQSNDYISPMCSCSSECIHKLGHRENLCVKQLVLEPLEMNENLENSKIDETLTIKTRSKCDLYGEKAKNQGGVVLKASVLEEELKDALIHQMPPFISAQKHRPTDSPEMNGGCNSNGQFRIEFADLSPSPSSFEKVPDHHSCHLQLPSDECEHFETCQDDSEKSNNCFQSSELEALENGKRSTLISSDGVSKKSEVKDLGPLEIHLVPYTPKFPTPKPRKTRTARLLRQKCVDTPSESTEEPGNSDSSSSCLTENSLKINKISVLHQNVLCKQEQVDKMKLGNKSELNMESNSDAQDLVNSQKAMCNETTSFEKMAPSFDKDSNLSSDSTTVDGSSMSLAVDEGTGFIRCTVSMSLPKQLKLTCNEHLQSGRNLGVSAPQMQKESVIKEENSLRIVPKKPQRHSLPATGVLKKAASEELLEKSSYPSSEEKSSEKSLERNHLQHLCAQNRGVSSSFDMPKRASEKPVWKLPHPILPFSGNPEFLKSVTVSSNSEPSTALTKPRAKSLSAMDVEKCTKPCKDSTKKNSFKKLLSMKLSICFMKSDFQKFWSKSSQLGDTTTGHLSSGEQKGIESDWQGLLVGEEKRSKPIKAYSTENYSLESQKKRKKSRGQTSAANGLRAESLDDQMLSRESSSQAPYKSVTSLCAPEYENIRHYEEIPEYENLPFIMAIRKTQELEWQNSSSMEDADANVYEVEEPYEAPDGQLQLGPRHQHSSSGASQEEQNDLGLGDLPSDEEEIINSSDEDDVSSESSKGEPDPLEDKQDEDNGMKSKVHHIAKEIMSSEKVFVDVLKLLHIDFRDAVAHASRQLGKPVIEDRILNQILYYLPQLYELNRDLLKELEERMLHWTEQQRIADIFVKKGPYLKMYSTYIKEFDKNIALLDEQCKKNPGFAAVVREFEMSPRCANLALKHYLLKPVQRIPQYRLLLTDYLKNLIEDAGDYRDTQDALAVVIEVANHANDTMKQGDNFQKLMQIQYSLNGHHEIVQPGRVFLKEGILMKLSRKVMQPRMFFLFNDALLYTTPVQSGMYKLNNMLSLAGMKVRKPTQEAYQNELKIESVERSFILSASSATERDEWLEAISRAIEEYAKKRITFCPSRSLDEADSENKEEVSPLGSKAPIWIPDTRATMCMICTSEFTLTWRRHHCRACGKIVCQACSSNKYGLDYLKNQPARVCEHCFQELQKLDHQHSPRIGSPGNHKSPSSALSSVLHSIPSGRKQKKIPAALKEVSANTEDSSMSGYLYRSKGNKKPWKHFWFVIKNKVLYTYAASEVRSEI

SEQ ID NO: 8999 - protein, 481 aa, Homo sapiens; identical to SEQ ID NO: 6507

SEQ ID NO: 9000 - protein, 155 aa, Homo sapiens
MDTMMLNVRNLFEQLVRRVEILSEGNEVQFIQLAKDFEDFRKKWQRTDHELGKYKDLLMKAETERSALDVKLKHARNQVDVEIKRRQRAEADCEKLERQIQLIREMLMCDTSGSIQLSEEQKSALAFLNRGQPSSSNAGNKRLSTIDESGSILSD

SEQ ID NO: 9001 - protein, 139 aa, Homo sapiens
MDTMMLNVRNLFEQLVRRVEILSEGNEVQFIQLAKDFEDFRKKWQRTDHELGKYKDLLMKAETERSALDVKLKHARNQVDVEIKRRQRAEADCEKLERQIQLIREMLMCDTSGSIQLSEEQKSALAFLNRGQPSSSNAG

SEQ ID NO: 9002 - protein, 1093 aa, Homo sapiens
MGGKAWPRRAVGTAGGPCAEQISAPFQTLLMPHLPLASFRPPFWGLRHSRGLPRFHSVSTQSEPHGSPISRRNREAKQKRLREKQATLEAEIAGESKSPAESIKAWRPKELVLYEIPTKPGEKKDVSGPLPPAYSPRYVEAAWYPWWVREGFFKPEYQARLPQATGETFSMCIPPPNVTGSLHIGHALTVAIQDALVRWHRMRGDQVLWVPGSDHAGIATQAVVEKQLWKERGVRRHELSREAFLREVWQWKEAKGGEICEQLRALGASLDWDRECFTMDVGSSVAVTEAFVRLYKAGLLYRNHQLVNWSCALRSAISDIEVENRPLPGHTQLRLPGCPTPVSFGLLFSVAFPVDGEPDAEVVVGTTRPETLPGDVAVAVHPDDSRYTHLHGRQLRHPLMGQPLPLITDYAVQPHVGTGAVKVTPAHSPADAEMGARHGLSPLNVIAEDGTMTSLCGDWLQGLHRFVAREKIMSVLSEWGLFRGLQNHPMVLPICSRSGDVIEYLLKNQWFVRCQEMGARAAKAVESGALELSPSFHQKNWQHWFSHIGDWCVSRQLWWGHQIPAYLVVEDHAQGEEDCWVVGRSEAEAREVAAELTGRPGAELTLERDPDVLDTWFSSALFPFSALGWPQETPDLARFYPLSLLETGSDLLLFWVGRMVMLGTQLTGQLPFSKVLLHPMVRDRQGRKMSKSLGNVLDPRDIISGVEMQVLQEKLRSGNLDPAELAIVAAAQKKDFPHGIPECGTDALRFTLCSHGVQAGDLHLSVSEVQSCRHFCNKIWNALRFILNALGEKFVPQPAEELSPSSPMDAWILSRLALAAQECERGFLTRELSLVTHALHHFWLHNLCDVYLEAVKPVLWHSPRPLGPPQVLFSCADLGLRLLAPLMPFLAEELWQRLPPRPGCPPAPSISVAPYPSACSLEHWRQPELERRFSRVQEVVQVLRALRATYQLTKARPRVLLQSSEPGDQGLFEAFLEPLGTLGYCGAVGLLPPGAAAPSGWAQAPLSDTAQVYMELQGLVDPQIQLPLLAARRYKLQKQLDSLTARTPSEGEAGTQRQQKLSSLQLELSKLDKAASHLRQLMDEPPAPGSPEL

SEQ ID NO: 9003 - protein, 76 aa, Homo sapiens
MNSVGEACTDMKREYDQCFNRWFAEKFLKGDSSGDPCTDLFKRYQQCVQKAIKEKEIPIEGLEFMGHGKEKPENSS

SEQ ID NO: 9004 - protein, 244 aa, Homo sapiens; identical to SEQ ID NO: 5556

SEQ ID NO: 9005 - protein, 257 aa, Homo sapiens
MPHLPLASFRPPFWGLRHSRGLPRFHSVSTQSEPHGSPISRRNREAKQKRLREKQATLEAEIAGESKSPAESIKAWRPKELVLYEIPTKPGEKKDVSGPLPPAYSPRYVEAAWYPWWVREGFFKPEYQARLPQATGETFSMCIPPPNVTGSLHIGHALTVAIQDALVRWHRMRGDQVLWVPGSDHAGIATQAVVEKQLWKERGVRRHELSREAFLREVWQWKEAKGGEICEQLRALGASLDWDRVFYHGCWLLSGCD

SEQ ID NO: 9006 - protein, 267 aa, Homo sapiens
MSKSESPKEPEQLRKLFIGGLSFETTDESLRSHFEQWGTLTDCVVMRDPNTKRSRGFGFVTYATVEEVDAAMNARPHKVDGRVVEPKRAVSREDSQRPGAHLTVKKIFVGGIKEDTEEHHLRDYFEQYGKIEVIEIMTDRGSGKKRGFAFVTFDDHDSVDKIVIQKYHTVNGHNCEVRKALSKQEMASASSSQRGRSGSGNFGGGSYNDFGNYNNQSSNFGPMKGGNFGGRSSGPYGGGGQYFAKPRNQGGYGGSSSSSSYGSGRRF

SEQ ID NO: 9007 - protein, 176 aa, Homo sapiens
MNESKPGDSQNLACVFCRKHDDCPNKYGEKKTKEKWNLTVHYYCLLMSSGIWQRGKEEEGVYGFLIEDIRKEVNRASKLKCCVCKKNGASIGCVAPRCKRSYHFPCGLQRECIFQFTGNFASFCWDHRPVQIITSNNYRESLPCTICLEFIEPIPSYNILRSPCCKNAWFHRDCLQ

SEQ ID NO: 9008 - protein, 1056 aa, Homo sapiens
MLSVVENGLDPQAAIPVIKKKLVGSVKALQKQYVSLDTVVTSEDGDANTMCSALEAVFIHGLHAKHIRAEAGGKRKKSAHQKPLPQPVFWPLLKAVTHKHIISELEHLTFVNTDVGRCRAWLRLALNDGLMECYLKLLLQEQARLHEYYQPTALLRDAEEGEFLLSFLQGLTSLSFELSYKSAILNEWTLTPLALSGLCPLSELDPLSTSGAELQRKESLDSISHSSGSEDIEVHHSGHKIRRNQKLTASSLSLDTASSSQLSCSLNSDSCLLQENGSKSPDHCEEPMSCDSDLGTANAEDSDRSLQEVLLEFSKAQVNSVPTNGLSQETEIPTPQASLSLHGLNTSTYLHCEAPAEPLPAQAASGTQDGVHVQEPRPQAPSPLDLQQPVESTSGQQPSSTVSETAREVGQGNGLQKAQAHDGAGLKLVVSSPTSPKNKSWISEDDFYRPSREQPLESASDHPIASYRGTPGSRPGLHRHFSQEPRKNCSLGALDQACVPSPGRRQAQAAPSQGHKSFRVVHRRQMGLSNPFRGLMKLGTVERRGAMGIWKELFCELSPLEFRLYLSNEEHTCVENCSLLRCESVGPAHSDGRFELVFSGKKLALRASSQDEAEDWLDRVREALQKVRPQQEDEWVNVQYPDQPEEPPEAPQGCLSPSDLLSEPAALQGTQFDWSSAQVPEPDAIKESLLYLYMDRTWMPYIFSLSLEALKCFRIRNNEKMLSDSHGVETIRDILPDTSLGGPSFFKIITAKAVLKLQAGNAEEAALWRDLVRKVLASYLETAEEAVTLGGSLDENCQEVLKFATRENGFLLQYLVAIPMEKGLDSQGCFCAGCSRQIGFSFVRPKLCAFSGLYYCDICHQDDASVIPARIIHNWDLTKRPICRQALKFLTQIRAQPLINLQMVNASLYEHVERMHLIGRRREQLKLLGDYLGLCRSGALKELSKRLNHRNYLLESPHRFSVADLQQIADGVYEGFLKALIEFASQHVYHCDLCTQRGFICQICQHHDIIFPFEFDTTVRCAECKTVFHQSCQAVVKKGCPRCARRRKYQEQNIFA

SEQ ID NO: 9009 - protein, 129 aa, Homo sapiens; identical to SEQ ID NO: 6440

SEQ ID NO: 9010 - protein, 115 aa, Homo sapiens [sequence omitted]

SEQ ID NO: 9011 - protein, 632 aa, Homo sapiens; identical to SEQ ID NO: 5339

SEQ ID NO: 9012 - protein, 129 aa, Homo sapiens; identical to SEQ ID NO: 6440

SEQ ID NO: 9013 - protein, 1739 aa, Homo sapiens
MMEGNGTENSCSRTRGWLQQDNDAKPWLWKFSNCFSRPEQTLPHSPQTKEYMENKKVAVELKDVPSPLHAGSKLFPAVPLPDIRSLQQPKIQLSSVPKVSCCAHCPNEPSTSPMRFGGGGGGSGGTSSLIHPGALLDSQSTRTITCQVGSGFAFQSASSLQNASARNNLAGIASDFPSMCLESNLSSCKHLPCCGKLHFQSCHGNVHKLHQFPSLQGCTSAGYFPCSDFTSGAPGHLEEHISQSELTPHLCTNSLHLNVVPPVCLKGSLYCEDCLNKPARNSIIDAAKVWPNIPPPNTQPAPLAVPLCNGCGTKGTGKETTLLLATSLGKAASKFEVAVAGQVLENLPPIGVFWDIENCSVPSGRSATAVVQRIREKFFKGHREAEFICVCDISKENKEVIQELNNCQVTVAHINATAKNAADDKLRQSLRRFANTHTAPATVVLVSTDVNFALELSDLRHRHGFHIILVHKNQASEALLHHANELIRFEEFISDLPPRLPLKMPQCHTLLYVYNLPANKDGKSVSNRLRRLSDNCGGKVLSITGCSAILRFINQDSAERAQKRMENEDVFGNRIIVSFTPKNRELCETKSSNAIADKVKSPKKLKNPKLCLIKDASEQSSSAKATPGKGSQANSGSATKNTNVKSLQELCRMESKTGHRNSEHQQGHLRLVVPTHGNSSAAVSTPKNSGVAEPVYKTSQKKENLSARSVTSSPVEKKDKEETVFQVSYPSAFSKLVASRQVSPLLASQSWSSRSMSPNLLNRASPLAFNIANSSSEADCPDPFANGADVQVSNIDYRLSRKELQQLLQEAFARHGKVKSVELSPHTDYQLKAVVQMENLQDAIGAVNSLHRYKIGSKKILVSLATGAASKSLSLLSAETMSVLQDAPACCLPLFKFTDIYEKKFGHKLNVSDLYKLTDTVAIREQGNGRLVCLLPSSQARQSPLGSSQSHDGSSTNCSPIIFEELEYHEPVCRQHCSNKDFSEHEFDPDSYKIPFVILSLKTFAPQVHSLLQTHEGTVPLLSFPDCYIAEFGDLEVVQENQGGVPLEHFITCVPGVNIATAQNGIKVVKWIHNKPPPPNTDPWLLRSKSPVGNPQLIQFSREVIDLLKSQPSCVIPISHFIPSYHHHFAKQCRVSDYGYSKLIELLEAVPHVLQILGMGSKRLLTLTHRAQVKRFTQDLLKLLKSQASKQVIVREFSQAYHWCFSKDWDVTEYGVCELIDIVSEIPDTTICLSQQDNEMVICIPKRERTQDEIERTKQFSKDVVDLLRHQPHFRMPFNKFIPSYHHHFGRQCKLAYYGFTKLLELFEAIPDTLQVLECGEEKILTLTEVERFKALAAQFVKLLRSQKDNCLMMTDLLTEYAKTFGYTFRLQDYDVSSISALTQKLCHVVKVADIESGRQIQLINRKSLRSLTAQLLVLLMSWEGTTHLSVEELKRHYESTHNTPLNPCEYGFMTLTELLKSLPYLVEVFTNDKMEECVKLTSLYLFAKNVRSLLHTYHYQQIFLHEFSMAYTKYVGETLQPKTYGHSSVEELLGAIPQVVWIKGHGHKRIVVLKNDMKSRLSSLSLSPANHENQPSEGERILEVPESHTASELKLGADGSGPSHTEQELLRLTDDSPVDLLCAPVPSCLPSPQLRPDPVILQSADLIQFEERPQEPSEIMILNQEEKMEIPIPGKSKTLTSDSSSSCISAAVPVPPCPSSETSESLLSKDPVESPAKKQPKNRVKLAANFSLAPITKL

SEQ ID NO: 9014 - protein, 129 aa, Homo sapiens; identical to SEQ ID NO: 6440

SEQ ID NO: 9015 - protein, 143 aa, Homo sapiens
MTLRCLEPSGNGGEGTRSQWGTAGSAEEPSPQAARLAKALRELGQTGWYWGSMTVNEAKEKLKEAPEGTFLIRDSSHSDYLLTISVKTSAGPTNLRIEYQDGKFRLDSIICVKSKLKQFDSVVHLIDYYVQMCKDKRTGPEAP

SEQ ID NO: 9016 - protein, 51 aa, Homo sapiens
MSSSMWYIMQSIQSKYSLSERLIRTIAAIRSFPHDNVEDLIRGGADVNCTH

SEQ ID NO: 9017 - protein, 633 aa, Homo sapiens
MEESPLSRAPSRGGVNFLNVARTYIPNTKVECHYTLPPGTMPSASDWIGIFKVEAACVRDYHTFVWSSVPESTTDGSPIHTSVQFQASYLPKPGAQLYQFRYVNRQGQVCGQSPPFQFREPRPMDELVTLEEADGGSDILLVVPKATVLQNQLDESQQERNDLMQLKLQLEGQVTELRSRVQELERALATARQEHTELMEQYKGISRSHGEITEERDILSRQQGDHVARILELEDDIQTISEKVLTKEVELDRLRDTVKALTREQEKLLGQLKEVQADKEQSEAELQVAQQENHHLNLDLKEAKSWQEEQSAQAQRLKDKVAQMKDTLGQAQQRVAELEPLKEQLRGAQELAASSQQKATLLGEELASAAAARDRTIAELHRSRLEVAEVNGRLAELGLHLKEEKCQWSKERAGLLQSVEAEKDKILKLSAEILRLEKAVQEERTQNQVFKTELAREKDSSLVQLSESKRELTELRSALRVLQKEKEQLQEEKQELLEYMRKLEARLEKVADEKWNEDATTEDEEAAVGLSCPAALTDSEDESPEDMRLPPYGLCERGDPGSSPAGPREASPLVVISQPAPISPHLSGPAEDSSSDSEAEDEKSVLMAAVQSGGEEANLLLPELGSAFYDMAR

SEQ ID NO: 9018 - protein, 269 aa, Homo sapiens; identical to SEQ ID NO: 7726

SEQ ID NO: 9019 - protein, 205 aa, Homo sapiens
MDKDSQGLLDSSLMASGTASRSEDEESLAGQKRASSQALGTIPKRRSSSRFIKRKKFDDELVESSLAKSSTRAKGASGVEPGRCSGSEPSSSEKKKVSKAPSTPVPPSPAPAPGLTKRVKKSKQPLQVTKDLGRWKPADDLLLINAVLQTNDLTSVHLGVKFSCRFTLREVQERWYALLYDPVISKLACQAMRQLHPEAIAAIQS

SEQ ID NO: 9020 - protein, 179 aa, Homo sapiens
MDWTPRLPSRHIISELEHLTFVNTDVGRCRAWLRLALNDGLMECYLKLLLQEQARLQLQRKESLDSISHSSGSEDIEVHHSGHKIRRNQKLTASSLSLDTASSSQLSCSLNSDSCLLQENGSKSPDHCEEPMSCDSDLGTANAEDSDRSLQEKTRAGSQRMTSTGLPGSNPWRVLQTTQ

SEQ ID NO: 9021 - protein, 244 aa, Homo sapiens; identical to SEQ ID NO: 5556

SEQ ID NO: 9022 - protein, 185 aa, Homo sapiens
MDKDSQGLLDSSLMASGTASRSEDEESLAGQKRASSQALGTIPKRRSSSRFIKRKKFDDELVESSLAKSSTRAKGASGVEPGRCSGSEPSSSEKKKVSKAPSTPVPPSPAPAPGLTKRVKKSKQPLQVTKDLGRWKPADDLLLINAVLQTNDLTSVHLGVKFSCRFTLREVQERWYALLYDPVIS

SEQ ID NO: 9023 - protein, 1000 aa, Homo sapiens
MVECFESGGTRLSLSSFNVSCDSLREQLREWRCFQWWRMDWTPRLPSRHIISELEHLTFVNTDVGRCRAWLRLALNDGLMECYLKLLLQEQARLHEYYQPTALLRDAEEGEFLLSFLQGLTSLSFELSYKSAILNEWTLTPLALSGLCPLSELDPLSTSGAELQRKESLDSISHSSGSEDIEVHHSGHKIRRNQKLTASSLSLDTASSSQLSCSLNSDSCLLQENGSKSPDHCEEPMSCDSDLGTANAEDSDRSLQEVLLEFSKAQVNSVPTNGLSQETEIPTPQASLSLHGLNTSTYLHCEAPAEPLPAQAASGTQDGVHVQEPRPQAPSPLDLQQPVESTSGQQPSSTVSETAREVGQGNGLQKAQAHDGAGLKLVVSSPTSPKNKSWISEDDFYRPSREQPLESASDHPIASYRGTPGSRPGLHRHFSQEPRKNCSLGALDQACVPSPGRRQAQAAPSQGHKSFRVVHRRQMGLSNPFRGLMKLGTVERRGAMGIWKELFCELSPLEFRLYLSNEEHTCVENCSLLRCESVGPAHSDGRFELVFSGKKLALRASSQDEAEDWLDRVREALQKVRPQQEDEWVNVQYPDQPEEPPEAPQGCLSPSDLLSEPAALQGTQFDWSSAQVPEPDAIKESLLYLYMDRTWMPYIFSLSLEALKCFRIRNNEKMLSDSHGVETIRDILPDTSLGGPSFFKIITAKAVLKLQAGNAEEAALWRDLVRKVLASYLETAEEAVTLGGSLDENCQEVLKFATRENGFLLQYLVAIPMEKGLDSQGCFCAGCSRQIGFSFVRPKLCAFSGLYYCDICHQDDASVIPARIIHNWDLTKRPICRQALKFLTQIRAQPLINLQMVNASLYEHVERMHLIGRRREQLKLLGDYLGLCRSGALKELSKRLNHRNYLLESPHRFSVADLQQIADGVYEGFSPKVPSEAAGLRPWGARSPEAASAFRCIDSSHLPSLRKVVPTLFLKCYFMQYTVPSEQGSGPEESLQCIEGIAAV

SEQ ID NO: 9024 - protein, 174 aa, Homo sapiens
MDTMMLNVRNLFEQLVRRVEILSEGNEVQFIQLAKDFEDFRKKWQRTDHELGKYKDLLMKAETERSALDVKLKHARNQVDVEIKRRQRAEADCEKLERQIQLIREMLMCDTSGSIQLSEEQKSALAFLNRGQPSSSNAGNKRLSTIDESGSILSDISFDKTDESLDWDSSLVKT

SEQ ID NO: 9025 - protein, 967 aa, Homo sapiens
MDWTPRLPSRHIISELEHLTFVNTDVGRCRAWLRLALNDGLMECYLKLLLQEQARLHEYYQPTALLRDAEEGEFLLSFLQGLTSLSFELSYKSAILNEWTLTPLALSGLCPLSELDPLSTSGAELQRKESLDSISHSSGSEDIEVHHSGHKIRRNQKLTASSLSLDTASSSQLSCSLNSDSCLLQENGSKSPDHCEEPMSCDSDLGTANAEDSDRSLQEVLLEFSKAQVNSVPTNGLSQETEIPTPQASLSLHGLNTSTYLHCEAPAEPLPAQAASGTQDGVHVQEPRPQAPSPLDLQQPVESTSGQQPSSTVSETAREVGQGNGLQKAQAHDGAGLKLVVSSPTSPKNKSWISEDDFYRPSREQPLESASDHPIASYRGTPGSRPGLHRHFSQEPRKNCSLGALDQACVPSPGRRQAQAAPSQGHKSFRVVHRRQMGLSNPFRGLMKLGTVERRGAMGIWKELFCELSPLEFRLYLSNEEHTCVENCSLLRCESVGPAHSDGRFELVFSGKKLALRASSQDEAEDWLDRVREALQKVRPQQEDEWVNVQYPDQPEEPPEAPQGCLSPSDLLSEPAALQGTQFDWSSAQVPEPDAIKESLLYLYMDRTWMPYIFSLSLEALKCFRIRNNEKMLSDSHGVETIRDILPDTSLGGPSFFKIITAKAVLKLQAGNAEEAALWRDLVRKVLASYLETAEEAVTLGGSLDENCQEVLKFATRENGFLLQYLVAIPMEKGLDSQGCFCAGCSRQIGFSFVRPKLCAFSGLYYCDICHQDDASVIPARIIHNWDLTKRPICRQALKFLTQIRAQPLINLQMVNASLYEHVERMHLIGRRREQLKLLGDYLGLCRSGALKELSKRLNHRNYLLESPHRFSVADLQQIADGVYEGFLKALIEFASQHVYHCDLCTQRGFICQICQHHDIIFPFEFDTTVRCAECKTVFHQSCQAVVKKGCPRCARRRKYQEQNIFA

SEQ ID NO: 9026 - protein, 481 aa, Homo sapiens; identical to SEQ ID NO: 6507

SEQ ID NO: 9027 - protein, 153 aa, Homo sapiens
MAPGSRGERSSFRSRRGPGVPSPQPDVTMLSRLLKEHQAKQNERKELQEKRRREAITAATCLTEALVDHLNVGVAQAYMNQRKLDHEVKTLQVQAAQFAKQTGQWIGMVENFNQALKEIGDVENWARSIELDMRTIATALEYVYKGQLQSAPS

SEQ ID NO: 9028 - protein, 436 aa, Homo sapiens
MLWNFKPHARAYRYVGHKDVVTSVQFSPHGNLLASASRDRTVRLWIPDKRGKFSEFKAHTAPVRSVDFSADGQFLATASEDKSIKVWSMYRQRFLYSLYRHTHWVRCAKFSPDGRLIVSCSEDKTIKIWDTTNKQCVNNFSDSVGFANFVDFNPSGTCIASAGSDQTVKVWDVRVNKLLQHYQVHSGGVNCISFHPSGNYLITASSDGTLKILDLLEGRLIYTLQGHTGPVFTVSFSKGGELFASGGADTQVLLWRTNFDELHCKGLTKRNLKRLHFDSPPHLLDIYPRTPHPHEEKVETVEINPKLEVIDLQISTPPVMDILSFDSTTTTETSGRTLPDKGEEACGYFLNPSLMSPECLPTTTKKKTEDMSDLPCESQRSIPLAVTDALEHIMEQLNVLTQTVSILEQRLTLTEDKLKDCLENQQKLFSAVQQKS

SEQ ID NO: 9029 - protein, 198 aa, Homo sapiens; identical to SEQ ID NO: 5709

SEQ ID NO: 9030 - protein, 198 aa, Homo sapiens; identical to SEQ ID NO: 5709

SEQ ID NO: 9031 - protein, 164 aa, Homo sapiens
MMEGNGTENSCSRTRGWLQQDNDAKPWLWKFSNCFSRPEQTLPHSPQTKEYMENKKVAVELKDVPSPLHAGSKLFPAVPLPDIRSLQQPKIQLSSVPKVSCCAHCPNEPSTSPMRFGGGGGGSGGTSSLIHPGALLDSQSTRTITCQVGSGFAFQSASSLQNAS

SEQ ID NO: 9032 - protein, 284 aa, Homo sapiens
MLSVVENGLDPQAAIPVIKKKLVGSVKALQKQYVSLDTVVTSEDGDANTMCSALEAVFIHGLHAKHIRAEAGGKRKKSAHQKPLPQPVFWPLLKAVTHKHIISELEHLTFVNTDVGRCRAWLRLALNDGLMECYLKLLLQEQARLQLQRKESLDSISHSSGSEDIEVHHSGHKIRRNQKLTASSLSLDTASSSQLSCSLNSDSCLLQENGSKSPDHCEEPMSCDSDLGTANAEDSDRSLQDIKIFSWAQWLTPVIPALWEAEAGGSQRQQIETFLANTVKPHLY

SEQ ID NO: 9033 - protein, 1093 aa, Homo sapiens
MGGKAWPRRAVGTAGGPCAEQISAPFQTLLMPHLPLASFRPPFWGLRHSRGLPRFHSVSTQSEPHGSPISRRNREAKQKRLREKQATLEAEIAGESKSPAESIKAWRPKELVLYEIPTKPGEKKDVSGPLPPAYSPRYVEAAWYPWWVREGFFKPEYQARLPQATGETFSMCIPPPNVTGSLHIGHALTVAIQDALVRWHRMRGDQVLWVPGSDHAGIATQAVVEKQLWKERGVRRHELSREAFLREVWQWKEAKGGEICEQLRALGASLDWDRECFTMDVGSSVAVTEAFVRLYKAGLLYRNHQLVNWSCALRSAISDIEVENRPLPGHTQLRLPGCPTPVSFGLLFSVAFPVDGEPDAEVVVGTTRPETLPGDVAVAVHPDDSRYTHLHGRQLRHPLMGQPLPLITDYAVQPHVGTGAVKVTPAHSPADAEMGARHGLSPLNVIAEDGTMTSLCGDWLQGLHRFVAREKIMSVLSERGLFRGLQNHPMVLPICSRSGDVIEYLLKNQWFVRCQEMGARAAKAVESGALELSPSFHQKNWQHWFSHIGDWCVSRQLWWGHQIPAYLVVEDHAQGEEDCWVVGRSEAEAREVAAELTGRPGAELTLERDPDVLDTWFSSALFPFSALGWPQETPDLARFYPLSLLETGSDLLLFWVGRMVMLGTQLTGQLPFSKVLLHPMVRDRQGRKMSKSLGNVLDPRDIISGVEMQLLQEKLRSGNLDPAELAIVAAAQKKDFPHGIPECGTDALRFTLCSHGVQAGDLHLSVSEVQSCRHFCNKIWNALRFILNALGEKFVPQPAEELSPSSPMDAWILSRLALAAQECERGFLTRELSLVTHALHHFWLHNLCDVYLEAVKPVLWHSPRPLGPPQVLFSCADLGLRLLAPLMPFLAEELWQRLPPRPGCPPAPSISVAPYPSACSLEHWRQPELERRFSRVQEVVQVLRALRATYQLTKARPRVLLQSSEPGDQGLFEAFLEPLGTLGYCGAVGLLPPGTAAPSGWAQAPLSDTAQVYMELQGLVDPQIQLPLLAARRYKLQKQLDSLTARTPSEGEAGTQRQQKLSSLQLELSKLDKAASHLRQLMDEPPAPGSPEL

SEQ ID NO: 9034 - protein, 1206 aa, Homo sapiens
MTSAAEIKKPPVAPKPKFVVANNKPAPPPIAPKPDIVISSVPQSTKKMKPAIAPKPKVLKTSPVREIGQSPSRKIMLNLEGHKQELAESTDNFNCKYEGNQSNDYISPMCSCSSECIHKLGHRENLCVKQLVLEPLEMNENLENSKIDETLTIKTRSKCDLYGEKAKNQGGVVLKASVLEEELKDALIHQMPPFISAQKHRPTDSPEMNGGCNSNGQFRIEFADLSPSPSSFEKVPDHHSCHLQLPSDECEHFETCQDDSEKSNNCFQSSELEALENGKRSTLISSDGVSKKSEVKDLGPLEIHLVPYTPKFPTPKPRKTRTARLLRQKCVDTPSESTEEPGNSDSSSSCLTENSLKINKISVLHQNVLCKQEQVDKMKLGNKSELNMESNSDAQDLVNSQKAMCNETTSFEKMAPSFDKDSNLSSDSTTVDGSSMSLAVDEGTGFIRCTVSMSLPKQLKLTCNEHLQSGRNLGVSAPQMQKESVIKEENSLRIVPKKPQRHSLPATGVLKKAASEELLEKSSYPSSEEKSSEKSLERNHLQHLCAQNRGVSSSFDMPKRASEKPVWKLPHPILPFSGNPEFLKSVTVSSNSEPSTALTKPRAKSLSAMDVEKCTKPCKDSTKKNSFKKLLSMKLSICFMKSDFQKFWSKSSQLGDTTTGHLSSGEQKGIESDWQGLLVGEEKRSKPIKAYSTENYSLESQKKRKKSRGQTSAANGLRAESLDDQMLSRESSSQAPYKSVTSLCAPEYENIRHYEEIPEYENLPFIMAIRKTQELEWQNSSSMEDADANVYEVEEPYEAPDGQLQLGPRHQHSSSGASQEEQNDLGLGDLPSDEEEIINSSDEDDVSSESSKGEPDPLEDKQDEDNGMKSKVHHIAKEIMSSEKVFVDVLKLLHIDFRDAVAHASRQLGKPVIEDRILNQILYYLPQLYELNRDLLKELEERMLHWTEQQRIADIFVKKGPYLKMYSTYIKEFDKNIALLDEQCKKNPGFAAVVREFEMSPRCANLALKHYLLKPVQRIPQYRLLLTDYLKNLIEDAGDYRDTQDALAVVIEVANHANDTMKQGDNFQKLMQIQYSLNGHHEIVQPGRVFLKEGILMKLSRKVMQPRMFFLFNDALLYTTPVQSGMYKLNNMLSLAGMKVRKPTQEAYQNELKIESVERSFILSASSATERDEWLEAISRAIEEYAKKRITFCPSRSLDEADSENK

SEQ ID NO: 9035 - protein, 144 aa, Homo sapiens
MDKDSQGLLDSSLMASGTASRSEDEESLAGQKRASSQALGTIPKRRSSSRTLYRFIKRKKFDDELVESSLAKSSTRAKGASGVEPGRCSGSEPSSSEKKKVSKAPSTPVPPSPAPAPGLTKRVKKSKQPLQVTKDLGRWKPADD

SEQ ID NO: 9036 - protein, 269 aa, Homo sapiens; identical to SEQ ID NO: 7726

SEQ ID NO: 9037 - protein, 166 aa, Homo sapiens
MANDPLEGFHEVNLASPTSPDLLGVYESGTQEQTTSPSVIYRPHPSALSSVPIQANALDVSELPTQPVYSSPRRLNCAEISSISFHVTDPAPCSTSGVTAGLTKLTTRKDNYNAEREFLQGATITEACDGSDDIFGLSTDSLSRLRSPSVLEVREKGYERLKEELA

SEQ ID NO: 9038 - protein, 129 aa, Homo sapiens
MDTMMLNVRNLFEQLVRRVEILSEGNEVQFIQLAKDFEDFRKKWQRTDHELGKYKDLLMKAETERSALDVKLKHARNQVDVEIKRRQRAEADCEKLERQIQLIREMLMCDTSGSIQLSEEQKSALAFLN

SEQ ID NO: 9039 - protein, 161 aa, Homo sapiens
MTLRCLEPSGNGGEGTRSQWGTAGSAEEPSPQAARLAKALRELGQTGWYWGSMTVNEAKEKLKEAPEGTFLIRDSSHSDYLLTISVKTSAGPTNLRIEYQDGKFRLDSIICVKSKLKQFDSVVHLIDYYVQMCKDKRTGPEAPRNGTVHLYLTKPLYTSAP

SEQ ID NO: 9040 - protein, 462 aa, Homo sapiens; identical to SEQ ID NO: 5758

SEQ ID NO: 9041 - protein, 191 aa, Homo sapiens; identical to SEQ ID NO: 4694

SEQ ID NO: 9042 - protein, 403 aa, Homo sapiens
MASSSVPPATVSAATAGPGPGFGFASKTKKKHFVQQKVKVFRAADPLVGVFLWGVAHSINELSQVPPPVMLLPDDFKASSKIKEYCPQVFRNLRDRFGIDDQDYLVSLTRNPPSESEGSDGRFLISYDRTLVIKEVSSEDIADMHSNLSNYHQYIVKCHGNTLLPQFLGMYRVSVDNEDSYMLVMRNMFSHRLPVHRKYDLKGSLVSREASDKEKVKELPTLKDMDFLNKNQKVYIGEEEKKIFLEKLKRDVEFLVQLKIMDYSLLLGIHDIIRGSEPEEEAPVREDESEVDGDCSLTGPPALVGSYGTSPEGIGGYIHSHRPLGPGEFESFIDVYAIRSAEGAPQKEVYFMGLIDILTQYDAKKKAAHAAKTVKHGAGAEISTVHPEQYAKRFLDFITNIFA

SEQ ID NO: 9043 - protein, 191 aa, Homo sapiens
KIEVIEIMTDRGSGKKRGFAFVTFDDHDSVDKIVIQKYHTVNGHNCEVRKALSKQEMASASSSQRGRSGSGNFGGGRGGGFGGNDNFGRGGNFSGRGGFGGSRGGGGYGGSGDGYNGFGNDGSNFGGGGSYNDFGNYNNQSSNFGPMKGGNFGGRSSGPYGGGGQYFAKPRNQGGYGGSSSSSSYGSGRRF

SEQ ID NO: 9044 - protein, 180 aa, Homo sapiens
MELTIFILRLAIYILTFPLYLLNFLGLWSWICKKWFPYFLVRFTVIYNEQMASKKRELFSNLQEFAGPSGKLSLLEVGCGTGANFKFYPPGCRVTCIDPNPNFEKFLIKSIAENRHLQFERFVVAAGENMHQVADGSVDVVVCTLVLCSVKNQERILREVCRVLRPGGAFYFMEHVAAEC

SEQ ID NO: 9045 - protein, 476 aa, Homo sapiens
MGLKKMKGLSYDEAFAMANDPLEGFHEVNLASPTSPDLLGVYESGTQEQTTSPSVIYRPHPSALSSVPIQANALDVSELPTQPVYSSPRRLNCAEISSISFHVTDPAPCSTSGVTAGLTKLTTRKDNYNAEREFLQGATITEACDGSDDIFGLSTDSLSRLRSPSVLEVREKGYERLKEELAKAQRELKLKDEECERLSKVRDQLGQELEELTASLFEEAHKMVREANIKQATAEKQLKEAQGKIDVLQAEVAALKTLVLSSSPTSPTQEPLPGGKTPFKKGHTRNKSTSSAMSGSHQDLSVIQPIVKDCKEADLSLYNEFRLWKDEPTMDRTCPFLDKIYQEDIFPCLTFSKSELASAVLEAVENNTLSIEPVGLQPIRFVKASAVECGGPKKCALTGQSKSCKHRIKLGDSSNYYYISPFCRYRITSVCNFFTYIRYIQQGLVKQQDVDQMFWEVMQLRKEMSLAKLGYFKEEL

SEQ ID NO: 9046 - protein, 111 aa, Homo sapiens
MDTMMLNVRNLFEQLVRRVEILSEGNEVQFIQLAKDFEDFRKKWQRTDHELGKYKDLLMKAETERSALDVKLKHARNQVDVEIKRRQRAEADCEKLERQIQLIREMLMCDT

SEQ ID NO: 9047 - protein, 107 aa, Homo sapiens
MIKNLEVQLRRATDEMKAYISSDQQEKRKAIREQYTKNTAEQENLGKKLREKQKVIRESHGPNMKQAKMWRDLEQLMECKKQCFLKQQSQTSIGQVIQEGGEDRLIL

SEQ ID NO: 9048 - protein, 923 aa, Homo sapiens
MCIPPPNVTGSLHIGHALTVAIQDALVRWHRMRGDQVLWVPGSDHAGIATQAVVEKQLWKERGVRRHELSREAFLREVWQWKEAKGGEICEQLRALGASLDWDRECFTMDVGSSVAVTEAFVRLYKAGLLYRNHQLVNWSCALRSAISDIEVENRPLPGHTQLRLPGCPTPVSFGLLFSVAFPVDGEPDAEVVVGTTRPETLPGDVAVAVHPDDSRYTHLHGRQLRHPLMGQPLPLITDYAVQPHVGTGAVKVTPAHSPADAEMGARHGLSPLNVIAEDGTMTSLCGDWLQGLHRFVAREKIMSVLSERGLFRGLQNHPMVLPICSRSGDVIEYLLKNQWFVRCQEMGARAAKAVESGALELSPSFHQKNWQHWFSHIGDWCVSRQLWWGHQIPAYLVVEDHAQGEEDCWVVGRSEAEAREVAAELTGRPGAELTLERDPDVLDTWFSSALFPFSALGWPQETPDLARFYPLSLLETGSDLLLFWVGRMVMLGTQLTGQLPFSKVLLHPMVRDRQGRKMSKSLGNVLDPRDIISGVEMQLLQEKLRSGNLDPAELAIVAAAQKKDFPHGIPECGTDALRFTLCSHGVQAGDLHLSVSEVQSCRHFCNKIWNALRFILNALGEKFVPQPAEELSPSSPMDAWILSRLALAAQECERGFLTRELSLVTHALHHFWLHNLCDVYLEAVKPVLWHSPRPLGPPQVLFSCADLGLRLLAPLMPFLAEELWQRLPPRPGCPPAPSISVAPYPSACSLEHWRQPELERRFSRVQEVVQVLRALRATYQLTKARPRVLLQSSEPGDQGLFEAFLEPLGTLGYCGAVGLLPPGTAAPSGWAQAPLSDTAQVYMELQGLVDPQIQLPLLAARRYKLQKQLDSLTARTPSEGEAGTQRQQKLSSLQLELSKLDKAASHLRQLMDEPPAPGSPEL

SEQ ID NO: 9049 - protein, 691 aa, Homo sapiens
MEESPLSRAPSRGGVNFLNVARTYIPNTKVECHYTLPPGTMPSASDWIGIFKVEAACVRDYHTFVWSSVPESTTDGSPIHTSVQFQASYLPKPGAQLYQFRYVNRQGQVCGQSPPFQFREPRPMDELVTLEEADGGSDILLVVPKATVLQNQLDESQQERNDLMQLKLQLEGQVTELRSRVQELERALATARQEHTELMEQYKGISRSHGEITEERDILSRQQGDHVARILELEDDIQTISEKVLTKEVELDRLRDTVKALTREQEKLLGQLKEVQADKEQSEAELQVAQQENHHLNLDLKEAKSWQEEQSAQAQRLKDKVAQMKDTLGQAQQRVAELEPLKEQLRGAQELAASSQQKATLLGEELASAAAARDRTIAELHRSRLEVAEVNGRLAELGLHLKEEKCQWSKERAGLLQSVEAEKDKILKLSAEILRLEKAVQEERTQNQVFKTELAREKDSSLVQLSESKRELTELRSALRVLQKEKEQLQEEKQELLEYMRKLEARLEKVADEKWNEDATTEDEEAAVGLSCPAALTDSEDESPEDMRLPPYGLCERGDPGSSPAGPREASPLVVISQPAPISPHLSGPAEDSSSDSEAEDEKSVLMAAVQSGGEEANLLLPELGSAFYDMASGFTVGTLSETSTGGPATPTWKECPICKERFPAESDKDALEDHMDGHFFFSTQDPFTFE

SEQ ID NO: 9050 - protein, 121 aa, Homo sapiens
MNESKPGDSQNLACVFCRKHDDCPNKYGEKKTKEKWNLTVHYYCLLMSSGIWQRGKEEEGVYGFLIEDIRKEVNRASKLKCCVCKKNGASIGCVAPRCKRSYHFPCGLQRECIFQFTGNFA

SEQ ID NO: 9051 - protein, 218 aa, Homo sapiens; identical to SEQ ID NO: 5651

SEQ ID NO: 9052 - protein, 632 aa, Homo sapiens; identical to SEQ ID NO: 5339

SEQ ID NO: 9053 - protein, 377 aa, Homo sapiens; identical to SEQ ID NO: 6495

SEQ ID NO: 9054 - protein, 377 aa, Homo sapiens; identical to SEQ ID NO: 6495

SEQ ID NO: 9055 - protein, 257 aa, Homo sapiens; identical to SEQ ID NO: 9005

SEQ ID NO: 9056 - protein, 481 aa, Homo sapiens; identical to SEQ ID NO: 6507

SEQ ID NO: 9057 - protein, 198 aa, Homo sapiens; identical to SEQ ID NO: 5709

SEQ ID NO: 9058 - protein, 114 aa, Homo sapiens
MTTRQATKDPLLRGVSPTPSKIPVRSQKRTPFPTVTSCAVDQENQDPRRWVQKPPLNIQRPLVDSAGPRPKARHQAETSQRLVGISQPRNPLEELRPSPRGQNVGPGPPAQTEA

SEQ ID NO: 9059 - protein, 481 aa, Homo sapiens; identical to SEQ ID NO: 6507

SEQ ID NO: 9060 - protein, 131 aa, Homo sapiens; identical to SEQ ID NO: 7306

SEQ ID NO: 9061 - protein, 254 aa, Homo sapiens; identical to SEQ ID NO: 5485

SEQ ID NO: 9062 - protein, 923 aa, Homo sapiens
MCIPPPNVTGSLHIGHALTVAIQDALVRWHRMRGDQVLWVPGSDHAGIATQAVVEKQLWKERGVRRHELSREAFLREVWQWKEAKGGEICEQLRALGASLDWDRECFTMDVGSSVAVTEAFVRLYKAGLLYRNHQLVNWSCALRSAISDIEVENRPLPGHTQLRLPGCPTPVSFGLLFSVAFPVDGEPDAEVVVGTTRPETLPGDVAVAVHPDDSRYTHLHGRQLRHPLMGQPLPLITDYAVQPHVGTGAVKVTPAHSPADAEMGARHGLSPLNVIAEDGTMTSLCGDWLQGLHRFVAREKIMSVLSEWGLFRGLQNHPMVLPICSRSGDVIEYLLKNQWFVRCQEMGARAAKAVESGALELSPSFHQKNWQHWFSHIGDWCVSRQLWWGHQIPAYLVVEDHAQGEEDCWVVGRSEAEAREVAAELTGRPGAELTLERDPDVLDTWFSSALFPFSALGWPQETPDLARFYPLSLLETGSDLLLFWVGRMVMLGTQLTGQLPFSKVLLHPMVRDRQGRKMSKSLGNVLDPRDIISGVEMQVLQEKLRSGNLDPAELAIVAAAQKKDFPHGIPECGTDALRFTLCSHGVQAGDLHLSVSEVQSCRHFCNKIWNALRFILNALGEKFVPQPAEELSPSSPMDAWILSRLALAAQECERGFLTRELSLVTHALHHFWLHNLCDVYLEAVKPVLWHSPRPLGPPQVLFSCADLGLRLLAPLMPFLAEELWQRLPPRPGCPPAPSISVAPYPSACSLEHWRQPELERRFSRVQEVVQVLRALRATYQLTKARPRVLLQSSEPGDQGLFEAFLEPLGTLGYCGAVGLLPPGAAAPSGWAQAPLSDTAQVYMELQGLVDPQIQLPLLAARRYKLQKQLDSLTARTPSEGEAGTQRQQKLSSLQLELSKLDKAASHLRQLMDEPPAPGSPEL

SEQ ID NO: 9063 - protein, 1742 aa, Homo sapiens
MMEGNGTENSCSRTRGWLQQDNDAKPWLWKFSNCFSRPEQTLPHSPQTKEYMENKKVAVELKDVPSPLHAGSKLFPAVPLPDIRSLQQPKIQLSSVPKVSCCAHCPNEPSTSPMRFGGGGGGSGGTSSLIHPGALLDSQSTRTITCQVGSGFAFQSASSLQNASARNNLAGIASDFPSMCLESNLSSCKHLPCCGKLHFQSCHGNVHKLHQFPSLQGCTSAGYFPCSDFTSGAPGHLEEHISQSELTPHLCTNSLHLNVVPPVCLKGSLYCEDCLNKPARNSIIDAAKVWPNIPPPNTQPAPLAVPLCNGCGTKGTGKETTLLLATSLGKAASKFGSPEVAVAGQVLENLPPIGVFWDIENCSVPSGRSATAVVQRIREKFFKGHREAEFICVCDISKENKEVIQELNNCQVTVAHINATAKNAADDKLRQSLRRFANTHTAPATVVLVSTDVNFALELSDLRHRHGFHIILVHKNQASEALLHHANELIRFEEFISDLPPRLPLKMPCHTLLYVYNLPANKDGKSVSNRLRRLSDNCGGKVLSITGCSAILRFINQDSAERAQKRMENEDVFGNRIIVSFTPKNRELCETKSSNAIADKVKSPKKLKNPKLCLIKDASEQSSSAKATPGKGSQANSGSATKNTNVKSLQELCRMESKTGHRNSEHQQGHLRLVVPTHGNSSAAVSTPKNSGVAEPVYKTSQKKENLSARSVTSSPVEKKDKEETVFQVSYPSAFSKLVASRQVSPLLASQSWSSSRSMSPNLLNRASPLAFNIANSSSEADCPDPFANGADVQVSNIDYRLSRKELQQLLQEAFARHGKVKSVELSPHTDYQLKAVVQMENLQDAIGAVNSLHRYKIGSKKILVSLATGAASKSLSLLSAETMSVLQDAPACCLPLFKFTDIYEKKFGHKLNVSDLYKLTDTVAIREQGNGRLVCLLPSSQARQSPLGSSQSHDGSSTNCSPIIFEELEYHEPVCRQHCSNKDFSEHEFDPDSYKIPFVILSLKTFAPQVHSLLQTHEGTVPLLSFPDCYIAEFGDLEVVQENQGGVPLEHFITCVPGVNIATAQNGIKVVKWIHNKPPPPNTDPWLLRSKSPVGNPQLIQFSREVIDLLKSQPSCVIPISHFIPSYHHHFAKQCRVSDYGYSKLIELLEAVPHVLQILGMGSKRLLTLTHRAQVKRFTQDLLKLLKSQASKQVIVREFSQAYHWCFSKDWDVTEYGVCELIDIVSEIPDTTICLSQQDNEMVICIPKRERTQDEIERTKQFSKDVVDLLRHQPHFRMPFNKFIPSYHHHFGRQCKLAYYGFTKLLELFEAIPDTLQVLECGEEKILTLTEVERFKALAAQFVKLLRSQKDNCLMMTDLLTEYAKTFGYTFRLQDYDVSSISALTQKLCHVVKVADIESGRQIQLINRKSLRSLTAQLLVLLMSWEGTTHLSVEELKRHYESTHNTPLNPCEYGFMTLTELLKSLPYLVEVFTNDKMEECVKLTSLYLFAKNVRSLLHTYHYQQIFLHEFSMAYTKYVGETLQPKTYGHSSVEELLGAIPQVVWIKGHGHKRIVVLKNDMKSRLSSLSLSPANHENQPSEGERILEVPESHTASELKLGADGSGPSHTEQELLRLTDDSPVDLLCAPVPSCLPSPQLRPDPVILQSADLIQFEERPQEPSEIMILNQEEKMEIPIPGKSKTLTSDSSSSCISAAVPVPPCPSSETSESLLSKDPVESPAKKQPKNRVKLAANFSLAPITKL

SEQ ID NO: 9064 - protein, 257 aa, Homo sapiens; identical to SEQ ID NO: 9005

SEQ ID NO: 9065 - protein, 377 aa, Homo sapiens; identical to SEQ ID NO: 6495

SEQ ID NO: 9066 - protein, 164 aa, Homo sapiens; identical to SEQ ID NO: 8707

SEQ ID NO: 9067 - protein, 130 aa, Homo sapiens
MDTMMLNVRNLFEQLVRRVEILSEGNEVQFIQLAKDFEDFRKKWQRTDHELGKYKDLLMKAETERSALDVKLKHARNQVDVEIKRRQRAEADCEKLERQIQLIREMLMCDTSGSIQLSEEQKSALAFLNR

SEQ ID NO: 9068 - protein, 107 aa, Homo sapiens
MDTMMLNVRNLFEQLVRRVEILSEGNEVQFIQLAKDFEDFRKKWQRTDHELGKYKDLLMKAETERSALDVKLKHARNQVDVEIKRRQRAEADCEKLERQIQLIREML

SEQ ID NO: 9069 - protein, 294 aa, Homo sapiens
MDTMMLNVRNLFEQLVRRVEILSEGNEVQFIQLAKDFEDFRKKWQRTDHELGKYKDLLMKAETERSALDVKLKHARNQVDVEIKRRQRAEADCEKLERQIQLIREMLMCDTSGSIQLSEEQKSALAFLNRGQPSSSNAGNKRLSTIDESGSILSDISFDKTDESLDWDSSLVKTFKLKKREKRRSTSRQFVDGPPGPVKKTRSIGSAVDQGNESIVAKTTVTVPNDGGPIEAVSTIETVPYWTRSRRKTGTLQPWNSDSTLNSRQLEPRTETDSVGTPQSNGGMRLHDFVSKTV

SEQ ID NO: 9070 - protein, 167 aa, Homo sapiens; identical to SEQ ID NO: 5257

SEQ ID NO: 9071 - protein, 293 aa, Homo sapiens
MLREPRKQGLAGRAHLLSPGTTGSMKTPVELAVSGMQTLGLQHRCRGGYRVKARTSYVDETLFGSPAGTRPTPPDFDPPWVEKANRTRGVGKEASKALGAKGSCETTPSRGSTPTLTPRKKNKYRPISHTPSYCDESLFGSRSEGASFGAPRMAKGDAAKLRALLWTPPPTPRGSHSPRPREAPLRAIHPAGPSKTEPGPAADSQKLSMGGLHSSRPLKRGLSHSLTHLNVPSTGHPATSAPHTNGPQDLRPSTSGVTFRSPLVTSRARSVSISVPSTPRRGGATQKPKPPWK

SEQ ID NO: 9072 - protein, 1093 aa, Homo sapiens; identical to SEQ ID NO: 9033

SEQ ID NO: 9073 - protein, 91 aa, Homo sapiens
MGKKTKRTADSSSSEDEEEYVVEKVLDRRVVKGQVEYLLKWKGFSEEHNTWEPEKNLDCPELISEFMKKYKKMKEGENNKPREKSESNKRK

SEQ ID NO: 9074 - protein, 129 aa, Homo sapiens; identical to SEQ ID NO: 6440

SEQ ID NO: 9075 - protein, 377 aa, Homo sapiens; identical to SEQ ID NO: 6495

SEQ ID NO: 9076 - protein, 676 aa, Homo sapiens; identical to SEQ ID NO: 4780

SEQ ID NO: 9077 - protein, 151 aa, Homo sapiens
MDTMMLNVRNLFEQLVRRVEILSEGNEVQFIQLAKDFEDFRKKWQRTDHELGKYKDLLMKAETERSALDVKLKHARNQVDVEIKRRQRAEADCEKLERQIQLIREMLMCDTSGSIQLSEEQKSALAFLNRGQPSSSNAGNKRLSTIDESGS

SEQ ID NO: 9078 - protein, 481 aa, Homo sapiens; identical to SEQ ID NO: 6507

SEQ ID NO: 9079 - protein, 254 aa, Homo sapiens; identical to SEQ ID NO: 5485

SEQ ID NO: 9080 - protein, 481 aa, Homo sapiens; identical to SEQ ID NO: 6507

SEQ ID NO: 9081 - protein, 657 aa, Homo sapiens
MLGPSWDGDEAESTGEIIRLGDTAHTFSLRSNGAQCPNEMLSKKALASPSSKSHEDMLYPPSVLSKSRTSFVEDTETLSVSGIPNARKLGEPIRAAIPLHPPYHPSEPRAPCPIGKEYLHSSHCSPAVNSTGEHTEFSGDLDDGLFLISKLPKGSKWEVYPAQVQGPRTRKPPKGKRNENRATASSCNSPFPQRPRKRLTEQELHDVSEKLSQRLSELDWMLKSALGDRIKEKTDHKEENTGNEEVEDGTEETLSQHSDGIVEYGPKKSRPGLSMRRKPPYRSHSLSPSPVNKHKQFHLERKRQRKPRETDVRQFQAQAFTEAFERELRRHKVQENIGPLRIHEKEEETEKIYRGEAVRKGTPECSQPWKIYSRKTTTQSLRGGLPKPNKAVPMKVSEHSLLPLMLEQFPFLYVSGPTLSKMWKQQIAQVEQLKKEACRENRSKKKLQDEIEEALRRHDLLTTLVKKEYEHNKRLQDFKDCIRRQRLTQSKIKENRQQIVRARKYYDDYRVQLCAKMMRMRTREEMIFKKLFEEGLNIQKQRLRDLRNYAKEKRDEQRRRHQDELDSMENYYKDQFSLLAEAISQEHQELKAREKSQAQTLHKVKRELRSKMEKEIQQLQDMITQNDDDVFFRELEAERFRSRLQLASFQYSKSPSL

SEQ ID NO: 9082 - protein, 168 aa, Homo sapiens
MQTFLKGKRVGYWLSEKKIKKLNFQAFAELCRKRGMEVVQLNLSRPIEEQGPLDVIIHKLTDVILEADQNDSQSLELVHRFQEYIDAHPETIVLDPLPAIRTLLDRSKSYELIRKIEAYMEDDRICSPPFMELTSLCGDDTMRLLEKNGLTFPFICKTRVAHGTNSHE

SEQ ID NO: 9083 - protein, 736 aa, Homo sapiens
MLIPALQISDSESVGLEDGIEQSAYLTESKMNESKPGDSQNLACVFCRKHDDCPNKYGEKKTKEKWNLTVHYYCLLMSSGIWQRGKEEEGVYGFLIEDIRKEVNRASKLKCCVCKKNGASIGCVAPRCKRSYHFPCGLQRECIFQFTGNFASFCWDHRPVQIITSNNYRESLPCTICLEFIEPIPSYNILRSPCCKNAWFHRDCLQVQAINAGVFFFRCTICNNSDIFQKEMLRMGIHIPEKDASWELEENAYQELLQHYERCDVRRCRCKEGRDYNAPDSKWEIKRCQCCGSSGTHLACSSLRSWEQNWECLECRGIIYNSGEFQKAKKHVLPNSNNVGITDCLLEESSPKLPRQSPGSQSKDLLRQGSKFRRNVSTLLIELGFQIKKKTKRLYINKANIWNSALDAFRNRNFNPSYAIEVAYVIENDNFGSEHPGSKQEFLSLLMQHLENSSLFEGSLSKNLSLNSQALKENLYYEAGKMLAISLVHGGPSPGFFSKTLFNCLVYGPENTQPILDDVSDFDVAQIIIRINTATTVADLKSIINECYNYLELIGCLRLITTLSDKYMLVKDILGYHVIQRVHTPFESFKQGLKTLGVLEKIQAYPEAFCSILCHKPESLSAKILSELFTVHTLPDVKALGFWNSYLQAVEDGKSTTTMEDILIFATGCSSIPPAGFKPTPSIECLHVDFPVGNKCNNCLAIPITNTYKEFQENMDFTIRNTLRLEKEESSHYIGH

SEQ ID NO: 9084 - protein, 376 aa, Homo sapiens
MANSANTNTVPKLYRSVIEDVINDVRDIFLDDGVDEQVLMELKTLWENKLMQSRAVDGFHSEEQQLLLQVQQQHQPQQQQHHHHHHHQQAQPQQTVPQQAQTQQVLIPASQQATAPQVIVPDSKLIQHMNASNMSAAATAATLALPAGVTPVQQILTNSGQLLQVVRAANGAQYIFQPQQSVVLQQQVIPQMQPGGVQAPVIQQVLAPLPGGISPQTGVIIQPQQILFTGNKTQVIPTTVAAPTPAQAQITATGQQQPQAQPAQTQAPLVLQVDGTGDTSSEEDEDEEEDYDDDEEEDKEKDGAEDGQVEEEPLNSEDDVSDEEGQELFDTENVVVCQYDKIHRSKNKWKFHLKDGIMNLNGRDYIFSKAIGDAEW

SEQ ID NO: 9085 - protein, 78 aa, Homo sapiens
METDCNPMELSSMSGFEEGSELNGFEGTDMKDMRLEAEAVVNDVLFAVNNMFVSKSLRCADDVAYINVETKERNRYCL

SEQ ID NO: 9086 - protein, 248 aa, Homo sapiens; identical to SEQ ID NO: 7960

SEQ ID NO: 9087 - protein, 789 aa, Homo sapiens
MSAQTSPAEKGLNPGLMCQESYACSGTDEAIFECDECCSLQCLRCEEELHRQERLRNHERIRLKPGHVPYCDLCKGLSGHLPGVRQRAIVRCQTCKINLCLECQKRTHSGGNKRRHPVTVYNVSNLQESLEAEEMDEETKRKKMTEKVVSFLLVDENEEIQVTNEEDFIRKLDCKPDQHLKVVSIFGNTGDGKSHTLNHTFFYGREVFKTSPTQESCTVGVWAAYDPVHKVAVIDTEGLLGATVNLSQRTRLLLKVLAISDLVIYRTHADRLHNDLFKFLGDASEAYLKHFTKELKATTARCGLDVPLSTLGPAVIIFHETVHTQLLGSDHPSEVPEKLIQDRFRKLGRFPEAFSSIHYKGTRTYNPPTDFSGLRRALEQLLENNTTRSPRHPGVIFKALKALSDRFSGEIPDDQMAHSSFFPDEYFTCSSLCLSCGVGCKKSMNHGKEGVPHEAKSRCRYSHQYDNRVYTCKACYERGEEVSVVPKTSASTDSPWMGLAKYAWSGYVIECPNCGVVYRSRQYWFGNQDPVDTVVRTEIVHVWPGTDGFLKDNNNAAQRLLDGMNFMAQSVSELSLGPTKAVTSWLTDQIAPAYWRPNSQILSCNKCATSFKDNDTKHHCRACGEGFCDSCSSKTRPVPERGWGPAPVRVCDNCYEARNVQLAVTEAQVDDEGGTLIARKVGEAVQNTLGAVVTAIDIPLGLVKDAARPAYWVPDHEILHCHNCRKEFSIKLSKHHCRACGQGFCDECSHDRRAVPSRGWDHPVRVCFNCNKKPAWTSLSVMTGKGPLC

SEQ ID NO: 9088 - protein, 756 aa, Homo sapiens
LAGNETEWVTIANNLLFKCHIHLRIHELQDCDANVFIALYQSILGEKVPDLIVIPRSQEDDAHNVQAVIDSLALDYLQVSLSHITALYSVSRRKYSERRMLGPSWDGDEAESTGEIIRLGDTAHTFSLRSNGAQCPNEMLSKKALASPSSKSHEDMLYPPSVLSKSRTSFVEDTETLSVSGIPNARKLGEPIRAAIPLHPPYHPSEPRAPCPIGKEYLHSSHCSPAVNSTGEHTEFSGDLDDGLFLISKLPKGSKWEVYPAQVQGPRTRKPPKGKRNENRATASSCNSPFPQRPRKRLTEQELHDVSEKLSQRLSELDWMLKSALGDRIKEKTDHKEENTGNEEVEDGTEETLSQHSDGIVEYGPKKSRPGLSMRRKPPYRSHSLSPSPVNKHKQFHLERKRQRKPRETDVRQFQAQAFTEAFERELRRHKVQENIGPLRIHEKEEETVGKNIQRRSFVKELQNVVSPGRFTLEKPQRRVRGGLPKPNKAVPMKVSEHSLLPLMLEQFPFLYVSGPTLSKMWKQQIAQVEQLKKEACRENRSKKKLQDEIEEALRRHDLLTTLVKKEYEHNKRLQDFKDCIRRQRLTQSKIKENRQQIVRARKYYDDYRVQLCAKMMRMRTREEMIFKKLFEEGLNIQKQRLRDLRNYAKEKRDEQRRRHQDELDSMENYYKDQFSLLAEAISQEHQELKAREKSQAQTLHKVKRELRSKMEKEIQQLQDMITQNDDDVFFRELEAERFRSRLQLASFQYSKSPSL

SEQ ID NO: 9089 - protein, 139 aa, Homo sapiens; identical to SEQ ID NO: 7777

SEQ ID NO: 9090 - protein, 99 aa, Homo sapiens
MTDTRRRVKVYTLNEDRQWDDRGTGHVSSGYVERLKGMSLLVRAESDGSLLLESKINPNTAYQKQQDTLIVWSEAENYDLALSFQEKAGCDEIWEKICQ

SEQ ID NO: 9091 - protein, 820 aa, Homo sapiens; identical to SEQ ID NO: 5658

SEQ ID NO: 9092 - protein, 131 aa, Homo sapiens
MNESKPGDSQNLACVFCRKHDDCPNKYGEKKTKEKWNLTVHYYCLLMSSGIWQRGKEEEGVYGFLIEDIRKEVNRASKLKCCVCKKNGASIGCVAPRCKRSYHFPCGLQRECIFQFTGNFASFCWDHRPVQ

SEQ ID NO: 9093 - protein, 1977 aa, Homo sapiens
MAARSAPSCHLRLEWVYGYRGHQCRNNLYYTAAKEIVYFVAGVGVVYSPREHRQKFYRGHSDDIISLALHPERVLVATGQVGKEPYICIWDSYTVQTISVLKDVHTHGIACLAFDLDGQRLVSVGLDSKNAVCVWDWKRGKMLSMAPGHTDRIFDISWDLYQPNKLVSCGVKHIKFWSLCGNALTPKRGVFGKTGDLQTILCLACARDELTYSGALNGDIYVWKGINLIRTIQGAHAAGIFSMNACEEGFATGGRDGCIRLWDLTFKPITVIDLRETDQGYKGLSVRSVCWRGDHILVGTQDSEIFEIVVQERNKPFLIMQGHCEGELWALAVHPTKPLAVTGSDDRSVRIWSLVDHALIARCNMEEPIRCAAVNADGIHLALGMKDGSFTVLRVRDMTEVVHIKDRKEAIHELKYSPDGTYLAVGCNDSSVDIYGVAQRYKKVGECLGSLSFITHLDWSSDSRYLQTNDGNGKRLFYRMPGGKEVTSTEEIKGVHWASWTCVSGLEVNGIWPKYSDINDINSVDGNYIGQVLVTADDYGIIKLFRYPCLRKGAKFRKYIGHSAHVTNVRWSHDYQWVISIGGADHSVFQWKFIPERKLKDAVHIAPQESLADSHSDESDSDLSDVPELDSEIEQETQLTYRRQVYKEDLPQLKEQCKEKQKSATSKRRERAPGNSIRLHFVHGYRGYDCRSNLFYTQIGEIVYHVAAVGVIYNRQQNTQRFYLGHDDDILCLTIHPLKDYVATGQVGRDPSIHIWDTETIKPLSILKGHHQYGVSAVDFSADGKRLASVGIDDSHTVVLWDWKKGEKLSIARGSKDKIFVVKMNPYVPDKLITAGIKHMKFWRKAGGGLIGRKGYIGTLGKNDTMMCAVYGWTEEMAFSGTSTGDVCIWRDIFLVKTVKAHDGPVFSMHALEKGFVTGGKDGIVALWDDSFERCLKTYAIKRAALAPGSKGLLLEDNPSIRAISLGHGHILVGTKNGEILEVDKSGPITLLVQGHMEGEVWGLATHPYLPICATVSDDKTLRIWDLSPSHCMLAVRKLKKGGRCCCFSPDGKALAVGLNDGSFLMANADTLEDLVSFHHRKDMISDIRFSPGSGKYLAVASHDSFIDIYNVMSSKRVGICKGATSYITHIDWDIRGKLLQVNTGAKEQLFFEAPRGKKQTIPSVEVEKIAWASWTSVLGLCCEGIWPVIGEVTDVTASCLTSDKMVLATGDDLGFVKLFRYPTKGKFGKFKRYVAHSTHVTNVRWTYDDSMLVTLGGTDMSLMVWTNEMEGYREKRPCDSEESDIDSEEDGGYDSDVTRENEISYTIRALSTNIRPMLGIKPHLQQKEPSIDERQGVVRGSRPPVSRAPPQPEKLQTNNVGKKKRPIEDLVLELIFGYRGRDCRNNVHYLNDGDDIIYHTASVGILHNVATGSQSFYQEHNDDILCLTVNQHPKFINIVATGQVGDSADMSATAPSIHIWDAMNKQTLSILRCYHSKGVCSVSFSATGKLLLSVGLDPEHTITIWRWQEGAKIASRAGHNQRIFVAEFRPDSDTQFVSVGVKHVKFWTLAGRALLSKKGLLSTLEDARMQTMLAIAFGANNLTFTGTISGDVCVWKDHILCRIVARAHNGPVFAMYTTLRDGLIVTGGKERPSKEGGAVKLWDQELRRCRAFRLETGQATDCVRSVCRGKGKILVGTRNAEIIEVGEKNAACNILVNGHVDGPIWGLATHPSRDFFLSAAEDGTVRLWDIADKKMLNKVNLGHAARTVCYSPEGDMVAIGMKNGEFIILLVSSLKIWGKKRDRRCAIHDIRFSPDSRYLAVGSSENSVDFYDLTLGPTLNRISYCKDIPSFVIQMDFSADSSYLQVSSGCYKRHVYEVPSGKHLMDHAAIDRITWATWTSILGDEVLGIWSRHAEKADVNCACVSHSGISLVTGDDFGMVKLFDFPCPEKFAKHKRFLGHSPHVTNIRFTSGDRHVVSAGGDDCSLFVWKCVHTPH

SEQ ID NO: 9094 - protein, 833 aa, Homo sapiens
MTDTRRRVKVYTLNEDRQWDDRGTGHVSSGYVERLKGMSLLVRAESDGSLLLESKINPNTAYQKQQDTLIVWSEAENYDLALSFQEKAGCDEIWEKICQVQGKDPSVDITQDLVDESEEERFDDMSSPGLELPSCELSRLEEIAELVASSLPSPLRREKLALALENEGYIKKLLELFHVCEDLENIEGLHHLYEIIKGIFLLNRTALFEVMFSEECIMDVIGCLEYDPALSQPRKHREFLTKTAKFKEVIPISDPELKQKIHQTYRVQYIQDMVLPTPSVFEENMLSTLHSFIFFNKVEIVGMLQEDEKFLTDLFAQLTDEATDEEKRQELVNFLKEFCAFSQTLQPQNRDAFFKTLSNMGILPALEVILGMDDTQVRSAATDIFSYLVEYNPSMVREFVMQEAQQNDDVSKKLTEQKITSKDILLINLIIEHMICDTDPELGGAVQLMGLLRTLVDPENMLATANKTEKTEFLGFFYKHCMHVLTAPLLANTTEDKPSKDDFQTAQLLALVLELLTFCVEHHTYHIKNYIINKDILRRVLVLMASKHAFLALCALRFKRKIIGLKDEFYNRYIMKSFLFEPVVKAFLNNGSRYNLMNSAIIEMFEFIRVEDIKSLTAHVIENYWKALEDVDYVQTFKGLKLRFEQQRERQDNPKLDSMRSILRNHRYRRDARTLEDEEEMWFNTDEDDMEDGEAVVSPSDKTKNDDDIMDPISKFMERKKLKESEEKEVLLKTNLSGRQSPSFKLSLSSGTKTNLTSQSSTTNLPGSPGSPGSPGSPGSPGSVPKNTSQTAAITTKGGLVGLVDYPDDDEDDDEDEDKEDTLPLSKKAKFDS

SEQ ID NO: 9095 - protein, 1328 aa, Homo sapiens
MWRRKHPRTSGGTRGVLSGNRGVEYGSGRGHLGTFEGRWRKLPKMPEAVGTDPSTSRKMAELEEVTLDGKPLQALRVTDLKAALEQRGLAKSGQKSALVKRLKGALMLENLQKHSTPHAAFQPNSQIGEEMSQNSFIKQYLEKQQELLRQRLEREAREAAELEEASAESEDEMIHPEGVASLLPPDFQSSLERPELELSRHSPRKSSSISEEKGDSDDEKPRKGERRSSRVRQARAAKLSEGSQPAEEEEDQETPSRNLRVRADRNLKTEEEEEEEEEEEEDDEEEEGDDEGQKSREAPILKEFKEEGEEIPRVKPEEMMDERPKTRSQEQEVLERGGRFTRSQEEARKSHLARQQQEKEMKTTSPLEEEEREIKSSQGLKEKSKSPSPPRLTEDRKKASLVALPEQTASEEETPPPLLTKEASSPPPHPQLHSEEEIEPMEGPAPAVLIQLSPPNTDADTRELLVSQHTVQLVGGLSPLSSPSDTKAESPAEKVPEESVLPLVQKSTLADYSAQKDLEPESDRSAQPLPLKIEELALAKGITEECLKQPSLEQKEGRRASHTLLPSHRLKQSADSSSSRSSSSSSSSSRSRSRSPDSSGSRSHSPLRSKQRDVAQARTHANPRGRPKMGSRSTSESRSRSRSRSRSASSNSRKSLSPGVSRDSSTSYTETKDPSSGQEVATPPVPQLQVCEPKERTSTSSSSVQARRLSQPESAEKHVTQRLQPERGSPKKCEAEEAEPPAATQPQTSETQTSHLPESERIHHTVEEKEEVTMDTSENRPENDVPEPPMPIADQVSNDDRPEGSVEDEEKKESSLPKSFKRKISVVSTKGVPAGNSDTEGGQPGRKRRWGASTATTQKKPSISITTESLKEAVVDLHADDSRISEDETERNGDDGTHDKGLKICRTVTQVVPAEGQENGQREEEEEEKEPEAEPPVPPQVSVEVALPPPAEHEVKKVTLGDTLTRRSISQQKSGVSITIDDPVRTAQVPSPPRGKISNIVHISNLVRPFTLGQLKELLGRTGTLVEEAFWIDKIKSHCFVTYSTVEEAVATRTALHGVKWPQSNPKFLCADYAEQDELDYHRGLLVDRPSETKTEEQGIPRPLHPPPPPPVQPPQHPRAEQREQERAVREQWAEREREMERRERTRSEREWDRDKVREGPRSRSRSRDRRRKERAKSKEKKSEKKEKAQEEPPAKLLDDLFRKTKAAPCIYWLPLTDSQIVQKEAERAERAKEREKRRKEQEEEEQKEREKEAERERNRQLEREKRREHSRERDRERERERERDRGDRDRDRERDRERGRERDRRDTKRHSRSRSRSTPVRDRGGRR

SEQ ID NO: 9096 - protein, 362 aa, Homo sapiens; identical to SEQ ID NO: 6853

SEQ ID NO: 9097 - protein, 139 aa, Homo sapiens; identical to SEQ ID NO: 7777

SEQ ID NO: 9098 - protein, 751 aa, Homo sapiens
MSEEELTKAMEGLGMDEGDGEGNILPIMQSIMQNLLSKDVLYPSLKEITEKYPEWLQSHRESLPPEQFEKYQEQHSVMCKICEQFEAETPTDSETTQKARFEMVLDLMQQLQDLGHPPKELAGEMLTWLFFCGSQWVYGPWLTYVGWLQQTSFKMSSKGSSTDGRTDLANGSLSSSPEEMSGAEEGRETSSGIEVEASDLSLSLTGDDGGPNRTSTESRGTDTESSGEDKDSDSMEDTGHYSINDENRVHDRSEEEEEEEEEEEEEQPRRRVQRKRANRDQDSSDDERALEDWVSSETSALPRPRWQALPALRERELGSSARFVYEACGARVFVQRFRLQHGLEGHTGCVNTLHFNQRGTWLASGSDDLKVVVWDWVRRQPVLDFESGHKSNVFQAKFLPNSGDSTLAMCARDGQVRVAELSATQCCKNTKRVAQHKGASHKLALEPDSPCTFLSAGEDAVVFTIDLRQDRPASKLVVTKEKEKKVGLYTIYVNPANTHQFAVGGRDQFVRIYDQRKIDENENNGVLKKFCPHHLVNSESKANITCLVYSHDGTELLASYNDEDIYLFNSSHSDGAQYVKRYKGHRNNATVKGVNFYGPKSEFVVSGSDCGHIFLWEKSSCQIIQFMEGDKGGVVNCLEPHPHLPVLATSGLDHDVKIWAPTAEASTELTGLKDVIKKNKRERDEDSLHQTDLFDSHMLWFLMHHLRQRRHHRRWREPGVGATDADSDESPSSSDTSDEEEGPDRVQCMPS

SEQ ID NO: 9099 - protein, 351 aa, Homo sapiens; identical to SEQ ID NO: 4991

SEQ ID NO: 9100 - protein, 195 aa, Homo sapiens
MPLPFGLKLKRTRRYTVSSKSCLVARIQLLNNEFVEFTLSVESTGQESLEAVAQRLELREVTYFSLWYYNKQNQRRWVDLEKPLKKQLDKYALEPTVYFGVVFYVPSVSQLQQEITRYQYYLQLKKDILEGSIPCTLEQAIQLAGLAVQADFGDFDQYESQDFLQKFALFPVGWLQDEKVLEEATQKVALLHQKY

SEQ ID NO: 9101 - protein, 117 aa, Homo sapiens
MGDKKSPTRPKRQPKPSSDEGYWDCSVCTFRNSAEAFKCMMCDVRKGTSTRDSKEGGKLVSYSTASLGVRGTLRNRVGGGSSEEKKQAEYLAPGRRRNIVHRGVGPGQRSGPSLKEA

SEQ ID NO: 9102 - protein, 1094 aa, Homo sapiens; identical to SEQ ID NO: 5061

SEQ ID NO: 9103 - protein, 450 aa, Homo sapiens
MREIVHIQAGQCGNQIGAKFWEVISDEHGIDPSGNYVGDSDLQLERISVYYNEASSHKYVPRAILVDLEPGTMDSVRSGAFGHLFRPDNFIFGQSGAGNNWAKGHYTEGAELVDSVLDVVRKECENCDCLQGFQLTHSLGGGTGSGMGTLLISKVREEYPDRIMNTFSVVPSPKVSDTVVEPYNATLSIHQLVENTDETYCIDNEALYDICFRTLKLATPTYGDLNHLVSATMSGVTTSLRFPGQLNADLRKLAVNMVPFPRLHFFMPGFAPLTARGSQQYRALTVPELTQQMFDAKNMMAACDPRHGRYLTVATVFRGRMSMKEVDEQMLAIQSKNSSYFVEWIPNNVKVAVCDIPPRGLKMSSTFIGNSTAIQELFKRISEQFTAMFRRKAFLHWYTGEGMDEMEFTEAESNMNDLVSEYQQYQDATAEEEGEMYEDDEEESEAQGPK

SEQ ID NO: 9104 - protein, 79 aa, Homo sapiens
MNESKPGDSQNLACVFCRKHDDCPNKYGEKKTKEKWNLTVHYYCLLMSSGIWQRGKEEEGVYGFLIEDIRKEVNRASKL

SEQ ID NO: 9105 - protein, 594 aa, Homo sapiens; identical to SEQ ID NO: 7579

SEQ ID NO: 9106 - protein, 179 aa, Homo sapiens
MAESSSESDHFRCRDRLSPWAARSTHRGTRSLPTVEVTEKVNTITSTLQDTSRNLRQVDQMLGRYREYSNGQAGAIEHLKESLEQSIDQLRSQRLLRNSGGRSISVTSLSASDLDGGTGSELHHFPPTSPLKDYGDPQGIKRMRSRTGVRFVQETDDMTQLHGFHQSLRDLSSEQIRLG

SEQ ID NO: 9107 - protein, 351 aa, Homo sapiens; identical to SEQ ID NO: 4991

SEQ ID NO: 9108 - protein, 109 aa, Homo sapiens
METDCNPMELSSMSGFEEGSELNGFEGTDMKDMRLEAEAVVNDVLFAVNNMFVSKSLRCADDVAYINVETKERNRYCLELTEAGLKVVGYAFDQVDDHLQTPYHETVYS

SEQ ID NO: 9109 - protein, 128 aa, Homo sapiens
MAESSSESDHFRCRDRLSPWAARSTHRGTRSLPTVEVTEKVNTITSTLQDTSRNLRQVDQMLGRYREYSNGQAGAIEHLKESLEQSIDQLRSQRLLRNSGGRSISVTSLSASDLDGGTGSELHHFPPT

SEQ ID NO: 9110 - protein, 122 aa, Homo sapiens; identical to SEQ ID NO: 5653

SEQ ID NO: 9111 - protein, 139 aa, Homo sapiens; identical to SEQ ID NO: 7777

SEQ ID NO: 9112 - protein, 1533 aa, Homo sapiens
MPVKRLREVVSQNHGDHLVLLKDELPCVPPALSANKRLPVGTGTSLNGTSRGSSDLTSARNCYQPLLENPMVSESDFSKDVAVQVLPLDKIEENNKQKANDIFISQYTMGQKDALRTVLKQKAQSMPVFKEVKVHLLEDAGIEKDAVTQETRISPSGIDSATTVAAATAAAIATAAPLIKVQSDLEAKVNSVTELLSKLQETDKHLQRVTEQQTSIQRKQEKLHCHDHEKQMNVFMEQHIRHLEKLQQQQIDIQTHFISAALKTSSFQPVSMPSSRAVEKYSVKPEHPNLGSCNPSLYNTFASKQAPLKEVEDTSFDKQKSPLETPAPRRFAPVPVSRDDELSKRENLLEEKENMEVSCHRGNVRLLEQILNNNDSLTRKSESSNTTSLTRSKIGWTPEKTNRFPSCEELETTKVTMQKSDDVLHDLGQKEKETNSMVQPKESLSMLKLPDLPQNSVKLQTTNTTRSVLKDAEKILRGVQNNKKVLEENLEAIIRAKDGAAMYSLINALSTNREMSEKIRIRKTVDEWIKTISAEIQDELSRTDYEQKRFDQKNQRTKKGQNMTKDIRTNTQDKTVNKSVIPRKHSQKQIEEHFRNLPMRGMPASSLQKERKEGLLKATTVIQDEDYMLQVYGKPVYQGHRSTLKKGPYLRFNSPSPKSRPQRPKVIERVKGTKVKSIRTQTDFYATKPKKMDSKMKHSVPVLPHGDQQYLFSPSREMPTFSGTLEGHLIPMAILLGQTQSNSDTMPPAGVIVSKPHPVTVTTSIPPSSRKVETGVKKPNIAIVEMKSEKKDPPQLTVQVLPSVDIDSISNSSADVLSPLSSPKEASLPPVQTWIKTPEIMKVDEEEVKFPGTNFDEIIDVIQEEEKCDEIPDSEPILEFNRSVKADSTKYNGPPFPPVASTFQPTADILDKVIERKETLENSLIQWVEQEIMSRIISGLFPVQQQIAPSISVSVSETSEPLTSDIVEGTSSGALQLFVDAGVPVNSNVIKHFVNEALAETIAVMLGDREAKKQGPVATGVSGDASTNETYLPARVCTPLPTPQPTPPCSPSSPAKECVLVKTPDSSPCDSDHDMAFPVKEICAEKGDDMPAIMLVNTPTVTPTTTPPPAAAVFTPTLSDISIDKLKVSSPELPKPWGDGDLPLEEENPNSPQEELHPRAIVMSVAKDEEPESMDFPAQPPPPEPVPFMPFPAGTKAPSPSQMPGSDSSTLESTLSVTVTETETLDKPISEGEILFSCGQKLAPKILEDIGLYLTNLNDSLSSTLHDAVEMEDDPPSEGQVIRMSHKKFHADAILSFAKQNQESAVSQQAVYHSEDLENSVGELSEGQRPQLTAAAENILMGHSLYMQPPVTNTQSLDQQCDPKPLSRQFDTVSGSIYEDSCASHGPMSLGELELEPNSKLVLPTTLLTAQENDVNLPVAAEDFSQYQLKQNQDVKQVEHKPSQSYLRVRNKSDIAPSQQQVSPGDMDRTQIELNPYLTCVFSGGKAVPLSASQMPPAKMSVMLPSVNLEDCSQSLSLSTMQEDMESSGADTF

SEQ ID NO: 9113 - protein, 777 aa, Homo sapiens
MSAQTSPAEKGLNPGLMCQESYACSGTDEAIFECDECCSLQCLRCEEELHRQERLRNHERIRLKPGHVPYCDLCKGLSGHLPGVRQRAIVRCQTCKINLCLECQKRTHSGGNKRRHPVTVYNVSNLQESLEAEEMDEETKRKKMTEKVVSFLLVDENEEIQVTNEEDFIRKLDCKPDQHLKVVSIFGNTGDGKSHTLNHTFFYGREVFKTSPTQESCTVGVWAAYDPVHKVAVIDTEGLLGATVNLSQRTRLLLKVLAISDLVIYRTHADRLHNDLFKFLGDASEAYLKHFTKELKATTARCGLDVPLSTLGPAVIIFHETVHTQLLGSDHPSEVPEKLIQDRFRKLGRFPEAFSSIHYKGTRTYNPPTDFSGLRRALEQLLENNTTRSPRHPGVIFKALKALSDRFSGEIPDDQMAHSSFFPDEYFTCSSLCLSCGVGCKKSMNHGKEGVPHEAKSRCRYSHQYDNRVYTCKACYERGEEVSVVPKTSASTDSPWMGLAKYAWSGYVIECPNCGVVYRSRQYWFGNQDPVDTVVRTEIVHVWPGTDGFLKDNNNAAQRLLDGMNFMAQSVSELSLGPTKAVTSWLTDQIAPAYWRPNSQILSCNKCATSFKDNDTKHHCRACGEGFCDSCSSKTRPVPERGWGPAPVRVCDNCYEARNVQLAVTEAQVDDEGGTLIARKVGEAVQNTLGAVVTAIDIPLGLVKDAARPAYWVPDHEILHCHNCRKEFSIKLSKHHCRACGQGFCDECSHDRRAVPSRGWDHPVRVCFNCNKKPGDL

SEQ ID NO: 9114 - protein, 288 aa, Homo sapiens
MEKLSALQEQKGELRKRLSYTTHKLEKLETEFDSTRHYLEIELRRAQEELEKVTEKLRRIQSNYMALQRINQELEDKLYRMGQHYEEEKRALSHEIVALNSHLLEAKVTIDKLSEDNELYRKDCNLAAQLLQCSQTYGRVHKVSELPSDFQERVSLHMEKHGCSLPSPLCHPAYADSVPTCVIAKVLEKPDPASLSSRLSDASARDLAFCDGVEKPGPRPPYKGDIYCSDTALYCPEERRRDRRPSVDAPVTDVGFLRAQNSTDSAAEEEEEAEAAAFPAGFQHEAFP

SEQ ID NO: 9115 - protein, 420 aa, Homo sapiens
  MOD_RES (1)..(1): Any amino acid
XTQAMALETPTPGPPREGQSPASQAGTQHPPAQATAHSQSSPEFKGSLASLSDSLGVSVMATDQDSYSTSSTEEELEQFSSPSVKKKPSMILGKARHRLSFASFSSMFHAFLSNNRKLYKKVVELAQDKGSYFGSLVQDYKVYSLEMMARQTSSTEMLQEIRTMMTQLKSYLLQSTELKALVDPALHSEEELEAIVESALYKCVLKPLKEAINSCLHQIHSKDGSLQQLKENQLVILATTTTDLGVTTSVPEVPMMEKILQKFTSMHKAYSPEKKISILLKTCKLIYDSMALGNPGKPYGADDFLPVLMYVLARSNLTEMLLNVEYMMELMDPALQLGEGSYYLTTTYGALEHIKSYDKITVTRQLSVEVQDSIHRWERRRTLNKARASRSSVQVRPESGRGPVGPCPRHHPCCLLAKEP

SEQ ID NO: 9116 - protein, 821 aa, Homo sapiens
MAGSDAEWVTIANNLLFKCHIHLRIHELQDCDANVFIALYQSILGEKVPDLIVIPRSQEDDAHNVQAVIDSLALDYLQVSLSHITGENIVKGDKESIKNLLEIFDGLLEYLTERISETSHEKSETEQYFKESDRGERLEEPESTKESKSSWKRVSFGRCSLSSEMLGPSWDGDEAESTGEIIRLGDTAHTFSLRSNGAQCPNEMLSKKALASPSSKSHEDMLYPPSVLSKSRTSFVEDTETLSVSGIPNARKLGEPIRAAIPLHPPYHPSEPRAPCPIGKEYLHSSHCSPAVNSTGEHTEFSGDLDDGLFLISKLPKGSKWEVYPAQVQGPRTRKPPKGKRNENRATASSCNSPFPQRPRKRLTEQELHDVSEKLSQRLSELDWMLKSALGDRIKEKTDHKEENTGNEEVEDGTEETLSQHSDGIVEYGPKKSRPGLSMRRKPPYRSHSLSPSPVNKHKQFHLERKRQRKPRETDVRQFQAQAFTEAFERELRRHKVQENIGPLRIHEKEEETEKIYRGEAVRKGTPECSQPWKIYSRKTTTQSLRGGLPKPNKAVPMKVSEHSLLPLMLEQFPFLYVSGPTLSKMWKQQIAQVEQLKKEACRENRSKKKLQDEIEEALRRHDLLTTLVKKEYEHNKRLQDFKDCIRRQRLTQSKIKENRQQIVRARKYYDDYRVQLCAKMMRMRTREEMIFKKLFEEGLNIQKQRLRDLRNYAKEKRDEQRRRHQDELDSMENYYKDQFSLLAEAISQEHQELKAREKSQAQTLHKVKRELRSKMEKEIQQLQDMITQNDDDVFFRELEAERFRSRLQLASFQYSKSPSL

SEQ ID NO: 9117 - protein, 1519 aa, Homo sapiens
MRIPDQKYVTLKLNDVIRFGYDSNMYVLERVQHRVPEEALKHEKYTSQLQVSVKGLAPKRSEALPEHTPYCEASNPRPEKGDRRPGTEAASYRTPLYGQPSWWGEDDGSTLPDAQRQGEPYPERPKGPVQQDGELHGFRAPAEPQGCSFRREPSYFEIPTKETPQPSQPPEVPAHEMPTKDAEAGGGGAAPVVQSHASFTIEFDDCSPGKMKIKDHITKFSLRQRRPPGKEATPGEMVSAETKVADWLVQNDPSLLHRVGPGDDRHSTKSDLPVHTRTLKGHKHEDGTQSDSEDPLAKAASAAGVPLEASGEQVRLQRQIKRDPQELLHNQQAFVIEFFDEDTPRKKRSQSFTHSPSGDPKADKRRGPTPADRDRPSVPAPVQAGGRSSGPQRAGSLKREKTEERLGSPSPASRTPARPFGSVGRRSRLAQDFMAQCLRESSPAARPSPEKVPPVLPAPLTPHGTSPVGPPTPPPAPTDPQLTKARKQEEDDSLSDAGTYTIETEAQDTEVEEARKMIDQVFGVLESPELSRASSATFRPVIRGDRDESDDGGVAQRMALLQEFASRPLGAAPQAEHQGLPVPGSPGGQKWVSRWASLADSYSDPGLTEDGLGRRGGEPEGSLPVRMRRRLPQLPSERADSPAGPESSRRSGPGPPELDSEQPSRLFGQEELDPDSLSDASGSDGGRGPEPGVEPQDSRRRSPQEGPTWSRGRRSPRAPGEPTPASFFIGDQNGDAVLSRKPLAAPGDGEGLGQTAQPSPPARDGVYVSANGRMVIQLRPGRSPEPDGPAPAFLRQESFTKEPASGPPAPGKPPHISSHPLLQDLAATRAARMDFHSQDTHLILKETETALAALEARLLSNSVDAECEGGSTPRPPEDALSGDSDVDTASTVSLRSGKSGPSPTTPQPLRAQKEMSPSPPAAQDPGGTALVSAREQSSERQHHPLGPTDMGRGEPVRRSAIRRGHRPRGSLDWPSEERGPVLAHLPSSDVMASNHETPEATGAGRLGSRRKPAAPPPSPAAREEQSRSSASSQKGPQALTRSNSLSTPRPTRASRLRRARLGDASDTEAADGERGSLGNPEPVGRPAAEQAKKLSRLDILAMPRKRAGSFTGTSDPEAAPARTSFSGRSVELCCASRKPTMAEARAVSRKAANTATTTGPRQPFSRARSGSARYTSNTRRRQQGSDYTSTSEEEYGSRHGSPKHTRSHTSTATQTPRAGSSSRARSRAPGPRDTDDDEEEPDPYGFIVQTAEIAEIARLSQTLVKDVAILAQEIHDVAGDGDTLGSSEPAHSASLSNMPSTPASTISAREELVQRIPEASLNFQKVPPGSLNSRDFDQNMNDSCEDALANKTRPRNREEVIFDNLMLNPVSQLSQAIRENTEHLAEKMKILFQNTGRAWEDLEARINAENEVPILKTSNKEISSILKELRRVQKQLEVINAIVDPSGSLDLLTGNRSLASSAQPGLGKGRVAAQSPPSPASAEALLPALPLRNFPQRASCGPPSLPDPTFLPDAERFLI

SEQ ID NO: 9118 - protein, 125 aa, Homo sapiens; identical to SEQ ID NO: 5274

SEQ ID NO: 9119 - protein, 1174 aa, Homo sapiens [sequence omitted]

SEQ ID NO: 9120 - protein, 414 aa, Homo sapiens; identical to SEQ ID NO: 4993

SEQ ID NO: 9121 - protein, 751 aa, Homo sapiens; identical to SEQ ID NO: 9098

SEQ ID NO: 9122 - protein, 351 aa, Homo sapiens; identical to SEQ ID NO: 5186

SEQ ID NO: 9123 - protein, 797 aa, Homo sapiens
MAVQGSQRRLLGSLNSTPTAIPQLGLAANQTGARCLEVSISDGLFLSLGLVSLVENALVVATIAKNRNLHSPMYCFICCLALSDLLVSGSNVLETAVILLLEAGALVARAAVLQQLDNVIDVITCSSMLSSLCFLGAIAVDRYISIFYALRYHSIVTLPRARRAVAAIWVASVVFSTLFIAYYDHVAVLLCLVVFFLAMLVLMAVLYVHMLARACQHAQGIARLHKRQRPVHQGFGLKGAVTLTILLGIFFLCWGPFFLHLTLIVLCPEHPTCGCIFKNFNLFLALIICNAIIDPLIYAFHSQELRRTLKEVLTCSCSQDRALVSWDVKSLGGSVCQELLPQQPQEKGLCDQKASSTALQRLLQKEFWEVISDEHGIDPSGNYVGDSDLQLERISVYYNEASSHKYVPRAILVDLEPGTMDSVRSGAFGHLFRPDNFIFGQSGAGNNWAKGHYTEGAELVDSVLDVVRKECENCDCLQGFQLTHSLGGGTGSGMGTLLISKVREEYPDRIMNTFSVVPSPKVSDTVVEPYNATLSIHQLVENTDETYCIDNEALYDICFRTLKLATPTYGDLNHLVSATMSGVTTSLRFPGQLNADLRKLAVNMVPFPRLHFFMPGFAPLTARGSQQYRALTVPELTQQMFDAKNMMAACDPRHGRYLTVATVFRGRMSMKEVDEQMLAIQSKNSSYFVEWIPNNVKVAVCDIPPRGLKMSSTFIGNSTAIQELFKRISEQFTAMFRRKAFLHWYTGEGMDEMEFTEAESNMNDLVSEYQQYQDATAEEEGEMYEDDEEESEAQGPK

SEQ ID NO: 9124 - protein, 32 aa, Homo sapiens
MAESSSESDHFRCRDRLSPWAARSTHRGTRSL

SEQ ID NO: 9125 - protein, 150 aa, Homo sapiens
MTDTRRRVKVYTLNEDRQWDDRGTGHVSSGYVERLKGMSLLVRAESDGSLLLESKINPNTAYQKQQDTLIVWSEAENYDLALSFQEKAGCDEIWEKICQVQGKDPSVDITQDLVDESEEERFDDMSSPGLELPSCELSRLEEIAELVASS

SEQ ID NO: 9126 - protein, 167 aa, Homo sapiens
MDWKEVLRRRLATPNTCPNKKKSEQELKDEEMDLFTKYYSEWKGGRKNTNEFYKTIPRFYYRLPAEDEVLLQKLREESRAVFLQRKSRELLDNEELQNLWFLLDKHQTPPMIGEEAMINYENFLKVGEKAGAKCKQFFTAKVFAKLLHTDSYGRISIMQFFNYVMRK

SEQ ID NO: 9127 - protein, 168 aa, Homo sapiens; identical to SEQ ID NO: 9082

SEQ ID NO: 9128 - protein, 273 aa, Homo sapiens
MPGLSCRFYQHKFPEVEDVVMVNVRSIAEMGAYVSLLEYNNIEGMILLSELSRRRIRSINKLIRIGRNECVVVIRVDKEKGYIDLSKRRVSPEEAIKCEDKFTKSKTVYSILRHVAEVLEYTKDEQLESLFQRTAWVFDDKYKRPGYGAYDAFKHAVSDPSILDSLDLNEDEREVLINNINRRLTPQAVKIRADIEVACYGYEGIDAVKEALRAGLNCSTENMPIKINLIAPPRYVMTTTTLERTEGLSVLSQAMAVIKEKIEEKRGVFNVQM

SEQ ID NO: 9129 - protein, 918 aa, Homo sapiens
  MOD_RES (1)..(1): Any amino acid
XRTNSRFVKVVLMSATISCKEFADYFAVPVQNKMNPAYIFEVEGKPHSVEEYYLNDLEHIHHSKLSPHLLEEPVITKDIYEVAVSLIQMFDDLDMKESGNKAWSGAQFVLERSSVLVFLPGLGEINYMHELLTSLVHKRLQVYPLHSSVALEEQNNVFLSPVPGYRKIILSTNIAESSVTVPDVKYVIDFCLTRTLVCDEDTNYQSLRLSWASKTSCNQRKGRAGRVSRGYCYRLVHKDFWDNSIPDHVVPEMLRCPLGSTILKVKLLDMGEPRALLATALSPPGLSDIERTILLLKEVGALAVSGQREDENPHDGELTFLGRVLAQLPVNQQLGKLIVLGHVFGCLDECLIIAAALSLKNFFAMPFRQHLDGYRNKVNFSGSSKSDCIALVEAFKTWKACRQTGELRYPKDELNWGRLNYIQIKRIREVAELYEELKTRISQFNMHVDSRRPVMDQEYIYKQRFILQVVLAGAFYPNYFTFGQPDEEMAVRELAGKDPKTTVVLKHIPPYGFLYYKQLQSLFRQCGQVKSIVFDGAKAFVEFSRNPTERFKTLPAVYMAIKMSQLKVSLELSVHSAEEIEGKVQGMNVSKLRNTRVNVDFQKQTVDPMQVSFNTSDRSQTVTDLLLTIDVTEVVEVGHFWGYRIDENNSEILKKLTAEINQLTLVPLPTHPHPDLVCLAPFADFDKQRYFRAQVLYVSGNSAEVFFVDYGNKSHVDLHLLMEIPCQFLELPFQALEFKICKMRPSAKSLVCGKHWSDGASQWFASLVSGCTLLVKVFSVVHSVLHVDVYQYSGVQDAINIRDVLIQQGYAELTEESYESKVNILRAAINKLVCDGPNGCKCLGPERVAQLQDIARQKLLGLFCQSKPREKIVPKWHEKPYEWNQVDPKLVMEQADRESSRGKNTFLYQLHKLVVLGT

SEQ ID NO: 9130 - protein, 168 aa, Homo sapiens
MEKLSALQEQKGELRKRLSYTTHKLEKLETEFDSTRHYLEIELRRAQEELEKVTEKLRRIQSNYMALQRINQELEDKLYRMGQHYEEEKRALSHEIVALNSHLLEAKVTIDKLSEDNELYRKDCNLAAQLLQCSQTYGRVHKVSELPSDFQERVSLHMEKHGCSLPSP

SEQ ID NO: 9131 - protein, 211 aa, Homo sapiens
MDMGNQHPSISRLQEIQKEVKSVEQQVIGFSGLSDDKNYKKLERILTKQLFEIDSVDTEGKGDIQQARKRAAQETERLLKELEQNANHPHRIEIQNIFEEAQSLVREKIVPFYNGGNCVTDEFEEGIQDIILRLTHVKTGGKISLRKARYHTLTKICAVQEIIEDCMKKQPSLPLSEDAHPSVAKINFVMCEVNKARGVLIALLMGVNNNE

SEQ ID NO: 9132 - protein, 994 aa, Homo sapiens
MSQWTPEYNELYTLKVDMKSEIPSDAPKTQESLKGILLHPEPIGAAKSFPAGVEMINSKVGNEFSHLCDDSQKQEKEMNGNQQEQEKSLVVRKKRKSQQAGPSYVQNCVKENQGILGLRQHLGTPSDEDNDSSFSDCLSSPSSSLHFGDSDTVTSDEDKEVSVRHSQTILNAKSRSHSARSHKWPRTETESVSGLLMKRPCLHGSSLRRLPCRKRFVKNNSSQRTQKQKERILMQRKKREVLARRKYALLPSSSSSSENDLSSESSSSSSTEGEEDLFVSASENHQNNPAVPSGSIDEDVVVIEASSTPQVTANEEINVTSTDSEVEIVTVGESYRSRSTLGHSRSHWSQGSSSHASRPQEPRNRSRISTVIQPLRQNAAEVVDLTVDEDEPTVVPTTSARMESQATSASINNSNPSTSEQASDTASAVTSSQPSTVSETSATLTSNSTTGTSIGDDSRRTTSSAVTETGPPAMPRLPSCCPQHSPCGGSSQNHHALGHPHTSCFQQHGHHFQHHHHHHHTPHPAVPVSPSFSDPACPVERPPQVQAPCGANSSSGTSYHEQQALPVDLSNSGIRSHGSGSFHGASAFDPCCPVSSSRAAIFGHQAAAAAPSQPLSSIDGYGSSMVAQPQPQPPPQPSLSSCRHYMPPPYASLTRPLHHQASACPHSHGNPPPQTQPPPQVDYVIPHPVHAFHSQISSHATSHPVAPPPPTHLASTAAPIPQHLPPTHQPISHHIPATAPPAQRLHPHEVMQRMEVQRRRMMQHPTRAHERPPPHPHRMHPNYGHGHHIHVPQTMSSHPRQAPERSAWELGIEAGVTAATYTPGALHPHLAHYHAPPRLHHLQLGALPLMVPDMAGYPHIRYISSGLDGTSFRGPFRGNFEELIHLEERLGNVNRGASQGTIERCTYPHKYKKVTTDWFSQRKLHCKQDGEEGTEEDTEEKCTICLSILEEGEDVRRLPCMHLFHQVCVDQWLITNKKCPICRVDIEAQLPSES

SEQ ID NO: 9133 - protein, 385 aa, Homo sapiens; identical to SEQ ID NO: 5529

SEQ ID NO: 9134 - protein, 2487 aa, Homo sapiens
  MOD_RES (1)..(1): Any amino acid
XEEEEDDDDEEEEVSEVESFILDQDDLENPMLETASKLLLSGTADGADLRTVDPETQARLEALLEAAGIGKLSTADGKAFADPEVLRRLTSSVSCALDEAAAALTRMRAESTANAGQSDNRSLAEACSEGDVNAVRKLLIEGRSVNEHTEEGESLLCLACSAGYYELAQVLLAMHANVEDRGIKGDITPLMAAANGGHVKIVKLLLAHKADVNAQSSTGNTALTYACAGGYVDVVKVLLESGASIEDHNENGHTPLMEAGSAGHVEVARLLLENGAGINTHSNEFKESALTLACYKGHLEMVRFLLEAGADQEHKTDEMHTALMEACMDGHVEVARLLLDSGAQVNMPADSFESPLTLAACGGHVELAALLIERGASLEEVNDEGYTPLMEAAREGHEEMVALLLGQGANINAQTEETQETALTLACCGGFLEVADFLIKAGADIELGCSTPLMEAAQEGHLELVKYLLAAGANVHATTATGDTALTYACENGHTDVADVLLQAGADLEHESEGGRTPLMKAARAGHVCTVQFLISKGANVNRTTANNDHTVLSLACAGGHLAVVELLLAHGADPTHRLKDGSTMLIEAAKGGHTSVVCYLLDYPNNLLSAPPPDVTQLTPPSHDLNRAPRVPVQALPMVVPPQEPDKPPANVATTLPIRNKAASKQKSSSHLPANSQDVQGYITNQSPESIVEEAQGKLTELEQRIKEAIEKNAQLQSLELAHADQLTKEKIEELNKTREEQIQKKQKILEELQKVERELQLKTQQQLKKQYLEVKAQRIQLQQQQQQSCQHLGLLTPVGVGEQLSEGDYARLQQVDPVLLKDEPQQTAAQMGFAPIQPLAMPQALPLAAGPLPPGSIANLTELQGVIVGQPVLGQAQLAGLGQGILTETQQGLMVASPAQTLNDTLDDIMAVSGRASAMSNTPTHSIAASISQPQTPTPSPIISPSAMLPIYPAIDIDAQTESNHDTALTLACAGGHEELVQTLLERGASIEHRDKKGFTPLILAATAGHVGVVEILLDNGADIEAQSERTKDTPLSLACSGGRQEVVELLLARGANKEHRNVSDYTPLSLAASGGYVNIIKILLNAGAEINSRTGSKLGISPLMLAAMNGHTAAVKLLLDMGSDINAQIETNRNTALTLACFQGRTEVVSLLLDRKANVEHRAKTGLTPLMEAASGGYAEVGRVLLDKGADVNAPPVPSSRDTALTIAADKGHYKFCELLIGRGAHIDVRNKKGNTPLWLAANGGHLDVVQLLVQAGADVDAADNRKITPLMAAFRKGHVKVVRYLVKEVNQFPSDSECMRYIATITDKEMLKKCHLCMESIVQAKDRQAAEANKNASILLEELDLEKLREESRRLALAAKREKRKEKRRKKKEEQRRKLEEIEAKNKENFELQAAQEKEKLKVEDEPEVLTEPPSATTTTTIGISATWTTLAGSHGKRNNTITTTSSKRKNRKNKITPENVQIIFDDPLPISYSQPEKVNGESKSSSTSESGDSDNMRISSCSDESSNSNSSRKSDNHSPAVVTTTVSSKKQPSVLVTFPKEERKSVSGKASIKLSETISEGTSNSLSTCTKSGPSPLSSPNGKLTVASPKRGQKREEGWKEVVRRSKKVSVPSTVISRVIGRGGCNINAIREFTGAHIDIDKQKDKTGDRIITIRGGTESTRQATQLINALIKDPDKEIDELIPKNRLKSSSANSKIGSSAPTTTAANTSLMGIKMTTVALSSTSQTATALTVPAISSASTHKTIKNPVNNVRPGFPVSLPLAYPPPQFAHALLAAQTFQQIRPPRLPMTHFGGTFPPAQSTWGPFPVRPLSPARATNSPKPHMVPRHSNQNSSGSQVNSAGSLTSSPTTTTSSSASTVPGTSTNGSPSSPSVRRQLFVTVVKTSNATTTTVTTTASNNNTAPTNATYPMPTAKEHYPVSSPSSPSPPAQPGGVSRNSPLDCGSASPNKVASSSEQEAGSPPVVETTNTRPPNSSSSSGSSSAHSNQQQPPGSVSQEPRPPLQQSQVPPPEVRMTVPPLATSSAPVAVPSTAPVTYPMPQTPMGCPQPTPKMETPAIRPPPHGTTAPHKNSASVQNSSVAVLSVNHIKRPHSVPSSVQLPSTLSTQSACQNSVHPANKPIAPNFSAPLPFGPFSTLFENSPTSAHAFWGGSVVSSQSTPESMLSGKSSYLPNSDPLHQSDTSKAPGFRPPLQRPAPSPSGIVNMDSPYGSVTPSSTHLGNFASNISGGQMYGPGAPLGGAPAAANFNRQHFSPLSLLTPCSSASNDSSAQSVSSGVRAPSPAPSSVPLGSEKPSNVSQDRKVPVPIGTERSARIRQTGTSAPSVIGSNLSTSVGHSGIWSFEGIGGNQDKVDWCNPGMGNPMIHRPMSDPGVFSQHQAMERDSTGIVTPSGTFHQHVPAGYMDFPKVGGMPFSVYGNAMIPPVAPIPDGAGGPIFNGPHAADPSWNSLIKMVSSSTENNGPQTVWTGPWAPHMNSVHMNQLG

SEQ ID NO: 9135 - protein, 10 aa, Homo sapiens
MALPHDSNET

SEQ ID NO: 9136 - protein, 153 aa, Homo sapiens
MATMIPPVKLKWLEHLNSSWITEDSESIATREGVAVLYSKLVSNKEVVPLPQQVLCLKGPQLPDFERESLSSDEQDHYLDALLSSQLALAKMVCSDSPFAGALRKRLLVLQRVFYALSNKYHDKGKVKQQQHSPESSSGSADVHSVSERPRSS

SEQ ID NO: 9137 - protein, 36 aa, Homo sapiens
MLPPKHLSATKPKKSWAPNLYELDSDLTKEPDVIIG

SEQ ID NO: 9138 - protein, 104 aa, Homo sapiens
MAQSGGEARPGPKTAVQIRVAIQEAEDVDELEDEEEGAETRGAGDPARYLSPGWGSASEEEPSRGHRTAQLPWLESQQVFSLKPFLLPTGIELTPENPWGSSVS

SEQ ID NO: 9139 - protein, 214 aa, Homo sapiens
MALPHDSNETSYLLPPNNEDWGRQTIPDFVYGQKDLMAEGIQWPRNAPGIPDALPQSPFDAALCSAWKQRVELGLFRYRLRELQTQILPGAVGFVAQLNVERGVQRRPPQTIKSVRQAFDPVQFNFNKIRPGEVLFRLHREPDLPGTLLQEDILVVINVSPLEWGHVLLVPEPARQLPQRLLPGALRAGIEAVLLSLHPGFRVGFNSLGGLASV

SEQ ID NO: 9140 - protein, 995 aa, Homo sapiens
MSQWTPEYNELYTLKVDMKSEIPSDAPKTQESLKGILLHPEPIGAAKSFPAGVEMINSKVGNEFSHLCDDSQKQEKEMNGNQQEQEKSLVVRKKRKSQQAGPSYVQNCVKENQGILGLRQHLGTPSDEDNDSSFSDCLSSPSSSLHFGDSDTVTSDEDKEVSVRHSQTILNAKSRSHSARSHKWPRTETESVSGLLMKRPCLHGSSLRRLPCRKRFVKNNSSQRTQKQKERILMQRKKREVLARRKYALLPSSSSSSENDLSSESSSSSSTEGEEDLFVSASENHQNNPAVPSGSIDEDVVVIEASSTPQVTANEEINVTSTDSEVEIVTVGESYRSRSTLGHSRSHWSQGSSSHASRPQEPRNRSRISTVIQPLRQNAAEVVDLTVDEDEPTVVPTTSARMESQATSASINNSNPSTSEQASDTASAVTSSQPSTVSETSATLTSNSTTGTSIGDDSRRTTSSAVTETGPPAMPRLPSCCPQHSPCGGSSQNHHALGHPHTSCFQQHGHHFQHHHHHHHTPHPAVPVSPSFSDPACPVERPPQVQAPCGANSSSGTSYHEQQALPVDLSNSGIRSHGSGSFHGASAFDPCCPVSSSRAAIFGHQAAAAAPSQPLSSIDGYGSSMVAQPQPQPPPQPSLSSCRHYMPPPYASLTRPLHHQASACPHSHGNPPPQTQPPPQVDYVIPHPVHAFHSQISSHATSHPVAPPPPTHLASTAAPIPQHLPPTHQPISHHIPATAPPAQRLHPHEVMQRMEVQRRRMMQHPTGLFVFCVSRRAHERPPPHPHRMHPNYGHGHHIHVPQTMSSHPRQAPERSAWELGIEAGVTAATYTPGALHPHLAHYHAPPRLHHLQLGALPLMVPDMAGYPHIRYISSGLDGTSFRGPFRGNFEELIHLEERLGNVNRGASQGTIERCTYPHKYKKRKLHCKQDGEEGTEEDTEEKCTICLSILEEGEDVRRLPCMHLFHQVCVDQWLITNKKCPICRVDIEAQLPSES

SEQ ID NO: 9141 - protein, 616 aa, Homo sapiens
MAGGRGAPGRGRDEPPESYPQRQDHELQALEAIYGADFQDLRPDACGPVKEPPEINLVLYPQGLTGEEVYVKVDLRVKCPPTYPDVVPEIELKNAKGLSNESVNLLKSRLEELAKKHCGEVMIFELAYHVQSFLSEHNKPPPKSFHEEMLERRAQEEQQRLLEAKRKEEQEQREILHEIQRRKEEIKEEKKRKEMAKQERLEIASLSNQDHTSKKDPGGHRTAAILHGGSPDFVGNGKHRANSSGRSRRERQYSVCNSEDSPGSCEILYFNMGSPDQLMVHKGKCIGSDEQLGKLVYNALETATGGFVLLYEWVLQWQKKMGPFLTSQEKEKIDKCKKQIQGTETEFNSLVKLSHPNVVRYLAMNLKEQDDSIVVDILVEHISGVSLAAHLSHSGPIPVHQLRRYTAQLLSGLDYLHSNSVVHKVLSASNVLVDAEGTVKITDYSISKRLADICKEDVFEQTRVRFSDNALPYKTGKKGDVWRLGLLLLSLSQGQECGEYPVTIPSDLPADFQDFLKKCVCLDDKERWSPQQLLKHSFINPQPKMPLVEQSPEDSEGQDYVETVIPSNRLPSAAFFSETQRQFSRYFIEFEELQLLGKGAFGAVIKVWYRVIPSPL

SEQ ID NO: 9142 - protein, 131 aa, Homo sapiens
MSQWTPEYNELYTLKVDMKSEIPSDAPKTQESLKGILLHPEPIGAAKSFPAGVEMINSKVGNEFSHLCDDSQKQEKEMNGNQQEQEKSLVVRKKRKSQQAGPSYVQNCVKENQGILGLRQHLGTPSDEDND

SEQ ID NO: 9143 - protein, 620 aa, Homo sapiens
MAPDSDPFPEGPLLKLLPLDARDRGTQRCRLGPAALHALGARLGSAVKISLPDGGSCLCTAWPRRDGADGFVQLDPLCASPGAAVGASRSRRSLSLNRLLLVPCPPLRRVAVWPVLRERAGAPGARNTAAVLEAAQELLRNRPISLGHVVVAPPGAPGLVAALHIVGGTPSPDPAGLVTPRTRVSLGGEPPSEAQPQPEVPLGGLSEAADSLRELLRLPLRYPRALTALGLAVPRGVLLAGPPGVGKTQLVRAVAREAGAELLAVSAPALQGSRPGETEENVRRVFQRARELASRGPSLLFLDEMDALCPQRGSRAPESRVVAQVLTLLDGASGDREVVVVGATNRPDALDPALRRPGRFDREVVIGTPTLKQRKEILQVITSKMPISSHVDLGLLAEMTVGYVGADLTALCREAAMHALLHSEKNQDNPVIDEIDFLEAFKNIQPSSFRSVIGLMDIKPVDWEEIGGLEDVKLKLKQSIEWPLKFPWEFVRMGLTQPKGVLLYGPPGCAKTTLVRALATSCHCSFVSVSGADLFSPFVGDSEKVLSQIFRQARASTPAILFLDEIDSILGARSASKTGCDVQERVLSVLLNELDGVGLKTIERRGSKSSQQGKYKELKK

SEQ ID NO: 9144 - protein, 1588 aa, Homo sapiens; identical to SEQ ID NO: 5490

SEQ ID NO: 9145 - protein, 20 aa, Homo sapiens
MATMIPPVKLKWLEHLNSSW

SEQ ID NO: 9146 - protein, 1462 aa, Homo sapiens
MYQPEDDNNSDVTSDDDMTRNRRESSPPHSVHSFSDRDWDRRGRSRDMEPRDRWSHTRNPRSRMPPRDLSLPVVAKTSFEMDREDDRDSRAYESRSQDAESYQNVVDLAEDRKPHNTIQDNMENYRKLLSLVQLAEDDGHSHMTQGHSSRSKRSAYPSTSRGLKTMPEAKKSTHRRGICEDESSHGVIMEKFIKDVSRSSKSGRARESSDRSQRFPRMSDDNWKDISLNKRESVIQQRVYEGNAFRGGFRFNSTLVSRKRVLERKRRYHFDTDGKGSIHDQKGCPRKKPFECGSEMRKAMSVSSLSSLSSPSFTESQPIDFGAMPYVCDECGRSFSVISEFVEHQIMHTRENLYEYGESFIHSVAVSEVQKSQVGGKRFECKDCGETFNKSAALAEHRKIHARGYLVECKNQECEEAFMPSPTFSELQKIYGKDKFYECRVCKETFLHSSALIEHQKIHFGDDKDNEREHERERERERGETFRPSPALNEFQKMYGKEKMYECKVCGETFLHSSSLKEHQKIHTRGNPFENKGKVCEETFIPGQSLKRRQKTYNKEKLCDFTDGRDAFMQSSELSEHQKIHSRKNLFEGRGYEKSVIHSGPFTESQKSHTITRPLESDEDEKAFTISSNPYENQKIPTKENVYEAKSYERSVIHSLASVEAQKSHSVAGPSKPKVMAESTIQSFDAINHQRVRAGGNTSEGREYSRSVIHSLVASKPPRSHNGNELVESNEKGESSIYISDLNDKRQKIPARENPCEGGSKNRNYEDSVIQSVFRAKPQKSVPGEGSGEFKKDGEFSVPSSNVREYQKARAKKKYIEHRSNETSVIHSLPFGEQTFRPRGMLYECQECGECFAHSSDLTEHQKIHDREKPSGSRNYEWSVIRSLAPTDPQTSYAQEQYAKEQARNKCKDFRQFFATSEDLNTNQKIYDQEKSHGEESQGENTDGEETHSEETHGQETIEDPVIQGSDMEDPQKDDPDDKIYECEDCGLGFVDLTDLTDHQKVHSRKCLVDSREYTHSVIHTHSISEYQRDYTGEQLYECPKCGESFIHSSFLFEHQRIHEQDQLYSMKGCDDGFIALLPMKPRRNRAAERNPALAGSAIRCLLCGQGFIHSSALNEHMRLHREDDLLEQSQMAEEAIIPGLALTEFQRSQTEERLFECAVCGESFVNPAELADHVTVHKNEPYEYGSSYTHTSFLTEPLKGAIPFYECKDCGKSFIHSTVLTKHKELHLEEEEEDEAAAAAAAAAQEVEANVHVPQVVLRIQGLNVEAAEPEVEAAEPEVEAAEPEVEAAEPNGEAEGPDGEAAEPIGEAGQPNGEAEQPNGDADEPDGAGIEDPEERAEEPEGKAEEPEGDADEPDGVGIEDPEEGEDQEIQVEEPYYDCHECTETFTSSTAFSEHLKTHASMIIFEPANAFGECSGYIERASTSTGGANQADEKYFKCDVCGQLFNDRLSLARHQNTHTG

SEQ ID NO: 9147 - protein, 145 aa, Homo sapiens
MATMIPPVKLKWLEHLNSSWITEDSESIATREGVAVLYSKLVSNKEVVPLPQQVLCLKGPQLPDFERESLSSDEQDHYLDALLSSQLALAKMVCSDSPFAGALRKRLLVLQRVFYALSNKYHDKGKVKQQQHSPESSSGSADVHS

SEQ ID NO: 9148 - protein, 1427 aa, Homo sapiens
  MOD_RES (1)..(1): Any amino acid
XAKQERLEIASLSNQDHTSKKDPGGHRTAAILHGGSPDFVGNGKHRANSSGRSRRERQYSVCNSEDSPGSCEILYFNMGSPDQLMVHKGKCIGSDEQLGKLVYNALETATGGFVLLYEWVLQWQKKMGPFLTSQEKEKIDKCKKQIQGTETEFNSLVKLSHPNVVRYLAMNLKEQDDSIVVDILVEHISGVSLAAHLSHSGPIPVHQLRRYTAQLLSGLDYLHSNSVVHKVLSASNVLVDAEGTVKITDYSISKRLADICKEDVFEQTRVRFSDNALPYKTGKKGDVWRLGLLLLSLSQGQECGEYPVTIPSDLPADFQDFLKKCVCLDDKERWSPQQLLKHSFINPQPKMPLVEQSPEDSEGQDYVETVIPSNRLPSAAFFSETQRQFSRYFIEFEELQLLGKGAFGAVIKVQNKLDGCCYAVKRIPINPASRQFRRIKGEVTLLSRLHHENIVRYYNAWIERHERPAGPGTPPPDSGPLAKDDRAARGQPASDTDGLDSVEAAAPPPILSSSVEWSTSGERSASARFPATGPGSSDDEDDDEDEHGGVFSQSFLPASDSESDIIFDNEDENSKSQNQMEYCEKSTLRDTIDQGLYRDTVRLWRLFREILDGLAYIHEKGMIHRDLKPVNIFLDSDDHVKIGDFGLATDHLAFSADSKQDDQTGDLIKSDPSGHLTGMVGTALYVSPEVQGSTKSAYNQKVDLFSLGIIFFEMSYHPMVTASERIFVLNQLRDPTSPKFPEDFDDGEHAKQKSVISWLLNHDPAKRPTATELLKSELLPPPQMEESELHEVLHHTLTNVDGKAYRTMMAQIFSQRISPAIDYTYDSDILKGNFSIRTAKMQQHVCETIIRIFKRHGAVQLCTPLLLPRNRQIYEHNEAALFMDHSGMLVMLPFDLRIPFARYVARNNILNLKRYCIERVFRPRKLDRFHPKELLECAFDIVTSTTNSFLPTAEIIYTIYEIIQEFPALQERNYSIYLNHTMLLKAILLHCGIPEDKLSQVYIILYDAVTEKLTRREVEAKFCNLSLSSNSLCRLYKFIEQKGDLQDLMPTINSLIKQKTGIAQLVKYGLKDLEEVVGLLKKLGIKLQVLINLGLVYKVQQHNGIIFQFVAFIKRRQRAVPEILAAGGRYDLLIPQFRGPQALGPVPTAIGVSIAIDKISAAVLNMEESVTISSCDLLVVSVGQMSMSRAINLTQKLWTAGITAEIMYDWSQSQEELQEYCRHHEITYVALVSDKEGSHVKVKSFEKERQTEKRVLETELVDHVLQKLRTKVTDERNGREASDNLAVQNLKGSFSNASGLFEIHGATVVPIVSVLAPEKLSASTRRRYETQVQTRLQTSLANLHQKSSEIEILAVDLPKETILQFLSLEWDADEQAFNTTVKQLLSRLPKQRYLKLVCDEIYNIKVEKKVSVLFLYSYRDDYYRILF

SEQ ID NO: 9149 - protein, 1588 aa, Homo sapiens; identical to SEQ ID NO: 5490

SEQ ID NO: 9150 - protein, 1003 aa, Homo sapiens; identical to SEQ ID NO: 7688

SEQ ID NO: 9151 - protein, 49 aa, Homo sapiens
MALPHDSNETSYLLPPNNEDWGRQTIPDFVYGQKDLMAEGIQWPRNAPG

SEQ ID NO: 9152 - protein, 124 aa, Homo sapiens; identical to SEQ ID NO: 5720

SEQ ID NO: 9153 - protein, 30 aa, Homo sapiens
MATDSWALAVDEQEAAAESRTELPSPYSTS

SEQ ID NO: 9154 - protein, 267 aa, Homo sapiens; identical to SEQ ID NO: 7572

SEQ ID NO: 9155 - protein, 370 aa, Homo sapiens; identical to SEQ ID NO: 6828

SEQ ID NO: 9156 - protein, 903 aa, Homo sapiens
MATSADSPSSPLGAEDLLSDSSEPPGLNQVSSEVTSQLYASLRLSRQAEATARAQLYLPSTSPPHEGLDGFAQELSRSLSVGLEKNLKKKDGSKHIFEMESVRGQLQTMLQTSRDTAYRDPLIPGAGSERREEDSFDSDSTATLLNTRPLQDLSPSSSAQALEELFPRYTSLRPGPPLNPPDFQGLRDALDSEHTRRKHCERHIQSLQTRVLELQQQLAVAVAADRKKDTMIEQLDKTLARVVEGWNRHEAERTEVLRGLQEEHQAAELTRSKQQETVTRLEQSLSEAMEALNREQESARLQQRERETLEEERQALTLRLEAEQQRCCVLQEERDAARAGQLSEHRELETLRAALEEERQTWAQQEHQLKEHYQALQEESQAQLEREKEKSQREAQAAWETQHQLALVQSEVRRLEGELDTARRERDALQLEMSLVQARYESQRIQLESELAVQLEQRVTERLAQAQESSLRQAASLREHHRKQLQDLSGQHQQELASQLAQFKVEMAEREERQQQVAEDYELRLAREQARVCELQSGNQQLEEQRVELVERLQAMLQAHWDEANQLLSTTLPPPNPPAPPAGPSSPGPQEPEKEERRVWTMPPMAVALKPVLQQSREARDELPGAPPVLCSSSSDLSLLLGPSFQSQHSFQPLEPKPDLTSSTAGAFSALGAFHPDHRAERPFPEEDPGPDGEGLLKQGLPPAQLEGLKNFLHQLLETVPQNNENPSVDLLPPKSGPLTVPSWEEAPQVPRIPPPVHKTKVPLAMASSLFRVPEPPSSHSQGSGPSSGSPERGGDGLTFPRQLMEVSQLLRLYQARGWGALPAEDLLLYLKRLEHSGTDGRGDNVPRRNTDSRLGEIPRKEIPSQAVPRRLATAPKTEKPPARKKSGHPAPSSMRSRGGVWR

SEQ ID NO: 9157 - protein, 45 aa, Homo sapiens
MPLLVEGRRVRLPQSAGDLVRAHPPLEAPSPFWVLMMPLLVTLWS

SEQ ID NO: 9158 - protein, 360 aa, Homo sapiens; identical to SEQ ID NO: 5289

SEQ ID NO: 9159 - protein, 450 aa, Homo sapiens; identical to SEQ ID NO: 4877

SEQ ID NO: 9160 - protein, 370 aa, Homo sapiens; identical to SEQ ID NO: 6828

SEQ ID NO: 9161 - protein, 245 aa, Homo sapiens
MGGGYDLNLFASPPDSNFVCSVCHGVLKRPARLPCSHIFCKKCILRWLARQKTCPCCRKEVKRKKVVHMNKLRKTIGRLEVKCKNADAGCIVTCPLAHRKGHQDSCPFELTACPNEGCTSQVPRGTLAEHRQHCQQGSQQRCPLGCGATLDPAERARHNCYRELHNAWSVRQERRRPLLLSLLRRVRWLDQATSVVRRELAELSNFLEEDTALLEGAPQEEAEAAPEGNVGAEVVGEPRANIPCK

SEQ ID NO: 9162 - protein, 102 aa, Homo sapiens; identical to SEQ ID NO: 6001

SEQ ID NO: 9163 - protein, 490 aa, Homo sapiens; identical to SEQ ID NO: 6952

SEQ ID NO: 9164 - protein, 602 aa, Homo sapiens; identical to SEQ ID NO: 5696

SEQ ID NO: 9165 - protein, 205 aa, Homo sapiens; identical to SEQ ID NO: 6647

SEQ ID NO: 9166 - protein, 119 aa, Homo sapiens; identical to SEQ ID NO: 5859

SEQ ID NO: 9167 - protein, 490 aa, Homo sapiens
MPMPTEGTPPPLSGTPIPVPAYFRHAEPGFSLKRPRGLSRSLPPPPPAKGSIPISRLFPPRTPGWHQLQPRRVSFRGEASETLQSPGYDPSRPESFFQQSFQRLSRLGHGSYGEVFKVRSKEDGRLYAVKRSMSPFRGPKDRARKLAEVGSHEKVGQHPCCVRLEQAWEEGGILYLQTELCGPSLQQHCEAWGASLPEAQVWGYLRDTLLALAHLHSQGLVHLDVKPANIFLGPRGRCKLGDFGLLVELGTAGAGEVQEGDPRYMAPELLQGSYGTAADVFSLGLTILEVACNMELPHGGEGWQQLRQGYLPPEFTAGLSSELRSVLVMMLEPDPKLRATAEALLALPVLRQPRAWGVLWCMAAEALSRGWALWQALLALLCWLWHGLAHPASWLQPLGPPATPPGSPPCSLLLDSSLSSNWDDDSLGPSLSPEAVLARTVGSTSTPRSRCTPRDALDLSDINSEPPRGSFPSFEPRNLLSLFEDTLDPT

SEQ ID NO: 9168 - protein, 430 aa, Homo sapiens
MLERWHQLQPRRVSFRGEASETLQSPGYDPSRPESFFQQSFQRLSRLGHGSYGEVFKVRSKEDGRLYAVKRSMSPFRGPKDRARKLAEVGSHEKVGQHPCCVRLEQAWEEGGILYLQTELCGPSLQQHCEAWGASLPEAQVWGYLRDTLLALAHLHSQGLVHLDVKPANIFLGPRGRCKLGDFGLLVELGTAGAGEVQEGDPRYMAPELLQGSYGTAADVFSLGLTILEVACNMELPHGGEGWQQLRQGYLPPEFTAGLSSELRSVLVMMLEPDPKLRATAEALLALPVLRQPRAWGVLWCMAAEALSRGWALWQALLALLCWLWHGLAHPASWLQPLGPPATPPGSPPCSLLLDSSLSSNWDDDSLGPSLSPEAVLARTVGSTSTPRSRCTPRDALDLSDINSEPPRGSFPSFEPRNLLSLFEDTLDPT

SEQ ID NO: 9169 - protein, 221 aa, Homo sapiens; identical to SEQ ID NO: 5870

SEQ ID NO: 9170 - protein, 743 aa, Homo sapiens; identical to SEQ ID NO: 8973

SEQ ID NO: 9171 - protein, 192 aa, Homo sapiens
MSTAAVPELKQISRVEAMRLGPGWSHSCHAMLYAANPGQLFGRIPMRFSVLMQMRFDGLLGFPGGFVDRRFWSLEDGLNRVLGLGLGCLRLTEADYLSSHLTEGPHRVVAHLYARQLTLEQLHAVEISAVHSRDHGLEVGPPPGPRPPPRGLALAPWKAPMGAGPRAGPAVHPEGPSRRLPQLPEQRLREHG

SEQ ID NO: 9172 - protein, 850 aa, Homo sapiens
MLERRALLWQREAGPGWGDRARAGTGGAGGGCGGAMAERGPAFCGLYDTSSLLRYCNDDNLSGTSGMEVDDRVSALEQRLQLQEDELAVLKAALADALRRLRACEEQGAALRARGTPKGRAPPRLGTTASVCQLLKGLPTRTPLNGSGPPRRVGGYATSPSSPKKEATSGRSSVRRYLSPERLASVRREDPRSRTTSSSSNCSAKKEGKTKEVIFSVEDGSVKMFLRGRPVPMMIPDELAPTYSLDTRSELPSCRLKLEWVYGYRGRDCRANLYLLPTGEIVYFVASVAVLYSVEEQRQRHYLGHNDDIKCLAIHPDMVTIATGQVAGTTKEGKPLPPHVRIWDSVSLSTLHVLGLGVFDRAVCCVGFSKSNGGNLLCAVDESNDHMLSVWDWAKETKVVDVKCSNEAVLVATFHPTDPTVLITCGKSHIYFWTLEGGSLSKRQGLFEKHEKPKYVLCVTFLEGGDVVTGDSGGNLYVWGKGGNRITQAVLGAHDGGVFGLCALRDGTLVSGGGRDRRVVLWGSDYSKLQEVEVPEDFGPVRTVAEGHGDTLYVGTTRNSILQGSVHTGFSLLVQGHVEELWGLATHPSRAQFVTCGQDKLVHLWSSDSHQPLWSRIIEDPARSAGFHPSGSVLAVGTVTGRWLLLDTETHDLVAIHTDGNEQISVVSFSPDGAYLAVGSHDNLVYVYTVDQGGRKVSRLGKCSGHSSFITHLDWAQDSSCFVTNSGDYEILYWDPATCKQITSADAVRNMEWATATCVLGFGVFGIWSEGADGTDINAVARSHDGKLLASADDFGKVHLFSYPCCQPRALSHKYGGHSSHVTNVAFLWDDSMALTTGGKDTSVLQWRVV

SEQ ID NO: 9173 - protein, 833 aa, Homo sapiens; identical to SEQ ID NO: 7784

SEQ ID NO: 9174 - protein, 1116 aa, Homo sapiens; identical to SEQ ID NO: 6025

SEQ ID NO: 9175 - protein, 684 aa, Homo sapiens; identical to SEQ ID NO: 5923

SEQ ID NO: 9176 - protein, 125 aa, Homo sapiens; identical to SEQ ID NO: 4724

SEQ ID NO: 9177 - protein, 1108 aa, Homo sapiens; identical to SEQ ID NO: 5688

SEQ ID NO: 9178 - protein, 197 aa, Homo sapiens; identical to SEQ ID NO: 7467

SEQ ID NO: 9179 - protein, 301 aa, Homo sapiens; identical to SEQ ID NO: 5683

SEQ ID NO: 9180 - protein, 329 aa, Homo sapiens; identical to SEQ ID NO: 5981

SEQ ID NO: 9181 - protein, 420 aa, Homo sapiens
MLSSFPVVLLETMSHYTDEPRFTIEQIDLLQRLRRTGMTKHEILHALETLDRLDQEHSDKFGRRSSYGGSSYGNSTNNVPASSSTATASTQTQHSGMSPSPSNSYDTSPQPCTTNQNGRENNERLSTSNGKMSPTRYHANSMGQRSYSFEASEEDLDVDDKVEELMRRDSSVIKEEIKAFLANRRISQAVVAQVTGISQSRISHWLLQQGSDLSEQKKRAFYRWYQLEKTNPGATLSMRPAPIPIEDPEWRQTPPPVSATSGTFRLRRGSRFTWRKECLAVMESYFNENQYPDEAKREEIANACNAVIQKPGKKLSDLERVTSLKVYNWFANRRKEIKRRANIEAAILESHGIDVQSPGGHSNSDDVDGNDYSEQDDSTSHSDHQDPISLAVEMAAVNHTILALARQGANEIKTEALDDD

SEQ ID NO: 9182 - protein, 420 aa, Homo sapiens; identical to SEQ ID NO: 9181

SEQ ID NO: 9183 - protein, 304 aa, Homo sapiens
MLSSFPVVLLETMSHYTDEPRFTIEQIDLLQRLRRTGMTKHEILHALETLDRLDQEHSDKFGRRSSYGGSSYGNSTNNVPASSSTATASTQTQHSGMSPSPSNSYDTSPQPCTTNQNGRENNERLSTSNGKMSPTRYHANSMGQRSYSFEASEEDLDVDDKVEELMRRDSSVIKEEIKAFLANRRISQAVVAQVTGISQSRISHWLLQQGSDLSEQKKRAFYRWYQLEKTNPGATLSMRPAPIPIEDPEWRQTPPPVSATSGTFRLRRGSRFTWRKECLAVMERNTWSPERRMEENKWKLLSAG

SEQ ID NO: 9184 - protein, 443 aa, Homo sapiens
MLSSFPVVLLETMSHYTDEPRFTIEQIDLLQRLRRTGMTKHEILHALETLDRLDQEHSDKFGRRSSYGGSSYGNSTNNVPASSSTATASTQTQHSGMSPSPSNSYDTSPQPCTTNQNGRENNERLSTSNGKMSPTRYHANSMGQRSYSFEASEEDLDVDDKVEELMRRDSSVIKEEIKAFLANRRISQAVVAQVTGISQSRISHWLLQQGSDLSEQKKRAFYRWYQLEKTNPGATLSMRPAPIPIEDPEWRQTPPPVSATSGTFRLRRGSRFTWRKECLAVMESYFNENQYPDEAKREEIANACNAVIQKPGKKLSDLERVTSLKVYNWFANRRKEIKRRANIAAILESHGIDVQSPGGHSNSDDVDGNDYSEQDTWQVRNGEEEEGRSSEGGREAEKDDSTSHSDHQDPISLAVEMAAVNHTILALARQGANEIKTEALDDD

SEQ ID NO: 9185 - protein, 118 aa, Homo sapiens
MLSSFPVVLLETMSHYTDEPRFTIEQIDLLQRLRRTGMTKHEILHALETLDRLDQEHSDKFGRRSSYGGSSYGNSTNNVPASSSTATASTQTQHSGMSPSPSNSYDTSPQPCTTNQNG

SEQ ID NO: 9186 - protein, 443 aa, Homo sapiens; identical to SEQ ID NO: 9184

SEQ ID NO: 9187 - protein, 405 aa, Homo sapiens
MLSSFPVVLLETMSHYTDEPRFTIEQIDLLQRLRRTGMTKHEILHALETLDRLDQEHSDKFGRRSSYGGSSYGNSTNNVPASSSTATASTQTQHSGMSPSPSNSYDTSPQPCTTNQNGRENNERLSTSNGKMSPTRYHANSMGQRSYSFEASEEDLDVDDKVEELMRRDSSVIKEEIKAFLANRRISQAVVAQVTGISQSRISHWLLQQGSDLSEQKKRAFYRWYQLEKTNPGATLSMRPAPIPIEDPEWRQTPPPVSATSGTFRLRRGSRFTWRKECLAVMESYFNENQYPDEAKREEIANACNAVIQKPGKKLSDLERVTSLKVYNWFANRRKEIKRRANIAAILESHGIDVQSPGGHSNSDDVDGNDYSEQDTWQVRNGEEEEGRSSEGGREAEKVEEERRI

SEQ ID NO: 9188 - DNA, 1380 bp, Homo sapiens
atgaccgccgaggagatgaaggccaccgagagcggcgcccagagcgcccccctgcccatggagggcgtggacatcagccccaagcaggacgagggcgtgctgaaggtgatcaagagagagggcaccggcaccgagatgcccatgatcggcgacagagtgttcgtgcactacaccggctggctgctggacggcaccaagttcgacagcagcctggacagaaaggacaagttcagcttcgacctgggcaagggcgaggtgatcaaggcctgggacatcgccatcgccaccatgaaggtgggcgaggtgtgccacatcacctgcaagcccgagtacgcctacggcagcgccggcagcccccccaagatcccccccaacgccaccctggtgttcgaggtggagctgttcgagttcaagggcgaggacctgaccgaggaggaggacggcggcatcatcagaagaatccagaccagaggcgagggctacgccaagcccaacgagggcgccatcgtggaggtggccctggagggctactacaaggacaagctgttcgaccagagagagctgagattcgagatcggcgagggcgagaacctggacctgccctacggcctggagagagccatccagagaatggagaagggcgagcacagcatcgtgtacctgaagcccagctacgccttcggcagcgtgggcaaggagaagttccagatcccccccaacgccgagctgaagtacgagctgcacctgaagagcttcgagaaggccaaggagagctgggagatgaacagcgaggagaagctggagcagagcaccatcgtgaaggagagaggcaccgtgtacttcaaggagggcaagtacaagcaggccctgctgcagtacaagaagatcgtgagctggctggagtacgagagcagcttcagcaacgaggaggcccagaaggcccaggccctgagactggccagccacctgaacctggccatgtgccacctgaagctgcaggccttcagcgccgccatcgagagctgcaacaaggccctggagctggacagcaacaacgagaagggcctgttcagaagaggcgaggcccacctggccgtgaacgacttcgagctggccagagccgacttccagaaggtgctgcagctgtaccccaacaacaaggccgccaagacccagctggccgtgtgccagcagagaatcagaagacagctggccagagagaagaagctgtacgccaacatgttcgagagactggccgaggaggagaacaaggccaaggccgaggccagcagcggcgaccaccccaccgacaccgagatgaaggaggagcagaagagcaacaccgccggcagccagagccaggtggagaccgaggcctag

SEQ ID NO: 9189 - DNA, 477 bp, Homo sapiens
atggagccccccgagggcgccggcaccggcgagatcgtgaaggaggccgaggtgccccaggccgccctgggcgtgcccgcccagggcaccggcgacaacggccacacccccgtggaggaggaggtgggcggcatccccgtgcccgcccccggcctgctgcaggtgaccgagagaagacagcccctgagcagcgtgagcagcctggaggtgcacttcgacctgctggacctgaccgagctgaccgacatgagcgaccaggagctggccgaggtgttcgccgacagcgacgacgagaacctgaacaccgagagccccgccggcctgcaccccctgcccagagccggctacctgagaagccccagctggaccagaaccagagccgagcagagccacgagaagcagcccctgggcgaccccgagagacaggccaccgtgctggacaccttcctgaccgtggagagaccccaggaggactag

SEQ ID NO: 9190 - DNA, 954 bp, Homo sapiens
atggccagcgtgatccccgccagcaacagaagcatgagaagcgacagaaacacctacgtgggcaagagattcgtgcacgtgaagaacccctacctggacctgatggacgaggacatcctgtaccacctggacctgggcaccaagacccacaacctgcccgccatgttcggcgacgtgaagttcgtgtgcgtgggcggcagccccaacagaatgaaggccttcgccctgttcatgcacaaggagctgggcttcgaggaggccgaggaggacatcaaggacatctgcgccggcaccgacagatactgcatgtacaagaccggccccgtgctggccatcagccacggcatgggcatccccagcatcagcatcatgctgcacgagctgatcaagctgctgcaccacgccagatgctgcgacgtgaccatcatcagaatcggcaccagcggcggcatcggcatcgcccccggcaccgtggtgatcaccgacatcgccgtggacagcttcttcaagcccagattcgagcaggtgatcctggacaacatcgtgaccagaagcaccgagctggacaaggagctgagcgaggagctgttcaactgcagcaaggagatccccaacttccccaccctggtgggccacaccatgtgcacctacgacttctacgagggccagggcagactggacggcgccctgtgcagcttcagcagagagaagaagctggactacctgaagagagccttcaaggccggcgtgagaaacatcgagatggagagcaccgtgttcgccgccatgtgcggcctgtgcggcctgaaggccgccgtggtgtgcgtgaccctgctggacagactggactgcgaccagatcaacctgccccacgacgtgctggtggagtaccagcagagaccccagctgctgatcagcaacttcatcagaagaagactgggcctgtgcgactag

SEQ ID NO: 9191 - DNA, 1095 bp, Homo sapiens
atgagcgaggtggaggccgccgccggcgccaccgccgtgcccgccgccaccgtgcccgccaccgccgccggcgtggtggccgtggtggtgcccgtgcccgccggcgagccccagaagggcggcggcgccggcggcggcggcggcgccgccagcggccccgccgccggcacccccagcgcccccggcagcagaacccccggcaaccccgccaccgccgtgagcggcacccccgccccccccgccagaagccaggccgacaagcccgtgctggccatccaggtgctgggcaccgtgaagtggttcaacgtgagaaacggctacggcttcatcaacagaaacgacaccaaggaggacgtgttcgtgcaccagaccgccatcaagagaaacaaccccagaaagttcctgagaagcgtgggcgacggcgagaccgtggagttcgacgtggtggagggcgagaagggcgccgaggccaccaacgtgaccggccccggcggcgtgcccgtgaagggcagcagatacgcccccaacagaagaaagagcagaagattcatccccagaccccccagcgtggcccccccccccatggtggccgagatccccagcgccggcaccggccccggcagcaagggcgagagagccgaggacagcggccagagacccagaagatggtgccccccccccttcttctacagaagaagattcgtgagaggccccagaccccccaaccagcagcagcccatcgagggcaccgacagagtggagcccaaggagaccgcccccctggagggccaccagcagcagggcgacgagagagtgcccccccccagattcagacccagatacagaagacccttcagacccagacccagacagcagcccaccaccgagggcggcgacggcgagaccaagcccagccagggccccgccgacggcagcagacccgagccccagagacccagaaacagaccctacttccagagaagaagacagcaggcccccggcccccagcaggcccccggccccagacagcccgccgcccccgagaccagcgcccccgtgaacagcggcgaccccaccaccaccatcctggagtag

SEQ ID NO: 9192 - DNA, 5706 bp, Homo sapiens
atggccaccttcagaaacaaccacatgaagaccaaggccagcgtgagaaagagcttcagcgaggacgtgttccagagcgtgaagagcctgctgcagagccagaaggagctgtgcagcgtgaccgccgaggactgcctgcagcaggacgagcacgccaacctgaccgaggtgaccttcctgggcttcaacgaggagaccgacgccgcccacatccaggacctggccgccgtgagcctggagctgcccgacatcctgaacagcctgcacttctgcagcctgaacgagaacgagatcatctgcatgaagaacatcaacaagcccctggacatcagcagcgaccccctgaaccagagccaccccagcggcatgctgtgcgtgatgagagtgagccccaccagccccagactgagaatcgacttcatcttcagcctgctgagcaagtacgccaccggcatcagatacaccctggacaccttcctgcaccagaagcaccagctggagaccaccgacgaggacgacgacgacaccaaccagagcgtgagcagcatcgaggacgacttcgtgaccgccttcgagcacctggaggaggaggagaccagcaagccctacaacgacggcatgaacatcaccgtgctgagaagccagtgcgacgccgccagccagaccgtgaccggccaccacctggagacccacgacctgaagatcctgatcagcagcggccagcagaagagcctggccaagcccagcaccagcagcgtgaacgtgctgggccacaaggagctgcccagcgtgaagaccagcgtgaccaccagcatcagcgagccctggacccagagaagcttctacagaagcagcaacgccagcgacaaggacagcgacctgcagaagaccttcttcagcagcagccccgcctacagcagcgagagcgagtgcagcagccccagccccgtgatcttcctggacgaggagggctaccagaagagcctgaaggccaagctggagctgcccaagatccccgtgatgaaggacgacatcgaggacagcgacagcgaggtgagcgagttcttcgacagcttcgaccagttcgacgagctggagcagaccctggagacctgcctgttcaacaaggaccccgtgatcggcaagagcagccagagaaagggccacaagcacggcaagagctgcatgaacccccagaagttcaagttcgacagacccgccctgcccgccaacgtgagaaagcccacccccagaaagcccgagagcccctacggcaacctgtgcgacgcccccgacagccccagacccgtgaaggccagcagagaggacagcggcctgttcagccccatcagaagcagcgccttcagccccctgggcggctgcacccccgccgagtgcttctgccagaccgacatcggcggcgacagaatccacgagaaccacgacagcgtgtactacacctacgaggactacgccaagagcatcagctgcgaggtgctgggcagcgtgctgagaacccaccacaccaacaccctgagcaacatcaacagcatcaagcacggcgagaacaagaccgtgaccttcaagcacggcaacctggaccagaagaacaagagcaagaacaagagcctgatgatcaaggacagcatccagaagttcgccgccgacctggtggagaagagcttcggcagcgccttcaaggacctgcagaagggcgtgagcagctgcaccaacgccctgtaccacctggccatcaagctgaccagcagcgtgctgcagatggccttcgacgagctgagaagacagagagccttcagcctgaaggagagagccatcagcggcctggccaacttcctggtgagcgaggccctgagcaacgccctgaaggacctgcagtacgtgaagaagcagatcttcaccaacaccgtggccagattcgccgccgacctggccgaggagctggtgttcgagggcatcatggaggtgtgccagttcagctacccccagacccccgccagcccccagtgcggcagcttcgacttcgaggacaaggtggtgaagctgtacgccaaggacctgagcgagagcgtgatccaggaggccttcatcgagctgagccaggtggacgtgaccttcaccaccaaggccgccgtgagcgtgagcaccgacaacatcaagtacgtgagcgccgagagcgtggtgcccagcacccaggccgtgaccttcagccccagcttccacaaccaggccatcatggtgaccaagcccgtgcaggagtacaagaaggagtacaccgtgcagcaggccctgttctgcaccagcggcatcgtgaccagcatccccgtgcccctggccggcagcgccctgctgccctaccacatcagcagcaccgcctgccaggccaaggcccacctgagcagcgacgacagcaacagcaacggcgacagcgcccaggtgcacatcgccaccaagaacagagaggagaaggccgcctgcctgagaaacatctgcctgcccagcgagcacaaccccggcaaccagaacgacttcaagcccaccaacgacgacatcgagatgcagagcagcagcaagctgcccaacgaccccgccatcatcagcaacttcagcgccgccgtggtgcacaccatcgtgaacgagaccctggagagcatgaccagcctggaggtgaccaagatggtggacgagagaaccgactacctgaccaagagcctgaaggagaagaccccccccttcagccactgcgaccaggccgtgctgcagtgcagcgaggccagcagcaacaaggacatgttcgccgacagactgagcaagagcatcatcaagcacagcatcgacaagagcaagagcgtgatccccaacatcgacaagaacgccgtgtacaaggagagcctgcccgtgagcggcgaggagagccagctgacccccgagaagagccccaagttccccgacagccagaaccagctgacccactgcagcctgagcgccgccaaggactgcgtgcccgagtgcaaggtgagcatggtgcacggcagcagcctggagaccctgcccagctgccccgccgtgaccggccagaagagcgacctgaaggagagcgccaaggaccagcccctgaagaagcacaacctgaacagcaccagcctggaggccctgagcttcggccaggagaaccccttcccccacagccacaccttcagcagcaccgccctgacctgcgtggacggcctgcacgtggaggacaagcagaaggtgagagacagaaacgtgatccccgacaccccccccagcacccccctggtgcccagcagagccagcagcgagtgggacatcaagaagctgaccaagaagctgaagggcgagctggccaaggagttcgcccccgccaccccccccagcaccccccacaacagcagcgtgggcagcctgagcgagaacgagcagaacaccatcgagaaggaggagttcatgctgaagctgatgagaagcctgagcgaggaggtggagagcagcgagagcggcgagctgcccgaggtggacgtgaagagcgagcacagcggcaagaaggtgcagttcgccgaggccctggccacccacatcctgagcctggccaccgagatggccgccagccacctggacaacaagatcatccaggagcccaaggtgaagaacccctgcctgaacgtgcagagccagagaagcgtgagccccaccttcctgaaccccagcgacgagaacctgaagaccctgtgcaacttcgccggcgacctggccgccgaggtgatcaccgaggccgagaagatcgccaaggtgagaaactgcatgctgttcaagcagaagaagaacagctgctacgccgacggcgacgaggactacaaggtggaggagaagctggacatcgaggccgtggtgcaccccagagaggtggaccccttcatcctgagcctgccccccagcagctgcatgagcggcctgatgtacaagtaccccagctgcgagagcgtgaccgacgagtacgccggccacctgatccagatcctgaagcaggagggcggcaacagcgagctgatcatggaccagtacgccaacagactggcctacagaagcgtgaagagcggcctgcaggaggccgccaagaccaccaaggtgcagtgcaacagcagaatgttccccgtgcccagcagccaggtgaagaccaacaaggagctgctgatgttcagcaacaaggagcaccaccaggaggccgacaagaagagacagagcaagagaaacgagggctacttctgcaagaaccagacctgcgagagaaccctggacccctacagaaacgaggtgagccagctgtacagcttcagcaccagcctggtgcacagcatcaccaaggacgccaaggaggagctgaccgccagcctggtgggcctgcccaagagcctgaccgacagctgcctgttcgagaagagcggctacgaggaggacaacgagtgccacgtgacccccgagctgcccaagagcctgcagcccagcagccagaaccacagattctaccacagcaccggcagcctgaacggctacggctgcggcgacaacgtggtgcaggccgtggagcagtacgccaagaaggtggtggacgacaccctggagctgaccctgggcagcaccgtgttcagagtgagcgagaccaccaagagcgccgacagagtgacctacgccgagaagctgagccccctgaccggccaggcctgcagatactgcgacctgaaggagctgcacaactgcaccggcaacagcagccagcacttcttcagacagggcagcctggccagcagcaagcccgccagcaaccccaagttcagcagcagataccagaagagcagaatcttccacctgagcgtgccccagatccacgtgaacctggacaagaaggccgtgctggccgagaagatcgtggccgaggccatcgagaaggccgagagagagctgagcagcaccagcctggccgccgacagcggcatcggccaggagggcgccagcttcgccgagagcctggccaccgagaccatgaccgccgccgtgaccaacgtgggccacgccgtgagcagcagcaaggagatcgaggacttccagagcaccgagagcgtgagcagccagcagatgaacctgagcatcggcgacgacagcaccggcagctggagcaacctgagcttcgaggacgagcaccaggacgagagcagcagcttccaccacctgagcgagagcaacggcaacagcagcagctggagcagcctgggcctggagggcgacctgtacgaggacaacctgagcttccccaccagcgacagcgacggccccgacgacaaggacgaggagcacgaggacgaggtggagggcctgggccaggacggcaagaccctgctgatcaccaacatcgacatggagccctgcaccgtggacccccagctgagaatcatcctgcagtggctgatcgccagcgaggccgaggtggccgagctgtacttccacgacagcgccaacaaggagttcatgctgctgagcaagcagctgcaggagaagggctggaaggtgggcgacctgctgcaggccgtgctgcagtactacgaggtgatggagaaggccagcagcgaggagagatgcaagagcctgttcgactggctgctggagaacgcctag

SEQ ID NO: 9193 - DNA, 417 bp, Homo sapiens
atggccgagctgcagcagctgagagtgcaggaggccgtggagagcatggtgaagagcctggagagagagaacatcagaaagatgcagggcctgatgttcagatgcagcgccagctgctgcgaggacagccaggccagcatgaagcaggtgcaccagtgcatcgagagatgccacgtgcccctggcccaggcccaggccctggtgaccagcgagctggagaagttccaggacagactggccagatgcaccatgcactgcaacgacaaggccaaggacagcatcgacgccggcagcaaggagctgcaggtgaagcagcagctggacagctgcgtgaccaagtgcgtggacgaccacatgcacctgatccccaccatgaccaagaagatgaaggaggccctgctgagcatcggcaagtag

SEQ ID NO: 9194 - DNA, 1110 bp, Homo sapiens
atgaccctggaggccatcagatacagcagaggcagcctgcagatcctggaccagctgctgctgcccaagcagagcagatacgaggccgtgggcagcgtgcaccaggcctgggaggccatcagagccatgaaggtgagaggcgcccccgccatcgccctggtgggctgcctgagcctggccgtggagctgcaggccggcgccggcggccccggcctggccgccctggtggccttcgtgagagacaagctgagcttcctggtgaccgccagacccaccgccgtgaacatggccagagccgccagagacctggccgacgtggccgccagagaggccgagagagagggcgccaccgaggaggccgtgagagagagagtgatctgctgcaccgaggacatgctggagaaggacctgagagacaacagaagcatcggcgacctgggcgccagacacctgctggagagagtggcccccagcggcggcaaggtgaccgtgctgacccactgcaacaccggcgccctggccaccgccggctacggcaccgccctgggcgtgatcagaagcctgcacagcctgggcagactggagcacgccttctgcaccgagaccagaccctacaaccagggcgccagactgaccgccttcgagctggtgtacgagcagatccccgccaccctgatcaccgacagcatggtggccgccgccatggcccacagaggcgtgagcgccgtggtggtgggcgccgacagagtggtggccaacggcgacaccgccaacaaggtgggcacctaccagctggccatcgtggccaagcaccacggcatccccttctacgtggccgcccccagcagcagctgcgacctgagactggagaccggcaaggagatcatcatcgaggagagacccggccaggagctgaccgacgtgaacggcgtgagaatcgccgcccccggcatcggcgtgtggaaccccgccttcgacgtgaccccccacgacctgatcaccggcggcatcatcaccgagctgggcgtgttcgcccccgaggagctgagaaccgccctgaccaccaccatcagcagcagagacggcaccctggacggcccccagatgtag

SEQ ID NO: 9195 - DNA, 3660 bp, Homo sapiens
atgatgagcctgagcgtgagaccccagagaagactgctgagcgccagagtgaacagaagccagagcttcgccggcgtgctgggcagccacgagagaggccccagaagcttccccgtgttcagcccccccggcccccccagaaagccccccgccctgagcagagtgagcagaatgttcagcgtggcccaccccgccgccaaggtgccccagcccgagagactggacctggtgtacaccgccctgaagagaggcctgaccgcctacctggaggtgcaccagcaggagcaggagaagctgcagggccagatcagagagagcaagagaaacagcagactgggcttcctgtacgacctggacaagcaggtgaagagcatcgagagattcctgagaagactggagttccacgccagcaagatcgacgagctgtacgaggcctactgcgtgcagagaagactgagagacggcgcctacaacatggtgagagcctacaccaccggcagccccggcagcagagaggccagagacagcctggccgaggccaccagaggccacagagagtacaccgagagcatgtgcctgctggagagcgagctggaggcccagctgggcgagttccacctgagaatgaagggcctggccggcttcgccagactgtgcgtgggcgaccagtacgagatctgcatgaagtacggcagacagagatggaagctgagaggcagaatcgagggcagcggcaagcaggtgtgggacagcgaggagaccatcttcctgcccctgctgaccgagttcctgagcatcaaggtgaccgagctgaagggcctggccaaccacgtggtggtgggcagcgtgagctgcgagaccaaggacctgttcgccgccctgccccaggtggtggccgtggacatcaacgacctgggcaccatcaagctgagcctggaggtgacctggagccccttcgacaaggacgaccagcccagcgccgccagcagcgtgaacaaggccagcaccgtgaccaagagattcagcacctacagccagagcccccccgacacccccagcctgagagagcaggccttctacaacatgctgagaagacaggaggagctggagaacggcaccgcctggagcctgagcagcgagagcagcgacgacagcagcagcccccagctgagcggcaccgccagacacagccccgcccccagacccctggtgcagcagcccgagcccctgcccatccaggtggccttcagaagacccgagacccccagcagcggccccctggacgaggagggcgccgtggcccccgtgctggccaacggccacgccccctacagcagaaccctgagccacatcagcgaggccagcgtggacgccgccctggccgaggccagcgtggaggccgtgggccccgagagcctggcctggggccccagcccccccacccaccccgcccccacccacggcgagcaccccagccccgtgccccccgccctggaccccggccacagcgccaccagcagcaccctgggcaccaccggcagcgtgcccaccagcaccgaccccgcccccagcgcccacctggacagcgtgcacaagagcaccgacagcggccccagcgagctgcccggccccacccacaccaccaccggcagcacctacagcgccatcaccaccacccacagcgcccccagccccctgacccacaccaccaccggcagcacccacaagcccatcatcagcaccctgaccaccaccggccccaccctgaacatcatcggccccgtgcagaccaccaccagccccacccacaccatgcccagccccacccacaccaccgccagccccacccacaccagcaccagccccacccacacccccaccagccccacccacaagaccagcatgagcccccccaccaccaccagccccacccccagcggcatgggcctggtgcagaccgccaccagccccacccaccccaccaccagccccacccaccccaccaccagccccatcctgatcaacgtgagccccagcaccagcctggagctggccaccctgagcagccccagcaagcacagcgaccccaccctgcccggcaccgacagcctgccctgcagcccccccgtgagcaacagctacacccaggccgaccccatggcccccagaaccccccaccccagccccgcccacagcagcagaaagcccctgaccagccccgcccccgaccccagcgagagcaccgtgcagagcctgagccccacccccagcccccccacccccgccccccagcacagcgacctgtgcctggccatggccgtgcagacccccgtgcccaccgccgccggcggcagcggcgacagaagcctggaggaggccctgggcgccctgatggccgccctggacgactacagaggccagttccccgagctgcagggcctggagcaggaggtgaccagactggagagcctgctgatgcagagacagggcctgaccagaagcagagccagcagcctgagcatcaccgtggagcacgccctggagagcttcagcttcctgaacgaggacgaggacgaggacaacgacgtgcccggcgacagaccccccagcagccccgaggccggcgccgaggacagcatcgacagccccagcgccagacccctgagcaccggctgccccgccctggacgccgccctggtgagacacctgtaccactgcagcagactgctgctgaagctgggcaccttcggccccctgagatgccaggaggcctgggccctggagagactgctgagagaggccagagtgctggaggccgtgtgcgagttcagcagaagatgggagatccccgccagcagcgcccaggaggtggtgcagttcagcgccagcagacccggcttcctgaccttctgggaccagtgcaccgagagactgagctgcttcctgtgccccgtggagagagtgctgctgaccttctgcaaccagtacggcgccagactgagcctgagacagcccggcctggccgaggccgtgtgcgtgaagttcctggaggacgccctgggccagaagctgcccagaagaccccagcccggccccggcgagcagctgaccgtgttccagttctggagcttcgtggagaccctggacagccccaccatggaggcctacgtgaccgagaccgccgaggaggtgctgctggtgagaaacctgaacagcgacgaccaggccgtggtgctgaaggccctgagactggcccccgagggcagactgagaagagacggcctgagagccctgagcagcctgctggtgcacggcaacaacaaggtgatggccgccgtgagcacccagctgagaagcctgagcctgggccccaccttcagagagagagccctgctgtgcttcctggaccagctggaggacgaggacgtgcagaccagagtggccggctgcctggccctgggctgcatcaaggcccccgagggcatcgagcccctggtgtacctgtgccagaccgacaccgaggccgtgagagaggccgccagacagagcctgcagcagtgcggcgaggagggccagagcgcccacagaagactggaggagagcctggacgccctgcccagaatcttcggccccggcagcatggccagcaccgccttctag

SEQ ID NO: 9196 - DNA, 1326 bp, Homo sapiens
atggccagcgtggccgccgccagagccgtgcccgtgggcagcggcctgagaggcctgcagagaaccctgcccctggtggtgatcctgggcgccaccggcaccggcaagagcaccctggccctgcagctgggccagagactgggcggcgagatcgtgagcgccgacagcatgcaggtgtacgagggcctggacatcatcaccaacaaggtgagcgcccaggagcagagaatctgcagacaccacatgatcagcttcgtggaccccctggtgaccaactacaccgtggtggacttcagaaacagagccaccgccctgatcgaggacatcttcgccagagacaagatccccatcgtggtgggcggcaccaactactacatcgagagcctgctgtggaaggtgctggtgaacaccaagccccaggagatgggcaccgagaaggtgatcgacagaaaggtggagctggagaaggaggacggcctggtgctgcacaagagactgagccaggtggaccccgagatggccgccaagctgcacccccacgacaagagaaaggtggccagaagcctgcaggtgttcgaggagaccggcatcagccacagcgagttcctgcacagacagcacaccgaggagggcggcggccccctgggcggccccctgaagttcagcaacccctgcatcctgtggctgcacgccgaccaggccgtgctggacgagagactggacaagagagtggacgacatgctggccgccggcctgctggaggagctgagagacttccacagaagatacaaccagaagaacgtgagcgagaacagccaggactaccagcacggcatcttccagagcatcggcttcaaggagttccacgagtacctgatcaccgagggcaagtgcaccctggagaccagcaaccagctgctgaagaagggccccggccccatcgtgccccccgtgtacggcctggaggtgagcgacgtgagcaagtgggaggagagcgtgctggagcccgccctggagatcgtgcagagcttcatccagggccacaagcccaccgccacccccatcaagatgccctacaacgaggccgagaacaagagaagctaccacctgtgcgacctgtgcgacagaatcatcatcggcgacagagagtgggccgcccacatcaagagcaagagccacctgaaccagctgaagaagagaagaagactggacagcgacgccgtgaacaccatcgagagccagagcgtgagccccgaccacaacaaggagcccaaggagaagggcagccccggccagaacgaccaggagctgaagtgcagcgtgtag

SEQ ID NO: 9197 - DNA, 618 bp, Homo sapiens
atggccgagcccctgcagcccgaccccggcgccgccgaggacgccgccgcccaggccgtggagacccccggctggaaggcccccgaggacgccggcccccagcccggcagctacgagatcagacactacggccccgccaagtgggtgagcaccagcgtggagagcatggactgggacagcgccatccagaccggcttcaccaagctgaacagctacatccagggcaagaacgagaaggagatgaagatcaagatgaccgcccccgtgaccagctacgtggagcccggcagcggccccttcagcgagagcaccatcaccatcagcctgtacatccccagcgagcagcagttcgacccccccagacccctggagagcgacgtgttcatcgaggacagagccgagatgaccgtgttcgtgagaagcttcgacggcttcagcagcgcccagaagaaccaggagcagctgctgaccctggccagcatcctgagagaggacggcaaggtgttcgacgagaaggtgtactacaccgccggctacaacagccccgtgaagctgctgaacagaaacaacgaggtgtggctgatccagaagaacgagcccaccaaggagaacgagtag

SEQ ID NO: 9198 - DNA, 624 bp, Homo sapiens
atgagctgcaccatcgagaagatcctgaccgacgccaagaccctgctggagagactgagagagcacgacgccgccgccgagagcctggtggaccagagcgccgccctgcacagaagagtggccgccatgagagaggccggcaccgccctgcccgaccagtaccaggaggacgccagcgacatgaaggacatgagcaagtacaagccccacatcctgctgagccaggagaacacccagatcagagacctgcagcaggagaacagagagctgtggatcagcctggaggagcaccaggacgccctggagctgatcatgagcaagtacagaaagcagatgctgcagctgatggtggccaagaaggccgtggacgccgagcccgtgctgaaggcccaccagagccacagcgccgagatcgagagccagatcgacagaatctgcgagatgggcgaggtgatgagaaaggccgtgcaggtggacgacgaccagttctgcaagatccaggagaagctggcccagctggagctggagaacaaggagctgagagagctgctgagcatcagcagcgagagcctgcaggccagaaaggagaacagcatggacaccgccagccaggccatcaagtag

SEQ ID NO: 9199 - DNA, 1032 bp, Homo sapiens
atgaacatccacagaagcacccccatcaccatcgccagatacggcagaagcagaaacaagacccaggacttcgaggagctgagcagcatcagaagcgccgagcccagccagagcttcagccccaacctgggcagccccagcccccccgagacccccaacctgagccactgcgtgagctgcatcggcaagtacctgctgctggagcccctggagggcgaccacgtgttcagagccgtgcacctgcacagcggcgaggagctggtgtgcaaggtgttcgacatcagctgctaccaggagagcctggccccctgcttctgcctgagcgcccacagcaacatcaaccagatcaccgagatcatcctgggcgagaccaaggcctacgtgttcttcgagagaagctacggcgacatgcacagcttcgtgagaacctgcaagaagctgagagaggaggaggccgccagactgttctaccagatcgccagcgccgtggcccactgccacgacggcggcctggtgctgagagacctgaagctgagaaagttcatcttcaaggacgaggagagaaccagagtgaagctggagagcctggaggacgcctacatcctgagaggcgacgacgacagcctgagcgacaagcacggctgccccgcctacgtgagccccgagatcctgaacaccagcggcagctacagcggcaaggccgccgacgtgtggagcctgggcgtgatgctgtacaccatgctggtgggcagataccccttccacgacatcgagcccagcagcctgttcagcaagatcagaagaggccagttcaacatccccgagaccctgagccccaaggccaagtgcctgatcagaagcatcctgagaagagagcccagcgagagactgaccagccaggagatcctggaccacccctggttcagcaccgacttcagcgtgagcaacagcgcctacggcgccaaggaggtgagcgaccagctggtgcccgacgtgaacatggaggagaacctggaccccttcttcaactag

SEQ ID NO: 9200 - DNA, 3048 bp, Homo sapiens
atgagaagattcctgagacccggccacgaccccgtgagagagagactgaagagagacctgttccagttcaacaagaccgtggagcacggcttcccccaccagcccagcgccctgggctacagccccagcctgagaatcctggccatcggcaccagaagcggcgccatcaagctgtacggcgcccccggcgtggagttcatgggcctgcaccaggagaacaacgccgtgacccagatccacctgctgcccggccagtgccagctggtgaccctgctggacgacaacagcctgcacctgtggagcctgaaggtgaagggcggcgccagcgagctgcaggaggacgagagcttcaccctgagaggcccccccggcgccgcccccagcgccacccagatcaccgtggtgctgccccacagcagctgcgagctgctgtacctgggcaccgagagcggcaacgtgttcgtggtgcagctgcccgccttcagagccctggaggacagaaccatcagcagcgacgccgtgctgcagagactgcccgaggaggccagacacagaagagtgttcgagatggtggaggccctgcaggagcaccccagagaccccaaccagatcctgatcggctacagcagaggcctggtggtgatctgggacctgcagggcagcagagtgctgtaccacttcctgagcagccagcagctggagaacatctggtggcagagagacggcagactgctggtgagctgccacagcgacggcagctactgccagtggcccgtgagcagcgaggcccagcagcccgagcccctgagaagcctggtgccctacggccccttcccctgcaaggccatcaccagaatcctgtggctgaccaccagacagggcctgcccttcaccatcttccagggcggcatgcccagagccagctacggcgacagacactgcatcagcgtgatccacgacggccagcagaccgccttcgacttcaccagcagagtgatcggcttcaccgtgctgaccgaggccgaccccgccgccaccttcgacgacccctacgccctggtggtgctggccgaggaggagctggtggtgatcgacctgcagaccgccggctggccccccgtgcagctgccctacctggccagcctgcactgcagcgccatcacctgcagccaccacgtgagcaacatccccctgaagctgtgggagagaatcatcgccgccggcagcagacagaacgcccacttcagcaccatggagtggcccatcgacggcggcaccagcctgacccccgcccccccccagagagacctgctgctgaccggccacgaggacggcaccgtgagattctgggacgccagcggcgtgtgcctgagactgctgtacaagctgagcaccgtgagagtgttcctgaccgacaccgaccccaacgagaacttcagcgcccagggcgaggacgagtggccccccctgagaaaggtgggcagcttcgacccctacagcgacgaccccagactgggcatccagaagatcttcctgtgcaagtacagcggctacctggccgtggccggcaccgccggccaggtgctggtgctggagctgaacgacgaggccgccgagcaggccgtggagcaggtggaggccgacctgctgcaggaccaggagggctacagatggaagggccacgagagactggccgccagaagcggccccgtgagattcgagcccggcttccagcccttcgtgctggtgcagtgccagccccccgccgtggtgaccagcctggccctgcacagcgagtggagactggtggccttcggcaccagccacggcttcggcctgttcgaccaccagcagagaagacaggtgttcgtgaagtgcaccctgcaccccagcgaccagctggccctggagggccccctgagcagagtgaagagcctgaagaagagcctgagacagagcttcagaagaatgagaagaagcagagtgagcagcagaaagagacaccccgccggcccccccggcgaggcccaggagggcagcgccaaggccgagagacccggcctgcagaacatggagctggcccccgtgcagagaaagatcgaggccagaagcgccgaggacagcttcaccggcttcgtgagaaccctgtacttcgccgacacctacctgaaggacagcagcagacactgccccagcctgtgggccggcaccaacggcggcaccatctacgccttcagcctgagagtgccccccgccgagagaagaatggacgagcccgtgagagccgagcaggccaaggagatccagctgatgcacagagcccccgtggtgggcatcctggtgctggacggccacagcgtgcccctgcccgagcccctggaggtggcccacgacctgagcaagagccccgacatgcagggcagccaccagctgctggtggtgagcgaggagcagttcaaggtgttcaccctgcccaaggtgagcgccaagctgaagctgaagctgaccgccctggagggcagcagagtgagaagagtgagcgtggcccacttcggcagcagaagagccgaggactacggcgagcaccacctggccgtgctgaccaacctgggcgacatccaggtggtgagcctgcccctgctgaagccccaggtgagatacagctgcatcagaagagaggacgtgagcggcatcgccagctgcgtgttcaccaagtacggccagggcttctacctgatcagccccagcgagttcgagagattcagcctgagcaccaagtggctggtggagcccagatgcctggtggacagcgccgagaccaagaaccacagacccggcaacggcgccggccccaagaaggcccccagcagagccagaaacagcggcacccagagcgacggcgaggagaagcagcccggcctggtgatggagagagccctgctgagcgacgagagagccgccaccggcgtgcacatcgagcccccctggggcgccgccagcgccatggccgagcagagcgagtggctgagcgtgcaggccgccagatag

SEQ ID NO: 9201 - DNA, 897 bp, Homo sapiens
atggccgccgccgagcccgccgtgctggccctgcccaacagcggcgccggcggcgccggcgcccccagcggcaccgtgcccgtgctgttctgcttcagcgtgttcgccagacccagcagcgtgccccacggcgccggctacgagctgctgatccagaagttcctgagcctgtacggcgaccagatcgacatgcacagaaagttcgtggtgcagctgttcgccgaggagtggggccagtacgtggacctgcccaagggcttcgccgtgagcgagagatgcaaggtgagactggtgcccctgcagatccagctgaccaccctgggcaacctgacccccagcagcaccgtgttcttctgctgcgacatgcaggagagattcagacccgccatcaagtacttcggcgacatcatcagcgtgggccagagactgctgcagggcgccagaatcctgggcatccccgtgatcgtgaccgagcagtaccccaagggcctgggcagcaccgtgcaggagatcgacctgaccggcgtgaagctggtgctgcccaagaccaagttcagcatggtgctgcccgaggtggaggccgccctggccgagatccccggcgtgagaagcgtggtgctgttcggcgtggagacccacgtgtgcatccagcagaccgccctggagctggtgggcagaggcgtggaggtgcacatcgtggccgacgccaccagcagcagaagcatgatggacagaatgttcgccctggagagactggccagaaccggcatcatcgtgaccaccagcgaggccgtgctgctgcagctggtggccgacaaggaccaccccaagttcaaggagatccagaacctgatcaaggccagcgcccccgagagcggcctgctgagcaaggtgtag

SEQ ID NO: 9202 - DNA, 2439 bp, Homo sapiens
atgagcgagcagggcgacctgaaccaggccatcgccgaggagggcggcaccgagcaggagaccgccacccccgagaacggcatcgtgaagagcgagagcctggacgaggaggagaagctggagctgcagagaagactggaggcccagaaccaggagagaagaaagagcaagagcggcgccggcaagggcaagctgaccagaagcctggccgtgtgcgaggagagcagcgccagacccggcggcgagagcctgcaggaccaggagagcatccacctgcagctgagcagcttcagcagcctgcaggaggaggacaagagcagaaaggacgacagcgagagagagaaggagaaggacaagaacaaggacaagaccagcgagaagcccaagatcagaatgctgagcaaggactgcagccaggagtacaccgacagcaccggcatcgacctgcacgagttcctgatcaacaccctgaagaacaacagcagagacagaatgatcctgctgaagatggagcaggagatcatcgacttcatcgccgacaacaacaaccactacaagaagttcccccagatgagcagctaccagagaatgctggtgcacagagtggccgcctacttcggcctggaccacaacgtggaccagaccggcaagagcgtgatcatcaacaagaccagcagcaccagaatccccgagcagagattctgcgagcacctgaaggacgagaagggcgaggagagccagaagagattcatcctgaagagagacaacagcagcatcgacaaggaggacaaccagcagaacagaatgcaccccttcagagacgacagaagaagcaagagcatcgaggagagagaggaggagtaccagagagtgagagagagaatcttcgcccacgacagcgtgtgcagccaggagagcctgttcgtggagaacagcagactgctggaggacagcaacatctgcaacgagacctacaagaagagacagctgttcagaggcaacagagacggcagcggcagaaccagcggcagcagacagagcagcagcgagaacgagctgaagtggagcgaccaccagagagcctggagcagcaccgacagcgacagcagcaacagaaacctgaagcccgccatgaccaagaccgccagcttcggcggcatcaccgtgctgaccagaggcgacagcaccagcagcaccagaagcaccggcaagctgagcaaggccggcagcgagagcagcagcagcgccggcagcagcggcagcctgagcagaacccacccccccctgcagagcacccccctggtgagcggcgtggccgccggcagccccggctgcgtgccctaccccgagaacggcatcggcggccaggtggcccccagcagcaccagctacatcctgctgcccctggaggccgccaccggcatcccccccggcagcatcctgctgaacccccacaccggccagcccttcgtgaaccccgacggcacccccgccatctacaacccccccaccagccagcagcccctgagaagcgccatggtgggccagagccagcagcagcccccccagcagcagcccagcccccagccccagcagcaggtgcagcccccccagccccagatggccggccccctggtgacccagagagacgacgtggccacccagttcggccagatgaccctgagcagacagagcagcggcgagacccccgagccccccagcggccccgtgtaccccagcagcctgatgccccagcccgcccagcagcccagctacgtgatcgccagcaccggccagcagctgcccaccggcggcttcagcggcagcggcccccccatcagccagcaggtgctgcagcccccccccagcccccagggcttcgtgcagcagcccccccccgcccagatgcccgtgtactactaccccagcggccagtaccccaccagcaccacccagcagtacagacccatggcccccgtgcagtacaacgcccagagaagccagcagatgccccaggccgcccagcaggccggctaccagcccgtgctgagcggccagcagggcttccagggcctgatcggcgtgcagcagcccccccagagccagaacgtgatcaacaaccagcagggcacccccgtgcagagcgtgatggtgagctaccccaccatgagcagctaccaggtgcccatgacccagggcagccagggcctgccccagcagagctaccagcagcccatcatgctgcccaaccaggccggccagggcagcctgcccgccaccggcatgcccgtgtactgcaacgtgaccccccccaccccccagaacaacctgagactgatcggcccccactgccccagcagcaccgtgcccgtgatgagcgccagctgcagaaccaactgcgccagcatgagcaacgccggctggcaggtgaagttctag

SEQ ID NO: 9203 - DNA, 1191 bp, Homo sapiens
atgaccaccctggtgctggacaacggcgcctacaacgccaagatcggctacagccacgagaacgtgagcgtgatccccaactgccagttcagaagcaagaccgccagactgaagaccttcaccgccaaccagatcgacgagatcaaggaccccagcggcctgttctacatcctgcccttccagaagggctacctggtgaactgggacgtgcagagacaggtgtgggactacctgttcggcaaggagatgtaccaggtggacttcctggacaccaacatcatcatcaccgagccctacttcaacttcaccagcatccaggagagcatgaacgagatcctgttcgaggagtaccagttccaggccgtgctgagagtgaacgccggcgccctgagcgcccacagatacttcagagacaaccccagcgagctgtgctgcatcatcgtggacagcggctacagcttcacccacatcgtgccctactgcagaagcaagaagaagaaggaggccatcatcagaatcaacgtgggcggcaagctgctgaccaaccacctgaaggagatcatcagctacagacagctgcacgtgatggacgagacccacgtgatcaaccaggtgaaggaggacgtgtgctacgtgagccaggacttctacagagacatggacatcgccaagctgaagggcgaggagaacaccgtgatgatcgactacgtgctgcccgacttcagcaccatcaagaagggcttctgcaagcccagagaggagatggtgctgagcggcaagtacaagagcggcgagcagatcctgagactggccaacgagagattcgccgtgcccgagatcctgttcaaccccagcgacatcggcatccaggagatgggcatccccgaggccatcgtgtacagcatccagaacctgcccgaggagatgcagccccacttcttcaagaacatcgtgctgaccggcggcaacagcctgttccccggcttcagagacagagtgtacagcgaggtgagatgcctgacccccaccgactacgacgtgagcgtggtgctgcccgagaaccccatcacctacgcctgggagggcggcaagctgatcagcgagaacgacgacttcgaggacatggtggtgaccagagaggactacgaggagaacggccacagcgtgtgcgaggagaagttcgacatctag

SEQ ID NO: 9204 - DNA, 1005 bp, Homo sapiens
atggagcccggccccaccgccgcccagagaagatgcagcctgcccccctggctgcccctgggcctgctgctgtggagcggcctggccctgggcgccctgcccttcggcagcagcccccacagagtgttccacgacctgctgagcgagcagcagctgctggaggtggaggacctgagcctgagcctgctgcagggcggcggcctgggccccctgagcctgccccccgacctgcccgacctggaccccgagtgcagagagctgctgctggacttcgccaacagcagcgccgagctgaccggctgcctggtgagaagcgccagacccgtgagactgtgccagacctgctaccccctgttccagcaggtggtgagcaagatggacaacatcagcagagccgccggcaacaccagcgagagccagagctgcgccagaagcctgctgatggccgacagaatgcagatcgtggtgatcctgagcgagttcttcaacaccacctggcaggaggccaactgcgccaactgcctgaccaacaacagcgaggagctgagcaacagcaccgtgtacttcctgaacctgttcaaccacaccctgacctgcttcgagcacaacctgcagggcaacgcccacagcctgctgcagaccaagaactacagcgaggtgtgcaagaactgcagagaggcctacaagaccctgagcagcctgtacagcgagatgcagaagatgaacgagctggagaacaaggccgagcccggcacccacctgtgcatcgacgtggaggacgccatgaacatcaccagaaagctgtggagcagaaccttcaactgcagcgtgccctgcagcgacaccgtgcccgtgatcgccgtgagcgtgttcatcctgttcctgcccgtggtgttctacctgagcagcttcctgcacagcgagcagaagaagagaaagctgatcctgcccaagagactgaagagcagcaccagcttcgccaacatccaggagaacagcaactag

SEQ ID NO: 9205 - DNA, 2172 bp, Homo sapiens
atgagcaccgccaccggccccgaggccgcccccaagcccagcgccaagagcatctacgagcagagaaagagatacagcaccgtggtgatggccgacgtgagccagtaccccgtgaaccacctggtgaccttctgcctgggcgaggacgacggcgtgcacaccgtggaggacgccagcagaaagctggccgtgatggacagccagggcagagtgtgggcccaggagatgctgctgagagtgagccccgaccacgtgaccctgctggaccccgccagcaaggaggagctggagagctaccccctgggcgccatcgtgagatgcgacgccgtgatgccccccggcagaagcagaagcctgctgctgctggtgtgccaggagcccgagagagcccagcccgacgtgcacttcttccagggcctgagactgggcgccgagctgatcagagaggacatccagggcgccctgcacaactacagaagcggcagaggcgagagaagagccgccgccctgagagccacccaggaggagctgcagagagacagaagccccgccgccgagaccccccccctgcagagaagacccagcgtgagagccgtgatcagcaccgtggagagaggcgccggcagaggcagaccccaggccaagcccatccccgaggccgaggaggcccagagacccgagcccgtgggcaccagcagcaacgccgacagcgccagccccgacctgggccccagaggccccgacctggccgtgctgcaggccgagagagaggtggacatcctgaaccacgtgttcgacgacgtggagagcttcgtgagcagactgcagaagagcgccgaggccgccagagtgctggagcacagagagagaggcagaagaagcagaagaagagccgccggcgagggcctgctgaccctgagagccaagccccccagcgaggccgagtacaccgacgtgctgcagaagatcaagtacgccttcagcctgctggccagactgagaggcaacatcgccgaccccagcagccccgagctgctgcacttcctgttcggccccctgcagatgatcgtgaacaccagcggcggccccgagttcgccagcagcgtgagaagaccccacctgaccagcgacgccgtggccctgctgagagacaacgtgacccccagagagaacgagctgtggaccagcctgggcgacagctggaccagacccggcctggagctgagccccgaggagggccccccctacagacccgagttcttcagcggctgggagccccccgtgaccgacccccagagcagagcctgggaggaccccgtggagaagcagctgcagcacgagagaagaagaagacagcagagcgccccccaggtggccgtgaacggccacagagacctggagcccgagagcgagccccagctggagagcgagaccgccggcaagtgggtgctgtgcaactacgacttccaggccagaaacagcagcgagctgagcgtgaagcagagagacgtgctggaggtgctggacgacagcagaaagtggtggaaggtgagagaccccgccggccaggagggctacgtgccctacaacatcctgaccccctaccccggccccagactgcaccacagccagagccccgccagaagcctgaacagcacccccccccccccccccgcccccgcccccgcccccccccccgccctggccagacccagatgggacagacccagatgggacagctgcgacagcctgaacggcctggaccccagcgagaaggagaagttcagccagatgctgatcgtgaacgaggagctgcaggccagactggcccagggcagaagcggccccagcagagccgtgcccggccccagagcccccgagccccagctgagccccggcagcgacgccagcgaggtgagagcctggctgcaggccaagggcttcagcagcggcaccgtggacgccctgggcgtgctgaccggcgcccagctgttcagcctgcagaaggaggagctgagagccgtgagccccgaggagggcgccagagtgtacagccaggtgaccgtgcagagaagcctgctggaggacaaggagaaggtgagcgagctggaggccgtgatggagaagcagaagaagaaggtggagggcgaggtggagatggaggtgatctag

SEQ ID NO: 9206 - DNA, 5622 bp, Homo sapiens
atgttcagcagaagaagccacggcgacgtgaagaagagcacccagaaggtgctggaccccaagaaggacgtgctgaccagactgaagcacctgagagccctgctggacaacgtggacgccaacgacctgaagcagttcttcgagaccaactacagccagatctacttcatcttctacgagaacttcatcgccctggagaacagcctgaagctgaagggcaacaacaagagccagagagaggagctggacagcatcctgttcctgttcgagaagatcctgcagttcctgcccgagagaatcttcttcagatggcactaccagagcatcggcagcaccctgaagaagctgctgcacaccggcaacagcatcaagatcagatgcgagggcatcagactgttcctgctgtggctgcaggccctgcagaccaactgcgccgaggagcaggtgctgatcttcgcctgcctggtgcccggcttccccgccgtgatgagcagcagaggcccctgcaccctggagaccctgatcaaccccagccccagcgtggccgacgtgaagatctaccccgaggagatcacccccctgctgcccgccatcagcggcgagaagatcgccgaggaccagacctgcttcttcctgcagatcctgctgaagtacatggtgatccaggccgccagcctggagtggaagaacaaggagaaccaggacaccggcttcaagttcctgttcaccctgttcagaaagtactacctgccccacctgttccccagcttcaccaagctgaccaacatctacaagcccgtgctggacatcccccacctgagacccaagcccgtgtacatcaccaccaccagagacaacgagaacatctacagcaccaagatcccctacatggccgccagagtggtgttcatcaagtggatcgtgaccttcttcctggagaagaagtacctgaccgccacccagaacaccaagaacggcgtggacgtgctgcccaagatcatccagaccgtgggcggcggcgccgtgcaggagagagcccccgagctggacggcggcggccccaccgagcaggacaagagccacagcaacagcagcaccctgagcgacagaagactgagcaacagcagcctgtgcagcatcgaggaggagcacagaatggtgtacgagatggtgcagagaatcctgctgagcaccagaggctacgtgaacttcgtgaacgaggtgttccaccaggccttcctgctgcccagctgcgagatcgccgtgaccagaaaggtggtgcaggtgtacagaaagtggatcctgcaggacaagcccgtgttcatggaggagcccgacagaaaggacgtggcccaggaggacgccgagaagctgggcttcagcgagaccgacagcaaggaggccagcagcgagagcagcggccacaagagaagcagcagctggggcagaacctacagcttcaccagcgccatgagcagaggctgcgtgaccgaggaggagaacaccaacgtgaaggccggcgtgcaggccctgctgcaggtgttcctgaccaacagcgccaacatcttcctgctggagccctgcgccgaggtgcccgtgctgctgaaggagcaggtggacgcctgcaaggccgtgctgatcatcttcagaagaatgatcatggagctgaccatgaacaagaagacctgggagcagatgctgcagatcctgctgagaatcaccgaggccgtgatgcagaagcccaaggacaagcagatcaaggacctgttcgcccagagcctggccggcctgctgttcagaaccctgatggtggcctggatcagagccaacctgtgcgtgtacatcagcagagagctgtgggacgacttcctgggcgtgctgagcagcctgaccgagtgggaggagctgatcaacgagtgggccaacatcatggacagcctgaccgccgtgctggccagaaccgtgtacggcgtggagatgaccaacctgcccctggacaagctgagcgagcagaaggagaagaagcagagaggcaagggctgcgtgctggacccccagaagggcaccaccgtgggcagaagcttcagcctgagctggagaagccaccccgacgtgaccgagcccatgagattcagaagcgccaccaccagcggcgcccccggcgtggagaaggccagaaacatcgtgagacagaaggccaccgaggtggaggagtgccagcagagcgagaacgcccccgccgccggcagcggccacctgaccgtgggccagcagcagcaggtgctgagaagcagcagcaccagcgacatccccgagcccctgtgcagcgacagcagccagggccagaaggccgagaacacccagaacagcagcagcagcgagccccagcccatccaggagaacaagggccacgtgaagagagagcacgagggcatcaccatcctggtgagaagaagcagcagccccgccgagctggacctgaaggacgacctgcagcagacccagggcaagtgcagagagagacagaagagcgagagcaccaacagcgacaccaccctgggctgcaccaacgaggccgagctgagcatgggcccctggcagacctgcgaggaggaccccgagctgaacacccccaccgacgtggtggccgacgccgacgccagacactggctgcagctgagccccaccgacgccagcaacctgaccgacagcagcgagtgcctgaccgacgactgcagcatcatcgccggcggcagcctgaccggctggcaccccgacagcgccgccgtgctgtggagaagagtgctgggcatcctgggcgacgtgaacaacatccagagccccaagatccacgccagagtgttctgctacctgtacgagctgtggtacaagctggccaagatcagagacaacctggccatcagcctggacaaccagagcagccccagcccccccgtgctgatcccccccctgagaatgttcgccagctggctgttcaaggccgccaccctgcccaacgagtacaaggagggcaagctgcaggcctacagactgatctgcgccatgatgaccagaagacaggacgtgctgcccaacagcgacttcctggtgcacttctacctggtgatgcacctgggcctgaccagcgaggaccaggacatcctgaacaccatcatcagacactgcccccccagattcttcagcctgggcttccccggcttcagcatgctggtgggcgacttcatcaccgccgccgccagagtgctgagcaccgacatcctgaccgcccccagaagcgaggccgtgaccgtgctgggcagcctggtgtgcttccccaacacctaccaggagatccccctgctgcagagcgtgcccgaggtgaacgaggccatcaccggcaccgaggacgtgaagcactacctgatcaacatcctgctgaagaacgccaccgaggagcccaacgagtacgccagatgcatcgccgtgtgcagcctgggcgtgtggatctgcgaggagctggcccagtgcaccagccacccccaggtgaaggaggccatcaacgtgatcggcgtgaccctgaagttccccaacaagatcgtggcccaggtggcctgcgacgtgctgcagctgctggtgagctactgggagaagctgcagatgttcgagaccagcctgcccagaaagatggccgagatcctggtggccaccgtggccttcctgctgcccagcgccgagtacagcagcgtggagaccgacaagaagttcatcgtgagcctgctgctgtgcctgctggactggtgcatggccctgcccgtgagcgtgctgctgcaccccgtgagcaccgccgtgctggaggagcagcacagcgccagagcccccctgctggactacatctacagagtgctgcactgctgcgtgtgcggcagcagcacctacacccagcagagccactacatcctgaccctggccgacctgagcagcaccgactacgaccccttcctgcccctggccaacgtgaagagcagcgagcccgtgcagtaccacagcagcgccgagctgggcaacctgctgaccgtggaggaggagaagaagagaagaagcctggagctgatccccctgaccgccagaatggtgatggcccacctggtgaaccacctgggccactaccccctgagcggcggccccgccatcctgcacagcctggtgagcgagaaccacgacaacgcccacgtggagggcagcgagctgagcttcgaggtgttcagaagccccaacctgcagctgttcgtgttcaacgacagcaccctgatcagctacctgcagacccccaccgagggccccgtgggcggcagccccgtgggcagcctgagcgacgtgagagtgatcgtgagagacatcagcggcaagtacagctgggacggcaaggtgctgtacggccccctggagggctgcctggcccccaacggcagaaaccccagcttcctgatcagcagctggcacagagacaccttcggcccccagaaggacagcagccaggtggaggagggcgacgacgtgctggacaagctgctggagaacatcggccacaccagccccgagtgcctgctgcccagccagctgaacctgaacgagcccagcctgaccccctgcggcatgaactacgaccaggagaaggagatcatcgaggtgatcctgagacagaacgcccaggaggacgagtacatccagagccacaacttcgacagcgccatgaaggtgaccagccagggccagcccagccccgtggagcccagaggccccttctacttctgcagactgctgctggacgacctgggcatgaacagctgggacagaagaaagaacttccacctgctgaagaagaacagcaagctgctgagagagctgaagaacctggacagcagacagtgcagagagacccacaagatcgccgtgttctacatcgccgagggccaggaggacaagtgcagcatcctgagcaacgagagaggcagccaggcctacgaggacttcgtggccggcctgggctgggaggtggacctgagcacccactgcggcttcatgggcggcctgcagagaaacggcagcaccggccagaccgccccctactacgccaccagcaccgtggaggtgatcttccacgtgagcaccagaatgcccagcgacagcgacgacagcctgaccaagaagctgagacacctgggcaacgacgaggtgcacatcgtgtggagcgagcacagcagagactacagaagaggcatcatccccaccgccttcggcgacgtgagcatcatcatctaccccatgaagaaccacatgttcttcatcgccatcaccaagaagcccgaggtgcccttcttcggccccctgttcgacggcgccatcgtgagcggcaagctgctgcccagcctggtgtgcgccacctgcatcaacgccagcagagccgtgaagtgcctgatccccctgtaccagagcttctacgaggagagagccctgtacctggaggccatcatccagaaccacagagaggtgatgaccttcgaggacttcgccgcccaggtgttcagccccagccccagctacagcctgagcggcaccgactag

SEQ ID NO: 9207 - DNA, 1041 bp, Homo sapiens
atggccagacccggccagagatggctgggcaagtggctggtggccatggtggtgtgggccctgtgcagactggccacccccctggccaagaacctggagcccgtgagctggagcagcctgaaccccaagttcctgagcggcaagggcctggtgatctaccccaagatcggcgacaagctggacatcatctgccccagagccgaggccggcagaccctacgagtactacaagctgtacctggtgagacccgagcaggccgccgcctgcagcaccgtgctggaccccaacgtgctggtgacctgcaacagacccgagcaggagatcagattcaccatcaagttccaggagttcagccccaactacatgggcctggagttcaagaagcaccacgactactacatcaccagcaccagcaacggcagcctggagggcctggagaacagagagggcggcgtgtgcagaaccagaaccatgaagatcatcatgaaggtgggccaggaccccaacgccgtgacccccgagcagctgaccaccagcagacccagcaaggaggccgacaacaccgtgaagatggccacccaggcccccggcagcagaggcagcctgggcgacagcgacggcaagcacgagaccgtgaaccaggaggagaagagcggccccggcgccagcggcggcagcagcggcgaccccgacggcttcttcaacagcaaggtggccctgttcgccgccgtgggcgccggctgcgtgatcttcctgctgatcatcatcttcctgaccgtgctgctgctgaagctgagaaagagacacagaaagcacacccagcagagagccgccgccctgagcctgagcaccctggccagccccaagggcggcagcggcaccgccggcaccgagcccagcgacatcatcatccccctgagaaccaccgagaacaactactgcccccactacgagaaggtgagcggcgactacggccaccccgtgtacatcgtgcaggagatgcccccccagagccccgccaacatctactacaaggtgtag

SEQ ID NO: 9208 - DNA, 1617 bp, Homo sapiens
atggccagcgaccccatcttcaccctggccccccccctgcactgccactacggcgccttcccccccaacgccagcggctgggagcagccccccaacgccagcggcgtgagcgtggccagcgccgccctggccgccagcgccgccagcagagtggccaccagcaccgaccccagctgcagcggcttcgccccccccgacttcaaccactgcctgaaggactgggactacaacggcctgcccgtgctgaccaccaacgccatcggccagtgggacctggtgtgcgacctgggctggcaggtgatcctggagcagatcctgttcatcctgggcttcgccagcggctacctgttcctgggctaccccgccgacagattcggcagaagaggcatcgtgctgctgaccctgggcctggtgggcccctgcggcgtgggcggcgccgccgccggcagcagcaccggcgtgatggccctgagattcctgctgggcttcctgctggccggcgtggacctgggcgtgtacctgatgagactggagctgtgcgaccccacccagagactgagagtggccctggccggcgagctggtgggcgtgggcggccacttcctgttcctgggcctggccctggtgagcaaggactggagattcctgcagagaatgatcaccgccccctgcatcctgttcctgttctacggctggcccggcctgttcctggagagcgccagatggctgatcgtgaagagacagatcgaggaggcccagagcgtgctgagaatcctggccgagagaaacagaccccacggccagatgctgggcgaggaggcccaggaggccctgcaggacctggagaacacctgccccctgcccgccaccagcagcttcagcttcgccagcctgctgaactacagaaacatctggaagaacctgctgatcctgggcttcaccaacttcatcgcccacgccatcagacactgctaccagcccgtgggcggcggcggcagccccagcgacttctacctgtgcagcctgctggccagcggcaccgccgccctggcctgcgtgttcctgggcgtgaccgtggacagattcggcagaagaggcatcctgctgctgagcatgaccctgaccggcatcgccagcctggtgctgctgggcctgtgggactgcgagcaccccatcttccccaccgtgtgggcccagcagggcaaccccaacagagacctgaacgaggccgccatcaccaccttcagcgtgctgggcctgttcagcagccaggccgccgccatcctgagcaccctgctggccgccgaggtgatccccaccaccgtgagaggcagaggcctgggcctgatcatggccctgggcgccctgggcggcctgagcggccccgcccagagactgcacatgggccacggcgccttcctgcagcacgtggtgctggccgcctgcgccctgctgtgcatcctgagcatcatgctgctgcccgagaccaagagaaagctgctgcccgaggtgctgagagacggcgagctgtgcagaagacccagcctgctgagacagcccccccccaccagatgcgaccacgtgcccctgctggccacccccaaccccgccctgtag

SEQ ID NO: 9209 - DNA, 1128 bp, Homo sapiens
atgagcaccgccggcaaggtgatcaagtgcaaggccgccgtgctgtgggagctgaagaagcccttcagcatcgaggaggtggaggtggccccccccaaggcccacgaggtgagaatcaagatggtggccgtgggcatctgcggcaccgacgaccacgtggtgagcggcaccatggtgacccccctgcccgtgatcctgggccacgaggccgccggcatcgtggagagcgtgggcgagggcgtgaccaccgtgaagcccggcgacaaggtgatccccctggccatcccccagtgcggcaagtgcagaatctgcaagaaccccgagagcaactactgcctgaagaacgacgtgagcaacccccagggcaccctgcaggacggcaccagcagattcacctgcagaagaaagcccatccaccacttcctgggcatcagcaccttcagccagtacaccgtggtggacgagaacgccgtggccaagatcgacgccgccagccccctggagaaggtgtgcctgatcggctgcggcttcagcaccggctacggcagcgccgtgaacgtggccaaggtgacccccggcagcacctgcgccgtgttcggcctgggcggcgtgggcctgagcgccatcatgggctgcaaggccgccggcgccgccagaatcatcgccgtggacatcaacaaggacaagttcgccaaggccaaggagctgggcgccaccgagtgcatcaacccccaggactacaagaagcccatccaggaggtgctgaaggagatgaccgacggcggcgtggacttcagcttcgaggtgatcggcagactggacaccatgatggccagcctgctgtgctgccacgaggcctgcggcaccagcgtgatcgtgggcgtgccccccgacagccagaacctgagcatgaaccccatgctgctgctgaccggcagaacctggaagggcgccatcctgggcggcttcaagagcaaggagtgcgtgcccaagctggtggccgacttcatggccaagaagttcagcctggacgccctgatcacccacgtgctgcccttcgagaagatcaacgagggcttcgacctgctgcacagcggcaagagcatcagaaccatcctgatgttctag

SEQ ID NO: 9210 - DNA, 1641 bp, Homo sapiens
atgtgcagcctgggcctgttccccccccccccccccagaggccaggtgaccctgtacgagcacaacaacgagctggtgaccggcagcagctacgagagccccccccccgacttcagaggccagtggatcaacctgcccgtgctgcagctgaccaaggaccccctgaagacccccggcagactggaccacggcaccagaaccgccttcatccaccacagagagcaggtgtggaagagatgcatcaacatctggagagacgtgggcctgttcggcgtgctgaacgagatcgccaacagcgaggaggaggtgttcgagtgggtgaagaccgccagcggctgggccctggccctgtgcagatgggccagcagcctgcacggcagcctgttcccccacctgagcctgagaagcgaggacctgatcgccgagttcgcccaggtgaccaactggagcagctgctgcctgagagtgttcgcctggcacccccacaccaacaagttcgccgtggccctgctggacgacagcgtgagagtgtacaacgccagcagcaccatcgtgcccagcctgaagcacagactgcagagaaacgtggccagcctggcctggaagcccctgagcgccagcgtgctggccgtggcctgccagagctgcatcctgatctggaccctggaccccaccagcctgagcaccagacccagcagcggctgcgcccaggtgctgagccaccccggccacacccccgtgaccagcctggcctgggcccccagcggcggcagactgctgagcgccagccccgtggacgccgccatcagagtgtgggacgtgagcaccgagacctgcgtgcccctgccctggttcagaggcggcggcgtgaccaacctgctgtggagccccgacggcagcaagatcctggccaccacccccagcgccgtgttcagagtgtgggaggcccagatgtggacctgcgagagatggcccaccctgagcggcagatgccagaccggctgctggagccccgacggcagcagactgctgttcaccgtgctgggcgagcccctgatctacagcctgagcttccccgagagatgcggcgagggcaagggctgcgtgggcggcgccaagagcgccaccatcgtggccgacctgagcgagaccaccatccagacccccgacggcgaggagagactgggcggcgaggcccacagcatggtgtgggaccccagcggcgagagactggccgtgctgatgaagggcaagcccagagtgcaggacggcaagcccgtgatcctgctgttcagaaccagaaacagccccgtgttcgagctgctgccctgcggcatcatccagggcgagcccggcgcccagccccagctgatcaccttccaccccagcttcaacaagggcgccctgctgagcgtgggctggagcaccggcagaatcgcccacatccccctgtacttcgtgaacgcccagttccccagattcagccccgtgctgggcagagcccaggagccccccgccggcggcggcggcagcatccacgacctgcccctgttcaccgagaccagccccaccagcgccccctgggaccccctgcccggccccccccccgtgctgccccacagcccccacagccacctgtag

SEQ ID NO: 9211 - DNA, 576 bp, Homo sapiens
atgggcaagaagaccaagagaaccgccgacagcagcagcagcgaggacgaggaggagtacgtggtggagaaggtgctggacagaagagtggtgaagggccaggtggagtacctgctgaagtggaagggcttcagcgaggagcacaacacctgggagcccgagaagaacctggactgccccgagctgatcagcgagttcatgaagaagtacaagaagatgaaggagggcgagaacaacaagcccagagagaagagcgagagcaacaagagaaagagcaacttcagcaacagcgccgacgacatcaagagcaagaagaagagagagcagagcaacgacatcgccagaggcttcgagagaggcctggagcccgagaagatcatcggcgccaccgacagctgcggcgacctgatgttcctgatgaagtggaaggacaccgacgaggccgacctggtgctggccaaggaggccaacgtgaagtgcccccagatcgtgatcgccttctacgaggagagactgacctggcacgcctaccccgaggacgccgagaacaaggagaaggagaccgccaagagctag

SEQ ID NO: 9212 - DNA, 1554 bp, Homo sapiens
atgggcagaaagagcaagaagtggggcaagaaggtgagcagatacgagggcaaggtgagactgaagaaggtgcccgccaagaagctggtgcccgcctggaaggagaaggtgctgtgggccctgctggccgtgctgctggccagctggagactgtgggccatcaaggacttccaggagtgcacctggcaggtggtgctgaacgagttcaagagagtgggcgagagcggcgtgagcgacagcttcttcgagcaggagcccgtggacaccgtgagcagcctgttccacatgctggtggacagccccatcgaccccagcgagaagtacctgggcttcccctactacctgaagatcaactacagctgcgaggagaagcccagcgaggacctggtgagaatgggccacctgaccggcctgaagcccctggtgctggtgaccttccagagccccgtgaacttctacagatggaagatcgagcagctgcagatccagatggaggccgcccccttcagaagcaagggcggccccggcggcggcggcagagacagaaacctggccggcatgaacatcaacggcttcctgaagagagacagagacaacaacatccagttcaccgtgggcgaggagctgttcaacctgatgccccagtacttcgtgggcgtgagcagcagacccctgtggcacaccgtggaccagagccccgtgctgatcctgggcggcatccccaacgagaagtacgtgctgatgaccgacaccagcttcaaggacttcagcctggtggaggtgaacggcgtgggccagatgctgagcatcgacagctgctgggtgggcagcttctactgcccccacagcggcttcaccgccaccatctacgacaccatcgccaccgagagcaccctgttcatcagacagaaccagctggtgtactacttcaccggcacctacaccaccctgtacgagagaaacagaggcagcggcgagtgcgccgtggccggccccacccccggcgagggcaccctggtgaaccccagcaccgagggcagctggatcagagtgctggccagcgagtgcatcaagaagctgtgccccgtgtacttccacagcaacggcagcgagtacatcatggccctgaccaccggcaagcacgagggctacgtgcacttcggcaccatcagagtgaccacctgcagcatcatctggagcgagtacatcgccggcgagtacaccctgctgctgctggtggagagcggctacggcaacgccagcaagagattccaggtggtgagctacaacaccgccagcgacgacctggagctgctgtaccacatccccgagttcatccccgaggccagaggcctggagttcctgatgatcctgggcaccgagagctacaccagcaccgccatggcccccaagggcatcttctgcaacccctacaacaacctgatcttcatctggggcaacttcctgctgcagagaagcggcaccagctggagagccgccaccggcagcaccagctgcagcctgcccagagccggcagatgcaccagcgcctag

SEQ ID NO: 9213 - DNA, 1203 bp, Homo sapiens
atgagcggcagagtgggcgacctgagccccaagcaggccgagaccctggccaagttcagagagaacgtgcaggacgtgctgcccgccctgcccaaccccgacgactacttcctgctgagatggctgagagccagaaacttcgacctgcagaagagcgaggccctgctgagaaagtacatggagttcagaaagaccatggacatcgaccacatcctggactggcagccccccgaggtgatccagaagtacatgcccggcggcctgtgcggctacgacagagacggctgccccgtgtggtacgacatcatcggccccctggaccccaagggcctgctgttcagcgtgaccaagcaggacctgctgaagaccaagatgagagactgcgagagaatcctgcacgagtgcgacctgcagaccgagagactgggcaagaagatcgagaccatcgtgatgatcttcgactgcgagggcctgggcctgaagcacttctggaagcccctggtggaggtgtaccaggagttcttcggcctgctggaggagaactaccccgagaccctgaagttcatgctgatcgtgaaggccaccaagctgttccccgtgggctacaacctgatgaagcccttcctgagcgaggacaccagaagaaagatcatcgtgctgggcaacaactggaaggagggcctgctgaagctgatcagccccgaggagctgcccgcccagttcggcggcaccctgaccgaccccgacggcaaccccaagtgcctgaccaagatcaactacggcggcgagatccccaagagcatgtacgtgagagaccaggtgaagacccagtacgagcacagcgtgcagatcaacagaggcagcagccaccaggtggagtacgagatcctgttccccggctgcgtgctgagatggcagttcagcagcgacggcgccgacatcggcttcggcgtgttcctgaagaccaagatgggcgagagacagagagccggcgagatgaccgacgtgctgcccagccagagatacaacgcccacatggtgcccgaggacggcaacctgacctgcagcgaggccggcgtgtacgtgctgagattcgacaacacctacagcttcgtgcacgccaagaaggtgagcttcaccgtggaggtgctgctgcccgacgagggcatgcagaagtacgacaaggagctgacccccgtgtag

SEQ ID NO: 9214 - DNA, 636 bp, Homo sapiens
atggccgagcagcacggcgcccccgagcaggccgccgccggcaagagccacggcgacctgggcggcagctacaaggtgatcctgtacgagctggagaacttccagggcaagagatgcgagctgagcgccgagtgccccagcctgaccgacagcctgctggagaaggtgggcagcatccaggtggagagcggcccctggctggccttcgagagcagagccttcagaggcgagcagttcgtgctggagaagggcgactaccccagatgggacgcctggagcaacagcagagacagcgacagcctgctgagcctgagacccctgaacatcgacagcccccaccacaagctgcacctgttcgagaaccccgccttcagcggcagaaagatggagatcgtggacgacgacgtgcccagcctgtgggcccacggcttccaggacagagtggccagcgtgagagccatcaacggcacctgggtgggctacgagttccccggctacagaggcagacagtacgtgttcgagagaggcgagtacagacactggaacgagtgggacgccagccagccccagctgcagagcgtgagaagaatcagagaccagaagtggcacaagagaggcagattccccagcagctag

SEQ ID NO: 9215 - DNA, 387 bp, Homo sapiens
atgaccgaggccgacgtgaaccccaaggcctaccccctggccgacgcccacctgaccaagaagctgctggacctggtgcagcagagctgcaactacaagcagctgagaaagggcgccaacgaggccaccaagaccctgaacagaggcatcagcgagttcatcgtgatggccgccgacgccgagcccctggagatcatcctgcacctgcccctgctgtgcgaggacaagaacgtgccctacgtgttcgtgagaagcaagcaggccctgggcagagcctgcggcgtgagcagacccgtgatcgcctgcagcgtgaccatcaaggagggcagccagctgaagcagcagatccagagcatccagcagagcatcgagagactgctggtgtag

SEQ ID NO: 9216 - DNA, 2592 bp, Homo sapiens
atggccggccccagaggcgccctgctggcctggtgcagaagacagtgcgagggctacagaggcgtggagatcagagacctgagcagcagcttcagagacggcctggccttctgcgccatcctgcacagacacagacccgacctgctggacttcgacagcctgagcaaggacaacgtgttcgagaacaacagactggccttcgaggtggccgagaaggagctgggcatccccgccctgctggaccccaacgacatggtgagcatgagcgtgcccgactgcctgagcatcatgacctacgtgagccagtactacaaccacttctgcagccccggccaggccggcgtgagcccccccagaaagggcctggccccctgcagcccccccagcgtggcccccacccccgtggagcccgaggacgtggcccagggcgaggagctgagcagcggcagcctgagcgagcagggcaccggccagacccccagcagcacctgcgccgcctgccagcagcacgtgcacctggtgcagagatacctggccgacggcagactgtaccacagacactgcttcagatgcagaagatgcagcagcaccctgctgcccggcgcctacgagaacggccccgaggagggcaccttcgtgtgcgccgagcactgcgccagactgggccccggcaccagaagcggcaccagacccggccccttcagccagcccaagcagcagcaccagcagcagctggccgaggacgccaaggacgtgcccggcggcggccccagcagcagcgcccccgccggcgccgaggccgacggccccaaggccagccccgaggccagaccccagatccccaccaagcccagagtgcccggcaagctgcaggagctggccagcccccccgccggcagacccacccccgcccccagaaaggccagcgagagcaccacccccgccccccccacccccagacccagaagcagcctgcagcaggagaacctggtggagcaggccggcagcagcagcctggtgaacggcagactgcacgagctgcccgtgcccaagcccagaggcacccccaagcccagcgagggcacccccgcccccagaaaggaccccccctggatcaccctggtgcaggccgagcccaagaagaagcccgcccccctgccccccagcagcagccccggcccccccagccaggacagcagacaggtggagaacggcggcaccgaggaggtggcccagcccagccccaccgccagcctggagagcaagccctacaaccccttcgaggaggaggaggaggacaaggaggaggaggcccccgccgcccccagcctggccaccagccccgccctgggccaccccgagagcacccccaagagcctgcacccctggtacggcatcacccccaccagcagccccaagaccaagaagagacccgcccccagagcccccagcgccagccccctggccctgcacgccagcagactgagccacagcgagccccccagcgccacccccagccccgccctgagcgtggagagcctgagcagcgagagcgccagccagaccgccggcgccgagctgctggagccccccgccgtgcccaagagcagcagcgagcccgccgtgcacgcccccggcacccccggcaaccccgtgagcctgagcaccaacagcagcctggccagcagcggcgagctggtggagcccagagtggagcagatgccccaggccagccccggcctggcccccagaaccagaggcagcagcggcccccagcccgccaagccctgcagcggcgccacccccacccccctgctgctggtgggcgacagaagccccgtgcccagccccggcagcagcagcccccagctgcaggtgaagagcagctgcaaggagaaccccttcaacagaaagcccagccccgccgccagccccgccaccaagaaggccaccaagggcagcaagcccgtgagaccccccgcccccggccacggcttccccctgatcaagagaaaggtgcaggccgaccagtacatccccgaggaggacatccacggcgagatggacaccatcgagagaagactggacgccctggagcacagaggcgtgctgctggaggagaagctgagaggcggcctgaacgagggcagagaggacgacatgctggtggactggttcaagctgatccacgagaagcacctgctggtgagaagagagagcgagctgatctacgtgttcaagcagcagaacctggagcagagacaggccgacgtggagtacgagctgagatgcctgctgaacaagcccgagaaggactggaccgaggaggacagagccagagagaaggtgctgatgcaggagctggtgaccctgatcgagcagagaaacgccatcatcaactgcctggacgaggacagacagagagaggaggaggaggacaagatgctggaggccatgatcaagaagaaggagttccagagagaggccgagcccgagggcaagaagaagggcaagttcaagaccatgaagatgctgaagctgctgggcaacaagagagacgccaagagcaagagccccagagacaagagctag

SEQ ID NO: 9217 - DNA, 708 bp, Homo sapiens
atgtggagaggcagagccggcgccctgctgagagtgtggggcttctggcccaccggcgtgcccagaagaagacccctgagctgcgacgccgccagccaggccggcagcaactaccccagatgctggaactgcggcggcccctggggccccggcagagaggacagattcttctgcccccagtgcagagccctgcaggcccccgaccccaccagagactacttcagcctgatggactgcaacagaagcttcagagtggacaccgccaagctgcagcacagataccagcagctgcagagactggtgcaccccgacttcttcagccagagaagccagaccgagaaggacttcagcgagaagcacagcaccctggtgaacgacgcctacaagaccctgctggcccccctgagcagaggcctgtacctgctgaagctgcacggcatcgagatccccgagagaaccgactacgagatggacagacagttcctgatcgagatcatggagatcaacgagaagctggccgaggccgagagcgaggccgccatgaaggagatcgagagcatcgtgaaggccaagcagaaggagttcaccgacaacgtgagcagcgccttcgagcaggacgacttcgaggaggccaaggagatcctgaccaagatgagatacttcagcaacatcgaggagaagatcaagctgaagaagatccccctgtag

SEQ ID NO: 9218 - DNA, 2010 bp, Homo sapiens
atggccaccgagagaagcagaagcgccatggacagccccgtgcccgccagcatgttcgcccccgagcccagcagccccggcgccgccagagccgccgccgccgccgccagactgcacggcggcttcgacagcgactgcagcgaggacggcgaggccctgaacggcgagcccgagctggacctgaccagcaagctggtgctggtgagccccaccagcgagcagtacgacagcctgctgagacagatgtgggagagaatggacgagggctgcggcgagaccatctacgtgatcggccagggcagcgacggcaccgagtacggcctgagcgaggccgacatggaggccagctacgccaccgtgaagagcatggccgagcagatcgaggccgacgtgatcctgctgagagagagacaggaggccggcggcagagtgagagactacctggtgagaaagagagtgggcgacaacgacttcctggaggtgagagtggccgtggtgggcaacgtggacgccggcaagagcaccctgctgggcgtgctgacccacggcgagctggacaacggcagaggcttcgccagacagaagctgttcagacacaagcacgagatcgagagcggcagaaccagcagcgtgggcaacgacatcctgggcttcgacagcgagggcaacgtggtgaacaagcccgacagccacggcggcagcctggagtggaccaagatctgcgagaagagcaccaaggtgatcaccttcatcgacctggccggccacgagaagtacctgaagaccaccgtgttcggcatgaccggccacctgcccgacttctgcatgctgatggtgggcagcaacgccggcatcgtgggcatgaccaaggagcacctgggcctggccctggccctgaacgtgcccgtgttcgtggtggtgaccaagatcgacatgtgccccgccaacatcctgcaggagaccctgaagctgctgcagagactgctgaagagccccggctgcagaaagatccccgtgctggtgcagagcaaggacgacgtgatcgtgaccgccagcaacttcagcagcgagagaatgtgccccatcttccagatcagcaacgtgaccggcgagaacctggacctgctgaagatgttcctgaacctgctgagccccagaaccagctacagagaggaggagcccgccgagttccagatcgacgacacctacagcgtgcccggcgtgggcaccgtggtgagcggcaccaccctgagaggcctgatcaagctgaacgacaccctgctgctgggccccgaccccctgggcaacttcctgagcatcgccgtgaagagcatccacagaaagagaatgcccgtgaaggaggtgagaggcggccagaccgccagcttcgccctgaagaagatcaagagaagcagcatcagaaagggcatggtgatggtgagccccagactgaacccccaggccagctgggagttcgaggccgagatcctggtgctgcaccaccccaccaccatcagccccagataccaggccatggtgcactgcggcagcatcagacagaccgccaccatcctgagcatggacaaggactgcctgagaaccggcgacaaggccaccgtgcacttcagattcatcaagacccccgagtacctgcacatcgaccagagactggtgttcagagagggcagaaccaaggccgtgggcaccatcaccaagctgctgcagaccaccaacaacagccccatgaacagcaagccccagcagatcaagatgcagagcaccaagaagggccccctgaccaagagagacgagggcggccccagcggcggccccgccgtgggcgcccccccccccggcgacgaggccagcagcgtgggcgccggccagcccgccgccagcagcaacctgcagccccagcccaagcccagcagcggcggcagaagaagaggcggccagagacacaaggtgaagagccagggcgcctgcgtgacccccgccagcggctgctag

SEQ ID NO: 9219 - DNA, 1656 bp, Homo sapiens
atggccgcccccgccctgagctggagactgcccctgctgatcctgctgctgcccctggccaccagctgggccagcgccgccgtgaacggcaccagccagttcacctgcttctacaacagcagagccaacatcagctgcgtgtggagccaggacggcgccctgcaggacaccagctgccaggtgcacgcctggcccgacagaagaagatggaaccagacctgcgagctgctgcccgtgagccaggccagctgggcctgcaacctgatcctgggcgcccccgacagccagaagctgaccaccgtggacatcgtgaccctgagagtgctgtgcagagagggcgtgagatggagagtgatggccatccaggacttcaagcccttcgagaacctgagactgatggcccccatcagcctgcaggtggtgcacgtggagacccacagatgcaacatcagctgggagatcagccaggccagccactacttcgagagacacctggagttcgaggccagaaccctgagccccggccacacctgggaggaggcccccctgctgaccctgaagcagaagcaggagtggatctgcctggagaccctgacccccgacacccagtacgagttccaggtgagagtgaagcccctgcagggcgagttcaccacctggagcccctggagccagcccctggccttcagaaccaagcccgccgccctgggcaaggacaccatcccctggctgggccacctgctggtgggcctgagcggcgccttcggcttcatcatcctggtgtacctgctgatcaactgcagaaacaccggcccctggctgaagaaggtgctgaagtgcaacacccccgaccccagcaagttcttcagccagctgagcagcgagcacggcggcgacgtgcagaagtggctgagcagccccttccccagcagcagcttcagccccggcggcctggcccccgagatcagccccctggaggtgctggagagagacaaggtgacccagctgctgctgcagcaggacaaggtgcccgagcccgccagcctgagcagcaaccacagcctgaccagctgcttcaccaaccagggctacttcttcttccacctgcccgacgccctggagatcgaggcctgccaggtgtacttcacctacgacccctacagcgaggaggaccccgacgagggcgtggccggcgcccccaccggcagcagcccccagcccctgcagcccctgagcggcgaggacgacgcctactgcaccttccccagcagagacgacctgctgctgttcagccccagcctgctgggcggccccagcccccccagcaccgcccccggcggcagcggcgccggcgaggagagaatgccccccagcctgcaggagagagtgcccagagactgggacccccagcccctgggcccccccacccccggcgtgcccgacctggtggacttccagcccccccccgagctggtgctgagagaggccggcgaggaggtgcccgacgccggccccagagagggcgtgagcttcccctggagcagaccccccggccagggcgagttcagagccctgaacgccagactgcccctgaacaccgacgcctacctgagcctgcaggagctgcagggccaggaccccacccacctggtgtag

SEQ ID NO: 9220 - DNA, 3516 bp, Homo sapiens
atggagaacaacctgaagacctgccccaaggaggacggcgacttcgtgagcgacaagatcaagttcaagatcgaggaggaggacgacgacggcatcccccccgacagcctggagagaatggacttcaagagcgagcaggaggacatgaagcagaccgacagcggcggcgagagagccggcctgggcggcaccggctgcagctgcaagccccccggcaagtacctgagcgccgagagcgaggacgactacggcgccctgttcagccagtacagcagcaccctgtacgacgtggccatggaggccgtgacccagagcctgctgagcagcagaaacatgagcagcagaaagaagagccccgcctggaagcacttcttcatcagccccagagacagcaccaaggccatctgcatgtactgcgtgaaggagttcagcagaggcaagaacgagaaggacctgagcaccagctgcctgatgagacacgtgagaagagcccaccccaccgtgctgatccaggagaacggcagcgtgagcgccgtgagcagcttccccagccccagcctgctgctgcccccccagcccgccgacgccggcgacctgagcaccatcctgagccccatcaagctggtgcagaaggtggccagcaagatccccagccccgacagaatcaccgaggagagcgtgagcgtggtgagcagcgaggagatcagcagcgacatgagcgtgagcgagaagtgcggcagagaggaggccctggtgggcagcagcccccacctgcccgccctgcactacgacgagcccgccgagaacctggccgagaagagcctgcccctgcccaagagcaccagcggcagcagaagaagaagcgccgtgtggaagcacttctacctgagccccctggacaacagcaaggccgtgtgcatccactgcatgaacgagttcagcagaggcaagaacggcaaggacctgggcaccagctgcctgatcagacacatgtggagagcccacagagccatcgtgctgcaggagaacggcggcaccggcatcccccccctgtacagcaccccccccaccctgctgcccagcctgctgccccccgagggcgagctgagcagcgtgagcagcagccccgtgaagcccgtgagagagagccccagcgccagcagcagccccgacagactgaccgaggacctgcagagccacctgaaccccggcgacggcctgatggaggacgtggccgccttcagcagcagcgacgacatcggcgaggccagcgccagcagccccgagaagcagcaggccgacggcctgagccccagactgttcgagagcggcgccatcttccagcagaacaagaaggtgatgaagagactgaagagcgaggtgtggcaccacttcagcctggcccccatggacagcctgaaggccgagtgcagatactgcggctgcgccatcagcagaggcaagaagggcgacgtgggcaccagctgcctgatgagacacctgtacagaagacaccccgaggtggtgggcagccagaagggcttcctgggcgccagcctggccaacagcccctacgccaccctggccagcgccgagagcagcagcagcaagctgaccgacctgcccaccgtggtgaccaagaacaaccaggtgatgttccccgtgaacagcaagaagaccagcaagctgtggaaccacttcagcatctgcagcgccgacagcaccaaggtggtgtgcctgcactgcggcagaaccatcagcagaggcaagaagcccaccaacctgggcaccagctgcctgctgagacacctgcagagattccacagcaacgtgctgaagaccgaggtgagcgagaccgccagacccagcagccccgacaccagagtgcccagaggcaccgagctgagcggcgccagcagcttcgacgacaccaacgagaagttctacgacagccaccccgtggccaagaagatcaccagcctgatcgccgagatgatcgccctggacctgcagccctacagcttcgtggacaacgtgggcttcaacagactgctggagtacctgaagccccagtacagcctgcccgcccccagctacttcagcagaaccgccatccccggcatgtacgacaacgtgaagcagatcatcatgagccacctgaaggaggccgagagcggcgtgatccacttcaccagcggcatctggatgagcaaccagaccagagagtacctgaccctgaccgcccactgggtgagcttcgagagccccgccagacccagatgcgacgaccaccactgcagcgccctgctggacgtgagccaggtggactgcgactacagcggcaacagcatccagaagcagctggagtgctggtgggaggcctgggtgaccagcaccggcctgcaggtgggcatcaccgtgaccgacaacgccagcatcggcaagaccctgaacgagggcgagcacagcagcgtgcagtgcttcagccacaccgtgaacctgatcgtgagcgaggccatcaagagccagagaatggtgcagaacctgctgagcctggccagaaagatctgcgagagagtgcacagaagccccaaggccaaggagaagctggccgagctgcagagagagtacgccctgccccagcaccacctgatccaggacgtgcccagcaagtggagcaccagcttccacatgctggagagactgatcgagcagaagagagccatcaacgagatgagcgtggagtgcaacttcagagagctgatcagctgcgaccagtgggaggtgatgcagagcgtgtgcagagccctgaagcccttcgaggccgccagcagagagatgagcacccagatgagcaccctgagccaggtgatccccatggtgcacatcctgaacagaaaggtggagatgctgttcgaggagaccatgggcatcgacaccatgctgagaagcctgaaggaggccatggtgagcagactgagcgccaccctgcacgaccccagatacgtgttcgccaccctgctggaccccagatacaaggccagcctgttcaccgaggaggaggccgagcagtacaagcaggacctgatcagagagctggagctgatgaacagcaccagcgaggacgtggccgccagccacagatgcgacgccggcagccccagcaaggacagcgccgccgaggagaacctgtggagcctggtggccaaggtgaagaagaaggaccccagagagaagctgcccgaggccatggtgctggcctacctggaggaggaggtgctggagcacagctgcgaccccctgacctactggaacctgaagaaggccagctggcccggcctgagcgccctggccgtgagattcctgggctgcccccccagcatcgtgcccagcgagaagctgttcaacacccccaccgagaacggcagcctgggccagagcagactgatgatggagcacttcgagaagctgatcttcctgaaggtgaacctgcccctgatctacttccagtactag

SEQ ID NO: 9221 - DNA, 744 bp, Homo sapiens
atgcagcccatcctgctgctgctggccttcctgctgctgcccagagccgacgccggcgagatcatcggcggccacgaggccaagccccacagcagaccctacatggcctacctgatgatctgggaccagaagagcctgaagagatgcggcggcttcctgatcagagacgacttcgtgctgaccgccgcccactgctggggcagcagcatcaacgtgaccctgggcgcccacaacatcaaggagcaggagcccacccagcagttcatccccgtgaagagacccatcccccaccccgcctacaaccccaagaacttcagcaacgacatcatgctgctgcagctggagagaaaggccaagagaaccagagccgtgcagcccctgagactgcccagcaacaaggcccaggtgaagcccggccagacctgcagcgtggccggctggggccagaccgcccccctgggcaagcacagccacaccctgcaggaggtgaagatgaccgtgcaggaggacagaaagtgcgagagcgacctgagacactactacgacagcaccatcgagctgtgcgtgggcgaccccgagatcaagaagaccagcttcaagggcgacagcggcggccccctggtgtgcaacaaggtggcccagggcatcgtgagctacggcagaaacaacggcatgccccccagagcctgcaccaaggtgagcagcttcgtgcactggatcaagaagaccatgaagagatactag

SEQ ID NO: 9222 - DNA, 1062 bp, Homo sapiens
atggaggacggcgtgctgaaggagggcttcctggtgaagagaggccacatcgtgcacaactggaaggccagatggttcatcctgagacagaacaccctggtgtactacaagctggagggcggcagaagagtgaccccccccaagggcagaatcctgctggacggctgcaccatcacctgcccctgcctggagtacgagaacagacccctgctgatcaagctgaagacccagaccagcaccgagtacttcctggaggcctgcagcagagaggagagagacgcctgggccttcgagatcaccggcgccatccacgccggccagcccggcaaggtgcagcagctgcacagcctgagaaacagcttcaagctgcccccccacatcagcctgcacagaatcgtggacaagatgcacgacagcaacaccggcatcagaagcagccccaacatggagcagggcagcacctacaagaagaccttcctgggcagcagcctggtggactggctgatcagcaacagcttcaccgccagcagactggaggccgtgaccctggccagcatgctgatggaggagaacttcctgagacccgtgggcgtgagaagcatgggcgccatcagaagcggcgacctggccgagcagttcctggacgacagcaccgccctgtacaccttcgccgagagctacaagaagaagatcagccccaaggaggagatcagcctgagcaccgtggagctgagcggcaccgtggtgaagcagggctacctggccaagcagggccacaagagaaagaactggaaggtgagaagattcgtgctgagaaaggaccccgccttcctgcactactacgaccccagcaaggaggagaacagacccgtgggcggcttcagcctgagaggcagcctggtgagcgccctggaggacaacggcgtgcccaccggcgtgaagggcaacgtgcagggcaacctgttcaaggtgatcaccaaggacgacacccactactacatccaggccagcagcaaggccgagagagccgagtggatcgaggccatcaagaagctgacctag

SEQ ID NO: 9223 - DNA, 2025 bp, Homo sapiens
atggccgaggtgcccgaggactacgacagcggccccgacgaggacggcgagctggagcccgagagacccgagctgcccggcctgcacaagctgtacgagaacgccgagcccgacaccatggccaaggccgacagcaagctgcccgccgagatctaccaggagccccagcccgagaccgaggaggaggacttcaaggagggcgagcccgacagcgccaagaacgtgcagctgaagcccggcggcaccagccaggagggcatcgccaaggagagcaagagagacgtgcccagcgagaccgagcccggcatccaccaggaggtgaagagcgagaccagcagagagatgggcgagttcttcaaggacctggaggcccccatggacgagacccacaaggagagcgacctggagccccccgaggaggccaagcccaacgtgaccgaggacgtgttcctggagagcgccatggagaccgaccccgaccccgtgccccccaccgagaccatgagcgaggtgagcggcgccaccgtgagagagagaaacctggagctgctggaggaggagaccgagcccggcgtgcccgaggagagcctgagagtgcagcacgaggagaccggcctggagccccccgagcagaccaagcaggacttccccagcgagaagctgggcgagagcctggaggagaccgacctgcagccccccaagatgaccaagcccgagacccccgaggagacccagagagagagcaccgagaagaagagaaccgagccccccgagcaggccagactggagttcctggagaaggagcccagaaagagcagcgaggaggccggcctggagccccccgaggagacccagcccgaggtgcccgaggagatgcagagaaaggccaccgaggagaagggcaccgagctgcccgagagaaccaagcccgacttccccgaccacaagcccagaaagagcaccgacgagaacgtgcccgagcccctggaggagatcaagctggagttccccgaggaggagagcagaaagaccaacgaggagaccatcctggagcagagcgagatgatgaagcccgagagccccgaggagatcagaaagagcaacgagaagaagaacccccagccccccgaggagaccggccccgtgctgccccaggagatcaacccccaggtggaggagaagacccagaccaagcccaccgagaagatcctggagctgcccgacgagaccaagcccagagagacccacgtggagttcagcaaggaggacagacccgagcccatcaagagcaagtacagcgtgggcaacgacgagctggagcacagagagcccaagagaggcaagctgagcctgagcgacaagttcagaaaggagtactacgccctgggcagcctgagagagagcgaggagagcatcggcacccactacgagttcctgcagcccctgcagaagctgctgaacgtgagcgaggagtgcagctacagcgaccccagcgagagccagaccgagctgagcgagttcgtgcacgagaaggaggtggtggacctgagccaggagctgaaggagagagtgagcgaggacgacgagacccagcccgagaagggcaccgagctgcagttcgagcacctgaactgggaccccgaggaggtggccgagtggatcagccagctgggcttcccccagtacaaggagtgcttcatcaccaacttcatcagcggcagaaagctgatccacgtgaactgcagcaacctgccccagatgggcatcaccaacttcgaggacatgaaggccatcagcagacacacccaggagctgctggagatcgaggagcccctgttcaagagaagcatcagcctgccctacagagacatcatcggcctgtacctggagcagaagggccacaccggcatcaagagcgacagcctgaccctgagcgagttcgtgaaggccgccggcctgcaggactacgcccccgagatcaccgcccccgaggagaacgaggagctgccctgcaccgagccctag

SEQ ID NO: 9224 - DNA, 1689 bp, Homo sapiens
atgagacccgagcccggcggctgctgctgcagaagaaccgtgagagccaacggctgcgtggccaacggcgaggtgagaaacggctacgtgagaagcagcgccgccgccgccgccgccgccgccgccggccagatccaccacgtgacccagaacggcggcctgtacaagagacccttcaacgaggccttcgaggagacccccatgctggtggccgtgctgacctacgtgggctacggcgtgctgaccctgttcggctacctgagagacttcctgagatactggagaatcgagaagtgccaccacgccaccgagagagaggagcagaaggacttcgtgagcctgtaccaggacttcgagaacttctacaccagaaacctgtacatgagaatcagagacaactggaacagacccatctgcagcgtgcccggcgccagagtggacatcatggagagacagagccacgactacaactggagcttcaagtacaccggcaacatcatcaagggcgtgatcaacatgggcagctacaactacctgggcttcgccagaaacaccggcagctgccaggaggccgccgccaaggtgctggaggagtacggcgccggcgtgtgcagcaccagacaggagatcggcaacctggacaagcacgaggagctggaggagctggtggccagattcctgggcgtggaggccgccatggcctacggcatgggcttcgccaccaacagcatgaacatccccgccctggtgggcaagggctgcctgatcctgagcgacgagctgaaccacgccagcctggtgctgggcgccagactgagcggcgccaccatcagaatcttcaagcacaacaacatgcagagcctggagaagctgctgaaggacgccatcgtgtacggccagcccagaaccagaagaccctggaagaagatcctgatcctggtggagggcatctacagcatggagggcagcatcgtgagactgcccgaggtgatcgccctgaagaagaagtacaaggcctacctgtacctggacgaggcccacagcatcggcgccctgggccccaccggcagaggcgtggtggagtacttcggcctggaccccgaggacgtggacgtgatgatgggcaccttcaccaagagcttcggcgccagcggcggctacatcggcggcaagaaggagctgatcgactacctgagaacccacagccacagcgccgtgtacgccaccagcctgagcccccccgtggtggagcagatcatcaccagcatgaagtgcatcatgggccaggacggcaccagcctgggcaaggagtgcgtgcagcagctggccgagaacaccagatacttcagaagaagactgaaggagatgggcttcatcatctacggcaacgaggacagccccgtggtgcccctgatgctgtacatgcccgccaagatcggcgccttcggcagagagatgctgaagagaaacatcggcgtggtggtggtgggcttccccgccacccccatcatcgagagcagagccagattctgcctgagcgccgcccacaccaaggagatcctggacaccgccctgaaggagatcgacgaggtgggcgacctgctgcagctgaagtacagcagacacagactggtgcccctgctggacagacccttcgacgagaccacctacgaggagaccgaggactag

SEQ ID NO: 9225 - DNA, 2346 bp, Homo sapiens
atgagcagcagcagccccaccggccagatcgccagcgccgccgacatcaagcaggagaacggcatggagagcgccagcgagggccaggaggcccacagagaggtggccggcggcgccgccgtgggcctgagcccccccgcccccgcccccttccccctggagcccggcgacgccgccaccgccgccgccagagtgagcggcgaggagggcgccgtggccgccgccgccgccggcgccgccgccgaccaggtgcagctgcacagcgagctgctgggcagacaccaccacgccgccgccgccgccgcccagacccccctggccttcagccccgaccacgtggcctgcgtgtgcgaggccctgcagcagggcggcaacctggacagactggccagattcctgtggagcctgccccagagcgacctgctgagaggcaacgagagcctgctgaaggccagagccctggtggccttccaccagggcatctaccccgagctgtacagcatcctggagagccacagcttcgagagcgccaaccaccccctgctgcagcagctgtggtacaaggccagatacaccgaggccgagagagccagaggcagacccctgggcgccgtggacaagtacagactgagaagaaagttccccctgcccagaaccatctgggacggcgaggagaccgtgtactgcttcaaggagaagagcagaaacgccctgaaggagctgtacaagcagaacagataccccagccccgccgagaagagacacctggccaagatcaccggcctgagcctgacccaggtgagcaactggttcaagaacagaagacagagagacagaaaccccagcgagacccagagcaagagcgagagcgacggcaaccccagcaccgaggacgagagcagcaagggccacgaggacctgagcccccaccccctgagcagcagcagcgacggcatcaccaacctgagcctgagcagccacatggagcccgtgtacatgcagcagatcggcaacgccaagatcagcctgagcagcagcggcgtgctgctgaacggcagcctggtgcccgccagcaccagccccgtgttcctgaacggcaacagcttcatccagggccccagcggcgtgatcctgaacggcctgaacgtgggcaacacccaggccgtggccctgaacccccccaagatgagcagcaacatcgtgagcaacggcatcagcatgaccgacatcctgggcagcaccagccaggacgtgaaggagttcaaggtgctgcagagcagcgccaacagcgccaccaccaccagctacagccccagcgtgcccgtgagcttccccggcctgatccccagcaccgaggtgaagagagagggcatccagaccgtggccagccaggacggcggcagcgtggtgaccttcaccacccccgtgcagatcaaccagtacggcatcgtgcagatccccaacagcggcgccaacagccagttcctgaacggcagcatcggcttcagccccctgcagctgccccccgtgagcgtggccgccagccagggcaacatcagcgtgagcagcagcaccagcgacggcagcaccttcaccagcgagagcaccaccgtgcagcagggcaaggtgttcctgagcagcctggcccccagcgccgtggtgtacaccgtgcccaacaccggccagaccatcggcagcgtgaagcaggagggcctggagagaagcctggtgttcagccagctgatgcccgtgaaccagaacgcccaggtgaacgccaacctgagcagcgagaacatcagcggcagcggcctgcaccccctggccagcagcctggtgaacgtgagccccacccacaacttcagcctgagccccagcaccctgctgaaccccaccgagctgaacagagacatcgccgacagccagcccatgagcgcccccgtggccagcaagagcaccgtgaccagcgtgagcaacaccaactacgccaccctgcagaactgcagcctgatcaccggccaggacctgctgagcgtgcccatgacccaggccgccctgggcgagatcgtgcccaccgccgaggaccaggtgggccaccccagccccgccgtgcaccaggacttcgtgcaggagcacagactggtgctgcagagcgtggccaacatgaaggagaacttcctgagcaacagcgagagcaaggccaccagcagcctgatgatgctggacagcaagagcaagtacgtgctggacggcatggtggacaccgtgtgcgaggacctggagaccgacaagaaggagctggccaagctgcagaccgtgcagctggacgaggacatgcaggacctgtag

SEQ ID NO: 9226 - DNA, 1392 bp, Homo sapiens
atgggcaaggagaagacccacatcaacatcgtggtgatcggccacgtggacagcggcaagagcaccaccaccggccacctgatctacaagtgcggcggcatcgacaagagaaccatcgagaagttcgagaaggaggccgccgagatgggcaagggcagcttcaagtacgcctgggtgctggacaagctgaaggccgagagagagagaggcatcaccatcgacatcagcctgtggaagttcgagaccaccaagtactacatcaccatcatcgacgcccccggccacagagacttcatcaagaacatgatcaccggcaccagccaggccgactgcgccgtgctgatcgtggccgccggcgtgggcgagttcgaggccggcatcagcaagaacggccagaccagagagcacgccctgctggcctacaccctgggcgtgaagcagctgatcgtgggcgtgaacaagatggacagcaccgagcccgcctacagcgagaagagatacgacgagatcgtgaaggaggtgagcgcctacatcaagaagatcggctacaaccccgccaccgtgcccttcgtgcccatcagcggctggcacggcgacaacatgctggagcccagccccaacatgccctggttcaagggctggaaggtggagagaaaggagggcaacgccagcggcgtgagcctgctggaggccctggacaccatcctgccccccaccagacccaccgacaagcccctgagactgcccctgcaggacgtgtacaagatcggcggcatcggcaccgtgcccgtgggcagagtggagaccggcatcctgagacccggcatggtggtgaccttcgcccccgtgaacatcaccaccgaggtgaagagcgtggagatgcaccacgaggccctgagcgaggccctgcccggcgacaacgtgggcttcaacgtgaagaacgtgagcgtgaaggacatcagaagaggcaacgtgtgcggcgacagcaagagcgaccccccccaggaggccgcccagttcaccagccaggtgatcatcctgaaccaccccggccagatcagcgccggctacagccccgtgatcgactgccacaccgcccacatcgcctgcaagttcgccgagctgaaggagaagatcgacagaagaagcggcaagaagctggaggacaaccccaagagcctgaagagcggcgacgccgccatcgtggagatggtgcccggcaagcccatgtgcgtggagagcttcagccagtacccccccctgggcagattcgccgtgagagacatgagacagaccgtggccgtgggcgtgatcaagaacgtggagaagaagagcggcggcgccggcaaggtgaccaagagcgcccagaaggcccagaaggccggcaagtag

SEQ ID NO: 9227 - DNA, 600 bp, Homo sapiens
atggccgccgccaacaagggcaagtgcctgcccggcgtggtgggcctggcccaggccctgcccgtgggccccggcagaagagccatcgccgccggcaacaagcccagagtgagaagcatcagattcgccgccggccacgacgccgagggcagccacagccacgtgcacttcgacgagaagctgcacgacagcgtggtgatggtgacccaggagagcgacagcagcttcctggtgaaggtgggcttcctgaagatcctgcacagatacgagatcaccttcaccctgccccccgtgcacagactgagcaaggacgtgagagaggcccccgtgcccagcctgcacctgaagctgctgagcgtggtgcccgtgcccgagggctacagcgtgaagtgcgagtacagcgcccacaaggagggcgtgctgaaggaggagatcctgctggcctgcgagggcggcaccggcacctgcgtgagagtgaccgtgcaggccagagtgatggacagacaccacggcacccccatgctgctggacggcgtgaagtgcgtgggcgccgagctggagtacgacagcgagcacagcgactggcacggcttcgactag

SEQ ID NO: 9228 - DNA, 270 bp, Homo sapiens
atgcagctgcaggccagcctgagcttcctgctgatcctgaccctgtgcctggagctgagaagcgagctggccagagacaccatcaaggacctgctgcccaacgtgtgcgccttccccatggagaagggcccctgccagacctacatgaccagatggttcttcaacttcgagaccggcgagtgcgagctgttcgcctacggcggctgcggcggcaacagcaacaacttcctgagaaaggagaagtgcgagaagttctgcaagttcacctag

SEQ ID NO: 9229 - DNA, 1251 bp, Homo sapiens
atgagcgaggccgacggcctgagacagagaagacccctgagaccccaggtggtgaccgacgacgacggccaggcccccgaggccaaggacggcagcagcttcagcggcagagtgttcagagtgaccttcctgatgctggccgtgagcctgaccgtgcccctgctgggcgccatgatgctgctggagagccccatcgacccccagcccctgagcttcaaggagccccccctgctgctgggcgtgctgcaccccaacaccaagctgagacaggccgagagactgttcgagaaccagctggtgggccccgagagcatcgcccacatcggcgacgtgatgttcaccggcaccgccgacggcagagtggtgaagctggagaacggcgagatcgagaccatcgccagattcggcagcggcccctgcaagaccagagacgacgagcccgtgtgcggcagacccctgggcatcagagccggccccaacggcaccctgttcgtggccgacgcctacaagggcctgttcgaggtgaacccctggaagagagaggtgaagctgctgctgagcagcgagacccccatcgagggcaagaacatgagcttcgtgaacgacctgaccgtgacccaggacggcagaaagatctacttcaccgacagcagcagcaagtggcagagaagagactacctgctgctggtgatggagggcaccgacgacggcagactgctggagtacgacaccgtgaccagagaggtgaaggtgctgctggaccagctgagattccccaacggcgtgcagctgagccccgccgaggacttcgtgctggtggccgagaccaccatggccagaatcagaagagtgtacgtgagcggcctgatgaagggcggcgccgacctgttcgtggagaacatgcccggcttccccgacaacatcagacccagcagcagcggcggctactgggtgggcatgagcaccatcagacccaaccccggcttcagcatgctggacttcctgagcgagagaccctggatcaagagaatgatcttcaagctgttcagccaggagaccgtgatgaagttcgtgcccagatacagcctggtgctggagctgagcgacagcggcgccttcagaagaagcctgcacgaccccgacggcctggtggccacctacatcagcgaggtgcacgagcacgacggccacctgtacctgggcagcttcagaagccccttcctgtgcagactgagcctgcaggccgtgtag

SEQ ID NO: 9230 - DNA, 870 bp, Homo sapiens
atggtgggcgtgaagcccgtgggcagcgaccccgacttccagcccgagctgagcggcgccggcagcagactggccgtggtgaagttcaccatgagaggctgcggcccctgcctgagaatcgcccccgccttcagcagcatgagcaacaagtacccccaggccgtgttcctggaggtggacgtgcaccagtgccagggcaccgccgccaccaacaacatcagcgccacccccaccttcctgttcttcagaaacaaggtgagaatcgaccagtaccagggcgccgacgccgtgggcctggaggagaagatcaagcagcacctggagaacgaccccggcagcaacgaggacaccgacatccccaagggctacatggacctgatgcccttcatcaacaaggccggctgcgagtgcctgaacgagagcgacgagcacggcttcgacaactgcctgagaaaggacaccaccttcctggagagcgactgcgacgagcagctgctgatcaccgtggccttcaaccagcccgtgaagctgtacagcatgaagttccagggccccgacaacggccagggccccaagtacgtgaagatcttcatcaacctgcccagaagcatggacttcgaggaggccgagagaagcgagcccacccaggccctggagctgaccgaggacgacatcaaggaggacggcatcgtgcccctgagatacgtgaagttccagaacgtgaacagcgtgaccatcttcgtgcagagcaaccagggcgaggaggagaccaccagaatcagctacttcaccttcatcggcacccccgtgcaggccaccaacatgaacgacttcaagagagtggtgggcaagaagggcgagagccactag

SEQ ID NO: 9231 - DNA, 1164 bp, Homo sapiens
atggtgttcgccttctggaaggtgttcctgatcctgagctgcctggccggccaggtgagcgtggtgcaggtgaccatccccgacggcttcgtgaacgtgaccgtgggcagcaacgtgaccctgatctgcatctacaccaccaccgtggccagcagagagcagctgagcatccagtggagcttcttccacaagaaggagatggagcccatcagcatctacttcagccagggcggccaggccgtggccatcggccagttcaaggacagaatcaccggcagcaacgaccccggcaacgccagcatcaccatcagccacatgcagcccgccgacagcggcatctacatctgcgacgtgaacaacccccccgacttcctgggccagaaccagggcatcctgaacgtgagcgtgctggtgaagcccagcaagcccctgtgcagcgtgcagggcagacccgagaccggccacaccatcagcctgagctgcctgagcgccctgggcacccccagccccgtgtactactggcacaagctggagggcagagacatcgtgcccgtgaaggagaacttcaaccccaccaccggcatcctggtgatcggcaacctgaccaacttcgagcagggctactaccagtgcaccgccatcaacagactgggcaacagcagctgcgagatcgacctgaccagcagccaccccgaggtgggcatcatcgtgggcgccctgatcggcagcctggtgggcgccgccatcatcatcagcgtggtgtgcttcgccagaaacaaggccaaggccaaggccaaggagagaaacagcaagaccatcgccgagctggagcccatgaccaagatcaaccccagaggcgagagcgaggccatgcccagagaggacgccacccagctggaggtgaccctgcccagcagcatccacgagaccggccccgacaccatccaggagcccgactacgagcccaagcccacccaggagcccgcccccgagcccgcccccggcagcgagcccatggccgtgcccgacctggacatcgagctggagctggagcccgagacccagagcgagctggagcccgagcccgagcccgagcccgagagcgagcccggcgtggtggtggagcccctgagcgaggacgagaagggcgtggtgaaggcctag

SEQ ID NO: 9232 - DNA, 1821 bp, Homo sapiens
atgagcgacaccagcgagagcggcgccggcctgaccagattccaggccgaggccagcgagaaggacagcagcagcatgatgcagaccctgctgaccgtgacccagaacgtggaggtgcccgagacccccaaggccagcaaggccctggaggtgagcgaggacgtgaaggtgagcaaggccagcggcgtgagcaaggccaccgaggtgagcaagacccccgaggccagagaggcccccgccacccaggccagcagcaccacccagctgaccgacacccaggtgctggccgccgagaacaagagcctggccgccgacaccaagaagcagaacgccgacccccaggccgtgaccatgcccgccaccgagaccaagaaggtgagccacgtggccgacaccaaggtgaacaccaaggcccaggagaccgaggccgcccccagccaggcccccgccgacgagcccgagcccgagagcgccgccgcccagagccaggagaaccaggacaccagacccaaggtgaaggccaagaaggccagaaaggtgaagcacctggacggcgaggaggacggcagcagcgaccagagccaggccagcggcaccaccggcggcagaagagtgagcaaggccctgatggccagcatggccagaagagccagcagaggccccatcgccttctgggccagaagagccagcagaaccagactggccgcctgggccagaagagccctgctgagcctgagaagccccaaggccagaagaggcaaggccagaagaagagccgccaagctgcagagcagccaggagcccgaggcccccccccccagagacgtggccctgctgcagggcagagccaacgacctggtgaagtacctgctggccaaggaccagaccaagatccccatcaagagaagcgacatgctgaaggacatcatcaaggagtacaccgacgtgtaccccgagatcatcgagagagccggctacagcctggagaaggtgttcggcatccagctgaaggagatcgacaagaacgaccacctgtacatcctgctgagcaccctggagcccaccgacgccggcatcctgggcaccaccaaggacagccccaagctgggcctgctgatggtgctgctgagcatcatcttcatgaacggcaacagaagcagcgaggccgtgatctgggaggtgctgagaaagctgggcctgagacccggcatccaccacagcctgttcggcgacgtgaagaagctgatcaccgacgagttcgtgaagcagaagtacctggactacgccagagtgcccaacagcaacccccccgagtacgagttcttctggggcctgagaagctactacgagaccagcaagatgaaggtgctgaagttcgcctgcaaggtgcagaagaaggaccccaaggagtgggccgcccagtacagagaggccatggaggccgacctgaaggccgccgccgaggccgccgccgaggccaaggccagagccgagatcagagccagaatgggcatcggcctgggcagcgagaacgccgccggcccctgcaactgggacgaggccgacatcggcccctgggccaaggccagaatccaggccggcgccgaggccaaggccaaggcccaggagagcggcagcgccagcaccggcgccagcaccagcaccaacaacagcgccagcgccagcgccagcaccagcggcggcttcagcgccggcgccagcctgaccgccaccctgaccttcggcctgttcgccggcctgggcggcgccggcgccagcaccagcggcagcagcggcgcctgcggcttcagctacaagtag

SEQ ID NO: 9233 - DNA, 369 bp, Homo sapiens
atgaccaccgccaccagacaggaggtgctgggcctgtacagaagcatcttcagactggccagaaagtggcaggccaccagcggccagatggaggacaccatcaaggagaagcagtacatcctgaacgaggccagaaccctgttcagaaagaacaagaacctgaccgacaccgacctgatcaagcagtgcatcgacgagtgcaccgccagaatcgagatcggcctgcactacaagatcccctaccccagacccatccacctgccccccatgggcctgacccccctgagaggcagaggcctgagaagccaggagaagctgagaaagctgagcaagcccgtgtacctgagaagccacgacgaggtgagctag

SEQ ID NO: 9234 - DNA, 582 bp, Homo sapiens
atgctgggcgtgctggagctgctgctgctgggcgccgcctggctggccggccccgccagaggccagaacgagaccgagcccatcgtgctggagggcaagtgcctggtggtgtgcgacagcaaccccaccagcgaccccaccggcaccgccctgggcatcagcgtgagaagcggcagcgccaaggtggccttcagcgccatcagaagcaccaaccacgagcccagcgagatgagcaacagaaccatgatcatctacttcgaccaggtgctggtgaacatcggcaacaacttcgacagcgagagaagcaccttcatcgcccccagaaagggcatctacagcttcaacttccacgtggtgaaggtgtacaacagacagaccatccaggtgagcctgatgctgaacggctggcccgtgatcagcgccttcgccggcgaccaggacgtgaccagagaggccgccagcaacggcgtgctgatccagatggagaagggcgacagagcctacctgaagctggagagaggcaacctgatgggcggctggaagtacagcaccttcagcggcttcctggtgttccccctgtag

SEQ ID NO: 9235 - DNA, 1578 bp, Homo sapiens
atgagcagacagctgctgcccgtgctgctgctgctgctgctgagagccagctgcccctggggccaggagcagggcgccagaagccccagcgaggagccccccgaggaggagatccccaaggaggacggcatcctggtgctgagcagacacaccctgggcctggccctgagagagcaccccgccctgctggtggagttctacgccccctggtgcggccactgccaggccctggcccccgagtacagcaaggccgccgccgtgctggccgccgagagcatggtggtgaccctggccaaggtggacggccccgcccagagagagctggccgaggagttcggcgtgaccgagtaccccaccctgaagttcttcagaaacggcaacagaacccaccccgaggagtacaccggccccagagacgccgagggcatcgccgagtggctgagaagaagagtgggccccagcgccatgagactggaggacgaggccgccgcccaggccctgatcggcggcagagacctggtggtgatcggcttcttccaggacctgcaggacgaggacgtggccaccttcctggccctggcccaggacgccctggacatgaccttcggcctgaccgacagacccagactgttccagcagttcggcctgaccaaggacaccgtggtgctgttcaagaagttcgacgagggcagagccgacttccccgtggacgaggagctgggcctggacctgggcgacctgagcagattcctggtgacccacagcatgagactggtgaccgagttcaacagccagaccagcgccaagatcttcgccgccagaatcctgaaccacctgctgctgttcgtgaaccagaccctggccgcccacagagagctgctggccggcttcggcgaggccgcccccagattcagaggccaggtgctgttcgtggtggtggacgtggccgccgacaacgagcacgtgctgcagtacttcggcctgaaggccgaggccgcccccaccctgagactggtgaacctggagaccaccaagaagtacgcccccgtggacggcggccccgtgaccgccgccagcatcaccgccttctgccacgccgtgctgaacggccaggtgaagccctacctgctgagccaggagatcccccccgactgggaccagagacccgtgaagaccctggtgggcaagaacttcgagcaggtggccttcgacgagaccaagaacgtgttcgtgaagttctacgccccctggtgcacccactgcaaggagatggcccccgcctgggaggccctggccgagaagtaccaggaccacgaggacatcatcatcgccgagctggacgccaccgccaacgagctggacgccttcgccgtgcacggcttccccaccctgaagtacttccccgccggccccggcagaaaggtgatcgagtacaagagcaccagagacctggagaccttcagcaagttcctggacaacggcggcgtgctgcccaccgaggagccccccgaggagcccgccgcccccttccccgagccccccgccaacagcaccatgggcagcaaggaggagctgtag

SEQ ID NO: 9236 - DNA, 2262 bp, Homo sapiens
atggccgacaagagaaagctgcagggcgagatcgacagatgcctgaagaaggtgagcgagggcgtggagcagttcgaggacatctggcagaagctgcacaacgccgccaacgccaaccagaaggagaagtacgaggccgacctgaagaaggagatcaagaagctgcagagactgagagaccagatcaagacctgggtggccagcaacgagatcaaggacaagagacagctgatcgacaacagaaagctgatcgagacccagatggagagattcaaggtggtggagagagagaccaagaccaaggcctacagcaaggagggcctgggcctggcccagaaggtggaccccgcccagaaggagaaggaggaggtgggccagtggctgaccaacaccatcgacaccctgaacatgcaggtggaccagttcgagagcgaggtggagagcctgagcgtgcagaccagaaagaagaagggcgacaaggacaagcaggacagaatcgagggcctgaagagacacatcgagaagcacagataccacgtgagaatgctggagaccatcctgagaatgctggacaacgacagcatcctggtggacgccatcagaaagatcaaggacgacgtggagtactacgtggacagcagccaggaccccgacttcgaggagaacgagttcctgtacgacgacctggacctggaggacatcccccaggccctggtggccaccagcccccccagccacagccacatggaggacgagatcttcaaccagagcagcagcacccccaccagcaccaccagcagcagccccatcccccccagccccgccaactgcaccaccgagaacagcgaggacgacaagaagagaggcagaagcaccgacagcgaggtgagccagagccccgccaagaacggcagcaagcccgtgcacagcaaccagcacccccagagccccgccgtgccccccacctaccccagcggccccccccccgccgccagcgccctgagcaccacccccggcaacaacggcgtgcccgcccccgccgccccccccagcgccctgggccccaaggccagccccgcccccagccacaacagcggcacccccgccccctacgcccaggccgtggccccccccgcccccagcggccccagcaccacccagcccagaccccccagcgtgcagcccagcggcggcggcggcggcggcagcggcggcggcggcagcagcagcagcagcaacagcagcgccggcggcggcgccggcaagcagaacggcgccaccagctacagcagcgtggtggccgacagccccgccgaggtggccctgagcagcagcggcggcaacaacgccagcagccaggccctgggcccccccagcggcccccacaaccccccccccagcaccagcaaggagcccagcgccgccgcccccaccggcgccggcggcgtggcccccggcagcggcaacaacagcggcggccccagcctgctggtgcccctgcccgtgaacccccccagcagccccacccccagcttcagcgacgccaaggccgccggcgccctgctgaacggccccccccagttcagcaccgcccccgagatcaaggcccccgagcccctgagcagcctgaagagcatggccgagagagccgccatcagcagcggcatcgaggaccccgtgcccaccctgcacctgaccgagagagacatcatcctgagcagcaccagcgccccccccgccagcgcccagccccccctgcagctgagcgaggtgaacatccccctgagcctgggcgtgtgccccctgggccccgtgcccctgaccaaggagcagctgtaccagcaggccatggaggaggccgcctggcaccacatgccccaccccagcgacagcgagagaatcagacagtacctgcccagaaacccctgccccacccccccctaccaccaccagatgccccccccccacagcgacaccgtggagttctaccagagactgagcaccgagaccctgttcttcatcttctactacctggagggcaccaaggcccagtacctggccgccaaggccctgaagaagcagagctggagattccacaccaagtacatgatgtggttccagagacacgaggagcccaagaccatcaccgacgagttcgagcagggcacctacatctacttcgactacgagaagtggggccagagaaagaaggagggcttcaccttcgagtacagatacctggaggacagagacctgcagtag

SEQ ID NO: 9237 - DNA, 1146 bp, Homo sapiens
atgcccttcggcaacacccacaacaagttcaagctgaactacaagcccgaggaggagtaccccgacctgagcaagcacaacaaccacatggccaaggtgctgaccctggagctgtacaagaagctgagagacaaggagacccccagcggcttcaccgtggacgacgtgatccagaccggcgtggacaaccccggccaccccttcatcatgaccgtgggctgcgtggccggcgacgaggagagctacgaggtgttcaaggagctgttcgaccccatcatcagcgacagacacggcggctacaagcccaccgacaagcacaagaccgacctgaaccacgagaacctgaagggcggcgacgacctggaccccaactacgtgctgagcagcagagtgagaaccggcagaagcatcaagggctacaccctgcccccccactgcagcagaggcgagagaagagccgtggagaagctgagcgtggaggccctgaacagcctgaccggcgagttcaagggcaagtactaccccctgaagagcatgaccgagaaggagcagcagcagctgatcgacgaccacttcctgttcgacaagcccgtgagccccctgctgctggccagcggcatggccagagactggcccgacgccagaggcatctggcacaacgacaacaagagcttcctggtgtgggtgaacgaggaggaccacctgagagtgatcagcatggagaagggcggcaacatgaaggaggtgttcagaagattctgcgtgggcctgcagaagatcgaggagatcttcaagaaggccggccaccccttcatgtggaaccagcacctgggctacgtgctgacctgccccagcaacctgggcaccggcctgagaggcggcgtgcacgtgaagctggcccacctgagcaagcaccccaagttcgaggagatcctgaccagactgagactgcagaagagaggcaccggcggcgtggacaccgccgccgtgggcagcgtgttcgacgtgagcaacgccgacagactgggcagcagcgaggtggagcaggtgcagctggtggtggacggcgtgaagctgatggtggagatggagaagaagctggagaagggccagagcatcgacgacatgatccccgcccagaagtag

SEQ ID NO: 9238 - DNA, 300 bp, Homo sapiens
atggcccagggccagagaaagttccaggcccacaagcccgccaagagcaagaccgccgccgccgccagcgagaagaacagaggccccagaaagggcggcagagtgatcgcccccaagaaggccagagtggtgcagcagcagaagctgaagaagaacctggaggtgggcatcagaaagaagatcgagcacgacgtggtgatgaaggccagcagcagcctgcccaagaagctggccctgctgaaggcccccgccaagaagaagggcgccgccgccgccaccagcagcaagacccccagctag

SEQ ID NO: 9239 - DNA, 1491 bp, Homo sapiens
atggacgacgtgcccgcccccacccccgcccccgccccccccgccgccgccgcccccagagtgcccttccactgcagcgagtgcggcaagagcttcagatacagaagcgacctgagaagacacttcgccagacacaccgccctgaagccccacgcctgccccagatgcggcaagggcttcaagcacagcttcaacctggccaaccacctgagaagccacaccggcgagagaccctacagatgcagcgcctgccccaagggcttcagagacagcaccggcctgctgcaccaccaggtggtgcacaccggcgagaagccctactgctgcctggtgtgcgagctgagattcagcagcagaagcagcctgggcagacacctgaagagacagcacagaggcgtgctgcccagccccctgcagcccggccccggcctgcccgccctgagcgccccctgcagcgtgtgctgcaacgtgggcccctgcagcgtgtgcggcggcagcggcgccggcggcggcgagggccccgagggcgccggcgccggcctgggcagctggggcctggccgaggccgccgccgccgccgccgccagcctgccccccttcgcctgcggcgcctgcgccagaagattcgaccacggcagagagctggccgcccactgggccgcccacaccgacgtgaagcccttcaagtgccccagatgcgagagagacttcaacgcccccgccctgctggagagacacaagctgacccacgacctgcagggccccggcgccccccccgcccaggcctgggccgccggccccggcgccggccccgagaccgccggcgagggcaccgccgccgaggccggcgacgcccccctggccagcgacagaagactgctgctgggccccgccggcggcggcgtgcccaagctgggcggcctgctgcccgagggcggcggcgaggcccccgcccccgccgccgccgccgagcccagcgaggacaccctgtaccagtgcgactgcggcaccttcttcgccagcgccgccgccctggccagccacctggaggcccacagcggccccgccacctacggctgcggccactgcggcgccctgtacgccgccctggccgccctggaggagcacagaagagtgagccacggcgagggcggcggcgaggaggccgccaccgccgccagagagagagagcccgccagcggcgagccccccagcggcagcggcagaggcaagaagatcttcggctgcagcgagtgcgagaagctgttcagaagccccagagacctggagagacacgtgctggtgcacaccggcgagaagcccttcccctgcctggagtgcggcaagttcttcagacacgagtgctacctgaagagacacagactgctgcacggcaccgagagacccttcccctgccacatctgcggcaagggcttcatcaccctgagcaacctgagcagacacctgaagctgcacagaggcatggactag

SEQ ID NO: 9240 - DNA, 663 bp, Homo sapiens
atgaagagcgtgatctaccacgccctgagccagaaggaggccaacgacagcgacgtgcagcccagcggcgcccagagagccgaggccttcgtgagagccttcctgaagagaagcacccccagaatgagcccccaggccagagaggaccagctgcagagaaaggccgtggtgctggagtacttcaccagacacaagagaaaggagaagaagaagaaggccaagggcctgagcgccagacagagaagagagctgagactgttcgacatcaagcccgagcagcagagatacagcctgttcctgcccctgcacgagctgtggaagcagtacatcagagacctgtgcagcggcctgaagcccgacacccagccccagatgatccaggccaagctgctgaaggccgacctgcacggcgccatcatcagcgtgaccaagagcaagtgccccagctacgtgggcatcaccggcatcctgctgcaggagaccaagcacatcttcaagatcatcaccaaggaggacagactgaaggtgatccccaagctgaactgcgtgttcaccgtggagaccgacggcttcatcagctacatctacggcagcaagttccagctgagaagcagcgagagaagcgccaagaagttcaaggccaagggcaccatcgacctgtag

SEQ ID NO: 9241 - DNA, 768 bp, Homo sapiens
atggccagagccaaggccctgctgggcggccccggcgaggagctggaggccgacaccgagtacctggaccccttcgacgcccagccccaccccgccccccccgacgacggctacatggagccctacgacgcccagtgggtgatgagcgagctgcccggcagaggcgtgcagctgtacgacaccccctacgaggagcaggaccccgagaccgccgacggcccccccagcggccagaagcccagacagagcagaatgccccaggaggacgagagacccgccgacgagtacgaccagccctgggagtggaagaaggaccacatcagcagagccttcgccgtgcagttcgacagccccgagtgggagagaacccccggcagcgccaaggagctgagaagacccccccccagaagcccccagcccgccgagagagtggaccccgccctgcccctggagaagcagccctggttccacggccccctgaacagagccgacgccgagagcctgctgagcctgtgcaaggagggcagctacctggtgagactgagcgagaccaacccccaggactgcagcctgagcctgagaagcagccagggcttcctgcacctgaagttcgccagaaccagagagaaccaggtggtgctgggccagcacagcggccccttccccagcgtgcccgagctggtgctgcactacagcagcagacccctgcccgtgcagggcgccgagcacctggccctgctgtaccccgtggtgacccagaccccctag

SEQ ID NO: 9242 - DNA, 858 bp, Homo sapiens
atgagcgacgacttcctgtggttcgagggcatcgccttccccaccatgggcttcagaagcgagaccctgagaaaggtgagagacgagttcgtgatcagagacgaggacgtgatcatcctgacctaccccaagagcggcaccaactggctggccgagatcctgtgcctgatgcacagcaagggcgacgccaagtggatccagagcgtgcccatctgggagagaagcccctgggtggagagcgagatcggctacaccgccctgagcgagaccgagagccccagactgttcagcagccacctgcccatccagctgttccccaagagcttcttcagcagcaaggccaaggtgatctacctgatgagaaaccccagagacgtgctggtgagcggctacttcttctggaagaacatgaagttcatcaagaagcccaagagctgggaggagtacttcgagtggttctgccagggcaccgtgctgtacggcagctggttcgaccacatccacggctggatgcccatgagagaggagaagaacttcctgctgctgagctacgaggagctgaagcaggacaccggcagaaccatcgagaagatctgccagttcctgggcaagaccctggagcccgaggagctgaacctgatcctgaagaacagcagcttccagagcatgaaggagaacaagatgagcaactacagcctgctgagcgtggactacgtggtggacaaggcccagctgctgagaaagggcgtgagcggcgactggaagaaccacttcaccgtggcccaggccgaggacttcgacaagctgttccaggagaagatggccgacctgcccagagagctgttcccctgggagtag

SEQ ID NO: 9243 - DNA, 1647 bp, Homo sapiens
atgaagacccccgccgacaccggcttcgccttccccgactgggcctacaagcccgagagcagccccggcagcagacagatccagctgtggcacttcatcctggagctgctgagaaaggaggagtaccagggcgtgatcgcctggcagggcgactacggcgagttcgtgatcaaggaccccgacgaggtggccagactgtggggcgtgagaaagtgcaagccccagatgaactacgacaagctgagcagagccctgagatactactacaacaagagaatcctgcacaagaccaagggcaagagattcacctacaagttcaacttcaacaagctggtgctggtgaactaccccttcatcgacgtgggcctggccggcggcgccgtgccccagagcgccccccccgtgcccagcggcggcagccacttcagattcccccccagcacccccagcgaggtgctgagccccaccgaggaccccagaagcccccccgcctgcagcagcagcagcagcagcctgttcagcgccgtggtggccagaagactgggcagaggcagcgtgagcgactgcagcgacggcaccagcgagctggaggagcccctgggcgaggaccccagagccagaccccccggcccccccgacctgggcgccttcagaggcccccccctggccagactgccccacgaccccggcgtgttcagagtgtaccccagacccagaggcggccccgagcccctgagccccttccccgtgagccccctggccggccccggcagcctgctgcccccccagctgagccccgccctgcccatgacccccacccacctggcctacacccccagccccaccctgagccccatgtaccccagcggcggcggcggccccagcggcagcggcggcggcagccacttcagcttcagccccgaggacatgaagagatacctgcaggcccacacccagagcgtgtacaactaccacctgagccccagagccttcctgcactaccccggcctggtggtgccccagccccagagacccgacaagtgccccctgccccccatggcccccgagaccccccccgtgcccagcagcgccagcagcagcagcagcagcagcagcagccccttcaagttcaagctgcagcccccccccctgggcagaagacagagagccgccggcgagaaggccgtggccggcgccgacaagagcggcggcagcgccggcggcctggccgagggcgccggcgccctggcccccccccccccccccccccagatcaaggtggagcccatcagcgagggcgagagcgaggaggtggaggtgaccgacatcagcgacgaggacgaggaggacggcgaggtgttcaagacccccagagccccccccgccccccccaagcccgagcccggcgaggcccccggcgccagccagtgcatgcccctgaagctgagattcaagagaagatggagcgaggactgcagactggagggcggcggcggccccgccggcggcttcgaggacgagggcgaggacaagaaggtgagaggcgagggccccggcgaggccggcggccccctgacccccagaagagtgagcagcgacctgcagcacgccaccgcccagctgagcctggagcacagagacagctag

SEQ ID NO: 9244 - DNA, 1530 bp, Homo sapiens
atgggcgtgctgaagttcaagcacatcttcttcagaagcttcgtgaagagcagcggcgtgagccagatcgtgttcaccttcctgctgatcccctgctgcctgaccctgaacttcagagccccccccgtgatccccaacgtgcccttcctgtgggcctggaacgcccccagcgagttctgcctgggcaagttcgacgagcccctggacatgagcctgttcagcttcatcggcagccccagaatcaacgccaccggccagggcgtgaccatcttctacgtggacagactgggctactacccctacatcgacagcatcaccggcgtgaccgtgaacggcggcatcccccagaagatcagcctgcaggaccacctggacaaggccaagaaggacatcaccttctacatgcccgtggacaacctgggcatggccgtgatcgactgggaggagtggagacccacctgggccagaaactggaagcccaaggacgtgtacaagaacagaagcatcgagctggtgcagcagcagaacgtgcagctgagcctgaccgaggccaccgagaaggccaagcaggagttcgagaaggccggcaaggacttcctggtggagaccatcaagctgggcaagctgctgagacccaaccacctgtggggctactacctgttccccgactgctacaaccaccactacaagaagcccggctacaacggcagctgcttcaacgtggagatcaagagaaacgacgacctgagctggctgtggaacgagagcaccgccctgtaccccagcatctacctgaacacccagcagagccccgtggccgccaccctgtacgtgagaaacagagtgagagaggccatcagagtgagcaagatccccgacgccaagagccccctgcccgtgttcgcctacaccagaatcgtgttcaccgaccaggtgctgaagttcctgagccaggacgagctggtgtacaccttcggcgagaccgtggccctgggcgccagcggcatcgtgatctggggcaccctgagcatcatgagaagcatgaagagctgcctgctgctggacaactacatggagaccatcctgaacccctacatcatcaacgtgaccctggccgccaagatgtgcagccaggtgctgtgccaggagcagggcgtgtgcatcagaaagaactggaacagcagcgactacctgcacctgaaccccgacaacttcgccatccagctggagaagggcggcaagttcaccgtgagaggcaagcccaccctggaggacctggagcagttcagcgagaagttctactgcagctgctacagcaccctgagctgcaaggagaaggccgacgtgaaggacaccgacgccgtggacgtgtgcatcgccgacggcgtgtgcatcgacgccttcctgaagccccccatggagaccgaggagccccagatcttctacaacgccagccccagcaccctgagcgccaccatgttcatcgtgagcatcctgttcctgatcatcagcagcgtggccagcctgtag

SEQ ID NO: 9245 - DNA, 1041 bp, Homo sapiens
atggagacccagctgagcaacggccccacctgcaacaacaccgccaacggccccaccaccatcaacaacaactgcagcagccccgtggacagcggcaacaccgaggacagcaagaccaacctgatcgtgaactacctgccccagaacatgacccaggaggagctgaagagcctgttcggcagcatcggcgagatcgagagctgcaagctggtgagagacaagatcaccggccagagcctgggctacggcttcgtgaactacatcgaccccaaggacgccgagaaggccatcaacaccctgaacggcctgagactgcagaccaagaccatcaaggtgagctacgccagacccagcagcgccagcatcagagacgccaacctgtacgtgagcggcctgcccaagaccatgacccagaaggagctggagcagctgttcagccagtacggcagaatcatcaccagcagaatcctggtggaccaggtgaccggcatcagcagaggcgtgggcttcatcagattcgacaagagaatcgaggccgaggaggccatcaagggcctgaacggccagaagccccccggcgccaccgagcccatcaccgtgaagttcgccaacaaccccagccagaagaccaaccaggccatcctgagccagctgtaccagagccccaacagaagataccccggccccctggcccagcaggcccagagattcagattcagccccatgaccatcgacggcatgaccagcctggccggcatcaacatccccggccaccccggcaccggctggtgcatcttcgtgtacaacctggcccccgacgccgacgagagcatcctgtggcagatgttcggccccttcggcgccgtgaccaacgtgaaggtgatcagagacttcaacaccaacaagtgcaagggcttcggcttcgtgaccatgaccaactacgacgaggccgccatggccatcgccagcctgaacggctacagactgggcgacagagtgctgcaggtgagcttcaagaccaacaagacccacaaggcctag

SEQ ID NO: 9246 - DNA, 1437 bp, Homo sapiens
atggcccacgtgcccgccagaaccagccccggccccggcccccagctgctgctgctgctgctgcccctgttcctgctgctgctgagagacgtggccggcagccacagagcccccgcctggagcgccctgcccgccgccgccgacggcctgcagggcgacagagacctgcagagacaccccggcgacgccgccgccaccctgggccccagcgcccaggacatggtggccgtgcacatgcacagactgtacgagaagtacagcagacagggcgccagacccggcggcggcaacaccgtgagaagcttcagagccagactggaggtggtggaccagaaggccgtgtacttcttcaacctgaccagcatgcaggacagcgagatgatcctgaccgccaccttccacttctacagcgagccccccagatggcccagagccctggaggtgctgtgcaagcccagagccaagaacgccagcggcagacccctgcccctgggcccccccaccagacagcacctgctgttcagaagcctgagccagaacaccgccacccagggcctgctgagaggcgccatggccctggcccccccccccagaggcctgtggcaggccaaggacatcagccccatcgtgaaggccgccagaagagacggcgagctgctgctgagcgcccagctggacagcgaggagagagaccccggcgtgcccagacccagcccctacgccccctacatcctggtgtacgccaacgacctggccatcagcgagcccaacagcgtggccgtgaccctgcagagatacgaccccttccccgccggcgaccccgagcccagagccgcccccaacaacagcgccgaccccagagtgagaagagccgcccaggccaccggccccctgcaggacaacgagctgcccggcctggacgagagaccccccagagcccacgcccagcacttccacaagcaccagctgtggcccagccccttcagagccctgaagcccagacccggcagaaaggacagaagaaagaagggccaggaggtgttcatggccgccagccaggtgctggacttcgacgagaagaccatgcagaaggccagaagaaagcagtgggacgagcccagagtgtgcagcagaagatacctgaaggtggacttcgccgacatcggctggaacgagtggatcatcagccccaagagcttcgacgcctactactgcgccggcgcctgcgagttccccatgcccaagatcgtgagacccagcaaccacgccaccatccagagcatcgtgagagccgtgggcatcatccccggcatccccgagccctgctgcgtgcccgacaagatgaacagcctgggcgtgctgttcctggacgagaacagaaacgtggtgctgaaggtgtaccccaacatgagcgtggacacctgcgcctgcagatag

SEQ ID NO: 9247 - DNA, 978 bp, Homo sapiens
atggagagcaagatgggcgagctgcccctggacatcaacatccaggagcccagatgggaccagagcaccttcctgggcagagccagacacttcttcaccgtgaccgaccccagaaacctgctgctgagcggcgcccagctggaggccagcagaaacatcgtgcagaactacagagccggcgtggtgacccccggcatcaccgaggaccagctgtggagagccaagtacgtgtacgacagcgccttccaccccgacaccggcgagaaggtggtgctgatcggcagaatgagcgcccaggtgcccatgaacatgaccatcaccggctgcatgctgaccttctacagaaagacccccaccgtggtgttctggcagtgggtgaaccagagcttcaacgccatcgtgaactacagcaacagaagcggcgacacccccatcaccgtgagacagctgggcaccgcctacgtgagcgccaccaccggcgccgtggccaccgccctgggcctgaagagcctgaccaagcacctgccccccctggtgggcagattcgtgcccttcgccgccgtggccgccgccaactgcatcaacatccccctgatgagacagagagagctgcaggtgggcatccccgtggccgacgaggccggccagagactgggctacagcgtgaccgccgccaagcagggcatcttccaggtggtgatcagcagaatctgcatggccatccccgccatggccatcccccccctgatcatggacaccctggagaagaaggacttcctgaagagaagaccctggctgggcgcccccctgcaggtgggcctggtgggcttctgcctggtgttcgccacccccctgtgctgcgccctgttcccccagaagagcagcatccacatcagcaacctggagcccgagctgagagcccagatccacgagcagaaccccagcgtggaggtggtgtactacaacaagggcctgtag

SEQ ID NO: 9248 - DNA, 1068 bp, Homo sapiens
atggagccccacctgctgggcctgctgctgggcctgctgctgggcggcaccagagtgctggccggctaccccatctggtggagcctggccctgggccagcagtacaccagcctgggcagccagcccctgctgtgcggcagcatccccggcctggtgcccaagcagctgagattctgcagaaactacatcgagatcatgcccagcgtggccgagggcgtgaagctgggcatccaggagtgccagcaccagttcagaggcagaagatggaactgcaccaccatcgacgacagcctggccatcttcggccccgtgctggacaaggccaccagagagagcgccttcgtgcacgccatcgccagcgccggcgtggccttcgccgtgaccagaagctgcgccgagggcaccagcaccatctgcggctgcgacagccaccacaagggcccccccggcgagggctggaagtggggcggctgcagcgaggacgccgacttcggcgtgctggtgagcagagagttcgccgacgccagagagaacagacccgacgccagaagcgccatgaacaagcacaacaacgaggccggcagaaccaccatcctggaccacatgcacctgaagtgcaagtgccacggcctgagcggcagctgcgaggtgaagacctgctggtgggcccagcccgacttcagagccatcggcgacttcctgaaggacaagtacgacagcgccagcgagatggtggtggagaagcacagagagagcagaggctgggtggagaccctgagagccaagtacagcctgttcaagccccccaccgagagagacctggtgtactacgagaacagccccaacttctgcgagcccaaccccgagaccggcagcttcggcaccagagacagaacctgcaacgtgaccagccacggcatcgacggctgcgacctgctgtgctgcggcagaggccacaacaccagaaccgagaagagaaaggagaagtgccactgcatcttccactggtgctgctacgtgagctgccaggagtgcatcagaatctacgacgtgcacacctgcaagtag

SEQ ID NO: 9249 - DNA, 1437 bp, Homo sapiens
atggccgccagacccatcaccctgggcatcgacctgggcaccaccagcgtgaaggccgccctgctgagagccgcccccgacgaccccagcggcttcgccgtgctggccagctgcgccagagccgccagagccgaggccgccgtggagagcgccgtggccggcccccagggcagagagcaggacgtgagcagaatcctgcaggccctgcacgagtgcctggccgccctgcccagaccccagctgagaagcgtggtgggcatcggcgtgagcggccagatgcacggcgtggtgttctggaagaccggccagggctgcgagtggaccgagggcggcatcacccccgtgttcgagcccagagccgtgagccacctggtgacctggcaggacggcagatgcagcagcgagttcctggccagcctgccccagcccaagagccacctgagcgtggccaccggcttcggctgcgccaccatcttctggctgctgaagtacagacccgagttcctgaagagctacgacgccgccggcaccatccacgactacgtggtggccatgctgtgcggcctgcccagacccctgatgagcgaccagaacgccgccagctggggctacttcaacacccagagccagagctggaacgtggagaccctgagaagcagcggcttccccgtgcacctgctgcccgacatcgccgagcccggcagcgtggccggcagaaccagccacatgtggttcgagatccccaagggcacccaggtgggcgtggccctgggcgacctgcaggccagcgtgtacagctgcatggcccagagaaccgacgccgtgctgaacatcagcaccagcgtgcagctggccgccagcatgcccagcggcttccagcccgcccagacccccgaccccaccgcccccgtggcctacttcccctacttcaacagaacctacctgggcgtggccgccagcctgaacggcggcaacgtgctggccaccttcgtgcacatgctggtgcagtggatggccgacctgggcctggaggtggaggagagcaccgtgtacagcagaatgatccaggccgccgtgcagcagagagacacccacctgaccatcacccccaccgtgctgggcgagagacacctgcccgaccagctggccagcgtgaccagaatcagcagcagcgacctgagcctgggccacgtgaccagagccctgtgcagaggcatcgtgcagaacctgcacagcatgctgcccatccagcagctgcaggactggggcgtggagagagtgatgggcagcggcagcgccctgagcagaaacgacgtgctgaagcaggaggtgcagagagccttccccctgcccatgagcttcggccaggacgtggacgccgccgtgggcgccgccctggtgatgctgagaagacacctgaaccagaaggagagctag

SEQ ID NO: 9250 - DNA, 1578 bp, Homo sapiens
atgagaagaagaagaagaagagacggcttctaccccgcccccgacttcagagacagagaggccgaggacatggccggcgtgttcgacatcgacctggaccagcccgaggacgccggcagcgaggacgagctggaggagggcggccagctgaacgagagcatggaccacggcggcgtgggcccctacgagctgggcatggagcactgcgagaagttcgagatcagcgagaccagcgtgaacagaggccccgagaagatcagacccgagtgcttcgagctgctgagagtgctgggcaagggcggctacggcaaggtgttccaggtgagaaaggtgaccggcgccaacaccggcaagatcttcgccatgaaggtgctgaagaaggccatgatcgtgagaaacgccaaggacaccgcccacaccaaggccgagagaaacatcctggaggaggtgaagcaccccttcatcgtggacctgatctacgccttccagaccggcggcaagctgtacctgatcctggagtacctgagcggcggcgagctgttcatgcagctggagagagagggcatcttcatggaggacaccgcctgcttctacctggccgagatcagcatggccctgggccacctgcaccagaagggcatcatctacagagacctgaagcccgagaacatcatgctgaaccaccagggccacgtgaagctgaccgacttcggcctgtgcaaggagagcatccacgacggcaccgtgacccacaccttctgcggcaccatcgagtacatggcccccgagatcctgatgagaagcggccacaacagagccgtggactggtggagcctgggcgccctgatgtacgacatgctgaccggcgccccccccttcaccggcgagaacagaaagaagaccatcgacaagatcctgaagtgcaagctgaacctgcccccctacctgacccaggaggccagagacctgctgaagaagctgctgaagagaaacgccgccagcagactgggcgccggccccggcgacgccggcgaggtgcaggcccaccccttcttcagacacatcaactgggaggagctgctggccagaaaggtggagccccccttcaagcccctgctgcagagcgaggaggacgtgagccagttcgacagcaagttcaccagacagacccccgtggacagccccgacgacagcaccctgagcgagagcgccaaccaggtgttcctgggcttcacctacgtggcccccagcgtgctggagagcgtgaaggagaagttcagcttcgagcccaagatcagaagccccagaagattcatcggcagccccagaacccccgtgagccccgtgaagttcagccccggcgacttctggggcagaggcgccagcgccagcaccgccaacccccagacccccgtggagtaccccatggagaccagcggcatcgagcagatggacgtgaccatgagcggcgaggccagcgcccccctgcccatcagacagcccaacagcggcccctacaagaagcaggccttccccatgatcagcaagagacccgagcacctgagaatgaacctgtag

SEQ ID NO: 9251 - DNA, 987 bp, Homo sapiens
atggccagaaccgtggtgctgatcaccggctgcagcagcggcatcggcctgcacctggccgtgagactggccagcgaccccagccagagcttcaaggtgtacgccaccctgagagacctgaagacccagggcagactgtgggaggccgccagagccctggcctgcccccccggcagcctggagaccctgcagctggacgtgagagacagcaagagcgtggccgccgccagagagagagtgaccgagggcagagtggacgtgctggtgtgcaacgccggcctgggcctgctgggccccctggaggccctgggcgaggacgccgtggccagcgtgctggacgtgaacgtggtgggcaccgtgagaatgctgcaggccttcctgcccgacatgaagagaagaggcagcggcagagtgctggtgaccggcagcgtgggcggcctgatgggcctgcccttcaacgacgtgtactgcgccagcaagttcgccctggagggcctgtgcgagagcctggccgtgctgctgctgcccttcggcgtgcacctgagcctgatcgagtgcggccccgtgcacaccgccttcatggagaaggtgctgggcagccccgaggaggtgctggacagaaccgacatccacaccttccacagattctaccagtacctggcccacagcaagcaggtgttcagagaggccgcccagaaccccgaggaggtggccgaggtgttcctgaccgccctgagagcccccaagcccaccctgagatacttcaccaccgagagattcctgcccctgctgagaatgagactggacgaccccagcggcagcaactacgtgaccgccatgcacagagaggtgttcggcgacgtgcccgccaaggccgaggccggcgccgaggccggcggcggcgccggccccggcgccgaggacgaggccggcagaggcgccgtgggcgaccccgagctgggcgacccccccgccgccccccagtag

SEQ ID NO: 9252 - DNA, 1626 bp, Homo sapiens
atgcccggcctgagaagagacagactgctgaccctgctgctgctgggcgccctgctgagcgccgacctgtacttccacctgtggccccaggtgcagagacagctgagacccagagagagacccagaggctgcccctgcaccggcagagccagcagcctggccagagacagcgccgccgccgccagcgaccccggcaccatcgtgcacaacttcagcagaaccgagcccagaaccgagcccgccggcggcagccacagcggcagcagcagcaagctgcaggccctgttcgcccaccccctgtacaacgtgcccgaggagccccccctgctgggcgccgaggacagcctgctggccagccaggaggccctgagatactacagaagaaaggtggccagatggaacagaagacacaagatgtacagagagcagatgaacctgaccagcctggacccccccctgcagctgagactggaggccagctgggtgcagttccacctgggcatcaacagacacggcctgtacagcagaagcagccccgtggtgagcaagctgctgcaggacatgagacacttccccaccatcagcgccgactacagccaggacgagaaggccctgctgggcgcctgcgactgcacccagatcgtgaagcccagcggcgtgcacctgaagctggtgctgagattcagcgacttcggcaaggccatgttcaagcccatgagacagcagagagacgaggagacccccgtggacttcttctacttcatcgacttccagagacacaacgccgagatcgccgccttccacctggacagaatcctggacttcagaagagtgccccccaccgtgggcagaatcgtgaacgtgaccaaggagatcctggaggtgaccaagaacgagatcctgcagagcgtgttcttcgtgagccccgccagcaacgtgtgcttcttcgccaagtgcccctacatgtgcaagaccgagtacgccgtgtgcggcaacccccacctgctggagggcagcctgagcgccttcctgcccagcctgaacctggcccccagactgagcgtgcccaacccctggatcagaagctacaccctggccggcaaggaggagtgggaggtgaaccccctgtactgcgacaccgtgaagcagatctacccctacaacaacagccagagactgctgaacgtgatcgacatggccatcttcgacttcctgatcggcaacatggacagacaccactacgagatgttcaccaagttcggcgacgacggcttcctgatccacctggacaacgccagaggcttcggcagacacagccacgacgagatcagcatcctgagccccctgagccagtgctgcatgatcaagaagaagaccctgctgcacctgcagctgctggcccaggccgactacagactgagcgacgtgatgagagagagcctgctggaggaccagctgagccccgtgctgaccgagccccacctgctggccctggacagaagactgcagaccatcctgagaaccgtggagggctgcatcgtggcccacggccagcagagcgtgatcgtggacggccccgtggagcagctggcccccgacagcggccaggccaacctgaccagctag

SEQ ID NO: 9253 - DNA, 954 bp, Homo sapiens
atgaagaccgccctgatcctgctgagcatcctgggcatggcctgcgccttcagcatgaagaacctgcacagaagagtgaagatcgaggacagcgaggagaacggcgtgttcaagtacagacccagatactacctgtacaagcacgcctacttctacccccacctgaagagattccccgtgcagggcagcagcgacagcagcgaggagaacggcgacgacagcagcgaggaggaggaggaggaggaggagaccagcaacgagggcgagaacaacgaggagagcaacgaggacgaggacagcgaggccgagaacaccaccctgagcgccaccaccctgggctacggcgaggacgccacccccggcaccggctacaccggcctggccgccatccagctgcccaagaaggccggcgacatcaccaacaaggccaccaaggagaaggagagcgacgaggaggaggaggaggaggaggagggcaacgagaacgaggagagcgaggccgaggtggacgagaacgagcagggcatcaacggcaccagcaccaacagcaccgaggccgagaacggcaacggcagcagcggcggcgacaacggcgaggagggcgaggaggagagcgtgaccggcgccaacgccgaggacaccaccgagaccggcagacagggcaagggcaccagcaagaccaccaccagccccaacggcggcttcgagcccaccacccccccccaggtgtacagaaccaccagcccccccttcggcaagaccaccaccgtggagtacgagggcgagtacgagtacaccggcgccaacgagtacgacaacggctacgagatctacgagagcgagaacggcgagcccagaggcgacaactacagagcctacgaggacgagtacagctacttcaagggccagggctacgacggctacgacggccagaactactaccaccaccagtag

SEQ ID NO: 9254 - DNA, 345 bp, Homo sapiens
atgagcctgcccagcagcagagccgccagagtgcccggccccagcggcagcctgtgcgccctgctggccctgctgctgctgctgaccccccccggccccctggccagcgccggccccgtgagcgccgtgctgaccgagctgagatgcacctgcctgagagtgaccctgagagtgaaccccaagaccatcggcaagctgcaggtgttccccgccggcccccagtgcagcaaggtggaggtggtggccagcctgaagaacggcaagcaggtgtgcctggaccccgaggcccccttcctgaagaaggtgatccagaagatcctggacagcggcaacaagaagaactag

SEQ ID NO: 9255 - DNA, 2100 bp, Homo sapiens
atgcccagcctgtggagagagatcctgctggagagcctgctgggctgcgtgagctggagcctgtaccacgacctgggccccatgatctactacttccccctgcagaccctggagctgaccggcctggagggcttcagcatcgccttcctgagccccatcttcctgaccatcacccccttctggaagctggtgaacaagaagtggatgctgaccctgctgagaatcatcaccatcggcagcatcgccagcttccaggcccccaacgccaagctgagactgatggtgctggccctgggcgtgagcagcagcctgatcgtgcaggccgtgacctggtggagcggcagccacctgcagagatacctgagaatctggggcttcatcctgggccagatcgtgctggtggtgctgagaatctggtacaccagcctgaaccccatctggagctaccagatgagcaacaaggtgatcctgaccctgagcgccatcgccaccctggacagaatcggcaccgacggcgactgcagcaagcccgaggagaagaagaccggcgaggtggccaccggcatggccagcagacccaactggctgctggccggcgccgccttcggcagcctggtgttcctgacccactgggtgttcggcgaggtgagcctggtgagcagatgggccgtgagcggccacccccaccccggccccgaccccaaccccttcggcggcgccgtgctgctgtgcctggccagcggcctgatgctgcccagctgcctgtggttcagaggcaccggcctgatctggtgggtgaccggcaccgccagcgccgccggcctgctgtacctgcacacctgggccgccgccgtgagcggctgcgtgttcgccatcttcaccgccagcatgtggccccagaccctgggccacctgatcaacagcggcaccaaccccggcaagaccatgaccatcgccatgatcttctacctgctggagatcttcttctgcgcctggtgcaccgccttcaagttcgtgcccggcggcgtgtacgccagagagagaagcgacgtgctgctgggcaccatgatgctgatcatcggcctgaacatgctgttcggccccaagaagaacctggacctgctgctgcagaccaagaacagcagcaaggtgctgttcagaaagagcgagaagtacatgaagctgttcctgtggctgctggtgggcgtgggcctgctgggcctgggcctgagacacaaggcctacgagagaaagctgggcaaggtggcccccaccaaggaggtgagcgccgccatctggcccttcagattcggctacgacaacgagggctggagcagcctggagagaagcgcccacctgctgaacgagaccggcgccgacttcatcaccatcctggagagcgacgccagcaagccctacatgggcaacaacgacctgaccatgtggctgggcgagaagctgggcttctacaccgacttcggccccagcaccagataccacacctggggcatcatggccctgagcagataccccatcgtgaagagcgagcaccacctgctgcccagccccgagggcgagatcgcccccgccatcaccctgaccgtgaacatcagcggcaagctggtggacttcgtggtgacccacttcggcaaccacgaggacgacctggacagaaagctgcaggccatcgccgtgagcaagctgctgaagagcagcagcaaccaggtgatcttcctgggctacatcaccagcgcccccggcagcagagactacctgcagctgaccgagcacggcaacgtgaaggacatcgacagcaccgaccacgacagatggtgcgagtacatcatgtacagaggcctgatcagactgggctacgccagaatcagccacgccgagctgagcgacagcgagatccagatggccaagttcagaatccccgacgaccccaccaactacagagacaaccagaaggtggtgatcgaccacagagaggtgagcgagaagatccacttcaaccccagattcggcagctacaaggagggccacaactacgagaacaaccaccacttccacatgaacacccccaagtacttcctgtag

SEQ ID NO: 9256 - DNA, 1449 bp, Homo sapiens
atgctgttcgagggcaaggtgaacccccagacccagagcctgctggccgagtgcggcgagtggaccagaagaagcctgcacctgagagtgctgggcagacagctgatcctgcccaccgacaagggcgtgcagcacttccagggcagcacccccgccagcgccgtgcacagaccccccctgagcgcctgcggccacagcagcaacatcagagagctgtgcatcagcggcagccagatcgtgcccgccgccctgagcgccagcgccctgcccggccccgacgacaccggcgtggccgacctgaccgccagaagcagcctggaggaggaggtgtaccacgtggacggcaagatcgaggagtacttcgccttcgacagaaaggaggacgacgacgagtgcctggagcagaagcccgcccagcccggcagaaagtggagaaagctgggcctgccccccgtgagccccagagactgcgtgaaggacgccgtggccgccgaggtgttcgaccacgtgtggaccaacatggtggagctgctggaggagctgatcagaaagcactgggagaccaccctgaccgagggcaagaagcagagagagaccctgaaggtggccggcaacagattcccccacgtgctggtgccccacgcccacgccgacggcgccagcggcccccccagcggccacgccgaggcccacggcatcagcctggccagcagactgaaccccccccagatccaccacttcagcagcagcttctacagcgacatgaacggcgtgatgaccatccaggccaagcccctgcagagaagacccgcctacttcgccgacagaacccagaacgagaaggaggacaaggccagcggcggcggcgccggcgccctgagcagcgccccccacagactgggcagagccagcgacacccacggcctgagccccagcgccaagaagacccccgtgccctggagactgcccagcctggccagcgacagccagagactgaagacccccaacatctacagcgacgaggtgctgagaggcaccaagctgcccaccggcgtggaccacatggccagccccctggtgcagaccagcagaagcagattcccccccctggtgaccgagaccagaggccagaacaccgccgtgcccggctgcagactggtgagctacagaggcagacacctgcagaacagagtgctgagcgccatgcccgacggcaccgagagaagcagactgagagagagaaccgccaccctggagagactgagcagacccagcaccacccacaccttcagacagagcgacacccccagaaagagcagcctgacccagatggagttcgccgcccacacctggaccggccagagcatcctgaccggcagccagtacgtgcccaagagcttccagagaaccaccctgaccttcaagagaagattccaggtgaccagctag

SEQ ID NO: 9257 - DNA, 1392 bp, Homo sapiens
atgggcgccggccccagcctgctgctggccgccctgctgctgctgctgagcggcgacggcgccgtgagatgcgacacccccgccaactgcacctacctggacctgctgggcacctgggtgttccaggtgggcagcagcggcagccagagagacgtgaactgcagcgtgatgggcccccaggagaagaaggtggtggtgtacctgcagaagctggacaccgcctacgacgacctgggcaacagcggccacttcaccatcatctacaaccagggcttcgagatcgtgctgaacgactacaagtggttcgccttcttcaagtacaaggaggagggcagcaaggtgaccacctactgcaacgagaccatgaccggctgggtgcacgacgtgctgggcagaaactgggcctgcttcaccggcaagaaggtgggcaccgccagcgagaacgtgtacgtgaacatcgcccacctgaagaacagccaggagaagtacagcaacagactgtacaagtacgaccacaacttcgtgaaggccatcaacgccatccagaagagctggaccgccaccacctacatggagtacgagaccctgaccctgggcgacatgatcagaagaagcggcggccacagcagaaagatccccagacccaagcccgcccccctgaccgccgagatccagcagaagatcctgcacctgcccaccagctgggactggagaaacgtgcacggcatcaacttcgtgagccccgtgagaaaccaggccagctgcggcagctgctacagcttcgccagcatgggcatgctggaggccagaatcagaatcctgaccaacaacagccagacccccatcctgagcccccaggaggtggtgagctgcagccagtacgcccagggctgcgagggcggcttcccctacctgatcgccggcaagtacgcccaggacttcggcctggtggaggaggcctgcttcccctacaccggcaccgacagcccctgcaagatgaaggaggactgcttcagatactacagcagcgagtaccactacgtgggcggcttctacggcggctgcaacgaggccctgatgaagctggagctggtgcaccacggccccatggccgtggccttcgaggtgtacgacgacttcctgcactacaagaagggcatctaccaccacaccggcctgagagaccccttcaaccccttcgagctgaccaaccacgccgtgctgctggtgggctacggcaccgacagcgccagcggcatggactactggatcgtgaagaacagctggggcaccggctggggcgagaacggctacttcagaatcagaagaggcaccgacgagtgcgccatcgagagcatcgccgtggccgccacccccatccccaagctgtag

SEQ ID NO: 9258 - DNA, 1941 bp, Homo sapiens
atgagcaagggccccgccgtgggcatcgacctgggcaccacctacagctgcgtgggcgtgttccagcacggcaaggtggagatcatcgccaacgaccagggcaacagaaccacccccagctacgtggccttcaccgacaccgagagactgatcggcgacgccgccaagaaccaggtggccatgaaccccaccaacaccgtgttcgacgccaagagactgatcggcagaagattcgacgacgccgtggtgcagagcgacatgaagcactggcccttcatggtggtgaacgacgccggcagacccaaggtgcaggtggagtacaagggcgagaccaagagcttctaccccgaggaggtgagcagcatggtgctgaccaagatgaaggagatcgccgaggcctacctgggcaagaccgtgaccaacgccgtggtgaccgtgcccgcctacttcaacgacagccagagacaggccaccaaggacgccggcaccatcgccggcctgaacgtgctgagaatcatcaacgagcccaccgccgccgccatcgcctacggcctggacaagaaggtgggcgccgagagaaacgtgctgatcttcgacctgggcggcggcaccttcgacgtgagcatcctgaccatcgaggacggcatcttcgaggtgaagagcaccgccggcgacacccacctgggcggcgaggacttcgacaacagaatggtgaaccacttcatcgccgagttcaagagaaagcacaagaaggacatcagcgagaacaagagagccgtgagaagactgagaaccgcctgcgagagagccaagagaaccctgagcagcagcacccaggccagcatcgagatcgacagcctgtacgagggcatcgacttctacaccagcatcaccagagccagattcgaggagctgaacgccgacctgttcagaggcaccctggaccccgtggagaaggccctgagagacgccaagctggacaagagccagatccacgacatcgtgctggtgggcggcagcaccagaatccccaagatccagaagctgctgcaggacttcttcaacggcaaggagctgaacaagagcatcaaccccgacgaggccgtggcctacggcgccgccgtgcaggccgccatcctgagcggcgacaagagcgagaacgtgcaggacctgctgctgctggacgtgacccccctgagcctgggcatcgagaccgccggcggcgtgatgaccgtgctgatcaagagaaacaccaccatccccaccaagcagacccagaccttcaccacctacagcgacaaccagcccggcgtgctgatccaggtgtacgagggcgagagagccatgaccaaggacaacaacctgctgggcaagttcgagctgaccggcatcccccccgcccccagaggcgtgccccagatcgaggtgaccttcgacatcgacgccaacggcatcctgaacgtgagcgccgtggacaagagcaccggcaaggagaacaagatcaccatcaccaacgacaagggcagactgagcaaggaggacatcgagagaatggtgcaggaggccgagaagtacaaggccgaggacgagaagcagagagacaaggtgagcagcaagaacagcctggagagctacgccttcaacatgaaggccaccgtggaggacgagaagctgcagggcaagatcaacgacgaggacaagcagaagatcctggacaagtgcaacgagatcatcaactggctggacaagaaccagaccgccgagaaggaggagttcgagcaccagcagaaggagctggagaaggtgtgcaaccccatcatcaccaagctgtaccagagcgccggcggcatgcccggcggcatgcccggcggcttccccggcggcggcgccccccccagcggcggcgccagcagcggccccaccatcgaggaggtggactag

SEQ ID NO: 9259 - DNA, 1017 bp, Homo sapiens
atgtgggaggccaaccccgagatgttccacaaggccgaggagctgttcagcaagaccaccaacaacgaggtggacgacatggacaccagcgacacccagtggggctggttctacctggccgagtgcggcaagtggcacatgttccagcccgacaccaacagccagtgcagcgtgagcagcgaggacatcgagaagagcttcaagaccaacccctgcggcagcatcagcttcaccaccagcaagttcagctacaagatcgacttcgccgagatgaagcagatgaacctgaccaccggcaagcagagactgatcaagagagcccccttcagcatcagcgccttcagctacatctgcgagaacgaggccatccccatgcccccccactgggagaacgtgaacacccaggtgccctaccagctgatccccctgcacaaccagacccacgagtacaacgaggtggccaacctgttcggcaagaccatggacagaaacagaatcaagagaatccagagaatccagaacctggacctgtgggagttcttctgcagaaagaaggcccagctgaagaagaagagaggcgtgccccagatcaacgagcagatgctgttccacggcaccagcagcgagttcgtggaggccatctgcatccacaacttcgactggagaatcaacggcatccacggcgccgtgttcggcaagggcacctacttcgccagagacgccgcctacagcagcagattctgcaaggacgacatcaagcacggcaacaccttccagatccacggcgtgagcctgcagcagagacacctgttcagaacctacaagagcatgttcctggccagagtgctgatcggcgactacatcaacggcgacagcaagtacatgagaccccccagcaaggacggcagctacgtgaacctgtacgacagctgcgtggacgacacctggaaccccaagatcttcgtggtgttcgacgccaaccagatctaccccgagtacctgatcgacttccactag

SEQ ID NO: 9260 - DNA, 1059 bp, Homo sapiens
atggtgagacccgtgagacacaagaagcccgtgaactacagccagttcgaccacagcgacagcgacgacgacttcgtgagcgccaccgtgcccctgaacaagaagagcagaaccgcccccaaggagctgaagcaggacaagcccaagcccaacctgaacaacctgagaaaggaggagatccccgtgcaggagaagacccccaagaagagactgcccgagggcaccttcagcatccccgccagcgccgtgccctgcaccaagatggccctggacgacaagctgtaccagagagacctggaggtggccctggccctgagcgtgaaggagctgcccaccgtgaccaccaacgtgcagaacagccaggacaagagcatcgagaagcacggcagcagcaagatcgagaccatgaacaagagcccccacatcagcaactgcagcgtggccagcgactacctggacctggacaagatcaccgtggaggacgacgtgggcggcgtgcagggcaagagaaaggccgccagcaaggccgccgcccagcagagaaagatcctgctggagggcagcgacggcgacagcgccaacgacaccgagcccgacttcgcccccggcgaggacagcgaggacgacagcgacttctgcgagagcgaggacaacgacgaggacttcagcatgagaaagagcaaggtgaaggagatcaagaagaaggaggtgaaggtgaagagccccgtggagaagaaggagaagaagagcaagagcaagtgcaacgccctggtgaccagcgtggacagcgcccccgccgccgtgaagagcgagagccagagcctgcccaagaaggtgagcctgagcagcgacaccaccagaaagcccctggagatcagaagccccagcgccgagagcaagaagcccaagtgggtgccccccgccgccagcggcggcagcagaagcagcagcagccccctggtggtggtgagcgtgaagagccccaaccagagcctgagactgggcctgagcagactggccagagtgaagcccctgcaccccaacgccaccagcacctag

SEQ ID NO: 9261 - DNA, 1488 bp, Homo sapiens
atgaccgtgatgagcggcgagaacgtggacgaggccagcgccgcccccggccacccccaggacggcagctaccccagacaggccgaccacgacgaccacgagtgctgcgagagagtggtgatcaacatcagcggcctgagattcgagacccagctgaagaccctggcccagttccccaacaccctgctgggcaaccccaagaagagaatgagatacttcgaccccctgagaaacgagtacttcttcgacagaaacagacccagcttcgacgccatcctgtactactaccagagcggcggcagactgagaagacccgtgaacgtgcccctggacatgttcagcgaggagatcaagttctacgagctgggcgaggaggccatggagaagttcagagaggacgagggcttcatcaaggaggaggagagacccctgcccgagaaggagtaccagagacaggtgtggctgctgttcgagtaccccgagagcagcggccccgccagagtgatcgccatcgtgagcgtgatggtgatcctgatcagcatcgtgatcttctgcctggagaccctgcccgagctgaaggacgacaaggacttcaccggcaccgtgcacagaatcgacaacaccaccgtgatctacaacagcaacatcttcaccgaccccttcttcatcgtggagaccctgtgcatcatctggttcagcttcgagctggtggtgagattcttcgcctgccccagcaagaccgacttcttcaagaacatcatgaacttcatcgacatcgtggccatcatcccctacttcatcaccctgggcaccgagatcgccgagcaggagggcaaccagaagggcgagcaggccaccagcctggccatcctgagagtgatcagactggtgagagtgttcagaatcttcaagctgagcagacacagcaagggcctgcagatcctgggccagaccctgaaggccagcatgagagagctgggcctgctgatcttcttcctgttcatcggcgtgatcctgttcagcagcgccgtgtacttcgccgaggccgaggaggccgagagccacttcagcagcatccccgacgccttctggtgggccgtggtgagcatgaccaccgtgggctacggcgacatgtaccccgtgaccatcggcggcaagatcgtgggcagcctgtgcgccatcgccggcgtgctgaccatcgccctgcccgtgcccgtgatcgtgagcaacttcaactacttctaccacagagagaccgagggcgaggagcaggcccagctgctgcacgtgagcagccccaacctggccagcgacagcgacctgagcagaagaagcagcagcaccatgagcaagagcgagtacatggagatcgaggaggacatgaacaacagcatcgcccactacagacaggtgaacatcagaaccgccaactgcaccaccgccaaccagaactgcgtgaacaagagcaagctgctgaccgacgtgtag

SEQ ID NO: 9262 - DNA, 1632 bp, Homo sapiens
atgagaaagcccgccgccggcttcctgcccagcctgctgaaggtgctgctgctgcccctggcccccgccgccgcccaggacagcacccaggccagcacccccggcagccccctgagccccaccgagtacgagagattcttcgccctgctgacccccacctggaaggccgagaccacctgcagactgagagccacccacggctgcagaaaccccaccctggtgcagctggaccagtacgagaaccacggcctggtgcccgacggcgccgtgtgcagcaacctgccctacgccagctggttcgagagcttctgccagttcacccactacagatgcagcaaccacgtgtactacgccaagagagtgctgtgcagccagcccgtgagcatcctgagccccaacaccctgaaggagatcgaggccagcgccgaggtgagccccaccaccatgaccagccccatcagcccccacttcaccgtgaccgagagacagaccttccagccctggcccgagagactgagcaacaacgtggaggagctgctgcagagcagcctgagcctgggcggccaggagcaggcccccgagcacaagcaggagcagggcgtggagcacagacaggagcccacccaggagcacaagcaggaggagggccagaagcaggaggagcaggaggaggagcaggaggaggagggcaagcaggaggagggccagggcaccaaggagggcagagaggccgtgagccagctgcagaccgacagcgagcccaagttccacagcgagagcctgagcagcaaccccagcagcttcgcccccagagtgagagaggtggagagcacccccatgatcatggagaacatccaggagctgatcagaagcgcccaggagatcgacgagatgaacgagatctacgacgagaacagctactggagaaaccagaaccccggcagcctgctgcagctgccccacaccgaggccctgctggtgctgtgctacagcatcgtggagaacacctgcatcatcacccccaccgccaaggcctggaagtacatggaggaggagatcctgggcttcggcaagagcgtgtgcgacagcctgggcagaagacacatgagcacctgcgccctgtgcgacttctgcagcctgaagctggagcagtgccacagcgaggccagcctgcagagacagcagtgcgacaccagccacaagacccccttcgtgagccccctgctggccagccagagcctgagcatcggcaaccaggtgggcagccccgagagcggcagattctacggcctggacctgtacggcggcctgcacatggacttctggtgcgccagactggccaccaagggctgcgaggacgtgagagtgagcggctggctgcagaccgagttcctgagcttccaggacggcgacttccccaccaagatctgcgacaccgactacatccagtaccccaactactgcagcttcaagagccagcagtgcctgatgagaaacagaaacagaaaggtgagcagaatgagatgcctgcagaacgagacctacagcgccctgagccccggcaagagcgaggacgtggtgctgagatggagccaggagttcagcaccctgaccctgggccagttcggctag

SEQ ID NO: 9263 - DNA, 666 bp, Homo sapiens
atgagcggctgggccgacgagagaggcggcgagggcgacggcagaatctacgtgggcaacctgcccaccgacgtgagagagaaggacctggaggacctgttctacaagtacggcagaatcagagagatcgagctgaagaacagacacggcctggtgcccttcgccttcgtgagattcgaggaccccagagacgccgaggacgccatctacggcagaaacggctacgactacggccagtgcagactgagagtggagttccccagaacctacggcggcagaggcggctggcccagaggcggcagaaacggcccccccaccagaagaagcgacttcagagtgctggtgagcggcctgccccccagcggcagctggcaggacctgaaggaccacatgagagaggccggcgacgtgtgctacgccgacgtgcagaaggacggcgtgggcatggtggagtacctgagaaaggaggacatggagtacgccctgagaaagctggacgacaccaagttcagaagccacgagggcgagaccagctacatcagagtgtaccccgagagaagcaccagctacggctacagcagaagcagaagcggcagcagaggcagagacagcccctaccagagcagaggcagcccccactacttcagccccttcagaccctactag

SEQ ID NO: 9264 - DNA, 2523 bp, Homo sapiens
atgagcgccttcagactgtggcccggcctgctgatcatgctgggcagcctgtgccacagaggcagcccctgcggcctgagcacccacgtggagatcggccacagagccctggagttcctgcagctgcacaacggcagagtgaactacagagagctgctgctggagcaccaggacgcctaccaggccggcatcgtgttccccgactgcttctaccccagcatctgcaagggcggcaagttccacgacgtgagcgagagcacccactggacccccttcctgaacgccagcgtgcactacatcagagagaactaccccctgccctgggagaaggacaccgagaagctggtggccttcctgttcggcatcaccagccacatggccgccgacgtgagctggcacagcctgggcctggagcagggcttcctgagaaccatgggcgccatcgacttccacggcagctacagcgaggcccacagcgccggcgacttcggcggcgacgtgctgagccagttcgagttcaacttcaactacctggccagaagatggtacgtgcccgtgaaggacctgctgggcatctacgagaagctgtacggcagaaaggtgatcaccgagaacgtgatcgtggactgcagccacatccagttcctggagatgtacggcgagatgctggccgtgagcaagctgtaccccacctacagcaccaagagccccttcctggtggagcagttccaggagtacttcctgggcggcctggacgacatggccttctggagcaccaacatctaccacctgaccagcttcatgctggagaacggcaccagcgactgcaacctgcccgagaaccccctgttcatcgcctgcggcggccagcagaaccacacccagggcagcaagatgcagaagaacgacttccacagaaacctgaccaccagcctgaccgagagcgtggacagaaacatcaactacaccgagagaggcgtgttcttcagcgtgaacagctggacccccgacagcatgagcttcatctacaaggccctggagagaaacatcagaaccatgttcatcggcggcagccagctgagccagaagcacgtgagcagccccctggccagctacttcctgagcttcccctacgccagactgggctgggccatgaccagcgccgacctgaaccaggacggccacggcgacctggtggtgggcgcccccggctacagcagacccggccacatccacatcggcagagtgtacctgatctacggcaacgacctgggcctgccccccgtggacctggacctggacaaggaggcccacagaatcctggagggcttccagcccagcggcagattcggcagcgccctggccgtgctggacttcaacgtggacggcgtgcccgacctggccgtgggcgcccccagcgtgggcagcgagcagctgacctacaagggcgccgtgtacgtgtacttcggcagcaagcagggcggcatgagcagcagccccaacatcaccatcagctgccaggacatctactgcaacctgggctggaccctgctggccgccgacgtgaacggcgacagcgagcccgacctggtgatcggcagccccttcgcccccggcggcggcaagcagaagggcatcgtggccgccttctacagcggccccagcctgagcgacaaggagaagctgaacgtggaggccgccaactggaccgtgagaggcgaggaggacttcagctggttcggctacagcctgcacggcgtgaccgtggacaacagaaccctgctgctggtgggcagccccacctggaagaacgccagcagactgggccacctgctgcacatcagagacgagaagaagagcctgggcagagtgtacggctacttcccccccaacggccagagctggttcaccatcagcggcgacaaggccatgggcaagctgggcaccagcctgagcagcggccacgtgctgatgaacggcaccctgaagcaggtgctgctggtgggcgcccccacctacgacgacgtgagcaaggtggccttcctgaccgtgaccctgcaccagggcggcgccaccagaatgtacgccctgaccagcgacgcccagcccctgctgctgagcaccttcagcggcgacagaagattcagcagattcggcggcgtgctgcacctgagcgacctggacgacgacggcctggacgagatcatcatggccgcccccctgagaatcgccgacgtgaccagcggcctgatcggcggcgaggacggcagagtgtacgtgtacaacggcaaggagaccaccctgggcgacatgaccggcaagtgcaagagctggatcaccccctgccccgaggagaaggcccagtacgtgctgatcagccccgaggccagcagcagattcggcagcagcctgatcaccgtgagaagcaaggccaagaaccaggtggtgatcgccgccggcagaagcagcctgggcgccagactgagcggcgccctgcacgtgtacagcctgggcagcgactag

SEQ ID NO: 9265 - DNA, 972 bp, Homo sapiens
atgaagagcgccctgttcaccagattcttcatcctgctgccctggatcctgatcgtgatcatcatgctggacgtggacaccagaagacccgtgccccccctgacccccagaccctacttcagcccctacgccgtgggcagaggcggcgccagactgcccctgagaagaggcggccccgcccacggcacccagaagagaaaccagagcagaccccagccccagcccgagccccagctgcccaccatctacgccatcacccccacctacagcagacccgtgcagaaggccgagctgaccagactggccaacaccttcagacaggtggcccagctgcactggatcctggtggaggacgccgccgccagaagcgagctggtgagcagattcctggccagagccggcctgcccagcacccacctgcacgtgcccacccccagaagatacaagagacccggcctgcccagagccaccgagcagagaaacgccggcctggcctggctgagacagagacaccagcaccagagagcccagcccggcgtgctgttcttcgccgacgacgacaacacctacagcctggagctgttccaggagatgagaaccaccagaaaggtgagcgtgtggcccgtgggcctggtgggcggcagaagatacgagagacccctggtggagaacggcaaggtggtgggctggtacaccggctggagagccgacagacccttcgccatcgacatggccggcttcgccgtgagcctgcaggtgatcctgagcaaccccaaggccgtgttcaagagaagaggcagccagcccggcatgcaggagagcgacttcctgaagcagatcaccaccgtggaggagctggagcccaaggccaacaactgcaccaaggtgctggtgtggcacaccagaaccgagaaggtgaacctggccaacgagcccaagtaccacctggacaccgtgaagatcgaggtgtag

SEQ ID NO: 9266 - DNA, 3213 bp, Homo sapiens
atgggcgccgccagaggcagccccgccagacccagaagactgcccctgctgagcgtgctgctgctgcccctgctgggcggcacccagaccgccatcgtgttcatcaagcagcccagcagccaggacgccctgcagggcagaagagccctgctgagatgcgaggtggaggcccccggccccgtgcacgtgtactggctgctggacggcgcccccgtgcaggacaccgagagaagattcgcccagggcagcagcctgagcttcgccgccgtggacagactgcaggacagcggcaccttccagtgcgtggccagagacgacgtgaccggcgaggaggccagaagcgccaacgccagcttcaacatcaagtggatcgaggccggccccgtggtgctgaagcaccccgccagcgaggccgagatccagccccagacccaggtgaccctgagatgccacatcgacggccaccccagacccacctaccagtggttcagagacggcacccccctgagcgacggccagagcaaccacaccgtgagcagcaaggagagaaacctgaccctgagacccgccggccccgagcacagcggcctgtacagctgctgcgcccacagcgccttcggccaggcctgcagcagccagaacttcaccctgagcatcgccgacgagagcttcgccagagtggtgctggccccccaggacgtggtggtggccagatacgaggaggccatgttccactgccagttcagcgcccagcccccccccagcctgcagtggctgttcgaggacgagacccccatcaccaacagaagcagacccccccacctgagaagagccaccgtgttcgccaacggcagcctgctgctgacccaggtgagacccagaaacgccggcatctacagatgcatcggccagggccagagaggcccccccatcatcctggaggccaccctgcacctggccgagatcgaggacatgcccctgttcgagcccagagtgttcaccgccggcagcgaggagagagtgacctgcctgccccccaagggcctgcccgagcccagcgtgtggtgggagcacgccggcgtgagactgcccacccacggcagagtgtaccagaagggccacgagctggtgctggccaacatcgccgagagcgacgccggcgtgtacacctgccacgccgccaacctggccggccagagaagacaggacgtgaacatcaccgtggccaccgtgcccagctggctgaagaagccccaggacagccagctggaggagggcaagcccggctacctggactgcctgacccaggccacccccaagcccaccgtggtgtggtacagaaaccagatgctgatcagcgaggacagcagattcgaggtgttcaagaacggcaccctgagaatcaacagcgtggaggtgtacgacggcacctggtacagatgcatgagcagcacccccgccggcagcatcgaggcccaggccagagtgcaggtgctggagaagctgaagttcaccccccccccccagccccagcagtgcatggagttcgacaaggaggccaccgtgccctgcagcgccaccggcagagagaagcccaccatcaagtgggagagagccgacggcagcagcctgcccgagtgggtgaccgacaacgccggcaccctgcacttcgccagagtgaccagagacgacgccggcaactacacctgcatcgccagcaacggcccccagggccagatcagagcccacgtgcagctgaccgtggccgtgttcatcaccttcaaggtggagcccgagagaaccaccgtgtaccagggccacaccgccctgctgcagtgcgaggcccagggcgaccccaagcccctgatccagtggaagggcaaggacagaatcctggaccccaccaagctgggccccagaatgcacatcttccagaacggcagcctggtgatccacgacgtggcccccgaggacagcggcagatacacctgcatcgccggcaacagctgcaacatcaagcacaccgaggcccccctgtacgtggtggacaagcccgtgcccgaggagagcgagggccccggcagcccccccccctacaagatgatccagaccatcggcctgagcgtgggcgccgccgtggcctacatcatcgccgtgctgggcctgatgttctactgcaagaagagatgcaaggccaagagactgcagaagcagcccgagggcgaggagcccgagatggagtgcctgaacggcggccccctgcagaacggccagcccagcgccgagatccaggaggaggtggccctgaccagcctgggcagcggccccgccgccaccaacaagagacacagcaccagcgacaagatgcacttccccagaagcagcctgcagcccatcaccaccctgggcaagagcgagttcggcgaggtgttcctggccaaggcccagggcctggaggagggcgtggccgagaccctggtgctggtgaagagcctgcagagcaaggacgagcagcagcagctggacttcagaagagagctggagatgttcggcaagctgaaccacgccaacgtggtgagactgctgggcctgtgcagagaggccgagccccactacatggtgctggagtacgtggacctgggcgacctgaagcagttcctgagaatcagcaagagcaaggacgagaagctgaagagccagcccctgagcaccaagcagaaggtggccctgtgcacccaggtggccctgggcatggagcacctgagcaacaacagattcgtgcacaaggacctggccgccagaaactgcctggtgagcgcccagagacaggtgaaggtgagcgccctgggcctgagcaaggacgtgtacaacagcgagtactaccacttcagacaggcctgggtgcccctgagatggatgagccccgaggccatcctggagggcgacttcagcaccaagagcgacgtgtgggccttcggcgtgctgatgtgggaggtgttcacccacggcgagatgccccacggcggccaggccgacgacgaggtgctggccgacctgcaggccggcaaggccagactgccccagcccgagggctgccccagcaagctgtacagactgatgcagagatgctgggccctgagccccaaggacagacccagcttcagcgagatcgccagcgccctgggcgacagcaccgtggacagcaagccctag

SEQ ID NO: 9267 - DNA, 1521 bp, Homo sapiens
atgcccctgctgggcctgctgcccagaagagcctgggccagcctgctgagccagctgctgagacccccctgcgccagctgcaccggcgccgtgagatgccagagccaggtggccgaggccgtgctgaccagccagctgaaggcccaccaggagaagcccaacttcatcatcaagacccccaagggcaccagagacctgagcccccagcacatggtggtgagagagaagatcctggacctggtgatcagctgcttcaagagacacggcgccaagggcatggacacccccgccttcgagctgaaggagaccctgaccgagaagtacggcgaggacagcggcctgatgtacgacctgaaggaccagggcggcgagctgctgagcctgagatacgacctgaccgtgcccttcgccagatacctggccatgaacaaggtgaagaagatgaagagataccacgtgggcaaggtgtggagaagagagagccccaccatcgtgcagggcagatacagagagttctgccagtgcgacttcgacatcgccggccagttcgaccccatgatccccgacgccgagtgcctgaagatcatgtgcgagatcctgagcggcctgcagctgggcgacttcctgatcaaggtgaacgacagaagaatcgtggacggcatgttcgccgtgtgcggcgtgcccgagagcaagttcagagccatctgcagcagcatcgacaagctggacaagatggcctggaaggacgtgagacacgagatggtggtgaagaagggcctggcccccgaggtggccgacagaatcggcgactacgtgcagtgccacggcggcgtgagcctggtggagcagatgttccaggaccccagactgagccagaacaagcaggccctggagggcctgggcgacctgaagctgctgttcgagtacctgaccctgttcggcatcgccgacaagatcagcttcgacctgagcctggccagaggcctggactactacaccggcgtgatctacgaggccgtgctgctgcagacccccacccaggccggcgaggagcccctgaacgtgggcagcgtggccgccggcggcagatacgacggcctggtgggcatgttcgaccccaagggccacaaggtgccctgcgtgggcctgagcatcggcgtggagagaatcttctacatcgtggagcagagaatgaagaccaagggcgagaaggtgagaaccaccgagacccaggtgttcgtggccaccccccagaagaacttcctgcaggagagactgaagctgatcgccgagctgtgggacagcggcatcaaggccgagatgctgtacaagaacaaccccaagctgctgacccagctgcactactgcgagagcaccggcatccccctggtggtgatcatcggcgagcaggagctgaaggagggcgtgatcaagatcagaagcgtggccagcagagaggaggtggccatcaagagagagaacttcgtggccgagatccagaagagactgagcgagagctag

SEQ ID NO: 9268 - DNA, 912 bp, Homo sapiens
atgagagcctggatcttcttcctgctgtgcctggccggcagagccctggccgccccccagcaggaggccctgcccgacgagaccgaggtggtggaggagaccgtggccgaggtgaccgaggtgagcgtgggcgccaaccccgtgcaggtggaggtgggcgagttcgacgacggcgccgaggagaccgaggaggaggtggtggccgagaacccctgccagaaccaccactgcaagcacggcaaggtgtgcgagctggacgagaacaacacccccatgtgcgtgtgccaggaccccaccagctgccccgcccccatcggcgagttcgagaaggtgtgcagcaacgacaacaagaccttcgacagcagctgccacttcttcgccaccaagtgcaccctggagggcaccaagaagggccacaagctgcacctggactacatcggcccctgcaagtacatccccccctgcctggacagcgagctgaccgagttccccctgagaatgagagactggctgaagaacgtgctggtgaccctgtacgagagagacgaggacaacaacctgctgaccgagaagcagaagctgagagtgaagaagatccacgagaacgagaagagactggaggccggcgaccaccccgtggagctgctggccagagacttcgagaagaactacaacatgtacatcttccccgtgcactggcagttcggccagctggaccagcaccccatcgacggctacctgagccacaccgagctggcccccctgagagcccccctgatccccatggagcactgcaccaccagattcttcgagacctgcgacctggacaacgacaagtacatcgccctggacgagtgggccggctgcttcggcatcaagcagaaggacatcgacaaggacctggtgatctag

SEQ ID NO: 9269 - DNA, 2634 bp, Homo sapiens
atggccagacccagaagagccagagagcccctgctggtggccctgctgcccctggcctggctggcccaggccggcctggccagagccgccggcagcgtgagactggccggcggcctgaccctgggcggcctgttccccgtgcacgccagaggcgccgccggcagagcctgcggccagctgaagaaggagcagggcgtgcacagactggaggccatgctgtacgccctggacagagtgaacgccgaccccgagctgctgcccggcgtgagactgggcgccagactgctggacacctgcagcagagacacctacgccctggagcaggccctgagcttcgtgcaggccctgatcagaggcagaggcgacggcgacgaggtgggcgtgagatgccccggcggcgtgccccccctgagacccgccccccccgagagagtggtggccgtggtgggcgccagcgccagcagcgtgagcatcatggtggccaacgtgctgagactgttcgccatcccccagatcagctacgccagcaccgcccccgagctgagcgacagcaccagatacgacttcttcagcagagtggtgccccccgacagctaccaggcccaggccatggtggacatcgtgagagccctgggctggaactacgtgagcaccctggccagcgagggcaactacggcgagagcggcgtggaggccttcgtgcagatcagcagagaggccggcggcgtgtgcatcgcccagagcatcaagatccccagagagcccaagcccggcgagttcagcaaggtgatcagaagactgatggagacccccaacgccagaggcatcatcatcttcgccaacgaggacgacatcagaagagtgctggaggccgccagacaggccaacctgaccggccacttcctgtgggtgggcagcgacagctggggcgccaagaccagccccatcctgagcctggaggacgtggccgtgggcgccatcaccatcctgcccaagagagccagcatcgacggcttcgaccagtacttcatgaccagaagcctggagaacaacagaagaaacatctggttcgccgagttctgggaggagaacttcaactgcaagctgaccagcagcggcacccagagcgacgacagcaccagaaagtgcaccggcgaggagagaatcggcagagacagcacctacgagcaggagggcaaggtgcagttcgtgatcgacgccgtgtacgccatcgcccacgccctgcacagcatgcaccaggccctgtgccccggccacaccggcctgtgccccgccatggagcccaccgacggcagaatgctgctgcagtacatcagagccgtgagattcaacggcagcgccggcacccccgtgatgttcaacgagaacggcgacgcccccggcagatacgacatcttccagtaccaggccaccaacggcagcgccagcagcggcggctaccaggccgtgggccagtgggccgagaccctgagactggacgtggaggccctgcagtggagcggcgacccccacgaggtgcccagcagcctgtgcagcctgccctgcggccccggcgagagaaagaagatggtgaagggcgtgccctgctgctggcactgcgaggcctgcgacggctacagattccaggtggacgagttcacctgcgaggcctgccccggcgacatgagacccacccccaaccacaccggctgcagacccacccccgtggtgagactgagctggagcagcccctgggccgccccccccctgctgctggccgtgctgggcatcgtggccaccaccaccgtggtggccaccttcgtgagatacaacaacacccccatcgtgagagccagcggcagagagctgagctacgtgctgctgaccggcatcttcctgatctacgccatcaccttcctgatggtggccgagcccggcgccgccgtgtgcgccgccagaagactgttcctgggcctgggcaccaccctgagctacagcgccctgctgaccaagaccaacagaatctacagaatcttcgagcagggcaagagaagcgtgacccccccccccttcatcagccccaccagccagctggtgatcaccttcagcctgaccagcctgcaggtggtgggcatgatcgcctggctgggcgccagacccccccacagcgtgatcgactacgaggagcagagaaccgtggaccccgagcaggccagaggcgtgctgaagtgcgacatgagcgacctgagcctgatcggctgcctgggctacagcctgctgctgatggtgacctgcaccgtgtacgccatcaaggccagaggcgtgcccgagaccttcaacgaggccaagcccatcggcttcaccatgtacaccacctgcatcatctggctggccttcgtgcccatcttcttcggcaccgcccagagcgccgagaagatctacatccagaccaccaccctgaccgtgagcctgagcctgagcgccagcgtgagcctgggcatgctgtacgtgcccaagacctacgtgatcctgttccaccccgagcagaacgtgcagaagagaaagagaagcctgaaggccaccagcaccgtggccgccccccccaagggcgaggacgccgaggcccacaagtag

SEQ ID NO: 9270 - DNA, 798 bp, Homo sapiens
atggccgccgccgtgcccaagagaatgagaggccccgcccaggccaagctgctgcccggcagcgccatccaggccctggtgggcctggccagacccctggtgctggccctgctgctggtgagcgccgccctgagcagcgtggtgagcagaaccgacagccccagccccaccgtgctgaacagccacatcagcacccccaacgtgaacgccctgacccacgagaaccagaccaagcccagcatcagccagatcagcaccaccctgccccccaccaccagcaccaagaagagcggcggcgccagcgtggtgccccaccccagccccacccccctgagccaggaggaggccgacaacaacgaggaccccagcatcgaggaggaggacctgctgatgctgaacagcagccccagcaccgccaaggacaccctggacaacggcgactacggcgagcccgactacgactggaccaccggccccagagacgacgacgagagcgacgacaccctggaggagaacagaggctacatggagatcgagcagagcgtgaagagcttcaagatgcccagcagcaacatcgaggaggaggacagccacttcttcttccacctgatcatcttcgccttctgcatcgccgtggtgtacatcacctaccacaacaagagaaagatcttcctgctggtgcagagcagaaagtggagagacggcctgtgcagcaagaccgtggagtaccacagactggaccagaacgtgaacgaggccatgcccagcctgaagatcaccaacgactacatcttctag

SEQ ID NO: 9271 - DNA, 2349 bp, Homo sapiens
atggcccccagcgcctgggccatctgctggctgctgggcggcctgctgctgcacggcggcagcagcggccccagccccggccccagcgtgcccagactgagactgagctacagagacctgctgagcgccaacagaagcgccatcttcctgggcccccagggcagcctgaacctgcaggccatgtacctggacgagtacagagacagactgttcctgggcggcctggacgccctgtacagcctgagactggaccaggcctggcccgaccccagagaggtgctgtggcccccccagcccggccagagagaggagtgcgtgagaaagggcagagaccccctgaccgagtgcgccaacttcgtgagagtgctgcagccccacaacagaacccacctgctggcctgcggcaccggcgccttccagcccacctgcgccctgatcaccgtgggccacagaggcgagcacgtgctgcacctggagcccggcagcgtggagagcggcagaggcagatgcccccacgagcccagcagacccttcgccagcaccttcatcgacggcgagctgtacaccggcctgaccgccgacttcctgggcagagaggccatgatcttcagaagcggcggccccagacccgccctgagaagcgacagcgaccagagcctgctgcacgaccccagattcgtgatggccgccagaatccccgagaacagcgaccaggacaacgacaaggtgtacttcttcttcagcgagaccgtgcccagccccgacggcggcagcaaccacgtgaccgtgagcagagtgggcagagtgtgcgtgaacgacgccggcggccagagagtgctggtgaacaagtggagcaccttcctgaaggccagactggtgtgcagcgtgcccggccccggcggcgccgagacccacttcgaccagctggaggacgtgttcctgctgtggcccaaggccggcaagagcctggaggtgtacgccctgttcagcaccgtgagcgccgtgttccagggcttcgccgtgtgcgtgtaccacatggccgacatctgggaggtgttcaacggccccttcgcccacagagacggcccccagcaccagtggggcccctacggcggcaaggtgcccttccccagacccggcgtgtgccccagcaagatgaccgcccagcccggcagacccttcggcagcaccaaggactaccccgacgaggtgctgcagttcgccagagcccaccccctgatgttctggcccgtgagacccagacacggcagacccgtgctggtgaagacccacctggcccagcagctgcaccagatcgtggtggacagagtggaggccgaggacggcacctacgacgtgatcttcctgggcaccgacagcggcagcgtgctgaaggtgatcgccctgcaggccggcggcagcgccgagcccgaggaggtggtgctggaggagctgcaggtgttcaaggtgcccacccccatcaccgagatggagatcagcgtgaagagacagatgctgtacgtgggcagcagactgggcgtggcccagctgagactgcaccagtgcgagacctacggcaccgcctgcgccgagtgctgcctggccagagacccctactgcgcctgggacggcgccagctgcacccactacagacccagcctgggcaagagaagattcagaagacaggacatcagacacggcaaccccgccctgcagtgcctgggccagagccaggaggaggaggccgtgggcctggtggccgccaccatggtgtacggcaccgagcacaacagcaccttcctggagtgcctgcccaagagcccccaggccgccgtgagatggctgctgcagagacccggcgacgagggccccgaccaggtgaagaccgacgagagagtgctgcacaccgagagaggcctgctgttcagaagactgagcagattcgacgccggcacctacacctgcaccaccctggagcacggcttcagccagaccgtggtgagactggccctggtggtgatcgtggccagccagctggacaacctgttcccccccgagcccaagcccgaggagccccccgccagaggcggcctggccagcaccccccccaaggcctggtacaaggacatcctgcagctgatcggcttcgccaacctgcccagagtggacgagtactgcgagagagtgtggtgcagaggcaccaccgagtgcagcggctgcttcagaagcagaagcagaggcaagcaggccagaggcaagagctgggccggcctggagctgggcaagaagatgaagagcagagtgcacgccgagcacaacagaacccccagagaggtggaggccacctag

SEQ ID NO: 9272 - DNA, 1725 bp, Homo sapiens
atggtggaggacggcgccgaggagctggaggacctggtgcacttcagcgtgagcgagctgcccagcagaggctacggcgtgatggaggagatcagaagacagggcaagctgtgcgacgtgaccctgaagatcggcgaccacaagttcagcgcccacagaatcgtgctggccgccagcatcccctacttccacgccatgttcaccaacgacatgatggagtgcaagcaggacgagatcgtgatgcagggcatggaccccagcgccctggaggccctgatcaacttcgcctacaacggcaacctggccatcgaccagcagaacgtgcagagcctgctgatgggcgccagcttcctgcagctgcagagcatcaaggacgcctgctgcaccttcctgagagagagactgcaccccaagaactgcctgggcgtgagacagttcgccgagaccatgatgtgcgccgtgctgtacgacgccgccaacagcttcatccaccagcacttcgtggaggtgagcatgagcgaggagttcctggccctgcccctggaggacgtgctggagctggtgagcagagacgagctgaacgtgaagagcgaggagcaggtgttcgaggccgccctggcctgggtgagatacgacagagagcagagaggcccctacctgcccgagctgctgagcaacatcagactgcccctgtgcagaccccagttcctgagcgacagagtgcagcaggacgacctggtgagatgctgccacaagtgcagagacctggtggacgaggccaaggactaccacctgatgcccgagagaagaccccacctgcccgccttcagaaccagacccagatgctgcaccagcatcgccggcctgatctacgccgtgggcggcctgaacagcgccggcgacagcctgaacgtggtggaggtgttcgaccccatcgccaactgctgggagagatgcagacccatgaccaccgccagaagcagagtgggcgtggccgtggtgaacggcctgctgtacgccatcggcggctacgacggccagctgagactgagcaccgtggaggcctacaaccccgagaccgacacctggaccagagtgggcagcatgaacagcaagagaagcgccatgggcaccgtggtgctggacggccagatctacgtgtgcggcggctacgacggcaacagcagcctgagcagcgtggagacctacagccccgagaccgacaagtggaccgtggtgaccagcatgagcagcaacagaagcgccgccggcgtgaccgtgttcgagggcagaatctacgtgagcggcggccacgacggcctgcagatcttcagcagcgtggagcactacaaccaccacaccgccacctggcaccccgccgccggcatgctgaacaagagatgcagacacggcgccgccagcctgggcagcaagatgttcgtgtgcggcggctacgacggcagcggcttcctgagcatcgccgagatgtacagcagcgtggccgaccagtggtgcctgatcgtgcccatgcacaccagaagaagcagagtgagcctggtggccagctgcggcagactgtacgccgtgggcggctacgacggccagagcaacctgagcagcgtggagatgtacgaccccgagaccgactgctggaccttcatggcccccatggcctgccacgagggcggcgtgggcgtgggctgcatccccctgctgaccatctag

SEQ ID NO: 9273 - DNA, 486 bp, Homo sapiens
atggccaaggaggagccccagagcatcagcagagacctgcaggagctgcagaagaagctgagcctgctgatcgacagcttccagaacaacagcaaggtggtggccttcatgaagagccccgtgggccagtacctggacagccaccccttcctggccttcaccctgctggtgttcatcgtgatgagcgccgtgcccgtgggcttcttcctgctgatcgtggtgctgaccaccctggccgccctgctgggcgtgatcatcctggagggcctggtgatcagcgtgggcggcttcagcctgctgtgcatcctgtgcggcctgggcttcgtgagcctggccatgagcggcatgatgatcgccagctacgtggtggtgagcagcctgatcagctgctggttcagccccagacccctgacccagcagaacaccagctgcgacttcctgcccgccatgaagagcgccgagttcgagggcctgtaccaggagtag

SEQ ID NO: 9274 - DNA, 4503 bp, Homo sapiens
atgaccagaatcctgaccgccttcaaggtggtgagaaccctgaagaccggcttcggcttcaccaacgtgaccgcccaccagaagtggaagttcagcagacccggcatcagactgctgagcgtgaaggcccagaccgcccacatcgtgctggaggacggcaccaagatgaagggctacagcttcggccaccccagcagcgtggccggcgaggtggtgttcaacaccggcctgggcggctaccccgaggccatcaccgaccccgcctacaagggccagatcctgaccatggccaaccccatcatcggcaacggcggcgcccccgacaccaccgccctggacgagctgggcctgagcaagtacctggagagcaacggcatcaaggtgagcggcctgctggtgctggactacagcaaggactacaaccactggctggccaccaagagcctgggccagtggctgcaggaggagaaggtgcccgccatctacggcgtggacaccagaatgctgaccaagatcatcagagacaagggcaccatgctgggcaagatcgagttcgagggccagcccgtggacttcgtggaccccaacaagcagaacctgatcgccgaggtgagcaccaaggacgtgaaggtgtacggcaagggcaaccccaccaaggtggtggccgtggactgcggcatcaagaacaacgtgatcagactgctggtgaagagaggcgccgaggtgcacctggtgccctggaaccacgacttcaccaagatggagtacgacggcatcctgatcgccggcggccccggcaaccccgccctggccgagcccctgatccagaacgtgagaaagatcctggagagcgacagaaaggagcccctgttcggcatcagcaccggcaacctgatcaccggcctggccgccggcgccaagacctacaagatgagcatggccaacagaggccagaaccagcccgtgctgaacatcaccaacaagcaggccttcatcaccgcccagaaccacggctacgccctggacaacaccctgcccgccggctggaagcccctgttcgtgaacgtgaacgaccagaccaacgagggcatcatgcacgagagcaagcccttcttcgccgtgcagttccaccccgaggtgacccccggccccatcgacaccgagtacctgttcgacagcttcttcagcctgatcaagaagggcaaggccaccaccatcaccagcgtgctgcccaagcccgccctggtggccagcagagtggaggtgagcaaggtgctgatcctgggcagcggcggcctgagcatcggccaggccggcgagttcgactacagcggcagccaggccgtgaaggccatgaaggaggagaacgtgaagaccgtgctgatgaaccccaacatcgccagcgtgcagaccaacgaggtgggcctgaagcaggccgacaccgtgtacttcctgcccatcaccccccagttcgtgaccgaggtgatcaaggccgagcagcccgacggcctgatcctgggcatgggcggccagaccgccctgaactgcggcgtggagctgttcaagagaggcgtgctgaaggagtacggcgtgaaggtgctgggcaccagcgtggagagcatcatggccaccgaggacagacagctgttcagcgacaagctgaacgagatcaacgagaagatcgcccccagcttcgccgtggagagcatcgaggacgccctgaaggccgccgacaccatcggctaccccgtgatgatcagaagcgcctacgccctgggcggcctgggcagcggcatctgccccaacagagagaccctgatggacctgagcaccaaggccttcgccatgaccaaccagatcctggtggagaagagcgtgaccggctggaaggagatcgagtacgaggtggtgagagacgccgacgacaactgcgtgaccgtgtgcaacatggagaacgtggacgccatgggcgtgcacaccggcgacagcgtggtggtggcccccgcccagaccctgagcaacgccgagttccagatgctgagaagaaccagcatcaacgtggtgagacacctgggcatcgtgggcgagtgcaacatccagttcgccctgcaccccaccagcatggagtactgcatcatcgaggtgaacgccagactgagcagaagcagcgccctggccagcaaggccaccggctaccccctggccttcatcgccgccaagatcgccctgggcatccccctgcccgagatcaagaacgtggtgagcggcaagaccagcgcctgcttcgagcccagcctggactacatggtgaccaagatccccagatgggacctggacagattccacggcaccagcagcagaatcggcagcagcatgaagagcgtgggcgaggtgatggccatcggcagaaccttcgaggagagcttccagaaggccctgagaatgtgccaccccagcatcgagggcttcacccccagactgcccatgaacaaggagtggcccagcaacctggacctgagaaaggagctgagcgagcccagcagcaccagaatctacgccatcgccaaggccatcgacgacaacatgagcctggacgagatcgagaagctgacctacatcgacaagtggttcctgtacaagatgagagacatcctgaacatggagaagaccctgaagggcctgaacagcgagagcatgaccgaggagaccctgaagagagccaaggagatcggcttcagcgacaagcagatcagcaagtgcctgggcctgaccgaggcccagaccagagagctgagactgaagaagaacatccacccctgggtgaagcagatcgacaccctggccgccgagtaccccagcgtgaccaactacctgtacgtgacctacaacggccaggagcacgacgtgaacttcgacgaccacggcatgatggtgctgggctgcggcccctaccacatcggcagcagcgtggagttcgactggtgcgccgtgagcagcatcagaaccctgagacagctgggcaagaagaccgtggtggtgaactgcaaccccgagaccgtgagcaccgacttcgacgagtgcgacaagctgtacttcgaggagctgagcctggagagaatcctggacatctaccaccaggaggcctgcggcggctgcatcatcagcgtgggcggccagatccccaacaacctggccgtgcccctgtacaagaacggcgtgaagatcatgggcaccagccccctgcagatcgacagagccgaggacagaagcatcttcagcgccgtgctggacgagctgaaggtggcccaggccccctggaaggccgtgaacaccctgaacgaggccctggagttcgccaagagcgtggactacccctgcctgctgagacccagctacgtgctgagcggcagcgccatgaacgtggtgttcagcgaggacgagatgaagaagttcctggaggaggccaccagagtgagccaggagcaccccgtggtgctgaccaagttcgtggagggcgccagagaggtggagatggacgccgtgggcaaggacggcagagtgatcagccacgccatcagcgagcacgtggaggacgccggcgtgcacagcggcgacgccaccctgatgctgcccacccagaccatcagccagggcgccatcgagaaggtgaaggacgccaccagaaagatcgccaaggccttcgccatcagcggccccttcaacgtgcagttcctggtgaagggcaacgacgtgctggtgatcgagtgcaacctgagagccagcagaagcttccccttcgtgagcaagaccctgggcgtggacttcatcgacgtggccaccaaggtgatgatcggcgagaacgtggacgagaagcacctgcccaccctggaccaccccatcatccccgccgactacgtggccatcaaggcccccatgttcagctggcccagactgagagacgccgaccccatcctgagatgcgagatggccagcaccggcgaggtggcctgcttcggcgagggcatccacaccgccttcctgaaggccatgctgagcaccggcttcaagatcccccagaagggcatcctgatcggcatccagcagagcttcagacccagattcctgggcgtggccgagcagctgcacaacgagggcttcaagctgttcgccaccgaggccaccagcgactggctgaacgccaacaacgtgcccgccacccccgtggcctggcccagccaggagggccagaaccccagcctgagcagcatcagaaagctgatcagagacggcagcatcgacctggtgatcaacctgcccaacaacaacaccaagttcgtgcacgacaactacgtgatcagaagaaccgccgtggacagcggcatccccctgctgaccaacttccaggtgaccaagctgttcgccgaggccgtgcagaagagcagaaaggtggacagcaagagcctgttccactacagacagtacagcgccggcaaggccgcctag

SEQ ID NO: 9275 - DNA, 846 bp, Homo sapiens
atggccgtgaacgtgtacagcaccagcgtgaccagcgagaacctgagcagacacgacatgctggcctgggtgaacgacagcctgcacctgaactacaccaagatcgagcagctgtgcagcggcgccgcctactgccagttcatggacatgctgttccccggctgcgtgcacctgagaaaggtgaagttccaggccaagctggagcacgagtacatccacaacttcaaggtgctgcaggccgccttcaagaagatgggcgtggacaagatcatccccgtggagaagctggtgaagggcaagttccaggacaacttcgagttcatccagtggttcaagaagttcttcgacgccaactacgacggcaaggactacaaccccctgctggccagacagggccaggacgtggcccccccccccaaccccggcgaccagatcttcaacaagagcaagaagctgatcggcaccgccgtgccccagagaaccagccccaccggccccaagaacatgcagaccagcggcagactgagcaacgtggcccccccctgcatcctgagaaagaacccccccagcgccagaaacggcggccacgagaccgacgcccagatcctggagctgaaccagcagctggtggacctgaagctgaccgtggacggcctggagaaggagagagacttctacttcagcaagctgagagacatcgagctgatctgccaggagcacgagagcgagaacagccccgtgatcagcggcatcatcggcatcctgtacgccaccgaggagggcttcgccccccccgaggacgacgagatcgaggagcaccagcaggaggaccaggacgagtactag

SEQ ID NO: 9276 - DNA, 531 bp, Homo sapiens
atggccctgtggagagcctaccagagagccctggccgcccacccctggaaggtgcaggtgctgaccgccggcagcctgatgggcctgggcgacatcatcagccagcagctggtggagagaagaggcctgcaggagcaccagagaggcagaaccctgaccatggtgagcctgggctgcggcttcgtgggccccgtggtgggcggctggtacaaggtgctggacagattcatccccggcaccaccaaggtggacgccctgaagaagatgctgctggaccagggcggcttcgccccctgcttcctgggctgcttcctgcccctggtgggcgccctgaacggcctgagcgcccaggacaactgggccaagctgcagagagactaccccgacgccctgatcaccaactactacctgtggcccgccgtgcagctggccaacttctacctggtgcccctgcactacagactggccgtggtgcagtgcgtggccgtgatctggaacagctacctgagctggaaggcccacagactgtag

SEQ ID NO: 9277 - DNA, 1143 bp, Homo sapiens
atggccagcctgcccgtgctgcagaaggagagcgtgttccagagcggcgcccacgcctacagaatccccgccctgctgtacctgcccggccagcagagcctgctggccttcgccgagcagagagccagcaagaaggacgagcacgccgagctgatcgtgctgagaagaggcgactacgacgcccccacccaccaggtgcagtggcaggcccaggaggtggtggcccaggccagactggacggccacagaagcatgaacccctgccccctgtacgacgcccagaccggcaccctgttcctgttcttcatcgccatccccggccaggtgaccgagcagcagcagctgcagaccagagccaacgtgaccagactgtgccaggtgaccagcaccgaccacggcagaacctggagcagccccagagacctgaccgacgccgccatcggccccgcctacagagagtggagcaccttcgccgtgggccccggccactgcctgcagctgcacgacagagccagaagcctggtggtgcccgcctacgcctacagaaagctgcaccccatccagagacccatccccagcgccttctgcttcctgagccacgaccacggcagaacctgggccagaggccacttcgtggcccaggacaccctggagtgccaggtggccgaggtggagaccggcgagcagagagtggtgaccctgaacgccagaagccacctgagagccagagtgcaggcccagagcaccaacgacggcctggacttccaggagagccagctggtgaagaagctggtggagccccccccccagggctgccagggcagcgtgatcagcttccccagccccagaagcggccccggcagccccgcccagtggctgctgtacacccaccccacccacagctggcagagagccgacctgggcgcctacctgaaccccagaccccccgcccccgaggcctggagcgagcccgtgctgctggccaagggcagctgcgcctacagcgacctgcagagcatgggcaccggccccgacggcagccccctgttcggctgcctgtacgaggccaacgactacgaggagatcgtgttcctgatgttcaccctgaagcaggccttccccgccgagtacctgccccagtag

SEQ ID NO: 9278 - DNA, 3165 bp, Homo sapiens
atggccgccgtgaaggagcccctggagttccacgccaagagaccctggagacccgaggaggccgtggaggaccccgacgaggaggacgaggacaacaccagcgaggccgagaacggcttcagcctggaggaggtgctgagactgggcggcaccaagcaggactacctgatgctggccaccctggacgagaacgaggaggtgatcgacggcggcaagaagggcgccatcgacgacctgcagcagggcgagctggaggccttcatccagaacctgaacctggccaagtacaccaaggccagcctggtggaggaggacgagcccgccgagaaggagaacagcagcaagaaggaggtgaagatccccaagatcaacaacaagaacaccgccgagagccagagaaccagcgtgaacaaggtgaagaacaagaacagacccgagccccacagcgacgagaacggcagcaccacccccaaggtgaagaaggacaagcagaacatcttcgagttcttcgagagacagaccctgctgctgagacccggcggcaagtggtacgacctggagtacagcaacgagtacagcctgaagccccagccccaggacgtggtgagcaagtacaagaccctggcccagaagctgtaccagcacgagatcaacctgttcaagagcaagaccaacagccagaagggcgccagcagcacctggatgaaggccatcgtgagcagcggcaccctgggcgacagaatggccgccatgatcctgctgatccaggacgacgccgtgcacaccctgcagttcgtggagaccctggtgaacctggtgaagaagaagggcagcaagcagcagtgcctgatggccctggacaccttcaaggagctgctgatcaccgacctgctgcccgacaacagaaagctgagaatcttcagccagagacccttcgacaagctggagcagctgagcagcggcaacaaggacagcagagacagaagactgatcctgtggtacttcgagcaccagctgaagcacctggtggccgagttcgtgcaggtgctggagaccctgagccacgacaccctggtgaccaccaagaccagagccctgaccgtggcccacgagctgctgtgcaacaagcccgaggaggagaaggccctgctggtgcaggtggtgaacaagctgggcgacccccagaacagaatcgccaccaaggccagccacctgctggagaccctgctgtgcaagcaccccaacatgaagggcgtggtgagcggcgaggtggagagactgctgttcagaagcaacatcagcagcaaggcccagtactacgccatctgcttcctgaaccagatggccctgagccacgaggagagcgagctggccaacaagctgatcaccgtgtacttctgcttcttcagaacctgcgtgaagaagaaggacgtggagagcaagatgctgagcgccctgctgaccggcgtgaacagagcctacccctacagccagaccggcgacgacaaggtgagagagcagatcgacaccctgttcaaggtgctgcacatcgtgaacttcaacaccagcgtgcaggccctgatgctgctgttccaggtgatgaacagccagcagaccatcagcgacagatactacaccgccctgtacagaaagatgctggaccccggcctgatgacctgcagcaagcaggccatgttcctgaacctggtgtacaagagcctgaaggccgacatcgtgctgagaagagtgaaggccttcgtgaagagactgctgcaggtgacctgccagcagatgccccccttcatctgcggcgccctgtacctggtgagcgagatcctgaaggccaagcccggcctgagaagccagctggacgaccaccccgagagcgacgacgaggagaacttcatcgacgccaacgacgacgaggacatggagaagttcaccgacgccgacaaggagaccgagatcgtgaagaagctggagaccgaggagaccgtgcccgagaccgacgtggagaccaagaagcccgaggtggccagctgggtgcacttcgacaacctgaagggcggcaagcagctgaacaagtacgaccccttcagcagaaaccccctgttctgcggcgccgagaacaccagcctgtgggagctgaagaagctgagcgtgcacttccaccccagcgtggccctgttcgccaagaccatcctgcagggcaactacatccagtacagcggcgaccccctgcaggacttcaccctgatgagattcctggacagattcgtgtacagaaaccccaagccccacaagggcaaggagaacaccgacagcgtggtgatgcagcccaagagaaagcacttcatcaaggacatcagacacctgcccgtgaacagcaaggagttcctggccaaggaggagagccagatccccgtggacgaggtgttcttccacagatactacaagaaggtggccgtgaaggagaagcagaagagagacgccgacgaggagagcatcgaggacgtggacgacgaggagttcgaggagctgatcgacaccttcgaggacgacaactgcttcagcagcggcaaggacgacatggacttcgccggcaacgtgaagaagagaaccaagggcgccaaggacaacaccctggacgaggacagcgagggcagcgacgacgagctgggcaacctggacgacgacgaggtgagcctgggcagcatggacgacgaggagttcgccgaggtggacgaggacggcggcaccttcatggacgtgctggacgacgagagcgagagcgtgcccgagctggaggtgcacagcaaggtgagcaccaagaagagcaagagaaagggcaccgacgacttcgacttcgccggcagcttccagggccccagaaagaagaagagaaacctgaacgacagcagcctgttcgtgagcgccgaggagttcggccacctgctggacgagaacatgggcagcaagttcgacaacatcggcatgaacgccatggccaacaaggacaacgccagcctgaagcagctgagatgggaggccgagagagacgactggctgcacaacagagacgccaagagcatcatcaagaagaagaagcacttcaagaagaagagaatcaagaccacccagaagaccaagaagcagagaaagtag

SEQ ID NO: 9279 - DNA, 1107 bp, Homo sapiens
atggagcccggccagcccagagagccccaggagcccagagagcccggccccggcgccgagaccgccgccgcccccgtgtgggaggaggccaagatcttctacgacaacctggcccccaagaagaagcccaagagccccaagccccagaacgccgtgaccatcgccgtgagcagcagagccctgttcagaatggacgaggagcagcagatctacaccgagcagggcgtggaggagtacgtgagataccagctggagcacgagaacgagcccttcagccccggccccgccttccccttcgtgaaggccctggaggccgtgaacagaagactgagagagctgtaccccgacagcgaggacgtgttcgacatcgtgctgatgaccaacaaccacgcccaggtgggcgtgagactgatcaacagcatcaaccactacgacctgttcatcgagagattctgcatgaccggcggcaacagccccatctgctacctgaaggcctaccacaccaacctgtacctgagcgccgacgccgagaaggtgagagaggccatcgacgagggcatcgccgccgccaccatcttcagccccagcagagacgtggtggtgagccagagccagctgagagtggccttcgacggcgacgccgtgctgttcagcgacgagagcgagagaatcgtgaaggcccacggcctggacagattcttcgagcacgagaaggcccacgagaacaagcccctggcccagggccccctgaagggcttcctggaggccctgggcagactgcagaagaagttctacagcaagggcctgagactggagtgccccatcagaacctacctggtgaccgccagaagcgccgccagcagcggcgccagagccctgaagaccctgagaagctggggcctggagaccgacgaggccctgttcctggccggcgcccccaagggccccctgctggagaagatcagaccccacatcttcttcgacgaccagatgttccacgtggccggcgcccaggagatgggcaccgtggccgcccacgtgccctacggcgtggcccagacccccagaagaaccgcccccgccaagcaggcccccagcgcccagtag

SEQ ID NO: 9280 - DNA, 1080 bp, Homo sapiens
atgctgagcgccgccagcagagtggtgagcagagccgccgtgcactgcgccctgagaagccccccccccgaggccagagccctggccatgagcagaccccccccccccagagtggccagcgtgctgggcaccatggagatgggcagaagaatggacgcccccgccagcgccgccgccgtgagagccttcctggagagaggccacaccgagctggacaccgccttcatgtacagcgacggccagagcgagaccatcctgggcggcctgggcctgggcctgggcggcggcgactgcagagtgaagatcgccaccaaggccaacccctgggacggcaagagcctgaagcccgacagcgtgagaagccagctggagaccagcctgaagagactgcagtgcccccaggtggacctgttctacctgcacgcccccgaccacggcacccccgtggaggagaccctgcacgcctgccagagactgcaccaggagggcaagttcgtggagctgggcctgagcaactacgccagctgggaggtggccgagatctgcaccctgtgcaagagcaacggctggatcctgcccaccgtgtaccagggcatgtacaacgccaccaccagacaggtggagaccgagctgttcccctgcctgagacacttcggcctgagattctacgcctacaaccccctggccggcggcctgctgaccggcaagtacaagtacgaggacaaggacggcaagcagcccgtgggcagattcttcggcaacagctgggccgagacctacagaaacagattctggaaggagcaccacttcgaggccatcgccctggtggagaaggccctgcaggccgcctacggcgccagcgcccccagcgtgaccagcgccgccctgagatggatgtaccaccacagccagctgcagggcgcccacggcgacgccgtgatcctgggcatgagcagcctggagcagctggagcagaacctggccgccaccgaggagggccccctggagcccgccgtggtggacgccttcaaccaggcctggcacctggtggcccacgagtgccccaactacttcagatag

SEQ ID NO: 9281 - DNA, 561 bp, Homo sapiens
atggacgccgacagcgacgtggccctggacatcctgatcaccaacgtggtgtgcgtgttcagaaccagatgccacctgaacctgagaaagatcgccctggagggcgccaacgtgatctacaagagagacgtgggcaaggtgctgatgaagctgagaaagcccagaatcaccgccaccatctggagcagcggcaagatcatctgcaccggcgccaccagcgaggaggaggccaagttcggcgccagaagactggccagaagcctgcagaagctgggcttccaggtgatcttcaccgacttcaaggtggtgaacgtgctggccgtgtgcaacatgcccttcgagatcagactgcccgagttcaccaagaacaacagaccccacgccagctacgagcccgagctgcaccccgccgtgtgctacagaatcaagagcctgagagccaccctgcagatcttcagcaccggcagcatcaccgtgaccggccccaacgtgaaggccgtggccaccgccgtggagcagatctaccccttcgtgttcgagagcagaaaggagatcctgtag

SEQ ID NO: 9282 - DNA, 537 bp, Homo sapiens
atggccgcccccctgggcggcatgttcagcggccagccccccggccccccccaggccccccccggcctgcccggccaggccagcctgctgcaggccgcccccggcgcccccagacccagcagcagcaccctggtggacgagctggagagcagcttcgaggcctgcttcgccagcctggtgagccaggactacgtgaacggcaccgaccaggaggagatcagaaccggcgtggaccagtgcatccagaagttcctggacatcgccagacagaccgagtgcttcttcctgcagaagagactgcagctgagcgtgcagaagcccgagcaggtgatcaaggaggacgtgagcgagctgagaaacgagctgcagagaaaggacgccctggtgcagaagcacctgaccaagctgagacactggcagcaggtgctggaggacatcaacgtgcagcacaagaagcccgccgacatcccccagggcagcctggcctacctggagcaggccagcgccaacatccccgcccccctgaagcccacctag

SEQ ID NO: 9283 - DNA, 738 bp, Homo sapiens
atggagaagaccgagctgatccagaaggccaagctggccgagcaggccgagagatacgacgacatggccacctgcatgaaggccgtgaccgagcagggcgccgagctgagcaacgaggagagaaacctgctgagcgtggcctacaagaacgtggtgggcggcagaagaagcgcctggagagtgatcagcagcatcgagcagaagaccgacaccagcgacaagaagctgcagctgatcaaggactacagagagaaggtggagagcgagctgagaagcatctgcaccaccgtgctggagctgctggacaagtacctgatcgccaacgccaccaaccccgagagcaaggtgttctacctgaagatgaagggcgactacttcagatacctggccgaggtggcctgcggcgacgacagaaagcagaccatcgacaacagccagggcgcctaccaggaggccttcgacatcagcaagaaggagatgcagcccacccaccccatcagactgggcctggccctgaacttcagcgtgttctactacgagatcctgaacaaccccgagctggcctgcaccctggccaagaccgccttcgacgaggccatcgccgagctggacaccctgaacgaggacagctacaaggacagcaccctgatcatgcagctgctgagagacaacctgaccctgtggaccagcgacagcgccggcgaggagtgcgacgccgccgagggcgccgagaactag

SEQ ID NO: 9284 - DNA, 534 bp, Homo sapiens
atgcccggcctgaccgcctacttcggcctgctggagatctgcggcgtgaagggcggcgagaccgtgatggtgaacgccgccgccggcgccgtgggcagcgtggtgggccagatcgccaagctgaagggctgcaaggtggtgggcgccgtgggcagcgacgagaaggtggcctacctgcagaagctgggcttcgacgtggtgttcaactacaagaccgtggagagcctggaggagaccctgaagaaggccagccccgacggctacgactgctacttcgacaacgtgggcggcgagttcagcaacaccgtgatcggccagatgaagaagttcggcagaatcgccatctgcggcgccatcagcacctacaacagaaccggccccctgccccccggccccccccccgagatcgtgatctaccaggagctgagaatggaggccttcgtggtgtacagatggcagggcgacgccagacagaaggccctgaaggacctgctgaagtgggtgctggagctgccctacttcgtgatcgactag

SEQ ID NO: 9285 - DNA, 3660 bp, Homo sapiens
atgttcggcgccggcgacgaggacgacaccgacttcctgagccccagcggcggcgccagactggccagcctgttcggcctggaccaggccgccgccggccacggcaacgagttcttccagtacaccgcccccaagcagcccaagaagggccagggcaccgccgccaccggcaaccaggccacccccaagaccgcccccgccaccatgagcacccccaccatcctggtggccaccgccgtgcacgcctacagatacaccaacggccagtacgtgaagcagggcaagttcggcgccgccgtgctgggcaaccacaccgccagagagtacagaatcctgctgtacatcagccagcagcagcccgtgaccgtggccagaatccacgtgaacttcgagctgatggtgagacccaacaactacagcaccttctacgacgaccagagacagaactggagcatcatgttcgagagcgagaaggccgccgtggagttcaacaagcaggtgtgcatcgccaagtgcaacagcaccagcagcctggacgccgtgctgagccaggacctgatcgtggccgacggccccgccgtggaggtgggcgacagcctggaggtggcctacaccggctggctgttccagaaccacgtgctgggccaggtgttcgacagcaccgccaacaaggacaagctgctgagactgaagctgggcagcggcaaggtgatcaagggctgggaggacggcatgctgggcatgaagaagggcggcaagagactgctgatcgtgccccccgcctgcgccgtgggcagcgagggcgtgatcggctggacccaggccaccgacagcatcctggtgttcgaggtggaggtgagaagagtgaagttcgccagagacagcggcagcgacggccacagcgtgagcagcagagacagcgccgcccccagccccatccccggcgccgacaacctgagcgccgaccccgtggtgagcccccccaccagcatccccttcaagagcggcgagcccgccctgagaaccaagagcaacagcctgagcgagcagctggccatcaacaccagccccgacgccgtgaaggccaagctgatcagcagaatggccaagatgggccagcccatgctgcccatcctgcccccccagctggacagcaacgacagcgagatcgaggacgtgaacaccctgcagggcggcggccagcccgtggtgacccccagcgtgcagcccagcctgcaccccgcccaccccgccctgccccagatgaccagccaggccccccagcccagcgtgaccggcctgcaggcccccagcgccgccctgatgcaggtgagcagcctggacagccacagcgccgtgagcggcaacgcccagagcttccagccctacgccggcatgcaggcctacgcctacccccaggccagcgccgtgaccagccagctgcagcccgtgagacccctgtaccccgcccccctgagccagcccccccacttccagggcagcggcgacatggccagcttcctgatgaccgaggccagacagcacaacaccgagatcagaatggccgtgagcaaggtggccgacaagatggaccacctgatgaccaaggtggaggagctgcagaagcacagcgccggcaacagcatgctgatccccagcatgagcgtgaccatggagaccagcatgatcatgagcaacatccagagaatcatccaggagaacgagagactgaagcaggagatcctggagaagagcaacagaatcgaggagcagaacgacaagatcagcgagctgatcgagagaaaccagagatacgtggagcagagcaacctgatgatggagaagagaaacaacagcctgcagaccgccaccgagaacacccaggccagagtgctgcacgccgagcaggagaaggccaaggtgaccgaggagctggccgccgccaccgcccaggtgagccacctgcagctgaagatgaccgcccaccagaagaaggagaccgagctgcagatgcagctgaccgagagcctgaaggagaccgacctgctgagaggccagctgaccaaggtgcaggccaagctgagcgagctgcaggagaccagcgagcaggcccagagcaagttcaagagcgagaagcagaacagaaagcagctggagctgaaggtgaccagcctggaggaggagctgaccgacctgagagtggagaaggagagcctggagaagaacctgagcgagagaaagaagaagagcgcccaggagagaagccaggccgaggaggagatcgacgagatcagaaagagctaccaggaggagctggacaagctgagacagctgctgaagaagaccagagtgagcaccgaccaggccgccgccgagcagctgagcctggtgcaggccgagctgcagacccagtgggaggccaagtgcgagcacctgctggccagcgccaaggacgagcacctgcagcagtaccaggaggtgtgcgcccagagagacgcctaccagcagaagctggtgcagctgcaggagaagtgcctggccctgcaggcccagatcaccgccctgaccaagcagaacgagcagcacatcaaggagctggagaagaacaagagccagatgagcggcgtggaggccgccgccagcgaccccagcgagaaggtgaagaagatcatgaaccaggtgttccagagcctgagaagagagttcgagctggaggagagctacaacggcagaaccatcctgggcaccatcatgaacaccatcaagatggtgaccctgcagctgctgaaccagcaggagcaggagaaggaggagagcagcagcgaggaggaggaggagaaggccgaggagagacccagaagacccagccaggagcagagcgccagcgccagcagcggccagccccaggcccccctgaacagagagagacccgagagccccatggtgcccagcgagcaggtggtggaggaggccgtgcccctgcccccccaggccctgaccaccagccaggacggccacagaagaaagggcgacagcgaggccgaggccctgagcgagatcaaggacggcagcctgccccccgagctgagctgcatccccagccacagagtgctgggcccccccaccagcatcccccccgagcccctgggccccgtgagcatggacagcgagtgcgaggagagcctggccgccagccccatggccgccaagcccgacaaccccagcggcaaggtgtgcgtgagagaggtggcccccgacggccccctgcaggagagcagcaccagactgagcctgaccagcgaccccgaggagggcgaccccctggccctgggccccgagagccccggcgagccccagcccccccagctgaagaaggacgacgtgaccagcagcaccggcccccacaaggagctgagcagcaccgaggccggcagcaccgtggccggcgccgccctgagacccagccaccacagccagagaagcagcctgagcggcgacgaggaggacgagctgttcaagggcgccaccctgaaggccctgagacccaaggcccagcccgaggaggaggacgaggacgaggtgagcatgaagggcagacccccccccacccccctgttcggcgacgacgacgacgacgacgacatcgactggctgggctag

SEQ ID NO: 9286 - DNA, 6978 bp, Homo sapiens
atgaagaagggcagccagcagaagatcttcagcaaggccaagatccccagcagcagccacagccccatccccagcagcatgagcaacatgagaagcagaagcctgagccccctgatcggcagcgagaccctgcccttccacagcggcggccagtggtgcgagcaggtggagatcgccgacgagaacaacatgctgctggactaccaggaccacaagggcgccgacagccacgccggcgtgagatacatcaccgaggccctgatcaagaagctgaccaagcaggacaacctggccctgatcaagagcctgaacctgagcctgagcaaggacggcggcaagaagttcaagtacatcgagaacctggagaagtgcgtgaagctggaggtgctgaacctgagctacaacctgatcggcaagatcgagaagctggacaagctgctgaagctgagagagctgaacctgagctacaacaagatcagcaagatcgagggcatcgagaacatgtgcaacctgcagaagctgaacctggccggcaacgagatcgagcacatccccgtgtggctgggcaagaagctgaagagcctgagagtgctgaacctgaagggcaacaagatcagcagcctgcaggacatcagcaagctgaagcccctgcaggacctgatcagcctgatcctggtggagaaccccgtggtgaccctgccccactacctgcagttcaccatcttccacctgagaagcctggagagcctggagggccagcccgtgaccacccaggacagacaggaggccttcgagagattcagcctggaggaggtggagagactggagagagacctggagaagaagatgatcgagaccgaggagctgaagagcaagcagaccagattcctggaggagatcaagaaccaggacaagctgaacaagagcctgaaggaggaggccatgctgcagaagcagagctgcgaggagctgaagagcgacctgaacaccaagaacgagctgctgaagcagaagaccatcgagctgaccagagcctgccagaagcagtacgagctggagcaggagctggccttctacaagatcgacgccaagttcgagcccctgaactactaccccagcgagtacgccgagatcgacaaggcccccgacgagagcccctacatcggcaagagcagatacaagagaaacatgttcgccaccgagagctacatcatcgacagcgcccaggccgtgcagatcaagaagatggagcccgacgagcagctgagaaacgaccacatgaacctgagaggccacacccccctggacacccagctggaggacaaggagaagaagatcagcgccgcccagaccagactgagcgagctgcacgacgagatcgagaaggccgagcagcagatcctgagagccaccgaggagttcaagcagctggaggaggccatccagctgaagaagatcagcgaggccggcaaggacctgctgtacaagcagctgagcggcagactgcagctggtgaacaagctgagacaggaggccctggacctggagctgcagatggagaagcagaagcaggagatcgccggcaagcagaaggagatcaaggacctgcagatcgccatcgacagcctggacagcaaggaccccaagcacagccacatgaaggcccagaagagcggcaaggagcagcagctggacatcatgaacaagcagtaccagcagctggagagcagactggacgagatcctgagcagaatcgccaaggagaccgaggagatcaaggacctggaggagcagctgaccgagggccagatcgccgccaacgaggccctgaagaaggacctggagggcgtgatcagcggcctgcaggagtacctgggcaccatcaagggccaggccacccaggcccagaacgagtgcagaaagctgagagacgagaaggagaccctgctgcagagactgaccgaggtggagcaggagagagaccagctggagatcgtggccatggacgccgagaacatgagaaaggagctggccgagctggagagcgccctgcaggagcagcacgaggtgaacgccagcctgcagcagacccagggcgacctgagcgcctacgaggccgagctggaggccagactgaacctgagagacgccgaggccaaccagctgaaggaggagctggagaaggtgaccagactgacccagctggagcagagcgccctgcaggccgagctggagaaggagagacaggccctgaagaacgccctgggcaaggcccagttcagcgaggagaaggagcaggagaacagcgagctgcacgccaagctgaagcacctgcaggacgacaacaacctgctgaagcagcagctgaaggacttccagaaccacctgaaccacgtggtggacggcctggtgagacccgaggaggtggccgccagagtggacgagctgagaagaaagctgaagctgggcaccggcgagatgaacatccacagccccagcgacgtgctgggcaagagcctggccgacctgcagaagcagttcagcgagatcctggccagaagcaagtgggagagagacgaggcccaggtgagagagagaaagctgcaggaggagatggccctgcagcaggagaagctggccaccggccaggaggagttcagacaggcctgcgagagagccctggaggccagaatgaacttcgacaagagacagcacgaggccagaatccagcagatggagaacgagatccactacctgcaggagaacctgaagagcatggaggagatccagggcctgaccgacctgcagctgcaggaggccgacgaggagaaggagagaatcctggcccagctgagagagctggagaagaagaagaagctggaggacgccaagagccaggagcaggtgttcggcctggacaaggagctgaagaagctgaagaaggccgtggccaccagcgacaagctggccaccgccgagctgaccatcgccaaggaccagctgaagagcctgcacggcaccgtgatgaagatcaaccaggagagagccgaggagctgcaggaggccgagagattcagcagaaaggccgcccaggccgccagagacctgaccagagccgaggccgagatcgagctgctgcagaacctgctgagacagaagggcgagcagttcagactggagatggagaagaccggcgtgggcaccggcgccaacagccaggtgctggagatcgagaagctgaacgagaccatggagagacagagaaccgagatcgccagactgcagaacgtgctggacctgaccggcagcgacaacaagggcggcttcgagaacgtgctggaggagatcgccgagctgagaagagaggtgagctaccagaacgactacatcagcagcatggccgaccccttcaagagaagaggctactggtacttcatgccccccccccccagcagcaaggtgagcagccacagcagccaggccaccaaggacagcggcgtgggcctgaagtacagcgccagcacccccgtgagaaagcccagacccggccagcaggacggcaaggagggcagccagcccccccccgccagcggctactgggtgtacagccccatcagaagcggcctgcacaagctgttccccagcagagacgccgacagcggcggcgacagccaggaggagagcgagctggacgaccaggaggagccccccttcgtgcccccccccggctacatgatgtacaccgtgctgcccgacggcagccccgtgccccagggcatggccctgtacgccccccccccccccctgcccaacaacagcagacccctgacccccggcaccgtggtgtacggccccccccccgccggcgcccccatggtgtacggcccccccccccccaacttcagcatccccttcatccccatgggcgtgctgcactgcaacgtgcccgagcaccacaacctggagaacgaggtgagcagactggaggacatcatgcagcacctgaagagcaagaagagagaggagagatggatgagagccagcaagagacagagcgagaaggagatggaggagctgcaccacaacatcgacgacctgctgcaggagaagaagagcctggagtgcgaggtggaggagctgcacagaaccgtgcagaagagacagcagcagaaggacttcatcgacggcaacgtggagagcctgatgaccgagctggagatcgagaagagcctgaagcaccacgaggacatcgtggacgagatcgagtgcatcgagaagaccctgctgaagagaagaagcgagctgagagaggccgacagactgctggccgaggccgagagcgagctgagctgcaccaaggagaagaccaagaacgccgtggagaagttcaccgacgccaagagaagcctgctgcagaccgagagcgacgccgaggagctggagagaagagcccaggagaccgccgtgaacctggtgaaggccgaccagcagctgagaagcctgcaggccgacgccaaggacctggagcagcacaagatcaagcaggaggagatcctgaaggagatcaacaagatcgtggccgccaaggacagcgacttccagtgcctgagcaagaagaaggagaagctgaccgaggagctgcagaagctgcagaaggacatcgagatggccgagagaaacgaggaccaccacctgcaggtgctgaaggagagcgaggtgctgctgcaggccaagagagccgagctggagaagctgaagagccaggtgaccagccagcagcaggagatggccgtgctggacagacagctgggccacaagaaggaggagctgcacctgctgcagggcagcatggtgcaggccaaggccgacctgcaggaggccctgagactgggcgagaccgaggtgaccgagaagtgcaaccacatcagagaggtgaagagcctgctggaggagctgagcttccagaagggcgagctgaacgtgcagatcagcgagagaaagacccagctgaccctgatcaagcaggagatcgagaaggaggaggagaacctgcaggtggtgctgagacagatgagcaagcacaagaccgagctgaagaacatcctggacatgctgcagctggagaaccacgagctgcagggcctgaagctgcagcacgaccagagagtgagcgagctggagaagacccaggtggccgtgctggaggagaagctggagctggagaacctgcagcagatcagccagcagcagaagggcgagatcgagtggcagaagcagctgctggagagagacaagagagagatcgagagaatgaccgccgagagcagagccctgcagagctgcgtggagtgcctgagcaaggagaaggaggacctgcaggagaagtgcgacatctgggagaagaagctggcccagaccaagagagtgctggccgccgccgaggagaacagcaagatggagcagagcaacctggagaagctggagctgaacgtgagaaagctgcagcaggagctggaccagctgaacagagacaagctgagcctgcacaacgacatcagcgccatgcagcagcagctgcaggagaagagagaggccgtgaacagcctgcaggaggagctggccaacgtgcaggaccacctgaacctggccaagcaggacctgctgcacaccaccaagcaccaggacgtgctgctgagcgagcagaccagactgcagaaggacatcagcgagtgggccaacagattcgaggactgccagaaggaggaggagaccaagcagcagcagctgcaggtgctgcagaacgagatcgaggagaacaagctgaagctggtgcagcaggagatgatgttccagagactgcagaaggagagagagagcgaggagagcaagctggagaccagcaaggtgaccctgaaggagcagcagcaccagctggagaaggagctgaccgaccagaagagcaagctggaccaggtgctgagcaaggtgctggccgccgaggagagagtgagaaccctgcaggaggaggagagatggtgcgagagcctggagaagaccctgagccagaccaagagacagctgagcgagagagagcagcagctggtggagaagagcggcgagctgctggccctgcagaaggaggccgacagcatgagagccgacttcagcctgctgagaaaccagttcctgaccgagagaaagaaggccgagaagcaggtggccagcctgaaggaggccctgaagatccagagaagccagctggagaagaacctgctggagcagaagcaggagaacagctgcatccagaaggagatggccaccatcgagctggtggcccaggacaaccacgagagagccagaagactgatgaaggagctgaaccagatgcagtacgagtacaccgagctgaagaagcagatggccaaccagaaggacctggagagaagacagatggagatcagcgacgccatgagaaccctgaagagcgaggtgaaggacgagatcagaaccagcctgaagaacctgaaccagttcctgcccgagctgcccgccgacctggaggccatcctggagagaaacgagaacctggagggcgagctggagagcctgaaggagaacctgcccttcaccatgaacgagggccccttcgaggagaagctgaacttcagccaggtgcacatcatggacgagcactggagaggcgaggccctgagagagaagctgagacacagagaggacagactgaaggcccagctgagacactgcatgagcaagcaggccgaggtgctgatcaagggcaagagacagaccgagggcaccctgcacagcctgagaagacaggtggacgccctgggcgagctggtgaccagcaccagcgccgacagcgccagcagccccagcctgagccagctggagagcagcctgaccgaggacagccagctgggccagaaccaggagaagaacgccagcgccagatag

SEQ ID NO: 9287 - DNA, 2811 bp, Homo sapiens
atggagcccgacatcatcagaatgtacagcagcagccccccccccctggacaacggcgccgaggacgacgacgacgacgagttcggcgagttcggcggcttcagcgaggtgagccccagcggcgtgggcttcgtggacttcgacacccccgactacaccagacccaaggaggagttcgtgcccagcaaccacttcatgcccatccacgagttcagcgagaacgtggacagcctgaccagcttcaagagcatcaagaacggcaacgacaaggacatcaccgccgagctgagcgcccccgtgaagggccagagcgacgtgctgctgagcaccaccagcaaggagatcatcagcagcgagatgctggccaccagcatcgacggcatggagagacccggcaacctgaacaaggtggtggagcagagacagaacgtgggcaccctggagagcttcagccccggcgacttcagaaccaacatgaacgtggtgcaccagaacaagcagctggagagctgcaacggcgagaagcccccctgcctggagatcctgaccaacggcttcgccgtgctggagaccgtgaacccccagggcaccgacgacctggacaacgtggccgacagcaagggcagaaagcccctgagcacccacagcaccgagtacaacctggacagcgtgcccagccccgccgaggagttcgccgacttcgccaccttcagcaagaaggagagaatccagctggaggagatcgagtgcgccgtgctgaacgacagagaggccctgaccatcagagagaacaacaagatcaacagagtgaacgagctgaacagcgtgaaggaggtggccctgggcagaagcctggacaacaagggcgacaccgacggcgaggaccaggtgtgcgtgagcgagatcagcatcgtgaccaacagaggcttcagcgtggagaagcagggcctgcccaccctgcagcaggacgagttcctgcagagcggcgtgcagagcaaggcctggagcctggtggacagcgccgacaacagcgaggccatcagaagagagcagtgcaagaccgaggagaagctggacctgctgaccagcaagtgcgcccacctgtgcatggacagcgtgaagaccagcgacgacgaggtgggcagccccaaggaggagagcagaaagttcaccaacttccagagccccaacatcgaccccaccgaggagaacgacctggacgacagcctgagcgtgaagaacggcgacagcagcaacgacttcgtgacctgcaacgacatcaacgaggacgacttcggcgacttcggcgacttcggcagcgccagcggcagcaccccccccttcgtgaccggcacccaggacagcatgagcgacgccaccttcgaggagagcagcgagcacttcccccacttcagcgagcccggcgacgacttcggcgagttcggcgacatcaacgccgtgagctgccaggaggagaccatcctgaccaagagcgacctgaagcagaccagcgacaacctgagcgaggagtgccagctggccagaaagagcagcggcaccggcaccgagcccgtggccaagctgaagaacggccaggagggcgagatcggccacttcgacagcgtgcccaacatccaggacgactgcaacggcttccaggacagcgacgacttcgccgacttcagcagcgccggccccagccaggtggtggactggaacgccttcgaggacgagcagaaggacagctgcagctgggccgccttcggcgaccagcaggccaccgagagccaccacagaaaggaggcctggcagagccacagaaccgacgagaacatcgacacccccggcacccccaagacccacagcgtgcccagcgccaccagcaagggcgccgtggccagcggccacctgcaggagagcgccaccagcgtgcagaccgccctgctgaacagactggagagaatcttcgaggcctgcttccccagcatcctggtgcccgacgccgaggaggaggtgaccagcctgaagcacctgctggagaccagcaccctgcccatcaagaccagagaggccctgcccgagagcggcgagctgctggacgtgtggaccgagctgcaggacatccacgacgcccacggcctgagataccagtggggcggcagccacagcaacaagaagctgctgagcagcctgggcatcgacaccagaaacatcctgttcaccggcaacaagaagcagcccgtgatcgtgcccatgtacgccgccggcctgggcatgctggagcccaccaaggagcccctgaagcccctgagcgccgccgagaagatcgccagcatcggccagaccgccaccatgagccccgacatgaacacctgcaccagcgaccagttccaggagagcctgccccccgtgcagttcgactggagcagcagcggcctgaccaaccccctggacgccagcggcggcagcaccctgctgaacctggacttcttcggccccgtggacgacagcagcagcagcagcagcaccaccatccccggcgtggaccccgagctgtacgagctgaccaccagcaagctggagatcagcaccagcagcctgaaggtgaccgacgccttcgccagactgatgagcaccgtggagaagaccagcaccagcaccagaaagcccaagagagaggagcacctgagcgaggaggccatcaaggtgatcgccggcctgcccgacctgaccttcatgcacgccaaggtgctgatgttccccgccaccctgacccccagcaccagcagccaggagaaggccgacggctag

SEQ ID NO: 9288 - DNA, 2730 bp, Homo sapiens
atggagcccgacatcatcagaatgtacagcagcagccccccccccctggacaacggcgccgaggacgacgacgacgacgagttcggcgagttcggcggcttcagcgaggtgagccccagcggcgtgggcttcgtggacttcgacacccccgactacaccagacccaaggaggagttcgtgcccagcaaccacttcatgcccatccacgagttcagcgagaacgtggacagcctgaccagcttcaagagcatcaagaacggcaacgacaaggacatcaccgccgagctgagcgcccccgtgaagggccagagcgacgtgctgctgagcaccaccagcaaggagatcatcagcagcgagatgctggccaccagcatcgacggcatggagagacccggcaacctgaacaaggtggtggagcagagacagaacgtgggcaccctggagagcttcagccccggcgacttcagaaccaacatgaacgtggtgcaccagaacaagcagctggagagctgcaacggcgagaagcccccctgcctggagatcctgaccaacggcttcgccgtgctggagaccgtgaacccccagggcaccgacgacctggacaacgtggccgacagcaagggcagaaagcccctgagcacccacagcaccgagtacaacctggacagcgtgcccagccccgccgaggagttcgccgacttcgccaccttcagcaagaaggagagaatccagctggaggagatcgagtgcgccgtgctgaacgacagagaggccctgaccatcagagagaacaacaagatcaacagagtgaacgagctgaacagcgtgaaggaggtggccctgggcagaagcctggacaacaagggcgacaccgacggcgaggaccaggtgtgcgtgagcgagatcagcatcgtgaccaacagaggcttcagcgtggagaagcagggcctgcccaccctgcagcaggacgagttcctgcagagcggcgtgcagagcaaggcctggagcctggtggacagcgccgacaacagcgaggccatcagaagagagcagtgcaagaccgaggagaagctggacctgctgaccagcaagtgcgcccacctgtgcatggacagcgtgaagaccagcgacgacgaggtgggcagccccaaggaggagagcagaaagttcaccaacttccagagccccaacatcgaccccaccgaggagaacgacctggacgacagcctgagcgtgaagaacggcgacagcagcaacgacttcgtgacctgcaacgacatcaacgaggacgacttcggcgacttcggcgacttcggcagcgccagcggcagcaccccccccttcgtgaccggcacccaggacagcatgagcgacgccaccttcgaggagagcagcgagcacttcccccacttcagcgagcccggcgacgacttcggcgagttcggcgacatcaacgccgtgagctgccaggaggagaccatcctgaccaagagcgacctgaagcagaccagcgacaacctgagcgaggagtgccagctggccagaaagagcagcggcaccggcaccgagcccgtggccaagctgaagaacggccaggagggcgagatcggccacttcgacagcgtgcccaacatccaggacgactgcaacggcttccaggacagcgacgacttcgccgacttcagcagcgccggccccagccaggtggtggactggaacgccttcgaggacgagcagaaggacagctgcagctgggccgccttcggcgaccagcaggccaccgagagccaccacagaaaggaggcctggcagagccacagaaccgacgagaacatcgacacccccggcacccccaagacccacagcgtgcccagcgccaccagcaagggcgccgtggccagcggccacctgcaggagagcgccaccagcgtgcagaccgccctgctgaacagactggagagaatcttcgaggcctgcttccccagcatcctggtgcccgacgccgaggaggaggtgaccagcctgaagcacctgctggagaccagcaccctgcccatcaagaccagagaggccctgcccgagagcggcgagctgctggacgtgtggaccgagctgcaggacatccacgacgcccacggcctgagataccagtggggcggcagccacagcaacaagaagctgctgagcagcctgggcatcgacaccagaaacatcctgttcaccggcaacaagaagcagcccgtgatcgtgcccatgtacgccgccggcctgggcatgctggagcccaccaaggagcccctgaagcccctgagcgccgccgagaagatcgccagcatcggccagaccgccaccatgagccccgacatgaacacctgcaccagcgaccagttccaggagagcctgccccccgtgcagttcgactggagcagcagcggcctgaccaaccccctggacggcgtggaccccgagctgtacgagctgaccaccagcaagctggagatcagcaccagcagcctgaaggtgaccgacgccttcgccagactgatgagcaccgtggagaagaccagcaccagcaccagcagaaagcccaagagagaggagcacctgagcgaggaggccatcaaggtgatcgccggcctgcccgacctgaccttcatgcacgccaaggtgctgatgttccccgccaccctgacccccagcaccagcagccaggagaaggccgacggctag

SEQ ID NO: 9289 - DNA, 306 bp, Homo sapiens
atggtgtgcgagaagtgcgagaagaagctgggcaccgtgatcacccccgacacctggaaggacggcgccagaaacaccaccgagagcggcggcagaaagctgaacgagaacaaggccctgaccagcaagaaggccagattcgacccctacggcaagaacaagttcagcacctgcagaatctgcaagagcagcgtgcaccagcccggcagccactactgccagggctgcgcctacaagaagggcatctgcgccatgtgcggcaagaaggtgctggacaccaagaactacaagcagaccagcgtgtag

SEQ ID NO: 9290 - DNA, 1467 bp, Homo sapiens
atgaacttcacccccacccacacccccgtgtgcagaaagagaaccgtggtgagcaagagaggcgtggccgtgagcggccccaccaagagaagaggcatggccgacagcctggagagcacccccctgcccagccccgaggacagactggccaagctgcaccccagcaaggagctgctggagtactaccagaagaagatggccgagtgcgaggccgagaacgaggacctgctgaagaagctggagctgtacaaggaggcctgcgagggccagcacaagctggagtgcgacctgcagcagagagaggaggagatcgccgagctgcagaaggccctgagcgacatgcaggtgtgcctgttccaggagagagagcacgtgctgagactgtacagcgagaacgacagactgagaatcagagagctggaggacaagaagaagatccagaacctgctggccctggtgggcaccgacgccggcgaggtgacctacttctgcaaggagcccccccacaaggtgaccatcctgcagaagaccatccaggccgtgggcgagtgcgagcagagcgagagcagcgccttcaaggccgaccccaagatcagcaagagaagacccagcagagagagaaaggagagcagcgagcactaccagagagacatccagaccctgatcctgcaggtggaggccctgcaggcccagctgggcgagcagaccaagctgagcagagagcagatcgagggcctgatcgaggacagaagaatccacctggaggagatccaggtgcagcaccagagaaaccagaacaagatcaaggagctgaccaagaacctgcaccacacccaggagctgctgtacgagagcaccaaggacttcctgcagctgagaagcgagaaccagaacaaggagaagagctggatgctggagaaggacaacctgatgagcaagatcaagcagtacagagtgcagtgcaagaagaaggaggacaagatcggcaaggtgctgcccgtgatgcacgagagccaccacgcccagagcgagtacatcaagagcctgaaggacaagctggtgcaggagaagaagctgagcaacatgtaccaggagcagtgcatcagcctggaggaggagctggccagaatcagagaggaggagggcatgagaagagagatcttcaaggacagaaccaacaagatgggcaagagactgcagatcatgaccaagagatacgaggccctggagagaagaagaatcctggaggtggagggcttcaagaccgacatcaaggtgctgagacagaagctgaaggacctggagcagatgctgtacaaggccaccgtgaacgccagagccaaccaggacctggccctgctgtgcgaggtgagagacagcaacagaagagcccacaagatccagggcgagctgaagaacctgaagagcaaggtgttcggcctggagaacgagctgagactgtgctag

SEQ ID NO: 9291 - DNA, 258 bp, Homo sapiens
atgagcaaggtgagcttcaagatcaccctgaccagcgaccccagactgccctacaaggtgctgagcgtgcccgagagcacccccttcaccgccgtgctgaagttcgccgccgaggagttcaaggtgcccgccgccaccagcgccatcatcaccaacgacggcatcggcatcaaccccgcccagaccgccggcaacgtgttcctgaagcacggcagcgagctgagaatcatccccagagacagagtgggcagctgctag

SEQ ID NO: 9292 - DNA, 585 bp, Homo sapiens
atggacgaggacggcctgcccctgatgggcagcggcatcgacctgaccaaggtgcccgccatccagcagaagagaaccgtggccttcctgaaccagttcgtggtgcacaccgtgcagttcctgaacagattcagcaccgtgtgcgaggagaagctggccgacctgagcctgagaatccagcagatcgagaccaccctgaacatcctggacgccaagctgagcagcatccccggcctggacgacgtgaccgtggaggtgagccccctgaacgtgaccagcgtgaccaacggcgcccaccccgaggccaccagcgagcagccccagcagaacagcacccaggacagcggcctgcaggagagcgaggtgagcgccgagaacatcctgaccgtggccaaggaccccagatacgccagatacctgaagatggtgcaggtgggcgtgcccgtgatggccatcagaaacaagatgatcagcgagggcctggaccccgacctgctggagagacccgacgcccccgtgcccgacggcgagagcgagaagaccgtggaggagagcagcgacagcgagagcagcttcagcgactag

SEQ ID NO: 9293 - DNA, 2226 bp, Homo sapiens
atgggcccccccggccccgccctgcccgccaccatgaacaacagcagcagcgagaccagaggccacccccacagcgccagcagccccagcgagagagtgttccccatgcccctgcccagaaaggcccccctgaacatccccggcacccccgtgctggaggacttcccccagaacgacgacgagaaggagagactgcagagaagaagaagcagagtgttcgacctgcagttcagcaccgacagccccagactgctggccagccccagcagcagaagcatcgacatcagcgccaccatccccaagttcaccaacacccagatcaccgagcactacagcacctgcatcaagctgagcaccgagaacaagatcaccaccaagaacgccttcggcctgcacctgatcgacttcatgagcgagatcctgaagcagaaggacaccgagcccaccaacttcaaggtggccgccggcaccctggacgccagcaccaagatctacgccgtgagagtggacgccgtgcacgccgacgtgtacagagtgctgggcggcctgggcaaggacgcccccagcctggaggaggtggagggccacgtggccgacggcagcgccaccgagatgggcaccaccaagaaggccgtgaagcccaagaagaagcacctgcacagaaccatcgagcagaacatcaacaacctgaacgtgagcgaggccgacagaaagtgcgagatcgaccccatgttccagaagaccgccgccagcttcgacgagtgcagcaccgccggcgtgttcctgagcaccctgcactgccaggactacagaagcgagctgctgttccccagcgacgtgcagaccctgagcaccggcgagcccctggagctgcccgagctgggctgcgtggagatgaccgacctgaaggcccccctgcagcagtgcgccgaggacagacagatctgccccagcctggccggcttccagttcacccagtgggacagcgagacccacaacgagagcgtgagcgccctggtggacaagttcaagaagaacgaccaggtgttcgacatcaacgccgaggtggacgagagcgactgcggcgacttccccgacggcagcctgggcgacgacttcgacgccaacgacgagcccgaccacaccgccgtgggcgaccacgaggagttcagaagctggaaggagccctgccaggtgcagagctgccaggaggagatgatcagcctgggcgacggcgacatcagaaccatgtgccccctgctgagcatgaagcccggcgagtacagctacttcagccccagaaccatgagcatgtgggccggccccgaccactggagattcagacccagaagaaagcaggacgcccccagccagagcgagaacaagaagaagagcaccaagaaggacttcgagatcgacttcgaggacgacatcgacttcgacgtgtacttcagaaagaccaaggccgccaccatcctgaccaagagcaccctggagaaccagaactggagagccaccaccctgcccaccgacttcaactacaacgtggacaccctggtgcagctgcacctgaagcccggcaccagactgctgaagatggcccagggccacagagtggagaccgagcactacgaggagatcgaggactacgactacaacaaccccaacgacaccagcaacttctgccccggcctgcaggccgccgacagcgacgacgaggacctggacgacctgttcgtgggccccgtgggcaacagcgacctgagcccctacccctgccacccccccaagaccgcccagcagaacggcgacacccccgaggcccagggcctggacatcaccacctacggcgagagcaacctggtggccgagccccagaaggtgaacaagatcgagatccactacgccaagaccgccaagaagatggacatgaagaagctgaagcagagcatgtggagcctgctgaccgccctgagcggcaaggaggccgacgccgaggccaaccacagagaggccggcaaggaggccgccctggccgaggtggccgacgagaagatgctgagcggcctgaccaaggacctgcagagaagcctgccccccgtgatggcccagaacctgagcatccccctggccttcgcctgcctgctgcacctggccaacgagaagaacctgaagctggagggcaccgaggacctgagcgacgtgctggtgagacagggcgactag

SEQ ID NO: 9294 - DNA, 510 bp, Homo sapiens
atgaagggcagcagaatcgagctgggcgacgtgaccccccacaacatcaagcagctgaagagactgaaccaggtgatcttccccgtgagctacaacgacaagttctacaaggacgtgctggaggtgggcgagctggccaagctggcctacttcaacgacatcgccgtgggcgccgtgtgctgcagagtggaccacagccagaaccagaagagactgtacatcatgaccctgggctgcctggccccctacagaagactgggcatcggcaccaagatgctgaaccacgtgctgaacatctgcgagaaggacggcaccttcgacaacatctacctgcacgtgcagatcagcaacgagagcgccatcgacttctacagaaagttcggcttcgagatcatcgagaccaagaagaactactacaagagaatcgagcccgccgacgcccacgtgctgcagaagaacctgaaggtgcccagcggccagaacgccgacgtgcagaagaccgacaactag

SEQ ID NO: 9295 - DNA, 1245 bp, Homo sapiens
atggccgccgccccccccagctactgcttcgtggccttcccccccagagccaaggacggcctggtggtgttcggcaagaacagcgccagacccagagacgaggtgcaggaggtggtgtacttcagcgccgccgaccacgagcccgagagcaaggtggagtgcacctacatcagcatcgaccaggtgcccagaacctacgccatcatgatcagcagacccgcctggctgtggggcgccgagatgggcgccaacgagcacggcgtgtgcatcgccaacgaggccatcaacaccagagagcccgccgccgagatcgaggccctgctgggcatggacctggtgagactgggcctggagagaggcgagaccgccaaggaggccctggacgtgatcgtgagcctgctggaggagcacggccagggcggcaactacttcgaggacgccaacagctgccacagcttccagagcgcctacctgatcgtggacagagacgaggcctgggtgctggagaccatcggcaagtactgggccgccgagaaggtgaccgagggcgtgagatgcatctgcagccagctgagcctgaccaccaagatggacgccgagcaccccgagctgagaagctacgcccagagccagggctggtggaccggcgagggcgagttcaacttcagcgaggtgttcagccccgtggaggaccacctggactgcggcgccggcaaggacagcctggagaagcaggaggagagcatcaccgtgcagaccatgatgaacaccctgagagacaaggccagcggcgtgtgcatcgacagcgagttcttcctgaccaccgccagcggcgtgagcgtgctgccccagaacagaagcagcccctgcatccactacttcaccggcacccccgaccccagcagaagcatcttcaagcccttcatcttcgtggacgacgtgaagctggtgcccaagacccagagcccctgcttcggcgacgacgaccccgccaagaaggagcccagattccaggagaagcccgacagaagacacgagctgtacaaggcccacgagtgggccagagccatcatcgagagcgaccaggagcagggcagaaagctgagaagcaccatgctggagctggagaagcagggcctggaggccatggaggagatcctgaccagcagcgagcccctggaccccgccgaggtgggcgacctgttctacgactgcgtggacaccgagatcaagttcttcaagtag

SEQ ID NO: 9296 - DNA, 2031 bp, Homo sapiens
atgagcgaccagatcaagttcatcatggacagcctgaacaaggagcccttcagaaagaactacaacctgatcaccttcgacagcctggagcccatgcagctgctgcaggtgctgagcgacgtgctggccgagatcgaccccaagcagctggtggacatcagagaggagatgcccgagcagaccgccaagagaatgctgagcctgctgggcatcctgaagtacaagcccagcggcaacgccaccgacatgagcaccttcagacagggcctggtgatcggcagcaagcccgtgatctaccccgtgctgcactggctgctgcagagaaccaacgagctgaagaagagagcctacctggccagattcctgatcaagctggaggtgcccagcgagttcctgcaggacgagaccgtggccgacaccaacaagcagtacgaggagctgatggaggccttcaagaccctgcacaaggagtacgagcagctgaagatcagcggcttcagcaccgccgagatcagaaaggacatcagcgccatggaggaggagaaggaccagctgatcaagagagtggagcacctgaagaagagagtggagaccgcccagaaccaccagtggatgctgaagatcgccagacagctgagagtggagaaggagagagaggagtacctggcccagcagaagcaggagcagaagaaccagctgttccacgccgtgcagagactgcagagagtgcagaaccagctgaagagcatgagacaggccgccgccgacgccaagcccgagagcctgatgaagagactggaggaggagatcaagttcaacctgtacatggtgaccgagaagttccccaaggagctggagaacaagaagaaggagctgcacttcctgcagaaggtggtgagcgagcccgccatgggccacagcgacctgctggagctggagagcaagatcaacgagatcaacaccgagatcaaccagctgatcgagaagaagatgatgagaaacgagcccatcgagggcaagctgagcctgtacagacagcaggccagcatcatcagcagaaagaaggaggccaaggccgaggagctgcaggaggccaaggagaagctggccagcctggagagagaggccagcgtgaagagaaaccagaccagagagttcgacggcaccgaggtgctgaagggcgacgagttcaagagatacgtgaacaagctgagaagcaagagcaccgtgttcaagaagaagcaccagatcatcgccgagctgaaggccgagttcggcctgctgcagagaaccgaggagctgctgaagcagagacacgagaacatccagcagcagctgcagaccatggaggagaagaagggcatcagcggctacagctacacccaggaggagctggagagagtgagcgccctgaagagcgaggtggacgagatgaagggcagaaccctggacgacatgagcgagatggtgaagaagctgtacagcctggtgagcgagaagaagagcgccctggccagcgtgatcaaggagctgagacagctgagacagaagtaccaggagctgacccaggagtgcgacgagaagaagagccagtacgacagctgcgccgccggcctggagagcaacagaagcaagctggagcaggaggtgagaagactgagagaggagtgcctgcaggaggagagcagataccactacaccaactgcatgatcaagaacctggaggtgcagctgagaagagccaccgacgagatgaaggcctacatcagcagcgaccagcaggagaagagaaaggccatcagagagcagtacaccaagaacaccgccgagcaggagaacctgggcaagaagctgagagagaagcagaaggtgatcagagagagccacggccccaacatgaagcaggccaagatgtggagagacctggagcagctgatggagtgcaagaagcagtgcttcctgaagcagcagagccagaccagcatcggccaggtgatccaggagggcggcgaggacagactgatcctgtag

SEQ ID NO: 9297 - DNA, 948 bp, Homo sapiens
atggccttccccgagcccaagcccagaccccccgagctgccccagaagagactgaagaccctggactgcggccagggcgccgtgagagccgtgagattcaacgtggacggcaactactgcctgacctgcggcagcgacaagaccctgaagctgtggaaccccctgagaggcaccctgctgagaacctacagcggccacggctacgaggtgctggacgccgccggcagcttcgacaacagcagcctgtgcagcggcggcggcgacaaggccgtggtgctgtgggacgtggccagcggccaggtggtgagaaagttcagaggccacgccggcaaggtgaacaccgtgcagttcaacgaggaggccaccgtgatcctgagcggcagcatcgacagcagcatcagatgctgggactgcagaagcagaagacccgagcccgtgcagaccctggacgaggccagagacggcgtgagcagcgtgaaggtgagcgaccacgagatcctggccggcagcgtggacggcagagtgagaagatacgacctgagaatgggccagctgttcagcgactacgtgggcagccccatcacctgcacctgcttcagcagagacggccagtgcaccctggtgagcagcctggacagcaccctgagactgctggacaaggacaccggcgagctgctgggcgagtacaagggccacaagaaccaggagtacaagctggactgctgcctgagcgagagagacacccacgtggtgagctgcagcgaggacggcaaggtgttcttctgggacctggtggagggcgccctggccctggccctgcccgtgggcagcggcgtggtgcagagcctggcctaccaccccaccgagccctgcctgctgaccgccatgggcggcagcgtgcagtgctggagagaggaggcctacgaggccgaggacggcgccggctag

SEQ ID NO: 9298 - DNA, 1803 bp, Homo sapiens
atggtgctgatcctgggcagaagactgaacagagaggacctgggcgtgagagacagccccgccaccaagagaaaggtgttcgagatggaccccaagagcctgaccggccacgagttcttcgacttcagcagcggcagcagccacgccgagaacatcctgcagatcttcaacgagttcagagacagcagactgttcaccgacgtgatcatctgcgtggagggcaaggagttcccctgccacagagccgtgctgagcgcctgcagcagctacttcagagccatgttctgcaacgaccacagagagagcagagagatgctggtggagatcaacggcatcctggccgaggccatggagtgcttcctgcagtacgtgtacaccggcaaggtgaagatcaccaccgagaacgtgcagtacctgttcgagaccagcagcctgttccagatcagcgtgctgagagacgcctgcgccaagttcctggaggagcagctggacccctgcaactgcctgggcatccagagattcgccgacacccacagcctgaagaccctgttcaccaagtgcaagaacttcgccctgcagaccttcgaggacgtgagccagcacgaggagttcctggagctggacaaggacgagctgatcgactacatctgcagcgacgagctggtgatcggcaaggaggagatggtgttcgaggccgtgatgagatgggtgtacagagccgtggacctgagaagacccctgctgcacgagctgctgacccacgtgagactgcccctgctgcaccccaactacttcgtgcagaccgtggaggtggaccagctgatccagaacagccccgagtgctaccagctgctgcacgaggccagaagataccacatcctgggcaacgagatgatgagccccagaaccagacccagaagaagcaccggctacagcgaggtgatcgtggtggtgggcggctgcgagagagtgggcggcttcaacctgccctacaccgagtgctacgaccccgtgaccggcgagtggaagagcctggccaagctgcccgagttcaccaagagcgagtacgccgtgtgcgccctgagaaacgacatcctggtgagcggcggcagaatcaacagcagagacgtgtggatctacaacagccagctgaacatctggatcagagtggccagcctgaacaagggcagatggagacacaagatggccgtgctgctgggcaaggtgtacgtggtgggcggctacgacggccagaacagactgagcagcgtggagtgctacgacagcttcagcaacagatggaccgaggtggcccccctgaaggaggccgtgagcagccccgccgtgaccagctgcgtgggcaagctgttcgtgatcggcggcggccccgacgacaacacctgcagcgacaaggtgcagagctacgaccccgagaccaacagctggctgctgagagccgccatccccatcgccaagagatgcatcaccgccgtgagcctgaacaacctgatctacgtggccggcggcctgaccaaggccatctactgctacgaccccgtggaggactactggatgcacgtgcagaacaccttcagcagacaggagaactgcggcatgagcgtgtgcaacggcaagatctacatcctgggcggcagaagagagaacggcgaggccaccgacaccatcctgtgctacgaccccgccaccagcatcatcaccggcgtggccgccatgcccagacccgtgagctaccacggctgcgtgaccatccacagatacaacgagaagtgcttcaagctgtag

SEQ ID NO: 9299 - DNA, 810 bp, Homo sapiens
atgaaccaggaggacctggaccccgacagcaccaccgacgtgggcgacgtgaccaacaccgaggaggagctgatcagagagtgcgaggagatgtggaaggacatggaggagtgccagaacaagctgagcctgatcggcaccgagaccctgaccgacagcaacgcccagctgagcctgctgatcatgcaggtgaagtgcctgaccgccgagctgagccagtggcagaagaagacccccgagaccatccccctgaccgaggacgtgctgatcaccctgggcaaggaggagttccagaagctgagacaggacctggagatggtgctgagcaccaaggagagcaagaacgagaagctgaaggaggacctggagagagagcagagatggctggacgagcagcagcagatcatggagagcctgaacgtgctgcacagcgagctgaagaacaaggtggagaccttcagcgagagcagaatcttcaacgagctgaagaccaagatgctgaacatcaaggagtacaaggagaagctgctgagcaccctgggcgagttcctggaggaccacttccccctgcccgacagaagcgtgaagaagaagaagaagaacatccaggagagcagcgtgaacctgatcaccctgcacgagatgctggagatcctgatcaacagactgttcgacgtgccccacgacccctacgtgaagatcagcgacagcttctggcccccctacgtggagctgctgctgagaaacggcatcgccctgagacaccccgaggaccccaccagaatcagactggaggccttccaccagtag

SEQ ID NO: 9300 - DNA, 1041 bp, Homo sapiens
atgtgcgagggccccagcagaatcagcggccccatcccccccgaccccaccctgtgccccgacaactacagaagacccaccagcgcccagggcagactggagggcaacgccctgaagctggacctgctgaccagcgacagagccctggacaccaccgcccccagaggcccctgcatcggccccggcgccggcgagatcctggagagaggccagagaggcgtgggcgacgtgctgctgcagctggagggcatcagcctgggccccggcgccagcctgaagagaaaggaccccaaggaccacgagaaggagaacctgagaagaatcagagagatccagaagagattcagagagcaggagagaagcagagagcagggccagcccagacccctgaaggccctgtggagaagccccaagtacgacaaggtggagagcagagtgaaggcccagctgcaggagcccggccccgccagcggcaccgagagcgcccacttcctgagagcccacagcagatgcggccccggcctgccccccccccacgtgagcagcccccagcccaccccccccggccccgaggccaaggagcccggcctgggcgtggacttcatcagacacaacgccagagccgccaagagagcccccagaagacacagctgcagcctgcaggtgctggcccaggtgctggagcagcagagacaggcccaggagcactacaacgccacccagaagggccacgtgccccactacctgctggagagaagagacctgtggagaagagaggccgaggccagaaagcagagccagcccgaccccgccatgccccccggccacaccagaatgcccgagaaccagagactggagaccctgaccaagctgctgcagagccagagccagctgctgagagagctggtgctgctgcccgccggcgccgacagcctgagagcccagagccacagagccgagctggacagaaagctggtgcaggtggaggaggccatcaagatcttcagcagacccaaggtgttcgtgaagatggacgactag

SEQ ID NO: 9301 - DNA, 1824 bp, Homo sapiens
atggccgccaacgtgttccccttcagagacgccagagccgcccccgaccccgtgctggaggccggccccgtggcccacggccccctgcccgtgcccctggtgctggacaacggcagcttccaggtgagagccggctgggcctgccccggccaggaccccggccccgagcccagactgcagttcagagccgtgtgcgccagaggcagaggcggcgccagaggcgccagcggcccccaggtgggcaacgccctgggcagcctggagcccctgagatggatgctgagaagccccttcgacagaaacgtgcccgtgaacctggagctgcaggagctgctgctggactacagcttccagcacctgggcgtgagcagccagggctgcgtggaccaccccatcgtgctgaccgaggccgtgtgcaaccccctgtacagcagacagatgatgagcgagctgctgttcgagtgctacggcatccccaaggtggcctacggcatcgacagcctgttcagcttctaccacaacaagcccaagaacagcatgtgcagcggcctgatcatcagcagcggctaccagtgcacccacgtgctgcccatcctggagggcagactggacgccaagaactgcaagagaatcaacctgggcggcagccaggccgccggctacctgcagagactgctgcagctgaagtaccccggccacctggccgccatcaccctgagcagaatggaggagatcctgcacgagcacagctacatcgccgaggactacgtggaggagctgcacaagtggagatgccccgactactacgagaacaacgtgcacaagatgcagctgcccttcagcagcaagctgctgggcagcaccctgaccagcgaggagaagcaggagagaagacagcagcagctgagaagactgcaggagctgaacgccagaagaagagaggagaagctgcagctggaccaggagagactggacagactgctgtacgtgcaggagctgctggaggacggccagatggaccagttccacaaggccctgatcgagctgaacatggacagccccgaggagctgcagagctacatccagaagctgagcatcgccgtggagcaggccaagcagaagatcctgcaggccgaggtgaacctggaggtggacgtggtggacagcaagcccgagacccccgacctggagcagctggagcccagcctggaggacgtggagagcatgaacgacttcgaccccctgttcagcgaggagacccccggcgtggagaagcccgtgaccaccgtgcagcccgtgttcaacctggccgcctaccaccagctgttcgtgggcaccgagagaatcagagcccccgagatcatcttccagcccagcctgatcggcgaggagcaggccggcatcgccgagaccctgcagtacatcctggacagataccccaaggacatccaggagatgctggtgcagaacgtgttcctgaccggcggcaacaccatgtaccccggcatgaaggccagaatggagaaggagctgctggagatgagacccttcagaagcagcttccaggtgcagctggccagcaaccccgtgctggacgcctggtacggcgccagagactgggccctgaaccacctggacgacaacgaggtgtggatcaccagaaaggagtacgaggagaagggcggcgagtacctgaaggagcactgcgccagcaacatctacgtgcccatcagactgcccaagcaggccagcagaagcagcgacgcccaggccagcagcaagggcagcgccgccggcggcggcggcgccggcgagcaggcctag

SEQ ID NO: 9302 - DNA, 1383 bp, Homo sapiens
atggccagcagagaggaggtgctggccctgcaggccgaggtggcccagagagaggaggagctgaacagcctgaagcagaagctggccagcgccctgctggccgagcaggagccccagcccgagagactggtgcccgtgagccccctgccccccaaggccgccctgagcagagacgagatcctgagatacagcagacagctggtgctgcccgagctgggcgtgcacggccagctgagactgggcaccgcctgcgtgctgatcgtgggctgcggcggcctgggctgccccctggcccagtacctggccgccgccggcgtgggcagactgggcctggtggactacgacgtggtggagatgagcaacctggccagacaggtgctgcacggcgaggccctggccggccaggccaaggccttcagcgccgccgccagcctgagaagactgaacagcgccgtggagtgcgtgccctacacccaggccctgacccccgccaccgccctggacctggtgagaagatacgacgtggtggccgactgcagcgacaacgtgcccaccagatacctggtgaacgacgcctgcgtgctggccggcagacccctggtgagcgccagcgccctgagattcgagggccagatcaccgtgtaccactacgacggcggcccctgctacagatgcatcttcccccagcccccccccgccgagaccgtgaccaactgcgccgacggcggcgtgctgggcgtggtgaccggcgtgctgggctgcctgcaggccctggaggtgctgaagatcgccgccggcctgggccccagctacagcggcagcctgctgctgttcgacgccctgagaggccacttcagaagcatcagactgagaagcagaagactggactgcgccgcctgcggcgagagacccaccgtgaccgacctgctggactacgaggccttctgcggcagcagcgccaccgacaagtgcagaagcctgcagctgctgagccccgaggagagagtgagcgtgaccgactacaagagactgctggacagcggcgccttccacctgctgctggacgtgagaccccaggtggaggtggacatctgcagactgccccacgccctgcacatccccctgaagcacctggagagaagagacgccgagagcctgaagctgctgaaggaggccatctgggaggagaagcagggcacccaggagggcgccgccgtgcccatctacgtgatctgcaagctgggcaacgacagccagaaggccgtgaagatcctgcagagcctgagcgccgcccaggagctggaccccctgaccgtgagagacgtggtgggcggcctgatggcctgggccgccaagatcgacggcaccttcccccagtactag

SEQ ID NO: 9303 - DNA, 1041 bp, Homo sapiens
atggagagcgtgagctgcagcgccgccgccgtgagaaccggcgacatggagagccagagagacctgagcctggtgcccgagagactgcagagaagagagcaggagagacagctggaggtggagagaagaaagcagaagagacagaaccaggaggtggagaaggagaacagccacttcttcgtggccaccttcgtgagagagagagccgccgtggaggagctgctggagagagccgagagcgtggagagactggaggaggccgccagcagactgcagggcctgcagaagctgatcaacgacagcgtgttcttcctggccgcctacgacctgagacagggccaggaggccctggccagactgcaggccgccctggccgagagaagaagaggcctgcagcccaagaagagattcgccttcaagaccagaggcaaggacgccgccagcagcaccaaggtggacgccgcccccggcatcccccccgccgtggagagcatccaggacagccccctgcccaagaaggccgagggcgacctgggccccagctgggtgtgcggcttcagcaacctggagagccaggtgctggagaagagagccagcgagctgcaccagagagacgtgctgctgaccgagctgagcaactgcaccgtgagactgtacggcaaccccaacaccctgagactgaccaaggcccacagctgcaagctgctgtgcggccccgtgagcaccagcgtgttcctggaggactgcagcgactgcgtgctggccgtggcctgccagcagctgagaatccacagcaccaaggacaccagaatcttcctgcaggtgaccagcagagccatcgtggaggactgcagcggcatccagttcgccccctacacctggagctaccccgagatcgacaaggacttcgagagcagcggcctggacagaagcaagaacaactggaacgacgtggacgacttcaactggctggccagagacatggccagccccaactggagcatcctgcccgaggaggagagaaacatccagtgggactag

SEQ ID NO: 9304 - DNA, 747 bp, Homo sapiens
atgacccccaagggccccgccatgtgcagcatgcccctgaccagcgccgactgcttcagcaacgacatccacaagctggacaccagcaccatgacctggaccctgatctgcaccaagggcagccccgccagatggagagacttccacagcgccaccatgctgggcagccacatgtacgtgttcggcggcagagccgacagattcggccccttccacagcaacaacgagatctactgcaacagaatcagagtgttcgacaccagaaccgaggcctggctggactgcccccccacccccgtgctgcccgagggcagaagaagccacagcgccttcggctacaacggcgagctgtacatcttcggcggctacaacgccagactgaacagacacttccacgacctgtggaagttcaaccccgtgagcttcacctggaagaagatcgagcccaagggcaagggcccctgccccagaagaagacagtgctgctgcatcgtgggcgacaagatcgtgctgttcggcggcaccagccccagccccgaggagggcctgggcgacgagttcgacctgatcgaccacagcgacctgcacatcctggacttcagccccagcctgaagaccctgtgcaagctggccgtgatccagtacaacctggaccagagctgcctgccccacgacatcagatgggagctgaacgccatgaccaccaacagcaacatcagcagacccatcgtgagcagccacggctag

SEQ ID NO: 9305 - DNA, 1401 bp, Homo sapiens
atggagtacgagagctactacttcgtgaagttccagaagtaccccaagatcgtgaagaagagcagcgacaccgccgagaacaacctgccccagagaagcagaggcaagaccagaagaatgatgaacgacagctgccagaacctgcccaagatcaaccagcagagacccagaagcaagaccaccgccggcaagaccggcgacaccaagagcctgaacaaggagcaccccaaccaggaggtggtggacaacaccagactggagagcgccaacttcggcctgcacatcagcagaatcagaaaggacagcggcgaggagaacgcccaccccagaagaggccagatcatcgacttccagggcctgctgaccgacgccatcaagggcgccaccagcgagctggccctgaacaccttcgaccacaaccccgaccccagcgagagactgctgaagcccctgagcgccttcatcggcatgaacagcgagatgagagagctggccgccgtggtgagcagagacatctacctgcacaaccccaacatcaagtggaacgacatcatcggcctggacgccgccaagcagctggtgaaggaggccgtggtgtaccccatcagatacccccagctgttcaccggcatcctgagcccctggaagggcctgctgctgtacggcccccccggcaccggcaagaccctgctggccaaggccgtggccaccgagtgcaagaccaccttcttcaacatcagcgccagcaccatcgtgagcaagtggagaggcgacagcgagaagctggtgagagtgctgttcgagctggccagataccacgcccccagcaccatcttcctggacgagctggagagcgtgatgagccagagaggcaccgccagcggcggcgagcacgagggcagcctgagaatgaagaccgagctgctggtgcagatggacggcctggccagaagcgaggacctggtgttcgtgctggccgccagcaacctgccctgggagctggactgcgccatgctgagaagactggagaagagaatcctggtggacctgcccagcagagaggccagacaggccatgatctaccactggctgccccccgtgagcaagagcagagccctggagctgcacaccgagctggagtacagcgtgctgagccaggagaccgagggctacagcggcagcgacatcaagctggtgtgcagagaggccgccatgagacccgtgagaaagatcttcgacgccctggagaaccaccagagcgagagcagcgacctgcccagaatccagctggacatcgtgaccaccgccgacttcctggacgtgctgacccacaccaagcccagcgccaagaacctggcccagagatacagcgactggcagagagagttcgagagcgtgtag

SEQ ID NO: 9306 - DNA, 6402 bp, Homo sapiens
atggacgaggtggagcaggaccagcacgaggccagactgaaggagctgttcgacagcttcgacaccaccggcaccggcagcctgggccaggaggagctgaccgacctgtgccacatgctgagcctggaggaggtggcccccgtgctgcagcagaccctgctgcaggacaacctgctgggcagagtgcacttcgaccagttcaaggaggccctgatcctgatcctgagcagaaccctgagcaacgaggagcacttccaggagcccgactgcagcctggaggcccagcccaagtacgtgagaggcggcaagagatacggcagaagaagcctgcccgagttccaggagagcgtggaggagttccccgaggtgaccgtgatcgagcccctggacgaggaggccagacccagccacatccccgccggcgactgcagcgagcactggaagacccagagaagcgaggagtacgaggccgagggccagctgagattctggaaccccgacgacctgaacgccagccagagcggcagcagccccccccaggactggatcgaggagaagctgcaggaggtgtgcgaggacctgggcatcaccagagacggccacctgaacagaaagaagctggtgagcatctgcgagcagtacggcctgcagaacgtggacggcgagatgctggaggaggtgttccacaacctggaccccgacggcaccatgagcgtggaggacttcttctacggcctgttcaagaacggcaagagcctgacccccagcgccagcaccccctacagacagctgaagagacacctgagcatgcagagcttcgacgagagcggcagaagaaccaccaccagcagcgccatgaccagcaccatcggcttcagagtgttcagctgcctggacgacggcatgggccacgccagcgtggagagaatcctggacacctggcaggaggagggcatcgagaacagccaggagatcctgaaggccctggacttcagcctggacggcaacatcaacctgaccgagctgaccctggccctggagaacgagctgctggtgaccaagaacagcatccaccaggccgccctggccagcttcaaggccgagatcagacacctgctggagagagtggaccaggtggtgagagagaaggagaagctgagaagcgacctggacaaggccgagaagctgaagagcctgatggccagcgaggtggacgaccaccacgccgccatcgagagaagaaacgagtacaacctgagaaagctggacgaggagtacaaggagagaatcgccgccctgaagaacgagctgagaaaggagagagagcagatcctgcagcaggccggcaagcagagactggagctggagcaggagatcgagaaggccaagaccgaggagaactacatcagagacagactggccctgagcctgaaggagaacagcagactggagaacgagctgctggagaacgccgagaagctggccgagtacgagaacctgaccaacaagctgcagagaaacctggagaacgtgctggccgagaagttcggcgacctggaccccagcagcgccgagttcttcctgcaggaggagagactgacccagatgagaaacgagtacgagagacagtgcagagtgctgcaggaccaggtggacgagctgcagagcgagctggaggagtacagagcccagggcagagtgctgagactgcccctgaagaacagccccagcgaggaggtggaggccaacagcggcggcatcgagcccgagcacggcctgggcagcgaggagtgcaaccccctgaacatgagcatcgaggccgagctggtgatcgagcagatgaaggagcagcaccacagagacatctgctgcctgagactggagctggaggacaaggtgagacactacgagaagcagctggacgagaccgtggtgagctgcaagaaggcccaggagaacatgaagcagagacacgagaacgagacccacaccctggagaagcagatcagcgacctgaagaacgagatcgccgagctgcagggccaggccgccgtgctgaaggaggcccaccacgaggccacctgcagacacgaggaggagaagaagcagctgcaggtgaagctggaggaggagaagacccacctgcaggagaagctgagactgcagcacgagatggagctgaaggccagactgacccaggcccaggccagcttcgagagagagagagagggcctgcagagcagcgcctggaccgaggagaaggtgagaggcctgacccaggagctggagcagttccaccaggagcagctgaccagcctggtggagaagcacaccctggagaaggaggagctgagaaaggagctgctggagaagcaccagagagagctgcaggagggcagagagaagatggagaccgagtgcaacagaagaaccagccagatcgaggcccagttccagagcgactgccagaaggtgaccgagagatgcgagagcgccctgcagagcctggagggcagatacagacaggagctgaaggacctgcaggagcagcagagagaggagaagagccagtgggagttcgagaaggacgagctgacccaggagtgcgccgaggcccaggagctgctgaaggagaccctgaagagagagaagaccaccagcctggtgctgacccaggagagagagatgctggagaagacctacaaggagcacctgaacagcatggtggtggagagacagcagctgctgcaggacctggaggacctgagaaacgtgagcgagacccagcagagcctgctgagcgaccagatcctggagctgaagagcagccacaagagagagctgagagagagagaggaggtgctgtgccaggccggcgccagcgagcagctggccagccagagactggagagactggagatggagcacgaccaggagagacaggagatgatgagcaagctgctggccatggagaacatccacaaggccacctgcgagaccgccgacagagagagagccgagatgagcaccgagatcagcagactgcagagcaagatcaaggagatgcagcaggccaccagccccctgagcatgctgcagagcggctgccaggtgatcggcgaggaggaggtggagggcgacggcgccctgagcctgctgcagcagggcgagcagctgctggaggagaacggcgacgtgctgctgagcctgcagagagcccacgagcaggccgtgaaggagaacgtgaagatggccaccgagatcagcagactgcagcagagactgcagaagctggagcccggcctggtgatgagcagctgcctggacgagcccgccaccgagttcttcggcaacaccgccgagcagaccgagcagttcctgcagcagaacagaaccaagcaggtggagggcgtgaccagaagacacgtgctgagcgacctggaggacgacgaggtgagagacctgggcagcaccggcaccagcagcgtgcagagacaggaggtgaagatcgaggagagcgaggccagcgtggagggcttcagcgagctggagaacagcgaggagaccagaaccgagagctgggagctgaagaaccagatcagccagctgcaggagcagctgatgatgctgtgcgccgactgcgacagagccagcgagaagaagcaggacctgctgttcgacgtgagcgtgctgaagaagaagctgaagatgctggagagaatccccgaggccagccccaagtacaagctgctgtacgaggacgtgagcagagagaacgactgcctgcaggaggagctgagaatgatggagaccagatacgacgaggccctggagaacaacaaggagctgaccgccgaggtgttcagactgcaggacgagctgaagaagatggaggaggtgaccgagaccttcctgagcctggagaagagctacgacgaggtgaagatcgagaacgagggcctgaacgtgctggtgctgagactgcagggcaagatcgagaagctgcaggagagcgtggtgcagagatgcgactgctgcctgtgggaggccagcctggagaacctggagatcgagcccgacggcaacatcctgcagctgaaccagaccctggaggagtgcgtgcccagagtgagaagcgtgcaccacgtgatcgaggagtgcaagcaggagaaccagtacctggagggcaacacccagctgctggagaaggtgaaggcccacgagatcgcctggctgcacggcaccatccagacccaccaggagagacccagagtgcagaaccaggtgatcctggaggagaacaccaccctgctgggcttccaggacaagcacttccagcaccaggccaccatcgccgagctggagctggagaagaccaagctgcaggagctgaccagaaagctgaaggagagagtgaccatcctggtgaagcagaaggacgtgctgagccacggcgagaaggaggaggagctgaaggccatgatgcacgacctgcagatcacctgcagcgagatgcagcagaaggtggagctgctgagatacgagagcgagaagctgcagcaggagaacagcatcctgagaaacgagatcaccaccctgaacgaggaggacagcatcagcaacctgaagctgggcaccctgaacggcagccaggaggagatgtggcagaagaccgagaccgtgaagcaggagaacgccgccgtgcagaagatggtggagaacctgaagaagcagatcagcgagctgaagatcaagaaccagcagctggacctggagaacaccgagctgagccagaagaacagccagaaccaggagaagctgcaggagctgaaccagagactgaccgagatgctgtgccagaaggagaaggagcccggcaacagcgccctggaggagagagagcaggagaagttcaacctgaaggaggagctggagagatgcaaggtgcagagcagcaccctggtgagcagcctggaggccgagctgagcgaggtgaagatccagacccacatcgtgcagcaggagaaccacctgctgaaggacgagctggagaagatgaagcagctgcacagatgccccgacctgagcgacttccagcagaagatcagcagcgtgctgagctacaacgagaagctgctgaaggagaaggaggccctgagcgaggagctgaacagctgcgtggacaagctggccaagagcagcctgctggagcacagaatcgccaccatgaagcaggagcagaagagctgggagcaccagagcgccagcctgaagagccagctggtggccagccaggagaaggtgcagaacctggaggacaccgtgcagaacgtgaacctgcagatgagcagaatgaagagcgacctgagagtgacccagcaggagaaggaggccctgaagcaggaggtgatgagcctgcacaagcagctgcagaacgccggcggcaagagctgggcccccgagatcgccacccaccccagcggcctgcacaaccagcagaagagactgagctgggacaagctggaccacctgatgaacgaggagcagcagctgctgtggcaggagaacgagagactgcagaccatggtgcagaacaccaaggccgagctgacccacagcagagagaaggtgagacagctggagagcaacctgctgcccaagcaccagaagcacctgaaccccagcggcaccatgaaccccaccgagcaggagaagctgagcctgaagagagagtgcgaccagttccagaaggagcagagccccgccaacagaaaggtgagccagatgaacagcctggagcaggagctggagaccatccacctggagaacgagggcctgaagaagaagcaggtgaagctggacgagcagctgatggagatgcagcacctgagaagcaccgccacccccagccccagcccccacgcctgggacctgcagctgctgcagcagcaggcctgccccatggtgcccagagagcagttcctgcagctgcagagacagctgctgcaggccgagagaatcaaccagcacctgcaggaggagctggagaacagaaccagcgagaccaacaccccccagggcaaccaggagcagctggtgaccgtgatggaggagagaatgatcgaggtggagcagaagctgaagctggtgaagagactgctgcaggagaaggtgaaccagctgaaggagcagctgtgcaagaacaccaaggccgacgccatggtgaaggacctgtacgtggagaacgcccagctgctgaaggccctggaggtgaccgagcagagacagaagaccgccgagaagaagaactacctgctggaggagaagatcgccagcctgagcaacatcgtgagaaacctgacccccgcccccctgaccagcaccccccccctgagaagctag

SEQ ID NO: 9307 - DNA, 1713 bp, Homo sapiens
atggccggcggcgccagagaggtgctgaccctgcagctgggccacttcgccggcttcgtgggcgcccactggtggaaccagcaggacgccgccctgggcagagccaccgacagcaaggagccccccggcgagctgtgccccgacgtgctgtacagaaccggcagaaccctgcacggccaggagacctacacccccagactgatcctgatggacctgaagggcagcctgagcagcctgaaggaggagggcggcctgtacagagacaagcagctggacgccgccatcgcctggcagggcaagctgaccacccacaaggaggagctgtaccccaagaacccctacctgcaggacttcctgagcgccgagggcgtgctgagcagcgacggcgtgtggagagtgaagagcatccccaacggcaagggcagcagccccctgcccaccgccaccacccccaagcccctgatccccaccgaggccagcatcagagtgtggagcgacttcctgagagtgcacctgcaccccagaagcatctgcatgatccagaagtacaaccacgacggcgaggccggcagactggaggccttcggccagggcgagagcgtgctgaaggagcccaagtaccaggaggagctggaggacagactgcacttctacgtggaggagtgcgactacctgcagggcttccagatcctgtgcgacctgcacgacggcttcagcggcgtgggcgccaaggccgccgagctgctgcaggacgagtacagcggcagaggcatcatcacctggggcctgctgcccggcccctaccacagaggcgaggcccagagaaacatctacagactgctgaacaccgccttcggcctggtgcacctgaccgcccacagcagcctggtgtgccccctgagcctgggcggcagcctgggcctgagacccgagccccccgtgagcttcccctacctgcactacgacgccaccctgcccttccactgcagcgccatcctggccaccgccctggacaccgtgaccgtgccctacagactgtgcagcagccccgtgagcatggtgcacctggccgacatgctgagcttctgcggcaagaaggtggtgaccgccggcgccatcatccccttccccctggcccccggccagagcctgcccgacagcctgatgcagttcggcggcgccaccccctggacccccctgagcgcctgcggcgagcccagcggcaccagatgcttcgcccagagcgtggtgctgagaggcatcgacagagcctgccacaccagccagctgacccccggcacccccccccccagcgccctgcacgcctgcaccaccggcgaggagatcctggcccagtacctgcagcagcagcagcccggcgtgatgagcagcagccacctgctgctgaccccctgcagagtggcccccccctacccccacctgttcagcagctgcagcccccccggcatggtgctggacggcagccccaagggcgccgccgtggagagcatccccgtgttcggcgccctgtgcagcagcagcagcctgcaccagaccctggaggccctggccagagacctgaccaagctggacctgagaagatgggccagcttcatggacgccggcgtggagcacgacgacgtggccgagctgctgcaggagctgcagagcctggcccagtgctaccagggcggcgacagcctggtggactag

SEQ ID NO: 9308 - DNA, 1791 bp, Homo sapiens
atgaacagaacctggcccagaagaatctggggcagcagccaggacgaggccgagctgatcagagaggacatccagggcgccctgcacaactacagaagcggcagaggcgagagaagagccgccgccctgagagccacccaggaggagctgcagagagacagaagccccgccgccgagaccccccccctgcagagaagacccagcgtgagagccgtgatcagcaccgtggagagaggcgccggcagaggcagaccccaggccaagcccatccccgaggccgaggaggcccagagacccgagcccgtgggcaccagcagcaacgccgacagcgccagccccgacctgggccccagaggccccgacctggccgtgctgcaggccgagagagaggtggacatcctgaaccacgtgttcgacgacgtggagagcttcgtgagcagactgcagaagagcgccgaggccgccagagtgctggagcacagagagagaggcagaagaagcagaagaagagccgccggcgagggcctgctgaccctgagagccaagccccccagcgaggccgagtacaccgacgtgctgcagaagatcaagtacgccttcagcctgctggccagactgagaggcaacatcgccgaccccagcagccccgagctgctgcacttcctgttcggccccctgcagatgatcgtgaacaccagcggcggccccgagttcgccagcagcgtgagaagaccccacctgaccagcgacgccgtggccctgctgagagacaacgtgacccccagagagaacgagctgtggaccagcctgggcgacagctggaccagacccggcctggagctgagccccgaggagggccccccctacagacccgagttcttcagcggctgggagccccccgtgaccgacccccagagcagagcctgggaggaccccgtggagaagcagctgcagcacgagagaagaagaagacagcagagcgccccccaggtggccgtgaacggccacagagacctggagcccgagagcgagccccagctggagagcgagaccgccggcaagtgggtgctgtgcaactacgacttccaggccagaaacagcagcgagctgagcgtgaagcagagagacgtgctggaggtgctggacgacagcagaaagtggtggaaggtgagagaccccgccggccaggagggctacgtgccctacaacatcctgaccccctaccccggccccagactgcaccacagccagagccccgccagaagcctgaacagcacccccccccccccccccgcccccgcccccgcccccccccccgccctggccagacccagatgggacagacccagatgggacagctgcgacagcctgaacggcctggaccccagcgagaaggagaagttcagccagatgctgatcgtgaacgaggagctgcaggccagactggcccagggcagaagcggccccagcagagccgtgcccggccccagagcccccgagccccagctgagccccggcagcgacgccagcgaggtgagagcctggctgcaggccaagggcttcagcagcggcaccgtggacgccctgggcgtgctgaccggcgcccagctgttcagcctgcagaaggaggagctgagagccgtgagccccgaggagggcgccagagtgtacagccaggtgaccgtgcagagaagcctgctggaggacaaggagaaggtgagcgagctggaggccgtgatggagaagcagaagaagaaggtggagggcgaggtggagatggaggtgatctag

SEQ ID NO: 9309 - DNA, 1950 bp, Homo sapiens
atgagcagcttcggcgccggcaagaccaaggaggtgatcttcagcgtggaggacggcagcgtgaagatgttcctgagaggcagacccgtgcccatgatgatccccgacgagctggcccccacctacagcctggacaccagaagcgagctgcccagctgcagactgaagctggagtgggtgtacggctacagaggcagagactgcagagccaacctgtacctgctgcccaccggcgagatcgtgtacttcgtggccagcgtggccgtgctgtacagcgtggaggagcagagacagagacactacctgggccacaacgacgacatcaagtgcctggccatccaccccgacatggtgaccatcgccaccggccaggtggccggcaccaccaaggagggcaagcccctgcccccccacgtgagaatctgggacagcgtgagcctgagcaccctgcacgtgctgggcctgggcgtgttcgacagagccgtgtgctgcgtgggcttcagcaagagcaacggcggcaacctgctgtgcgccgtggacgagagcaacgaccacatgctgagcgtgtgggactgggccaaggagaccaaggtggtggacgtgaagtgcagcaacgaggccgtgctggtggccaccttccaccccaccgaccccaccgtgctgatcacctgcggcaagagccacatctacttctggaccctggagggcggcagcctgagcaagagacagggcctgttcgagaagcacgagaagcccaagtacgtgctgtgcgtgaccttcctggagggcggcgacgtggtgaccggcgacagcggcggcaacctgtacgtgtggggcaagggcggcaacagaatcacccaggccgtgctgggcgcccacgacggcggcgtgttcggcctgtgcgccctgagagacggcaccctggtgagcggcggcggcagagacagaagagtggtgctgtggggcagcgactacagcaagctgcaggaggtggaggtgcccgaggacttcggccccgtgagaaccgtggccgagggccacggcgacaccctgtacgtgggcaccaccagaaacagcatcctgcagggcagcgtgcacaccggcttcagcctgctggtgcagggccacgtggaggagctgtggggcctggccacccaccccagcagagcccagttcgtgacctgcggccaggacaagctggtgcacctgtggagcagcgacagccaccagcccctgtggagcagaatcatcgaggaccccgccagaagcgccggcttccaccccagcggcagcgtgctggccgtgggcaccgtgaccggcagatggctgctgctggacaccgagacccacgacctggtggccatccacaccgacggcaacgagcagatcagcgtggtgagcttcagccccgacggcgcctacctggccgtgggcagccacgacaacctggtgtacgtgtacaccgtggaccagggcggcagaaaggtgagcagactgggcaagtgcagcggccacagcagcttcatcacccacctggactgggcccaggacagcagctgcttcgtgaccaacagcggcgactacgagatcctgtactgggaccccgccacctgcaagcagatcaccagcgccgacgccgtgagaaacatggagtgggccaccgccacctgcgtgctgggcttcggcgtgttcggcatctggagcgagggcgccgacggcaccgacatcaacgccgtggccagaagccacgacggcaagctgctggccagcgccgacgacttcggcaaggtgcacctgttcagctacccctgctgccagcccagagccctgagccacaagtacggcggccacagcagccacgtgaccaacgtggccttcctgtgggacgacagcatggccctgaccaccggcggcaaggacaccagcgtgctgcagtggagagtggtgtag

SEQ ID NO: 9310 - DNA, 792 bp, Homo sapiens
atggccggcctggaggtgctgttcgccagcgccgcccccgccatcacctgcagacaggacgccctggtgtgcttcctgcactgggaggtggtgacccacggctacttcggcctgggcgtgggcgaccagcccggccccaacgacaagaagagcgagctgctgcccgccggctggaacaacaacaaggacctgtacgtgctgagatacgagtacaaggacggcagcagaaagctgctggtgaaggccatcaccgtggagagcagcatgatcctgaacgtgctggagtacggcagccagcaggtggccgacctgaccctgaacctggacgactacatcgacgccgagcacctgggcgacttccacagaacctacaagaacagcgaggagctgagaagcagaatcgtgagcggcatcatcacccccatccacgagcagtgggagaaggccaacgtgagcagcccccacagagagttcccccccgccaccgccagagaggtggaccccctgagaatccccccccaccacccccacaccagcagacagcccccctggtgcgaccccctgggccccttcgtggtgggcggcgaggacctggaccccttcggccccagaagaggcggcatgatcgtggaccccctgagaagcggcttccccagagccctgatcgaccccagcagcggcctgcccaacagactgccccccggcgccgtgccccccggcgccagattcgaccccttcggccccatcggcaccagcccccccggccccagacccgacagaagaggccagtag

SEQ ID NO: 9311 - DNA, 273 bp, Homo sapiens
atggacaacatgagccccagactgagagccttcctgagcgagcccatcggcgagaaggacgtgtgctgggtggacggcatcagccacgagctggccatcaacctggtgaccaagggcatcaacaaggcctacatcctgctgggccagttcctgctgatgcacaagaacgaggccgagttccagagatggctgatctgctgcttcggcgccaccgagtgcgaggcccagcagaccagccactgcctgaaggagtggtgcgcctgcttcctgtag

SEQ ID NO: 9312 - DNA, 888 bp, Homo sapiens
atgcccgtgcacaccctgagccccggcgcccccagcgcccccgccctgccctgcagactgagaaccagagtgcccggctacctgctgagaggccccgccgacggcggcgccagaaagcccagcgccgtggagagactggaggccgacaaggccaagtacgtgaagagcctgcacgtggccaacaccagacaggagcccgtgcagcccctgctgagcaagcagcccctgttcagccccgagaccagaagaaccgtgctgacccccagcagaagagccctgcccggcccctgcagaagaccccagctggacctggacatcctgagcagcctgatcgacctgtgcgacagccccgtgagccccgccgaggccagcagaacccccggcagagccgagggcgccggcagacccccccccgccaccccccccagacccccccccagcaccagcgccgtgagaagagtggacgtgagacccctgcccgccagccccgccagaccctgccccagccccggccccgccgccgccagcagccccgccagaccccccggcctgcagagaagcaagagcgacctgagcgagagattcagcagagccgccgccgacctggagagattcttcaacttctgcggcctggaccccgaggaggccagaggcctgggcgtggcccacctggccagagccagcagcgacatcgtgagcctggccggccccagcgccggccccggcagcagcgagggcggctgcagcagaagaagcagcgtgaccgtggaggagagagccagagagagagtgccctacggcgtgagcgtggtggagagaaacgccagagtgatcaagtggctgtacggcctgagacaggccagagagagccccgccgccgagggctag

SEQ ID NO: 9313 - DNA, 582 bp, Homo sapiens
atgcccaccaccagcagacccgccctggacgtgaagggcggcaccagccccgccaaggaggacgccaaccaggagatgagcagcgtggcctacagcaacctggccgtgaaggacagaaaggccgtggccatcctgcactaccccggcgtggccagcaacggcaccaaggccagcggcgcccccaccagcagcagcggcagccccatcggcagccccaccaccaccccccccaccaagccccccagcttcaacctgcaccccgccccccacctgctggccagcatgcacctgcagaagctgaacagccagtaccagggcatggccgccgccacccccggccagcccggcgaggccggccccctgcagaactgggacttcggcgcccaggccggcggcgccgagagcctgagccccagcgccggcgcccagagccccgccatcatcgacagcgaccccgtggacgaggaggtgctgatgagcctggtggtggagctgggcctggacagagccaacgagctgcccgagctgtggctgggccagaacgagttcgacttcaccgccgacttccccagcagctgctag

SEQ ID NO: 9314 - DNA, 1077 bp, Homo sapiens
atggccgccgtgctgaagcccgtgctgctgggcctgagagacgcccccgtgcacggcagccccaccggccccggcgcctggaccgccagcaagctgggcggcatccccgacgccctgcccaccgtggccgcccccagacccgtgtgccagagatgcggccagcccctggccctggtggtgcaggtgtactgccccctggagggcagccccttccacagactgctgcacgtgttcgcctgcgcctgccccggctgcagcaccggcggcgccagaagctggaaggtgttcagaagccagtgcctgcaggtgcccgagagagaggcccaggacgcccagaagcagggcaacagcctggccgccgaggactggtgcgagggcgccgacgactggggcagcgacaccgaggagggccccagcccccagttcaccctggacttcggcaacgacgccagcagcgccaaggacgtggactggaccgccagactgcaggacctgagactgcaggacgccgtgctgggcgccgcccaccccgtgccccccggcctgcccctgttcctgccctactacatctgcgtggccgacgaggacgactacagagacttcgtgaacctggaccacgcccacagcctgctgagagactaccagcagagagagggcatcgccatggaccagctgctgagccagagcctgcccaacgacggcgacgagaagtacgagaagaccatcatcaagagcggcgaccagaccttctacaagttcatgaagagaatcgccgcctgccaggagcagatcctgagatacagctggagcggcgagcccctgttcctgacctgccccaccagcgaggtgaccgagctgcccgcctgcagccagtgcggcggccagagaatcttcgagttccagctgatgcccgccctggtgagcatgctgaagagcgccaacctgggcctgagcgtggagttcggcaccatcctggtgtacacctgcgagaagagctgctggccccccaaccaccagacccccatggaggagttctgcatcatccaggaggaccccgacgagctgctgttcaagtag

SEQ ID NO: 9315 - DNA, 1779 bp, Homo sapiens
atggccagcgtggtggtgaagaccatctggcagagcaaggagatccacgaggccggcgacacccccaccggcgtggagagctgcagccagctggtgcccgaggcccccagaagagtgaccagcagagccaagggcatccccaagaagaagaaggccgtgagcttccacggcgtggagccccagatgagccaccagcccatgcactggtgcctgaacctgaagagaagcagcgcctgcaccaacgtgagcctgctgaacctggccgccatggagcccaccgacagcaccggcaccgacagcaccgtggaggacctgagcggccagctgaccctggccggcccccccgccagccccaccctgccctgggaccccgacgacgccgacatcaccgagatcctgagcggcgtgaacagcggcctggtgagagccaaggacagcatcaccagcctgaaggagaagaccaacagagtgaaccagcacgtgcagagcctgcagagcgagtgcagcgtgctgagcgagaacctggagagaagaagacaggaggccgaggagctggagggctactgcatccagctgaaggagaactgctggaaggtgaccagaagcgtggaggacgccgagatcaagaccaacgtgctgaagcagaacagcgccctgctggaggagaagctgagatacctgcagcagcagctgcaggacgagacccccagaagacaggaggccgagctgcaggagcccgaggagaagcaggagcccgaggagaagcaggagcccgaggagaagcagaagcccgaggccggcctgagctggaacagcctgggccccgccgccaccagccagggctgccccggcccccccggcagccccgacaagcccagcagaccccacggcctggtgcccgccggctggggcatgggccccagagccggcgagggcccctacgtgagcgagcaggagctgcagaagctgttcaccggcatcgaggagctgagaagagaggtgagcagcctgaccgccagatggcaccaggaggagggcgccgtgcaggaggccctgagactgctgggcggcctgggcggcagagtggacggcttcctgggccagtgggagagagcccagagagagcaggcccagaccgccagagacctgcaggagctgagaggcagagccgacgagctgtgcaccatggtggagagaagcgccgtgagcgtggccagcctgagaagcgagctggagggcctgggccccctgaagcccatcctggaggagttcggcagacagttccagaacagcagaagaggccccgacctgagcatgaacctggacagaagccaccagggcaactgcgccagatgcgccagccagggcagccagctgagcaccgagagcctgcagcagctgctggacagagccctgaccagcctggtggacgaggtgaagcagagaggcctgacccccgcctgccccagctgccagagactgcacaagaagatcctggagctggagagacaggccctggccaagcacgtgagagccgaggccctgagcagcaccctgagactggcccaggacgaggccctgagagccaagaacctgctgctgaccgacaagatgaagcccgaggagaagatggccaccctggaccacctgcacctgaagatgtgcagcctgcacgaccacctgagcaacctgcccctggagggcagcaccggcaccatgggcggcggcagcagcgccggcaccccccccaagcagggcggcagcgcccccgagcagtag

SEQ ID NO: 9316 - DNA, 2541 bp, Homo sapiens
atgagcagcagccacttcgccagcagacacagaaaggacatcagcaccgagatgatcagaaccaagatcgcccacagaaagagcctgagccagaaggagaacagacacaaggagtacgagagaaacagacacttcggcctgaaggacgtgaacatccccaccctggagggcagaatcctggtggagctggacgagaccagccagggcctggtgcccgagaagaccaacgtgaagcccagagccatgaagaccatcctgggcgaccagagaaagcagatgctgcagaagtacaaggaggagaagcagctgcagaagctgaaggagcagagagagaaggccaagagaggcatcttcaaggtgggcagatacagacccgacatgccctgcttcctgctgagcaaccagaacgccgtgaaggccgagcccaagaaggccatccccagcagcgtgagaatcaccagaagcaaggccaaggaccagatggagcagaccaagatcgacaacgagagcgacgtgagagccatcagacccggccccagacagaccagcgagaagaaggtgagcgacaaggagaagaaggtggtgcagcccgtgatgcccaccagcctgagaatgaccagaagcgccacccaggccgccaagcaggtgcccagaaccgtgagcagcaccaccgccagaaagcccgtgaccagagccgccaacgagaacgagcccgagggcaaggtgcccagcaagggcagacccgccaagaacgtggagaccaagcccgacaagggcatcagctgcaaggtggacagcgaggagaacaccctgaacagccagaccaacgccaccagcggcatgaaccccgacggcgtgctgagcaagatggagaacctgcccgagatcaacaccgccaagatcaagggcaagaacagcttcgcccccaaggacttcatgttccagcccctggacggcctgaagacctaccaggtgacccccatgacccccagaagcgccaacgccttcctgacccccagctacacctggacccccctgaagaccgaggtggacgagagccaggccaccaaggagatcctggcccagaagtgcaagacctacagcaccaagaccatccagcaggacagcaacaagctgccctgccccctgggccccctgaccgtgtggcacgaggagcacgtgctgaacaagaacgaggccaccaccaagaacctgaacggcctgcccatcaaggaggtgcccagcctggagagaaacgagggcagaatcgcccagccccaccacggcgtgccctacttcagaaacatcctgcagagcgagaccgagaagctgaccagccactgcttcgagtgggacagaaagctggagctggacatccccgacgacgccaaggacctgatcagaaccgccgtgggccagaccagactgctgatgaaggagagattcaagcagttcgagggcctggtggacgactgcgagtacaagagaggcatcaaggagaccacctgcaccgacctggacggcttctgggacatggtgagcttccagatcgaggacgtgatccacaagttcaacaacctgatcaagctggaggagagcggctggcaggtgaacaacaacatgaaccacaacatgaacaagaacgtgttcagaaagaaggtggtgagcggcatcgccagcaagcccaagcaggacgacgccggcagaatcgccgccagaaacagactggccgccatcaagaacgccatgagagagagaatcagacaggaggagtgcgccgagaccgccgtgagcgtgatccccaaggaggtggacaagatcgtgttcgacgccggcttcttcagagtggagagccccgtgaagctgttcagcggcctgagcgtgagcagcgagggccccagccagagactgggcacccccaagagcgtgaacaaggccgtgagccagagcagaaacgagatgggcatcccccagcagaccaccagccccgagaacgccggcccccagaacaccaagagcgagcacgtgaagaagaccctgttcctgagcatccccgagagcagaagcagcatcgaggacgcccagtgccccggcctgcccgacctgatcgaggagaaccacgtggtgaacaagaccgacctgaaggtggactgcctgagcagcgagagaatgagcctgcccctgctggccggcggcgtggccgacgacatcaacaccaacaagaaggagggcatcagcgacgtggtggagggcatggagctgaacagcagcatcaccagccaggacgtgctgatgagcagccccgagaagaacaccgccagccagaacagcatcctggaggagggcgagaccaagatcagccagagcgagctgttcgacaacaagagcctgaccaccgagtgccacctgctggacagccccggcctgaactgcagcaaccccttcacccagctggagagaagacaccaggagcacgccagacacatcagcttcggcggcaacctgatcaccttcagccccctgcagcccggcgagttctag

SEQ ID NO: 9317 - DNA, 1128 bp, Homo sapiens
atggccagcgccccctggcccgagagagtgcccagactgctggcccccagactgcccagctaccccccccccccccccaccgtgggcctgagaagcatggagcaggaggagacctacctggagctgtacctggaccagtgcgccgcccaggacggcctggccccccccagaagccccctgttcagccccgtggtgccctacgacatgtacatcctgaacgccagcaaccccgacaccgccttcaacagcaaccccgaggtgaaggagaccagcggcgacttcagcagcgtggacctgagcttcctgcccgacgaggtgacccaggagaacaaggaccagcccgtgatcagcaagcacgagaccgaggagaacagcgagagccagagcccccagagcagactgcccagccccagcgagcaggacgtgggcctgggcctgaacagcagcagcctgagcaacagccacagccagctgcaccccggcgacaccgacagcgtgcagcccagccccgagaagcccaacagcgacagcctgagcctggccagcatcacccccatgacccccatgacccccatcagcgagtgctgcggcatcgtgccccagctgcagaacatcgtgagcaccgtgaacctggcctgcaagctggacctgaagaagatcgccctgcacgccaagaacgccgagtacaaccccaagagattcgccgccgtgatcatgagaatcagagagcccagaaccaccgccctgatcttcagcagcggcaagatggtgtgcaccggcgccaagagcgaggagcagagcagactggccgccagaaagtacgccagagtggtgcagaagctgggcttccccgccagattcctggacttcaagatccagaacatggtgggcagctgcgacgtgagattccccatcagactggagggcctggtgctgacccaccagcagttcagcagctacgagcccgagctgttccccggcctgatctacagaatggtgaagcccagaatcgtgctgctgatcttcgtgagcggcaaggtggtgctgaccggcgccaaggagagaagcgagatctacgaggccttcgagaacatctaccccatcctgaagggcttcaagaaggcctag

SEQ ID NO: 9318 - DNA, 633 bp, Homo sapiens
atgcaggccgagggccagggcaccggcggcagcaccggcgacgccgacggccccggcggccccggcatccccgacggccccggcggcaacgccggcggccccggcgaggccggcgccaccggcggcagaggccccagaggcgccggcgccgccagagccagcggccccagaggcggcgcccccagaggcccccacggcggcgccgccagcgcccaggacggcagatgcccctgcggcgccagaagacccgacagcagactgctgcagctgcacatcaccatgcccttcagcagccccatggaggccgagctggtgagaagaatcctgagcagagacgccgcccccctgcccagacccggcgccgtgctgaaggacttcaccgtgagcggcaacctgctgttcatgagcgtgagagaccaggacagagagggcgccggcagaatgagagtggtgggctggggcctgggcagcgccagccccgagggccagaaggccagagacctgagaacccccaagcacaaggtgagcgagcagagacccggcacccccggcccccccccccccgagggcgcccagggcgacggctgcagaggcgtggccttcaacgtgatgttcagcgccccccacatctag

SEQ ID NO: 9319 - DNA, 582 bp, Homo sapiens
atggtggtgctgagagccggcaagaagaccttcctgccccccctgtgcagagccttcgcctgcagaggctgccagctggcccccgagagaggcgccgagagaagagacaccgcccccagcggcgtgagcagattctgcccccccagaaagagctgccacgactggatcggcccccccgacaagtacagcaacctgagacccgtgcacttctacatccccgagaacgagagccccctggagcagaagctgagaaagctgagacaggagacccaggagtggaaccagcagttctgggccaaccagaacctgaccttcagcaaggagaaggaggagttcatccacagcagactgaagaccaagggcctgggcctgagaaccgagagcggccagaaggccaccctgaacgccgaggagatggccgacttctacaaggagttcctgagcaagaacttccagaagcacatgtactacaacagagactggtacaagagaaacttcgccatcaccttcttcatgggcaaggtggccctggagagaatctggaacaagctgaagcagaagcagaagaagagaagcaactag

SEQ ID NO: 9320 - DNA, 1383 bp, Homo sapiens
atggccaacgaccccctggagggcttccacgaggtgaacctggccagccccaccagccccgacctgctgggcgtgtacgagagcggcacccaggagcagaccaccagccccagcgtgatctacagaccccaccccagcgccctgagcagcgtgcccatccaggccaacgccctggacgtgagcgagctgcccacccagcccgtgtacagcagccccagaagactgaactgcgccgagatcagcagcatcagcttccacgtgaccgaccccgccccctgcagcaccagcggcgtgaccgccggcctgaccaagctgaccaccagaaaggacaactacaacgccgagagagagttcctgcagggcgccaccatcaccgaggcctgcgacggcagcgacgacatcttcggcctgagcaccgacagcctgagcagactgagaagccccagcgtgctggaggtgagagagaagggctacgagagactgaaggaggagctggccaaggcccagagagagctgaagctgaaggacgaggagtgcgagagactgagcaaggtgagagaccagctgggccaggagctggaggagctgaccgccagcctgttcgaggaggcccacaagatggtgagagaggccaacatcaagcaggccaccgccgagaagcagctgaaggaggcccagggcaagatcgacgtgctgcaggccgaggtggccgccctgaagaccctggtgctgagcagcagccccaccagccccacccaggagcccctgcccggcggcaagacccccttcaagaagggccacaccagaaacaagagcaccagcagcgccatgagcggcagccaccaggacctgagcgtgatccagcccatcgtgaaggactgcaaggaggccgacctgagcctgtacaacgagttcagactgtggaaggacgagcccaccatggacagaacctgccccttcctggacaagatctaccaggaggacatcttcccctgcctgaccttcagcaagagcgagctggccagcgccgtgctggaggccgtggagaacaacaccctgagcatcgagcccgtgggcctgcagcccatcagattcgtgaaggccagcgccgtggagtgcggcggccccaagaagtgcgccctgaccggccagagcaagagctgcaagcacagaatcaagctgggcgacagcagcaactactactacatcagccccttctgcagatacagaatcaccagcgtgtgcaacttcttcacctacatcagatacatccagcagggcctggtgaagcagcaggacgtggaccagatgttctgggaggtgatgcagctgagaaaggagatgagcctggccaagctgggctacttcaaggaggagctgtag

SEQ ID NO: 9321 - DNA, 981 bp, Homo sapiens
atggccaccctggtggagctgcccgacagcgtgctgctggagatcttcagctacctgcccgtgagagacagaatcagaatcagcagagtgtgccacagatggaagagactggtggacgacagatggctgtggagacacgtggacctgaccctgtacaccatgagacccaaggtgatgtggcacctgctgagaagatacatggccagcagactgcacagcctgagaatgggcggctacctgttcagcggcagccaggccccccagctgagccccgccctgctgagagccctgggccagaagtgccccaacctgaagagactgtgcctgcacgtggccgacctgagcatggtgcccatcaccagcctgcccagcaccctgagaaccctggagctgcacagctgcgagatcagcatggcctggctgcacaagcagcaggaccccaccgtgctgcccctgctggagtgcatcgtgctggacagagtgcccgccttcagagacgagcacctgcagggcctgaccagattcagagccctgagaagcctggtgctgggcggcacctacagagtgaccgagaccggcctggacgccggcctgcaggagctgagctacctgcagagactggaggtgctgggctgcaccctgagcgccgacagcaccctgctggccatcagcagacacctgagagacgtgagaaagatcagactgaccgtgagaggcctgagcgcccccggcctggccgtgctggagggcatgcccgccctggagagcctgtgcctgcagggccccctggtgacccccgagatgcccagccccaccgagatcctgagcagctgcctgaccatgcccaagctgagagtgctggagctgcagggcctgggctgggagggccaggaggccgagaagatcctgtgcaagggcctgccccactgcatggtgatcgtgagagcctgccccaaggagagcatggactggtggatgtag

SEQ ID NO: 9322 - DNA, 3090 bp, Homo sapiens
atggccagcgaggccgtgaaggtggtggtgagatgcagacccatgaaccagagagagagagagctgagatgccagcccgtggtgaccgtggactgcgccagagcccagtgctgcatccagaaccccggcgccgccgacgagccccccaagcagttcaccttcgacggcgcctaccacgtggaccacgtgaccgagcagatctacaacgagatcgcctaccccctggtggagggcgtgaccgagggctacaacggcaccatcttcgcctacggccagaccggcagcggcaagagcttcaccatgcagggcctgcccgacccccccagccagagaggcatcatccccagagccttcgagcacgtgttcgagagcgtgcagtgcgccgagaacaccaagttcctggtgagagccagctacctggagatctacaacgaggacgtgagagacctgctgggcgccgacaccaagcagaagctggagctgaaggagcaccccgagaagggcgtgtacgtgaagggcctgagcatgcacaccgtgcacagcgtggcccagtgcgagcacatcatggagaccggctggaagaacagaagcgtgggctacaccctgatgaacaaggacagcagcagaagccacagcatcttcaccatcagcatcgagatgagcgccgtggacgagagaggcaaggaccacctgagagccggcaagctgaacctggtggacctggccggcagcgagagacagagcaagaccggcgccaccggcgagagactgaaggaggccaccaagatcaacctgagcctgagcgccctgggcaacgtgatcagcgccctggtggacggcagatgcaagcacgtgccctacagagacagcaagctgaccagactgctgcaggacagcctgggcggcaacaccaagaccctgatggtggcctgcctgagccccgccgacaacaactacgacgagaccctgagcaccctgagatacgccaacagagccaagaacatcagaaacaagcccagaatcaacgaggaccccaaggacgccctgctgagagagtaccaggaggagatcaagaagctgaaggccatcctgacccagcagatgagccccagcagcctgagcgccctgctgagcagacaggtgccccccgaccccgtgcaggtggaggagaagctgctgccccagcccgtgatccagcacgacgtggaggccgagaagcagctgatcagagaggagtacgaggagagactggccagactgaaggccgactacaaggccgagcaggagagcagagccagactggaggaggacatcaccgccatgagaaacagctacgacgtgagactgagcaccctggaggagaacctgagaaaggagaccgaggccgtgctgcaggtgggcgtgctgtacaaggccgaggtgatgagcagagccgagttcgccagcagcgccgagtacccccccgccttccagtacgagaccgtggtgaagcccaaggtgttcagcaccaccgacaccctgcccagcgacgacgtgagcaagacccaggtgagcagcagattcgccgagctgcccaaggtggagcccagcaagagcgagatcagcctgggcagcagcgagagcagcagcctggaggagaccagcgtgagcgaggccttccccggccccgaggagcccagcaacgtggaggtgagcatgcccaccgaggagagcagaagcagatacttcctggacgagtgcctgggccaggaggccgccggccacctgctgggcgagcagaactacctgccccaggaggagccccaggaggtgcccctgcagggcctgctgggcctgcaggaccccttcgccgaggtggaggccaagctggccagactgagcagcaccgtggccagaaccgacgccccccaggccgacgtgcccaaggtgcccgtgcaggtgcccgcccccaccgacctgctggagcccagcgacgccagacccgaggccgaggccgccgacgacttcccccccagacccgaggtggacctggccagcgaggtggccctggaggtggtgagaaccgccgagcccggcgtgtggctggaggcccaggcccccgtggccctggtggcccagcccgagcccctgcccgccaccgccggcgtgaagagagagagcgtgggcatggaggtggccgtgctgaccgacgaccccctgcccgtggtggaccagcagcaggtgctggccagactgcagctgctggagcagcaggtggtgggcggcgagcaggccaagaacaaggacctgaaggagaagcacaagagaagaaagagatacgccgacgagagaagaaagcagctggtggccgccctgcagaacagcgacgaggacagcggcgactgggtgctgctgaacgtgtacgacagcatccaggaggaggtgagagccaagagcaagctgctggagaagatgcagagaaagctgagagccgccgaggtggagatcaaggacctgcagagcgagttccagctggagaagatcgactacctggccaccatcagaagacaggagagagacagcatgctgctgcagcagctgctggagcaggtgcagcccctgatcagaagagactgcaactacagcaacctggagaagatcctgagagagagctgctgggacgaggacaacggcttctggaagatcccccaccccgtgatcaccaagaccagcctgcccgtggccgtgagcaccggcccccagaacaagcccgccagaaagaccagcgccgccgacaacggcgagcccaacatggaggacgacagatacagactgatgctgagcagaagcaacagcgagaacatcgccagcaactacttcagaagcaagagagccagccagatcctgagcaccgacgccagaaagagcctgacccaccacaacagcccccccggcctgagctgccccctgagcaacaacagcgccatcccccccacccaggcccccgagatgccccagcccagacccttcagactggagagcctggacatccccttcaccaaggccaagagaaagaagagcaagagcaacttcggcagcgagcccctgtag

SEQ ID NO: 9323 - DNA, 417 bp, Homo sapiens
atgatcctgcagcagcccctgcagagaggcccccagggcggcgcccagagactgcccagagccgccctgggcgtgacctggggcctggacgccagcagccccctgagaggcgccgtgcccatgagcaccaagagaagactggaggaggagcaggagcccctgagaaagcagttcctgagcgaggagaacatggccacccacttcagccagctgagcctgcacaacgaccacccctactgcagcccccccatgaccttcagccccgccctgccccccctgagaagcccctgcagcgagctgctgctgtggagataccccggcagcctgatccccgaggccctgagactgctgagactgggcgacacccccagccccccctaccccgccacccccgccggcgacatcatggagctgtag

SEQ ID NO: 9324 - DNA, 573 bp, Homo sapiens
atgttccaggtgcccgacagcgagggcggcagagccggcagcagagccatgaagccccccggcggcgagagcagcaacctgttcggcagccccgaggaggccacccccagcagcagacccaacagaatggccagcaacatcttcggccccaccgaggagccccagaacatccccaagagaaccaacccccccggcggcaagggcagcggcatcttcgacgagagcacccccgtgcagaccagacagcacctgaacccccccggcggcaagaccagcgacatcttcggcagccccgtgaccgccaccagcagactggcccaccccaacaagcccaaggaccacgtgttcctgtgcgagggcgaggagcccaagagcgacctgaaggccgccagaagcatccccgccggcgccgagcccggcgagaagggcagcgccagaaaggccggccccgccaaggagcaggagcccatgcccaccgtggacagccacgagcccagactgggccccagacccagaagccacaacaaggtgctgaacccccccggcggcaagagcagcatcagcttctactag

SEQ ID NO: 9325 - DNA, 690 bp, Homo sapiens
atgacctgctgcagccaggtgccccccagaagaagacccagcctggccctgagccccagactggactgcaacggcctgaacggcgtgcccggcagcatctgggacttcgtgagcggcagcttcagccccagccccagccccatcctgagcgccggcccccccagcagcagcagcgccagccccaacggcgccgagctggccagagtgagaagacagctggacgaggccaagagaaagatcagacagtgggaggagagctggcagcaggtgaagcaggtgtgcgacgcctggcagagagaggcccaggaggccaaggagagagccagagtggccgacagcgacagacagctggccctgcagaagaaggaggaggtggaggcccaggtgaagcagctgcaggaggagctggagggcctgggcgtggccagcaccctgcccggcctgagaggctgcggcgacatcggcaccatccccctgcccaagctgcacagcctgcagagccagctgagactggacctggaggccgtggacggcgtgatcttccagctgagagccaagcagtgcgtggcctgcagagagagagcccacggcgccgtgctgagaccctgccagcaccacatcctgtgcgagccctgcgccgccaccgcccccgagtgcccctactgcaagggccagcccctgcagtggtag

SEQ ID NO: 9326 - DNA, 5460 bp, Homo sapiens
atggccagcatcacccagctgttcgacgacctgtgcgaggccctgctgcccgccgccaagacccacctgggccagagaagcgtgaacagaaagagagccaagagaagcctgaagaaggtggcctacaacgccctgttcaccaacctgttccaggacgagacccagcagctgcagcccgacatgagcaagctgcccgccagaaacaagatcctgatgctgagcttcgacctgagagtgggcggcctgggccccaaggccgacagactggaggagctggtggaggagctggaggccgccccctgctgccccctgctggaggtgggcagcgtgctggacctgctggtgcagctggccggcagcggccccccccaggtgctgcccagaaagagagactacttcctgaacaacaagcacgtgggcagaaacgtgccctacagcggctacgactgcgacgacctgagcgtgttcgagatggacgtgcagagcctgatcagcagagaggagtgcctgtgccacagcatgatccaggagaccctgcaggtgatggaggccgcccccggcaccggcctgcccaccgtgggcctgttcagcttcggcgacccctgcggcgacagattcgagagagacaccagagtgagcctgttcggcgccctggtgcacagcagaacctacgacatggacgtgagactgggcctgccccccgtgcccgacaacgccgacctgagcggcctggccatcaaggtgccccccagcgtggaccagtgggaggacgagggcttccagagcgccagcaacctgacccccgacagccagagcgagcccagcgtgacccccgacgtggacctgtgggaggccgccctgacctacgaggccagcaagagaagatgctgggagagagtgggctgcccccccggccacagagaggagccctacctgaccgaggccggcagagacgccttcgacaagttctgcagactgcaccagggcgagctgcagctgctggccggcggcgtgctgcaggccccccagcccgtgctggtgaaggagtgcgagctggtgaaggacgtgctgaacgtgctgatcggcgtggtgagcgccaccttcagcctgtgccagcccgcccaggccttcgtggtgaagagaggcgtgcacgtgagcggcgccagccccgagagcatcagcagcctgctgagcgaggtggccgagtacggcacctgctacaccagactgagccacttcagcctgcagcccgtgctggacagcctgtacagcaagggcctggtgttccaggccttcaccagcggcctgagaagatacctgcagtactacagagcctgcgtgctgagcaccccccccaccctgagcctgctgaccatcggcttcctgttcaagaagctgggcagacagctgagatacctggccgagctgtgcggcgtgggcgccgtgctgcccggcacctgcggcggcggccccagagccgccttccccaccggcgtgaagctgctgagctacctgtaccaggaggccctgcacaactgcagcaacgagcactaccccgtgctgctgagcctgctgaagaccagctgcgagccctacaccagattcatccacgactgggtgtacagcggcgtgttcagagacgcctacggcgagttcatgatccaggtgaaccacgagtacctgagcttcagagacaagctgtactggacccacggctacgtgctgatcagcaaggaggtggaggactgcgtgcccgtgttcctgaagcacatcgcccacgacatctacgtgtgcggcaagaccatcaacctgctgaagctgtgctgccccagacactacctgtgctggagcgacgtgcccgtgcccagaatcagcgtgatcttcagcctggaggagctgaaggagatcgagaaggactgcgccgtgtacgtgggcagaatggagagagtggccagacacagcagcgtgagcaaggaggagaaggagctgagaatggagatcgccaagcaggagctgatcgcccacgccagagaggccgccagcagagtgctgagcgccctgagcgacagacagatgagcgagagaatggccctggacgccagaaagagagagcagttccagagactgaaggagcagttcgtgaaggaccaggagagaagacaggccgccagacaggaggagctggacgacgacttcagctacgccagagagctgagagacagagagagaagactgaagagcctggaggaggagctggagagaaaggccagacaggccctggtggaccactacagcaagctgagcgccgaggccgccagaagagagcagaaggccctgtggagaatccagagacacagactggagagcgccagactgagattcctgctggaggacgagaagcacatccaggagatgctgaaggccgtgagcgaggcccaccagccccaggagccccccgacgtgctgctgagcgtgcacccccaggtgaccagccccggccccgagcaccccgagggcggccagggctgcgacagcggcagcgccgagcagcacagccccgcctgggacggctggaacagacccggcctgctgaccccccagcccctgaagcccctggccgtgggcgccggcggcagaggcctgcagcaggccgagggcgccagacccttcagcgacagcctgagcatcggcgacttcctgcccgtgggccccggcgccgagcccagcgtgcagaccggcatggtgcccctgctggaggtggccctgcagaccatcaacctggacctgccccccagcgcccccggcgaggcccccgccgccgccagcacccagcccagcagaccccaggagtacgacttcagcaccgtgctgagacccgccgtggccaccagccccgcccccggccccctgcaggccgccgagtgcagcctgggcagcagcggcctgcagctgtgggaggacagctgcggcaagatggacgcctgcggcagcgccagcagagagaccctgctgcccagccacccccccagaagagccgccctggaggagggcagcagccagcccaccgagagactgttcggccaggtgagcggcggcggcctgcccaccggcgactacgccagcgagatcgcccccaccagacccagatggaacacccacggccacgtgagcgacgccagcatcagagtgggcgagaacgtgagcgacgtggcccccacccagcccagatggaacacccacggccacgtgagcaacgccagcatcagcctgggcgagagcgtgagcgacgtggcccccaccagacccagatggaacatccacggccacgtgagcaacgccagcatcagagtgggcgagaacgtgagcgacgtggcccccaccagacccagatggaacacccacggccacgtgagcaacgccagcatcagagtgggcgagaacgtgagcgacgtggcccccaccagacccagatggaacacccacggccacgtgagcgacgccagcatcagcctgggcgagagcgtgagcgacatggcccccgccagacccagatggaacacccacggccacgtgagcgacgccagcatcagcctgggcgagagcgtgagcgacatggcccccaccagacccagatggaacacccacggccacgtgagcgacaccagcatcagagtgggcgagaacgtgagcgacgtggcccccatcagaagcagatgcaacacccacggccacgtgagcgacgccagcatcagcctgggcgagcccgtgagcgacgtggtgagcaccagacccagatggaacacccacgtgcccatcccccccccccacatggtgctgggcgccctgagccccgaggccgagcccaacacccccagaccccagcagagcccccccggccacaccagccagagcgccctgagcctgggcgcccagagcaccgtgctggactgcggccccagactgcccgtggaggtgggccccagcctgagcagccccagcagcggctgcggcgagggcagcatcagcgtgggcgagaacgtgagcgacgtggcccccacccagccctggtggcccaacacccccggcgacagcgtgagcgaggagctgggccccggcagaagcggcgacaccgaggacctgagccccaactggcccctgaacagccaggaggacaccgccgcccagagcagccccggcagaggcgaggaggccgaggccagcgccgccgaggcccagggcggcgagcaggcctacctggccggcctggccggccagtaccacctggagagataccccgacagctacgagagcatgagcgagccccccatcgcccacctgctgagacccgtgctgcccagagccttcgccttccccgtggacccccaggtgcagagcgccgccgacgagaccgccgtgcagctgagcgagctgctgaccctgcccgtgctgatgaagagaagcatcaccgcccccctggccgcccacatcagcctggtgaacaaggccgccgtggactacttcttcgtggagctgcacctggaggcccactacgaggccctgagacacttcctgctgatggaggacggcgagttcgcccagagcctgagcgacctgctgttcgagaagctgggcgccggccagacccccggcgagctgctgaaccccctggtgctgaacagcgtgctgagcaaggccctgcagtgcagcctgcacggcgacaccccccacgccagcaacctgagcctggccctgaagtacctgcccgaggtgttcgcccccaacgcccccgacgtgctgagctgcctggagctgagatacaaggtggactggcccctgaacatcgtgatcaccgagggctgcgtgagcaagtacagcggcgtgttcagcttcctgctgcagctgaagctgatgatgtgggccctgaaggacgtgtgcttccacctgaagagaaccgccctgctgagccacatggccggcagcgtgcagttcagacagctgcagctgttcaagcacgagatgcagcacttcgtgaaggtgatccagggctacatcgccaaccagatcctgcacgtgacctggtgcgagttcagagccagactggccaccgtgggcgacctggaggagatccagagagcccacgccgagtacctgcacaaggccgtgttcagaggcctgctgaccgagaaggccgcccccgtgatgaacgtgatccacagcatcttcagcctggtgctgaagttcagaagccagctgatcagccaggcctggggcccccccggcggccccagaggcgccgagcaccccaacttcgccctgatgcagcagagctacaacaccttcaagtactacagccacttcctgttcaaggtggtgaccaagctggtgaacagaggctaccagccccacctggaggacttcctgctgagaatcaacttcaacaactactaccaggacgcctag

SEQ ID NO: 9327 - DNA, 2250 bp, Homo sapiens
atgagcggcagccacacccccgcctgcggccccttcagcgccctgacccccagcatctggccccaggagatcctggccaagtacacccagaaggaggagagcgccgagcagcccgagttctactacgacgagttcggcttcagagtgtacaaggaggagggcgacgagcccggcagcagcctgctggccaacagccccctgatggaggacgccccccagagactgagatggcaggcccacctggagttcacccacaaccacgacgtgggcgacctgacctgggacaagatcgccgtgagcctgcccagaagcgagaagctgagaagcctggtgctggccggcatcccccacggcatgagaccccagctgtggatgagactgagcggcgccctgcagaagaagagaaacagcgagctgagctacagagagatcgtgaagaacagcagcaacgacgagaccatcgccgccaagcagatcgagaaggacctgctgagaaccatgcccagcaacgcctgcttcgccagcatgggcagcatcggcgtgcccagactgagaagagtgctgagagccctggcctggctgtaccccgagatcggctactgccagggcaccggcatggtggccgcctgcctgctgctgttcctggaggaggaggacgccttctggatgatgagcgccatcatcgaggacctgctgcccgccagctacttcagcaccaccctgctgggcgtgcagaccgaccagagagtgctgagacacctgatcgtgcagtacctgcccagactggacaagctgctgcaggagcacgacatcgagctgagcctgatcaccctgcactggttcctgaccgccttcgccagcgtggtggacatcaagctgctgctgagaatctgggacctgttcttctacgagggcagcagagtgctgttccagctgaccctgggcatgctgcacctgaaggaggaggagctgatccagagcgagaacagcgccagcatcttcaacaccctgagcgacatccccagccagatggaggacgccgagctgctgctgggcgtggccatgagactggccggcagcctgaccgacgtggccgtggagacccagagaagaaagcacctggcctacctgatcgccgaccagggccagctgctgggcgccggcaccctgaccaacctgagccaggtggtgagaagaagaacccagagaagaaagagcaccatcaccgccctgctgttcggcgaggacgacctggaggccctgaaggccaagaacatcaagcagaccgagctggtggccgacctgagagaggccatcctgagagtggccagacacttccagtgcaccgaccccaagaactgcagcgtggagctgacccccgactacagcatggagagccaccagagagaccacgagaactacgtggcctgcagcagaagccacagaagaagagccaaggccctgctggacttcgagagacacgacgacgacgagctgggcttcagaaagaacgacatcatcaccatcgtgagccagaaggacgagcactgctgggtgggcgagctgaacggcctgagaggctggttccccgccaagttcgtggaggtgctggacgagagaagcaaggagtacagcatcgccggcgacgacagcgtgaccgagggcgtgaccgacctggtgagaggcaccctgtgccccgccctgaaggccctgttcgagcacggcctgaagaagcccagcctgctgggcggcgcctgccacccctggctgttcatcgaggaggccgccggcagagaggtggagagagacttcgccagcgtgtacagcagactggtgctgtgcaagaccttcagactggacgaggacggcaaggtgctgacccccgaggagctgctgtacagagccgtgcagagcgtgaacgtgacccacgacgccgtgcacgcccagatggacgtgaagctgagaagcctgatctgcgtgggcctgaacgagcaggtgctgcacctgtggctggaggtgctgtgcagcagcctgcccaccgtggagaagtggtaccagccctggagcttcctgagaagccccggctgggtgcagatcaagtgcgagctgagagtgctgtgctgcttcgccttcagcctgagccaggactgggagctgcccgccaagagagaggcccagcagcccctgaaggagggcgtgagagacatgctggtgaagcaccacctgttcagctgggacgtggacggctag

SEQ ID NO: 9328 - DNA, 2097 bp, Homo sapiens
atgctgagccccaagatcagacaggccagaagagccagaagcaagagcctggtgatgggcgagcagagcagaagccccggcagaatgccctgcccccacagactgggccccgtgctgaaggccggctggctgaagaagcagagaagcatcatgaagaactggcagcagagatggttcgtgctgagaggcgaccagctgttctactacaaggacaaggacgagatcaagccccagggcttcatcagcctgcagggcacccaggtgaccgagctgccccccggccccgaggaccccggcaagcacctgttcgagatcagccccggcggcgccggcgagagagagaaggtgcccgccaaccccgaggccctgctgctgatggccagcagccagagagacatggaggactgggtgcaggccatcagaagagtgatctgggcccccctgggcggcggcatcttcggccagagactggaggagaccgtgcaccacgagagaaagtacggccccagactggcccccctgctggtggagcagtgcgtggacttcatcagagagagaggcctgaccgaggagggcctgttcagaatgcccggccaggccaacctggtgagagacctgcaggacagcttcgactgcggcgagaagcccctgttcgacagcaccaccgacgtgcacaccgtggccagcctgctgaagctgtacctgagagagctgcccgagcccgtggtgcccttcgccagatacgaggacttcctgagctgcgcccagctgctgaccaaggacgagggcgagggcaccctggagctggccaagcaggtgagcaacctgccccaggccaactacaacctgctgagatacatctgcaagttcctggacgaggtgcaggcctacagcaacgtgaacaagatgagcgtgcagaacctggccaccgtgttcggccccaacatcctgagaccccaggtggaggaccccgtgaccatcatggagggcaccagcctggtgcagcacctgatgaccgtgctgatcagaaagcacagccagctgttcaccgcccccgtgcccgagggccccaccagccccagaggcggcctgcagtgcgccgtgggctggggcagcgaggaggtgaccagagacagccagggcgagcccggcggccccggcctgcccgcccacagaaccagcagcctggacggcgccgccgtggccgtgctgagcagaaccgcccccaccggccccggcagcagatgcagccccggcaagaaggtgcagaccctgcccagctggaagagcagcttcagacagcccagaagcctgagcggcagccccaagggcggcggcagcagcctggaggtgcccatcatcagcagcggcggcaactggctgatgaacggcctgagcagcctgagaggccacagaagagccagcagcggcgacagactgaaggacagcggcagcgtgcagagactgagcacctacgacaacgtgcccgcccccggcctggtgcccggcatccccagcgtggccagcatggcctggagcggcgccagcagcagcgagagcagcgtgggcggcagcctgagcagctgcaccgcctgcagagccagcgacagcagcgccagaagcagcctgcacaccgactgggccctggagcccagccccctgcccagcagcagcgaggaccccaagagcctggacctggaccacagcatggacgaggccggcgccggcgccagcaacagcgagcccagcgagcccgacagccccaccagagagcacgccagaagaagcgaggccctgcagggcctggtgaccgagctgagagccgagctgtgcagacagagaaccgagtacgagagaagcgtgaagagaatcgaggagggcagcgccgacctgagaaagagaatgagcagactggaggaggagctggaccaggagaagaagaagtacatcatgctggagatcaagctgagaaacagcgagagagccagagaggacgccgagagaagaaaccagctgctgcagagagagatggaggagttcttcagcaccctgggcagcctgaccgtgggcgccaagggcgccagagcccccaagtag

SEQ ID NO: 9329 - DNA, 180 bp, Homo sapiens
atgaccagaggcaaccagagagagctggccagacagaagaacatgaagaagcagagcgacagcgtgaagggcaagagaagagacgacggcctgagcgccgccgccagaaagcagagagacagcgagatcatgcagcagaagcagaagaaggccaacgagaagaaggaggagcccaagtag

SEQ ID NO: 9330 - DNA, 372 bp, Homo sapiens
atggccagatacgaggaggtgagcgtgagcggcttcgaggagttccacagagccgtggagcagcacaacggcaagaccatcttcgcctacttcaccggcagcaaggacgccggcggcaagagctggtgccccgactgcgtgcaggccgagcccgtggtgagagagggcctgaagcacatcagcgagggctgcgtgttcatctactgccaggtgggcgagaagccctactggaaggaccccaacaacgacttcagaaagaacctgaaggtgaccgccgtgcccaccctgctgaagtacggcaccccccagaagctggtggagagcgagtgcctgcaggccaacctggtggagatgctgttcagcgaggactag

SEQ ID NO: 9331 - DNA, 1401 bp, Homo sapiens
atgggctggatcaccgaggacctgatcagaagaaacgccgagcacaacgactgcgtgatcttcagcctggaggagctgagcctgcaccagcaggagatcgagagactggagcacatcgacaagtggtgcagagacctgaagatcctgtacctgcagaacaacctgatcggcaagatcgagaacgtgagcaagctgaagaagctggagtacctgaacctggccctgaacaacatcgagaagatcgagaacctggagggctgcgaggagctggccaagctggacctgaccgtgaacttcatcggcgagctgagcagcatcaagaacctgcagcacaacatccacctgaaggagctgttcctgatgggcaacccctgcgccagcttcgaccactacagagagttcgtggtggccaccctgccccagctgaagtggctggacggcaaggagatcgagcccagcgagagaatcaaggccctgcaggactacagcgtgatcgagccccagatcagagagcaggagaaggaccactgcctgaagagagccaagctgaaggaggaggcccagagaaagcaccaggaggaggacaagaacgaggacaagagaagcaacgccggcttcgacggcagatggtacaccgacatcaacgccaccctgagcagcctggagagcaaggaccacctgcaggcccccgacaccgaggagcacaacaccaagaagctggacaacagcgaggacgacctggagttctggaacaagccctgcctgttcacccccgagagcagactggagaccctgagacacatggagaagcagagaaagaagcaggagaagctgagcgagaagaagaagaaggtgaagccccccagaaccctgatcaccgaggacggcaaggccctgaacgtgaacgagcccaagatcgacttcagcctgaaggacaacgagaagcagatcatcctggacctggccgtgtacagatacatggacaccagcctgatcgacgtggacgtgcagcccacctacgtgagagtgatgatcaagggcaagcccttccagctggtgctgcccgccgaggtgaagcccgacagcagcagcgccaagagaagccagaccaccggccacctggtgatctgcatgcccaaggtgggcgaggtgatcaccggcggccagagagccttcaagagcatgaagaccaccagcgacagaagcagagagcagaccaacaccagaagcaagcacatggagaagctggaggtggaccccagcaagcacagcttccccgacgtgaccaacatcgtgcaggagaagaagcacacccccagaagaagacccgagcccaagatcatccccagcgaggaggaccccaccttcgaggacaaccccgaggtgccccccctgatctag

SEQ ID NO: 9332 - DNA, 1050 bp, Homo sapiens
atggaggacccccagagcaaggagcccgccggcgaggccgtggccctggccctgctggagagccccagacccgagggcggcgaggagccccccagacccagccccgaggagacccagcagtgcaagttcgacggccaggagaccaagggcagcaagttcatcaccagcagcgccagcgacttcagcgaccccgtgtacaaggagatcgccatcaccaacggctgcatcaacagaatgagcaaggaggagctgagagccaagctgagcgagttcaagctggagaccagaggcgtgaaggacgtgctgaagaagagactgaagaactactacaagaagcagaagctgatgctgaaggagagcaacttcgccgacagctactacgactacatctgcatcatcgacttcgaggccacctgcgaggagggcaacccccccgagttcgtgcacgagatcatcgagttccccgtggtgctgctgaacacccacaccctggagatcgaggacaccttccagcagtacgtgagacccgagatcaacacccagctgagcgacttctgcatcagcctgaccggcatcacccaggaccaggtggacagagccgacaccttcccccaggtgctgaagaaggtgatcgactggatgaagctgaaggagctgggcaccaagtacaagtacagcctgctgaccgacggcagctgggacatgagcaagttcctgaacatccagtgccagctgagcagactgaagtacccccccttcgccaagaagtggatcaacatcagaaagagctacggcaacttctacaaggtgcccagaagccagaccaagctgaccatcatgctggagaagctgggcatggactacgacggcagaccccactgcggcctggacgacagcaagaacatcgccagaatcgccgtgagaatgctgcaggacggctgcgagctgagaatcaacgagaagatgcacgccggccagctgatgagcgtgagcagcagcctgcccatcgagggcaccccccccccccagatgccccacttcagaaagtag

SEQ ID NO: 9333 - DNA, 843 bp, Homo sapiens
atgctgagcgccgtggccagaggctaccagggctggttccacccctgcgccagactgagcgtgagaatgagcagcaccggcatcgacagaaagggcgtgctggccaacagagtggccgtggtgaccggcagcaccagcggcatcggcttcgccatcgccagaagactggccagagacggcgcccacgtggtgatcagcagcagaaagcagcagaacgtggacagagccatggccaagctgcagggcgagggcctgagcgtggccggcatcgtgtgccacgtgggcaaggccgaggacagagagcagctggtggccaaggccctggagcactgcggcggcgtggacttcctggtgtgcagcgccggcgtgaaccccctggtgggcagcaccctgggcaccagcgagcagatctgggacaagatcctgagcgtgaacgtgaagagccccgccctgctgctgagccagctgctgccctacatggagaacagaagaggcgccgtgatcctggtgagcagcatcgccgcctacaaccccgtggtggccctgggcgtgtacaacgtgagcaagaccgccctgctgggcctgaccagaaccctggccctggagctggcccccaaggacatcagagtgaactgcgtggtgcccggcatcatcaagaccgacttcagcaaggtgttccacggcaacgagagcctgtggaagaacttcaaggagcaccaccagctgcagagaatcggcgagagcgaggactgcgccggcatcgtgagcttcctgtgcagccccgacgccagctacgtgaacggcgagaacatcgccgtggccggctacagcaccagactgtag

SEQ ID NO: 9334 - DNA, 909 bp, Homo sapiens
atggtgaccgagcaggaggtggacgccatcggccagaccctggtggaccccaagcagcccctgcaggccagattcagagccctgttcaccctgagaggcctgggcggccccggcgccatcgcctggatcagccaggccttcgacgacgacagcgccctgctgaagcacgagctggcctactgcctgggccagatgcaggacgccagagccatccccatgctggtggacgtgctgcaggacaccagacaggagcccatggtgagacacgaggccggcgaggccctgggcgccatcggcgaccccgaggtgctggagatcctgaagcagtacagcagcgaccccgtgatcgaggtggccgagacctgccagctggccgtgagaagactggagtggctgcagcagcacggcggcgagcccgccgccggcccctacctgagcgtggaccccgccccccccgccgaggagagagacgtgggcagactgagagaggccctgctggacgagagcagacccctgttcgagagatacagagccatgttcgccctgagaaacgccggcggcgaggaggccgccctggccctggccgagggcctgcactgcggcagcgccctgttcagacacgaggtgggctacgtgctgggccagctgcagcacgaggccgccgtgccccagctggccgccgccctggccagatgcaccgagaaccccatggtgagacacgagtgcgccgaggccctgggcgccatcgccagacccgcctgcctggccgccctgcaggcccacgccgacgaccccgagagagtggtgagagagagctgcgaggtggccctggacatgtacgagcacgagaccggcagagccttccagtacgccgacggcctggagcagctgagaggcgcccccagctag

SEQ ID NO: 9335 - DNA, 3384 bp, Homo sapiens
atggaggtgcaggtgagccaggccagcctgggcttcgagctgaccagcgtggagaagagcctgagagagtggagcagactgagcagagaggtgatcgcctggctgtgccccagcagccccaacttcatcctgaacttcccccccccccccagcgccagcagcgtgagcatggtgcagctgttcagcagccccttcggctaccagagccccagcggccacagcgaggaggagagagagggcaacatgaagagcgccaagccccaggtgaaccacagccagcacggcgagagccagagagccctgagccccctgcagagcaccctgagcagcgccgccagccccagccaggcctacgagacctacatcgagaacggcctgatctgcctgaagcacaagatcagaaacatcgagaagaagaagctgaagctggaggactacaaggacagactgaagagcggcgagcacctgaaccccgaccagctggaggccgtggagaagtacgaggaggtgctgcacaacctggagttcgccaaggagctgcagaagaccttcagcggcctgagcctggacctgctgaaggcccagaagaaggcccagagaagagagcacatgctgaagctggaggccgagaagaagaagctgagaaccatcctgcaggtgcagtacgtgctgcagaacctgacccaggagcacgtgcagaaggacttcaagggcggcctgaacggcgccgtgtacctgcccagcaaggagctggactacctgatcaagttcagcaagctgacctgccccgagagaaacgagagcctgagcgtggaggaccagatggagcagagcagcctgtacttctgggacctgctggagggcagcgagaaggccgtggtgggcaccacctacaagcacctgaaggacctgctgagcaagctgctgaacagcggctacttcgagagcatccccgtgcccaagaacgccaaggagaaggaggtgcccctggaggaggagatgctgatccagagcgagaagaagacccagctgagcaagaccgagagcgtgaaggagagcgagagcctgatggagttcgcccagcccgagatccagccccaggagttcctgaacagaagatacatgaccgaggtggactacagcaacaagcagggcgaggagcagccctgggaggccgactacgccagaaagcccaacctgcccaagagatgggacatgctgaccgagcccgacggccaggagaagaagcaggagagcttcaagagctgggaggccagcggcaagcaccaggaggtgagcaagcccgccgtgagcctggagcagagaaagcaggacaccagcaagctgagaagcaccctgcccgaggagcagaagaagcaggagatcagcaagagcaagcccagccccagccagtggaagcaggacacccccaagagcaaggccggctacgtgcaggaggagcagaagaagcaggagacccccaagctgtggcccgtgcagctgcagaaggagcaggaccccaagaagcagacccccaagagctggacccccagcatgcagagcgagcagaacaccaccaagagctggaccacccccatgtgcgaggagcaggacagcaagcagcccgagacccccaagagctgggagaacaacgtggagagccagaagcacagcctgaccagccagagccagatcagccccaagagctggggcgtggccaccgccagcctgatccccaacgaccagctgctgcccagaaagctgaacaccgagcccaaggacgtgcccaagcccgtgcaccagcccgtgggcagcagcagcaccctgcccaaggaccccgtgctgagaaaggagaagctgcaggacctgatgacccagatccagggcacctgcaacttcatgcaggagagcgtgctggacttcgacaagcccagcagcgccatccccaccagccagccccccagcgccacccccggcagccccgtggccagcaaggagcagaacctgagcagccagagcgacttcctgcaggagcccctgcaggccaccagcagccccgtgacctgcagcagcaacgcctgcctggtgaccaccgaccaggccagcagcggcagcgagaccgagttcatgaccagcgagacccccgaggccgccatcccccccggcaagcagcccagcagcctggccagccccaacccccccatggccaagggcagcgagcagggcttccagagcccccccgccagcagcagcagcgtgaccatcaacaccgcccccttccaggccatgcagaccgtgttcaacgtgaacgcccccctgccccccagaaaggagcaggagatcaaggagagcccctacagccccggctacaaccagagcttcaccaccgccagcacccagacccccccccagtgccagctgcccagcatccacgtggagcagaccgtgcacagccaggagaccgccgccaactaccaccccgacggcaccatccaggtgagcaacggcagcctggccttctaccccgcccagaccaacgtgttccccagacccacccagcccttcgtgaacagcagaggcagcgtgagaggctgcaccagaggcggcagactgatcaccaacagctacagaagccccggcggctacaagggcttcgacacctacagaggcctgcccagcatcagcaacggcaactacagccagctgcagttccaggccagagagtacagcggcgccccctacagccagagagacaacttccagcagtgctacaagagaggcggcaccagcggcggccccagagccaacagcagagccggctggagcgacagcagccaggtgagcagccccgagagagacaacgagaccttcaacagcggcgacagcggccagggcgacagcagaagcatgacccccgtggacgtgcccgtgaccaaccccgccgccaccatcctgcccgtgcacgtgtaccccctgccccagcagatgagagtggccttcagcgccgccagaaccagcaacctggcccccggcaccctggaccagcccatcgtgttcgacctgctgctgaacaacctgggcgagaccttcgacctgcagctgggcagattcaactgccccgtgaacggcacctacgtgttcatcttccacatgctgaagctggccgtgaacgtgcccctgtacgtgaacctgatgaagaacgaggaggtgctggtgagcgcctacgccaacgacggcgcccccgaccacgagaccgccagcaaccacgccatcctgcagctgttccagggcgaccagatctggctgagactgcacagaggcgccatctacggcagcagctggaagtacagcaccttcagcggctacctgctgtaccaggactag

SEQ ID NO: 9336 - DNA, 2448 bp, Homo sapiens
atggaggtgagagccagcctgcagaaggtgagcggcagcagcgacagcgtggccaccatgaacagcgaggagttcgtgctggtgccccagtacgccgacgacaacagcaccaagcacgaggagaagccccagctgaagatcgtgagcaacggcgacgagcagctggagaaggccatggaggagatcctgagagacagcgagaagagacccagcagcctgctggtggactgccagagcagcagcgagatcagcgaccacagcttcggcgacatccccgccagccagaccaacaagcccagcctgcagctgatcctggaccccagcaacaccgagatcagcacccccagacccagcagccccggcggcctgcccgaggaggacagcgtgctgttcaacaagctgacctacctgggctgcatgaaggtgagcagccccagaaacgaggtggaggccctgagagccatggccaccatgaagagcagcagccagtaccccttccccgtgaccctgtacgtgcccaacgtgcccgagggcagcgtgagaatcatcgaccagagcagcaacgtggagatcgccagcttccccatctacaaggtgctgttctgcgccagaggccacgacggcaccaccgagagcaactgcttcgccttcaccgagagcagccacggcagcgaggagttccagatccacgtgttcagctgcgagatcaaggaggccgtgagcagaatcctgtacagcttctgcaccgccttcaagagaagcagcagacaggtgagcgacgtgaaggacagcgtgatccccacccccgacagcgacgtgttcaccttcagcgtgagcctggaggtgaaggaggacgacggcaagggcaacttcagccccgtgcccaaggacagagacaagttctacttcaagctgaagcagggcatcgagaagaaggtggtgatcaccgtgcagcagctgagcaacaaggagctggccatcgagagatgcttcggcatgctgctgagccccggcagaaacgtgaagaacagcgacatgcacctgctggacatggagagcatgggcaagagctacgacggcagagcctacgtgatcaccggcatgtggaaccccaacgcccccgtgttcctggccctgaacgaggagacccccaaggacaagcaggtgtacatgaccgtggccgtggacatggtggtgaccgaggtggtggagcccgtgagattcctgctggagaccgtggtgagagtgtaccccgccaacgagagattctggtacttcagcagaaagaccttcaccgagaccttcttcatgagactgaagcagagcgagggcaagggccacaccaacgccggcgacgccatctacgaggtggtgagcctgcagagagagagcgacaaggaggagcccgtgacccccaccagcggcggcggccccatgagcccccaggacgacgaggccgaggaggagagcgacaacgagctgagcagcggcaccggcgacgtgagcaaggactgccccgagaagatcctgtacagctggggcgagctgctgggcaagtggcacagcaacctgggcgccagacccaagggcctgagcaccctggtgaagagcggcgtgcccgaggccctgagagccgaggtgtggcagctgctggccggctgccacgacaaccaggccatgctggacagatacagaatcctgatcaccaaggacagcgcccaggagagcgtgatcaccagagacatccacagaaccttccccgcccacgactacttcaaggacaccggcggcgacggccaggagagcctgtacaagatctgcaaggcctacagcgtgtacgacgaggacatcggctactgccagggccagagcttcctggccgccgtgctgctgctgcacatgcccgaggagcaggccttctgcgtgctggtgaagatcatgtacgactacggcctgagagacctgtacagaaacaacttcgaggacctgcactgcaagttctaccagctggagagactgatgcaggagcagctgcccgacctgcacagccacttcagcgacctgaacctggaggcccacatgtacgccagccagtggttcctgaccctgttcaccgccaagttccccctgtgcatggtgttccacatcatcgacctgctgctgtgcgagggcctgaacatcatcttccacgtggccctggccctgctgaagaccagcaaggaggacctgctgcaggccgacttcgagggcgccctgaagttcttcagagtgcagctgcccaagagatacagagccgaggagaacgccagaagactgatggagcaggcctgcaacatcaaggtgcccaccaagaagctgaagaagtacgagaaggagtaccagaccatgagagagagccagctgcagcaggaggaccccatggacagatacaagttcgtgtacctgtag

SEQ ID NO: 9337 - DNA, 639 bp, Homo sapiens
atggcccagaccgacaagcccacctgcatcccccccgagctgcccaagatgctgaaggagttcgccaaggccgccatcagagcccagccccaggacctgatccagtggggcgccgactacttcgaggccctgagcagaggcgagaccccccccgtgagagagagaagcgagagagtggccctgtgcaactgggccgagctgacccccgagctgctgaagatcctgcacagccaggtggccggcagactgatcatcagagccgaggagctggcccagatgtggaaggtggtgaacctgcccaccgacctgttcaacagcgtgatgaacgtgggcagattcaccgaggagatcgagtggctgaagttcctggccctggcctgcagcgccctgggcgtgaccatcaccaagaccctgaagatcgtgtgcgaggtgctgagctgcgaccacaacggcggcctgcccagaatccccttcagcaccttccagttcctgtacacctacatcgccgaggtggacggcgagatctgcgccagccacgtgagcagaatgctgaactacatcgagcaggaggtgatcggccccgacggcctgatcaccgtgaacgacttcacccagaaccccagagtgtggctggagtag

SEQ ID NO: 9338 - DNA, 1938 bp, Homo sapiens
atggccagcctgctgcaggaccagctgaccaccgaccaggacctgctgctgatgcaggagggcatgcccatgagaaaggtgagaagcaagagctggaagaagctgagatacttcagactgcagaacgacggcatgaccgtgtggcacgccagacaggccagaggcagcgccaagcccagcttcagcatcagcgacgtggagaccatcagaaacggccacgacagcgagctgctgagaagcctggccgaggagctgcccctggagcagggcttcaccatcgtgttccacggcagaagaagcaacctggacctgatggccaacagcgtggaggaggcccagatctggatgagaggcctgcagctgctggtggacctggtgaccagcatggaccaccaggagagactggaccagtggctgagcgactggttccagagaggcgacaagaaccaggacggcaagatgagcttccaggaggtgcagagactgctgcacctgatgaacgtggagatggaccaggagtacgccttcagcctgttccaggccgccgacaccagccagagcggcaccctggagggcgaggagttcgtgcagttctacaaggccctgaccaagagagccgaggtgcaggagctgttcgagagcttcagcgccgacggccagaagctgaccctgctggagttcctggacttcctgcaggaggagcagaaggagagagactgcaccagcgagctggccctggagctgatcgacagatacgagcccagcgacagcggcaagctgagacacgtgctgagcatggacggcttcctgagctacctgtgcagcaaggacggcgacatcttcaaccccgcctgcctgcccatctaccaggacatgacccagcccctgaaccactacttcatctgcagcagccacaacacctacctggtgggcgaccagctgtgcggccagagcagcgtggagggctacatcagagccctgaagagaggctgcagatgcgtggaggtggacgtgtgggacggccccagcggcgagcccgtggtgtaccacggccacaccctgaccagcagaatcctgttcaaggacgtggtggccaccgtggcccagtacgccttccagaccagcgactaccccgtgatcctgagcctggagacccactgcagctgggagcagcagcagaccatggccagacacctgaccgagatcctgggcgagcagctgctgagcaccaccctggacggcgtgctgcccacccagctgcccagccccgaggagctgagaagaaagatcctggtgaagggcaagaagctgaccctggaggaggacctggagtacgaggaggaggaggccgagcccgagctggaggagagcgagctggccctggagagccagttcgagaccgagcccgagccccaggagcagaacctgcagaacaaggacaagaagaagaagagcaagcccatcctgtgccccgccctgagcagcctggtgatctacctgaagagcgtgagcttcagaagcttcacccacagcaaggagcactaccacttctacgagatcagcagcttcagcgagaccaaggccaagagactgatcaaggaggccggcaacgagttcgtgcagcacaacacctggcagctgagcagagtgtaccccagcggcctgagaaccgacagcagcaactacaacccccaggagctgtggaacgccggctgccagatggtggccatgaacatgcagaccgccggcctggagatggacatctgcgacggccacttcagacagaacggcggctgcggctacgtgctgaagcccgacttcctgagagacatccagagcagcttccaccccgagaagcccatcagccccttcaaggcccagaccctgagcatcccctacagacacctgcagctgatcttccccatcaacagcgtgtag

SEQ ID NO: 9339 - DNA, 7554 bp, Homo sapiens
atggtgggcgagagacacgccggcgacctgatggtgcccctgggccccagactgcaggcctaccccgaggagctgatcagacagagacccggccacgacggccaccccgagtacctgatcagatggagcgtgctgaagtgcggcgaggtgggcaaggtgggcgtggaggagggcaaggccgagcacatcctgatgtggctgagcgcccccgaggtgtacgccaactgccccggcctgctgggcgagagagccctgagcaagggcctgcagcacgagcccgccggcgtgagcggcagcttccccagagaccccggcggcctggacgaggtggccatgggcgagatggaggccgacgtgcaggccctggtgagaagagccgccagacagctggccgagagcggcacccccagcctgaccgccgccgtgctgcacaccatccacgtgctgagcgcctacgccagcatcggccccctgaccggcgtgttcagagagaccggcgccctggacctgctgatgcacatgctgtgcaaccccgagccccagatcagaagaagcgccggcaagatgctgcaggccctggccgcccacgacgccggcagcagagcccacgtgctgctgagcctgagccagcaggacggcatcgagcagcacatggacttcgacagcagatacaccctgctggagctgttcgccgagaccaccagcagcgaggagcactgcatggccttcgagggcatccacctgccccagatccccggcaagctgctgttcagcctggtgaagagatacctgtgcgtgaccagcctgctggaccagctgaacagcagccccgagctgggcgccggcgaccagagcagcccctgcgccaccagagagaagagcagaggccagagagagctggagttcagcatggccgtgggcaacctgatcagcgagctggtgagaagcatgggctgggccagaaacctgagcgagcagggcatgagcccccccagacccaccagaagcatcttccagccctacatcagcggccccagcctgctgctgcccaccatcgtgaccacccccagaagacagggctgggtgttcagacagagaagcgagttcagcagcagaagcggctacggcgagtacgtgcagcagaccctgcagcccggcatgagagtgagaatgctggacgactacgaggagatcagcgccggcgacgagggcgagttcagacagagcaacaacggcatcccccccgtgcaggtgttctggcagagcaccggcagaacctactgggtgcactggcacatgctggagatcctgggccccgaggaggccaccgaggacaaggccagcgccgccgtggagaagggcgccggcgccaccgtgctgggcaccgccttccccagctgggactggaaccccatggacggcctgtaccccctgccctacctgcagcccgagccccagaagaacgagagagtgggctacctgacccaggccgagtggtgggagctgctgttcttcatcaagaagctggacctgtgcgagcagcagcccatcttccagaacctgtggaagaacctggacgagaccctgggcgagaaggccctgggcgagatcagcgtgagcgtggagatggccgagagcctgctgcaggtgctgagcagcagattcgagggcagcaccctgaacgacctgctgaacagccagatctacaccaagtacggcctgctgagcaacgagcccagcagcagcagcaccagcagaaaccacagctgcacccccgaccccgaggaggagagcaagagcgaggccagcttcagcgaggaggagaccgagagcctgaaggccaaggccgaggcccccaagaccgaggccgagcccaccaagaccagaaccgagacccccatggcccagagcgacagccagctgttcaaccagctgctggtgaccgagggcatgaccctgcccaccgagatgaaggaggccgccagcgagatggccagagccctgagaggccccggccccagaagcagcctggaccagcacgtggccgccgtggtggccaccgtgcagatcagcagcctggacaccaacctgcagctgagcggcctgagcgccctgagccaggccgtggaggaggtgaccgagagagaccaccccctggtgagacccgacagaagcctgagagagaagctggtgaagatgctggtggagctgctgaccaaccaggtgggcgagaagatggtggtggtgcaggccctgagactgctgtacctgctgatgaccaagcacgagtggagacccctgttcgccagagagggcggcatctacgccgtgctggtgtgcatgcaggagtacaagaccagcgtgctggtgcagcaggccggcctggccgccctgaagatgctggccgtggccagcagcagcgagatccccaccttcgtgaccggcagagacagcatccacagcctgttcgacgcccagatgaccagagagatcttcgccagcatcgacagcgccaccagacccggcagcgagagcctgctgctgaccgtgcccgccgccgtgatcctgatgctgaacaccgagggctgcagcagcgccgccagaaacggcctgctgctgctgaacctgctgctgtgcaaccaccacaccctgggcgaccagatcatcacccaggagctgagagacaccctgttcagacacagcggcatcgcccccagaaccgagcccatgcccaccaccagaaccatcctgatgatgctgctgaacagatacagcgagccccccggcagccccgagagagccgccctggagacccccatcatccagggccaggacggcagccccgagctgctgatcagaagcctggtgggcggccccagcgccgagctgctgctggacctggagagagtgctgtgcagagagggcagccccggcggcgccgtgagacccctgctgaagagactgcagcaggagacccagcccttcctgctgctgctgagaaccctggacgcccccggccccaacaagaccctgctgctgagcgtgctgagagtgatcaccagactgctggacttccccgaggccatggtgctgccctggcacgaggtgctggagccctgcctgaactgcctgagcggccccagcagcgacagcgagatcgtgcaggagctgacctgcttcctgcacagactggccagcatgcacaaggactacgccgtggtgctgtgctgcctgggcgccaaggagatcctgagcaaggtgctggacaagcacagcgcccagctgctgctgggctgcgagctgagagacctggtgaccgagtgcgagaagtacgcccagctgtacagcaacctgaccagcagcatcctggccggctgcatccagatggtgctgggccagatcgaggaccacagaagaacccaccagcccatcaacatccccttcttcgacgtgttcctgagacacctgtgccagggcagcagcgtggaggtgaaggaggacaagtgctgggagaaggtggaggtgagcagcaacccccacagagccagcaagctgaccgaccacaaccccaagacctactgggagagcaacggcagcaccggcagccactacatcaccctgcacatgcacagaggcgtgctggtgagacagctgaccctgctggtggccagcgaggacagcagctacatgcccgccagagtggtggtgttcggcggcgacagcaccagctgcatcggcaccgagctgaacaccgtgaacgtgatgcccagcgccagcagagtgatcctgctggagaacctgaacagattctggcccatcatccagatcagaatcaagagatgccagcagggcggcatcgacaccagagtgagaggcgtggaggtgctgggccccaagcccaccttctggcccctgttcagagagcagctgtgcagaagaacctgcctgttctacaccatcagagcccaggcctggagcagagacatcgccgaggaccacagaagactgctgcagctgtgccccagactgaacagagtgctgagacacgagcagaacttcgccgacagattcctgcccgacgacgaggccgcccaggccctgggcaagacctgctgggaggccctggtgagccccctggtgcagaacatcaccagccccgacgccgagggcgtgagcgccctgggctggctgctggaccagtacctggagcagagagagaccagcagaaaccccctgagcagagccgccagcttcgccagcagagtgagaagactgtgccacctgctggtgcacgtggagcccccccccggccccagccccgagcccagcaccagacccttcagcaagaacagcaagggcagagacagaagccccgcccccagccccgtgctgcccagcagcagcctgagaaacatcacccagtgctggctgagcgtggtgcaggagcaggtgagcagattcctggccgccgcctggagagcccccgacttcgtgcccagatactgcaagctgtacgagcacctgcagagagccggcagcgagctgttcggccccagagccgccttcatgctggccctgagaagcggcttcagcggcgccctgctgcagcagagcttcctgaccgccgcccacatgagcgagcagttcgccagatacatcgaccagcagatccagggcggcctgatcggcggcgcccccggcgtggagatgctgggccagctgcagagacacctggagcccatcatggtgctgagcggcctggagctggccaccaccttcgagcacttctaccagcactacatggccgacagactgctgagcttcggcagcagctggctggagggcgccgtgctggagcagatcggcctgtgcttccccaacagactgccccagctgatgctgcagagcctgagcaccagcgaggagctgcagagacagttccacctgttccagctgcagagactggacaagctgttcctggagcaggaggacgaggaggagaagagactggaggaggaggaggaggaggaggaggaggaggaggccgagaaggagctgttcatcgaggaccccagccccgccatcagcatcctggtgctgagccccagatgctggcccgtgagccccctgtgctacctgtaccaccccagaaagtgcctgcccaccgagttctgcgacgccctggacagattcagcagcttctacagccagagccagaaccaccccgtgctggacatgggcccccacagaagactgcagtggacctggctgggcagagccgagctgcagttcggcaagcagatcctgcacgtgagcaccgtgcagatgtggctgctgctgaagttcaaccagaccgaggaggtgagcgtggagaccctgctgaaggacagcgacctgagccccgagctgctgctgcaggccctggtgcccctgaccagcggcaacggccccctgaccctgcacgagggccaggacttcccccacggcggcgtgctgagactgcacgagcccggcccccagagaagcggcgaggccctgtggctgatccccccccaggcctacctgaacgtggagaaggacgagggcagaaccctggagcagaagagaaacctgctgagctgcctgctggtgagaatcctgaaggcccacggcgagaagggcctgcacatcgaccagctggtgtgcctggtgctggaggcctggcagaagggccccaacccccccggcaccctgggccacaccgtggccggcggcgtggcctgcaccagcaccgacgtgctgagctgcatcctgcacctgctgggccagggctacgtgaagagaagagacgacagaccccagatcctgatgtacgccgcccccgagcccatgggcccctgcagaggccaggccgacgtgcccttctgcggcagccagagcgagaccagcaagcccagccccgaggccgtggccaccctggccagcctgcagctgcccgccggcagaaccatgagcccccaggaggtggagggcctgatgaagcagaccgtgagacaggtgcaggagaccctgaacctggagcccgacgtggcccagcacctgctggcccacagccactggggcgccgagcagctgctgcagagctacagcgaggaccccgagcccctgctgctggccgccggcctgtgcgtgcaccaggcccaggccgtgcccgtgagacccgaccactgccccgtgtgcgtgagccccctgggctgcgacgacgacctgcccagcctgtgctgcatgcactactgctgcaagagctgctggaacgagtacctgaccaccagaatcgagcagaacctggtgctgaactgcacctgccccatcgccgactgccccgcccagcccaccggcgccttcatcagagccatcgtgagcagccccgaggtgatcagcaagtacgagaaggccctgctgagaggctacgtggagagctgcagcaacctgacctggtgcaccaacccccagggctgcgacagaatcctgtgcagacagggcctgggctgcggcaccacctgcagcaagtgcggctgggccagctgcttcaactgcagcttccccgaggcccactaccccgccagctgcggccacatgagccagtgggtggacgacggcggctactacgacggcatgagcgtggaggcccagagcaagcacctggccaagctgatcagcaagagatgccccagctgccaggcccccatcgagaagaacgagggctgcctgcacatgacctgcgccaagtgcaaccacggcttctgctggagatgcctgaagagctggaagcccaaccacaaggactactacaactgcagcgccatggtgagcaaggccgccagacaggagaagagattccaggactacaacgagagatgcaccttccaccaccaggccagagagttcgccgtgaacctgagaaacagagtgagcgccatccacgaggtgcccccccccagaagcttcaccttcctgaacgacgcctgccagggcctggagcaggccagaaaggtgctggcctacgcctgcgtgtacagcttctacagccaggacgccgagtacatggacgtggtggagcagcagaccgagaacctggagctgcacaccaacgccctgcagatcctgctggaggagaccctgctgagatgcagagacctggccagcagcctgagactgctgagagccgactgcctgagcaccggcatggagctgctgagaagaatccaggagagactgctggccatcctgcagcacagcgcccaggacttcagagtgggcctgcagagccccagcgtggaggcctgggaggccaagggccccaacatgcccggcagccagccccaggccagcagcggccccgaggccgaggaggaggaggaggacgacgaggacgacgtgcccgagtggcagcaggacgagttcgacgaggagctggacaacgacagcttcagctacgacgagagcgagaacctggaccaggagaccttcttcttcggcgacgaggaggaggacgaggacgaggcctacgactag

SEQ ID NO: 9340 - DNA, 1476 bp, Homo sapiens
atggaggagatccccgcccaggaggccgccggcagccccagagtgcagttccagagcctggagacccagagcgagtgcctgagccccgagccccagttcgtgcaggacaccgacatggagcagggcctgaccggcgacggcgagaccagagaggagaacaagctgctgatccccaagcagaagatcagcgaggaggtgcacagctacaaggtgagagtgggcagactgaagcacgacatcacccaggtgcccgagaccagagaggtgtacaagagcgaggacagactggagagactgcaggagatcctgagaaagttcctgtacctggagagagagttcagacagatcaccatcagcaaggagaccttcaccagcgagaagaacaacgagtgccacgagcccgagaagagcttcagcctggacagcaccatcgacgccgaccagagagtgctgagaatccagaacaccgacgacaacgacaagtacgacatgagcttcaaccagaacagcgccagcggcaagcacgagcacctgaacctgaccgaggacttccagagcagcgagtgcaaggagagcctgatggacctgagccacctgaacaagtgggagagcatccccaacaccgagaagagctacaagtgcgacgtgtgcggcaagatcttccaccagagcagcgccctgaccagacaccagagaatccacaccagagagaagccctacaagtgcaaggagtgcgagaagagcttcagccagagcagcagcctgagcagacacaagagaatccacaccagagagaagccctacaagtgcgaggccagcgacaagagctgcgaggccagcgacaagagctgcagccccagcagcggcatcatccagcacaagaagatccacaccagagccaagagctacaagtgcagcagctgcgagagagtgttcagcagaagcgtgcacctgacccagcaccagaagatccacaaggagatgccctgcaagtgcaccgtgtgcggcagcgacttctgccacaccagctacctgctggagcaccagagagtgcaccacgaggagaaggcctacgagtacgacgagtacggcctggcctacatcaagcagcagggcatccacttcagagagaagccctacacctgcagcgagtgcggcaaggacttcagactgaacagccacctgatccagcaccagagaatccacaccggcgagaaggcccacgagtgcaacgagtgcggcaaggccttcagccagaccagctgcctgatccagcaccacaagatgcacagaaaggagaagagctacgagtgcaacgagtacgagggcagcttcagccacagcagcgacctgatcctgcagcaggaggtgctgaccagacagaaggccttcgactgcgacgtgtgggagaagaacagcagccagagagcccacctggtgcagcaccagagcatccacaccaaggagaacagctag

SEQ ID NO: 9341 - DNA, 2709 bp, Homo sapiens
atgagcgagttcagaatccaccacgacgtgaacgagctgctgagcctgctgagagtgcacggcggcgacggcgccgaggtgtacatcgacctgctgcagaagaacagaaccccctacgtgaccaccaccgtgagcgcccacagcgccaaggtgaagatcgccgagttcagcagaacccccgaggacttcctgaagaagtacgacgagctgaagagcaagaacaccagaaacctggaccccctggtgtacctgctgagcaagctgaccgaggacaaggagaccctgcagtacctgcagcagaacgccaaggagagagccgagctggccgccgccgccgtgggcagcagcaccaccagcatcaacgtgcccgccgccgccagcaagatcagcatgcaggagctggaggagctgagaaagcagctgggcagcgtggccaccggcagcaccctgcagcagagcctggagctgaagagaaagatgctgagagacaagcagaacaagaagaacagcggccagcacctgcccatcttccccgcctgggtgtacgagagacccgccctgatcggcgacttcctgatcggcgccggcatcagcaccgacaccgccctgcccatcggcaccctgcccctggccagccaggagagcgccgtggtggaggacctgctgtacgtgctggtgggcgtggacggcagatacgtgagcgcccagcccctggccggcagacagagcagaaccttcctggtggaccccaacctggacctgagcatcagagagctggtgcacagaatcctgcccgtggccgccagctacagcgccgtgaccagattcatcgaggagaagagcagcttcgagtacggccaggtgaaccacgccctggccgccgccatgagaaccctggtgaaggagcacctgatcctggtgagccagctggagcagctgcacagacagggcctgctgagcctgcagaagctgtggttctacatccagcccgccatgagaaccatggacatcctggccagcctggccaccagcgtggacaagggcgagtgcctgggcggcagcaccctgagcctgctgcacgacagaagcttcagctacaccggcgacagccaggcccaggagctgtgcctgtacctgaccaaggccgccagcgccccctacttcgaggtgctggagaagtggatctacagaggcatcatccacgacccctacagcgagttcatggtggaggagcacgagctgagaaaggagagaatccaggaggactacaacgacaagtactgggaccagagatacaccatcgtgcagcagcagatccccagcttcctgcagaagatggccgacaagatcctgagcaccggcaagtacctgaacgtggtgagagagtgcggccacgacgtgacctgccccgtggccaaggagatcatctacaccctgaaggagagagcctacgtggagcagatcgagaaggccttcaactacgccagcaaggtgctgctggacttcctgatggaggagaaggagctggtggcccacctgagaagcatcaagagatacttcctgatggaccagggcgacttcttcgtgcacttcatggacctggccgaggaggagctgagaaagcccgtggaggacatcaccccccccagactggaggccctgctggagctggccctgagaatgagcaccgccaacaccgaccccttcaaggacgacctgaagatcgacctgatgccccacgacctgatcacccagctgctgagagtgctggccatcgagaccaagcaggagaaggccatggcccacgccgaccccaccgagctggccctgagcggcctggaggccttcagcttcgactacatcgtgaagtggcccctgagcctgatcatcaacagaaaggccctgaccagataccagatgctgttcagacacatgttctactgcaagcacgtggagagacagctgtgcagcgtgtggatcagcaacaagaccgccaagcagcacagcctgcacagcgcccagtggttcgccggcgccttcaccctgagacagagaatgctgaacttcgtgcagaacatccagtactacatgatgttcgaggtgatggagcccacctggcacatcctggagaagaacctgaagagcgccagcaacatcgacgacgtgctgggccaccacaccggcttcctggacacctgcctgaaggactgcatgctgaccaaccccgagctgctgaaggtgttcagcaagctgatgagcgtgtgcgtgatgttcaccaactgcatgcagaagttcacccagagcatgaagctggacggcgagctgggcggccagaccctggagcacagcaccgtgctgggcctgcccgccggcgccgaggagagagccagaaaggagctggccagaaagcacctggccgagcacgccgacaccgtgcagctggtgagcggcttcgaggccaccatcaacaagttcgacaagaacttcagcgcccacctgctggacctgctggccagactgagcatctacagcaccagcgactgcgagcacggcatggccagcgtgatcagcagactggacttcaacggcttctacaccgagagactggagagactgagcgccgagagaagccagaaggccaccccccaggtgcccgtgctgagaggcccccccgcccccgcccccagagtggccgtgaccgcccagtag

SEQ ID NO: 9342 - DNA, 2289 bp, Homo sapiens
atggccatgcaggagaagtaccccaccgagggcatcagccacgtgaccagccccagcagcgacgtgatccagaagggcagcagcctgggcaccgagtggcagacccccgtgatcagcgagcccttcagaagcagattcagcagatgcagcagcgtggccgacagcggcgacaccgccatcggcaccagctgcagcgacatcgccgaggacttctgcagcagcagcggcagcccccccttccagcccatcaagagccacgtgaccatccccaccgcccacgtgatgcccagcaccctgggcaccagccccgccaagcccaacagcacccccgtgggccccagcagcagcaagctgcccctgagcggcctggccgagagcgtgggcatgaccagaaacggcgacctgggcgccatgaagcacagccccggcctgagcagagacctgatgtacttcagcggcgccaccggcgagaacggcatcgagcagagctggttccccgccgtgggccacgagagacaggaggaggccagaaagttcgacatccccagcatggagagcaccctgaaccagagcgccatgatggagaccctgtacagcgacccccaccacagagtgagattccacaaccccagaaccagcaccagcaaggagctgtacagagtgctgcccgaggccaagaaggcccccggcagcggcgccgtgttcgagagaaacggcccccacagcaacagcagcggcgtgctgcccctgggcctgcagcccgcccccggcctgagcaagcccctgcccagccaggtgtggcagcccagccccgacacctggcaccccagagagcagagctgcgagctgagcacctgcagacagcagctggagctgatcagactgcagatggagcagatgcagctgcagaacggcgccatctgccaccaccccgccgccttcggccccagcctgcccatcctggagcccgcccagtggatcagcatcctgaacagcaacgagcacctgctgaaggagaaggagctgctgatcgacaagcagagaaagcacatcagccagctggagcagaaggtgagagagagcgagctgcaggtgcacagcgccctgctgggcagacccgcccccttcggcgacgtgtgcctgctgagactgcaggagctgcagagagagaacaccttcctgagagcccagttcgcccagaagaccgaggccctgagcagagagaagatcgacctggagaagaagctgagcgccagcgaggtggaggtgcagctgatcagagagagcctgaaggtggccctgcagaagcacagcgaggaggtgaagaagcaggaggagagagtgaagggcagagacaagcacatcaacaacctgaagaagaagtgccagaaggagagcgagcagaacagagagaagcagcagagaatcgagaccctggagagatacctggccgacctgcccaccctggaggaccaccagaagcagagccagcagctgaaggacagcgagctgaagagcaccgagctgcaggagaaggtgaccgagctggagagcctgctggaggagacccaggccatctgcagagagaaggagatccagctggagagcctgagacagagagaggccgagttcagcagcgccggccacagcctgcaggacaagcagagcgtggaggagaccagcggcgagggccccgaggtggagatggagagctggcagaagagatacgacagcctgcagaagatcgtggagaagcagcagcagaagatggaccagctgagaagccaggtgcagagcctggagcaggaggtggcccaggaggagggcaccagccaggccctgagagaggaggcccagagaagagacagcgccctgcagcagctgagaaccgccgtgaaggagctgagcgtgcagaaccaggacctgatcgagaagaacctgaccctgcaggagcacctgagacaggcccagcccggcagcccccccagccccgacaccgcccagctggccctggagctgcaccaggagctggccagctgcctgcaggacctgcaggccgtgtgcagcatcgtgacccagagagcccagggccacgaccccaacctgagcctgctgctgggcatccacagcgcccagcaccccgagacccagctggacctgcagaagcccgacgtgatcaagagaaagctggaggaggtgcagcagctgagaagagacatcgaggacctgagaaccaccatgagcgacagatacgcccaggacatgggcgagaactgcgtgacccagtag

SEQ ID NO: 9343 - DNA, 1443 bp, Homo sapiens
atgatcgtggccgacagcgagtgcagagccgagctgaaggactacctgagattcgcccccggcggcgtgggcgacagcggccccggcgaggagcagagagagagcagagccagaagaggccccagaggccccagcgccttcatccccgtggaggaggtgctgagagagggcgccgagagcctggagcagcacctgggcctggaggccctgatgagcagcggcagagtggacaacctggccgtggtgatgggcctgcaccccgactacttcaccagcttctggagactgcactacctgctgctgcacaccgacggccccctggccagcagctggagacactacatcgccatcatggccgccgccagacaccagtgcagctacctggtgggcagccacatggccgagttcctgcagaccggcggcgaccccgagtggctgctgggcctgcacagagcccccgagaagctgagaaagctgagcgagatcaacaagctgctggcccacagaccctggctgatcaccaaggagcacatccaggccctgctgaagaccggcgagcacacctggagcctggccgagctgatccaggccctggtgctgctgacccactgccacagcctgagcagcttcgtgttcggctgcggcatcctgcccgagggcgacgccgacggcagccccgccccccaggcccccaccccccccagcgagcagagcagcccccccagcagagaccccctgaacaacagcggcggcttcgagagcgccagagacgtggaggccctgatggagagaatgcagcagctgcaggagagcctgctgagagacgagggcaccagccaggaggagatggagagcagattcgagctggagaagagcgagagcctgctggtgacccccagcgccgacatcctggagcccagcccccaccccgacatgctgtgcttcgtggaggaccccaccttcggctacgaggacttcaccagaagaggcgcccaggccccccccaccttcagagcccaggactacacctgggaggaccacggctacagcctgatccagagactgtaccccgagggcggccagctgctggacgagaagttccaggccgcctacagcctgacctacaacaccatcgccatgcacagcggcgtggacaccagcgtgctgagaagagccatctggaactacatccactgcgtgttcggcatcagatacgacgactacgactacggcgaggtgaaccagctgctggagagaaacctgaaggtgtacatcaagaccgtggcctgctaccccgagaagaccaccagaagaatgtacaacctgttctggagacacttcagacacagcgagaaggtgcacgtgaacctgctgctgctggaggccagaatgcaggccgccctgctgtacgccctgagagccatcaccagatacatgacctag

SEQ ID NO: 9344 - DNA, 633 bp, Homo sapiens
atgcccggcgtgaagctgaccacccaggcctactgcaagatggtgctgcacggcgccaagtacccccactgcgccgtgaacggcctgctggtggccgagaagcagaagcccagaaaggagcacctgcccctgggcggccccggcgcccaccacaccctgttcgtggactgcatccccctgttccacggcaccctggccctggcccccatgctggaggtggccctgaccctgatcgacagctggtgcaaggaccacagctacgtgatcgccggctactaccaggccaacgagagagtgaaggacgccagccccaaccaggtggccgagaaggtggccagcagaatcgccgagggcttcagcgacaccgccctgatcatggtggacaacaccaagttcaccatggactgcgtggcccccaccatccacgtgtacgagcaccacgagaacagatggagatgcagagacccccaccacgactactgcgaggactggcccgaggcccagagaatcagcgccagcctgctggacagcagaagctacgagaccctggtggacttcgacaaccacctggacgacatcagaaacgactggaccaaccccgagatcaacaaggccgtgctgcacctgtgctag

SEQ ID NO: 9345 - DNA, 1059 bp, Homo sapiens
atgaccgaggccggcaagctgcccctgcccctgccccccagactggactggttcgtgcacacccagatgggccagctggcccaggacggcgtgcccgagtggttccacggcgccatcagcagagaggacgccgagaacctgctggagagccagcccctgggcagcttcctgatcagagtgagccacagccacgtgggctacaccctgagctacaaggcccagagcagctgctgccacttcatggtgaagctgctggacgacggcaccttcatgatccccggcgagaaggtggcccacaccagcctggacgccctggtgaccttccaccagcagaagcccatcgagcccagaagagagctgctgacccagccctgcagacagaaggaccccgccaacgtggactacgaggacctgttcctgtacagcaacgccgtggccgaggaggccgcctgccccgtgagcgcccccgaggaggccagccccaagcccgtgctgtgccaccagagcaaggagagaaagcccagcgccgagatgaacagaatcaccaccaaggaggccaccagcagctgcccccccaagagccccctgggcgagaccagacagaagctgtggagaagcctgaagatgctgcccgagagaggccagagagtgagacagcagctgaagagccacctggccaccgtgaacctgagcagcctgctggacgtgagaagaagcaccgtgatcagcggccccggcaccggcaagggcagccaggaccacagcggcgaccccaccagcggcgacagaggctacaccgacccctgcgtggccaccagcctgaagagccccagccagccccaggcccccaaggacagaaaggtgcccaccagaaaggccgagagaagcgtgagctgcatcgaggtgacccccggcgacagaagctggcaccagatggtggtgagagccctgagcagccaggagagcaagcccgagcaccagggcctggccgagcccgagaacgaccagctgcccgaggagtaccagcagcccccccccttcgcccccggctactgctag

SEQ ID NO: 9346 - DNA, 480 bp, Homo sapiens
atgacccactgctgcagcccctgctgccagcccacctgctgcagaaccacctgctggaagcccaccaccgtgaccacctgcagcagcaccccctgctgccagcccagctgctgcgtgagcagctgctgccagccctgctgcagacccacctgctgccagaacacctgctgccagcccatctgcgtgaccagctgctgccagcccagctgctgcagcaccccctgctgccagcccacctgctgcggccagaccagctgcggcagcagctgcggccagagcagcagctgcgcccccgtgtactgcagaagaacctgctaccaccccaccaccgtgtgcctgcccggctgcctgaaccagagctgcggcagcaactgctgccagccctgctgcagacccgcctgctgcgagaccacctgctgcagaaccacctgcttccagcccacctgcgtgagcagctgctgccagcccagctgctgctag

SEQ ID NO: 9347 - DNA, 615 bp, Homo sapiens
atggaccccaaggacagaaagaagatccagttcagcgtgcccgccccccccagccagctggaccccagacaggtggagatgatcagaagaagaagacccacccccgccatgctgttcagactgagcgagcacagcagccccgaggaggaggccagcccccaccagagagccagcggcgagggccaccacctgaagagcaagagacccaacccctgcgcctacaccccccccagcctgaaggccgtgcagagaatcgccgagagccacctgcagagcatcagcaacctgaacgagaaccaggccagcgaggaggaggacgagctgggcgagctgagagagctgggctaccccagagaggaggacgaggaggaggaggaggacgacgaggaggaggaggaggaggaggacagccaggccgaggtgctgaaggtgatcagacagagcgccggccagaagaccacctgcggccagggcctggagggcccctgggagagacccccccccctggacgagagcgagagagacggcggcagcgaggaccaggtggaggaccccgccctgagcgagcccggcgaggagccccagagacccagccccagcgagcccggcacctag

SEQ ID NO: 9348 - DNA, 2061 bp, Homo sapiens
atgaccgacgccctgctgcccgccgccccccagcccctggagaaggagaacgacggctacttcagaaagggctgcaaccccctggcccagaccggcagaagcaagctgcagaaccagagagccgccctgaaccagcagatcctgaaggccgtgagaatgagaaccggcgccgagaacctgctgaaggtggccaccaacagcaaggtgagagagcaggtgagactggagctgagcttcgtgaacagcgacctgcagatgctgaaggaggagctggagggcctgaacatcagcgtgggcgtgtaccagaacaccgaggaggccttcaccatccccctgatccccctgggcctgaaggagaccaaggacgtggacttcgccgtggtgctgaaggacttcatcctggagcactacagcgaggacggctacctgtacgaggacgagatcgccgacctgatggacctgagacaggcctgcagaacccccagcagagacgaggccggcgtggagctgctgatgacctacttcatccagctgggcttcgtggagagcagattcttcccccccaccagacagatgggcctgctgttcacctggtacgacagcctgaccggcgtgcccgtgagccagcagaacctgctgctggagaaggccagcgtgctgttcaacaccggcgccctgtacacccagatcggcaccagatgcgacagacagacccaggccggcctggagagcgccatcgacgccttccagagagccgccggcgtgctgaactacctgaaggacaccttcacccacacccccagctacgacatgagccccgccatgctgagcgtgctggtgaagatgatgctggcccaggcccaggagagcgtgttcgagaagatcagcctgcccggcatcagaaacgagttcttcatgctggtgaaggtggcccaggaggccgccaaggtgggcgaggtgtaccagcagctgcacgccgccatgagccaggcccccgtgaaggagaacatcccctacagctgggccagcctggcctgcgtgaaggcccaccactacgccgccctggcccactacttcaccgccatcctgctgatcgaccaccaggtgaagcccggcaccgacctggaccaccaggagaagtgcctgagccagctgtacgaccacatgcccgagggcctgacccccctggccaccctgaagaacgaccagcagagaagacagctgggcaagagccacctgagaagagccatggcccaccacgaggagagcgtgagagaggccagcctgtgcaagaagctgagaagcatcgaggtgctgcagaaggtgctgtgcgccgcccaggagagaagcagactgacctacgcccagcaccaggaggaggacgacctgctgaacctgatcgacgcccccagcgtggtggccaagaccgagcaggaggtggacatcatcctgccccagttcagcaagctgaccgtgaccgacttcttccagaagctgggccccctgagcgtgttcagcgccaacaagagatggaccccccccagaagcatcagattcaccgccgaggagggcgacctgggcttcaccctgagaggcaacgcccccgtgcaggtgcacttcctggacccctactgcagcgccagcgtggccggcgccagagagggcgactacatcgtgagcatccagctggtggactgcaagtggctgaccctgagcgaggtgatgaagctgctgaagagcttcggcgaggacgagatcgagatgaaggtggtgagcctgctggacagcaccagcagcatgcacaacaagagcgccacctacagcgtgggcatgcagaagacctacagcatgatctgcctggccatcgacgacgacgacaagaccgacaagaccaagaagatcagcaagaagctgagcttcctgagctggggcaccaacaagaacagacagaagagcgccagcaccctgtgcctgcccagcgtgggcgccgccagaccccaggtgaagaagaagctgcccagccccttcagcctgctgaacagcgacagcagctggtactag

SEQ ID NO: 9349 - DNA, 1254 bp, Homo sapiens
atgcccctgtacgagggcctgggcagcggcggcgagaagaccgccgtggtgatcgacctgggcgaggccttcaccaagtgcggcttcgccggcgagaccggccccagatgcatcatccccagcgtgatcaagagagccggcatgcccaagcccgtgagagtggtgcagtacaacatcaacaccgaggagctgtacagctacctgaaggagttcatccacatcctgtacttcagacacctgctggtgaaccccagagacagaagagtggtgatcatcgagagcgtgctgtgccccagccacttcagagagaccctgaccagagtgctgttcaagtacttcgaggtgcccagcgtgctgctggcccccagccacctgatggccctgctgaccctgggcatcaacagcgccatggtgctggactgcggctacagagagagcctggtgctgcccatctacgagggcatccccgtgctgaactgctggggcgccctgcccctgggcggcaaggccctgcacaaggagctggagacccagctgctggagcagtgcaccgtggacaccagcgtggccaaggagcagagcctgcccagcgtgatgggcagcgtgcccgagggcgtgctggaggacatcaaggccagaacctgcttcgtgagcgacctgaagagaggcctgaagatccaggccgccaagttcaacatcgacggcaacaacgagagacccagccccccccccaacgtggactaccccctggacggcgagaagatcctgcacatcctgggcagcatcagagacagcgtggtggagatcctgttcgagcaggacaacgaggagcagagcgtggccaccctgatcctggacagcctgatccagtgccccatcgacaccagaaagcagctggccgagaacctggtggtgatcggcggcaccagcatgctgcccggcttcctgcacagactgctggccgagatcagatacctggtggagaagcccaagtacaagaaggccctgggcaccaagaccttcagaatccacaccccccccgccaaggccaactgcgtggcctggctgggcggcgccatcttcggcgccctgcaggacatcctgggcagcagaagcgtgagcaaggagtactacaaccagaccggcagaatccccgactggtgcagcctgaacaacccccccctggagatgatgttcgacgtgggcaagacccagccccccctgatgaagagagccttcagcaccgagaagtag

SEQ ID NO: 9350 - DNA, 2643 bp, Homo sapiens
atgagccagcccgccggcggcagaagaaagcccagaaccctgggcccccccgtgtgcagcatcagacccttcaagagcagcgagcagtacctggaggccatgaaggaggacctggccgagtggctgagagacctgtacggcctggacatcgacgccgccaacttcctgcaggtgctggagaccggcctggtgctgtgccagcacgccaacgtggtgaccgacgccgccctggccttcctggccgaggcccccgcccaggcccagaagatccccatgcccagagtgggcgtgagctgcaacggcgccgcccagcccggcaccttccaggccagagacaacgtgagcaacttcatccagtggtgcagaaaggagatgggcatccaggaggtgctgatgttcgagaccgaggacctggtgctgagaaagaacgtgaagaacgtggtgctgtgcctgctggagctgggcagaagagcctggagattcggcgtggccgcccccaccctggtgcagctggaggaggagatcgaggaggaggtgagaagagagctggccctgcccccccccgaccccagcccccccgccccccccagaagacagccctgccacttcagaaacctggaccagatggtgcagagcctggtgagccactgcacctgccccgtgcagttcagcatggtgaaggtgagcgagggcaagtacagagtgggcgacagcaacaccctgatcttcatcagaatcctgagaaaccacgtgatggtgagagtgggcggcggctgggacaccctgggccactacctggacaagcacgacccctgcagatgcaccagcctgagccacaagcccggcagcttcctgaagccccccgccccccccgtgcagcacgaggtgagagtgcaggacggccccagccagacccagcccaccatgaccatcagcagaagccagagcccccccccccccgtggactggaagacctacaccagcagcgacagaagactgagaccccccacccccagcagccccagacccagaagagagagaggcgccggcaccggcgccagcagagagatggcccccttcctgagatgccaggagagaagcctgatccccagctggagacagcccaccgccggcgacagcccccccagcccccagagcagcagcacccagaagggcagagacccccagtgcaccagcagcggcaagagagaggagagatacccccccgagctgcccagaggcagaatccccaccagctgggtgcacgaggagaccgacagctggggcaccgacgccggcaaccccaccccccagagactgagagccatcgaggccaccaccaagggcatcagcgccagaggccccagccccctgcccagaagcttcggccccgccgagtgcctgggcctgagactgcccctgagagacgaggccaagggcgccttcttccagttcagagagcccgagagcgtgagaagccccacccccgtgcagggcctgaccaagatccccatcagactgccccccgccagaccccccacccccggcagaagcttccccggcgccaccagcggcagccccagaaccgagctgggcagagaccccatccccctgagagccgtgaccgtggacctggccggcagcacccacggcgactgcagcgtggaggtgagacaggaggaccagcagctggacatccaggtgatggccgaggccagagagagctgggacctgggcctgcaggagcaggagggcagatacacccccctgcccctgggcggcaacaaggagcaggccatctactgcagcctggaggaggagatcctgggcaacatgaagctgctggaggtgagaagcgcctgcccccagggcaccagaagcggcgtgatccccagaagcggcgtgtacatccccagactggccggccagtggcccgagcccggcggcccctacgacaaggccatccaggagctggcccagggcagccccagcctgctgaaggtggacctggaggcctggaaggccgcccccaccggcagccccaagcccgccgtgacccccggccccggcagcctgaagggcaagctgggcgccagacagagcggccccagaaccaaggccagcctgagcgccaagggcacccacatgagaaaggtgcccccccagggcggccaggactgcagcgccagcaccgtgagcgccagccccgaggcccccacccccagccccctggaccccaacagcgacaaggccaaggcctgcctgagcaagggcagaagaaccctgagaaagcccaagagagtgcccagcatctacaagctgaagctgagacccagaatcagacccagaagagaccacagacccgagaagcagcccagcagaatccccagacccctggcctacgtgttcctgggccccgccagacagccccccaaggacagactgctgagagccgtgctgggcagcaagggcggcgaggccagcagagtggacggcgccagcgtgggcgaggaggaggaggagggcaaggaggagaaggagcccgccgcccccctggagagcagcccccagccccccgagggcctgcagccccactggctgaaccaggcccccctgccccccgaggaggagagctgggtgtag

SEQ ID NO: 9351 - DNA, 14262 bp, Homo sapiens
atggtgcccgaggagagaagagtgggcctgagcagcgacgagaccagcagcgacagcctgaagagctggcacagcatctgcgtgctggacagcaaggagcagcccctggcctgccagcagaagcagagacagttcgtgaagcccgtgaccgagagcgagcagcccaccgtgctggagctgctgctggccgagctgagaaccctgttcagcgccgtgctgcaggacagcagccccgccgcctggagatacctgcacgccgtgctgggcctgctgcccccctacagagagctgctggtgggccacctggacctgctgcccttcctggagcagctgtactgctgggccccctgggtgcagacccacctgcacctggacctgctgggcgccatcgtgcaggccttcccccccgacagcagcctgctggacagcgccagccacgccgactgctgcccccagaagagaagactgcaccacagacccccctgccccgcctgccccttcgtgcaggcccagtggagcagacagcaggtgaaggaggagctggccacctggctgagacccctgaccctgcccgagctgcagagatgcctgggcatcgtgggcgcccaggtggccctggaggaggccgtgtggctggacggcctgagcctgctgcccctggccctggccgccgacatccccgtgagatacgagagcagcgacaccgacaacgccgaggtggagcccgtgggcagaaaggagaccagaagccagctggactacgaggtgcccagagagaaggccttccagaagagcagcaccggcttcagccccgagaccagcttcctggacagccaggtgatgaccgccctgaagatggagagatacctgaagaagatccacttcctgtacctgaacgtggcccccagcagatacttcagaccctacagcctgatggtggtgccccccgacaaggtgaaccccgagcactacatcttcagccccttcggcatcctgcacgtgcaccccgtggagggcagcgagaccatgaccctgggcacctggcaccaccactgcgtgctgtggcagcagctgcagttcatccccttcttcaagtactgcctgctgagaaagagcttcacctgctggaagaagaacgtgagactgcagggcctgcacagactgcagaagttcctggagaaccacctgctgctggccgtgccccacttcggcgccggcctgctgcacatcagcagactgctgcaggagctgcacagcgtgagctggctgccccaggagctggacagatgctacgagctgctggacctgcagaccgccctggccgaggagaagcacaaggccctgagactgctgcacagatgcctgaacctgtgcaccagcatcctgagactggtgcacgaggacacctaccacatgcagcagtgcctgcaggagagagtgcagaactgcgacagaatcagaaccggccagggcagcatctacctgcagagagtgcagcacaagcagctggagcagaagctgaagcaggccgaggcctggtggctgcagctgggcaagttcgccagactggtggactacatgatctgccagagcctgatcagcgtgctggaggagcagatcaccagcttcgtggccaacatcctgcaggcccccagacagaagcccttcctgagcagccagctggtgttcgacgaccacggccagctgagccacgtgccctgcgtggagaacatgatccagaccctgaccggcggcctgcagagcgtgaagaccagcgccctgcaggtggtgcagagcgccgacctgaagaccagcagcgacagcctgtacagcgaggaggaggacgaggaggaggacagcaaggacgagttcctgatgcccaagttccagggccagcccagcgacgccgtgagcatcttctgcggccccaacgtgggcctggtgtggccctggaagagccaccccatcgccggcatcctggaggtgagaggctgcagactgagaggccagtacttcccccacaactacaagcagctggaggaggacctggacaacaaccccaagatccagcaggccctgaacatccagcaggtgctgctggagggcgtgctgtgcaaggtgcaggagttctgcagagagcaccactggatcaccggcatctacgagttcctgcagagctggggcccccagaagctggaggacatgagaggcggccccatcaagaactacgtgaccctggtgagcagactgaacgtgtggcaggccagagtgagcagcatgcccatcgagctgctgaccaagggcggcctgctgctgctgagctgccacgacgtgcaggccgagatggagagcaagctgaacagcatcagaaaggacatcctggcccacgtgcagaacgagtgctggaacctgagccagcagctgatgaccgagctgaccgacttcatgcacatcttcagaaccatcaacagcgacatccacgccatcgcccagtgcacccagaagctgaacgaggccaacgagcagtacgtggagctggaggagagaatggagtacgtgagagccctgcacgagctgatcagaaaccacttcagcctgttcagcgccgagaacgaggccctggacatcagcgtgagaagacagttcggcgagagccccatccccccctgccccccccccccccagccccacctgctgcactgccccctgctggccccccagctgctggacatgtgggaggccttccagttcgagaagagccaggccagcgagttcctgctgagcaagagacacgccatcatgcccaagctgcagcagctgatggccgccgccctggccgagctggagggcctgctggccaaggccctgagcggccccttcatggaccccacccaggaccagagaagcaccgagcaccagctggtgagcctggagagacagttccagaacaccgtgagcgacctgagcgagctgcaccacgcctacgccatcttcaccgaggacgagacccccgtgcccctgcccatctgcggcaccagacccatcgtgcagcagcagagaatctggcacctgtacagagtgatcagcgagaacatcagcgagtggaagtgcatggccttcgccaagttcagccccgccatggcccaggagaagaccgagggctggctgaccgaggccgccagaatgagcaccaccctggagctgcacagccccgtgctgcagcactgcatgagaatcctgggcgagttcagaagctacctgcccctgctgaccaagctgggcagcctgcacccccagagcctgaactgccagtgcctgctgagagccctgggcctgggcagcctgcagaccatcgagctgctgaccctgggccagctgctgacctaccccctgctggagttcgccgacagaatcaaccaggtgtggcagaacgagaacgagagaatccacgcccaggagaccatcagaagactgcagagatactgggaggccagacagctgagactgctgaacttcatcctgcacgtgccctacgagccccccgccagcgagagaagcaagagacaggtgctgagaagcccccagtgggaggtggtggacaaggacagcggcaccttcatcctgagcgactacagcaacctgcaggacagcatccaggagagcctgcaggtgctgagcaagatcctggccatcgagaagagcggcgacctgaacaagatcgccctggagtgggtggccatcatgcacggcctgggcgccctgctggaggtgtggctgaccttccagcagaagtggatcttcctgaacaaggtgctgcacgagatgaagatccagttccccaacgccgacctgaacagcagattcaaggtgatggacgaccagtacagaaccctgatgagaatcagcgtggccgaccccatggtgctgagcctggtggtgcccagcgccgagagaagcccctacttccagggccagcagctgcagcagctgctgcaggccggcagcgtggagctggagggcatcatcatgagcctggagagcgtgctgtacggcgtgtgcgcccacttccccagactgttcttcctgagcgacagcgagctggtggccctgctggccgccagactggagagctgcgaggcccagctgtgggtgagaagatgcttcccccacgtgcacgccgtgagcttcagaagctgccccaccggcgagaagaacaccgacgactgggagagcagccccaacacccagacccaggtggaggccctggccgtgctgggcgccggcggcgaggaggtgaagctgcagggccccctgcccctgcaccccgacctgcccaagtggctggccagcctggagaagtgcctgagactggccctggtgcacatgctgcagggctgcgtggccgccagactggccagaggccccagcctgggcgaggccctgaagcagctgcccaagcagaacaagctgtacctgcagctgtacgtgcagcactggatcgacctggtgcaggccttcccctggcagtgcgtgctggtggccgaggaggtggtgtggagagccgagatggaggaggccctgctggagtggggcaccctggccatggtgagcatgcacatgagaaagctggaggtgctggtgaacttcatgagagcccagagagccagccagggcggccagagcctgcccagcgtgagacagaccagcctgctgagcgccctgctggtgatggccgtgacccacagagacatcgcccagctgctggagcagcaccaggtgagcgacctgaccgacttccactgggtgagacagctgaagtaccacctgggcagcccccacatcatccccaagagccccctgcagagcctgaagaccatcgccagcagcgagcccagcctgagccccgccgcctgctggatcgacgtgctgggcagaagcttcctgtacaactacgagtacctgggccccagactgggccccctgcccagcctgctgcccgagagacccgccctggtgctgctgctggccctggaggaggtggcctgcggcaccgtgctgggccccaacggcgtgggcaagagagccatcgtgaacagcctggcccaggccctgggcagacagctggtgatgctgccctgcagcccccagatcgaggcccagtgcctgagcaactacctgaacggcgccctgcagggcggcgcctggctgctgctggagaaggtgcaccagctgccccccggcctgctgagcgccctgggccagagactgggcgagctgcaccacctgtacgcccccctgtaccaggaggccagcagaaacaccagcaccatcgaccccacccagccccagctgctgggcagcagcttcttcgagaagcaccacgtgagcgtgagactgggctacggctgcctgctggtgctgagagccctgagcagcgccgtgcccgccaacctgcacctgctgctgagacccgtggccctggccctgcccgacctgagacaggtggccgagctgaccctgctgggcgccggcatgagagacgccttccagatggccaccagactgagcaagttcttcagcctggagagagagctggtgagcggccccctgccctgcagactgcccctgctgaagcagatcctggaggacaccatcagaaccctgaacgtgaccaaggaggagcccaagtgccagaagcccagaagcctggccgccatcgaggaggccgccctgctgagaagccccctgttcagcatcctgaacggcctgcacctgcacaacctgagaggcctgctgtgcgccctgttccccagcgccagccaggtgctggccgagcccatgacctacaagctgatgaagcccctggtggtggaggagctgcagcaggtgggcctggaccccagccccgacatcctgggcagcctggagcagctgagccaggccctgagcagagccagcggcatcctgctgctgggccccgccggcagcggcaagaccacctgctggcacagcctgttcaagatccagaacagactggccgccatggaggacaccagcacccagggctgccagcccgtggagatcacccacctgtaccccagcggcctgagcccccaggagttcctgggctggctggagggcagctgctggcaccacggcatcttccccaaggtgctgagagccgccggccagtgcaacaacatgggccagaagagacagaccgaggagagcatcggcatccagcactggatcatctgcgacggcgccagcaacggcgcctggctggacagcatcacctgcctgctgagcgagctgccccagctgagcctgcccagcggccagcagatcgccagaccccccggcaccttcctgctgatggaggtggccgacaccaccggcatcagccccaccgtggtgggctgctgcgccctggtgtggtgcggcggcgagcagacctggcagtgcatcctgagcgccctgatggccagcctgccctacgagtacagactgcagcacagaaccgtggccgagctgaaccacatggccgaggtgctggtgcccgccaccctgagattcctgacctgccagggcgtgagcagcctgctgcaggtgcacggccagcaggccgtgtgcgccggcgtggccgaggtgaccagcatggccagaatcctgcacagcctgctggacctgcacctgagactgaaggaggagaaggcccccggccccgaggacctgagctacagcgaccccgtggcccagagcttcagaagcagcaagagcagcttcctgaacagaagccaggtggacagcgacgacgtgcccgacaagtgcagagagcacctgctggccgtgagcagcttcctgttcgccctgatctggggcttcggcgcccacctgcccagcagattctggcccatcttcgacaccttcatcagagacagcatcagcagactgagcaactaccccgagcccccccccagcgccctggtgttcgacctgcacgtgagccccgaggacggcaccctggtgcccttcaccggccagtacctgagcagccacatcaagggcaccctgggcaccttccaccccagcatccagaccgagagactgctgtacgtggtggacctgctgctgagcggcggccagcccgtgctgctggccggcgaggccgccaccggcaagagcgccttcgtggaggtgctggtggagccccaccacccctacatctacagccccatccaccccgccttcagcagcagccacctgagactgctgctgagcagaggcatccagggccagacccaggccagcccccagcccggccaccaccaggacagcaagcccagcctgctgttcctgctggaggacctgcacctggccaccagcgaccccgagaagagctgccagcccgtgctggagaccctgagacaggccatggacggcaccgtgtacgcccacagcaccctggagctgcagaccctgcagcccaccgtgaacttcctggccaccgtgaccgtgcccggctactgcgagagacccctgtgccccagactgttcagactgttcaccgtgctggccctggagagcatgacccaggccaccctgctggagagacacgtgcccatcatccaggcctggctggagagattccccagcgtggagagagagagagccctggccagaggcctggtgagagccagcgtggaggcctgggaggccgtgtgcaactgcttcatgcccagccccctgcacccccactaccacttcagcctgcacagcgtgagccacctgctgagcagcctgcagctgctgcccaacagaaccggcagcagaggcttcgtggactaccccaaccaccaggagcacctgagaagagtgagcggcctgagaggcacctgcctgaccgtgatgatggccaccagaaacgtggtgagactgtggctgcacgaggcccagagaaccttctgcgacagactggacagccccagagagagaagctactgcgccaagctgctgctggtggtggcccagagcgtgttctgctgcggccccggcccccagcacctgggcaaggaccaccaggagagcgaggaggaggaggaggaggagagagtgcccgaggtggagagcgagggcgagctggcccagtgggaggacttcagcaacagcaacagcgagaccgaggaggaggaggagccctacggcctgcaggtggccagagtgagcaacagcagagaccccagcctgacccccagcatcggccccgtgagcagaggcatgaaggagagcatcagccacaagatcagacaggagaagggcaccagagccagcaactacagactgcaggtgagaagaagcttcaagacctggtggcagaagaagccccagatggacctgatcagccccctgctgctgcccgtgctgctgctgcacccccaggagaagcccagcgacctggtgttcagccaggagctgatcctgggccccaacagcgagacccccaacctgtacctggagagacagtgggagaagctggaggagcagctggccaccagcgccgcccagctgaagctgagcccccacctggccagatgccacagcatggcccagcacgtggccagactggtgagagtgctggccagacccagacagcacggcctgctgctgagcggcgccctgggcaccggcagacacaccgccatcaccctggccagcagcatctgccaggcccacttcttccacctgcccagcggcagcgaggaggccatcctgcagtgcctgagagacgccagctggcacgccggcatgctgagccagcccgtggccctgctggtgcccagcggcgtggacctgaccaccctgcacagactgctggccctggccaccagcggcagcttccccggccagtacaccgaggccgacctggacagaatcggcgagcacctgcccagagagaacctgggcgtgaagcagaacatcaagaaggagatggtgctgcagagattccaccagcaggtgtgcagccacctgcacctgttcttcctgatcggcgacaagcaggcccacaagcagctgcccagcaccctgttcctgagactgctgcagctggccaccgccagcatcgacagatacgagccctgggaccaggccgccctggccaaggtggcccagcaccacctggagggcgcccagagcgtgcccctggacgacggcagctggaagtaccccgacctgcaggccagcatccccagcgtggccaaggccatggccctgatccacctgagcgccacccactaccacgagcacctgtgccccgccctgcccctggtgacccccaagaccttcctggacttcctggacaccttcctgatgctgcagcagcagaccatcctgaagatcaagaacaaggcccagagagtgcagaacgccctggagaacctgagaatgctgatcaaggagcacggcacccacgccaacctgatcttcgacctggagcagcagctgaaggacagcggcaagagcctgagcatgttccagcagcagctggagcagagcaagctgctgtacaagcagcagctggaggagtgcagacaccaggagaacctgatcgagaacctggccagacagagagacgccctgcaggcccagagagaggccttcctggagcagatgagcaaggccttcctggagcccctgagccagctgcaggtggccgacttcgaggagatcagaagctacagagccccccccgagagcgtggtgagagtgaccgacgccatgtgcgacctgttccaccacgagaccggctgggccagcgccaagcagctgctgtgcaccgaggacttctaccaggagctggtgttcttccccaaggagaagatcaccgacagcgagctgatcaagctgcacctgatcctgaaggcccccggcatggacgacgccgccctgagagccgtgagcagacccgccgccagcctggccgcctggctgtgggccgtgctgcactacggcctggcccactgcagaggcctgcccaccgacctgctgctgcagcaggtggaggccaccctgaccagagagcaggccagactgggctactaccagttccaggcccaggagaccctggagcacaacctggccctggccaagatggtggaggacgcccaggccagccacaactgcgtggccaagaccctgagccaggcccagtgcggccagtaccacaagtggcccatgaaggccgccctgctgacccccatgagagcctggaccacccagctgcagaagctgaagggcagatgcatgaccgtgttcggcgacaccctgctgtgcagcgccgccatcatctacctgggccccttcccccccctgagaagacaggagctgctggacgagtggctggccctgtgcagaggcttccaggaggccctgggccccgacgacgtggcccaggccctgaagagaaagcagaagagcgtgagcatcccccccaagaaccccctgctggccacccacagccccttcagcatcctgagcctgctgagcagcgagagcgagcagtaccagtgggacggcaacctgaagccccaggccaagagcgcccacctggccggcctgctgctgagaagccccacccactacagcagctgcagatggcccctgctgctggaccccagcaacgaggccctgatctggctggaccccctgcccctggaggagaacagaagcttcgcccccgccctgaccgagggcagaggcaagggcctgatgagaaaccagaagagagagagcaagaccgacatgaaggaggaggacgacgagagcgaggagagcaacgaggccgaggaccagaccaaggagcagaaggccgaggagagaaagaacgagcaggagaaggagcaggaggagaacgaggagaaggaggaggagaagaccgagagccagggcagcaagcccgcctacgagacccagctgcccagcctgccctacctgagcgtgctgagcggcgccgaccccgagctgggcagccagctgcaggaggccgccgcctgcggcctgcccgtgctgctgaccaacgtggagctgggcctgggctgcgaggagctgcagtggctgctgcagagagagcagctgagccccccccaggtgcagcccggcttctgcctgtacctgagcaccaccctgagcctgtgcgccatggagaaggtgctgggctgcgagctgctgaagggcctgaacgtgctggacctgggcctgaacatggagatcctggaggagcagatgctgcacgagatcctgtgcagagagtaccccgagctggagaccagatggcaggacctgaagatcagagccctggacacctgcaaggccgtggaggccgccgaggagagactgctgaccatgctgctgttccagaaccccaagagacagaagcccgccaagttcctgagaaacatcgtgagagcccagggcaagctgtgccagctgagagcccactgcgaggagctggagggccagaagctgcaggagatggtgctgtgggccccctacagacccgtggtgtggcacggcatggccatggtgaaggccctgagccagctgcagaacctgctgcccctgttctgcatgagccccgagaactggctggccgtgaccaagcaggccctggacagcatgaagcccagagagatcaaccacggcgaggacctggccagccacctgctgcagctgagagcccacctgaccagacagctgctgggcagcaccgtgaccgccctgggcctgacccaggtgcccctggtgggcgccctgggcgccctggccctgctgcaggccaccggcaaggccagcgagctggagagactggccctgtggcccggcctggccgccagccccagcaccgtgcacagcaagcccgtgagcgacgtggccagacccgcctggctgggccccaaggcctggcacgagtgcgagatgctggagctgctgccccccttcgtgggcctgtgcgccagcctggccggccacagcagcgcctggcaggcctacctgagcctgagcagcaccgtgctgggccccgcccccggccccggccccgagcccctgagcctgctgcagaagctgatcctgtggagagtgctgagacccgagtgcctggccggcgccctggccgacttcaccaccagcctgctgggcagacccctggacgagaacacctacgcccccaccatgcccttcaagcacagccaggccacccagcccatgctgatcctgctgcccccccccggccaccccagcgccaccctgcaccccctgaccgtgatccagaagctggccgccaagtaccagcagggccagaagcagctgcaggtgatcgccctgggcagcgaggcctgggaccccgtgagcgtggtggtgagcaccctgagccaggccatgtacgagggccactggctggtgctggacaactgccacctgatgccccactggcccaaggagctgctgcagctgctgctggagctgctgggcagagccaaggtggtggccgacctggagagcgagcagctgctggaccagcccgagagcagaaacgtgagcaccgtgcacagagacttcagactgtggctgatcgtgcccgccgagagcagcgccagcctgcccgccgtgctgacccagcacagcatgcccgtgttctggaaccagagcctggagctgggccacgtgctgatcgacagcgtggagctggcccagcaggtgctgtacatgcagccccccacccaggccctgcccctgctgctgctgcacggcctgctgctgcacagacagctgtacggcaccagactgcaggcccacagaggcagatggagccaggtgaccctgacccaggtgctgcagacccaggaccagctgtgggccagcctgagcaaccccagagccgccatgcaggagctggccgccagcgtgttctacggcggccccctgggcgacaccgaggacagagaggccctgatcagcctgacccaggcctgcctgagccccagcagcggcagctgggtgcagccccacaccccccagagcctgctggccaccctgatgcccctgcccgagctgagagagctggacgccatggccgagtgcaaggcccagatgcacctgctgcccagcccccccgagcccagactgtgcggcctgagcgagggcccccaggcctggctgctgagaagacagagcagagccctgctgagcgccctgcagagaagcagccccgtgtgggtgcccgagagcagaagaggcgcccagctggccgagagaagactgagacagagactggtgcaggtgaacagaagactggagagcctgcaggacctgctgacccacgtgatcagacaggacgagagcgacgccccctggagcgtgctgggccccaacgccagaagacccctggagggcgtgctggagaccgaggccctggagctgagccagctggtgggcaccctgcagagagacctggactgcctgctgcagcagctgaagggcgcccccccctgccccagcagaagatgcgccgccgtggcccacgccctgtggaccggcagactgcccctgccctggagaccccacgcccccgccggcccccagcccccctggcactggctgagacagctgagcagaagaggccagctgctggtgagatacctgggcgtgggcgccgacgccagcagcgacgtgcccgagagagtgttccacctgagcgccttcagacaccccagaagactgctgctggccctgagaggcgaggccgccctggaccagaacgtgcccagcagcaacttccccggcagcagaggcagcgtgagcagccagctgcagtacaagagactggagatgaacagcaaccccctgcacttcagagtggagaacggccccaaccccaccgtgcccgagagaggcctgctgctgatcggcctgcaggtgctgcacgccgagtgggaccccatcgccggcgccctgcaggacagccccagcagccagcccagccccctgccccccgtgagcatcagcacccaggcccccggcaccagcgacctgcccgcccccgccgacctgaccgtgtacagctgccccgtgtacatgggcggccccctgggcaccgccaagctgcagagcagaaacatcgtgatgcacctgcccctgcccaccaagctgacccccaacacctgcgtgcagagaagagtgcacgtgtgcagcccccccctgagctag

SEQ ID NO: 9352 - DNA, 1179 bp, Homo sapiens
atggacctgttcggcgacctgcccgagcccgagagaagccccagacccgccgccggcaaggaggcccagaagggccccctgctgttcgacgacctgccccccgccagcagcaccgacagcggcagcggcggccccctgctgttcgacgacctgccccccgccagcagcggcgacagcggcagcctggccaccagcatcagccagatggtgaagaccgagggcaagggcgccaagagaaagaccagcgaggaggagaagaacggcagcgaggagctggtggagaagaaggtgtgcaaggccagcagcgtgatcttcggcctgaagggctacgtggccgagagaaagggcgagagagaggagatgcaggacgcccacgtgatcctgaacgacatcaccgaggagtgcagaccccccagcagcctgatcaccagagtgagctacttcgccgtgttcgacggccacggcggcatcagagccagcaagttcgccgcccagaacctgcaccagaacctgatcagaaagttccccaagggcgacgtgatcagcgtggagaagaccgtgaagagatgcctgctggacaccttcaagcacaccgacgaggagttcctgaagcaggccagcagccagaagcccgcctggaaggacggcagcaccgccacctgcgtgctggccgtggacaacatcctgtacatcgccaacctgggcgacagcagagccatcctgtgcagatacaacgaggagagccagaagcacgccgccctgagcctgagcaaggagcacaaccccacccagtacgaggagagaatgagaatccagaaggccggcggcaacgtgagagacggcagagtgctgggcgtgctggaggtgagcagaagcatcggcgacggccagtacaagagatgcggcgtgaccagcgtgcccgacatcagaagatgccagctgacccccaacgacagattcatcctgctggcctgcgacggcctgttcaaggtgttcacccccgaggaggccgtgaacttcatcctgagctgcctggaggacgagaagatccagaccagagagggcaagagcgccgccgacgccagatacgaggccgcctgcaacagactggccaacaaggccgtgcagagaggcagcgccgacaacgtgaccgtgatggtggtgagaatcggccactag

SEQ ID NO: 9353 - DNA, 2193 bp, Homo sapiens
atgttcggcagaaagagaagcgtgagcttcggcggcttcggctggatcgacaagaccatgctggccagcctgaaggtgaagaagcaggagctggccaacagcagcgacgccaccctgcccgacagacccctgagcccccccctgaccgccccccccaccatgaagagcagcgagttcttcgagatgctggagaagatgcagggcatcaagctggaggagcagaagcccggcccccagaagaacaaggacgactacatcccctaccccagcatcgacgaggtggtggagaagggcggcccctacccccaggtgatcctgccccagttcggcggctactggatcgaggaccccgagaacgtgggcacccccaccagcctgggcagcagcatctgcgaggaggaggaggaggacaacctgagccccaacaccttcggctacaagctggagtgcaagggcgaggccagagcctacagaagacacttcctgggcaaggaccacctgaacttctactgcaccggcagcagcctgggcaacctgatcctgagcgtgaagtgcgaggaggccgagggcatcgagtacctgagagtgatcctgagaagcaagctgaagaccgtgcacgagagaatccccctggccggcctgagcaagctgcccagcgtgccccagatcgccaaggccttctgcgacgacgccgtgggcctgagattcaaccccgtgctgtaccccaaggccagccagatgatcgtgagctacgacgagcacgaggtgaacaacaccttcaagttcggcgtgatctaccagaaggccagacagaccctggaggaggagctgttcggcaacaacgaggagagccccgccttcaaggagttcctggacctgctgggcgacaccatcaccctgcaggacttcaagggcttcagaggcggcctggacgtgacccacggccagaccggcgtggagagcgtgtacaccaccttcagagacagagagatcatgttccacgtgagcaccaagctgcccttcaccgacggcgacgcccagcagctgcagagaaagagacacatcggcaacgacatcgtggccatcatcttccaggaggagaacacccccttcgtgcccgacatgatcgccagcaacttcctgcacgcctacatcgtggtgcaggtggagacccccggcaccgagacccccagctacaaggtgagcgtgaccgccagagaggacgtgcccaccttcggcccccccctgcccagcccccccgtgttccagaagggccccgagttcagagagttcctgctgaccaagctgaccaacgccgagaacgcctgctgcaagagcgacaagttcgccaagctggaggacagaaccagagccgccctgctggacaacctgcacgacgagctgcacgcccacacccaggccatgctgggcctgggccccgaggaggacaagttcgagaacggcggccacggcggcttcctggagagcttcaagagagccatcagagtgagaagccacagcatggagaccatggtgggcggccagaagaagagccacagcggcggcatccccggcagcctgagcggcggcatcagccacaacagcatggaggtgaccaagaccaccttcagcccccccgtggtggccgccaccgtgaagaaccagagcagaagccccatcaagagaagaagcggcctgttccccagactgcacaccggcagcgagggccagggcgacagcagagccagatgcgacagcaccagcagcacccccaagacccccgacggcggccacagcagccaggagatcaagagcgagaccagcagcaaccccagcagccccgagatctgccccaacaaggagaagcccttcatgaagctgaaggagaacggcagagccatcagcagaagcagcagcagcaccagcagcgtgagcagcaccgccggcgagggcgaggccatggaggagggcgacagcggcggcagccagcccagcaccaccagccccttcaagcaggaggtgttcgtgtacagccccagccccagcagcgagagccccagcctgggcgccgccgccacccccatcatcatgagcagaagccccaccgacgccaagagcagaaacagccccagaagcaacctgaagttcagattcgacaagctgagccacgccagcagcggcgccggccactag

SEQ ID NO: 9354 - DNA, 1110 bp, Homo sapiens
atgtggagcggcagaaagctgggcagcagcggcggctggttcctgagagtgctgggccccggcggctgcaacaccaaggccgccagacccctgatcagcagcgccgtgtacgtgaagaaccagctgagcggcaccctgcagatcaagcccggcgtgttcaacgagtacagaaccatctggttcaagagctacagaaccatcttcagctgcctgaacagaatcaagagcttcagatacccctgggccagactgtacagcaccagccagaccaccgtggacagcggcgaggtgaagaccttcctggccctggcccacaagtggtgggacgagcagggcgtgtacgcccccctgcacagcatgaacgacctgagagtgcccttcatcagagacaacctgctgaagaccatccccaaccaccagcccggcaagcccctgctgggcatgaagatcctggacgtgggctgcggcggcggcctgctgaccgagcccctgggcagactgggcgccagcgtgatcggcatcgaccccgtggacgagaacatcaagaccgcccagtgccacaagagcttcgaccccgtgctggacaagagaatcgagtacagagtgtgcagcctggaggagatcgtggaggagaccgccgagaccttcgacgccgtggtggccagcgaggtggtggagcacgtgatcgacctggagaccttcctgcagtgctgctgccaggtgctgaagcccggcggcagcctgttcatcaccaccatcaacaagacccagctgagctacgccctgggcatcgtgttcagcgagcagatcgccagcatcgtgcccaagggcacccacacctgggagaagttcgtgagccccgagaccctggagagcatcctggagagcaacggcctgagcgtgcagaccgtggtgggcatgctgtacaaccccttcagcggctactggcactggagcgagaacaccagcctgaactacgccgcctacgccgtgaagagcagagtgcaggagcaccccgccagcgccgagttcgtgctgaagggcgagaccgaggagctgcaggccaacgcctgcaccaaccccgccgtgcacgagaagctgaagaagtag

SEQ ID NO: 9355 - DNA, 1782 bp, Homo sapiens
atggagggctgcatgggcgaggagagcttccagatgtgggagctgaacagaagactggaggcctacctggccagagtgaaggccctggaggagcagaacgagctgctgagcgccgagctgggcggcctgagagcccagagcgccgacaccagctggagagcccacgccgacgacgagctggccgccctgagagccctggtggaccagagatggagagagaagcacgccgccgaggtggccagagacaacctggccgaggagctggagggcgtggccggcagatgccagcagctgagactggccagagagagaaccaccgaggaggtggccagaaacagaagagccgtggaggccgagaagtgcgccagagcctggctgagcagccaggtggccgagctggagagagagctggaggccctgagagtggcccacgaggaggagagagtgggcctgaacgcccaggccgcctgcgcccccagatgccccgccccccccagaggcccccccgcccccgcccccgaggtggaggagctggccagaagactgggcgaggcctggagaggcgccgtgagaggctaccaggagagagtggcccacatggagaccagcctgggccaggccagagagagactgggcagagccgtgcagggcgccagagagggcagactggagctgcagcagctgcaggccgagagaggcggcctgctggagagaagagccgccctggagcagagactggagggcagatggcaggagagactgagagccaccgagaagttccagctggccgtggaggccctggagcaggagaagcagggcctgcagagccagatcgcccaggtgctggagggcagacagcagctggcccacctgaagatgagcctgagcctggaggtggccacctacagaaccctgctggaggccgagaacagcagactgcagacccccggcggcggcagcaagaccagcctgagcttccaggaccccaagctggagctgcagttccccagaacccccgagggcagaagactgggcagcctgctgcccgtgctgagccccaccagcctgcccagccccctgcccgccaccctggagacccccgtgcccgccttcctgaagaaccaggagttcctgcaggccagaacccccaccctggccagcacccccatcccccccaccccccaggcccccagccccgccgtggacgccgagatcagagcccaggacgcccccctgagcctgctgcagacccagggcggcagaaagcaggcccccgagcccctgagagccgaggccagagtggccatccccgccagcgtgctgcccggccccgaggagcccggcggccagagacaggaggccagcaccggccagagccccgaggaccacgccagcctggccccccccctgagccccgaccacagcagcctggaggccaaggacggcgagagcggcggcagcagagtgttcagcatctgcagaggcgagggcgagggccagatctggggcctggtggagaaggagaccgccatcgagggcaaggtggtgagcagcctgcagcaggagatctgggaggaggaggacctgaacagaaaggagatccaggacagccaggtgcccctggagaaggagaccctgaagagcctgggcgaggagatccaggagagcctgaagaccctggagaaccagagccacgagaccctggagagagagaaccaggagtgccccagaagcctggaggaggacctggagaccctgaagagcctggagaagaagaagtag

SEQ ID NO: 9356 - DNA, 3456 bp, Homo sapiens
atgatggccgccgccctgggcccccccgaggtgatcgcccagctggagaacgccgccaaggtgctgatggccccccccagcatggtgaacaacgagcagagacagcacgccgagcacatcttcctgagcttcagaaagagcaagagccccttcgccgtgtgcaagcacatcctggagaccagcaaggtggactacgtgctgttccaggccgccaccgccatcatggaggccgtggtgagagagtggatcctgctggagaagggcagcatcgagagcctgagaaccttcctgctgacctacgtgctgcagagacccaacctgcagaagtacgtgagagagcagatcctgctggccgtggccgtgatcgtgaagagaggcagcctggacaagagcatcgactgcaagagcatcttccacgaggtgagccagctgatcagcagcggcaaccccaccgtgcagaccctggcctgcagcatcctgaccgccctgctgagcgagttcagcagcagcagcaagaccagcaacatcggcctgagcatggagttccacggcaactgcaagagagtgttccaggaggaggacctgagacagatcttcatgctgaccgtggaggtgctgcaggagttcagcagaagagagaacctgaacgcccagatgagcagcgtgttccagagatacctggccctggccaaccaggtgctgagctggaacttcctgccccccaacctgggcagacactacatcgccatgttcgagagcagccagaacgtgctgctgaagcccaccgagagctggagagagaccctgctggacagcagagtgatggagctgttcttcaccgtgcacagaaagatcagagaggacagcgacatggcccaggacagcctgcagtgcctggcccagctggccagcctgcacggccccatcttccccgacgagggcagccaggtggactacctggcccacttcatcgagggcctgctgaacaccatcaacggcatcgagatcgaggacagcgaggccgtgggcatcagcagcatcatcagcaacctgatcaccgtgttccccagaaacgtgctgaccgccatccccagcgagctgttcagcagcttcgtgaactgcctgacccacctgacctgcagcttcggcagaagcgccgccctggaggaggtgctggacaaggacgacatggtgtacatggaggcctacgacaagctgctggagagctggctgaccctggtgcaggacgacaagcacttccacaagggcttcttcacccagcacgccgtgcaggtgttcaacagctacatccagtgccacctggccgcccccgacggcaccagaaacctgaccgccaacggcgtggccagcagagaggaggaggagatcagcgagctgcaggaggacgacagagaccagttcagcgaccagctggccagcgtgggcatgctgggcagaatcgccgccgagcactgcatccccctgctgaccagcctgctggaggagagagtgaccagactgcacggccagctgcagagacaccagcagcagctgctggccagccccggcagcagcaccgtggacaacaagatgctggacgacctgtacgaggacatccactggctgatcctggtgaccggctacctgctggccgacgacacccagggcgagacccccctgatcccccccgagatcatggagtacagcatcaagcacagcagcgaggtggacatcaacaccaccctgcagatcctgggcagccccggcgagaaggccagcagcatccccggctacaacagaaccgacagcgtgatcagactgctgagcgccatcctgagagtgagcgaggtggagagcagagccatcagagccgacctgacccacctgctgagcccccagatgggcaaggacatcgtgtggttcctgaagagatgggccaagacctacctgctggtggacgagaagctgtacgaccagatcagcctgcccttcagcaccgccttcggcgccgacaccgagggcagccagtggatcatcggctacctgctgcagaaggtgatcagcaacctgagcgtgtggagcagcgagcaggacctggccaacgacaccgtgcagctgctggtgaccctggtggagagaagagagagagccaacctggtgatccagtgcgagaactggtggaacctggccaagcagttcgccagcagaagcccccccctgaacttcctgagcagccccgtgcagagaaccctgatgaaggccctggtgctgggcggcttcgcccacatggacaccgagaccaagcagcagtactggaccgaggtgctgcagcccctgcagcagagattcctgagagtgatcaaccaggagaacttccagcagatgtgccagcaggaggaggtgaagcaggagatcaccgccaccctggaggccctgtgcggcatcgccgaggccacccagatcgacaacgtggccatcctgttcaacttcctgatggacttcctgaccaactgcatcggcctgatggaggtgtacaagaacacccccgagaccgtgaacctgatcatcgaggtgttcgtggaggtggcccacaagcagatctgctacctgggcgagagcaaggccatgaacctgtacgaggcctgcctgaccctgctgcaggtgtacagcaagaacaacctgggcagacagagaatcgacgtgaccgccgaggaggagcagtaccaggacctgctgctgatcatggagctgctgaccaacctgctgagcaaggagttcatcgacttcagcgacaccgacgaggtgttcagaggccacgagcccggccaggccgccaacagaagcgtgagcgccgccgacgtggtgctgtacggcgtgaacctgatcctgcccctgatgagccaggacctgctgaagttccccaccctgtgcaaccagtactacaagctgatcaccttcatctgcgagatcttccccgagaagatcccccagctgcccgaggacctgttcaagagcctgatgtacagcctggagctgggcatgaccagcatgagcagcgaggtgtgccagctgtgcctggaggccctgacccccctggccgagcagtgcgccaaggcccaggagaccgacagccccctgttcctggccaccagacacttcctgaagctggtgttcgacatgctggtgctgcagaagcacaacaccgagatgaccaccgccgccggcgaggccttctacaccctggtgtgcctgcaccaggccgagtacagcgagctggtggagaccctgctgagcagccagcaggaccccgtgatctaccagagactggccgacgccttcaacaagctgaccgccagcagcaccccccccaccctggacagaaagcagaagatggccttcctgaagagcctggaggagttcatggccaacgtgggcggcctgctgtgcgtgaagtag

SEQ ID NO: 9357 - DNA, 1578 bp, Homo sapiens
atggccgccggcggcagcggcggcagagccagctgcccccccggcgtgggcgtgggccccggcaccggcggcagccccggccccagcgccaacgccgccgccacccccgcccccggcaacgccgccgccgccgccgccgccgccgccgccgccgccgccgcccccggccccaccccccccgccccccccggccccggcaccgacgcccaggccgccggcgccgagagagccgaggaggccgccggccccggcgccgccgccctgcagagagaggccgcctacaactggcaggccagcaagcccaccgtgcaggagagattcgccttcctgttcaacaacgaggtgctgtgcgacgtgcacttcctggtgggcaagggcctgagcagccagagaatccccgcccacagattcgtgctggccgtgggcagcgccgtgttcgacgccatgttcaacggcggcatggccaccaccagcaccgagatcgagctgcccgacgtggagcccgccgccttcctggccctgctgaagttcctgtacagcgacgaggtgcagatcggccccgagaccgtgatgaccaccctgtacaccgccaagaagtacgccgtgcccgccctggaggcccactgcgtggagttcctgaagaagaacctgagagccgacaacgccttcatgctgctgacccaggccagactgttcgacgagccccagctggccagcctgtgcctggagaacatcgacaagaacaccgccgacgccatcaccgccgagggcttcaccgacatcgacctggacaccctggtggccgtgctggagagagacaccctgggcatcagagaggtgagactgttcaacgccgtggtgagatggagcgaggccgagtgccagagacagcagctgcaggtgacccccgagaacagaagaaaggtgctgggcaaggccctgggcctgatcagattccccctgatgaccatcgaggagttcgccgccggccccgcccagagcggcatcctggtggacagagaggtggtgagcctgttcctgcacttcaccgtgaaccccaagcccagagtggagttcatcgacagacccagatgctgcctgagaggcaaggagtgcagcatcaacagattccagcaggtggagagcagatggggctacagcggcaccagcgacagaatcagattcagcgtgaacaagagaatcttcgtggtgggcttcggcctgtacggcagcatccacggccccaccgactaccaggtgaacatccagatcatccacaccgacagcaacaccgtgctgggccagaacgacaccggcttcagctgcgacggcagcgccagcaccttcagagtgatgttcaaggagcccgtggaggtgctgcccaacgtgaactacaccgcctgcgccaccctgaagggccccgacagccactacggcaccaagggcctgagaaaggtgacccacgagagccccaccaccggcgccaagacctgcttcaccttctgctacgccgccggcaacaacaacggcaccagcgtggaggacggccagatccccgaggtgatcttctacacctag

SEQ ID NO: 9358 - DNA, 525 bp, Homo sapiens
atggccaccgtggccgagctgaaggccgtgctgaaggacaccctggagaagaagggcgtgctgggccacctgaaggccagaatcagagccgaggtgttcaacgccctggacgacgacagagagcccagacccagcctgagccacgagaacctgctgatcaacgagctgatcagagagtacctggagttcaacaagtacaagtacaccgccagcgtgctgatcgccgagagcggccagcccgtggtgcccctggacagacagttcctgatccacgagctgaacgccttcgaggagagcaaggacaacaccatccccctgctgtacggcatcctggcccacttcctgagaggcaccaaggacggcatccagaacgccttcctgaagggccccagcctgcagcccagcgaccccagcctgggcagacagcccagcagaagaaagcccatggacgaccacctgagaaaggaggagcagaagagcaccaacatcgaggacctgcacgtgagccaggccgtgaacagatag

SEQ ID NO: 9359 - DNA, 1257 bp, Homo sapiens
atggccggcagcctgcccccctgcgtggtggactgcggcaccggctacaccaagctgggctacgccggcaacaccgagccccagttcatcatccccagctgcatcgccatcagagagagcgccaaggtggtggaccaggcccagagaagagtgctgagaggcgtggacgacctggacttcttcatcggcgacgaggccatcgacaagcccacctacgccaccaagtggcccatcagacacggcatcatcgaggactgggacctgatggagagattcatggagcaggtggtgttcaagtacctgagagccgagcccgaggaccactacttcctgatgaccgagccccccctgaacacccccgagaacagagagtacctggccgagatcatgttcgagagcttcaacgtgcccggcctgtacatcgccgtgcaggccgtgctggccctggccgccagctggaccagcagacaggtgggcgagagaaccctgaccggcatcgtgatcgacagcggcgacggcgtgacccacgtgatccccgtggccgagggctacgtgatcggcagctgcatcaagcacatccccatcgccggcagagacatcacctacttcatccagcagctgctgagagagagagaggtgggcatcccccccgagcagagcctggagaccgccaaggccatcaaggagaagtactgctacatctgccccgacatcgtgaaggagttcgccaagtacgacgtggaccccagaaagtggatcaagcagtacaccggcatcaacgccatcaaccagaagaagttcgtgatcgacgtgggctacgagagattcctgggccccgagatcttcttccaccccgagttcgccaaccccgacttcatggagagcatcagcgacgtggtggacgaggtgatccagaactgccccatcgacgtgagaagacccctgtacaagaacgtggtgctgagcggcggcagcaccatgttcagagacttcggcagaagactgcagagagacctgaagagagtggtggacgccagactgagactgagcgaggagctgagcggcggcagaatcaagcccaagcccgtggaggtgcaggtggtgacccaccacatgcagagatacgccgtgtggttcggcggcagcatgctggccagcacccccgagttcttccaggtgtgccacaccaagaaggactacgaggagtacggccccagcatctgcagacacaaccccgtgttcggcgtgatgagctag

SEQ ID NO: 9360 - DNA, 1044 bp, Homo sapiens
atggccgccgccgagcccgccagcagcggccagcaggcccccgccggccagggccagggccagagaccccccccccagcccccccaggcccaggccccccagccccccccccccccccagctgggcggcgccggcggcggcagcagcagacacgagaagagcctgggcctgctgaccaccaagttcgtgagcctgctgcaggaggccaaggacggcgtgctggacctgaaggccgccgccgacaccctggccgtgagacagaagagaagaatctacgacatcaccaacgtgctggagggcatcgacctgatcgagaagaagagcaagaacagcatccagtggaagggcgtgggcgccggctgcaacaccaaggaggtgatcgacagactgagatacctgaaggccgagatcgaggacctggagctgaaggagagagagctggaccagcagaagctgtggctgcagcagagcatcaagaacgtgatggacgacagcatcaacaacagaaccttcagctacgtgacccacgaggacatctgcaactgcttcaacggcgacaccctgctggccatccaggcccccagcggcacccagctggaggtgcccatccccgagatgggccagaacggccagaagaagtaccagatcaacctgaagagccacagcggccccatccacgtgctgctgatcaacaaggagagcagcagcagcaagcccgtggtgttccccgtgcccccccccgacgacctgacccagcccagcagccagagcctgacccccgtgaccccccagaagagcagcatggccacccagaacctgcccgagcagcacgtgagcgagagaagccaggccctgcagcagaccagcgccaccgacatcagcagcgccggcagcatcagcggcgacatcatcgacgagctgatgagcagcgacgtgttccccctgctgagactgagccccacccccgccgacgactacaacttcaacctggacgacaacgagggcgtgtgcgacctgttcgacgtgcagatcctgaactactag

SEQ ID NO: 9361 - DNA, 636 bp, Homo sapiens
atgtgccccggcaactggctgtgggccagcatgaccttcatggccagattcagcagaagcagcagcagaagccccgtgagaaccagaggcaccctggaggagatgcccaccgtgcagcaccccttcctgaacgtgttcgagctggagagactgctgtacaccggcaagaccgcctgcaaccacgccgacgaggtgtggcccggcctgtacctgggcgaccaggacatggccaacaacagaagagagctgagaagactgggcatcacccacgtgctgaacgccagccacagcagatggagaggcacccccgaggcctacgagggcctgggcatcagatacctgggcgtggaggcccacgacagccccgccttcgacatgagcatccacttccagaccgccgccgacttcatccacagagccctgagccagcccggcggcaagatcctggtgcactgcgccgtgggcgtgagcagaagcgccaccctggtgctggcctacctgatgctgtaccaccacctgaccctggtggaggccatcaagaaggtgaaggaccacagaggcatcatccccaacagaggcttcctgagacagctgctggccctggacagaagactgagacagggcctggaggcctag

SEQ ID NO: 9362 - DNA, 948 bp, Homo sapiens
atgcccggcctgagctgcagattctaccagcacaagttccccgaggtggaggacgtggtgatggtgaacgtgagaagcatcgccgagatgggcgcctacgtgagcctgctggagtacaacaacatcgagggcatgatcctgctgagcgagctgagcagaagaagaatcagaagcatcaacaagctgatcagaatcggcagaaacgagtgcgtggtggtgatcagagtggacaaggagaagggctacatcgacctgagcaagagaagagtgagccccgaggaggccatcaagtgcgaggacaagttcaccaagagcaagaccgtgtacagcatcctgagacacgtggccgaggtgctggagtacaccaaggacgagcagctggagagcctgttccagagaaccgcctgggtgttcgacgacaagtacaagagacccggctacggcgcctacgacgccttcaagcacgccgtgagcgaccccagcatcctggacagcctggacctgaacgaggacgagagagaggtgctgatcaacaacatcaacagaagactgaccccccaggccgtgaagatcagagccgacatcgaggtggcctgctacggctacgagggcatcgacgccgtgaaggaggccctgagagccggcctgaactgcagcaccgagaacatgcccatcaagatcaacctgatcgccccccccagatacgtgatgaccaccaccaccctggagagaaccgagggcctgagcgtgctgagccaggccatggccgtgatcaaggagaagatcgaggagaagagaggcgtgttcaacgtgcagatggagcccaaggtggtgaccgacaccgacgagaccgagctggccagacagatggagagactggagagagagaacgccgaggtggacggcgacgacgacgccgaggagatggaggccaaggccgaggactag

SEQ ID NO: 9363 - DNA, 318 bp, Homo sapiens
atggccggccaggaggaccccgtgcagagagagatccaccaggactgggccaacagagagtacatcgagatcatcaccagcagcatcaagaagatcgccgacttcctgaacagcttcgacatgagctgcagaagcagactggccaccctgaacgagaagctgaccgccctggagagaagaatcgagtacatcgaggccagagtgaccaagggcgagaccctgagaaccgtgccctgctgctgctgggaggtggccctgcacaacaccggccacatgggcaaggcccccgccgccttcagcagcttcctgagcccctag

SEQ ID NO: 9364 - DNA, 1902 bp, Homo sapiens
atggccgccgccgccgccgccgccaccaccgccgcctgcagcagcggcagcgccggcaccgacgccgccggcgccagcggcctgcagcagccccccccccagccccagccccagcccgccgccgccgcccccgcccagcccccccccgagccccccagaaagcccagaatggaccccagaagaagacaggccgccctgagcttcctgaccaacatcagcctggacggcagactgcccccccaggacgccgagtggggcggcggcgaggagggcggcgccgccaagcccggcgccggcggcgcctgcggcgccagaaccagattcagcctgctggccgccgccgagagaggcggctgcatcgccctggccgcccccggcacccccgccgccggcctggccgccggcagcggcccctgcctgccccagcccagcagcctgccccccctgatccccggcggccacgccaccgtgagcggccccggcgtggccagaggcttcgccagccccctgggcgccggcagagccagcggcgagcagtggcagccccccagacccgcccccctggccgcctgcgcccagctgcagctgctggacggcagcggcgccgccggccaggaggagctggaggaggacgacgccttcatcagcgtgcaggtgcccgccgccgccttcctgggcagcggcacccccggcagcggcagcggcagcagaggcagactgaacagcttcacccagggcatcctgcccatcgccttcagcagacccaccagccagaactactgcagcctggagcagcccggccagggcggcagcaccagcgccttcgagcagctgcagagaagcagaagaagactgatcagccagagaagcagcctggagaccctggaggacatcgaggagaacgcccccctgagaagatgcagaaccctgagcggcagccccagacccaagaacttcaagaagatccacttcatcaagaacatgagacagcacgacaccagaaacggcagaatcgtgctgatcagcggcagaagaagcttctgcagcatcttcagcgtgctgccctacagagacagcacccaggtgggcgacctgaagctggacggcggcagacagagcaccggcgccgtgagcctgaaggagatcatcggcctggagggcgtggagctgggcgccgacggcaagaccgtgagctacacccagttcctgctgcccaccaacgccttcggcgccagaagaaacaccatcgacagcaccagcagcttcagccagttcagaaacctgagccacagaagcctgagcatcggcagagccagcggcacccagggcagcctggacaccggcagcgacctgggcgacttcatggactacgaccccaacctgctggacgacccccagtggccctgcggcaagcacaagagagtgctgatcttccccagctacatgaccaccgtgatcgactacgtgaagcccagcgacctgaagaaggacatgaacgagaccttcaaggagaagttcccccacatcaagctgaccctgagcaagatcagaagcctgaagagagagatgagaaagctggcccaggaggactgcggcctggaggagcccaccgtggccatggccttcgtgtacttcgagaagctggccctgaagggcaagctgaacaagcagaacagaaagctgtgcgccggcgcctgcgtgctgctggccgccaagatcggcagcgacctgaagaagcacgaggtgaagcacctgatcgacaagctggaggagaagttcagactgaacagaagagagctgatcgccttcgagttccccgtgctggtggccctggagttcgccctgcacctgcccgagcacgaggtgatgccccactacagaagactggtgcagagcagctag

SEQ ID NO: 9365 - DNA, 3423 bp, Homo sapiens
atgaccaccgccgtggagagaaagtacatcaacatcagaaagagactggaccagctgggctacagacagaccctgaccgtggagtgcctgcccctggtggagaagctgttcagcgacctggtgcacaccaccgagagcctgagacagagcaagctgagcgccgtgaaggccgagaaggagagcgccaacttcgacttcgtgctggagccctacaagctggagaacgccagactgagcagagagaacaacgagctgtacctggagctgatgaagctgagagagcacagcgaccagcacgtgaaggagctgaagaccagcctgaagaagtgcgccagagagaccgccgacctgaagttcctgaacaaccagtacgcccacaagctgaagctgctggagaaggagagcaaggccaagaacgagagaatccagcagctgcaggagaagaacctgcacgccgtggtgcagacccccggcggcaagaagagaagcatcgccttcagaagacagagaatgcagatcgacgagcccgtgccccccagcgaggtgagcagctaccccgtgccccagcccgacgacccctacatcgccgacctgctgcaggtggccgacaacagaatccaggagctgcagcaggaggtgcaccagctgcaggagaagctggccatgatggagagcggcgtgagagactacagcaagcagatcgagctgagagagagagagatcgagagactgagcgtggccctggacggcggcagaagccccgacgtgctgagcctggagagcagaaacaagaccaacgagaagctgatcgcccacctgaacatccaggtggacttcctgcagcaggccaacaaggacctggagaagagaatcagagagctgatggagaccaaggagaccgtgaccagcgaggtggtgaacctgagcaacaagaacgagaagctgtgccaggagctgaccgagatcgaccagctggcccagcagctggagagacacaaggaggaggtgctggagaccgccgacaaggagctgggcgaggccaagaaggagatcaagagaaagctgagcgagatgcaggacctggaggagaccatggccaagctgcagctggagctgaacctgtgccagaaggagaaggagagactgagcgacgagctgctggtgaagagcgacctggagaccgtggtgcaccagctggagcaggagaagcagagactgagcaagaaggtggagagcttcgccgtgaccgagagacagctgaccctggaggtggagagaatgagactggagcacggcatcaagagaagagacagaagccccagcagactggacaccttcctgaagggcatcgaggaggagagagactactacaagaaggagctggagagactgcagcacatcatccagagaagaagctgcagcaccagctacagcgccagagagaagagcagcatcttcagaacccccgagaagggcgactacaacagcgagatccaccagatcaccagagagagagacgagctgcagagaatgctggagagattcgagaagtacatggaggacatccagagcaacgtgaagctgctgaccgccgagagagacaagctgagcgtgctgtacaacgaggcccaggaggagctgagcgccctgagaaaggagagcacccagaccaccgccccccacaacatcgtgagcctgatggagaaggagaaggagctggccctgagcgacctgagaagaatcatggccgagaaggaggccctgagagagaagctggagcacatcgaggaggtgagcctgttcggcaagagcgagctggagaagaccatcgagcacctgacctgcgtgaaccaccagctggagagcgagaagtacgagctgaagagcaaggtgctgatcatgaaggagaccatcgagagcctggagaacaagctgaaggtgcaggcccagaagttcagccacgtggccggcgacagcagccaccagaagaccgaggtgaacagcctgagaatcgtgaacgagcagctgcagagaagcgtggacgactaccagcacagactgagcatcaagagaggcgagctggagagcgcccaggcccagatcaagatcctggaggagaagatcgacgagctgaacctgaagatgaccagccaggacgaggaggcccacgtgatgaagaagaccatcggcgtgatcgacaaggagaaggacttcctgcaggagaccgtggacgagaagaccgagaagatcgccaacctgcaggagaacctggccaacaaggagaaggccgtggcccagatgaagatcatgatcagcgagtgcgagagcagcgtgaaccagctgaaggagaccctggtgaacagagacagagagatcaacagcctgagaagacagctggacgccgcccacaaggagctggacgaggtgggcagaagcagagagatcgccttcaaggagaacagaagactgcaggacgacctggccaccatggccagagagaaccaggagatcagcctggagctggaggccgccgtgcaggagaaggaggagatgaagagcagagtgcacaagtacatcaccgaggtgagcagatgggagagcctgatggccgccaaggagaaggagaaccaggacctgctggacagattccagatgctgcacaacagagccgaggactgggaggtgaaggcccaccaggccgagggcgagagcagcagcgtgagactggagctgctgagcatcgacaccgagagaagacacctgagagagagagtggagctgctggagaaggagatccaggagcacatcaacgcccaccacgcctacgagagccagatcagcagcatggccaaggccatgagcagactggaggaggagctgagacaccaggaggacgagaaggccaccgtgctgaacgacctgagcagcctgagagagctgtgcatcaagctggacagcggcaaggacatcatgacccagcagctgaacagcaagaacctggagttcgagagagtggtggtggagctggagaacgtgaagagcgagagcgacctgctgaagaagcagctgagcaacgagagacacaccgtgaagaacctggagagcctgctggccaccaacagagacaaggagttccacagccacctgaccagccacgagaaggacaccgagatccagctgctgaaggagaagctgaccctgagcgagagcaagctgaccagccagagcagagagaacaccatgctgagagccaaggtggcccagctgcagaccgactacgacgccctgaagagacagatcagcaccgagagatacgagagagagagagccatccaggagatgagaagacacggcctggccaccccccccctgagcagcaccctgagaagccccagccacagccccgagcacagaaacgtgtag

SEQ ID NO: 9366 - DNA, 1512 bp, Homo sapiens
atgcccaacgtggccgagaccgagagaagcaacgacagcggcaacggcgagcacaagagcgagagaaagagccccgaggagaacctgcagggcgccgtgaagagcttctgcaccagcgccagcggcgcccccctgggccccaagggcgacggccactacccctggagctgccccgtgacccacaccagagagaagatctacgccatctgcagcgactacgccttcctgaaccaggccaccagcatctacaagacccccaaccccagcagaagcccctgcctgcccgacagcaccagcctgagcgccggcaacaacagcagcagatacatcggcatccccaccagcaccagcgagatcatctacaacgaggagaacagcctggagaacctgagcaacagcctgggcaagctgcccctggcctgggagatcgacaagagcgagttcgacggcgtgaccaccaacagcaagcacaagagcggcaacgccaagaagcaggtgagcaagagaaagaccagcgacaagaagggcagataccagaaggagtgcccccagcacagccccctggaggacatcaagcagagaaaggtgctggacctgagaagatggtactgcatcagcagaccccagtacaagaccagctgcggcatcagcagcctgatcagctgctggaacttcctgtacagcaccatgggcgccggcaacctgccccccatcacccaggaggaggccctgcacatcctgggcttccagccccccttcgaggacatcagattcggccccttcaccggcaacaccaccctgatgagatggttcagacagatcaacgaccacttccacgtgaagggctgcagctacgtgctgtacaagccccacggcaagaacaagaccgccggcgagaccgccagcggcgccctgagcaagctgaccagaggcctgaaggacgagagcctggcctacatctaccactgccagaaccactacttctgccccatcggcttcgaggccacccccgtgaaggccaacaaggccttcagcagaggccccctgagcccccaggaggtggagtactggatcctgatcggcgagagcagcagaaagcaccccgccatccactgcaagaagtgggccgacatcgtgaccgacctgaacacccagaaccccgagtacctggacatcagacacctggagagaggcctgcagtacagaaagaccaagaaggtgggcggcaacctgcactgcatcatcgccttccagagactgaactggcagagattcggcctgtggaacttccccttcggcaccatcagacaggagagccagccccccacccacgcccagggcatcgccaagagcgagagcgaggacaacatcagcaagaagcagcacggcagactgggcagaagcttcagcgccagcttccaccaggacagcgcctggaagaagatgagcagcatccacgagagaagaaacagcggctaccagggctacagcgactacgacggcaacgactag

SEQ ID NO: 9367 - DNA, 813 bp, Homo sapiens
atggaggccgaggagctggagcaggagagagagcagctgagactgcagctgtgggaggcctactgccaggtgagatacctgtgcagccacctgagaggcaacgacagcgccgacagcgccgtgagcaccgacagcagcatggacgagagcagcgagaccagcagcgccaaggacgtgcccgccggcagcctgagaaccgccctgaacgagctgaagagactgatccagagcatcgtggacggcatggagcccaccggcagcagaagactggacgacgacagcctggaggagcagatcagacagaccagcgaggacagcagagccctgagagagctgatggagggcgagagaggcaagctgagacagagcctggaggagctgcagagactgcacagccaggtgaccctgctgagcgtggagatgaccgccctgaaggaggagagagacagactgagagtgaccagcgaggacaaggagcccaaggagcagctgcagaaggccatcagagacagagacgaggccatcgccaagaagaacgccgtggagctggagctggccaagtgcagaatggacatgatgagcctgaacagccagctgctggacgccatccagcagaagctgaacctgagccagcagctggaggcctggcaggacgacatgcacagagtgatcgacagacagctgatggacacccacctgaaggagagaagccagcccgccgccgccctgtgcagaggccacagcgccggcagaggcgacgagcccagcatcgccgagggcaagagactgttcagcttcttcagaaagatctag

SEQ ID NO: 9368 - DNA, 2379 bp, Homo sapiens
atgctgcccgccggcgagatcggcgccagccccgccgccccctgctgcagcgagagcggcgacgagagaaagaacctggaggagaagagcgacatcaacgtgaccgtgctgatcggcagcaagcaggtgagcgagggcaccgacaacggcgacctgcccagctacgtgagcgccttcatcgagaaggaggtgggcaacgacctgaagagcctgaagaagctggacaagctgatcgagcagagaaccgtgagcaagatgcagctggaggagcaggtgctgaccatcagcagcgagatccccaagagaatcagaagcgccctgaagaacgccgaggagagcaagcagttcctgaaccagttcctggagcaggagacccacctgttcagcgccatcaacagccacctgctgaccgcccagccctggatggacgacctgggcaccatgatcagccagatcgaggagatcgagagacacctggcctacctgaagtggatcagccagatcgaggagctgagcgacaacatccagcagtacctgatgaccaacaacgtgcccgaggccgccagcaccctggtgagcatggccgagctggacatcaagctgcaggagagcagctgcacccacctgctgggcttcatgagagccaccgtgaagttctggcacaagatcctgaaggacaagctgaccagcgacttcgaggagatcctggcccagctgcactggcccttcatcgcccccccccagagccagaccgtgggcctgagcagacccgccagcgcccccgagatctacagctacctggagaccctgttctgccagctgctgaagctgcagaccagcgacgagctgctgaccgagcccaagcagctgcccgagaagtacagcctgcccgccagccccagcgtgatcctgcccatccaggtgatgctgacccccctgcagaagagattcagataccacttcagaggcaacagacagaccaacgtgctgagcaagcccgagtggtacctggcccaggtgctgatgtggatcggcaaccacaccgagttcctggacgagaagatccagcccatcctggacaaggtgggcagcctggtgaacgccagactggagttcagcagaggcctgatgatgctggtgctggagaagctggccaccgacatcccctgcctgctgtacgacgacaacctgttctgccacctggtggacgaggtgctgctgttcgagagagagctgcacagcgtgcacggctaccccggcaccttcgccagctgcatgcacatcctgagcgaggagacctgcttccagagatggctgaccgtggagagaaagttcgccctgcagaagatggacagcatgctgagcagcgaggccgcctgggtgagccagtacaaggacatcaccgacgtggacgagatgaaggtgcccgactgcgccgagaccttcatgaccctgctgctggtgatcaccgacagatacaagaacctgcccaccgccagcagaaagctgcagttcctggagctgcagaaggacctggtggacgacttcagaatcagactgacccaggtgatgaaggaggagaccagagccagcctgggcttcagatactgcgccatcctgaacgccgtgaactacatcagcaccgtgctggccgactgggccgacaacgtgttcttcctgcagctgcagcaggccgccctggaggtgttcgccgagaacaacaccctgagcaagctgcagctgggccagctggccagcatggagagcagcgtgttcgacgacatgatcaacctgctggagagactgaagcacgacatgctgaccagacaggtggaccacgtgttcagagaggtgaaggacgccgccaagctgtacaagaaggagagatggctgagcctgcccagccagagcgagcaggccgtgatgagcctgagcagcagcgcctgccccctgctgctgaccctgagagaccacctgctgcagctggagcagcagctgtgcttcagcctgttcaagatcttctggcagatgctggtggagaagctggacgtgtacatctaccaggagatcatcctggccaaccacttcaacgagggcggcgccgcccagctgcagttcgacatgaccagaaacctgttccccctgttcagccactactgcaagagacccgagaactacttcaagcacatcaaggaggcctgcatcgtgctgaacctgaacgtgggcagcgccctgctgctgaaggacgtgctgcagagcgccagcggccagctgcccgccaccgccgccctgaacgaggtgggcatctacaagctggcccagcaggacgtggagatcctgctgaacctgagaaccaactggcccaacaccggcaagtag

SEQ ID NO: 9369 - DNA, 1068 bp, Homo sapiens
gtgagaggcgtgagagccgccaccgccgccgccgtggccgccaccgccgccagcggcctgagcagaagagaggccggcggcagagccggcgccgccgccgccgtggtgagaccccccggcagaaagtgcggcagatgcagaagactggccaacttccccggcagaaagagaagaagaagaagaagaaagggcctgggcgccaccaccggcggctgcggcgaggccgtgagcagcctgcaccccgccccccacagccccagcagcgtgagacccgccggcagaagagccagaagacagagaagaggcgccggcagcgccgagagacccatgagcggcgccggcgaggccctggcccccggccccgtgggcccccagagagtggccgaggccggcggcggccagctgggcagcaccgcccagggcaagtgcgacaaggacaacaccgagaaggacatcacccaggccaccaacagccacttcacccacggcgagatgcaggaccagagcatctggggcaaccccagcgacggcgagctgatcagaacccagccccagagactgccccagctgcagaccagcgcccaggtgcccagcggcgaggagatcggcaagatcaagaacggccacaccggcctgagcaacggcaacggcatccaccacggcgccaagcacggcagcgccgacaacagaaagctgagcgcccccgtgagccagaagatgcacagaaagatccagagcagcctgagcgtgaacagcgacatcagcaagaagagcaaggtgaacgccgtgttcagccagaagaccggcagcagccccgaggactgctgcgtgcactgcatcctggcctgcctgttctgcgagttcctgaccctgtgcaacatcgtgctgggccaggccagctgcggcatctgcaccagcgaggcctgctgctgctgctgcggcgacgagatgggcgacgactgcaactgcccctgcgacatggactgcggcatcatggacgcctgctgcgagagcagcgactgcctggagatctgcatggagtgctgcggcatctgcttccccagctag

SEQ ID NO: 9370 - DNA, 378 bp, Homo sapiens
atgctgagcagactgctgaaggagcaccaggccaagcagaacgagagaaaggagctgcaggagaagagaagaagagaggccatcaccgccgccacctgcctgaccgaggccctggtggaccacctgaacgtgggcgtggcccaggcctacatgaaccagagaaagctggaccacgaggtgaagaccctgcaggtgcaggccgcccagttcgccaagcagaccggccagtggatcggcatggtggagaacttcaaccaggccctgaaggagatcggcgacgtggagaactgggccagaagcatcgagctggacatgagaaccatcgccaccgccctggagtacgtgtacaagggccagctgcagagcgcccccagctag

SEQ ID NO: 9371 - DNA, 2337 bp, Homo sapiens
atgaccaccagacaggccaccaaggaccccctgctgagaggcgtgagccccacccccagcaagatccccgtgagaagccagaagagaacccccttccccaccgtgaccagctgcgccgtggaccaggagaaccaggaccccagaagatgggtgcagaagccccccctgaacatccagagacccctggtggacagcgccggccccagacccaaggccagacaccaggccgagaccagccagagactggtgggcatcagccagcccagaaaccccctggaggagctgagacccagccccagaggccagaacgtgggccccggcccccccgcccagaccgaggcccccggcaccatcgagttcgtggccgaccccgccgccctggccaccatcctgagcggcgagggcgtgaagagctgccacctgggcagacagcccagcctggccaagagagtgctggtgagaggcagccagggcggcaccacccagagagtgcagggcgtgagagccagcgcctacctggcccccagaacccccacccacagactggaccccgccagagccagctgcttcagcagactggagggccccggccccagaggcagaaccctgtgcccccagagactgcaggccctgatcagccccagcggccccagcttccaccccagcaccagacccagcttccaggagctgagaagagagaccgccggcagcagcagaaccagcgtgagccaggccagcggcctgctgctggagacccccgtgcagcccgccttcagcctgcccaagggcgagagagaggtggtgacccacagcgacgagggcggcgtggccagcctgggcctggcccagagagtgcccctgagagagaacagagagatgagccacaccagagacagccacgacagccacctgatgcccagccccgcccccgtggcccagcccctgcccggccacgtggtgccctgccccagccccttcggcagagcccagagagtgcccagccccggcccccccaccctgaccagctacagcgtgctgagaagactgaccgtgcagcccaagaccagattcacccccatgcccagcacccccagagtgcagcaggcccagtggctgagaggcgtgagcccccagagctgcagcgaggaccccgccctgccctgggagcaggtggccgtgagactgttcgaccaggagagctgcatcagaagcctggagggcagcggcaagccccccgtggccacccccagcggcccccacagcaacagaacccccagcctgcaggaggtgaagatccagagaatcggcatcctgcagcagctgctgagacaggaggtggagggcctggtgggcggccagtgcgtgcccctgaacggcggcagcagcctggacatggtggagctgcagcccctgctgaccgagatcagcagaaccctgaacgccaccgagcacaacagcggcaccagccacctgcccggcctgctgaagcacagcggcctgcccaagccctgcctgcccgaggagtgcggcgagccccagccctgcccccccgccgagcccggcccccccgaggccttctgcagaagcgagcccgagatccccgagcccagcctgcaggagcagctggaggtgcccgagccctacccccccgccgagcccagacccctggagagctgctgcagaagcgagcccgagatccccgagagcagcagacaggagcagctggaggtgcccgagccctgcccccccgccgagcccagacccctggagagctactgcagaatcgagcccgagatccccgagagcagcagacaggagcagctggaggtgcccgagccctgcccccccgccgagcccggccccctgcagcccagcacccagggccagagcggcccccccggcccctgccccagagtggagctgggcgccagcgagccctgcaccctggagcacagaagcctggagagcagcctgcccccctgctgcagccagtgggcccccgccaccaccagcctgatcttcagcagccagcaccccctgtgcgccagcccccccatctgcagcctgcagagcctgagaccccccgccggccaggccggcctgagcaacctggcccccagaaccctggccctgagagagagactgaagagctgcctgaccgccatccactgcttccacgaggccagactggacgacgagtgcgccttctacaccagcagagccccccccagcggccccaccagagtgtgcaccaaccccgtggccaccctgctggagtggcaggacgccctgtgcttcatccccgtgggcagcgccgccccccagggcagcccctag

SEQ ID NO: 9372 - DNA, 1803 bp, Homo sapiens
atgagctgcagaagctacagagtgagcagcggccacagagtgggcaacttcagcagctgcagcgccatgaccccccagaacctgaacagattcagagccaacagcgtgagctgctggagcggccccggcttcagaggcctgggcagcttcggcagcagaagcgtgatcaccttcggcagctacagccccagaatcgccgccgtgggcagcagacccatccactgcggcgtgagattcggcgccggctgcggcatgggcttcggcgacggcagaggcgtgggcctgggccccagagccgacagctgcgtgggcctgggcttcggcgccggcagcggcatcggctacggcttcggcggccccggcttcggctacagagtgggcggcgtgggcgtgcccgccgcccccagcatcaccgccgtgaccgtgaacaagagcctgctgacccccctgaacctggagatcgaccccaacgcccagagagtgaagaaggacgagaaggagcagatcaagaccctgaacaacaagttcgccagcttcatcgacaaggtgagattcctggagcagcagaacaagctgctggagaccaagtggagcttcctgcaggagcagaagtgcatcagaagcaacctggagcccctgttcgagagctacatcaccaacctgagaagacagctggaggtgctggtgagcgaccaggccagactgcaggccgagagaaaccacctgcaggacgtgctggagggcttcaagaagaagtacgaggaggaggtggtgtgcagagccaacgccgagaacgagttcgtggccctgaagaaggacgtggacgccgccttcatgaacaagagcgacctggaggccaacgtggacaccctgacccaggagatcgacttcctgaagaccctgtacatggaggagatccagctgctgcagagccacatcagcgagaccagcgtgatcgtgaagatggacaacagcagagacctgaacctggacggcatcatcgccgaggtgaaggcccagtacgaggaggtggccagaagaagcagagccgacgccgaggcctggtaccagaccaagtacgaggagatgcaggtgaccgccggccagcactgcgacaacctgagaaacatcagaaacgagatcaacgagctgaccagactgatccagagactgaaggccgagatcgagcacgccaaggcccagagagccaagctggaggccgccgtggccgaggccgagcagcagggcgaggccaccctgagcgacgccaagtgcaagctggccgacctggagtgcgccctgcagcaggccaagcaggacatggccagacagctgtgcgagtaccaggagctgatgaacgccaagctgggcctggacatcgagatcgccacctacagaagactgctggagggcgaggagagcagactgtgcgagggcgtgggccccgtgaacatcagcgtgagcagcagcagaggcggcctggtgtgcggccccgagcccctggtggccggcagcaccctgagcagaggcggcgtgaccttcagcggcagcagcagcgtgtgcgccaccagcggcgtgctggccagctgcggccccagcctgggcggcgccagagtggcccccgccaccggcgacctgctgagcaccggcaccagaagcggcagcatgctgatcagcgaggcctgcgtgcccagcgtgccctgccccctgcccacccagggcggcttcagcagctgcagcggcggcagaagcagcagcgtgagattcgtgagcaccaccaccagctgcagaaccaagtactag

SEQ ID NO: 9373 - DNA, 1542 bp, Homo sapiens
atgagctaccacagcttccagcccggcagcagatgcggcagccagagcttcagcagctacagcgccgtgatgcccagaatggtgacccactacgccgtgagcaagggcccctgcagacccggcggcggcagaggcctgagagccctgggctgcctgggcagcagaagcctgtgcaacgtgggcttcggcagacccagagtggccagcagatgcggcggcaccctgcccggcttcggctacagactgggcgccacctgcggccccagcgcctgcatcacccccgtgaccatcaacgagagcctgctggtgcccctggccctggagatcgaccccaccgtgcagagagtgaagagagacgagaaggagcagatcaagtgcctgaacaacagattcgccagcttcatcaacaaggtgagattcctggagcagaagaacaagctgctggagaccaagtggaacttcatgcagcagcagagatgctgccagaccaacatcgagcccatcttcgagggctacatcagcgccctgagaagacagctggactgcgtgagcggcgacagagtgagactggagagcgagctgtgcagcctgcaggccgccctggagggctacaagaagaagtacgaggaggagctgagcctgagaccctgcgtggagaacgagttcgtggccctgaagaaggacgtggacaccgccttcctgatgaaggccgacctggagaccaacgccgaggccctggtgcaggagatcgacttcctgaagagcctgtacgaggaggagatctgcctgctgcagagccagatcagcgagaccagcgtgatcgtgaagatggacaacagcagagagctggacgtggacggcatcatcgccgagatcaaggcccagtacgacgacatcgccagcagaagcaaggccgaggccgaggcctggtaccagtgcagatacgaggagctgagagtgaccgccggcaaccactgcgacaacctgagaaacagaaagaacgagatcctggagatgaacaagctgatccagagactgcagcaggagaccgagaacgtgaaggcccagagatgcaagctggagggcgccatcgccgaggccgagcagcagggcgaggccgccctgaacgacgccaagtgcaagctggccggcctggaggaggccctgcagaaggccaagcaggacatggcctgcctgctgaaggagtaccaggaggtgatgaacagcaagctgggcctggacatcgagatcgccacctacagaagactgctggagggcgaggagcacagactgtgcgagggcatcggccccgtgaacatcagcgtgagcagcagcaagggcgccttcctgtacgagccctgcggcgtgagcacccccgtgctgagcaccggcgtgctgagaagcaacggcggctgcagcatcgtgggcaccggcgagctgtacgtgccctgcgagccccagggcctgctgagctgcggcagcggcagaaagagcagcatgaccctgggcgccggcggcagcagccccagccacaagcactag

SEQ ID NO: 9374 - DNA, 1632 bp, Homo sapiens
atgatgcccacccccgtgatcctgctgaaggagggcaccgacagcagccagggcatcccccagctggtgagcaacatcagcgcctgccaggtgatcgccgaggccgtgagaaccaccctgggccccagaggcatggacaagctgatcgtggacggcagaggcaaggccaccatcagcaacgacggcgccaccatcctgaagctgctggacgtggtgcaccccgccgccaagaccctggtggacatcgccaagagccaggacgccgaggtgggcgacggcaccaccagcgtgaccctgctggccgccgagttcctgaagcaggtgaagccctacgtggaggagggcctgcacccccagatcatcatcagagccttcagaaccgccacccagctggccgtgaacaagatcaaggagatcgccgtgaccgtgaagaaggccgacaaggtggagcagagaaagctgctggagaagtgcgccatgaccgccctgagcagcaagctgatcagccagcagaaggccttcttcgccaagatggtggtggacgccgtgatgatgctggacgacctgctgcagctgaagatgatcggcatcaagaaggtgcagggcggcgccctggaggacagccagctggtggccggcgtggccttcaagaagaccttcagctacgccggcttcgagatgcagcccaagaagtaccacaaccccaagatcgccctgctgaacgtggagctggagctgaaggccgagaaggacaacgccgagatcagagtgcacaccgtggaggactaccaggccatcgtggacgccgagtggaacatcctgtacgacaagctggagaagatccaccacagcggcgccaaggtggtgctgagcaagctgcccatcggcgacgtggccacccagtacttcgccgacagagacatgttctgcgccggcagagtgcccgaggaggacctgaagagaaccatgatggcctgcggcggcagcatccagaccagcgtgaacgccctgagcgccgacgtgctgggcagatgccaggtgttcgaggagacccagatcggcggcgagagatacaacttcttcaccggctgccccaaggccaagacctgcaccttcatcctgagaggcggcgccgagcagttcatggaggagaccgagagaagcctgcacgacgccatcatgatcgtgagaagagccatcaagaacgacagcgtggtggccggcggcggcgccatcgagatggagctgagcaagtacctgagagactacagcagaaccatccccggcaagcagcagctgctgatcggcgcctacgccaaggccctggagatcatccccagacagctgtgcgacaacgccggcttcgacgccaccaacatcctgaacaagctgagagccagacacgcccagggcggcacctggtacggcgtggacatcaacaacgaggacatcgccgacaacttcgaggccttcgtgtgggagcccgccatggtgagaatcaacgccctgaccgccgccagcgaggccgcctgcctgatcgtgagcgtggacgagaccatcaagaaccccagaagcaccgtggacgcccccaccgccgccggcagaggcagaggcagaggcagaccccactag

SEQ ID NO: 9375 - DNA, 1479 bp, Homo sapiens
atggcccccgtgggcgtggagaagaagctgctgctgggccccaacggccccgccgtggccgccgccggcgacctgaccagcgaggaggaggagggccagagcctgtggagcagcatcctgagcgaggtgagcaccagagccagaagcaagctgcccagcggcaagaacatcctggtgttcggcgaggacggcagcggcaagaccaccctgatgaccaagctgcagggcgccgagcacggcaagaagggcagaggcctggagtacctgtacctgagcgtgcacgacgaggacagagacgaccacaccagatgcaacgtgtggatcctggacggcgacctgtaccacaagggcctgctgaagttcgccgtgagcgccgagagcctgcccgagaccctggtgatcttcgtggccgacatgagcagaccctggaccgtgatggagagcctgcagaagtgggccagcgtgctgagagagcacatcgacaagatgaagatcccccccgagaagatgagagagctggagagaaagttcgtgaaggacttccaggactacatggagcccgaggagggctgccagggcagcccccagagaagaggccccctgaccagcggcagcgacgaggagaacgtggccctgcccctgggcgacaacgtgctgacccacaacctgggcatccccgtgctggtggtgtgcaccaagtgcgacgccgtgagcgtgctggagaaggagcacgactacagagacgagcacctggacttcatccagagccacctgagaagattctgcctgcagtacggcgccgccctgatctacaccagcgtgaaggaggagaagaacctggacctgctgtacaagtacatcgtgcacaagacctacggcttccacttcaccacccccgccctggtggtggagaaggacgccgtgttcatccccgccggctgggacaacgagaagaagatcgccatcctgcacgagaacttcaccaccgtgaagcccgaggacgcctacgaggacttcatcgtgaagccccccgtgagaaagctggtgcacgacaaggagctggccgccgaggacgagcaggtgttcctgatgaagcagcagagcctgctggccaagcagcccgccacccccaccagagccagcgagagccccgccagaggccccagcggcagccccagaacccagggcagaggcggccccgccagcgtgcccagcagcagccccggcaccagcgtgaagaagcccgaccccaacatcaagaacaacgccgccagcgagggcgtgctggccagcttcttcaacagcctgctgagcaagaagaccggcagccccggcagccccggcgccggcggcgtgcagagcaccgccaagaagagcggccagaagaccgtgctgagcaacgtgcaggaggagctggacagaatgaccagaaagcccgacagcatggtgaccaacagcagcaccgagaacgaggcctag

SEQ ID NO: 9376 - DNA, 540 bp, Homo sapiens
atggacaaggacttcgacaagctgcacgagttcgtggagatcatgaaggagatgcagaaggacatggacgagaagatggacatcctgatcaacacccagaagaactacaagctgcccctgagaagagcccccaaggagcagcaggagctgagactgatgggcaagacccacagagagccccagctgagacccaagaagatggacggcgccagcggcgtgaacggcgccccctgcgccctgcacaagaagaccatggccccccagaagaccaagcagggcagcctggaccccctgcaccactgcggcacctgctgcgagaagtgcctgctgtgcgccctgaagaacaactacaacagagccgcccccctgaaggaggccagacacctgctgaccgccaacagcatcgaccccagcgccgccctggtgctgctgatcgagttcctgctgctgaccctggtgaccggcgccgccgcccccggcctggacgcctgcggccaccagagaaacatgagagacgagatcaacagcgagagaagatag

SEQ ID NO: 9377 - DNA, 3600 bp, Homo sapiens
atggccagcgccggcacccagcactacagcatcggcctgagacagaagaacagcttcaagcagagcggccccagcggcaccgtgcccgccaccccccccgagaagcccagcgagggcagagtgtggccccaggcccaccagcaggtgaagcccatctggaagctggagaagaagcaggtggagaccctgagcgccggcctgggccccggcctgctgggcgtgcccccccagcccgcctacttcttctgccccagcaccctgtgcagcagcggcaccaccgccgtgatcgccggccacagcagcagctgctacctgcacagcctgcccgacctgttcaacagcaccctgctgtacagaagaagcagctacagacagaagccctaccagcagctggagagcttctgcctgagaagcagccccagcgagaagagccccttcagcctgccccagaagagcctgcccgtgagcctgaccgccaacaaggccaccagcagcatggtgttcagcatggcccagcccatggccagcagcagcaccgagccctacctgtgcctggccgccgccggcgagaaccccagcggcaagagcctggccagcgccatcagcggcaagatccccagccccctgagcagcagctacaagcccatgctgaacaacaacagcttcatgtggcccaacagcacccccgtgcccctgctgcagaccacccagggcctgaagcccgtgagcccccccaagatccagcccgtgagctggcaccacagcggcggcaccggcgactgcgccccccagcccgtggaccacaaggtgcccaagagcatcggcaccgtgcccgccgacgccagcgcccacatcgccctgagcaccgccagcagccacgacaccagcaccaccagcgtggccagcagctggtacaacagaaacaacctggccatgagagccgagcccctgagctgcgccctggacgacagcagcgacagccaggaccccaccaaggagatcagattcaccgaggccgtgagaaagctgaccgccagaggcttcgagaagatgcccagacagggctgccagctggagcagagcagcttcctgaaccccagcttccagtggaacgtgctgaacagaagcagaagatggaagccccccgccgtgaaccagcagttcccccaggaggacgccggcagcgtgagaagagtgctgcccggcgccagcgacaccctgggcctggacaacaccgtgttctgcaccaagagaatcagcatccacctgctggccagccacgccagcggcctgaaccacaaccccgcctgcgagagcgtgatcgacagcagcgccttcggcgagggcaaggcccccggcccccccttcccccagaccctgggcatcgccaacgtggccaccagactgagcagcatccagctgggccagagcgagaaggagagacccgaggaggccagagagctggacagcagcgacagagacatcagcagcgccaccgacctgcagcccgaccaggccgagaccgaggacaccgaggaggagctggtggacggcctggaggactgctgcagcagagacgagaacgaggaggaggagggcgacagcgagtgcagcagcctgagcgccgtgagccccagcgagagcgtggccatgatcagcagaagctgcatggagatcctgaccaagcccctgagcaaccacgagaaggtggtgagacccgccctgatctacagcctgttccccaacgtgccccccaccatctacttcggcaccagagacgagagagtggagaagctgccctgggagcagagaaagctgctgagatggaagatgagcaccgtgacccccaacatcgtgaagcagaccatcggcagaagccacttcaagatcagcaagagaaacgacgactggctgggctgctggggccaccacatgaagagccccagcttcagaagcatcagagagcaccagaagctgaaccacttccccggcagcttccagatcggcagaaaggacagactgtggagaaacctgagcagaatgcagagcagattcggcaagaaggagttcagcttcttcccccagagcttcatcctgccccaggacgccaagctgctgagaaaggcctgggagagcagcagcagacagaagtggatcgtgaagccccccgccagcgccagaggcatcggcatccaggtgatccacaagtggagccagctgcccaagagaagacccctgctggtgcagagatacctgcacaagccctacctgatcagcggcagcaagttcgacctgagaatctacgtgtacgtgaccagctacgaccccctgagaatctacctgttcagcgacggcctggtgagattcgccagctgcaagtacagccccagcatgaagagcctgggcaacaagttcatgcacctgaccaactacagcgtgaacaagaagaacgccgagtaccaggccaacgccgacgagatggcctgccagggccacaagtgggccctgaaggccctgtggaactacctgagccagaagggcgtgaacagcgacgccatctgggagaagatcaaggacgtggtggtgaagaccatcatcagcagcgagccctacgtgaccagcctgctgaagatgtacgtgagaagaccctacagctgccacgagctgttcggcttcgacatcatgctggacgagaacctgaagccctgggtgctggaggtgaacatcagccccagcctgcacagcagcagccccctggacatcagcatcaagggccagatgatcagagacctgctgaacctggccggcttcgtgctgcccaacgccgaggacatcatcagcagccccagcagctgcagcagcagcaccaccagcctgcccaccagccccggcgacaagtgcagaatggcccccgagcacgtgaccgcccagaagatgaagaaggcctactacctgacccagaagatccccgaccaggacttctacgccagcgtgctggacgtgctgacccccgacgacgtgagaatcctggtggagatggaggacgagttcagcagaagaggccagttcgagagaatcttccccagccacatcagcagcagatacctgagattcttcgagcagcccagatacttcaacatcctgaccacccagtgggagcagaagtaccacggcaacaagctgaagggcgtggacctgctgagaagctggtgctacaagggcttccacatgggcgtggtgagcgacagcgcccccgtgtggagcctgcccaccagcctgctgaccatcagcaaggacgacgtgatcctgaacgccttcagcaagagcgagaccagcaagctgggcaagcagagcagctgcgaggtgagcctgctgctgagcgaggacggcaccacccccaagagcaagaagacccaggccggcctgagcccctacccccagaagcccagcagcagcaaggacagcgaggacaccagcaaggagcccagcctgagcacccagaccctgcccgtgatcaagtgcagcggccagaccagcagactgagcgccagcagcaccttccagagcatcagcgacagcctgctggccgtgagcccctag

SEQ ID NO: 9378 - DNA, 2772 bp, Homo sapiens
atgctgagaagaggcagccaggccctgagaagattcagcaccggcagagtgtacttcaagaacaagctgaagctggccctgatcggccagagcctgttcggccaggaggtgtacagccacctgagaaaggagggccacagagtggtgggcgtgttcaccgtgcccgacaaggacggcaaggccgaccccctggccctggccgccgagaaggacggcacccccgtgttcaagctgcccaagtggagagtgaagggcaagaccatcaaggaggtggccgaggcctacagaagcgtgggcgccgagctgaacgtgctgcccttctgcacccagttcatccccatggacatcatcgacagccccaagcacggcagcatcatctaccaccccagcatcctgcccagacacagaggcgccagcgccatcaactggaccctgatcatgggcgacaagaaggccggcttcagcgtgttctgggccgacgacggcctggacaccggccccatcctgctgcagagaagctgcgacgtggagcccaacgacaccgtggacgccctgtacaacagattcctgttccccgagggcatcaaggccatggtggaggccgtgcagctgatcgccgacggcaaggcccccagaatcccccagcccgaggagggcgccacctacgagggcatccagaagaaggagaacgccgagatcagctgggaccagagcgccgaggtgctgcacaactggatcagaggccacgacaaggtgcccggcgcctggaccgagatcaacggccagatggtgaccttctacggcagcaccctgctgaacagcagcgtgccccccggcgagcccctggagatcaagggcgccaagaagcccggcctggtgaccaagaacggcctggtgctgttcggcaacgacggcaaggccctgaccgtgagaaacctgcagttcgaggacggcaagatgatccccgccagccagtacttcagcaccggcgagaccagcgtggtggagctgaccgccgaggaggtgaaggtggccgagaccatcaaggtgatctgggccggcatcctgagcaacgtgcccatcatcgaggacagcaccgacttcttcaagagcggcgccagcagcatggacgtggccagactggtggaggagatcagacagaagtgcggcggcctgcagctgcagaacgaggacgtgtacatggccaccaagttcgagggcttcatccagaaggtggtgagaaagctgagaggcgaggaccaggaggtggagctggtggtggactacatcagcaaggaggtgaacgagatcatggtgaagatgccctaccagtgcttcatcaacggccagttcaccgacgccgacgacggcaagacctacgacaccatcaaccccaccgacggcagcaccatctgcaaggtgagctacgccagcctggccgacgtggacaaggccgtggccgccgccaaggacgccttcgagaacggcgagtggggcagaatgaacgccagagagagaggcagactgatgtacagactggccgacctgctggaggagaaccaggaggagctggccaccatcgaggccctggacagcggcgccgtgtacaccctggccctgaagacccacatcggcatgagcgtgcagaccttcagatacttcgccggctggtgcgacaagatccagggcagcaccatccccatcaaccaggccagacccaacagaaacctgaccttcaccaagaaggagcccctgggcgtgtgcgccatcatcatcccctggaactaccccctgatgatgctggcctggaagagcgccgcctgcctggccgccggcaacaccctggtgctgaagcccgcccaggtgacccccctgaccgccctgaagttcgccgagctgagcgtgaaggccggcttccccaagggcgtgatcaacatcatccccggcagcggcggcatcgccggccagagactgagcgagcaccccgacatcagaaagctgggcttcaccggcagcacccccatcggcaagcagatcatgaagagctgcgccgtgagcaacctgaagaaggtgagcctggagctgggcggcaagagccccctgatcatcttcaacgactgcgagctggacaaggccgtgagaatgggcatgggcgccgtgttcttcaacaagggcgagaactgcatcgccgccggcagactgttcgtggaggagagcatccacgacgagttcgtgaccagagtggtggaggagatcaagaagatgaagatcggcgaccccctggacagaagcaccgaccacggcccccagaaccacaaggcccacctggagaagctgctgcagtactgcgagaccggcgtgaaggagggcgccaccctggtgtacggcggcagacaggtgcagagacccggcttcttcatggagcccaccgtgttcaccgacgtggaggactacatgtacctggccaaggaggagagcttcggccccatcatggtgatcagcaagttccagaacggcgacatcgacggcgtgctgcagagagccaacagcaccgagtacggcctggccagcggcgtgttcaccagagacatcaacaaggccatgtacgtgagcgagaagctggaggccggcaccgtgttcatcaacacctacaacaagaccgacgtggccgcccccttcggcggcgtgaagcagagcggcttcggcaaggacctgggcgaggaggccctgaacgagtacctgaagaccaagaccgtgaccctggagtactag

SEQ ID NO: 9379 - DNA, 1323 bp, Homo sapiens
atggagggcgtgctgtacaagtggaccaactacctgagcggctggcagcccagatggttcctgctgtgcggcggcatcctgagctactacgacagccccgaggacgcctggaagggctgcaagggcagcatccagatggccgtgtgcgagatccaggtgcacagcgtggacaacaccagaatggacctgatcatccccggcgagcagtacttctacctgaaggccagaagcgtggccgagagacagagatggctggtggccctgggcagcgccaaggcctgcctgaccgacagcagaacccagaaggagaaggagttcgccgagaacaccgagaacctgaagaccaagatgagcgagctgagactgtactgcgacctgctggtgcagcaggtggacaagaccaaggaggtgaccaccaccggcgtgagcaacagcgaggagggcatcgacgtgggcaccctgctgaagagcacctgcaacaccttcctgaagaccctggaggagtgcatgcagatcgccaacgccgccttcaccagcgagctgctgtacagaaccccccccggcagcccccagctggccatgctgaagagcagcaagatgaagcaccccatcatccccatccacaacagcctggagagacagatggagctgagcacctgcgagaacggcagcctgaacatggagatcaacggcgaggaggagatcctgatgaagaacaagaacagcctgtacctgaagagcgccgagatcgactgcagcatcagcagcgaggagaacaccgacgacaacatcaccgtgcagggcgagatcagaaaggaggacggcatggagaacctgaagaaccacgacaacaacctgacccagagcggcagcgacagcagctgcagccccgagtgcctgtgggaggagggcaaggaggtgatccccaccttcttcagcaccatgaacaccagcttcagcgacatcgagctgctggaggacagcggcatccccaccgaggccttcctggccagctgctacgccgtggtgcccgtgctggacaagctgggccccaccgtgttcgcccccgtgaagatggacctggtgggcaacatcaagaaggtgaaccagaagtacatcaccaacaaggaggagttcaccaccctgcagaagatcgtgctgcacgaggtggaggccgacgtggcccaggtgagaaacagcgccaccgaggccctgctgtggctgaagagaggcctgaagttcctgaagggcttcctgaccgaggtgaagaacggcgagaaggacatccagaccgccctgagaaaccccaccgagaacacctag

SEQ ID NO: 9380 - DNA, 1272 bp, Homo sapiens
atggccatctgccagttcttcctgcagggcagatgcagattcggcgacagatgctggaacgagcaccccggcgccagaggcgccggcggcggcagacagcagccccagcagcagcccagcggcaacaacagaagaggctggaacaccaccagccagagatacagcaacgtgatccagcccagcagcttcagcaagagcaccccctggggcggcagcagagaccaggagaagccctacttcagcagcttcgacagcggcgccagcaccaacagaaaggagggcttcggcctgagcgagaaccccttcgccagcctgagccccgacgagcagaaggacgagaagaagctgctggagggcatcgtgaaggacatggaggtgtgggagagcagcggccagtggatgttcagcgtgtacagccccgtgaagaagaagcccaacatcagcggcttcaccgacatcagccccgaggagctgagactggagtaccacaacttcctgaccagcaacaacctgcagagctacctgaacagcgtgcagagactgatcaaccagtggagaaacagagtgaacgagctgaagagcctgaacatcagcaccaaggtggccctgctgagcgacgtgaaggacggcgtgaaccaggccgcccccgccttcggcttcggcagcagccaggccgccaccttcatgagccccggcttccccgtgaacaacagcagcagcgacaacgcccagaacttcagcttcaagaccaacagcggcttcgccgccgccagcagcggcagccccgccggcttcggcagcagccccgccttcggcgccgccgccagcaccagcagcggcatcagcaccagcgcccccgccttcggcttcggcaagcccgaggtgaccagcgccgccagcttcagcttcaagagccccgccgccagcagcttcggcagccccggcttcagcggcctgcccgccagcctggccaccggccccgtgagagcccccgtggcccccgccttcggcggcggcagcagcgtggccggcttcggcagccccggcagccacagccacaccgccttcagcaagcccagcagcgacaccttcggcaacagcagcatcagcaccagcctgagcgccagcagcagcatcatcgccaccgacaacgtgctgttcacccccagagacaagctgaccgtggaggagctggagcagttccagagcaagaagttcaccctgggcaagatccccctgaagcccccccccctggagctgctgaacgtgtag

SEQ ID NO: 9381 - DNA, 1323 bp, Homo sapiens
atgatggccgacgaggaggaggaggtgaagcccatcctgcagaagctgcaggagctggtggaccagctgtacagcttcagagactgctacttcgagacccacagcgtggaggacgccggcagaaagcagcaggacgtgcagaaggagatggagaagaccctgcagcagatggaggaggtggtgggcagcgtgcagggcaaggcccaggtgctgatgctgaccggcaaggccctgaacgtgacccccgactacagccccaaggccgaggagctgctgagcaaggccgtgaagctggagcccgagctggtggaggcctggaaccagctgggcgaggtgtactggaagaagggcgacgtggccgccgcccacacctgcttcagcggcgccctgacccactgcagaaacaaggtgagcctgcagaacctgagcatggtgctgagacagctgagaaccgacaccgaggacgagcacagccaccacgtgatggacagcgtgagacaggccaagctggccgtgcagatggacgtgcacgacggcagaagctggtacatcctgggcaacagctacctgagcctgtacttcagcaccggccagaaccccaagatcagccagcaggccctgagcgcctacgcccaggccgagaaggtggacagaaaggccagcagcaaccccgacctgcacctgaacagagccaccctgcacaagtacgaggagagctacggcgaggccctggagggcttcagcagagccgccgccctggaccccgcctggcccgagcccagacagagagagcagcagctgctggagttcctggacagactgaccagcctgctggagagcaagggcaaggtgaagaccaagaagctgcagagcatgctgggcagcctgagacccgcccacctgggcccctgcagcgacggccactaccagagcgccagcggccagaaggtgaccctggagctgaagcccctgagcaccctgcagcccggcgtgaacagcggcgccgtgatcctgggcaaggtggtgttcagcctgaccaccgaggagaaggtgcccttcaccttcggcctggtggacagcgacggcccctgctacgccgtgatggtgtacaacatcgtgcagagctggggcgtgctgatcggcgacagcgtggccatccccgagcccaacctgagactgcacagaatccagcacaagggcaaggactacagcttcagcagcgtgagagtggagacccccctgctgctggtggtgaacggcaagccccagggcagcagcagccaggccgtggccaccgtggccagcagaccccagtgcgagtag

SEQ ID NO: 9382 - DNA, 1341 bp, Homo sapiens
atggaggagaccatcaaggacccccccaccagcgccgtgctgctggaccactgccacttcagccaggtgatcttcaacagcgtggagaagttctacatccccggcggcgacgtgacctgccactacaccttcacccagcacttcatccccagaagaaaggactggatcggcatcttcagagtgggctggaagaccaccagagagtactacaccttcatgtgggtgaccctgcccatcgacctgaacaacaagagcgccaagcagcaggaggtgcagttcaaggcctactacctgcccaaggacgacgagtactaccagttctgctacgtggacgaggacggcgtggtgagaggcgccagcatccccttccagttcagacccgagaacgaggaggacatcctggtggtgaccacccagggcgaggtggaggagatcgagcagcacaacaaggagctgtgcaaggagaaccaggagctgaaggacagctgcatcagcctgcagaagcagaacagcgacatgcaggccgagctgcagaagaagcaggaggagctggagaccctgcagagcatcaacaagaagctggagctgaaggtgaaggagcagaaggactactgggagaccgagctgctgcagctgaaggagcagaaccagaagatgagcagcgagaacgagaagatgggcatcagagtggaccagctgcaggcccagctgagcacccaggagaaggagatggagaagctggtgcagggcgaccaggacaagaccgagcagctggagcagctgaagaaggagaacgaccacctgttcctgagcctgaccgagcagagaaaggaccagaagaagctggagcagaccgtggagcagatgaagcagaacgagaccaccgccatgaagaagcagcaggagctgatggacgagaacttcgacctgagcaagagactgagcgagaacgagatcatctgcaacgccctgcagagacagaaggagagactggagggcgagaacgacctgctgaagagagagaacagcagactgctgagctacatgggcctggacttcaacagcctgccctaccaggtgcccaccagcgacgagggcggcgccagacagaaccccggcctggcctacggcaacccctacagcggcatccaggagagcagcagccccagccccctgagcatcaagaagtgccccatctgcaaggccgacgacatctgcgaccacaccctggagcagcagcagatgcagcccctgtgcttcaactgccccatctgcgacaagatcttccccgccaccgagaagcagatcttcgaggaccacgtgttctgccacagcctgtag

SEQ ID NO: 9383 - DNA, 1329 bp, Homo sapiens
atggccctgcccggcgccagagccagaggctgggccgccgccgccagagccgcccagagaagaagaagagtggagaacgccggcggcagccccagccccgagcccgccggcagaagagccgccctgtacgtgcactggccctactgcgagaagagatgcagctactgcaacttcaacaagtacatccccagaagactggaggaggccgccatgcagaagtgcctggtgaccgaggcccagaccctgctgagactgagcggcgtgcagagagtggagagcgtgttcttcggcggcggcacccccagcctggccagcccccacaccgtggccgccgtgctggaggccgtggcccaggccgcccacctgcccgccgacctggaggtgaccctggaggccaaccccaccagcgcccccggcagcagactggccgagttcggcgccgccggcgtgaacagactgagcatcggcctgcagagcctggacgacaccgagctgagactgctgggcagaacccacagcgcctgcgacgccctgagaaccctggccgaggccagaagactgttccccggcagagtgagcgtggacctgatgctgggcctgcccgcccagcaggtgggcccctggctgggccagctgcaggagctgctgcaccactgcgacgaccacctgagcctgtaccagctgagcctggagagaggcaccgccctgttcgcccaggtgcagagaggcgccctgcccgcccccgaccccgagctggccgccgagatgtaccagagaggcagagccgtgctgagagaggccggcttccaccagtacgaggtgagcaacttcgccagaaacggcgccctgagcacccacaactggacctactggcagtgcggccagtacctgggcgtgggccccggcgcccacggcagattcatgccccagggcgccggcggccacaccagagaggccagaatccagaccctggagcccgacaactggatgaaggaggtgatgctgttcggccacggcaccagaaagagagtgcccctgggcagactggagctgctggaggaggtgctggccctgggcctgagaaccgacgtgggcatcacccaccagcactggcagcagttcgagccccagctgaccctgtgggacgtgttcggcgccaacaaggaggtgcaggagctgctggagagaggcctgctgcagctggaccacagaggcctgagatgcagctgggagggcctggccgtgctggacagcctgctgctgaccctgctgccccagctgcaggaggcctggcagcagagaacccccagccccgtgcccggcggctag

SEQ ID NO: 9384 - DNA, 1278 bp, Homo sapiens
atggacaagaacatcggcgagcagctgaacaaggcctacgaggccttcagacaggcctgcatggacagagacagcgccgtgaaggagctgcagcagaagaccgagaactacgagcagagaatcagagagcagcaggagcagctgagcctgcagcagaccatcatcgacaagctgaagagccagctgctgctggtgaacagcacccaggacaacaactacggctgcgtgcccctgctggaggacagcgagaccagaaagaacaacctgaccctggaccagccccaggacaaggtgatcagcggcatcgccagagagaagctgcccaaggtgagaagacaggaggtgagcagccccagaaaggagaccagcgccagaagcctgggcagccccctgctgcacgagagaggcaacatcgagaagaccttctgggacctgaaggaggagttccacaagatctgcatgctggccaaggcccagaaggaccacctgagcaagctgaacatccccgacaccgccaccgagacccagtgcagcgtgcccatccagtgcaccgacaagaccgacaagcaggaggccctgttcaagccccaggccaaggacgacatcaacagaggcgcccccagcatcaccagcgtgacccccagaggcctgtgcagagacgaggaggacaccagcttcgagagcctgagcaagttcaacgtgaagttcccccccatggacaacgacagcaccttcctgcacagcacccccgagagacccggcatcctgagccccgccaccagcgaggccgtgtgccaggagaagttcaacatggagttcagagacaaccccggcaacttcgtgaagaccgaggagaccctgttcgagatccagggcatcgaccccatcgccagcgccatccagaacctgaagaccaccgacaagaccaagcccagcaacctggtgaacacctgcatcagaaccaccctggacagagccgcctgcctgccccccggcgaccacaacgccctgtacgtgaacagcttccccctgctggaccccagcgacgcccccttccccagcctggacagccccggcaaggccatcagaggcccccagcagcccatctggaagcccttccccaaccaggacagcgacagcgtggtgctgagcggcaccgacagcgagctgcacatccccagagtgtgcgagttctgccaggccgtgttcccccccagcatcaccagcagaggcgacttcctgagacacctgaacagccacttcaacggcgagacctag

SEQ ID NO: 9385 - DNA, 2055 bp, Homo sapiens
atggagaacctgcagaccaacttcagcctggtgcagggcagcaccaagaagctgaacggcatgggcgacgacggcagcccccccgccaagaagatgatcaccgacatccacgccaacggcaagaccatcaacaaggtgcccaccgtgaagaaggagcacctggacgactacggcgaggcccccgtggagaccgacggcgagcacgtgaagagaacctgcaccagcgtgcccgagaccctgcacctgaaccccagcctgaagcacaccctggcccagttccacctgagcagccagagcagcctgggcggccccgccgccttcagcgccagacacagccaggagagcatgagccccaccgtgttcctgcccctgcccagcccccaggtgctgcccggccccctgctgatccccagcgacagcagcaccgagctgacccagaccgtgctggagggcgagagcatcagctgcttccaggtgggcggcgagaagagactgtgcctgccccaggtgctgaacagcgtgctgagagagttcaccctgcagcagatcaacaccgtgtgcgacgagctgtacatctactgcagcagatgcaccagcgaccagctgcacatcctgaaggtgctgggcatcctgcccttcaacgcccccagctgcggcctgatcaccctgaccgacgcccagagactgtgcaacgccctgctgagacccagaaccttcccccagaacggcagcgtgctgcccgccaagagcagcctggcccagctgaaggagaccggcagcgccttcgaggtggagcacgagtgcctgggcaagtgccagggcctgttcgccccccagttctacgtgcagcccgacgccccctgcatccagtgcctggagtgctgcggcatgttcgccccccagaccttcgtgatgcacagccacagaagccccgacaagagaacctgccactggggcttcgagagcgccaagtggcactgctacctgcacgtgaaccagaagtacctgggcacccccgaggagaagaagctgaagatcatcctggaggagatgaaggagaagttcagcatgagaagcggcaagagaaaccagagcaagaccgacgcccccagcggcatggagctgcagagctggtaccccgtgatcaagcaggagggcgaccacgtgagccagacccacagcttcctgcaccccagctactacctgtacatgtgcgacaaggtggtggcccccaacgtgagcctgaccagcgccgtgagccagagcaaggagctgaccaagaccgaggccagcaagagcatcagcagacagagcgagaaggcccacagcagcggcaagctgcagaagaccgtgagctaccccgacgtgagcctggaggagcaggagaagatggacctgaagaccagcagagagctgtgcagcagactggacgccagcatcagcaacaacagcaccagcaagagaaagagcgagagcgccacctgcaacctggtgagagacatcaacaaggtgggcatcggcctggtggccgccgccagcagccccctgctggtgaaggacgtgatctgcgaggacgacaagggcaagatcatggaggaggtgatgagaacctacctgaagcagcaggagaagctgaacctgatcctgcagaagaagcagcagctgcagatggaggtgaagatgctgagcagcagcaagagcatgaaggagctgaccgaggagcagcagaacctgcagaaggagctggagagcctgcagaacgagcacgcccagagaatggaggagttctacgtggagcagaaggacctggagaagaagctggagcagatcatgaagcagaagtgcacctgcgacagcaacctggagaaggacaaggaggccgagtacgccggccagctggccgagctgagacagagactggaccacgccgaggccgacagacaggagctgcaggacgagctgagacaggagagagaggccagacagaagctggagatgatgatcaaggagctgaagctgcagatcctgaagagcagcaagaccgccaaggagtag

SEQ ID NO: 9386 - DNA, 1080 bp, Homo sapiens
atgagctacagaagagagctggagaagtacagagacctggacgaggacgagatcctgggcgccctgaccgaggaggagctgagaaccctggagaacgagctggacgagctggaccccgacaacgccctgctgcccgccggcctgagacagaaggaccagaccaccaaggcccccaccggccccttcaagagagaggagctgctggaccacctggagaagcaggccaaggagttcaaggacagagaggacctggtgccctacaccggcgagaagagaggcaaggtgtgggtgcccaagcagaagcccctggaccccgtgctggagagcgtgaccctggagcccgagctggaggaggccctggccaacgccagcgacgccgagctgtgcgacatcgccgccatcctgggcatgcacaccctgatgagcaaccagcagtactaccaggccctgagcagcagcagcatcatgaacaaggagggcctgaacagcgtgatcaagcccacccagtacaagcccgtgcccgacgaggagcccaacagcaccgacgtggaggagaccctggagagaatcaagaacaacgaccccaagctggaggaggtgaacctgaacaacatcagaaacatccccatccccaccctgaaggcctacgccgaggccctgaaggagaacagctacgtgaagaagttcagcatcgtgggcaccagaagcaacgaccccgtggcctacgccctggccgagatgctgaaggagaacaaggtgctgaagaccctgaacgtggagagcaacttcatcagcggcgccggcatcctgagactggtggaggccctgccctacaacaccagcctggtggagatgaagatcgacaaccagagccagcccctgggcaacaaggtggagatggagatcgtgagcatgctggagaagaacgccaccctgctgaagttcggctaccacttcacccagcagggccccagactgagagccagcaacgccatgatgaacaacaacgacctggtgagaaagagaagactggccgacctgaccggccccatcatccccaagtgcagaagcggcgtgtag

SEQ ID NO: 9387 - DNA, 1941 bp, Homo sapiens
atggaggagagaggcagccccgacggcgacctggccagaagcctggagcagggccccgagggccccgagacccccatccaggtggtgctgagagtgagacccatgagcgccgccgagctgagaagaggccagcagagcgtgctgcactgcagcggcaccagaaccctgcagggcggccccgaggtggccttcagattcggcgccgtgctggacgccgccagaacccaggaggacgtgttcagagcctgcggcgtgagaagactgggcgagctggccctgagaggcttcagctgcaccgtgttcaccttcggccagaccggcagcggcaagacctacaccctgaccggcccccccccccagggcgagggcgtgcccgtgccccccagcctggccggcatcatgcagagaaccttcgcctggctgctggacagagtgcagcacctgggcgcccccgtgaccctgagagccagctacctggagatctacaacgagcaggtgagagacctgctgagcctgggcagccccagacccctgcccgtgagatggaacaagaccagaggcttctacgtggagcagctgagagtggtggagttcggcagcctggaggccctgatggagctgctgcagaccggcctgagcagaagaagaaacagcgcccacaccctgaaccaggccagcagcagaagccacgccctgctgaccctgtacatcagcagacagaccgcccagcagatgcccagcgtggaccccggcgagccccccgtgggcggcaagctgtgcttcgtggacctggccggcagcgagaaggtggccgccaccggcagcagaggcgagctgatgctggaggccaacagcatcaacagaagcctgctggccctgggccactgcatcagcctgctgctggacccccagagaaagcagagccacatccccttcagagacagcaagctgaccaagctgctggccgacagcctgggcggcagaggcgtgaccctgatggtggcctgcgtgagccccagcgcccagtgcctgcccgagaccctgagcaccctgagatacgccagcagagcccagagagtgaccaccagaccccaggcccccaagagccccgtggccaagcagccccagagactggagaccgagatgctgcagctgcaggaggagaacagaagactgcagttccagctggaccagatggactgcaaggccagcggcctgagcggcgccagagtggcctgggcccagagaaacctgtacggcatgctgcaggagttcatgctggagaacgagagactgagaaaggagaagagccagctgcagaacagcagagacctggcccagaacgagcagagaatcctggcccagcaggtgcacgccctggagagaagactgctgagcgcctgctaccaccaccagcagggccccggcctgacccccccctgcccctgcctgatggcccccgcccccccctgccacgccctgccccccctgtacagctgcccctgctgccacatctgccccctgtgcagagtgcccctggcccactgggcctgcctgcccggcgagcaccacctgccccaggtgctggaccccgaggccagcggcggcagaccccccagcgccagaccccccccctgggcccccccctgcagccccggcagcgccaagtgccccagagagagaagccacagcgactggacccagaccagagtgctggccgagatgctgaccgaggaggaggtggtgcccagcgccccccccctgcccgtgagaccccccaagaccagccccggcctgagaggcggcgccggcgtgcccaacctggcccagagactggaggccctgagagaccagatcggcagcagcctgagaagaggcagaagccagcccccctgcagcgagggcgccagaagccccggccaggtgctgcccccccactag

SEQ ID NO: 9388 - DNA, 462 bp, Homo sapiens
atggccagaaacaccctgagcagcagattcagaagagtggacatcgacgagttcgacgagaacaagttcgtggacgagcaggaggaggccgccgccgccgccgccgagcccggccccgaccccagcgaggtggacggcctgctgagacagggcgacatgctgagagccttccacgccgccctgagaaacagccccgtgaacaccaagaaccaggccgtgaaggagagagcccagggcgtggtgctgaaggtgctgaccaacttcaagagcagcgagatcgagcaggccgtgcagagcctggacagaaacggcgtggacctgctgatgaagtacatctacaagggcttcgagaagcccaccgagaacagcagcgccgtgctgctgcagtggcacgagaaggccctggccgtgggcggcctgggcagcatcatcagagtgctgaccgccagaaagaccgtgtag

SEQ ID NO: 9389 - DNA, 3318 bp, Homo sapiens
atggccgccaccgccagcgccggcgtgcccgccaccgtgagcgagaagcaggagttctaccagctgctgaagaacctgatcaaccccagctgcatggtgagaagacaggccgaggagatctacgagaacatccccggcctgtgcaagaccaccttcctgctggacgccgtgagaaacagaagagccggctacgaggtgagacagatggccgccgccctgctgagaagactgctgagcagcggcttcgaggaggtgtaccccaacctgcccgccgacgtgcagagagacgtgaagatcgagctgatcctggccgtgaagctggagacccacgccagcatgagaaagaagctgtgcgacatcttcgccgtgctggccagaaacctgatcgacgaggacggcaccaaccactggcccgagggcctgaagttcctgatcgacagcatctacagcaagaacgtggtgctgtgggaggtggccctgcacgtgttctggcacttccccggcatcttcggcacccaggagagacacgacctggacatcatcaagagactgctggaccagtgcatccaggaccaggagcaccccgccatcagaaccctgagcgccagagccgccgccgccttcgtgctggccaacgagaacaacatcgccctgttcaaggacttcgccgacctgctgcccggcatcctgcaggccgtgaacgacagctgctaccaggacgacgacagcgtgctggagagcctggtggagatcgccgacaccgtgcccaagtacctgggcccctacctggaggacaccctgcagctgagcctgaagctgtgcggcgacagcagactgagcaacctgcagagacagctggccctggaggtgatcgtgaccctgagcgagaccgccacccccatgctgaagaagcacaccaacatcatcgcccaggccgtgccccacatcctggccatgatggtggacctgcaggacgacgaggactgggtgaacgccgacgagatggaggaggacgacttcgacagcaacgccgtggccgccgagagcgccctggacagactggcctgcggcctgggcggcaaggtggtgctgcccatgaccaaggagcacatcatgcagatgctgcagagccccgactggaagtacagacacgccggcctgatggccctgagcgccatcggcgagggctgccaccagcagatggagagcatcctggacgagaccgtgaacagcgtgctgctgttcctgcaggacccccaccccagagtgagagccgccgcctgcaccaccctgggccagatggccaccgacttcgcccccaacttccagaagaagttccacgagaccgtgatcgccgccctgctgagaaccatggagaaccagggcaaccagagagtgcagagccacgccgccagcgccctgatcatcttcatcgaggactgccccaagagcctgctggtgctgtacgtggacagcatggtgaagaacctgcacagcgtgctggtgatcaagctgcaggagctgatcagaaacggcaccaagctggccctggagcagctggtgaccaccatcgccagcgtggccgacaccatcgaggagaagttcgtgccctactacgacatcttcatgcccagcctgaagcacatcgtggagctggccgtgcagaaggagctgaagctgctgagaggcaagaccatcgagtgcatcagccacatcggcctggccgtgggcaaggagaagttcatgcaggacgccagcaacgtgatgcagctgctgctgaagacccagagcgacctgaacaacatggaggacgacgacccccagaccagctacatggtgagcgcctgggccagaatgtgcaagatcctgggcaaggacttccagcagtacctgcccctggtgatcgagcccctgatcaagaccgccagcgccaagcccgacgtggccctgctggacacccaggacgtggagaacatgagcgacgacgacggctggcagttcgtgaacctgggcgaccagcagagcttcggcatcaagaccagcggcctggaggccaaggccaccgcctgccagatgctggtgtactacgccaaggagctgagagagggcttcgtggagtacaccgagcaggtggtgaagctgatggtgcccctgctgaagttctacttccacgacaacgtgagagtggccgccgccgagagcatgcccttcctgctggagtgcgccagaatcagaggccccgagtacctggcccagatgtggcagttcatctgcgaccccctgatcaaggccatcggcaccgagcccgacaccgacgtgctgagcgagatcatgaacagcttcgccaagagcatcgaggtgatgggcgacggctgcctgaacgacgagcacctggaggagctgggcggcatcctgaaggccaagctggagggccacttcaagaaccaggagctgagacaggtgaagagacaggaggagaactacgaccagcaggtggagatgagcctgcaggacgaggacgagtgcgacgtgtacatcctgaccaaggtgagcgacatcctgcacagcctgttcagcacctacaaggagaagatcctgccctggttcgagcagctgctgcccctgatcgtgaacctgatctgcagcagcagaccctggcccgacagacagtggggcctgtgcatcttcgacgacatcatcgagcactgcagccccaccagcttcaagtacgtggagtacttcagatggcccatgctgctgaacatgagagacaacaaccccgaggtgagacaggccgccgcctacggcctgggcgtgatggcccagttcggcggcgacgactacagaagcctgtgcagcgaggccgtgcccctgctggtgaaggtgatcaagtgcgccaacagcaagaccaagaagaacgtgatcgccaccgagaactgcatcagcgccatcggcaagatcctgaagttcaagcccaactgcgtgaacgtggacgaggtgctgccccactggctgagctggctgcccctgcacgaggacaaggaggaggccatccagaccctgagcttcctgtgcgacctgatcgagagcaaccaccccgtggtgatcggccccaacaacagcaacctgcccaagatcatcagcatcatcgccgagggcaagatcaacgagaccatcaactacgaggacccctgcgccaagagactggccaacgtggtgagacaggtgcagaccagcgaggacctgtggctggagtgcgtgagccagctggacgacgagcagcaggaggccctgcaggagctgctgaacttcgcctag

SEQ ID NO: 9390 - DNA, 1914 bp, Homo sapiens
atggaggtgaccggcttcggcgtgaccagacccggcaaggtgccccaggccagaatgagcggcctggtgctgggccagagagacgagcccgccggccacagactgagccaggaggagatcctgggcagcaccagactggtgagccagggcctggaggccctgagaagcgagcaccaggccgtgctgcagagcctgagccagaccatcgagtgcctgcagcagggcggccacgaggagggcctggtgcacgagaaggccagacagctgagaagaagcatggagaacatcgagctgggcctgagcgaggcccaggtgatgctggccctggccagccacctgagcaccgtggagagcgagaagcagaagctgagagcccaggtgagaagactgtgccaggagaaccagtggctgagagacgagctggccggcacccagcagagactgcagagaagcgagcaggccgtggcccagctggaggaggagaagaagcacctggagttcctgggccagctgagacagtacgacgaggacggccacaccagcgaggagaaggagggcgacgccaccaaggacagcctggacgacctgttccccaacgaggaggaggaggaccccagcaacggcctgagcagaggccagggcgccaccgccgcccagcagggcggctacgagatccccgccagactgagaaccctgcacaacctggtgatccagtacgccgcccagggcagatacgaggtggccgtgcccctgtgcaagcaggccctggaggacctggagagaaccagcggcagaggccaccccgacgtggccaccatgctgaacatcctggccctggtgtacagagaccagaacaagtacaaggaggccgcccacctgctgaacgacgccctgagcatcagagagagcaccctgggccccgaccaccccgccgtggccgccaccctgaacaacctggccgtgctgtacggcaagagaggcaagtacaaggaggccgagcccctgtgccagagagccctggagatcagagagaaggtgctgggcaccaaccaccccgacgtggccaagcagctgaacaacctggccctgctgtgccagaaccagggcaagtacgaggccgtggagagatactaccagagagccctggccatctacgagggccagctgggccccgacaaccccaacgtggccagaaccaagaacaacctggccagctgctacctgaagcagggcaagtacgccgaggccgagaccctgtacaaggagatcctgaccagagcccacgtgcaggagttcggcagcgtggacgacgaccacaagcccatctggatgcacgccgaggagagagaggagatgagcaagagcagacaccacgagggcggcaccccctacgccgagtacggcggctggtacaaggcctgcaaggtgagcagccccaccgtgaacaccaccctgagaaacctgggcgccctgtacagaagacagggcaagctggaggccgccgagaccctggaggagtgcgccctgagaagcagaagacagggcaccgaccccatcagccagaccaaggtggccgagctgctgggcgagagcgacggcagaagaaccagccaggagggccccggcgacagcgtgaagttcgagggcggcgaggacgccagcgtggccgtggagtggagcggcgacggcagcggcaccctgcagagaagcggcagcctgggcaagatcagagacgtgctgagaagaagcagcgagctgctggtgagaaagctgcagggcaccgagcccagacccagcagcagcaacatgaagagagccgccagcctgaactacctgaaccagcccagcgccgcccccctgcaggtgagcagaggcctgagcgccagcaccatggacctgagcagcagcagctag

SEQ ID NO: 9391 - DNA, 3966 bp, Homo sapiens
atgcagtgcctggccgccgccctgaaggacgagaccaacatgagcggcggcggcgagcaggccgacatcctgcccgccaactacgtggtgaaggacagatggaaggtgctgaagaagatcggcggcggcggcttcggcgagatctacgaggccatggacctgctgaccagagagaacgtggccctgaaggtggagagcgcccagcagcccaagcaggtgctgaagatggaggtggccgtgctgaagaagctgcagggcaaggaccacgtgtgcagattcatcggctgcggcagaaacgagaagttcaactacgtggtgatgcagctgcagggcagaaacctggccgacctgagaagaagccagcccagaggcaccttcaccctgagcaccaccctgagactgggcaagcagatcctggagagcatcgaggccatccacagcgtgggcttcctgcacagagacatcaagcccagcaacttcgccatgggcagactgcccagcacctacagaaagtgctacatgctggacttcggcctggccagacagtacaccaacaccaccggcgacgtgagaccccccagaaacgtggccggcttcagaggcaccgtgagatacgccagcgtgaacgcccacaagaacagagagatgggcagacacgacgacctgtggagcctgttctacatgctggtggagttcgccgtgggccagctgccctggagaaagatcaaggacaaggagcaggtgggcatgatcaaggagaagtacgagcacagaatgctgctgaagcacatgcccagcgagttccacctgttcctggaccacatcgccagcctggactacttcaccaagcccgactaccagctgatcatgagcgtgttcgagaacagcatgaaggagagaggcatcgccgagaacgaggccttcgactgggagaaggccggcaccgacgccctgctgagcaccagcaccagcacccccccccagcagaacaccagacagaccgccgccatgttcggcgtggtgaacgtgacccccgtgcccggcgacctgctgagagagaacaccgaggacgtgctgcagggcgagcacctgagcgaccaggagaacgccccccccatcctgcccggcagacccagcgagggcctgggccccagcccccacctggtgccccaccccggcggccccgaggccgaggtgtgggaggagaccgacgtgaacagaaacaagctgagaatcaacatcggcaagagcccctgcgtggaggaggagcagagcagaggcatgggcgtgcccagcagccccgtgagagccccccccgacagccccaccacccccgtgagaagcctgagatacagaagagtgaacagccccgagagcgagagactgagcaccgccgacggcagagtggagctgcccgagagaagaagcagaatggacctgcccggcagccccagcagacaggcctgcagcagccagcccgcccagatgctgagcgtggacaccggccacgccgacagacaggccagcggcagaatggacgtgagcgccagcgtggagcaggaggccctgagcaacgccttcagaagcgtgcccctggccgaggaggaggacttcgacagcaaggagtgggtgatcatcgacaaggagaccgagctgaaggacttcccccccggcgccgagcccagcaccagcggcaccaccgacgaggagcccgaggagctgagacccctgcccgaggagggcgaggagagaagaagactgggcgccgagcccaccgtgagacccagaggcagaagcatgcaggccctggccgaggaggacctgcagcacctgcccccccagcccctgcccccccagctgagccagggcgacggcagaagcgagaccagccagccccccacccccggcagccccagccacagccccctgcacagcggccccagacccagaagaagagagagcgaccccaccggcccccagagacaggtgttcagcgtggccccccccttcgaggtgaacggcctgcccagagccgtgcccctgagcctgccctaccaggacttcaagagagacctgagcgactacagagagagagccagactgctgaacagagtgagaagagtgggcttcagccacatgctgctgaccaccccccaggtgcccctggcccccgtgcagccccaggccaacggcaaggaggaggaggaggaggaggaggaggacgaggaggaggaggaggaggacgaggaggaggaggaggaggaggaggaggaggaggaggaggaggaggaggaggaggaggaggaggaggaggccgccgccgccgtggccctgggcgaggtgctgggccccagaagcggcagcagcagcgagggcagcgagagaagcaccgacagaagccaggagggcgcccccagcaccctgctggccgacgaccagaaggagagcagaggcagagccagcatggccgacggcgacctggagcccgaggagggcagcaagaccctggtgctggtgagccccggcgacatgaagaagagccccgtgaccgccgagctggcccccgaccccgacctgggcaccctggccgccctgaccccccagcacgagagaccccagcccaccggcagccagctggacgtgagcgagcccggcaccctgagcagcgtgctgaagagcgagcccaagccccccggccccggcgccggcctgggcgccggcaccgtgaccaccggcgtgggcggcgtggccgtgaccagcagccccttcaccaaggtggagagaaccttcgtgcacatcgccgagaagacccacctgaacgtgatgagcagcggcggccaggccctgagaagcgaggagttcagcgccggcggcgagctgggcctggagctggccagcgacggcggcgccgtggaggagggcgccagagcccccctggagaacggcctggccctgagcggcctgaacggcgccgagatcgagggcagcgccctgagcggcgcccccagagagacccccagcgagatggccaccaacagcctgcccaacggccccgccctggccgacggccccgcccccgtgagccccctggagcccagccccgagaaggtggccaccatcagccccagaagacacgccatgcccggcagcagacccagaagcagaatccccgtgctgctgagcgaggaggacaccggcagcgagcccagcggcagcctgagcgccaaggagagatggagcaagagagccagaccccagcaggacctggccagactggtgatggagaagagacagggcagactgctgctgagactggccagcggcgccagcagcagcagcagcgaggagcagagaagagccagcgagaccctgagcggcaccggcagcgaggaggacacccccgccagcgagcccgccgccgccctgcccagaaagagcggcagagccgccgccaccagaagcagaatccccagacccatcggcctgagaatgcccatgcccgtggccgcccagcagcccgccagcagaagccacggcgccgcccccgccctggacaccgccatcaccagcagactgcagctgcagaccccccccggcagcgccaccgccgccgacctgagacccaagcagccccccggcagaggcctgggccccggcagagcccaggccggcgccagaccccccgcccccagaagccccagactgcccgccagcaccagcgccgccagaaacgccagcgccagccccagaagccagagcctgagcagaagagagagccccagccccagccaccaggccagacccggcgtgcccccccccagaggcgtgccccccgccagagcccagcccgacggcacccccagccccggcggcagcaagaagggccccagaggcaagctgcaggcccagagagccaccaccaagggcagagccggcggcgccgagggcagagccggcgccagatag

SEQ ID NO: 9392 - DNA, 1818 bp, Homo sapiens
atgagccagctgagcagcaccctgaagagatacaccgagagcgccagatacaccgacgcccactacgccaagagcggctacggcgcctacacccccagcagctacggcgccaacctggccgccagcctgctggagaaggagaagctgggcttcaagcccgtgcccaccagcagcttcctgaccagacccagaacctacggccccagcagcctgctggactacgacagaggcagacccctgctgagacccgacatcaccggcggcggcaagagagccgagagccagaccagaggcaccgagagacccctgggcagcggcctgagcggcggcagcggcttcccctacggcgtgaccaacaactgcctgagctacctgcccatcaacgcctacgaccagggcgtgaccctgacccagaagctggacagccagagcgacctggccagagacttcagcagcctgagaaccagcgacagctacagaatcgaccccagaaacctgggcagaagccccatgctggccagaaccagaaaggagctgtgcaccctgcagggcctgtaccagaccgccagctgccccgagtacctggtggactacctggagaactacggcagaaagggcagcgccagccaggtgcccagccaggccccccccagcagagtgcccgagatcatcagccccacctacagacccatcggcagatacaccctgtgggagaccggcaagggccaggcccccggccccagcagaagcagcagccccggcagagacggcatgaacagcaagagcgcccagggcctggccggcctgagaaacctgggcaacacctgcttcatgaacagcatcctgcagtgcctgagcaacaccagagagctgagagactactgcctgcagagactgtacatgagagacctgcaccacggcagcaacgcccacaccgccctggtggaggagttcgccaagctgatccagaccatctggaccagcagccccaacgacgtggtgagccccagcgagttcaagacccagatccagagatacgcccccagattcgtgggctacaaccagcaggacgcccaggagttcctgagattcctgctggacggcctgcacaacgaggtgaacagagtgaccctgagacccaagagcaaccccgagaacctggaccacctgcccgacgacgagaagggcagacagatgtggagaaagtacctggagagagaggacagcagaatcggcgacctgttcgtgggccagctgaagagcagcctgacctgcaccgactgcggctactgcagcaccgtgttcgaccccttctgggacctgagcctgcccatcgccaagagaggctaccccgaggtgaccctgatggactgcatgagactgttcaccaaggaggacgtgctggacggcgacgagaagcccacctgctgcagatgcagaggcagaaagagatgcatcaagaagttcagcatccagagattccccaagatcctggtgctgcacctgaagagattcagcgagagcagaatcagaaccagcaagctgaccaccttcgtgaacttccccctgagagacctggacctgagagagttcgccagcgagaacaccaaccacgccgtgtacaacctgtacgccgtgagcaaccacagcggcaccaccatgggcggccactacaccgcctactgcagaagccccggcaccggcgagtggcacaccttcaacgacagcagcgtgacccccatgagcagcagccaggtgagaaccagcgacgcctacctgctgttctacgagctggccagcccccccagcagaatgtag

SEQ ID NO: 9393 - DNA, 1353 bp, Homo sapiens
atggtgcccctggtggccgtggtgagcggccccagagcccagctgttcgcctgcctgctgagactgggcacccagcaggtgggccccctgcagctgcacaccggcgccagccacgccgccagaaaccactacgaggtgctggtgctgggcggcggcagcggcggcatcaccatggccgccagaatgaagagaaaggtgggcgccgagaacgtggccatcgtggagcccagcgagagacacttctaccagcccatctggaccctggtgggcgccggcgccaagcagctgagcagcagcggcagacccaccgccagcgtgatccccagcggcgtggagtggatcaaggccagagtgaccgagctgaaccccgacaagaactgcatccacaccgacgacgacgagaagatcagctacagatacctgatcatcgccctgggcatccagctggactacgagaagatcaagggcctgcccgagggcttcgcccaccccaagatcggcagcaactacagcgtgaagaccgtggagaagacctggaaggccctgcaggacttcaaggagggcaacgccatcttcaccttccccaacacccccgtgaagtgcgccggcgccccccagaagatcatgtacctgagcgaggcctacttcagaaagaccggcaagagaagcaaggccaacatcatcttcaacaccagcctgggcgccatcttcggcgtgaagaagtacgccgacgccctgcaggagatcatccaggagagaaacctgaccgtgaactacaagaagaacctgatcgaggtgagagccgacaagcaggaggccgtgttcgagaacctggacaagcccggcgagacccaggtgatcagctacgagatgctgcacgtgaccccccccatgagcccccccgacgtgctgaagaccagccccgtggccgacgccgccggctgggtggacgtggacaaggagaccctgcagcacagaagataccccaacgtgttcggcatcggcgactgcaccaacctgcccaccagcaagaccgccgccgccgtggccgcccagagcggcatcctggacagaaccatcagcgtgatcatgaagaaccagacccccaccaagaagtacgacggctacaccagctgccccctggtgaccggctacaacagagtgatcctggccgagttcgactacaaggccgagcccctggagaccttccccttcgaccagagcaaggagagactgagcatgtacctgatgaaggccgacctgatgcccttcctgtactggaacatgatgctgagaggctactggggcggccccgccttcctgagaaagctgttccacctgggcatgagctag

SEQ ID NO: 9394 - DNA, 5244 bp, Homo sapiens
atggacggcgtgagcagcgaggccaacgaggagaacgacaacatcgagagacccgtgagaagaagacacagcagcatcctgaagccccccagaagccccctgcaggacctgagaggcggcaacgagagagtgcaggagagcaacgccctgagaaacaagaagaacagcagaagagtgagcttcgccgacaccatcaaggtgttccagaccgagagccacatgaagatcgtgagaaagagcgagatggaggagaccgagaccggcgagaacctgctgctgatccagaacaagaagctggaggacaactactgcgagatcaccggcatgaacaccctgctgagcgcccccatccacacccagatgcagcagaaggagttcagcatcatcgagcacaccagagagagaaagcacgccaacgaccagaccgtgatcttcagcgacgagaaccagatggacctgaccagcagccacaccgtgatgatcaccaagggcctgctggacaaccccatcagcgagaagagcaccaagatcgacaccaccagcttcctggccaacctgaagctgcacaccgaggacagcagaatgaagaaggaggtgaacttcagcgtggaccagaacaccagcagcgagaacaagatcgacttcaacgacttcatcaagagactgaagaccggcaagtgcagcgccttccccgacgtgcccgacaaggagaacttcgagatccccatctacagcaaggagcccaacagcgccagcagcacccaccagatgcacgtgagcctgaaggaggacgagaacaacagcaacatcaccagactgttcagagagaaggacgacggcatgaacttcacccagtgccacaccgccaacatccagaccctgatccccaccagcagcgagaccaacagcagagagagcaagggcaacgacatcaccatctacggcaacgacttcatggacctgaccttcaaccacaccctgcagatcctgcccgccaccggcaacttcagcgagatcgagaaccagacccagaacgccatggacgtgaccaccggctacggcaccaaggccagcggcaacaagaccgtgttcaagagcaagcagaacaccgccttccaggacctgagcatcaacagcgccgacaagatccacatcaccagaagccacatcatgggcgccgagacccacatcgtgagccagacctgcaaccaggacgccagaatcctggccatgacccccgagagcatctacagcaaccccagcatccagggctgcaagaccgtgttctacagcagctgcaacgacgccatggagatgaccaagtgcctgagcaacatgagagaggagaagaacctgctgaagcacgacagcaactacgccaagatgtactgcaaccccgacgccatgagcagcctgaccgagaagaccatctacagcggcgaggagaacatggacatcaccaagagccacaccgtggccatcgacaaccagatcttcaagcaggaccagagcaacgtgcagatcgccgccgcccccacccccgagaaggagatgatgctgcagaacctgatgaccaccagcgaggacggcaagatgaacgtgaactgcaacagcgtgccccacgtgagcaaggagagaatccagcagagcctgagcaaccccctgagcatcagcctgaccgacagaaagaccgagctgctgagcggcgagaacatggacctgaccgagagccacaccagcaacctgggcagccaggtgcccctggccgcctacaacctggcccccgagagcaccagcgagagccacagccagagcaagagcagcagcgacgagtgcgaggagatcaccaagagcagaaacgagcccttccagagaagcgacatcatcgccaagaacagcctgaccgacacctggaacaaggacaaggactgggtgctgaagatcctgccctacctggacaaggacagcccccagagcgccgactgcaaccaggagatcgccaccagccacaacatcgtgtactgcggcggcgtgctggacaagcagatcaccaacagaaacaccgtgagctgggagcagagcctgttcagcaccaccaagcccctgttcagcagcggccagttcagcatgaagaaccacgacaccgccatcagcagccacaccgtgaagagcgtgctgggccagaacagcaagctggccgagcccctgagaaagagcctgagcaaccccacccccgactactgccacgacaagatgatcatctgcagcgaggaggagcagaacatggacctgaccaagagccacaccgtggtgatcggcttcggccccagcgagctgcaggagctgggcaagaccaacctggagcacaccaccggccagctgaccaccatgaacagacagatcgccgtgaaggtggagaagtgcggcaagagccccatcgagaagagcggcgtgctgaagagcaactgcatcatggacgtgctggaggacgagagcgtgcagaagcccaagttccccaaggagaagcagaacgtgaagatctggggcagaaagagcgtgggcggccccaagatcgacaagaccatcgtgttcagcgaggacgacaagaacgacatggacatcaccaagagctacaccatcgagatcaaccacagacccctgctggagaagagagactgccacctggtgcccctggccggcaccagcgagaccatcctgtacacctgcagacaggacgacatggagatcaccagaagccacaccaccgccctggagtgcaagaccgtgagccccgacgagatcaccaccagacccatggacaagaccgtggtgttcgtggacaaccacgtggagctggagatgaccgagagccacaccgtgttcatcgactaccaggagaaggagagaaccgacagacccaacttcgagctgagccagagaaagagcctgggcacccccaccgtgatctgcacccccaccgaggagagcgtgttcttccccggcaacggcgagagcgacagactggtggccaacgacagccagctgacccccctggaggagtggagcaacaacagaggccccgtggaggtggccgacaacatggagctgagcaagagcgccacctgcaagaacatcaaggacgtgcagagccccggcttcctgaacgagcccctgagcagcaagagccagagaagaaagagcctgaagctgaagaacgacaagaccatcgtgttcagcgagaaccacaagaacgacatggacatcacccagagctgcatggtggagatcgacaacgagagcgccctggaggacaaggaggacttccacctggccggcgccagcaagaccatcctgtacagctgcggccaggacgacatggagatcaccagaagccacaccaccgccctggagtgcaagaccctgctgcccaacgagatcgccatcagacccatggacaagaccgtgctgttcaccgacaactacagcgacctggaggtgaccgacagccacaccgtgttcatcgactgccaggccaccgagaagatcctggaggagaaccccaagttcggcatcggcaagggcaagaacctgggcgtgagcttccccaaggacaacagctgcgtgcaggagatcgccgagaagcaggccctggccgtgggcaacaagatcgtgctgcacaccgagcagaagcagcagctgttcgccgccaccaacagaaccaccaacgagatcatcaagttccacagcgccgccatggacgagaaggtgatcggcaaggtggtggaccaggcctgcaccctggagaaggcccaggtggagagctgccagctgaacaacagagacagaagaaacgtggacttcaccagcagccacgccaccgccgtgtgcggcagcagcgacaactacagctgcctgcccaacgtgatcagctgcaccgacaacctggagggcagcgccatgctgctgtgcgacaaggacgaggagaaggccaactactgccccgtgcagaacgacctggcctacgccaacgacttcgccagcgagtactacctggagagcgagggccagcccctgagcgccccctgccccctgctggagaaggaggaggtgatccagaccagcaccaagggccagctggactgcgtgatcaccctgcacaaggaccaggacctgatcaaggaccccagaaacctgctggccaaccagaccctggtgtacagccaggacctgggcgagatgaccaagctgaacagcaagagagtgagcttcaagctgcccaaggaccagatgaaggtgtacgtggacgacatctacgtgatcccccagccccacttcagcaccgaccagccccccctgcccaagaagggccagagcagcatcaacaaggaggaggtgatcctgagcaaggccggcaacaagagcctgaacatcatcgagaacagcagcgcccccatctgcgagaacaagcccaagatcctgaacagcgaggagtggttcgccgccgcctgcaagaaggagctgaaggagaacatccagaccaccaactacaacaccgccctggacttccacagcaacagcgacgtgaccaagcaggtgatccagacccacgtgaacgccggcgaggcccccgaccccgtgatcaccagcaacgtgccctgcttccacagcatcaagcccaacctgaacaacctgaacggcaagaccggcgagttcctggccttccagaccgtgcacctgccccccctgcccgagcagctgctggagctgggcaacaaggcccacaacgacatgcacatcgtgcaggccaccgagatccacaacatcaacatcatcagcagcaacgccaaggacagcagagacgaggagaacaagaagagccacaacggcgccgagaccaccagcctgccccccaagaccgtgttcaaggacaaggtgagaagatgcagcctgggcatcttcctgcccagactgcccaacaagagaaactgcagcgtgaccggcatcgacgacctggagcagatccccgccgacaccaccgacatcaaccacctggagacccagcccgtgagcagcaaggacagcggcatcggcagcgtggccggcaagctgaacctgagccccagccagtacatcaacgaggagaacctgcccgtgtaccccgacgagatcaacagcagcgacagcatcaacatcgagaccgagcccaagaagaacgtgggcaccagaagaagaagatacagctag

SEQ ID NO: 9395 - DNA, 2061 bp, Homo sapiens
atgatccccggcaagtacagaagcgtgagcggcagagccgccaacaacgtgaactgcggcctgcacctggtgatccagaccagcagcctgcccgagaagaacaaggtggagttcaagctgaacaaggacaccagcagcttccccggcagactgctgcagcacgacctggagagaaactacagcagcagacagggcgaccacatcaacctggtgagcagcagcctgagcagcttccccatcctgcagagaagcagcgaggagaagatcctgtacagcgacagactgagcctggagagacagaagctgaccgtgtgccccatcatcaacggcgaggaccacctgagactgctgaacttccagcacaacttcatcaccagaatccagaacatcagcaacctgcagaagctgatcagcctggacctgtacgacaaccagatcgaggagatcagcggcctgagcaccctgagatgcctgagagtgctgctgctgggcaagaacagaatcaagaagatcagcaacctggagaacctgaagagcctggacgtgctggacctgcacggcaaccagatcaccaagatcgagaacatcaaccacctgtgcgagctgagagtgctgaacctggccagaaacttcctgagccacgtggacaacctgaacggcctggacagcctgaccgagctgaacctgagacacaaccagatcaccttcgtgagagacgtggacaacctgccctgcctgcagcacctgttcctgagcttcaacaacatcagcagcttcgacagcgtgagctgcctggccgacagcagcagcctgagcgacatcaccttcgacggcaaccccatcgcccaggagagctggtacaagcacaccgtgctgcagaacatgatgcagctgagacagctggacatgaagagaatcaccgaggaggagagaagaatggccagcgtgctggccaagaaggaggaggagaagaagagagagagccacaagcagagcctgctgaaggagaagaagagactgaccatcaacaacgtggccagacagtgggacctgcagcagcagagagtggccaacatcgccaccaacgaggacagaaaggacagcgacagcccccaggacccctgccagatcgacggcagcaccctgagcgccttccccgaggagaccggccccctggacagcggcctgaacaacgccctgcagggcctgagcgtgatcgacacctacctggtggaggtggacggcgacaccctgagcctgtacggcagcggcgccctggagagcctggacagaaactggagcgtgcagaccgccggcatgatcaccaccgtgagcttcaccttcatcgagttcgacgagatcgtgcaggtgctgcccaagctgaagatcaagttccccaacagcctgcacctgaagttcaaggagaccaacctggtgatgctgcagcagttcaacgccctggcccagctgagaagaatcgaccagctgaccatcgacccccagggcaaccccgtggtgaacttcaccctgtggaagtactacgtgctgttcagactgagccacttcagcatgcagaagatcaacggcaccgaggtgacccagaacgacatgatcatggccgagagactgttcggcatcctggcccacgtggccagcagcgagctgccccagtacagactgatcagcatcctgggcgacgccagaaagaagcagttcagatacctgctggagagcaagggcaagaagcccggcatcatcaacgaggagaacaacgacagcaagagactggtgggcgagaacaccaacagagccaccctgaactacaccaccagagacttctacaacgagaagctggaggagatcaaggagaagaagaagttctgcaagacctacatcgaggacctggtgaaggaggccaccgagatcaacatgaagaacgaggccctgcagaagctgtggccccagatgttcatcgagctggtgagagacgccgtgatcgagatcagaaacaagaacagctacatgaagctgtgcctgcagcagatcaccgaccagaagtag

SEQ ID NO: 9396 - DNA, 255 bp, Homo sapiens
atgccctacctgctgatcagcacccagatcagaatggaggtgggccccaccatggtgggcgacgagcagagcgaccccgagctgatgcagcacctgggcgccagcaagagaagagccctgggcaacaacttctacgagtactacgtggacgacccccccagaatcgtgctggacaagctggagagaagaggcttcagagtgctgagcatgaccggcgtgggccagaccctggtgtggtgcctgcacaaggagtag

SEQ ID NO: 9397 - DNA, 2664 bp, Homo sapiens
atgcccagcctgccccaggagggcgtgatccagggccccagccccctggacctgaacaccgagctgccctaccagagcaccatgaagagaaaggtgagaaagaagaagaagaagggcaccatcaccgccaacgtggccggcaccaagttcgagatcgtgagactggtgatcgacgagatgggcttcatgaagacccccgacgaggacgagaccagcaacctgatctggtgcgacagcgccgtgcagcaggagaagatcagcgagctgcagaactaccagagaatcaaccacttccccggcatgggcgagatctgcagaaaggacttcctggccagaaacatgaccaagatgatcaagagcagacccctggactacaccttcgtgcccagaacctggatcttccccgccgagtacacccagttccagaactacgtgaaggagctgaagaagaagagaaagcagaagaccttcatcgtgaagcccgccaacggcgccatgggccacggcatcagcctgatcagaaacggcgacaagctgcccagccaggaccacctgatcgtgcaggagtacatcgagaagcccttcctgatggagggctacaagttcgacctgagaatctacatcctggtgaccagctgcgaccccctgaagatcttcctgtaccacgacggcctggtgagaatgggcaccgagaagtacatcccccccaacgagagcaacctgacccagctgtacatgcacctgaccaactacagcgtgaacaagcacaacgagcacttcgagagagacgagaccgagaacaagggcagcaagagaagcatcaagtggttcaccgagttcctgcaggccaaccagcacgacgtggccaagttctggagcgacatcagcgagctggtggtgaagaccctgatcgtggccgagccccacgtgctgcacgcctacagaatgtgcagacccggccagccccccggcagcgagagcgtgtgcttcgaggtgctgggcttcgacatcctgctggacagaaagctgaagccctggctgctggagatcaacagagcccccagcttcggcaccgaccagaagatcgactacgacgtgaagagaggcgtgctgctgaacgccctgaagctgctgaacatcagaaccagcgacaagagaagaaacctggccaagcagaaggccgaggcccagagaagactgtacggccagaacagcatcaagagactgctgcccggcagcagcgactgggagcagcagagacaccagctggagagaagaaaggaggagctgaaggagagactggcccaggtgagaaagcagatcagcagagaggagcacgagaacagacacatgggcaactacagaagaatctacccccccgaggacaaggccctgctggagaagtacgagaacctgctggccgtggccttccagaccttcctgagcggcagagccgccagcttccagagagagctgaacaaccccctgaagagaatgaaggaggaggacatcctggacctgctggagcagtgcgagatcgacgacgagaagctgatgggcaagaccaccaagaccagaggccccaagcccctgtgcagcatgcccgagagcaccgagatcatgaagagacccaagtactgcagcagcgacagcagctacgacagcagcagcagcagcagcgagagcgacgagaacgagaaggaggagtaccagaacaagaagagagagaagcaggtgacctacaacctgaagcccagcaaccactacaagctgatccagcagcccagcagcatcagaagaagcgtgagctgccccagaagcatcagcgcccagagccccagcagcggcgacaccagacccttcagcgcccagcagatgatcagcgtgagcagacccaccagcgccagcagaagccacagcctgaacagagccagcagctacatgagacacctgccccacagcaacgacgcctgcagcaccaacagccaggtgagcgagagcctgagacagctgaagaccaaggagcaggaggacgacctgaccagccagaccctgttcgtgctgaaggacatgaagatcagattccccggcaagagcgacgccgagagcgagctgctgatcgaggacatcatcgacaactggaagtaccacaagaccaaggtggccagctactggctgatcaagctggacagcgtgaagcagagaaaggtgctggacatcgtgaagaccagcatcagaaccgtgctgcccagaatctggaaggtgcccgacgtggaggaggtgaacctgtacagaatcttcaacagagtgttcaacagactgctgtggagcagaggccagggcctgtggaactgcttctgcgacagcggcagcagctgggagagcatcttcaacaagagccccgaggtggtgacccccctgcagctgcagtgctgccagagactggtggagctgtgcaagcagtgcctgctggtggtgtacaagtacgccaccgacaagagaggcagcctgagcggcatcggccccgactggggcaacagcagatacctgctgcccggcagcacccagttcttcctgagaacccccacctacaacctgaagtacaacagccccggcatgaccagaagcaacgtgctgttcaccagcagatacggccacctgtag

SEQ ID NO: 9398 - DNA, 1140 bp, Homo sapiens
atggccggccccagagtggaggtggacggcagcatcatggagggcggcggccagatcctgagagtgagcaccgccctgagctgcctgctgggcctgcccctgagagtgcagaagatcagagccggcagaagcacccccggcctgagcagcggcggctggaagagcaagatcaaggtgctgaccagaccccagcacctgagcggcctggagatgatcagagacctgtgcgacggccagctggagggcgccgagatcggcagcaccgagatcaccttcacccccgagaagatcaagggcggcatccacaccgccgacaccaagaccgccggcagcgtgtgcctgctgatgcaggtgagcatgccctgcgtgctgttcgccgccagccccagcgagctgcacctgaagggcggcaccaacgccgagatggccccccagatcgactacaccgtgatggtgttcaagcccatcgtggagaagttcggcttcatcttcaactgcgacatcaagaccagaggctactaccccaagggcggcggcgaggtgatcgtgagaatgagccccgtgaagcagctgaaccccatcaacctgaccgagagaggctgcgtgaccaagatctacggcagagccttcgtggccggcgtgctgcccttcaaggtggccaaggacatggccgccgccgccgtgagatgcatcagaaaggagatcagagacctgtacgtgaacatccagcccgtgcaggagcccaaggaccaggccttcggcaacggcaacggcatcatcatcatcgccgagaccagcaccggctgcctgttcgccggcagcagcctgggcaagagaggcgtgaacgccgacaaggtgggcatcgaggccgccgagatgctgctggccaacctgagacacggcggcaccgtggacgagtacctgcaggaccagctgatcgtgttcatggccctggccaacggcgtgagcagaatcaagaccggccccgtgaccctgcacacccagaccgccatccacttcgccgagcagatcgccaaggccaagttcatcgtgaagaagagcgaggacgaggaggacgccgccaaggacacctacatcatcgagtgccagggcatcggcatgaccaaccccaacctgtag

SEQ ID NO: 9399 - DNA, 1056 bp, Homo sapiens
atgcccagcgagaccctgtgggagatcgccaaggccgaggtggagaagagaggcatcaacggcagcgagggcgacggcgccgagatcgccgagaagttcgtgttcttcatcggcagcaagaacggcggcaagaccaccatcatcctgagatgcctggacagagacgagccccccaagcccaccctggccctggagtacacctacggcagaagagccaagggccacaacacccccaaggacatcgcccacttctgggagctgggcggcggcaccagcctgctggacctgatcagcatccccatcaccggcgacaccctgagaaccttcagcctggtgctggtgctggacctgagcaagcccaacgacctgtggcccaccatggagaacctgctgcaggccaccaagagccacgtggacaaggtgatcatgaagctgggcaagaccaacgccaaggccgtgagcgagatgagacagaagatctggaacaacatgcccaaggaccaccccgaccacgagctgatcgaccccttccccgtgcccctggtgatcatcggcagcaagtacgacgtgttccaggacttcgagagcgagaagagaaaggtgatctgcaagaccctgagattcgtggcccactactacggcgccagcctgatgttcaccagcaagagcgaggccctgctgctgaagatcagaggcgtgatcaaccagctggccttcggcatcgacaagagcaagagcatctgcgtggaccagaacaagcccctgttcatcaccgccggcctggacagcttcggccagatcggcagcccccccgtgcccgagaacgacatcggcaagctgcacgcccacagccccatggagctgtggaagaaggtgtacgagaagctgttcccccccaagagcatcaacaccctgaaggacatcaaggaccccgccagagacccccagtacgccgagaacgaggtggacgagatgagaatccagaaggacctggagctggagcagtacaagagaagcagcagcaagagctggaagcagatcgagctggacagctag

SEQ ID NO: 9400 - DNA, 798 bp, Homo sapiens
atgtgcaccagcgagaccttccaggccctggacaccttcgaggccagacacgacgacatcgtgctggccagctaccccaagtgcggcagcaactggatcctgcacatcgtgagcgagctgatctacgccgtgagcaagaagaagtacaagtaccccgagttccccgtgctggagtgcggcgacagcgagaagtaccagagaatgaagggcttccccagccccagaatcctggccacccacctgcactacgacaagctgcccggcagcatcttcgagaacaaggccaagatcctggtgatcttcagaaaccccaaggacaccgccgtgagcttcctgcacttccacaacgacgtgcccgacatccccagctacggcagctgggacgagttcttcagacagttcatgaagggccaggtgagctggggcagatacttcgacttcgccatcaactggaacaagcacctggacggcgacaacgtgaagttcatcctgtacgaggacctgaaggagaacctggccgccggcatcaagcagatcgccgagttcctgggcttcttcctgaccggcgagcagatccagaccatcagcgtgcagagcaccttccaggccatgagagccaagagccaggacacccacggcgccgtgggccccttcctgttcagaaagggcgaggtgggcgactggaagaacctgttcagcgagatccagaaccaggagatggacgagaagttcaaggagtgcctggccggcaccagcctgggcgccaagctgaagtacgagagctactgccagggctag

SEQ ID NO: 9401 - DNA, 5343 bp, Homo sapiens
atggagagcaacttcaaccaggagggcgtgcccagacccagctacgtgttcagcgccgaccccatcgccagacccagcgagatcaacttcgacggcatcaagctggacctgagccacgagttcagcctggtggcccccaacaccgaggccaacagcttcgagagcaaggactacctgcaggtgtgcctgagaatcagacccttcacccagagcgagaaggagctggagagcgagggctgcgtgcacatcctggacagccagaccgtggtgctgaaggagccccagtgcatcctgggcagactgagcgagaagagcagcggccagatggcccagaagttcagcttcagcaaggtgttcggccccgccaccacccagaaggagttcttccagggctgcatcatgcagcccgtgaaggacctgctgaagggccagagcagactgatcttcacctacggcctgaccaacagcggcaagacctacaccttccagggcaccgaggagaacatcggcatcctgcccagaaccctgaacgtgctgttcgacagcctgcaggagagactgtacaccaagatgaacctgaagccccacagaagcagagagtacctgagactgagcagcgagcaggagaaggaggagatcgccagcaagagcgccctgctgagacagatcaaggaggtgaccgtgcacaacgacagcgacgacaccctgtacggcagcctgaccaacagcctgaacatcagcgagttcgaggagagcatcaaggactacgagcaggccaacctgaacatggccaacagcatcaagttcagcgtgtgggtgagcttcttcgagatctacaacgagtacatctacgacctgttcgtgcccgtgagcagcaagttccagaagagaaagatgctgagactgagccaggacgtgaagggctacagcttcatcaaggacctgcagtggatccaggtgagcgacagcaaggaggcctacagactgctgaagctgggcatcaagcaccagagcgtggccttcaccaagctgaacaacgccagcagcagaagccacagcatcttcaccgtgaagatcctgcagatcgaggacagcgagatgagcagagtgatcagagtgagcgagctgagcctgtgcgacctggccggcagcgagagaaccatgaagacccagaacgagggcgagagactgagagagaccggcaacatcaacaccagcctgctgaccctgggcaagtgcatcaacgtgctgaagaacagcgagaagagcaagttccagcagcacgtgcccttcagagagagcaagctgacccactacttccagagcttcttcaacggcaagggcaagatctgcatgatcgtgaacatcagccagtgctacctggcctacgacgagaccctgaacgtgctgaagttcagcgccatcgcccagaaggtgtgcgtgcccgacaccctgaacagcagccaggagaagctgttcggccccgtgaagagcagccaggacgtgagcctggacagcaacagcaacagcaagatcctgaacgtgaagagagccaccatcagctgggagaacagcctggaggacctgatggaggacgaggacctggtggaggagctggagaacgccgaggagacccagaacgtggagaccaagctgctggacgaggacctggacaagaccctggaggagaacaaggccttcatcagccacgaggagaagagaaagctgctggacctgatcgaggacctgaagaagaagctgatcaacgagaagaaggagaagctgaccctggagttcaagatcagagaggaggtgacccaggagttcacccagtactgggcccagagagaggccgacttcaaggagaccctgctgcaggagagagagatcctggaggagaacgccgagagaagactggccatcttcaaggacctggtgggcaagtgcgacaccagagaggaggccgccaaggacatctgcgccaccaaggtggagaccgaggaggccaccgcctgcctggagctgaagttcaaccagatcaaggccgagctggccaagaccaagggcgagctgatcaagaccaaggaggagctgaagaagagagagaacgagagcgacagcctgatccaggagctggagaccagcaacaagaagatcatcacccagaaccagagaatcaaggagctgatcaacatcatcgaccagaaggaggacaccatcaacgagttccagaacctgaagagccacatggagaacaccttcaagtgcaacgacaaggccgacaccagcagcctgatcatcaacaacaagctgatctgcaacgagaccgtggaggtgcccaaggacagcaagagcaagatctgcagcgagagaaagagagtgaacgagaacgagctgcagcaggacgagccccccgccaagaagggcagcatccacgtgagcagcgccatcaccgaggaccagaagaagagcgaggaggtgagacccaacatcgccgagatcgaggacatcagagtgctgcaggagaacaacgagggcctgagagccttcctgctgaccatcgagaacgagctgaagaacgagaaggaggagaaggccgagctgaacaagcagatcgtgcacttccagcaggagctgagcctgagcgagaagaagaacctgaccctgagcaaggaggtgcagcagatccagagcaactacgacatcgccatcgccgagctgcacgtgcagaagagcaagaaccaggagcaggaggagaagatcatgaagctgagcaacgagatcgagaccgccaccagaagcatcaccaacaacgtgagccagatcaagctgatgcacaccaagatcgacgagctgagaaccctggacagcgtgagccagatcagcaacatcgacctgctgaacctgagagacctgagcaacggcagcgaggaggacaacctgcccaacacccagctggacctgctgggcaacgactacctggtgagcaagcaggtgaaggagtacagaatccaggagcccaacagagagaacagcttccacagcagcatcgaggccatctgggaggagtgcaaggagatcgtgaaggccagcagcaagaagagccaccagatcgaggagctggagcagcagatcgagaagctgcaggccgaggtgaagggctacaaggacgagaacaacagactgaaggagaaggagcacaagaaccaggacgacctgctgaaggagaaggagaccctgatccagcagctgaaggaggagctgcaggagaagaacgtgaccctggacgtgcagatccagcacgtggtggagggcaagagagccctgagcgagctgacccagggcgtgacctgctacaaggccaagatcaaggagctggagaccatcctggagacccagaaggtggagtgcagccacagcgccaagctggagcaggacatcctggagaaggagagcatcatcctgaagctggagagaaacctgaaggagttccaggagcacctgcaggacagcgtgaagaacaccaaggacctgaacgtgaaggagctgaagctgaaggaggagatcacccagctgaccaacaacctgcaggacatgaagcacctgctgcagctgaaggaggaggaggaggagaccaacagacaggagaccgagaagctgaaggaggagctgagcgccagcagcgccagaacccagaacctgaaggccgacctgcagagaaaggaggaggactacgccgacctgaaggagaagctgaccgacgccaagaagcagatcaagcaggtgcagaaggaggtgagcgtgatgagagacgaggacaagctgctgagaatcaagatcaacgagctggagaagaagaagaaccagtgcagccaggagctggacatgaagcagagaaccatccagcagctgaaggagcagctgaacaaccagaaggtggaggaggccatccagcagtacgagagagcctgcaaggacctgaacgtgaaggagaagatcatcgaggacatgagaatgaccctggaggagcaggagcagacccaggtggagcaggaccaggtgctggaggccaagctggaggaggtggagagactggccaccgagctggagaagtggaaggagaagtgcaacgacctggagaccaagaacaaccagagaagcaacaaggagcacgagaacaacaccgacgtgctgggcaagctgaccaacctgcaggacgagctgcaggagagcgagcagaagtacaacgccgacagaaagaagtggctggaggagaagatgatgctgatcacccaggccaaggaggccgagaacatcagaaacaaggagatgaagaagtacgccgaggacagagagagattcttcaagcagcagaacgagatggagatcctgaccgcccagctgaccgagaaggacagcgacctgcagaagtggagagaggagagagaccagctggtggccgccctggagatccagctgaaggccctgatcagcagcaacgtgcagaaggacaacgagatcgagcagctgaagagaatcatcagcgagaccagcaagatcgagacccagatcatggacatcaagcccaagagaatcagcagcgccgaccccgacaagctgcagaccgagcccctgagcaccagcttcgagatcagcagaaacaagatcgaggacggcagcgtggtgctggacagctgcgaggtgagcaccgagaacgaccagagcaccagattccccaagcccgagctggagatccagttcacccccctgcagcccaacaagatggccgtgaagcaccccggctgcaccacccccgtgaccgtgaagatccccaaggccagaaagagaaagagcaacgagatggaggaggacctggtgaagtgcgagaacaagaagaacgccacccccagaaccaacctgaagttccccatcagcgacgacagaaacagcagcgtgaagaaggagcagaaggtggccatcagacccagcagcaagaagacctacagcctgagaagccaggccagcatcatcggcgtgaacctggccaccaagaagaaggagggcaccctgcagaagttcggcgacttcctgcagcacagccccagcatcctgcagagcaaggccaagaagatcatcgagaccatgagcagcagcaagctgagcaacgtggaggccagcaaggagaacgtgagccagcccaagagagccaagagaaagctgtacaccagcgagatcagcagccccatcgacatcagcggccaggtgatcctgatggaccagaagatgaaggagagcgaccaccagatcatcaagagaagactgagaaccaagaccgccaagtag

SEQ ID NO: 9402 - DNA, 1371 bp, Homo sapiens
atgaacagcagcgacgaggagaagcagctgcagctgatcaccagcctgaaggagcaggccatcggcgagtacgaggacctgagagccgagaaccagaagaccaaggagaagtgcgacaagatcagacaggagagagacgaggccgtgaagaagctggaggagttccagaagatcagccacatggtgatcgaggaggtgaacttcatgcagaaccacctggagatcgagaagacctgcagagagagcgccgaggccctggccaccaagctgaacaaggagaacaagaccctgaagagaatcagcatgctgtacatggccaagctgggccccgacgtgatcaccgaggagatcaacatcgacgacgaggacagcaccaccgacaccgacggcgccgccgagacctgcgtgagcgtgcagtgccagaagcagatcaaggagctgagagaccagatcgtgagcgtgcaggaggagaagaagatcctggccatcgagctggagaacctgaagagcaagctggtggaggtgatcgaggaggtgaacaaggtgaagcaggagaagaccgtgctgaacagcgaggtgctggagcagagaaaggtgctggagaagtgcaacagagtgagcatgctggccgtggaggagtacgaggagatgcaggtgaacctggagctggagaaggacctgagaaagaaggccgagagcttcgcccaggagatgttcatcgagcagaacaagctgaagagacagagccacctgctgctgcagagcagcatccccgaccagcagctgctgaaggccctggacgagaacgccaagctgacccagcagctggaggaggagagaatccagcaccagcagaaggtgaaggagctggaggagcagctggagaacgagaccctgcacaaggagatccacaacctgaagcagcagctggagctgctggaggaggacaagaaggagctggagctgaagtaccagaacagcgaggagaaggccagaaacctgaagcacagcgtggacgagctgcagaagagagtgaaccagagcgagaacagcgtgcccccccccccccccccccccccccccctgcccccccccccccccaaccccatcagaagcctgatgagcatgatcagaaagagaagccaccccagcggcagcggcgccaagaaggagaaggccacccagcccgagaccaccgaggaggtgaccgacctgaagagacaggccgtggaggagatgatggacagaatcaagaagggcgtgcacctgagacccgtgaaccagaccgccagacccaagaccaagcccgagagcagcaagggctgcgagagcgccgtggacgagctgaagggcatcctggccagccagtag

SEQ ID NO: 9403 - DNA, 630 bp, Homo sapiens
atgaagaaggtgagactgaaggagctggagagcagactgcagcaggtggacggcttcgagaagcccaagctgctgctggagcagtaccccaccagaccccacatcgccgcctgcatgctgtacaccatccacaacacctacgacgacatcgagaacaaggtggtggccgacctgggctgcggctgcggcgtgctgagcatcggcaccgccatgctgggcgccggcctgtgcgtgggcttcgacatcgacgaggacgccctggagatcttcaacagaaacgccgaggagttcgagctgaccaacatcgacatggtgcagtgcgacgtgtgcctgctgagcaacagaatgagcaagagcttcgacaccgtgatcatgaacccccccttcggcaccaagaacaacaagggcaccgacatggccttcctgaagaccgccctggagatggccagaaccgccgtgtacagcctgcacaagagcagcaccagagagcacgtgcagaagaaggccgccgagtggaagatcaagatcgacatcatcgccgagctgagatacgacctgcccgccagctacaagttccacaagaagaagagcgtggacatcgaggtggacctgatcagattcagcttctag

SEQ ID NO: 9404 - DNA, 4719 bp, Homo sapiens
atggccagcagcgccagagagcacctgctgttcgtgagaagaagaaacccccagatgagatacaccctgagccccgagaacctgcagagcctggccgcccagagcagcatgcccgagaacatgaccctgcagagagccaacagcgacaccgacctggtgaccagcgagagcagaagcagcctgaccgccagcatgtacgagtacaccctgggccaggcccagaacctgatcatcttctgggacatcaaggaggaggtggaccccagcgactggatcggcctgtaccacatcgacgagaacagccccgccaacttctgggacagcaagaacagaggcgtgaccggcacccagaagggccagatcgtgtggagaatcgagcccggcccctacttcatggagcccgagatcaagatctgcttcaagtactaccacggcatcagcggcgccctgagagccaccaccccctgcatcaccgtgaagaaccccgccgtgatgatgggcgccgagggcatggagggcggcgccagcggcaacctgcacagcagaaagctggtgagcttcaccctgagcgacctgagagccgtgggcctgaagaagggcatgttcttcaaccccgacccctacctgaagatgagcatccagcccggcaagaagagcagcttccccacctgcgcccaccacggccaggagagaagaagcaccatcatcagcaacaccaccaaccccatctggcacagagagaagtacagcttcttcgccctgctgaccgacgtgctggagatcgagatcaaggacaagttcgccaagagcagacccatcatcaagagattcctgggcaagctgaccatccccgtgcagagactgctggagagacaggccatcggcgaccagatgctgagctacaacctgggcagaagactgcccgccgaccacgtgagcggctacctgcagttcaaggtggaggtgaccagcagcgtgcacgaggacgccagccccgaggccgtgggcaccatcctgggcgtgaacagcgtgaacggcgacctgggcagccccagcgacgacgaggacatgcccggcagccaccacgacagccaggtgtgcagcaacggccccgtgagcgaggacagcgccgccgacggcacccccaagcacagcttcagaaccagcagcaccctggagatcgacaccgaggagctgaccagcaccagcagcagaaccagcccccccagaggcagacaggacagcctgaacgactacctggacgccatcgagcacaacggccacagcagacccggcaccgccacctgcagcgagagaagcatgggcgccagccccaagctgagaagcagcttccccaccgacaccagactgaacgccatgctgcacatcgacagcgacgaggaggaccacgagttccagcaggacctgggctaccccagcagcctggaggaggagggcggcctgatcatgttcagcagagccagcagagccgacgacggcagcctgaccagccagaccaagctggaggacaaccccgtggagaacgaggaggccagcacccacgaggccgccagcttcgaggacaagcccgagaacctgcccgagctggccgagagcagcctgcccgccggccccgcccccgaggagggcgagggcggccccgagccccagcccagcgccgaccagggcagcgccgagctgtgcggcagccaggaggtggaccagcccaccagcggcgccgacaccggcaccagcgacgccagcggcggcagcagaagagccgtgagcgagaccgagagcctggaccagggcagcgagcccagccaggtgagcagcgagaccgagcccagcgaccccgccagaaccgagagcgtgagcgaggccagcaccagacccgagggcgagagcgacctggagtgcgccgacagcagctgcaacgagagcgtgaccacccagctgagcagcgtggacaccagatgcagcagcctggagagcgccagattccccgagacccccgccttcagcagccaggaggaggaggacggcgcctgcgccgccgagcccaccagcagcggccccgccgagggcagccaggagagcgtgtgcaccgccggcagcctgcccgtggtgcaggtgcccagcggcgaggacgagggccccggcgccgagagcgccaccgtgcccgaccaggaggagctgggcgaggtgtggcagagaagaggcagcctggagggcgccgccgccgccgccgagagccccccccaggaggagggcagcgccggcgaggcccagggcacctgcgagggcgccaccgcccaggaggagggcgccaccggcggcagccaggccaacggccaccagcccctgagaagcctgcccagcgtgagacaggacgtgagcagataccagagagtggacgaggccctgccccccaactgggaggccagaatcgacagccacggcagaatcttctacgtggaccacgtgaacagaaccaccacctggcagagacccaccgccccccccgccccccaggtgctgcagagaagcaacagcatccagcagatggagcagctgaacagaagataccagagcatcagaagaaccatgaccaacgagagacccgaggagaacaccaacgccatcgacggcgccggcgaggaggccgacttccaccaggccagcgccgacttcagaagagagaacatcctgccccacagcaccagcagaagcagaatcaccctgctgctgcagagcccccccgtgaagttcctgatcagccccgagttcttcaccgtgctgcacagcaaccccagcgcctacagaatgttcaccaacaacacctgcctgaagcacatgatcaccaaggtgagaagagacacccaccacttcgagagataccagcacaacagagacctggtgggcttcctgaacatgttcgccaacaagcagctggagctgcccagaggctgggagatgaagcacgaccaccagggcaaggccttcttcgtggaccacaacagcagaaccaccaccttcatcgaccccagactgcccctgcagagcagcagacccaccagcgccctggtgcacagacagcacctgaccagacagagaagccacagcgccggcgaggtgggcgaggacagcagacacgccggcccccccgtgctgcccagacccagcagcaccttcaacaccgtgagcagaccccagtaccaggacatggtgcccgtggcctacaacgacaagatcgtggccttcctgagacagcccaacatcttcgagatcctgcaggagagacagcccgacctgaccagaaaccacagcctgagagagaagatccagttcatcagaaccgagggcacccccggcctggtgagactgagcagcgacgccgacctggtgatgctgctgagcctgttcgaggaggagatcatgagctacgtgcccccccacgccctgctgcaccccagctactgccagagccccagaggcagccccgtgagcagcccccagaacagccccggcacccagagagccaacgccagagcccccgccccctacaagagagacttcgaggccaagctgagaaacttctacagaaagctggagaccaagggctacggccagggccccggcaagctgaagctgatcatcagaagagaccacctgctggaggacgccttcaaccagatcatgggctacagcagaaaggacctgcagagaaacaagctgtacgtgaccttcgtgggcgaggagggcctggactacagcggccccagcagagagttcttcttcctggtgagcagagagctgttcaacccctactacggcctgttcgagtacagcgccaacgacacctacaccgtgcagatcagccccatgagcgccttcgtggacaaccaccacgagtggttcagattcagcggcagaatcctgggcctggccctgatccaccagtacctgctggacgccttcttcaccagacccttctacaaggccctgctgagaatcctgtgcgacctgagcgacctggagtacctggacgaggagttccaccagagcctgcagtggatgaaggacaacgacatccacgacatcctggacctgaccttcaccgtgaacgaggaggtgttcggccagatcaccgagagagagctgaagcccggcggcgccaacatccccgtgaccgagaagaacaagaaggagtacatcgagagaatggtgaagtggagaatcgagagaggcgtggtgcagcagaccgagagcctggtgagaggcttctacgaggtggtggacgccagactggtgagcgtgttcgacgccagagagctggagctggtgatcgccggcaccgccgagatcgacctgagcgactggagaaacaacaccgagtacagaggcggctaccacgacaaccacatcgtgatcagatggttctgggccgccgtggagagattcaacaacgagcagagactgagactgctgcagttcgtgaccggcaccagcagcatcccctacgagggcttcgccagcctgagaggcagcaacggccccagaagattctgcgtggagaagtggggcaagatcaccgccctgcccagagcccacacctgcttcaacagactggacctgcccccctaccccagcttcagcatgctgtacgagaagctgctgaccgccgtggaggagaccagcaccttcggcctggagtag

SEQ ID NO: 9405 - DNA, 1206 bp, Homo sapiens
atgagctgcagatgctggatcagcagacaccccagctacgagggctggaacctgcagagcatcatcttccacaagcagatcagaggcgtggacctggagagcaccttcgtgaccaagttcggcaacaactgcagcctgagactgaacgagaccgtggacatccacaaggagaaggtggccagaagagagatcggcatcctgaccaccaacaagaacaccagcagaacccacaagatcatcgcccccgccaacctggagagacccgtgagatacatcagaaagcccatcgactacaccatcctggacgacatcggccacggcgtgaaggtgagcacccagaacatgaagatgggcggcctgcccagaaccaccccccccacccagaagccccccagcccccccatgagcggcaagggcaccctgggcagacacagcccctacagaaccctggagcccgtgagaccccccgtggtgcccaacgactacgtgcccagccccaccagaaacatggcccccagccagcagagccccgtgagaaccgccagcgtgaaccagagaaacagaacctacagcagcagcggcagcagcggcggcagccaccccagcagcagaagcagcagcagagagaacagcggcagcggcagcgtgggcgtgcccatcgccgtgcccacccccagcccccccagcgtgttccccggccaccccgtgcagttctacagcatgaacagacccgccagcagacacaccccccccaccatcggcggcagcctgccctacagaagaccccccagcatcaccagccagaccagcctgcagaaccagatgaacggcggccccttctacagccagaaccccgtgagcgacaccccccccccccccccccccgtggaggagcccgtgttcgacgagagccccccccccccccccccccccgaggactacgaggaggaggaggccgccgtggtggagtacagcgacccctacgccgaggaggaccccccctgggcccccagaagctacctggagaaggtggtggccatctacgactacaccaaggacaaggaggacgagctgagcttccaggagggcgccatcatctacgtgatcaagaagaacgacgacggctggtacgagggcgtgatgaacggcgtgaccggcctgttccccggcaactacgtggagagcatcatgcactacagcgagtag

SEQ ID NO: 9406 - DNA, 1428 bp, Homo sapiens
atggccgagctgcagatgctgctggaggaggagatccccggcggcagaagagccctgttcgacagctacaccaacctggagagagtggccgactactgcgagaacaactacatccagagcgccgacaagcagagagccctggaggagaccaaggcctacaccacccagagcctggccagcgtggcctacctgatcaacaccctggccaacaacgtgctgcagatgctggacatccaggccagccagctgagaagaatggagagcagcatcaaccacatcagccagaccgtggacatccacaaggagaaggtggccagaagagagatcggcatcctgaccaccaacaagaacaccagcagaacccacaagatcatcgcccccgccaacctggagagacccgtgagatacatcagaaagcccatcgactacaccatcctggacgacatcggccacggcgtgaaggtgagcacccagaacatgaagatgggcggcctgcccagaaccaccccccccacccagaagccccccagcccccccatgagcggcaagggcaccctgggcagacacagcccctacagaaccctggagcccgtgagaccccccgtggtgcccaacgactacgtgcccagccccaccagaaacatggcccccagccagcagagccccgtgagaaccgccagcgtgaaccagagaaacagaacctacagcagcagcggcagcagcggcggcagccaccccagcagcagaagcagcagcagagagaacagcggcagcggcagcgtgggcgtgcccatcgccgtgcccacccccagcccccccagcgtgttccccggccaccccgtgcagttctacagcatgaacagacccgccagcagacacaccccccccaccatcggcggcagcctgccctacagaagaccccccagcatcaccagccagaccagcctgcagaaccagatgaacggcggccccttctacagccagaaccccgtgagcctggccccccccccccccagcatcctgcaggtgaccccccagctgcccctgatgggcttcgtggccagagtgcaggagaacatcagcgacaccccccccccccccccccccgtggaggagcccgtgttcgacgagagccccccccccccccccccccccgaggactacgaggaggaggaggccgccgtggtggagtacagcgacccctacgccgaggaggaccccccctgggcccccagaagctacctggagaaggtggtggccatctacgactacaccaaggacaaggaggacgagctgagcttccaggagggcgccatcatctacgtgatcaagaagaacgacgacggctggtacgagggcgtgatgaacggcgtgaccggcctgttccccggcaactacgtggagagcatcatgcactacagcgagtag

SEQ ID NO: 9407 - DNA, 900 bp, Homo sapiens
atgaagatgggcggcctgcccagaaccaccccccccacccagaagccccccagcccccccatgagcggcaagggcaccctgggcagcagcggcagcagcggcggcagccaccccagcagcagaagcagcagcagagagaacagcggcagcggcagcgtgggcgtgcccatcgccgtgcccacccccagcccccccagcgtgttccccgcccccgccggcagcgccggcaccccccccctgcccgccaccagcgccagcgcccccgcccccctggtgcccgccaccgtgcccagcagcaccgcccccgacgccgccgccggcggcgcccagaccctggccgacggcttcaccagccccaccccccccgtggtgagcagcaccccccccaccggccaccccgtgcagttctacagcatgaacagacccgccagcagacacaccccccccaccatcggcggcagcctgccctacagaagaccccccagcatcaccagccagaccagcctgcagaaccagatgaacggcggccccttctacagccagaaccccgtgagcgacaccccccccccccccccccccgtggaggagcccgtgttcgacgagagccccccccccccccccccccccgaggactacgaggaggaggaggccgccgtggtggagtacagcgacccctacgccgaggaggaccccccctgggcccccagaagctacctggagaaggtggtggccatctacgactacaccaaggacaaggaggacgagctgagcttccaggagggcgccatcatctacgtgatcaagaagaacgacgacggctggtacgagggcgtgatgaacggcgtgaccggcctgttccccggcaactacgtggagagcatcatgcactacagcgagtag

SEQ ID NO: 9408 - DNA, 1926 bp, Homo sapiens
atgggcagaagaagcaccagcagcaccaagagcggcaagttcatgaaccccaccgaccaggccagaaaggaggccagaaagagagagctgaagaagaacaagaagcagagaatgatggtgagagccgccgtgctgaagatgaaggaccccaagcagatcatcagagacatggagaagctggacgagatggagttcaaccccgtgcagcagccccagctgaacgagaaggtgctgaaggacaagagaaagaagctgagagagaccttcgagagaatcctgagactgtacgagaaggagaaccccgacatctacaaggagctgagaaagctggaggtggagtacgagcagaagagagcccagctgagccagtacttcgacgccgtgaagaacgcccagcacgtggaggtggagagcatccccctgcccgacatgccccacgcccccagcaacatcctgatccaggacatccccctgcccggcgcccagccccccagcatcctgaagaagaccagcgcctacggcccccccaccagagccgtgagcatcctgcccctgctgggccacggcgtgcccagactgccccccggcagaaagccccccggccccccccccggccccccccccccccaggtggtgcagatgtacggcagaaaggtgggcttcgccctggacctgccccccagaagaagagacgaggacatgctgtacagccccgagctggcccagagaggccacgacgacgacgtgagcagcaccagcgaggacgacggctaccccgaggacatggaccaggacaagcacgacgacagcaccgacgacagcgacaccgacaagagcgacggcgagagcgacggcgacgagttcgtgcacagagacaacggcgagagagacaacaacgaggagaagaagagcggcctgagcgtgagattcgccgacatgcccggcaagagcagaaagaagaagaagaacatgaaggagctgacccccctgcaggccatgatgctgagaatggccggccaggagatccccgaggagggcagagaggtggaggagttcagcgaggacgacgacgaggacgacagcgacgacagcgaggccgagaagcagagccagaagcagcacaaggaggagagccacagcgacggcaccagcaccgccagcagccagcagcaggcccccccccagagcgtgccccccagccagatccaggccccccccatgcccggccccccccccctgggccccccccccgccccccccctgagaccccccggcccccccaccggcctgccccccggccccccccccggcgccccccccttcctgagaccccccggcatgcccggcctgagaggccccctgcccagactgctgccccccggccccccccccggcagaccccccggccccccccccggccccccccccggcctgccccccggccccccccccagaggccccccccccagactgcccccccccgccccccccggcatccccccccccagacccggcatgatgagaccccccctggtgccccccctgggccccgccccccccggcctgttcccccccgcccccctgcccaaccccggcgtgctgagcgccccccccaacctgatccagagacccaaggccgacgacaccagcgccgccaccatcgagaagaaggccaccgccaccatcagcgccaagccccagatcaccaaccccaaggccgagatcaccagattcgtgcccaccgccctgagagtgagaagagagaacaagggcgccaccgccgccccccagagaaagagcgaggacgacagcgccgtgcccctggccaaggccgcccccaagagcggccccagcgtgcccgtgagcgtgcagaccaaggacgacgtgtacgaggccttcatgaaggagatggagggcctgctgtag

SEQ ID NO: 9409 - DNA, 4419 bp, Homo sapiens
atgaagggcagcgaggtgagcctggagaagaagaagaagatcaagatgcccgtgaagagactgagagaggtggtgagccagaaccacggcgaccacctggtgctgctgaaggacgagctgccctgcgtgccccccgccctgagcgccaacaagagactgcccgtgggcaccggcaccagcctgaacggcaccagcagaggcagcagcgacctgaccagcgccagaaactgctaccagcccctgctggagaaccccatggtgagcgagagcgacttcagcaaggacgtggccgtgcaggtgctgcccctggacaagatcgaggagaacaacaagcagaaggccaacgacatcttcatcagccagtacaccatgggccagaaggacgccctgagaaccgtgctgaagcagaaggcccagagcatgcccgtgttcaaggaggtgaaggtgcacctgctggaggacgccggcatcgagaaggacgccgtgacccaggagaccagaatcagccccagcggcatcgacagcgccaccaccgtggccgccgccaccgccgccgccatcgccaccgccgcccccctgatcaaggtgcagagcgacctggaggccaaggtgaacagcgtgaccgagctgctgagcaagctgcaggagaccgacaagcacctgcagagagtgaccgagcagcagaccagcatccagagaaagcaggagaagctgcactgccacgaccacgagaagcagatgaacgtgttcatggagcagcacatcagacacctggagaagctgcagcagcagcagatcgacatccagacccacttcatcagcgccgccctgaagaccagcagcttccagcccgtgagcatgcccagcagcagagccgtggagaagtacagcgtgaagcccgagcaccccaacctgggcagctgcaaccccagcctgtacaacaccttcgccagcaagcaggcccccctgaaggaggtggaggacaccagcttcgacaagcagaagagccccctggagacccccgcccccagaagattcgcccccgtgcccgtgagcagagacgacgagctgagcaagagagagaacctgctggaggagaaggagaacatggaggtgagctgccacagaggcaacgtgagactgctggagcagatcctgaacaacaacgacagcctgaccagaaagagcgagagcagcaacaccaccagcctgaccagaagcaagatcggctggacccccgagaagaccaacagattccccagctgcgaggagctggagaccaccaaggtgaccatgcagaagagcgacgacgtgctgcacgacctgggccagaaggagaaggagaccaacagcatggtgcagcccaaggagagcctgagcatgctgaagctgcccgacctgccccagaacagcgtgaagctgcagaccaccaacaccaccagaagcgtgctgaaggacgccgagaagatcctgagaggcgtgcagaacaacaagaaggtgctggaggagaacctggaggccatcatcagagccaaggacggcgccgccatgtacagcctgatcaacgccctgagcaccaacagagagatgagcgagaagatcagaatcagaaagaccgtggacgagtggatcaagaccatcagcgccgagatccagggcctgctgaaggccaccaccgtgatccaggacgaggactacatgctgcaggtgtacggcaagcccgtgtaccagggccacagaagcaccctgaagaagggcccctacctgagattcaacagccccagccccaagagcagaccccagagacccaaggtgatcgagagagtgaagggcaccaaggtgaagagcatcagaacccagaccgacttctacgccaccaagcccaagaagatggacagcaagatgaagcacagcgtgcccgtgctgccccacggcgaccagcagtacctgttcagccccagcagagagatgcccaccttcagcggcaccctggagggccacctgatccccatggccatcctgctgggccagacccagagcaacagcgacaccatgccccccgccggcgtgatcgtgagcaagccccaccccgtgaccgtgaccaccagcatcccccccagcagcagaaaggtggagaccggcgtgaagaagcccaacatcgccatcgtggagatgaagagcgagaagaaggaccccccccagctgaccgtgcaggtgctgcccagcgtggacatcgacagcatcagcaacagcagcgccgacgtgctgagccccctgagcagccccaaggaggccagcctgccccccgtgcagacctggatcaagacccccgagatcatgaaggtggacgaggaggaggtgaagttccccggcaccaacttcgacgagatcatcgacgtgatccaggaggaggagaagtgcgacgagatccccgacagcgagcccatcctggagttcaacagaagcgtgaaggccgacagcaccaagtacaacggcccccccttcccccccgtggccagcaccttccagcccaccgccgacatcctggacaaggtgatcgagagaaaggagaccctggagaacagcctgatccagtgggtggagcaggagatcatgagcagaatcatcagcggcctgttccccgtgcagcagcagatcgcccccagcatcagcgtgagcgtgagcgagaccagcgagcccctgaccagcgacatcgtggagggcaccagcagcggcgccctgcagctgttcgtggacgccggcgtgcccgtgaacagcaacgtgatcaagcacttcgtgaacgaggccctggccgagaccatcgccgtgatgctgggcgacagagaggccaagaagcagggccccgtggccaccggcgtgagcggcgacgccagcaccaacgagacctacctgcccgccagagtgtgcacccccctgcccaccccccagcccacccccccctgcagccccagcagccccgccaaggagtgcgtgctggtgaagacccccgacagcagcccctgcgacagcgaccacgacatggccttccccgtgaaggagatctgcgccgagaagggcgacgacatgcccgccatcatgctggtgaacacccccaccgtgacccccaccaccacccccccccccgccgccgccgtgttcacccccaccctgagcgacatcagcatcgacaagctgaaggtgagcagccccgagctgcccaagccctggggcgacggcgacctgcccctggaggaggagaaccccaacagcccccaggaggagctgcaccccagagccatcgtgatgagcgtggccaaggacgaggagcccgagagcatggacttccccgcccagccccccccccccgagcccgtgcccttcatgcccttccccgccggcaccaaggcccccagccccagccagatgcccggcagcgacagcagcaccctggagagcaccctgagcgtgaccgtgaccgagaccgagaccctggacaagcccatcagcgagggcgagatcctgttcagctgcggccagaagctggcccccaagatcctggaggacatcggcctgtacctgaccaacctgaacgacagcctgagcagcaccctgcacgacgccgtggagatggaggacgacccccccagcgagggccaggtgatcagaatgagccacaagaagttccacgccgacgccatcctgagcttcgccaagcagaaccaggagagcgccgtgagccagcaggccgtgtaccacagcgaggacctggagaacagcgtgggcgagctgagcgagggccagagaccccagctgaccgccgccgccgagaacatcctgatgggccacagcctgtacatgcagccccccgtgaccaacacccagagcctggaccagcagtgcgaccccaagcccctgagcagacagttcgacaccgtgagcggcagcatctacgaggacagctgcgccagccacggccccatgagcctgggcgagctggagctggagcccaacagcaagctggtgctgcccaccaccctgctgaccgcccaggagaacgacgtgaacctgcccgtggccgccgaggacttcagccagtaccagctgaagcagaaccaggacgtgaagcaggtggagcacaagcccagccagagctacctgagagtgagaaacaagagcgacatcgcccccagccagcagcaggtgagccccggcgacatggacagaacccagatcgagctgaacccctacctgacctgcgtgttcagcggcggcaaggccgtgcccctgagcgccagccagatgccccccgccaagatgagcgtgatgctgcccagcgtgaacctggaggactgcagccagagcctgagcctgagcaccatgcaggaggacatggagagcagcggcgccgacaccttctag

SEQ ID NO: 9410 - DNA, 1986 bp, Homo sapiens
atggagggcgccgccgcccccgtggccggcgacagacccgacctgggcctgggcgcccccggcagccccagagaggccgtggccggcgccaccgccgccctggagcccagaaagccccacggcgtgaagagacaccaccacaagcacaacctgaagcacagatacgagctgcaggagaccctgggcaagggcacctacggcaaggtgaagagagccaccgagagattcagcggcagagtggtggccatcaagagcatcagaaaggacaagatcaaggacgagcaggacatggtgcacatcagaagagagatcgagatcatgagcagcctgaaccacccccacatcatcagcatctacgaggtgttcgagaacaaggacaagatcgtgatcatcatggagtacgccagcaagggcgagctgtacgactacatcagcgagagaagaagactgagcgagagagagaccagacacttcttcagacagatcgtgagcgccgtgcactactgccacaagaacggcgtggtgcacagagacctgaagctggagaacatcctgctggacgacaactgcaacatcaagatcgccgacttcggcctgagcaacctgtaccagaaggacaagttcctgcagaccttctgcggcagccccctgtacgccagccccgagatcgtgaacggcagaccctacagaggccccgaggtggacagctgggccctgggcgtgctgctgtacaccctggtgtacggcaccatgcccttcgacggcttcgaccacaagaacctgatcagacagatcagcagcggcgagtacagagagcccacccagcccagcgacgccagaggcctgatcagatggatgctgatggtgaaccccgacagaagagccaccatcgaggacatcgccaaccactggtgggtgaactggggctacaagagcagcgtgtgcgactgcgacgccctgcacgacagcgagagccccctgctggccagaatcatcgactggcaccacagaagcaccggcctgcaggccgacaccgaggccaagatgaagggcctggccaagcccaccaccagcgaggtgatgctggagagacagagaagcctgaagaagagcaagaaggagaacgacttcgcccagagcggccaggacgccgtgcccgagagccccagcaagctgagcagcaagagacccaagggcatcctgaagaagagaagcaacagcgagcacagaagccacagcaccggcttcatcgagggcgtggtgggccccgccctgcccagcaccttcaagatggagcaggacctgtgcagaaccggcgtgctgctgcccagcagccccgaggccgaggtgcccggcaagctgagccccaagcagagcgccaccatgcccaagaagggcatcctgaagaagacccagcagagagagagcggctactacagcagccccgagagaagcgagagcagcgagctgctggacagcaacgacgtgatgggcagcagcatccccagccccagcccccccgaccccgccagagtgaccagccacagcctgagctgcagaagaaagggcatcctgaagcacagcagcaagtacagcgccggcaccatggaccccgccctggtgagccccgagatgcccaccctggagagcctgagcgagcccggcgtgcccgccgagggcctgagcagaagctacagcagacccagcagcgtgatcagcgacgacagcgtgctgagcagcgacagcttcgacctgctggacctgcaggagaacagacccgccagacagagaatcagaagctgcgtgagcgccgagaacttcctgcagatccaggacttcgagggcctgcagaacagacccagaccccagtacctgaagagatacagaaacagactggccgacagcagcttcagcctgctgaccgacatggacgacgtgacccaggtgtacaagcaggccctggagatctgcagcaagctgaactag

SEQ ID NO: 9411 - DNA, 603 bp, Homo sapiens
atggccaacatcgccgtgcagagaatcaagagagagttcaaggaggtgctgaagagcgaggagaccagcaagaaccagatcaaggtggacctggtggacgagaacttcaccgagctgagaggcgagatcgccggcccccccgacaccccctacgagggcggcagataccagctggagatcaagatccccgagacctaccccttcaacccccccaaggtgagattcatcaccaagatctggcaccccaacatcagcagcgtgaccggcgccatctgcctggacatcctgaaggaccagtgggccgccgccatgaccctgagaaccgtgctgctgagcctgcaggccctgctggccgccgccgagcccgacgacccccaggacgccgtggtggccaaccagtacaagcagaaccccgagatgttcaagcagaccgccagactgtgggcccacgtgtacgccggcgcccccgtgagcagccccgagtacaccaagaagatcgagaacctgtgcgccatgggcttcgacagaaacgccgtgatcgtggccctgagcagcaagagctgggacgtggagaccgccaccgagctgctgctgagcaactag

SEQ ID NO: 9412 - DNA, 5313 bp, Homo sapiens
atgcccagaagaagaaagaacctgggcggcaaccccttcagaaagaccgccaaccccaaggaggtggtggtgagcagcgtggccagcagagaggagcccaccaccaccctgcccagcatgggcgagaccaaggtggaccaggaggagctgttcaccagcatcagcgagatcttcagcgacctggaccccgacgtggtgtacctgatgctgagcgagtgcgacttcaaggtggagaacgccatggactgcctgctggagctgagcgccaccgacaccaagatcgaggagagcagcagccagagcttcgtggccagcgagaaccaggtgggcgccgccgagagcaagatcatggagaagagacccgaggaggagagcgaggacagcaagatggacagcttcctggacatgcagctgaccgaggacctggacagcctgatccagaacgccttcgagaagctgaacagcagccccgacgaccaggtgtacagcttcctgcccagccaggacgtgaacagcttcaacgacagcagcgagttcatcaaccccgacagcagcaacatgacccccatcttcagcacccagaacatgaacctgaacggcgagaacctggagaacagcggcagcaccctgagcctgaaccccctgcccagccacagcgtgctgaacgagagcaagtgcttcatcaaggacaacaccctggccctggagagcaactaccccgaggacagcctgctgagcagcagcctgaacgtggccagcgacagcatcgccggctgcagcagcctgaaccagaagcagaaggagctgctggagagcgagtgcgtggaggcccagttcagcgaggcccccgtggacctggacgccagcgagccccaggcctgcctgaacctgcccggcctggacctgcccggcaccggcggcgaccagaagagcaccagagtgagcgacgtgttcctgcccagcgagggcttcaacttcaagccccacaagcaccccgagctgcccaccaagggcaaggacgtgagctactgccccgtgctggcccccctgcccctgctgctgcccccccccccccccccccccatgtggaaccccatgatccccgccttcgacctgttccagggcaaccacggcttcgtggcccccgtggtgaccaccgccgcccactggagaagcgtgaactacaccttcccccccagcgtgatcagccacaccagccccaccaaggtgtggagaaacaaggacggcaccagcgcctaccaggtgcaggagacccccgtgagccaggtggtgagaaagaagaccagctacgtgggcctggtgctggtgctgctgagaggcctgcccggcagcggcaagagcttcctggccagaaccctgcaggaggacaaccccagcggcgtgatcctgagcaccgacgactacttctacatcaacggccagtaccagttcgacgtgaagtacctgggcgaggcccacgagtggaaccagaacagagccaaggaggccttcgagaagaagatcagccccatcatcatcgacaacaccaacctgcaggcctgggagatgaagccctacgtggccctgagccagaagcacaagtacaaggtgctgttcagagagcccgacacctggtggaagttcaagcccaaggagctggccagaagaaacatccacggcgtgagcaaggagaagatcaccagaatgctggagcactaccagagattcgtgagcgtgcccatcatcatgagcagcagcgtgcccgagaagatcgagagaatcgagctgtgcgcctacagctgcgaggacagaagcaccagccccagagacgacgaggacatcatcagcgagaaggaggagaacatcctgagcctgagcctgaagcacctggagttcaccgaggagaagaacctggacgtgaccaaggagaccatgctgcccgagaacgtggcctacctgagcaacgccgacctgaacaagagaagaaaggagatcagcgacatgaaccccagcatccagagcgccctgatcctggagaccccccacatgtacttcagcgacagcgagagcaagctgcaggccaccgacaagagcgagaacgagcagatcgagatggtggccgtgaagggctacagcaagaccgacaccgacagcagcatggagagagtgagccccagcacctgctgcagcgagaacaaccaggaggactgcgacctggccaacagcggccccctgcagaacgagaagagcagccccggcgagatcgtggaggagagagccaccgtgaccaagaaggccttcggcaagcagaagagcaagagcaccctggagaagttccccagacacgagctgagcaacttcgtgggcgactggcccgtggacaagaccatcggccagagaaccaagagaaacagaaagaccgagaagaccagcagcgtgcagagcgacaagaagtacaactacccccagagccacaagctggtgaacagcgtgagcgtgaacaccgactgcgtgcagcagagaggcagcccccacgagagcgtggaggacggcagaaagagccagtgcgacgacgccagcgagcccctgaacagctacaagtacgacgcctacaagaacatcgacaagaacagcttcaacatcatgggcgactggcccagcagcgacagcctggcccagagagagcacagaagcagaatgcccaagaccggcctgagcgagcccaacctggagatcggcaccaacgacaagatgaacgagatcagcctgagcaccgcccacgaggcctgctggggcaccagcagccagaagctgaagaccctgggcagcagcaacctgggcagcagcgagatgctgctgagcgagatgacctgcgagagccagacctgcctgagcaagaagagccacggccagcacaccagcctgcccctgaccttcaccaacagcgcccccaccgtgagcggcgtggtggagccccagaccctggccgagtgccaggagcagatgcccaagagagaccccggcaaggaggtgggcatgtgcacccagaccgagccccaggacttcgccctgctgtggaagatcgagaagaacaagatcagcatcagcgacagcatcaaggtgctgaccggcagactggacggcttcaagcccaaggtgttcaacatcaacaccaagagcgacgtgcaggaggccatcccctacagagtgatgtacgacaagagcaccttcgtggaggagagcgagctgaccagcgccgacgagagcgagaacctgaacatcctgtgcaagctgttcggcagcttcagcctggaggccctgaaggacctgtacgagagatgcaacaaggacatcatctgggccaccagcctgctgctggacagcgagaccaagctgtgcgaggacaccgagttcgagaacttccagaagagctgcgacggcagccagatcggccccttcagcctgggcctgaacctgaaggagatcatcagccagagaggcaccctggagaacagcaacagccccgtgcccgagttcagccacggcatcggcatcagcaacgccgacagccagagcacctgcgacgccgagagaggcaacagcgagcaggccgagatgagagccgtgacccccgagaaccacgagagcatgaccagcatcttccccagcgccgccgtgggcctgaagaacaacaacgacatcctgcccaacagccaggaggagctgctgtacagcagcaagcagagcttccccggcatcctgaaggccaccacccccaaggacatgagcgagaccgagaagaacctggtggtgaccgagaccggcgacaacatccacagccccagccacttcagcgacatcttcaacttcgtgagcagcaccagcaacctggagctgaacgaggagatctacttcaccgacagcctggagatcaagagaaacgagaacttccccaaggactacgtgaagttcagcgacgaggaggagttcatgaacgaggacgagaaggagatgaaggagatcctgatggccggcagcagcctgagcgccggcgtgagcggcgaggacaagaccgagatcctgaaccccacccccgccatggccaagagcctgaccatcgactgcctggagctggccctgccccccgagctggccttccagctgaacgagctgttcggccccgtgggcatcgacagcggcagcctgaccgtggaggactgcgtggtgcacatcgacctgaacctggccaaggtgatccacgagaagtggaaggagagcgtgatggagagacagagacaggaggaggtgagctgcggcaagttcatgcaggaccccagcctggtgggccacaccggcctggacaaccccgagcagaagagcagccagagaaccggcaagaagctgctgaagaccctgaccgccagcgagatgctgcccctgctggaccactggaacacccagaccaagaaggtgagcctgagagagatcatgagcgaggagatcgccctgcaggagaagcacaacctgaagagagagaccctgatgttcgagaaggactgcgccaccaagctgaaggagaagcagctgttcaagatcttccccgccatcaaccagaacttcctggtggacatcttcaaggaccacaactacagcctggagcacaccgtgcagttcctgaactgcgtgctggagggcgaccccgtgaagaccgtggtggcccaggagttcgtgcaccagaacgagaacgtgaccagccacaccggccagaagagcaaggagaagaagcccaagaagctgaaggagaccgaggagacccccagcgagctgagcttccaggacttcgagtaccccgactacgacgactacagagccgaggccttcctgcaccagcagaagagaatggagtgctacagcaaggccaaggaggcctacagaatcggcaagaagaacgtggccaccttctacgcccagcagggcaccctgcacgagcagaagatgaaggaggccaaccacctggccgccatcgagatcttcgagaaggtgaacgccagcctgctgccccagaacgtgctggacctgcacggcctgcacgtggacgaggccctggagcacctgatgagagtgctggagaagaagaccgaggagttcaagcagaacggcggcaagccctacctgagcgtgatcaccggcagaggcaaccacagccagggcggcgtggccagaatcaagcccgccgtgatcaagtacctgatcagccacagcttcagattcagcgagatcaagcccggctgcctgaaggtgatgctgaagtag

SEQ ID NO: 9413 - DNA, 1362 bp, Homo sapiens
atggactggaaggaggtgctgagaagaagactggccacccccaacacctgccccaacaagaagaagagcgagcaggagctgaaggacgaggagatggacctgttcaccaagtactacagcgagtggaagggcggcagaaagaacaccaacgagttctacaagaccatccccagattctactacagactgcccgccgaggacgaggtgctgctgcagaagctgagagaggagagcagagccgtgttcctgcagagaaagagcagagagctgctggacaacgaggagctgcagaacctgtggttcctgctggacaagcaccagaccccccccatgatcggcgaggaggccatgatcaactacgagaacttcctgaaggtgggcgagaaggccggcgccaagtgcaagcagttcttcaccgccaaggtgttcgccaagctgctgcacaccgacagctacggcagaatcagcatcatgcagttcttcaactacgtgatgagaaaggtgtggctgcaccagaccagaatcggcctgagcctgtacgacgtggccggccagggctacctgagagagagcgacctggagaactacatcctggagctgatccccaccctgccccagctggacggcctggagaagagcttctacagcttctacgtgtgcaccgccgtgagaaagttcttcttcttcctggaccccctgagaaccggcaagatcaagatccaggacatcctggcctgcagcttcctggacgacctgctggagctgagagacgaggagctgagcaaggagagccaggagaccaactggttcagcgcccccagcgccctgagagtgtacggccagtacctgaacctggacaaggaccacaacggcatgctgagcaaggaggagctgagcagatacggcaccgccaccatgaccaacgtgttcctggacagagtgttccaggagtgcctgacctacgacggcgagatggactacaagacctacctggacttcgtgctggccctggagaacagaaaggagcccgccgccctgcagtacatcttcaagctgctggacatcgagaacaagggctacctgaacgtgttcagcctgaactacttcttcagagccatccaggagctgatgaagatccacggccaggaccccgtgagcttccaggacgtgaaggacgagatcttcgacatggtgaagcccaaggaccccctgaagatcagcctgcaggacctgatcaacagcaaccagggcgacaccgtgaccaccatcctgatcgacctgaacggcttctggacctacgagaacagagaggccctggtggccaacgacagcgagaacagcgccgacctggacgacacctag

SEQ ID NO: 9414 - DNA, 3348 bp, Homo sapiens
atgcccgaggaccaggtgggcaagctggaggccaccgagaacaccatcagcgccatggccgccgccgccgccgagcagcagcagttctacctgctgctgggcaacctgctgagccccgacaacgtggtgagaaagcaggccgaggagacctacgagaacatccccggccagagcaagatcaccttcctgctgcaggccatcagaaacaccaccgccgccgaggaggccagacagatggccgccgtgctgctgagaagactgctgagcagcgccttcgacgaggtgtaccccgccctgcccagcgacgtgcagaccgccatcaagagcgagctgctgatgatcatccagatggagacccagagcagcatgagaaagaaggtgtgcgacatcgccgccgagctggccagaaacctgatcgacgaggacggcaacaaccagtggcccgagggcctgaagttcctgttcgacagcgtgagcagccagaacgtgggcctgagagaggccgccctgcacatcttctggaacttccccggcatcttcggcaaccagcagcagcactacctggacgtgatcaagagaatgctggtgcagtgcatgcaggaccaggagcaccccagcatcagaaccctgagcgccagagccaccgccgccttcatcctggccaacgagcacaacgtggccctgttcaagcacttcgccgacctgctgcccggcttcctgcaggccgtgaacgacagctgctaccagaacgacgacagcgtgctgaagagcctggtggagatcgccgacaccgtgcccaagtacctgagaccccacctggaggccaccctgcagctgagcctgaagctgtgcggcgacaccagcctgaacaacatgcagagacagctggccctggaggtgatcgtgaccctgagcgagaccgccgccgccatgctgagaaagcacaccaacatcgtggcccagaccatcccccagatgctggccatgatggtggacctggaggaggacgaggactgggccaacgccgacgagctggaggacgacgacttcgacagcaacgccgtggccggcgagagcgccctggacagaatggcctgcggcctgggcggcaagctggtgctgcccatgatcaaggagcacatcatgcagatgctgcagaaccccgactggaagtacagacacgccggcctgatggccctgagcgccatcggcgagggctgccaccagcagatggagggcatcctgaacgagatcgtgaacttcgtgctgctgttcctgcaggacccccaccccagagtgagatacgccgcctgcaacgccgtgggccagatggccaccgacttcgcccccggcttccagaagaagttccacgagaaggtgatcgccgccctgctgcagaccatggaggaccagggcaaccagagagtgcaggcccacgccgccgccgccctgatcaacttcaccgaggactgccccaagagcctgctgatcccctacctggacaacctggtgaagcacctgcacagcatcatggtgctgaagctgcaggagctgatccagaagggcaccaagctggtgctggagcaggtggtgaccagcatcgccagcgtggccgacaccgccgaggagaagttcgtgccctactacgacctgttcatgcccagcctgaagcacatcgtggagaacgccgtgcagaaggagctgagactgctgagaggcaagaccatcgagtgcatcagcctgatcggcctggccgtgggcaaggagaagttcatgcaggacgccagcgacgtgatgcagctgctgctgaagacccagaccgacttcaacgacatggaggacgacgacccccagatcagctacatgatcagcgcctgggccagaatgtgcaagatcctgggcaaggagttccagcagtacctgcccgtggtgatgggccccctgatgaagaccgccagcatcaagcccgaggtggccctgctggacacccaggacatggagaacatgagcgacgacgacggctgggagttcgtgaacctgggcgaccagcagagcttcggcatcaagaccgccggcctggaggagaagagcaccgcctgccagatgctggtgtgctacgccaaggagctgaaggagggcttcgtggagtacaccgagcaggtggtgaagctgatggtgcccctgctgaagttctacttccacgacggcgtgagagtggccgccgccgagagcatgcccctgctgctggagtgcgccagagtgagaggccccgagtacctgacccagatgtggcacttcatgtgcgacgccctgatcaaggccatcggcaccgagcccgacagcgacgtgctgagcgagatcatgcacagcttcgccaagtgcatcgaggtgatgggcgacggctgcctgaacaacgagcacttcgaggagctgggcggcatcctgaaggccaagctggaggagcacttcaagaaccaggagctgagacaggtgaagagacaggacgaggactacgacgagcaggtggaggagagcctgcaggacgaggacgacaacgacgtgtacatcctgaccaaggtgagcgacatcctgcacagcatcttcagcagctacaaggagaaggtgctgccctggttcgagcagctgctgcccctgatcgtgaacctgatctgcccccacagaccctggcccgacagacagtggggcctgtgcatcttcgacgacgtgatcgagcactgcagccccgccagcttcaagtacgccgagtacttcctgagacccatgctgcagtacgtgtgcgacaacagccccgaggtgagacaggccgccgcctacggcctgggcgtgatggcccagtacggcggcgacaactacagacccttctgcaccgaggccctgcccctgctggtgagagtgatccagagcgccgacagcaagaccaaggagaacgtgaacgccaccgagaactgcatcagcgccgtgggcaagatcatgaagttcaagcccgactgcgtgaacgtggaggaggtgctgccccactggctgagctggctgcccctgcacgaggacaaggaggaggccgtgcagaccttcaactacctgtgcgacctgatcgagagcaaccaccccatcgtgctgggccccaacaacaccaacctgcccaagatcttcagcatcatcgccgagggcgagatgcacgaggccatcaagcacgaggacccctgcgccaagagactggccaacgtggtgagacaggtgcagaccagcggcggcctgtggaccgagtgcatcgcccagctgagccccgagcagcaggccgccatccaggagctgctgaacagcgcctag

SEQ ID NO: 9415 - DNA, 1929 bp, Homo sapiens
atgaagagaagcagcgtgagcagcggcggcgccggcagactgagcatgcaggagctgagaagccaggacgtgaacaagcagggcctgtacaccccccagaccaaggagaagcccaccttcggcaagctgagcatcaacaagcccaccagcgagagaaaggtgagcctgttcggcaagagaaccagcggccacggcagcagaaacagccagctgggcatcttcagcagcagcgagaagatcaaggaccccagacccctgaacgacaaggccttcatccagcagtgcatcagacagctgtgcgagttcctgaccgagaacggctacgcccacaacgtgagcatgaagagcctgcaggcccccagcgtgaaggacttcctgaagatcttcaccttcctgtacggcttcctgtgccccagctacgagctgcccgacaccaagttcgaggaggaggtgcccagaatcttcaaggacctgggctaccccttcgccctgagcaagagcagcatgtacaccgtgggcgccccccacacctggccccacatcgtggccgccctggtgtggctgatcgactgcatcaagatccacaccgccatgaaggagagcagccccctgttcgacgacggccagccctggggcgaggagaccgaggacggcatcatgcacaacaagctgttcctggactacaccatcaagtgctacgagagcttcatgagcggcgccgacagcttcgacgagatgaacgccgagctgcagagcaagctgaaggacctgttcaacgtggacgccttcaagctggagagcctggaggccaagaacagagccctgaacgagcagatcgccagactggagcaggagagagagaaggagcccaacagactggagagcctgagaaagctgaaggccagcctgcagggcgacgtgcagaagtaccaggcctacatgagcaacctggagagccacagcgccatcctggaccagaagctgaacggcctgaacgaggagatcgccagagtggagctggagtgcgagaccatcaagcaggagaacaccagactgcagaacatcatcgacaaccagaagtacagcgtggccgacatcgagagaatcaaccacgagagaaacgagctgcagcagaccatcaacaagctgaccaaggacctggaggccgagcagcagaagctgtggaacgaggagctgaagtacgccagaggcaaggaggccatcgagacccagctggccgagtaccacaagctggccagaaagctgaagctgatccccaagggcgccgagaacagcaagggctacgacttcgagatcaagttcaaccccgaggccggcgccaactgcctggtgaagtacagagcccaggtgtacgtgcccctgaaggagctgctgaacgagaccgaggaggagatcaacaaggccctgaacaagaagatgggcctggaggacaccctggagcagctgaacgccatgatcaccgagagcaagagaagcgtgagaaccctgaaggaggaggtgcagaagctggacgacctgtaccagcagaagatcaaggaggccgaggaggaggacgagaagtgcgccagcgagctggagagcctggagaagcacaagcacctgctggagagcaccgtgaaccagggcctgagcgaggccatgaacgagctggacgccgtgcagagagagtaccagctggtggtgcagaccaccaccgaggagagaagaaaggtgggcaacaacctgcagagactgctggagatggtggccacccacgtgggcagcgtggagaagcacctggaggagcagatcgccaaggtggacagagagtacgaggagtgcatgagcgaggacctgagcgagaacatcaaggagatcagagacaagtacgagaagaaggccaccctgatcaagagcagcgaggagtag

SEQ ID NO: 9416 - DNA, 4770 bp, Homo sapiens
atgagcctgcccttctaccagagatgccaccagcactacgacctgagctacagaaacaaggacgtgagaagcaccgtgagccactaccagagagagaagaagagaagcgccgtgtacacccagggcagcaccgcctacagcagcagaagcagcgccgcccacagaagagagagcgaggccttcagaagagccagcgccagcagcagccagcagcaggccagccagcacgccctgagcagcgaggtgagcagaaaggccgccagcgcctacgactacggcagcagccacggcctgaccgacagcagcctgctgctggacgactacagcagcaagctgagccccaagcccaagagagccaagcacagcctgctgagcggcgaggagaaggagaacctgcccagcgactacatggtgcccatcttcagcggcagacagaagcacgtgagcggcatcaccgacaccgaggaggagagaatcaaggaggccgccgcctacatcgcccagagaaacctgctggccagcgaggagggcatcaccaccagcaagcagagcaccgccagcaagcagaccaccgccagcaagcagagcaccgccagcaagcagagcaccgccagcaagcagagcaccgccagcagacagagcaccgccagcagacagagcgtggtgagcaagcaggccaccagcgccctgcagcaggaggagaccagcgagaagaagagcagaaaggtggtgatcagagagaaggccgagagactgagcctgagaaagaccctggaggagaccgagacctaccacgccaagctgaacgaggaccacctgctgcacgcccccgagttcatcatcaagcccagaagccacaccgtgtgggagaaggagaacgtgaagctgcactgcagcatcgccggctggcccgagcccagagtgacctggtacaagaaccaggtgcccatcaacgtgcacgccaaccccggcaagtacatcatcgagagcagatacggcatgcacaccctggagatcaacggctgcgacttcgaggacaccgcccagtacagagccagcgccatgaacgtgaagggcgagctgagcgcctacgccagcgtggtggtgaagagatacaagggcgagttcgacgagaccagattccacgccggcgccagcaccatgcccctgagcttcggcgtgaccccctacggctacgccagcagattcgagatccacttcgacgacaagttcgacgtgagcttcggcagagagggcgagaccatgagcctgggctgcagagtggtgatcacccccgagatcaagcacttccagcccgagatccagtggtacagaaacggcgtgcccctgagccccagcaagtgggtgcagaccctgtggagcggcgagagagccaccctgaccttcagccacctgaacaaggaggacgagggcctgtacaccatcagagtgagaatgggcgagtactacgagcagtacagcgcctacgtgttcgtgagagacgccgacgccgagatcgagggcgcccccgccgcccccctggacgtgaagtgcctggaggccaacaaggactacatcatcatcagctggaagcagcccgccgtggacggcggcagccccatcctgggctacttcatcgacaagtgcgaggtgggcaccgacagctggagccagtgcaacgacacccccgtgaagttcgccagattccccgtgaccggcctgatcgagggcagaagctacatcttcagagtgagagccgtgaacaagatgggcatcggcttccccagcagagtgagcgagcccgtggccgccctggaccccgccgagaaggccagactgaagagcagacccagcgccccctggaccggccagatcatcgtgaccgaggaggagcccagcgagggcatcgtgcccggcccccccaccgacctgagcgtgaccgaggccaccagaagctacgtggtgctgagctggaagccccccggccagagaggccacgagggcatcatgtacttcgtggagaagtgcgaggccggcaccgagaactggcagagagtgaacaccgagctgcccgtgaagagccccagattcgccctgttcgacctggccgagggcaagagctactgcttcagagtgagatgcagcaacagcgccggcgtgggcgagcccagcgaggccaccgaggtgaccgtggtgggcgacaagctggacatccccaaggcccccggcaagatcatccccagcagaaacaccgacaccagcgtggtggtgagctgggaggagagcaaggacgccaaggagctggtgggctactacatcgaggccagcgtggccggcagcggcaagtgggagccctgcaacaacaaccccgtgaagggcagcagattcacctgccacggcctggtgaccggccagagctacatcttcagagtgagagccgtgaacgccgccggcctgagcgagtacagccaggacagcgaggccatcgaggtgaaggccgccatcgccccccccagccccccctgcgacatcacctgcctggagagcttcagagacagcatggtgctgggctggaagcagcccgacaagatcggcggcgccgagatcaccggctactacgtgaactacagagaggtgatcgacggcgtgcccggcaagtggagagaggccaacgtgaaggccgtgagcgaggaggcctacaagatcagcaacctgaaggagaacatggtgtaccagttccaggtggccgccatgaacatggccggcctgggcgcccccagcgccgtgagcgagtgcttcaagtgcgaggagtggaccatcgccgtgcccggccccccccacagcctgaagtgcagcgaggtgagaaaggacagcctggtgctgcagtggaagccccccgtgcacagcggcagaacccccgtgaccggctacttcgtggacctgaaggaggccaaggccaaggaggaccagtggagaggcctgaacgaggccgccatcaagaacgtgtacctgaaggtgagaggcctgaaggagggcgtgagctacgtgttcagagtgagagccatcaaccaggccggcgtgggcaagcccagcgacctggccggccccgtggtggccgagaccagacccggcaccaaggaggtggtggtgaacgtggacgacgacggcgtgatcagcctgaacttcgagtgcgacaagatgacccccaagagcgagttcagctggagcaaggactacgtgagcaccgaggacagccccagactggaggtggagagcaagggcaacaagaccaagatgaccttcaaggacctgggcatggacgacctgggcatctacagctgcgacgtgaccgacaccgacggcatcgccagcagctacctgatcgacgaggaggagctgaagagactgctggccctgagccacgagcacaagttccccaccgtgcccgtgaagagcgagctggccgtggagatcctggagaagggccaggtgagattctggatgcaggccgagaagctgagcggcaacgccaaggtgaactacatcttcaacgagaaggagatcttcgagggccccaagtacaagatgcacatcgacagaaacaccggcatcatcgagatgttcatggagaagctgcaggacgaggacgagggcacctacaccttccagctgcaggacggcaaggccaccaaccacagcaccgtggtgctggtgggcgacgtgttcaagaagctgcagaaggaggccgagttccagagacaggagtggatcagaaagcagggcccccacttcgtggagtacctgagctgggaggtgaccggcgagtgcaacgtgctgctgaagtgcaaggtggccaacatcaagaaggagacccacatcgtgtggtacaaggacgagagagagatcagcgtggacgagaagcacgacttcaaggacggcatctgcaccctgctgatcaccgagttcagcaagaaggacgccggcatctacgaggtgatcctgaaggacgacagaggcaaggacaagagcagactgaagctggtggacgaggccttcaaggagctgatgatggaggtgtgcaagaagatcgccctgagcgccaccgacctgaagatccagagcaccgccgagggcatccagctgtacagcttcgtgacctactacgtggaggacctgaaggtgaactggagccacaacggcagcgccatcagatacagcgacagagtgaagaccggcgtgaccggcgagcagatctggctgcagatcaacgagcccacccccaacgacaagggcaagtacgtgatggagctgttcgacggcaagaccggccaccagaagaccgtggacctgagcggccaggcctacgacgaggcctacgccgagttccagagactgaagcaggccgccatcgccgagaagaacagagccagagtgctgggcggcctgcccgacgtggtgaccatccaggagggcaaggccctgaacctgacctgcaacgtgtggggcgaccccccccccgaggtgagctggctgaagaacgagaaggccctggccagcgacgaccactgcaacctgaagttcgaggccggcagaaccgcctacttcaccatcaacggcgtgagcaccgccgacagcggcaagtacggcctggtggtgaagaacaagtacggcagcgagaccagcgacttcaccgtgagcgtgttcatccccgaggaggaggccagaatggccgccctggagagcctgaagggcggcaagaaggccaagtag

SEQ ID NO: 9417 - DNA, 546 bp, Homo sapiens
atgggcggcttcttcagcagcatcttcagcagcctgttcggcaccagagagatgagaatcctgatcctgggcctggacggcgccggcaagaccaccatcctgtacagactgcaggtgggcgaggtggtgaccaccatccccaccatcggcttcaacgtggagaccgtgacctacaagaacctgaagttccaggtgtgggacctgggcggccagaccagcatcagaccctactggagatgctactacagcaacaccgacgccgtgatctacgtggtggacagctgcgacagagacagaatcggcatcagcaagagcgagctggtggccatgctggaggaggaggagctgagaaaggccatcctggtggtgttcgccaacaagcaggacatggagcaggccatgaccagcagcgagatggccaacagcctgggcctgcccgccctgaaggacagaaagtggcagatcttcaagaccagcgccaccaagggcaccggcctggacgaggccatggagtggctggtggagaccctgaagagcagacagtag

SEQ ID NO: 9418 - DNA, 1269 bp, Homo sapiens
atggccgccgccgccgtggtggagttccagagagcccagagcctgctgagcaccgacagagaggccagcatcgacatcctgcacagcatcgtgaagagagacatccaggagaacgacgaggaggccgtgcaggtgaaggagcagagcatcctggagctgggcagcctgctggccaagaccggccaggccgccgagctgggcggcctgctgaagtacgtgagacccttcctgaacagcatcagcaaggccaaggccgccagactggtgagaagcctgctggacctgttcctggacatggaggccgccaccggccaggaggtggagctgtgcctggagtgcatcgagtgggccaagagcgagaagagaaccttcctgagacaggccctggaggccagactggtgagcctgtacttcgacaccaagagataccaggaggccctgcacctgggcagccagctgctgagagagctgaagaagatggacgacaaggccctgctggtggaggtgcagctgctggagagcaagacctaccacgccctgagcaacctgcccaaggccagagccgccctgaccagcgccagaaccaccgccaacgccatctactgcccccccaagctgcaggccaccctggacatgcagagcggcatcatccacgccgccgaggagaaggactggaagaccgcctacagctacttctacgaggccttcgagggctacgacagcatcgacagccccaaggccatcaccagcctgaagtacatgctgctgtgcaagatcatgctgaacacccccgaggacgtgcaggccctggtgagcggcaagctggccctgagatacgccggcagacagaccgaggccctgaagtgcgtggcccaggccagcaagaacagaagcctggccgacttcgagaaggccctgaccgactacagagccgagctgagagacgaccccatcatcagcacccacctggccaagctgtacgacaacctgctggagcagaacctgatcagagtgatcgagcccttcagcagagtgcagatcgagcacatcagcagcctgatcaagctgagcaaggccgacgtggagagaaagctgagccagatgatcctggacaagaagttccacggcatcctggaccagggcgagggcgtgctgatcatcttcgacgagccccccgtggacaagacctacgaggccgccctggagaccatccagaacatgagcaaggtggtggacagcctgtacaacaaggccaagaagctgacctag

SEQ ID NO: 9419 - DNA, 1449 bp, Homo sapiens
atggccagcctgggccccgccgccgccggcgagcaggccagcggcgccgaggccgagcccggccccgccggccccccccccccccccagccccagcagcctgggccccctgctgcccctgcagagagagcccctgtacaactggcaggccaccaaggccagcctgaaggagagattcgccttcctgttcaacagcgagctgctgagcgacgtgagattcgtgctgggcaagggcagaggcgccgccgccgccggcggcccccagagaatccccgcccacagattcgtgctggccgccggcagcgccgtgttcgacgccatgttcaacggcggcatggccaccaccagcgccgagatcgagctgcccgacgtggagcccgccgccttcctggccctgctgagattcctgtacagcgacgaggtgcagatcggccccgagaccgtgatgaccaccctgtacaccgccaagaagtacgccgtgcccgccctggaggcccactgcgtggagttcctgaccaagcacctgagagccgacaacgccttcatgctgctgacccaggccagactgttcgacgagccccagctggccagcctgtgcctggacaccatcgacaagagcaccatggacgccatcagcgccgagggcttcaccgacatcgacatcgacaccctgtgcgccgtgctggagagagacaccctgagcatcagagagagcagactgttcggcgccgtggtgagatgggccgaggccgagtgccagagacagcagctgcccgtgaccttcggcaacaagcagaaggtgctgggcaaggccctgagcctgatcagattccccctgatgaccatcgaggagttcgccgccggccccgcccagagcggcatcctgagcgacagagaggtggtgaacctgttcctgcacttcaccgtgaaccccaagcccagagtggagtacatcgacagacccagatgctgcctgagaggcaaggagtgctgcatcaacagattccagcaggtggagagcagatggggctacagcggcaccagcgacagaatcagattcaccgtgaacagaagaatcagcatcgtgggcttcggcctgtacggcagcatccacggccccaccgactaccaggtgaacatccagatcatcgagtacgagaagaagcagaccctgggccagaacgacaccggcttcagctgcgacggcaccgccaacaccttcagagtgatgttcaaggagcccatcgagatcctgcccaacgtgtgctacaccgcctgcgccaccctgaagggccccgacagccactacggcaccaagggcctgaagaaggtggtgcacgagacccccgccgccagcaagaccgtgttcttcttcttcagcagccccggcaacaacaacggcaccagcatcgaggacggccagatccccgagatcatcttctacacctag

SEQ ID NO: 9420 - DNA, 2883 bp, Homo sapiens
atgagcagactgatcgtgaagaacctgcccaacggcatgaaggaggagagattcagacagctgttcgccgccttcggcaccctgaccgactgcagcctgaagttcaccaaggacggcaagttcagaaagttcggcttcatcggcttcaagagcgaggaggaggcccagaaggcccagaagcacttcaacaagagcttcatcgacaccagcagaatcaccgtggagttctgcaagagcttcggcgaccccgccaagcccagagcctggagcaagcacgcccagaagcccagccagcccaagcagccccccaaggacagcaccacccccgagatcaagaaggacgagaagaagaagaaggtggccggccagctggagaagctgaaggaggacaccgagttccaggagttcctgagcgtgcaccagagaagagcccaggccgccacctgggccaacgacggcctggacgccgagcccagcaagggcaagagcaagcccgccagcgactacctgaacttcgacagcgacagcggccaggagagcgaggaggagggcgccggcgaggacctggaggaggaggccagcctggagcccaaggccgccgtgcagaaggagctgagcgacatggactacctgaagagcaagatggtgaaggccggcagcagcagcagcagcgaggaggaggagagcgaggacgaggccgtgcactgcgacgagggcagcgaggccgaggaggaggacagcagcgccacccccgtgctgcaggagagagacagcaagggcgccggccaggagcagggcatgcccgccggcaagaagagaccccccgaggccagagccgagaccgagaagcccgccaaccagaaggagcccaccacctgccacaccgtgaagctgagaggcgcccccttcaacgtgaccgagaagaacgtgatggagttcctggcccccctgaagcccgtggccatcagaatcgtgagaaacgcccacggcaacaagaccggctacatcttcgtggacttcagcaacgaggaggaggtgaagcaggccctgaagtgcaacagagagtacatgggcggcagatacatcgaggtgttcagagagaagaacgtgcccaccaccaagggcgcccccaagaacaccaccaagagctggcagggcagaatcctgggcgagaacgaggaggaggaggacctggccgagagcggcagactgttcgtgagaaacctgccctacaccagcaccgaggaggacctggagaagctgttcagcaagtacggccccctgagcgagctgcactaccccatcgacagcctgaccaagaagcccaagggcttcgccttcatcaccttcatgttccccgagcacgccgtgaaggcctacagcgaggtggacggccaggtgttccagggcagaatgctgcacgtgctgcccagcaccatcaagaaggaggccagcgaggacgccagcgccctgggcagcagcagctacaagaagaagaaggaggcccaggacaaggccaacagcgccagcagccacaactggaacaccctgttcatgggccccaacgccgtggccgacgccatcgcccagaagtacaacgccaccaagagccaggtgttcgaccacgagaccaagggcagcgtggccgtgagagtggccctgggcgagacccagctggtgcaggaggtgagaagattcctgatcgacaacggcgtgagcctggacagcttcagccaggccgccgccgagagaagcaagaccgtgatcctggtgaagaacctgcccgccggcaccctggccgcccagctgcaggagaccttcggccacttcggcagcctgggcagagtgctgctgcccgagggcggcatcaccgccatcgtggagttcctggagcccctggaggccagaaaggccttcagacacctggcctacagcaagttccaccacgtgcccctgtacctggagtgggcccccgtgggcgtgttcagcagcaccgccccccagaagaagaagctgcaggacacccccagcgagcccatggagaaggaccccgccgagcccgagaccgtgcccgacggcgagacccccgaggacgagaaccccaccgaggagggcgccgacaacagcagcgccaagatggaggaggaggaggaggaggaggaggaggaggaggagagcctgcccggctgcaccctgttcatcaagaacctgaacttcgacaccaccgaggagaagctgaaggaggtgttcagcaaggtgggcaccgtgaagagctgcagcatcagcaagaagaagaacaaggccggcgtgctgctgagcatgggcttcggcttcgtggagtacagaaagcccgagcaggcccagaaggccctgaagcagctgcagggccacgtggtggacggccacaagctggaggtgagaatcagcgagagagccaccaagcccgccgtgaccctggccagaaagaagcaggtgcccagaaagcagaccaccagcaagatcctggtgagaaacatccccttccaggcccacagcagagagatcagagagctgttcagcaccttcggcgagctgaagaccgtgagactgcccaagaagatgaccggcaccggcacccacagaggcttcggcttcgtggacttcctgaccaagcaggacgccaagagagccttcaacgccctgtgccacagcacccacctgtacggcagaagactggtgctggagtgggccgacagcgaggtgaccctgcaggccctgagaagaaagaccgccgcccacttccacgagccccccaagaagaagagaagcgtggtgctggacgagatcctggagcagctggagggcagcgacagcgacagcgaggagcagaccctgcagctgtag

SEQ ID NO: 9421 - DNA, 2919 bp, Homo sapiens
atggccaccagaggccacgtgcaggaccccaacgacagaagactgagacccatctacgactacctggacaacggcaacaacaagatggccatccagcaggccgacaagctgctgaagaagcacaaggacctgcactgcgccaaggtgctgaaggccatcggcctgcagagaaccggcaagcaggaggaggccttcaccctggcccaggaggtggccgccctggagcccaccgacgacaacagcctgcaggccctgaccatcctgtacagagagatgcacagacccgagctggtgaccaagctgtacgaggccgccgtgaagaaggtgcccaacagcgaggagtaccacagccacctgttcatggcctacgccagagtgggcgagtacaagaagatgcagcaggccggcatggccctgtacaagatcgtgcccaagaacccctactacttctggagcgtgatgagcctgatcatgcagagcatcagcgcccaggacgagaacctgagcaagaccatgttcctgcccctggccgagagaatggtggagaagatggtgaaggaggacaagatcgaggccgaggccgaggtggagctgtactacatgatcctggagagactgggcaagtaccaggaggccctggacgtgatcagaggcaagctgggcgagaagctgaccagcgagatccagagcagagagaacaagtgcatggccatgtacaagaagctgagcagatggcccgagtgcaacgccctgagcagaagactgctgctgaagaacagcgacgactggcagttctacctgacctacttcgacagcgtgttcagactgatcgaggaggcctggagcccccccgccgagggcgagcacagcctggagggcgaggtgcactacagcgccgagaaggccgtgaagttcatcgaggacagaatcaccgaggagagcaagagcagcagacacctgagaggcccccacctggccaagctggagctgatcagaagactgagaagccagggctgcaacgacgagtacaagctgggcgaccccgaggagctgatgttccagtacttcaagaagttcggcgacaagccctgctgcttcaccgacctgaaggtgttcgtggacctgctgcccgccacccagtgcaccaagttcatcaaccagctgctgggcgtggtgcccctgagcacccccaccgaggacaagctggccctgcccgccgacatcagagccctgcagcagcacctgtgcgtggtgcagctgaccagactgctgggcctgtaccacaccatggacaagaaccagaagctgagcgtggtgagagagctgatgctgagataccagcacggcctggagttcggcaagacctgcctgaagaccgagctgcagttcagcgactactactgcctgctggccgtgcacgccctgatcgacgtgtggagagagaccggcgacgagaccaccgtgtggcaggccctgaccctgctggaggagggcctgacccacagccccagcaacgcccagttcaagctgctgctggtgagaatctactgcatgctgggcgccttcgagcccgtggtggacctgtacagcagcctggacgccaagcacatccagcacgacaccatcggctacctgctgaccagatacgccgagagcctgggccagtacgccgccgccagccagagctgcaacttcgccctgagattcttccacagcaaccagaaggacaccagcgagtacatcatccaggcctacaagtacggcgccttcgagaagatccccgagttcatcgccttcagaaacagactgaacaacagcctgcacttcgcccaggtgagaaccgagagaatgctgctggacctgctgctggaggccaacatcagcaccagcctggccgagagcatcaagagcatgaacctgagacccgaggaggacgacatcccctgggaggacctgagagacaacagagacctgaacgtgttcttcagctgggaccccaaggacagagacgtgagcgaggagcacaagaagctgagcctggaggaggagaccctgtggctgagaatcagaagcctgaccctgagactgatcagcggcctgcccagcctgaaccaccccgtggagcccaagaacagcgagaagaccgccgagaacggcgtgagcagcagaatcgacatcctgagactgctgctgcagcagctggaggccaccctggagaccggcaagagattcatcgagaaggacatccagtaccccttcctgggccccgtgcccaccagaatgggcggcttcttcaacagcggctgcagccagtgccagatcagcagcttctacctggtgaacgacatctacgagctggacaccagcggcctggaggacaccatggagatccaggagagaatcgagaacagcttcaagagcctgctggaccagctgaaggacgtgttcagcaagtgcaagggcgacctgctggaggtgaaggacggcaacctgaagacccaccccaccctgctggagaacctggtgttcttcgtggagaccatcagcgtgatcctgtgggtgagcagctactgcgagagcgtgctgagaccctacaagctgaacctgcagaagaagaagaagaagaagaaggagaccagcatcatcatgccccccgtgttcaccagcttccaggactacgtgaccggcctgcagaccctgatcagcaacgtggtggaccacatcaagggcctggagacccacctgatcgccctgaagctggaggagctgatcctggaggacaccagcctgagccccgaggagagaaagttcagcaagaccgtgcagggcaaggtgcagagcagctacctgcacagcctgctggagatgggcgagctgctgaagaagagactggagaccaccaagaagctgaagatctag

SEQ ID NO: 9422 - DNA, 2166 bp, Homo sapiens
atggccgagaagttcgagagcctgatgaacatccacggcttcgacctgggcagcagatacatggacctgaagcccctgggctgcggcggcaacggcctggtgttcagcgccgtggacaacgactgcgacaagagagtggccatcaagaagatcgtgctgaccgacccccagagcgtgaagcacgccctgagagagatcaagatcatcagaagactggaccacgacaacatcgtgaaggtgttcgagatcctgggccccagcggcagccagctgaccgacgacgtgggcagcctgaccgagctgaacagcgtgtacatcgtgcaggagtacatggagaccgacctggccaacgtgctggagcagggccccctgctggaggagcacgccagactgttcatgtaccagctgctgagaggcctgaagtacatccacagcgccaacgtgctgcacagagacctgaagcccgccaacctgttcatcaacaccgaggacctggtgctgaagatcggcgacttcggcctggccagaatcatggacccccactacagccacaagggccacctgagcgagggcctggtgaccaagtggtacagaagccccagactgctgctgagccccaacaactacaccaaggccatcgacatgtgggccgccggctgcatcttcgccgagatgctgaccggcaagaccctgttcgccggcgcccacgagctggagcagatgcagctgatcctggagagcatccccgtggtgcacgaggaggacagacaggagctgctgagcgtgatccccgtgtacatcagaaacgacatgaccgagccccacaagcccctgacccagctgctgcccggcatcagcagagaggccctggacttcctggagcagatcctgaccttcagccccatggacagactgaccgccgaggaggccctgagccacccctacatgagcatctacagcttccccatggacgagcccatcagcagccaccccttccacatcgaggacgaggtggacgacatcctgctgatggacgagacccacagccacatctacaactgggagagataccacgactgccagttcagcgagcacgactggcccgtgcacaacaacttcgacatcgacgaggtgcagctggaccccagagccctgagcgacgtgaccgacgaggaggaggtgcaggtggaccccagaaagtacctggacggcgacagagagaagtacctggaggaccccgccttcgacaccaactacagcaccgagccctgctggcagtacagcgaccaccacgagaacaagtactgcgacctggagtgcagccacacctgcaactacaagaccagaagcagcagctacctggacaacctggtgtggagagagagcgaggtgaaccactactacgagcccaagctgatcatcgacctgagcaactggaaggagcagagcaaggagaagagcgacaagaagggcaagagcaagtgcgagagaaacggcctggtgaaggcccagatcgccctggaggaggccagccagcagctggccggcaaggagagagagaagaaccagggcttcgacttcgacagcttcatcgccggcaccatccagctgagcagccagcacgagcccaccgacgtggtggacaagctgaacgacctgaacagcagcgtgagccagctggagctgaagagcctgatcagcaagagcgtgagccaggagaagcaggagaagggcatggccaacctggcccagctggaggccctgtaccagagcagctgggacagccagttcgtgagcggcggcgaggactgcttcttcatcaaccagttctgcgaggtgagaaaggacgagcaggtggagaaggagaacacctacaccagctacctggacaagttcttcagcagaaaggaggacaccgagatgctggagaccgagcccgtggaggacggcaagctgggcgagagaggccacgaggagggcttcctgaacaacagcggcgagttcctgttcaacaagcagctggagagcatcggcatcccccagttccacagccccgtgggcagccccctgaagagcatccaggccaccctgacccccagcgccatgaagagcagcccccagatcccccaccagacctacagcagcatcctgaagcacctgaactag

SEQ ID NO: 9423 - DNA, 948 bp, Homo sapiens
atggccgccggcgtgccctgcgccctggtgaccagctgcagcagcgtgttcagcggcgaccagctggtgcagcacatcctgggcaccgaggacctgatcgtggaggtgaccagcaacgacgccgtgagattctacccctggaccatcgacaacaagtactacagcgccgacatcaacctgtgcgtggtgcccaacaagttcctggtgaccgccgagatcgccgagagcgtgcaggccttcgtggtgtacttcgacagcacccagaagagcggcctggacagcgtgagcagctggctgcccctggccaaggcctggctgcccgaggtgatgatcctggtgtgcgacagagtgagcgaggacggcatcaacagacagaaggcccaggagtggtgcatcaagcacggcttcgagctggtggagctgagccccgaggagctgcccgaggaggacgacgacttccccgagagcaccggcgtgaagagaatcgtgcaggccctgaacgccaacgtgtggagcaacgtggtgatgaagaacgacagaaaccagggcttcagcctgctgaacagcctgaccggcaccaaccacagcatcggcagcgccgacccctgccaccccgagcagccccacctgcccgccgccgacagcaccgagagcctgagcgaccacagaggcggcgccagcaacaccaccgacgcccaggtggacagcatcgtggaccccatgctggacctggacatccaggagctggccagcctgaccaccggcggcggcgacgtggagaacttcgagagactgttcagcaagctgaaggagatgaaggacaaggccgccaccctgccccacgagcagagaaaggtgcacgccgagaaggtggccaaggccttctggatggccatcggcggcgacagagacgagatcgagggcctgagcagcgacgaggagcactag

SEQ ID NO: 9424 - DNA, 1338 bp, Homo sapiens
atggccgcccccgaggagagagacctgacccaggagcagaccgagaagctgctgcagttccaggacctgaccggcatcgagagcatggaccagtgcagacacaccctggagcagcacaactggaacatcgaggccgccgtgcaggacagactgaacgagcaggagggcgtgcccagcgtgttcaaccccccccccagcagacccctgcaggtgaacaccgccgaccacagaatctacagctacgtggtgagcagaccccagcccagaggcctgctgggctggggctactacctgatcatgctgcccttcagattcacctactacaccatcctggacatcttcagattcgccctgagattcatcagacccgaccccagaagcagagtgaccgaccccgtgggcgacatcgtgagcttcatgcacagcttcgaggagaagtacggcagagcccaccccgtgttctaccagggcacctacagccaggccctgaacgacgccaagagagagctgagattcctgctggtgtacctgcacggcgacgaccaccaggacagcgacgagttctgcagaaacaccctgtgcgcccccgaggtgatcagcctgatcaacaccagaatgctgttctgggcctgcagcaccaacaagcccgagggctacagagtgagccaggccctgagagagaacacctaccccttcctggccatgatcatgctgaaggacagaagaatgaccgtggtgggcagactggagggcctgatccagcccgacgacctgatcaaccagctgaccttcatcatggacgccaaccagacctacctggtgagcgagagactggagagagaggagagaaaccagacccaggtgctgagacagcagcaggacgaggcctacctggccagcctgagagccgaccaggagaaggagagaaagaagagagaggagagagagagaaagagaagaaaggaggaggaggtgcagcagcagaagctggccgaggagagaagaagacagaacctgcaggaggagaaggagagaaagctggagtgcctgccccccgagcccagccccgacgaccccgagagcgtgaagatcatcttcaagctgcccaacgacagcagagtggagagaagattccacttcagccagagcctgaccgtgatccacgacttcctgttcagcctgaaggagagccccgagaagttccagatcgaggccaacttccccagaagagtgctgccctgcatccccagcgaggagtggcccaacccccccaccctgcaggaggccggcctgagccacaccgaggtgctgttcgtgcaggacctgaccgacgagtag

SEQ ID NO: 9425 - DNA, 2724 bp, Homo sapiens
atggccacccccgaccagaagagccccaacgtgctgctgcagaacctgtgctgcagaatcctgggcagaagcgaggccgacgtggcccagcagttccagtacgccgtgagagtgatcggcagcaacttcgcccccaccgtggagagagacgagttcctggtggccgagaagatcaagaaggagctgatcagacagagaagagaggccgacgccgccctgttcagcgagctgcacagaaagctgcacagccagggcgtgctgaagaacaagtggagcatcctgtacctgctgctgagcctgagcgaggaccccagaagacagcccagcaaggtgagcagctacgccaccctgttcgcccaggccctgcccagagacgcccacagcaccccctactactacgccagaccccagaccctgcccctgagctaccaggacagaagcgcccagagcgcccagagcagcggcagcgtgggcagcagcggcatcagcagcatcggcctgtgcgccctgagcggccccgcccccgccccccagagcctgctgcccggccagagcaaccaggcccccggcgtgggcgactgcctgagacagcagctgggcagcagactggcctggaccctgaccgccaaccagcccagcagccaggccaccaccagcaagggcgtgcccagcgccgtgagcagaaacatgaccagaagcagaagagagggcgacaccggcggcaccatggagatcaccgaggccgccctggtgagagacatcctgtacgtgttccagggcatcgacggcaagaacatcaagatgaacaacaccgagaactgctacaaggtggagggcaaggccaacctgagcagaagcctgagagacaccgccgtgagactgagcgagctgggctggctgcacaacaagatcagaagatacaccgaccagagaagcctggacagaagcttcggcctggtgggccagagcttctgcgccgccctgcaccaggagctgagagagtactacagactgctgagcgtgctgcacagccagctgcagctggaggacgaccagggcgtgaacctgggcctggagagcagcctgaccctgagaagactgctggtgtggacctacgaccccaagatcagactgaagaccctggccgccctggtggaccactgccagggcagaaagggcggcgagctggccagcgccgtgcacgcctacaccaagaccggcgacccctacatgagaagcctggtgcagcacatcctgagcctggtgagccaccccgtgctgagcttcctgtacagatggatctacgacggcgagctggaggacacctaccacgagttcttcgtggccagcgaccccaccgtgaagaccgacagactgtggcacgacaagtacaccctgagaaagagcatgatccccagcttcatgaccatggaccagagcagaaaggtgctgctgatcggcaagagcatcaacttcctgcaccaggtgtgccacgaccagacccccaccaccaagatgatcgccgtgaccaagagcgccgagagcccccaggacgccgccgacctgttcaccgacctggagaacgccttccagggcaagatcgacgccgcctacttcgagaccagcaagtacctgctggacgtgctgaacaagaagtacagcctgctggaccacatgcaggccatgagaagatacctgctgctgggccagggcgacttcatcagacacctgatggacctgctgaagcccgagctggtgagacccgccaccaccctgtaccagcacaacctgaccggcatcctggagaccgccgtgagagccaccaacgcccagttcgacagccccgagatcctgagaagactggacgtgagactgctggaggtgagccccggcgacaccggctgggacgtgttcagcctggactaccacgtggacggccccatcgccaccgtgttcaccagagagtgcatgagccactacctgagagtgttcaacttcctgtggagagccaagagaatggagtacatcctgaccgacatcagaaagggccacatgtgcaacgccaagctgctgagaaacatgcccgagttcagcggcgtgctgcaccagtgccacatcctggccagcgagatggtgcacttcatccaccagatgcagtactacatcaccttcgaggtgctggagtgcagctgggacgagctgtggaacaaggtgcagcaggcccaggacctggaccacatcatcgccgcccacgaggtgttcctggacaccatcatcagcagatgcctgctggacagcgacagcagagccctgctgaaccagctgagagccgtgttcgaccagatcatcgagctgcagaacgcccaggacgccatctacagagccgccctggaggagctgcagagaagactgcagttcgaggagaagaagaagcagagagagatcgagggccagtggggcgtgaccgccgccgaggaggaggaggagaacaagagaatcggcgagttcaaggagagcatccccaagatgtgcagccagctgagaatcctgacccacttctaccagggcatcgtgcagcagttcctggtgctgctgaccaccagcagcgacgagagcctgagattcctgagcttcagactggacttcaacgagcactacaaggccagagagcccagactgagagtgagcctgggcaccagaggcagaagaagcagccacacctag

SEQ ID NO: 9426 - DNA, 1086 bp, Homo sapiens
atgaccggcaaggccggcgaggccctgagcaagcccaagagcgagaccgtggccaagagcaccagcggcggcgcccccgccagatgcaccggcttcggcatccaggagatcctgggcctgaacaaggagccccccagcagccaccccagagccgccctggacggcctggcccccggccacctgctggccgccagaagcgtgctgagccccgccggcgtgggcggcatgggcctgctgggccccggcggcctgcccggcttctacacccagcccaccttcctggaggtgctgagcgacccccagagcgtgcacctgcagcccctgggcagagccagcggccccctggacaccagccagaccgccagcagcgacagcgaggacgtgagcagcagcgacagaaagatgagcaagagcgccctgaaccagaccaagaagagaaagaagagaagacacagaaccatcttcaccagctaccagctggaggagctggagaaggccttcaacgaggcccactaccccgacgtgtacgccagagagatgctggccatgaagaccgagctgcccgaggacagaatccaggtgtggttccagaacagaagagccaagtggagaaagagagagaagtgctggggcagaagcagcgtgatggccgagtacggcctgtacggcgccatggtgagacacagcatccccctgcccgagagcatcctgaagagcgccaaggacggcatcatggacagctgcgccccctggctgctgggcatgcacaagaagagcctggaggccgccgccgagagcggcagaaagcccgagggcgagagacaggccctgcccaagctggacaagatggagcaggacgagagaggccccgacgcccaggccgccatcagccaggaggagctgagagagaacagcatcgccgtgctgagagccaaggcccaggagcacagcaccaaggtgctgggcaccgtgagcggccccgacagcctggccagaagcaccgagaagcccgaggaggaggaggccatggacgaggacagacccgccgagagactgagccccccccagctggaggacatggcctag

SEQ ID NO: 9427 - DNA, 2073 bp, Homo sapiens
atggaggagagccccctgagcagagcccccagcagaggcggcgtgaacttcctgaacgtggccagaacctacatccccaacaccaaggtggagtgccactacaccctgccccccggcaccatgcccagcgccagcgactggatcggcatcttcaaggtggaggccgcctgcgtgagagactaccacaccttcgtgtggagcagcgtgcccgagagcaccaccgacggcagccccatccacaccagcgtgcagttccaggccagctacctgcccaagcccggcgcccagctgtaccagttcagatacgtgaacagacagggccaggtgtgcggccagagcccccccttccagttcagagagcccagacccatggacgagctggtgaccctggaggaggccgacggcggcagcgacatcctgctggtggtgcccaaggccaccgtgctgcagaaccagctggacgagagccagcaggagagaaacgacctgatgcagctgaagctgcagctggagggccaggtgaccgagctgagaagcagagtgcaggagctggagagagccctggccaccgccagacaggagcacaccgagctgatggagcagtacaagggcatcagcagaagccacggcgagatcaccgaggagagagacatcctgagcagacagcagggcgaccacgtggccagaatcctggagctggaggacgacatccagaccatcagcgagaaggtgctgaccaaggaggtggagctggacagactgagagacaccgtgaaggccctgaccagagagcaggagaagctgctgggccagctgaaggaggtgcaggccgacaaggagcagagcgaggccgagctgcaggtggcccagcaggagaaccaccacctgaacctggacctgaaggaggccaagagctggcaggaggagcagagcgcccaggcccagagactgaaggacaaggtggcccagatgaaggacaccctgggccaggcccagcagagagtggccgagctggagcccctgaaggagcagctgagaggcgcccaggagctggccgccagcagccagcagaaggccaccctgctgggcgaggagctggccagcgccgccgccgccagagacagaaccatcgccgagctgcacagaagcagactggaggtggccgaggtgaacggcagactggccgagctgggcctgcacctgaaggaggagaagtgccagtggagcaaggagagagccggcctgctgcagagcgtggaggccgagaaggacaagatcctgaagctgagcgccgagatcctgagactggagaaggccgtgcaggaggagagaacccagaaccaggtgttcaagaccgagctggccagagagaaggacagcagcctggtgcagctgagcgagagcaagagagagctgaccgagctgagaagcgccctgagagtgctgcagaaggagaaggagcagctgcaggaggagaagcaggagctgctggagtacatgagaaagctggaggccagactggagaaggtggccgacgagaagtggaacgaggacgccaccaccgaggacgaggaggccgccgtgggcctgagctgccccgccgccctgaccgacagcgaggacgagagccccgaggacatgagactgcccccctacggcctgtgcgagagaggcgaccccggcagcagccccgccggccccagagaggccagccccctggtggtgatcagccagcccgcccccatcagcccccacctgagcggccccgccgaggacagcagcagcgacagcgccgaggacgagaagagcgtgctgatggccgccgtgcagagcggcggcgaggaggccaacctgctgctgcccgagctgggcagcgccttctacgacatggccagcggcttcaccgtgggcaccctgagcgagaccagcaccggcggccccgccacccccacctggaaggagtgccccatctgcaaggagagattccccgccgagagcgacaaggacgccctggaggaccacatggacggccacttcttcttcagcacccaggaccccttcaccttcgagtag

SEQ ID NO: 9428 - DNA, 1980 bp, Homo sapiens
atgagcctgccccccgagaaggccagcgagctgaagcagctgatccaccagcagctgagcaagatggacgtgcacggcagaatcagagagatcctggccgagaccatcagagaggagctggcccccgaccagcagcacctgagcaccgaggacctgatcaaggccctgagaagaagaggcatcatcgacgacgtgatgaaggagctgaacttcgtgaccgacagcgtggagcaggagctgcccagcagccccaagcagcccatctgcttcgacagacagagcaccctgaagaagaccaacatcgaccccaccagaagatacctgtacctgcaggtgctgggcggcaaggccttcctggagcacctgcaggagcccgagcccctgcccggccaggtgtgcagcaccttcaccctgtgcctgcactacagaaaccagagattcagaagcaagcccgtgccctgcgcctgcgagcccgacttccacgacggcttcctgctggaggtgcacagagagagcctgggcgacggcaccagaatggccgacagcaccaccatgctgagcatcagcgaccccatccacatggtgctgatcaagaccgacatcttcggcgagaccaccctggtggccagctacttcctggagtggagaagcgtgctgggcagcgagaacggcgtgaccagcctgaccgtggagctgatgggcgtgggcaccgagagcaaggtgagcgtgggcatcctgaacatcaagctggagatgtacccccccctgaaccagaccctgagccaggaggtggtgaacacccagctggccctggagagacagaagaccgccgagaaggagagactgttcctggtgtacgccaagcagtggtggagagagtacctgcagatcagacccagccacaacagcagactggtgaagatcttcgcccaggacgagaacggcatcaacagacccgtgtgcagctacgtgaagcccctgagagccggcagactgctggacacccccagacaggccgccagattcgtgaacgtgctgggctacgagagagcccccgtgatcggcggcggcggcaagcaggagcagtggtgcaccctgctggccttcctgtgcagaaacaagggcgactgcgaggaccacgccaacctgctgtgcagcctgctgctgggctacggcctggaggccttcgtgtgcgtgggcaccaaggccaagggcgtgccccacgcctgggtgatgacctgcggcaccgacggcgccatcaccttctgggagagcctgaccggccacagatacatccacaagcccaccaaccccgacgagccccccgtggccgagcagcccaagcccctgtacccctacagaaccatcggctgcgtgttcaaccaccagatgttcctgggcaactgccagcccagcgacgccgtggagacctgcgtgttcgacctgaacgacgagagcaagtggaagcccatgagcgaggaggccatcaagagcgtgtgcgcccccggcgccaccaccagcctgccccccttcccccccctgtgcgccagcaccatcgacgccagcgtgaccagcaacgagatcgagatgcagctgagactgctggtgagcgagcacagaaaggacctgggcctgaccaccgtgtgggaggaccagctgagctacctgctgagccccgccctggccagctacgagttcgagagaaccaccagcatcagcgccggcaacgaggagttccaggacgccatcagaagagccgtgcccgacggccacaccttcaagggcttccccatccacttcgtgtacagaaacgccagaagagccttcgccacctgcctgagaagccccttctgcgaggagatcatctgctgcagaggcgaccaggtgagactggccgtgagagtgagagtgttcacctaccccgagagcgcctgcgccgtgtggatcatgttcgcctgcaagtacagaagcgtgctgtag

SEQ ID NO: 9429 - DNA, 1500 bp, Homo sapiens
atgctggagagaccccccgccctggccatgcccatgcccaccgagggcacccccccccccctgagcggcacccccatccccgtgcccgcctacttcagacacgccgagcccggcttcagcctgaagagacccagaggcctgagcagaagcctgcccccccccccccccgccaagggcagcatccccatcagcagactgttcccccccagaacccccggctggcaccagctgcagcccagaagagtgagcttcagaggcgaggccagcgagaccctgcagagccccggctacgaccccagcagacccgagagcttcttccagcagagcttccagagactgagcagactgggccacggcagctacggcgaggtgttcaaggtgagaagcaaggaggacggcagactgtacgccgtgaagagaagcatgagccccttcagaggccccaaggacagagccagaaagctggccgaggtgggcagccacgagaaggtgggccagcacccctgctgcgtgagactggagcaggcctgggaggagggcggcatcctgtacctgcagaccgagctgtgcggccccagcctgcagcagcactgcgaggcctggggcgccagcctgcccgaggcccaggtgtggggctacctgagagacaccctgctggccctggcccacctgcacagccagggcctggtgcacctggacgtgaagcccgccaacatcttcctgggccccagaggcagatgcaagctgggcgacttcggcctgctggtggagctgggcaccgccggcgccggcgaggtgcaggagggcgaccccagatacatggcccccgagctgctgcagggcagctacggcaccgccgccgacgtgttcagcctgggcctgaccatcctggaggtggcctgcaacatggagctgccccacggcggcgagggctggcagcagctgagacagggctacctgccccccgagttcaccgccggcctgagcagcgagctgagaagcgtgctggtgatgatgctggagcccgaccccaagctgagagccaccgccgaggccctgctggccctgcccgtgctgagacagcccagagcctggggcgtgctgtggtgcatggccgccgaggccctgagcagaggctgggccctgtggcaggccctgctggccctgctgtgctggctgtggcacggcctggcccaccccgccagctggctgcagcccctgggcccccccgccaccccccccggcagccccccctgcagcctgctgctggacagcagcctgagcagcaactgggacgacgacagcctgggccccagcctgagccccgaggccgtgctggccagaaccgtgggcagcaccagcacccccagaagcagatgcacccccagagacgccctggacctgagcgacatcaacagcgagccccccagaggcagcttccccagcttcgagcccagaaacctgctgagcctgttcgaggacaccctggaccccacctag

SEQ ID NO: 9430 - DNA, 486 bp, Homo sapiens
atggacgtgttcctgatgatcagaagacacaagaccaccatcttcaccgacgccaaggagagcagcaccgtgttcgagctgaagagaatcgtggagggcatcctgaagagaccccccgacgagcagagactgtacaaggacgaccagctgctggacgacggcaagaccctgggcgagtgcggcttcaccagccagaccgccagaccccaggcccccgccaccgtgggcctggccttcagagccgacgacaccttcgaggccctgtgcatcgagcccttcagcagcccccccgagctgcccgacgtgatgaagccccaggacagcggcagcagcgccaacgagcaggccgtgcacctgcacgtgcacagccagaccatggccaagagcagaaacaccagctggagccagtgccccggcctgaccgcctgcagcaccagagagccccaggacggccccacccaggtgcaccccagatggggcctgtag

SEQ ID NO: 9431 - DNA, 1521 bp, Homo sapiens
atgaccggcgagaagatcagaagcctgagaagagaccacaagcccagcaaggaggagggcgacctgctggagcccggcgacgaggaggccgccgccgccctgggcggcaccttcaccagaagcagaatcggcaagggcggcaaggcctgccacaagatcttcagcaaccaccaccacagactgcagctgaaggccgcccccgccagcagcaacccccccggcgcccccgccctgcccctgcacaacagcagcgtgaccgccaacagccagagccccgccctgctggccggcaccaaccccgtggccgtggtggccgacggcggcagctgccccgcccactaccccgtgcacgagtgcgtgttcaagggcgacgtgagaagactgagcagcctgatcagaacccacaacatcggccagaaggacaaccacggcaacacccccctgcacctggccgtgatgctgggcaacaaggtgaccgccctgctgagaaagctgaagcagcagagcagagagagcgtggaggagaagagacccagactgctgaaggccctgaaggagctgggcgacttctacctggagctgcactgggacttccagagctgggtgcccctgctgagcagaatcctgcccagcgacgcctgcaagatctacaagcagggcatcaacatcagactggacaccaccctgatcgacttcaccgacatgaagtgccagagaggcgacctgagcttcatcttcaacggcgacgccgcccccagcgagagcttcgtggtgctggacaacgagcagaaggtgtaccagagaatccaccacgaggagagcgagatggagaccgaggaggaggtggacatcctgatgagcagcgacatctacagcgccaccctgagcaccaagagcatcagcttcaccagagcccagaccggctggctgttcagagaggacaagaccgagagagtgggcaacttcctggccgacttctacctggtgaacggcctggtgctggagagcagaaagagaagagagcacctgagcgaggaggacatcctgagaaacaaggccatcatggagagcctgagcaagggcggcaacatcatggagcagaacttcgagcccatcagaagacagagcctgaccccccccccccagaacaccatcacctgggaggagtacatcagcgccgagaacggcaaggccccccacctgggcagagagctggtgtgcaaggagagcaagaagaccttcaaggccaccatcgccatgagccaggagttccccctgggcatcgagctgctgctgaacgtgctggaggtggtggcccccttcaagcacttcaacaagctgagagagttcgtgcagatgaagctgccccccggcttccccgtgaagctggacatccccgtgttccccaccatcaccgccaccgtgaccttccaggagttcagatacgacgagttcgacggcagcatcttcaccatccccgacgactacaaggaggaccccagcagattccccgacctgtag

SEQ ID NO: 9432 - DNA, 699 bp, Homo sapiens
atgcagccccccgccccccccgccgagctggccgcccccctgcccagccccctgcccgagcagcccctggacagccccgccgcccccgccctgagccccagcggcctgggcctgcagcccggccccgagagaaccagcaccaccaagagcaaggagctgagccccggcagcgcccagaagggcagccccggcagcagccagggcaccgcctgcgccggcacccagcccggcgcccagcccggcgcccagcccggcgccagccccagccccagccagccccccgccgaccagagcccccacaccctgagaaaggtgagcaagaagctggcccccatcccccccaaggtgcccttcggccagcccggcgccatggccgaccagagcgccggccagcccagccccgtgagcctgagccccaccccccccagcacccccagcccctacggcctgagctacccccagggctacagcctggccagcggccagctgagccccgccgccgccccccccctggccagccccagcgtgttcaccagcaccctgagcaagagcagacccacccccaagcccagacagagacccaccctgccccccccccagccccccaccgtgaacctgagcgccagcagcccccagagcaccgaggcccccatgctggacggcatgagccccggcgagagcatgagcaccgccgtgtag

SEQ ID NO: 9433 - DNA, 1221 bp, Homo sapiens
atgcaccccgccgtgttcctgagcctgcccgacctgagatgcagcctgctgctgctggtgacctgggtgttcacccccgtgaccaccgagatcaccagcctggacaccgagaacatcgacgagatcctgaacaacgccgacgtggccctggtgaacttctacgccgactggtgcagattcagccagatgctgcaccccatcttcgaggaggccagcgacgtgatcaaggaggagttccccaacgagaaccaggtggtgttcgccagagtggactgcgaccagcacagcgacatcgcccagagatacagaatcagcaagtaccccaccctgaagctgttcagaaacggcatgatgatgaagagagagtacagaggccagagaagcgtgaaggccctggccgactacatcagacagcagaagagcgaccccatccaggagatcagagacctggccgagatcaccaccctggacagaagcaagagaaacatcatcggctacttcgagcagaaggacagcgacaactacagagtgttcgagagagtggccaacatcctgcacgacgactgcgccttcctgagcgccttcggcgacgtgagcaagcccgagagatacagcggcgacaacatcatctacaagccccccggccacagcgcccccgacatggtgtacctgggcgccatgaccaacttcgacgtgacctacaactggatccaggacaagtgcgtgcccctggtgagagagatcaccttcgagaacggcgaggagctgaccgaggagggcctgcccttcctgatcctgttccacatgaaggaggacaccgagagcctggagatcttccagaacgaggtggccagacagctgatcagcgagaagggcaccatcaacttcctgcacgccgactgcgacaagttcagacaccccctgctgcacatccagaagacccccgccgactgccccgtgatcgccatcgacagcttcagacacatgtacgtgttcggcgacttcaaggacgtgctgatccccggcaagctgaagcagttcgtgttcgacctgcacagcggcaagctgcacagagagttccaccacggccccgaccccaccgacaccgcccccggcgagcaggcccaggacgtggccagcagcccccccgagagcagcttccagaagctggcccccagcgagtacagatacaccctgctgagagacagagacgagctgtag

SEQ ID NO: 9434 - DNA, 5601 bp, Homo sapiens
atggaccccgtgggcctgcagctgggcaacaagaacctgtggagctgcctggtgagactgctgaccaaggaccccgagtggctgaacgccaagatgaagttcttcctgcccaacaccgacctggacagcagaaacgagaccctggaccccgagcagagagtgatcctgcagctgaacaagctgcacgtgcagggcagcgacacctggcagagcttcatccactgcgtgtgcatgcagctggaggtgcccctggacctggaggtgctgctgctgagcaccttcggctacgacgacggcttcaccagccagctgggcgccgagggcaagagccagcccgagagccagctgcaccacggcctgaagagaccccaccagagctgcggcagcagccccagaagaaagcagtgcaagaagcagcagctggagctggccaagaagtacctgcagctgctgagaaccagcgcccagcagagatacagaagccagatccccggcagcggccagccccacgccttccaccaggtgtacgtgccccccatcctgagaagagccaccgccagcctggacacccccgagggcgccatcatgggcgacgtgaaggtggaggacggcgccgacgtgagcatcagcgacctgttcaacaccagagtgaacaagggccccagagtgaccgtgctgctgggcaaggccggcatgggcaagaccaccctggcccacagactgtgccagaagtgggccgagggccacctgaactgcttccaggccctgttcctgttcgagttcagacagctgaacctgatcaccagattcctgacccccagcgagctgctgttcgacctgtacctgagccccgagagcgaccacgacaccgtgttccagtacctggagaagaacgccgaccaggtgctgctgatcttcgacggcctggacgaggccctgcagcccatgggccccgacggccccggccccgtgctgaccctgttcagccacctgtgcaacggcaccctgctgcccggctgcagagtgatggccaccagcagacccggcaagctgcccgcctgcctgcccgccgaggccgccatggtgcacatgctgggcttcgacggccccagagtggaggagtacgtgaaccacttcttcagcgcccagcccagcagagagggcgccctggtggagctgcagaccaacggcagactgagaagcctgtgcgccgtgcccgccctgtgccaggtggcctgcctgtgcctgcaccacctgctgcccgaccacgcccccggccagagcgtggccctgctgcccaacatgacccagctgtacatgcagatggtgctggccctgagcccccccggccacctgcccaccagcagcctgctggacctgggcgaggtggccctgagaggcctggagaccggcaaggtgatcttctacgccaaggacatcgccccccccctgatcgccttcggcgccacccacagcctgctgaccagcttctgcgtgtgcaccggccccggccaccagcagaccggctacgccttcacccacctgagcctgcaggagttcctggccgccctgcacctgatggccagccccaaggtgaacaaggacaccctgacccagtacgtgaccctgcacagcagatgggtgcagagaaccaaggccagactgggcctgagcgaccacctgcccaccttcctggccggcctggccagctgcacctgcagacccttcctgagccacctggcccagggcaacgaggactgcgtgggcgccaagcaggccgccgtggtgcaggtgctgaagaagctggccaccagaaagctgaccggccccaaggtggtggagctgtgccactgcgtggacgagacccaggagcccgagctggccagcctgaccgcccagagcctgccctaccagctgcccttccacaacttccccctgacctgcaccgacctggccaccctgaccaacatcctggagcacagagaggcccccatccacctggacttcgacggctgccccctggagccccactgccccgaggccctggtgggctgcggccagatcgagaacctgagcttcaagagcagaaagtgcggcgacgccttcgccgaggccctgagcagaagcctgcccaccatgggcagactgcagatgctgggcctggccggcagcaagatcaccgccagaggcatcagccacctggtgaaggccctgcccctgtgcccccagctgaaggaggtgagcttcagagacaaccagctgagcgaccaggtggtgctgaacatcgtggaggtgctgccccacctgcccagactgagaaagctggacctgagcagcaacagcatctgcgtgagcaccctgctgtgcctggccagagtggccgtgacctgccccaccgtgagaatgctgcaggccagagaggccgacctgatcttcctgctgagcccccccaccgagaccaccgccgagctgcagagagcccccgacctgcaggagagcgacggccagagaaagggcgcccagagcagaagcctgaccctgagactgcagaagtgccagctgcaggtgcacgacgccgaggccctgatcgccctgctgcaggagggcccccacctggaggaggtggacctgagcggcaaccagctggaggacgagggctgcagactgatggccgaggccgccagccagctgcacatcgccagaaagctggacctgagcaacaacggcctgagcgtggccggcgtgcactgcgtgctgagagccgtgagcgcctgctggaccctggccgagctgcacatcagcctgcagcacaagaccgtgatcttcatgttcgcccaggagcccgaggagcagaagggcccccaggagagagccgccttcctggacagcctgatgctgcagatgcccagcgagctgcccctgagcagcagaagaatgagactgacccactgcggcctgcaggagaagcacctggagcagctgtgcaaggccctgggcggcagctgccacctgggccacctgcacctggacttcagcggcaacgccctgggcgacgagggcgccgccagactggcccagctgctgcccggcctgggcgccctgcagagcctgaacctgagcgagaacggcctgagcctggacgccgtgctgggcctggtgagatgcttcagcaccctgcagtggctgttcagactggacatcagcttcgagagccagcacatcctgctgagaggcgacaagaccagcagagacatgtgggccaccggcagcctgcccgacttccccgccgccgccaagttcctgggcttcagacagagatgcatccccagaagcctgtgcctgagcgagtgccccctggagccccccagcctgaccagactgtgcgccaccctgaaggactgccccggccccctggagctgcagctgagctgcgagttcctgagcgaccagagcctggagaccctgctggactgcctgccccagctgccccagctgagcctgctgcagctgagccagaccggcctgagccccaagagccccttcctgctggccaacaccctgagcctgtgccccagagtgaagaaggtggacctgagaagcctgcaccacgccaccctgcacttcagaagcaacgaggaggaggagggcgtgtgctgcggcagattcaccggctgcagcctgagccaggagcacgtggagagcctgtgctggctgctgagcaagtgcaaggacctgagccaggtggacctgagcgccaacctgctgggcgacagcggcctgagatgcctgctggagtgcctgccccaggtgcccatcagcggcctgctggacctgagccacaacagcatcagccaggagagcgccctgtacctgctggagaccctgcccagctgccccagagtgagagaggccagcgtgaacctgggcagcgagcagagcttcagaatccacttcagcagagaggaccaggccggcaagaccctgagactgagcgagtgcagcttcagacccgagcacgtgagcagactggccaccggcctgagcaagagcctgcagctgaccgagctgaccctgacccagtgctgcctgggccagaagcagctggccatcctgctgagcctggtgggcagacccgccggcctgttcagcctgagagtgcaggagccctgggccgacagagccagagtgctgagcctgctggaggtgtgcgcccaggccagcggcagcgtgaccgagatcagcatcagcgagacccagcagcagctgtgcgtgcagctggagttccccagacaggaggagaaccccgaggccgtggccctgagactggcccactgcgacctgggcgcccaccacagcctgctggtgggccagctgatggagacctgcgccagactgcagcagctgagcctgagccaggtgaacctgtgcgaggacgacgacgccagcagcctgctgctgcagagcctgctgctgagcctgagcgagctgaagaccttcagactgaccagcagctgcgtgagcaccgagggcctggcccacctggccagcggcctgggccactgccaccacctggaggagctggacctgagcaacaaccagttcgacgaggagggcaccaaggccctgatgagagccctggagggcaagtggatgctgaagagactggacctgagccacctgctgctgaacagcagcaccctggccctgctgacccacagactgagccagatgacctgcctgcagagcctgagactgaacagaaacagcatcggcgacgtgggctgctgccacctgagcgaggccctgagagccgccaccagcctggaggagctggacctgagccacaaccagatcggcgacgccggcgtgcagcacctggccaccatcctgcccggcctgcccgagctgagaaagatcgacctgagcggcaacagcatcagcagcgccggcggcgtgcagctggccgagagcctggtgctgtgcagaagactggaggagctgatgctgggctgcaacgccctgggcgaccccaccgccctgggcctggcccaggagctgccccagcacctgagagtgctgcacctgcccttcagccacctgggccccggcggcgccctgagcctggcccaggccctggacggcagcccccacctggaggagatcagcctggccgagaacaacctggccggcggcgtgctgagattctgcatggagctgcccctgctgagacagatcgacctggtgagctgcaagatcgacaaccagaccgccaagctgctgaccagcagcttcaccagctgccccgccctggaggtgatcctgctgagctggaacctgctgggcgacgaggccgccgccgagctggcccaggtgctgccccagatgggcagactgaagagagtggacctggagaagaaccagatcaccgccctgggcgcctggctgctggccgagggcctggcccagggcagcagcatccaggtgatcagactgtggaacaaccccatcccctgcgacatggcccagcacctgaagagccaggagcccagactggacttcgccttcttcgacaaccagccccaggccccctggggcacctag

SEQ ID NO: 9435 - DNA, 897 bp, Homo sapiens
atgatgaacgtgaacaccagaggcacctacctggccagcaaggcctgcatcccctacctgaagaagagcaaggtggcccacatcctgaacatcagcccccccctgaacctgaaccccgtgtggttcaagcagcactgcgcctacaccatcgccaagtacggcatgagcatgtacgtgctgggcatggccgaggagttcaagggcgagatcgccgtgaacgccctgtggcccaagaccgccatccacaccgccgccatggacatgctgggcggccccggcatcgagagccagtgcagaaaggtggacatcatcgccgacgccgcctacagcatcttccagaagcccaagagcttcaccggcaacttcgtgatcgacgagaacatcctgaaggaggagggcatcgagaacttcgacgtgtacgccatcaagcccggccaccccctgcagcccgacttcttcctggacgagtaccccgaggccgtgagcaagaaggtggagagcaccggcgccgtgcccgagttcaaggaggagaagctgcagctgcagcccaagcccagaagcggcgccgtggaggagaccttcagaatcgtgaaggacagcctgagcgacgacgtggtgaaggccacccaggccatctacctgttcgagctgagcggcgaggacggcggcacctggttcctggacctgaagagcaagggcggcaacgtgggctacggcgagcccagcgaccaggccgacgtggtgatgagcatgaccaccgacgacttcgtgaagatgttcagcggcaagctgaagcccaccatggccttcatgagcggcaagctgaagatcaagggcaacatggccctggccatcaagctggagaagctgatgaaccagatgaacgccagactgtag

SEQ ID NO: 9436 - DNA, 4026 bp, Homo sapiens
atgtggagaagaaagcaccccagaaccagcggcggcaccagaggcgtgctgagcggcaacagaggcgtggagtacggcagcggcagaggccacctgggcaccttcgagggcagatggagaaagctgcccaagatgcccgaggccgtgggcaccgaccccagcaccagcagaaagatggccgagctggaggaggtgaccctggacggcaagcccctgcaggccctgagagtgaccgacctgaaggccgccctggagcagagaggcctggccaagagcggccagaagagcgccctggtgaagagactgaagggcgccctgatgctggagaacctgcagaagcacagcaccccccacgccgccttccagcccaacagccagatcggcgaggagatgagccagaacagcttcatcaagcagtacctggagaagcagcaggagctgctgagacagagactggagagagaggccagagaggccgccgagctggaggaggccagcgccgagagcgaggacgagatgatccaccccgagggcgtggccagcctgctgccccccgacttccagagcagcctggagagacccgagctggagctgagcagacacagccccagaaagagcagcagcatcagcgaggagaagggcgacagcgacgacgagaagcccagaaagggcgagagaagaagcagcagagtgagacaggccagagccgccaagctgagcgagggcagccagcccgccgaggaggaggaggaccaggagacccccagcagaaacctgagagtgagagccgacagaaacctgaagaccgaggaggaggaggaggaggaggaggaggaggaggaggacgacgaggaggaggagggcgacgacgagggccagaagagcagagaggcccccatcctgaaggagttcaaggaggagggcgaggagatccccagagtgaagcccgaggagatgatggacgagagacccaagaccagaagccaggagcaggaggtgctggagagaggcggcagattcaccagaagccaggaggaggccagaaagagccacctggccagacagcagcaggagaaggagatgaagaccaccagccccctggaggaggaggagagagagatcaagagcagccagggcctgaaggagaagagcaagagccccagcccccccagactgaccgaggacagaaagaaggccagcctggtggccctgcccgagcagaccgccagcgaggaggagacccccccccccctgctgaccaaggaggccagcagcccccccccccacccccagctgcacagcgaggaggagatcgagcccatggagggccccgcccccgccgtgctgatccagctgagcccccccaacaccgacgccgacaccagagagctgctggtgagccagcacaccgtgcagctggtgggcggcctgagccccctgagcagccccagcgacaccaaggccgagagccccgccgagaaggtgcccgaggagagcgtgctgcccctggtgcagaagagcaccctggccgactacagcgcccagaaggacctggagcccgagagcgacagaagcgcccagcccctgcccctgaagatcgaggagctggccctggccaagggcatcaccgaggagtgcctgaagcagcccagcctggagcagaaggagggcagaagagccagccacaccctgctgcccagccacagactgaagcagagcgccgacagcagcagcagcagaagcagcagcagcagcagcagcagcagcagaagcagaagcagaagccccgacagcagcggcagcagaagccacagccccctgagaagcaagcagagagacgtggcccaggccagaacccacgccaaccccagaggcagacccaagatgggcagcagaagcaccagcgagagcagaagcagaagcagaagcagaagcagaagcgccagcagcaacagcagaaagagcctgagccccggcgtgagcagagacagcagcaccagctacaccgagaccaaggaccccagcagcggccaggaggtggccaccccccccgtgccccagctgcaggtgtgcgagcccaaggagagaaccagcaccagcagcagcagcgtgcaggccagaagactgagccagcccgagagcgccgagaagcacgtgacccagagactgcagcccgagagaggcagccccaagaagtgcgaggccgaggaggccgagccccccgccgccacccagccccagaccagcgagacccagaccagccacctgcccgagagcgagagaatccaccacaccgtggaggagaaggaggaggtgaccatggacaccagcgagaacagacccgagaacgacgtgcccgagccccccatgcccatcgccgaccaggtgagcaacgacgacagacccgagggcagcgtggaggacgaggagaagaaggagagcagcctgcccaagagcttcaagagaaagatcagcgtggtgagcgccaccaagggcgtgcccgccggcaacagcgacaccgagggcggccagcccggcagaaagagaagatggggcgccagcaccgccaccacccagaagaagcccagcatcagcatcaccaccgagagcctgaagagcctgatccccgacatcaagcccctggccggccaggaggccgtggtggacctgcacgccgacgacagcagaatcagcgaggacgagaccgagagaaacggcgacgacggcacccacgacaagggcctgaagatctgcagaaccgtgacccaggtggtgcccgccgagggccaggagaacggccagagagaggaggaggaggaggagaaggagcccgaggccgagccccccgtgcccccccaggtgagcgtggaggtggccctgcccccccccgccgagcacgaggtgaagaaggtgaccctgggcgacaccctgaccagaagaagcatcagccagcagaagagcggcgtgagcatcaccatcgacgaccccgtgagaaccgcccaggtgcccagcccccccagaggcaagatcagcaacatcgtgcacatcagcaacctggtgagacccttcaccctgggccagctgaaggagctgctgggcagaaccggcaccctggtggaggaggccttctggatcgacaagatcaagagccactgcttcgtgacctacagcaccgtggaggaggccgtggccaccagaaccgccctgcacggcgtgaagtggccccagagcaaccccaagttcctgtgcgccgactacgccgagcaggacgagctggactaccacagaggcctgctggtggacagacccagcgagaccaagaccgaggagcagggcatccccagacccctgcacccccccccccccccccccgtgcagcccccccagcaccccagagccgagcagagagagcaggagagagccgtgagagagcagtgggccgagagagagagagagatggagagaagagagagaaccagaagcgagagagagtgggacagagacaaggtgagagagggccccagaagcagaagcagaagcagagacagaagaagaaaggagagagccaagagcaaggagaagaagagcgagaagaaggagaaggcccaggaggagccccccgccaagctgctggacgacctgttcagaaagaccaaggccgccccctgcatctactggctgcccctgaccgacagccagatcgtgcagaaggaggccgagagagccgagagagccaaggagagagagaagagaagaaaggagcaggaggaggaggagcagaaggagagagagaaggaggccgagagagagagaaacagacagctggagagagagaagagaagagagcacagcagagagagagacagagagagagagagagagagagagagagacagaggcgacagagacagagacagagagagagacagagagagaggcagagagagagacagaagagacaccaagagacacagcagaagcagaagcagaagcacccccgtgagagacagaggcggcagaagatag

SEQ ID NO: 9437 - DNA, 600 bp, Homo sapiens
atgagcagcggcaacgccaagatcggccaccccgcccccaacttcaaggccaccgccgtgatgcccgacggccagttcaaggacatcagcctgagcgactacaagggcaagtacgtggtgttcttcttctaccccctggacttcaccttcgtgtgccccaccgagatcatcgccttcagcgacagagccgaggagttcaagaagctgaactgccaggtgatcggcgccagcgtggacagccacttctgccacctggcctgggtgaacacccccaagaagcagggcggcctgggccccatgaacatccccctggtgagcgaccccaagagaaccatcgcccaggactacggcgtgctgaaggccgacgagggcatcagcttcagaggcctgttcatcatcgacgacaagggcatcctgagacagatcaccgtgaacgacctgcccgtgggcagaagcgtggacgagaccctgagactggtgcaggccttccagttcaccgacaagcacggcgaggtgtgccccgccggctggaagcccggcagcgacaccatcaagcccgacgtgcagaagagcaaggagtacttcagcaagcagaagtag

SEQ ID NO: 9438 - DNA, 1077 bp, Homo sapiens
atggagaagaagaagatggtgacccagggcaaccaggagcccaccaccacccccgacgccatggtgcagcccttcaccaccatccccttccccccccccccccagaacggcatccccaccgagtacggcgtgccccacacccaggactacgccggccagaccggcgagcacaacctgaccctgtacggcagcacccaggcccacggcgagcagagcagcaacagccccagcacccagaacggcagcctgaccaccgagggcggcgcccagaccgacggccagcagagccagacccagagcagcgagaacagcgagagcaagagcacccccaagagactgcacgtgagcaacatccccttcagattcagagaccccgacctgagacagatgttcggcggcttcggcttcgtgaccttcgagaacagcgccgacgccgacagagccagagagaagctgcacggcaccgtggtggagggcagaaagatcgaggtgaacaacgccaccgccagagtgatgaccaacaagaagatggtgaccccctacgccaacggctggaagctgagccccgtggtgggcgccgtgtacggccccgagctgtacgccgccagcagcttccaggccgacgtgagcctgggcaacgacgccgccgtgcccctgagcggcagaggcggcatcaacacctacatccccctgatcatccccggcttcccctaccccaccgccgccaccaccgccgccgccttcagaggcgcccacctgagaggcagaggcagaaccgtgtacggcgccgtgagagccgtgccccccaccgccatccccgcctaccccggcgtggtgtaccaggacggcttctacggcgccgacctgtacggcggctacgccgcctacagatacgcccagcccgccaccgccaccgccgccaccgccgccgccgccgccgccgccgcctacagcgacggctacggcagagtgtacaccgccgacccctaccacgccctggcccccgccgccagctacggcgtgggcgccgtggccagcctgtacagaggcggctacagcagattcgccccctactag

SEQ ID NO: 9439 - DNA, 1596 bp, Homo sapiens
atgagctaccccgccgacgactacgagagcgaggccgcctacgacccctacgcctaccccagcgactacgacatgcacaccggcgaccccaagcaggacctggcctacgagagacagtacgagcagcagacctaccaggtgatccccgaggtgatcaagaacttcatccagtacttccacaagaccgtgagcgacctgatcgaccagaaggtgtacgagctgcaggccagcagagtgagcagcgacgtgatcgaccagaaggtgtacgagatccaggacatctacgagaacagctggaccaagctgaccgagagattcttcaagaacaccccctggcccgaggccgaggccatcgccccccaggtgggcaacgacgccgtgttcctgatcctgtacaagatcctgcaggcccacggccccgcccccctggagctgcccaaccagtggctgtgggacatcatcgacgagttcatctaccagttccagagcttcagccagtacagatgcaagaccgccaagaagagcgaggaggagatcgacttcctgagaagcaaccccaagatctggaacgtgcacagcgtgctgaacgtgctgcacagcctggtggacaagagcaacatcaacagacagctggaggtgtacaccagcggcggcgaccccgagagcgtggccggcgagtacggcagacacagcctgtacaagatgctgggctacttcagcctggtgggcctgctgagactgcacagcctgctgggcgactactaccaggccatcaaggtgctggagaacatcgagctgaacaagaagagcatgtacagcagagtgcccgagtgccaggtgaccacctactactacgtgggcttcgcctacctgatgatgagaagataccaggacgccatcagagtgttcgccaacatcctgctgtacatccagagaaccaagagcatgttccagagaaccacctacaagtacgagatgatcaacaagcagaacgagcagatgcacgccctgctggccatcgccctgaccatgtaccccatgagaatcgacgagagcatccacctgcagctgagagagaagtacggcgacaagatgctgagaatgcagaagggcgacccccaggtgtacgaggagctgttcagctacagctgccccaagttcctgagccccgtggtgcccaactacgacaacgtgcaccccaactaccacaaggagcccttcctgcagcagctgaaggtgttcagcgacgaggtgcagcagcaggcccagctgagcaccatcagaagcttcctgaagctgtacaccaccatgcccgtggccaagctggccggcttcctggacctgaccgagcaggagttcagaatccagctgctggtgttcaagcacaagatgaagaacctggtgtggaccagcggcatcagcgccctggacggcgagttccagagcgccagcgaggtggacttctacatcgacaaggacatgatccacatcgccgacaccaaggtggccagaagatacggcgacttcttcatcagacagatccacaagttcgaggagctgaacagaaccctgaagaagatgggccagagaccctag

SEQ ID NO: 9440 - DNA, 5952 bp, Artificial Sequence
  Description of Artificial Sequence: Synthetic coding sequence
atgagcggcaacaagagaggcagcagagccagctgcccccacagaggcgccgagtgcctgctgccctgggccgccctgaacctgcagggcttccagctgctgctgctgcaccccagcgccaccgccatgatggacgtgagcgagctgggcgagagcgccagatacctgagacagggctaccaggagatgaccaaggtgcacaccatcccctgggacggcaagaagagagtgtgggtgcccgacgagcaggacgcctacgtggaggccgaggtgaagagcgaggccaccggcggcagagtgaccgtggagaccaaggaccagaaggtgctgatggtgagagaggccgagctgcagcccatgaacccccccagattcgacctgctggaggacatggccatgatgacccacctgaacgaggccagcgtgctgcacaacctgagacagagatacgccagatggatgatctacacctacagcggcctgttctgcgtgaccatcaacccctacaagtggctgcccgtgtacaccgccagcgtggtggccgcctacaagggcaagagaagaagcgacagccccccccacatctacgccgtggccgacaacgcctacaacgacatgctgagaaacagagacaaccagagcatgctgatcaccggcgagagcggcgccggcaagaccgtgaacaccaagagagtgatccagtacttcgccatcgtggccgccctgggcgacggccccggcaagaaggcccagttcctggccaccaagaccggcggcaccctggaggaccagatcatcgaggccaaccccgccatggaggccttcggcaacgccaagaccctgagaaacgacaacagcagcagattcggcaagttcatcagaatccacttcggccccagcggcaagctggccagcgccgacatcgacagctacctgctggagaagagcagagtgatcttccagctgcccggcgagagaagctaccacgtgtactaccagatcctgagcggcagaaagcccgagctgcaggacatgctgctgctgagcatgaacccctacgactaccacttctgcagccagggcgtgatcaccgtggacaacatgaacgacggcgaggagctgatcgccaccgaccacgccatggacatcctgggcttcagcgtggacgagaagtgcgcctgctacaagatcgtgggcgccctgctgcacttcggcaacatgaagttcaagcagaagcagagagaggagcaggccgaggccgacggcaccgagagcgccgacaaggccgcctacctgatgggcgtgagcagcggcgacctgctgaagggcctgctgcaccccagagtgagagtgggcaacgagtacgtgaccaagggccagagcgtggagcaggtggtgttcgccgtgggcgccctggccaaggccacctacgacagactgttcagatggctggtgagcagaatcaaccagaccctggacaccaagctgcccagacagttcttcatcggcgtgctggacatcgccggcttcgagatcttcgagttcaacagcttcgagcagctgtgcatcaacttcaccaacgagaagctgcagcagttcttcaaccagcacatgttcgtgctggagcaggaggagtacaagagagagggcatcgactgggtgttcatcgacttcggcctggacctgcagccctgcatcgacctgatcgagaagcccctgggcatcctgagcatcctggaggaggagtgcatgttccccaaggccagcgacgccagcttcagagccaagctgtacgacaaccacgccggcaagagccccaacttccagcagcccagacccgacaagaagagaaagtaccaggcccacttcgaggtggtgcactacgccggcgtggtgccctacagcatcgtgggctggctggagaagaacaaggaccccctgaacgagaccgtggtgcccatcttccagaagagccagaacagactgctggccaccctgtacgagaactacgccggcagctgcagcaccgagccccccaagagcggcgtgaaggagaagagaaagaaggccgccagcttccagaccgtgagccagctgcacaaggagaacctgaacaagctgatgaccaacctgagagccacccagccccacttcgtgagatgcatcgtgcccaacgagaacaagacccccggcgtgatggacgccttcctggtgctgcaccagctgagatgcaacggcgtgctggagggcatcagaatctgcagacagggcttccccaacagactgctgtacaccgacttcagacagagatacagaatcctgaaccccagcgccatccccgacgacaccttcatggacagcagaaaggccaccgagaagctgctgggcagcctggacctggaccacacccagtaccagttcggccacaccaaggtgttcttcaaggccggcctgctgggcgtgctggaggagctgagagaccagagactggccaaggtgctgaccctgctgcaggccagaagcagaggcagactgatgagactggagtaccagagactgctgggcggcagagacgccctgttcaccatccagtggaacatcagagccttcaacgccgtgaagaactggagctggatgaagctgttcttcaagatgaagcccctgctgagaagcgcccaggccgaggaggagctggccgccctgagagccgagctgagaggcctgagaggcgccctggccgccgccgaggccaagagacaggagctggaggagacccacgtgagcatcacccaggagaagaacgacctggccctgcagctgcaggccgagcaggacaacctggccgacgccgaggagagatgccacctgctgatcaagagcaaggtgcagctggagggcaaggtgaaggagctgagcgagagactggaggacgaggaggaggtgaacgccgacctggccgccagaagaagaaagctggaggacgagtgcaccgagctgaagaaggacatcgacgacctgaagctgaccctggccaaggccgagaaggagaagcaggccaccgagaacaaggtgaagaacctgaccgaggagatggccgccctggacgagagcgtggccagactgaccaaggagaagaaggccctgcaggaggcccaccagcaggccctgggcgacctgcaggccgaggaggacagagtgagcgccctgaccaaggccaagctgagactggagcagcaggtggaggacctggagtgcagcctggagcaggagaagaagctgagaatggacaccgagagagccaagagaaagctggagggcgacctgaagctgacccaggagagcgtggccgacgccgcccaggacaagcagcagctggaggagaagctgaagaagaaggacagcgagctgagccagctgagcctgagagtggaggacgagcagctgctgggcgcccagatgcagaagaagatcaaggagctgcaggccagagccgaggagctggaggaggagctggaggccgagagagccgccagagccagagtggagaagcagagagccgaggccgccagagagctggaggagctgagcgagagactggaggaggccggcggcgccagcgccggccagagagagggctgcagaaagagagaggccgagctgggcagactgagaagagagctggaggaggccgccctgagacacgaggccaccgtggccgccctgagaagaaagcaggccgagggcgccgccgagctgggcgagcaggtggacagcctgcagagagtgagacagaagctggagaaggagaagagcgagctgagaatggaggtggacgacctggccgccaacgtggagaccctgaccagagccaaggccagcgccgagaagctgtgcagaacctacgaggaccagctgagcgaggccaagatcaaggtggaggagctgcagagacagctggccgacgccagcacccagagaggcagactgcagaccgagagcggcgagctgagcagactgctggaggagaaggagtgcctgatcagccagctgagcagaggcaaggccctggccgcccagagcctggaggagctgagaagacagctggaggaggagagcaaggccaagagcgccctggcccacgccgtgcaggccctgagacacgactgcgacctgctgagagagcagcacgaggaggaggccgaggcccaggccgagctgcagagactgctgagcaaggccaacgccgaggtggcccagtggagaagcaagtacgaggccgacgccatccagagaaccgaggagctggaggaggccaagaagaagctggccctgagactgcaggaggccgaggagggcgtggaggccgccaacgccaagtgcagcagcctggagaaggccaagctgagactgcagaccgagagcgaggacgtgaccctggagctggagagagccaccagcgccgccgccgccctggacaagaagcagagacacctggagagagccctggaggagagaagaagacaggaggaggagatgcagagagagctggaggccgcccagagagagagcagaggcctgggcaccgagctgttcagactgagacacggccacgaggaggccctggaggccctggagaccctgaagagagagaacaagaacctgcaggaggagatcagcgacctgaccgaccaggtgagcctgagcggcaagagcatccaggagctggagaagaccaagaaggccctggagggcgagaagagcgagatccaggccgccctggaggaggccgagggcgccctggagctggaggagaccaagaccctgagaatccagctggagctgagccaggtgaaggccgaggtggacagaaagctggccgagaaggacgaggagtgcgccaacctgagaagaaaccaccagagagccgtggagagcctgcaggccagcctggacgccgagaccagagccagaaacgaggccctgagactgaagaagaagatggagggcgacctgaacgacctggagctgcagctgggccacgccaccagacaggccaccgaggcccaggccgccaccagactgatgcaggcccagctgaaggaggagcaggccggcagagacgaggagcagagactggccgccgagctgcacgagcaggcccaggccctggagagaagagccagcctgctggccgccgagctggaggagctgagagccgccctggagcagggcgagagaagcagaagactggccgagcaggagctgctggaggccaccgagagactgaacctgctgcacagccagaacaccggcctgctgaaccagaagaagaagctggaggccgacctggcccagctgagcggcgaggtggaggaggccgcccaggagagaagagaggccgaggagaaggccaagaaggccatcaccgacgccgccatgatggccgaggagctgaagaaggagcaggacaccagcgcccacctggagagaatgaagaagaccctggagcagaccgtgagagagctgcaggccagactggaggaggccgagcaggccgccctgagaggcggcaagaagcaggtgcagaagctggaggccaaggtgagagagctggaggccgagctggacgccgagcagaagaagcacgccgaggccctgaagggcgtgagaaagcacgagagaagagtgaaggagctggcctaccaggccgaggaggacagaaagaacctggccagaatgcaggacctggtggacaagctgcagagcaaggtgaagagctacaagagacagttcgaggaggccgagcagcaggccaacaccaacctggccaagtacagaaaggcccagcacgagctggacgacgccgaggagagagccgacatggccgagacccaggccaacaagctgagagccagaaccagagacgccctgggccccaagcacaaggagtag

SEQ ID NO: 9441 - DNA, 2730 bp, Artificial Sequence
  Description of Artificial Sequence: Synthetic coding sequence
atggagagagccatggagcagctgaacagactgaccagaagcctgagaagagccagaaccgtggagctgcccgaggacaacgagaccgccgtgtacaccctgatgcccatggtgatggccgaccagcacagaagcgtgagcgagctgctgagcaacagcaagttcgacgtgaactacgccttcggcagagtgaagagaagcctgctgcacatcgccgccaactgcggcagcgtggagtgcctggtgctgctgctgaagaagggcgccaaccccaactaccaggacatcagcggctgcacccccctgcacctggccgccagaaacggccagaagaagtgcatgagcaagctgctggagtacagcgccgacgtgaacatctgcaacaacgagggcctgaccgccatccactggctggccgtgaacggcagaaccgagctgctgcacgacctggtgcagcacgtgagcgacgtggacgtggaggacgccatgggccagaccgccctgcacgtggcctgccagaacggccacaagaccaccgtgcagtgcctgctggacagcggcgccgacatcaacagacccaacgtgagcggcgccacccccctgtacttcgcctgcagccacggccagagagacaccgcccagatcctgctgctgagaggcgccaagtacctgcccgacaagaacggcgtgacccccctggacctgtgcgtgcagggcggctacggcgagacctgcgaggtgctgatccagtaccaccccagactgttccagaccatcatccagatgacccagaacgaggacctgagagagaacatgctgagacaggtgctggagcacctgagccagcagagcgagagccagtacctgaagatcctgaccagcctggccgaggtggccaccaccaacggccacaagctgctgagcctgagcagcaactacgacgcccagatgaagagcctgctgagaatcgtgagaatgttctgccacgtgttcagaatcggccccagcagccccagcaacggcatcgacatgggctacaacggcaacaagacccccagaagccaggtgttcaagcccctggagctgctgtggcacagcctggacgagtggctggtgctgatcgccaccgagctgatgaagaacaagagagacagcaccgagatcaccagcatcctgctgaagcagaagggccaggaccaggacgccgccagcatcccccccttcgagccccccggccccggcagctacgagaacctgagcaccggcaccagagagagcaagcccgacgccctggccggcagacaggaggccagcgccgactgccaggacgtgatcagcatgaccgccaacagactgagcgccgtgatccaggccttctacatgtgctgcagctgccagatgccccccggcatgaccagccccagattcatcgagttcgtgtgcaagcacgacgaggtgctgaagtgcttcgtgaacagaaaccccaagatcatcttcgaccacttccacttcctgctggagtgccccgagctgatgagcagattcatgcacatcatcaaggcccagcccttcaaggacagatgcgagtggttctacgagcacctgcacagcggccagcccgacagcgacatggtgcacagacccgtgaacgagaacgacatcctgctggtgcacagagacagcatcttcagaagcagctgcgaggtggtgagcaaggccaactgcgccaagctgaagcagggcatcgccgtgagattccacggcgaggagggcatgggccagggcgtggtgagagagtggttcgacatcctgagcaacgagatcgtgaaccccgactacgccctgttcacccagagcgccgacggcaccaccttccagcccaacagcaacagctacgtgaaccccgaccacctgaactacttcagattcgccggccagatcctgggcctggccctgaaccacagacagctggtgaacatctacttcaccagaagcttctacaagcacatcctgggcatccccgtgaactaccaggacgtggccagcatcgaccccgagtacgccaagaacctgcagtggatcctggacaacgacatcagcgacctgggcctggagctgaccttcagcgtggagaccgacgtgttcggcgccatggaggaggtgcccctgaagcccggcggcggcagcatcctggtgacccagaacaacaaggccgagtacgtgcagctggtgaccgagctgagaatgaccagagccatccagccccagatcaacgccttcctgcagggcttccacatgttcatcccccccagcctgatccagctgttcgacgagtacgagctggagctgctgctgagcggcatgcccgagatcgacgtgagcgactggatcaagaacaccgagtacaccagcggctacgagagagaggaccccgtgatccagtggttctgggaggtggtggaggacatcacccaggaggagagagtgctgctgctgcagttcgtgaccggcagcagcagagtgccccacggcggcttcgccaacatcatgggcggcagcggcctgcagaacttcaccatcgccgccgtgccctacacccccaacctgctgcccaccagcagcacctgcatcaacatgctgaagctgcccgagtaccccagcaaggagatcctgaaggacagactgctggtggccctgcactgcggcagctacggctacaccatggcctag

SEQ ID NO: 9442 - DNA, 2679 bp, Artificial Sequence
  Description of Artificial Sequence: Synthetic coding sequence
atgagaaaggtgaagaagctgagactggacaaggagaacaccggcagctggagaagcttcagcctgaacagcgagggcgccgagagaatggccaccaccggcacccccaccgccgacagaggcgacgccgccgccaccgacgaccccgccgccagattccaggtgcagaagcacagctgggacggcctgagaagcatcatccacggcagcagaaagtacagcggcctgatcgtgaacaaggccccccacgacttccagttcgtgcagaagaccgacgagagcggcccccacagccacagactgtactacctgggcatgccctacggcagcagagagaacagcctgctgtacagcgagatccccaagaaggtgagaaaggaggccctgctgctgctgagctggaagcagatgctggaccacttccaggccaccccccaccacggcgtgtacagcagagaggaggagctgctgagagagagaaagagactgggcgtgttcggcatcaccagctacgacttccacagcgagagcggcctgttcctgttccaggccagcaacagcctgttccactgcagagacggcggcaagaacggcttcatggtgagccccatgaagcccctggagatcaagacccagtgcagcggccccagaatggaccccaagatctgccccgccgaccccgccttcttcagcttcatcaacaacagcgacctgtgggtggccaacatcgagaccggcgaggagagaagactgaccttctgccaccagggcctgagcaacgtgctggacgaccccaagagcgccggcgtggccaccttcgtgatccaggaggagttcgacagattcaccggctactggtggtgccccaccgccagctgggagggcagcgagggcctgaagaccctgagaatcctgtacgaggaggtggacgagagcgaggtggaggtgatccacgtgcccagccccgccctggaggagagaaagaccgacagctacagataccccagaaccggcagcaagaaccccaagatcgccctgaagctggccgagttccagaccgacagccagggcaagatcgtgagcacccaggagaaggagctggtgcagcccttcagcagcctgttccccaaggtggagtacatcgccagagccggctggaccagagacggcaagtacgcctgggccatgttcctggacagaccccagcagtggctgcagctggtgctgctgccccccgccctgttcatccccagcaccgagaacgaggagcagagactggccagcgccagagccgtgcccagaaacgtgcagccctacgtggtgtacgaggaggtgaccaacgtgtggatcaacgtgcacgacatcttctaccccttcccccagagcgagggcgaggacgagctgtgcttcctgagagccaacgagtgcaagaccggcttctgccacctgtacaaggtgaccgccgtgctgaagagccagggctacgactggagcgagcccttcagccccggcgaggacgagttcaagtgccccatcaaggaggagatcgccctgaccagcggcgagtgggaggtgctggccagacacggcagcaagatctgggtgaacgaggagaccaagctggtgtacttccagggcaccaaggacacccccctggagcaccacctgtacgtggtgagctacgaggccgccggcgagatcgtgagactgaccacccccggcttcagccacagctgcagcatgagccagaacttcgacatgttcgtgagccactacagcagcgtgagcacccccccctgcgtgcacgtgtacaagctgagcggccccgacgacgaccccctgcacaagcagcccagattctgggccagcatgatggaggccgccagctgcccccccgactacgtgccccccgagatcttccacttccacaccagaagcgacgtgagactgtacggcatgatctacaagccccacgccctgcagcccggcaagaagcaccccaccgtgctgttcgtgtacggcggcccccaggtgcagctggtgaacaacagcttcaagggcatcaagtacctgagactgaacaccctggccagcctgggctacgccgtggtggtgatcgacggcagaggcagctgccagagaggcctgagattcgagggcgccctgaagaaccagatgggccaggtggagatcgaggaccaggtggagggcctgcagttcgtggccgagaagtacggcttcatcgacctgagcagagtggccatccacggctggagctacggcggcttcctgagcctgatgggcctgatccacaagccccaggtgttcaaggtggccatcgccggcgcccccgtgaccgtgtggatggcctacgacaccggctacaccgagagatacatggacgtgcccgagaacaaccagcacggctacgaggccggcagcgtggccctgcacgtggagaagctgcccaacgagcccaacagactgctgatcctgcacggcttcctggacgagaacgtgcacttcttccacaccaacttcctggtgagccagctgatcagagccggcaagccctaccagctgcagatctaccccaacgagagacacagcatcagatgccccgagagcggcgagcactacgaggtgaccctgctgcacttcctgcaggagtacctgtag

SEQ ID NO: 9443 - DNA, 1533 bp, Artificial Sequence
  Description of Artificial Sequence: Synthetic coding sequence
atggccgccgagctggtggaggccaagaacatggtgatgagcttcagagtgagcgacctgcagatgctgctgggcttcgtgggcagaagcaagagcggcctgaagcacgagctggtgaccagagccctgcagctggtgcagttcgactgcagccccgagctgttcaagaagatcaaggagctgtacgagaccagatacgccaagaagaacagcgagcccgccccccagccccacagacccctggaccccctgaccatgcacagcacctacgacagagccggcgccgtgcccagaacccccctggccggccccaacatcgactaccccgtgctgtacggcaagtacctgaacggcctgggcagactgcccgccaagaccctgaagcccgaggtgagactggtgaagctgcccttcttcaacatgctggacgagctgctgaagcccaccgagctggtgccccagaacaacgagaagctgcaggagagcccctgcatcttcgccctgacccccagacaggtggagctgatcagaaacagcagagagctgcagcccggcgtgaaggccgtgcaggtggtgctgagaatctgctacagcgacaccagctgcccccaggaggaccagtacccccccaacatcgccgtgaaggtgaaccacagctactgcagcgtgcccggctactaccccagcaacaagcccggcgtggagcccaagagaccctgcagacccatcaacctgacccacctgatgtacctgagcagcgccaccaacagaatcaccgtgacctggggcaactacggcaagagctacagcgtggccctgtacctggtgagacagctgaccagcagcgagctgctgcagagactgaagaccatcggcgtgaagcaccccgagctgtgcaaggccctggtgaaggagaagctgagactggaccccgacagcgagatcgccaccaccggcgtgagagtgagcctgatctgccccctggtgaagatgagactgagcgtgccctgcagagccgagacctgcgcccacctgcagtgcttcgacgccgtgttctacctgcagatgaacgagaagaagcccacctggatgtgccccgtgtgcgacaagcccgccccctacgaccagctgatcatcgacggcctgctgagcaagatcctgagcgagtgcgaggacgccgacgagatcgagtacctggtggacggcagctggtgccccatcagagccgagaaggagagaagctgcagcccccagggcgccatcctggtgctgggccccagcgacgccaacggcctgctgcccgcccccagcgtgaacggcagcggcgccctgggcagcaccggcggcggcggccccgtgggcagcatggagaacggcaagcccggcgccgacgtggtggacctgaccctggacagcagcagcagcagcgaggacgaggaggaggaggaggaggaggaggaggacgaggacgaggagggccccagacccaagagaagatgccccttccagaagggcctggtgcccgcctgctag

SEQ ID NO: 9444 - DNA, 684 bp, Artificial Sequence
  Description of Artificial Sequence: Synthetic coding sequence
atggccgcccagagacccctgagagtgctgtgcctggccggcttcagacagagcgagagaggcttcagagagaagaccggcgccctgagaaaggccctgagaggcagagccgagctggtgtgcctgagcggcccccaccccgtgcccgacccccccggccccgagggcgccagaagcgacttcggcagctgcccccccgaggagcagcccagaggctggtggttcagcgagcaggaggccgacgtgttcagcgccctggaggagcccgccgtgtgcagaggcctggaggagagcctgggcatggtggcccaggccctgaacagactgggccccttcgacggcctgctgggcttcagccagggcgccgccctggccgccctggtgtgcgccctgggccaggccggcgaccccagattccccctgcccagattcatcctgctggtgagcggcttctgccccagaggcatcggcttcaaggagagcatcctgcagagacccctgagcctgcccagcctgcacgtgttcggcgacaccgacaaggtgatccccagccaggagagcgtgcagctggccagccagttccccggcgccatcaccctgacccacagcggcggccacttcatccccgccgccgccccccagagacaggcctacctgaagttcctggaccagttcgccgagtag

SEQ ID NO: 9445 - DNA, 1656 bp, Artificial Sequence
  Description of Artificial Sequence: Synthetic coding sequence
atggaggaggccgagctggtgaagggcagactgcaggccatcaccgacaagagaaagatccaggaggagatcagccagaagagactgaagatcgaggaggacaagctgaagcaccagcacctgaagaagaaggccctgagagagaagtggctgctggacggcatcagcagcggcaaggagcaggaggagatgaagaagcagaaccagcaggaccagcaccagatccaggtgctggagcagagcatcctgagactggagaaggagatccaggacctggagaaggccgagctgcagatcagcaccaaggaggaggccatcctgaagaagctgaagagcatcgagagaaccaccgaggacatcatcagaagcgtgaaggtggagagagaggagagagccgaggagagcatcgaggacatctacgccaacatccccgacctgcccaagagctacatccccagcagactgagaaaggagatcaacgaggagaaggaggacgacgagcagaacagaaaggccctgtacgccatggagatcaaggtggagaaggacctgaagaccggcgagagcaccgtgctgagcagcatccccctgcccagcgacgacttcaagggcaccggcatcaaggtgtacgacgacggccagaagagcgtgtacgccgtgagcagcaaccacagcgccgcctacaacggcaccgacggcctggcccccgtggaggtggaggagctgctgagacaggccagcgagagaaacagcaagagccccaccgagtaccacgagcccgtgtacgccaaccccttctacagacccaccaccccccagagagagaccgtgacccccggccccaacttccaggagagaatcaagatcaagaccaacggcctgggcatcggcgtgaacgagagcatccacaacatgggcaacggcctgagcgaggagagaggcaacaacttcaaccacatcagccccatcccccccgtgccccaccccagaagcgtgatccagcaggccgaggagaagctgcacaccccccagaagagactgatgaccccctgggaggagagcaacgtgatgcaggacaaggacgcccccagccccaagcccagactgagccccagagagaccatcttcggcaagagcgagcaccagaacagcagccccacctgccaggaggacgaggaggacgtgagatacaacatcgtgcacagcctgccccccgacatcaacgacaccgagcccgtgaccatgatcttcatgggctaccagcaggccgaggacagcgaggaggacaagaagttcctgaccggctacgacggcatcatccacgccgagctggtggtgatcgacgacgaggaggaggaggacgagggcgaggccgagaagcccagctaccaccccatcgccccccacagccaggtgtaccagcccgccaagcccacccccctgcccagaaagagaagcgaggccagcccccacgagaacaccaaccacaagagcccccacaagaacagcatcagcctgaaggagcaggaggagagcctgggcagccccgtgcaccacagccccttcgacgcccagaccaccggcgacggcaccgaggaccccagcctgaccgccctgagaatgagaatggccaagctgggcaagaaggtgatctag

SEQ ID NO: 9446 - DNA, 1701 bp, Artificial Sequence
  Description of Artificial Sequence: Synthetic coding sequence
atgttcgtgagcgacttcagaaaggagttctacgaggtggtgcagagccagagagtgctgctgttcgtggccagcgacgtggacgccctgtgcgcctgcaagatcctgcaggccctgttccagtgcgaccacgtgcagtacaccctggtgcccgtgagcggctggcaggagctggagaccgccttcctggagcacaaggagcagttccactacttcatcctgatcaactgcggcgccaacgtggacctgctggacatcctgcagcccgacgaggacaccatcttcttcgtgtgcgacacccacagacccgtgaacgtggtgaacgtgtacaacgacacccagatcaagctgctgatcaagcaggacgacgacctggaggtgcccgcctacgaggacatcttcagagacgaggaggaggacgaggagcacagcggcaacgacagcgacggcagcgagcccagcgagaagagaaccagactggaggaggagatcgtggagcagaccatgagaagaagacagagaagagagtgggaggccagaagaagagacatcctgttcgactacgagcagtacgagtaccacggcaccagcagcgccatggtgatgttcgagctggcctggatgctgagcaaggacctgaacgacatgctgtggtgggccatcgtgggcctgaccgaccagtgggtgcaggacaagatcacccagatgaagtacgtgaccgacgtgggcgtgctgcagagacacgtgagcagacacaaccacagaaacgaggacgaggagaacaccctgagcgtggactgcaccagaatcagcttcgagtacgacctgagactggtgctgtaccagcactggagcctgcacgacagcctgtgcaacaccagctacaccgccgccagattcaagctgtggagcgtgcacggccagaagagactgcaggagttcctggccgacatgggcctgcccctgaagcaggtgaagcagaagttccaggccatggacatcagcctgaaggagaacctgagagagatgatcgaggagagcgccaacaagttcggcatgaaggacatgagagtgcagaccttcagcatccacttcggcttcaagcacaagttcctggccagcgacgtggtgttcgccaccatgagcctgatggagagccccgagaaggacggcagcggcaccgaccacttcatccaggccctggacagcctgagcagaagcaacctggacaagctgtaccacggcctggagctggccaagaagcagctgagagccacccagcagaccatcgccagctgcctgtgcaccaacctggtgatcagccagggccccttcctgtactgcagcctgatggagggcacccccgacgtgatgctgttcagcagacccgccagcctgagcctgctgagcaagcacctgctgaagagcttcgtgtgcagcaccaagaacagaagatgcaagctgctgcccctggtgatggccgcccccctgagcatggagcacggcaccgtgaccgtggtgggcatcccccccgagaccgacagcagcgacagaaagaacttcttcggcagagccttcgagaaggccgccgagagcaccagcagcagaatgctgcacaaccacttcgacctgagcgtgatcgagctgaaggccgaggacagaagcaagttcctggacgccctgatcagcctgctgagctag

SEQ ID NO: 9447 - DNA, 1461 bp, Artificial Sequence
  Description of Artificial Sequence: Synthetic coding sequence
atgagcgtgacctacgacgacagcgtgggcgtggaggtgagcagcgacagcttctgggaggtgggcaactacaagagaaccgtgaagagaatcgacgacggccacagactgtgcagcgacctgatgaactgcctgcacgagagagccagaatcgagaaggcctacgcccagcagctgaccgagtgggccagaagatggagacagctggtggagaagggcccccagtacggcaccgtggagaaggcctggatggccttcatgagcgaggccgagagagtgagcgagctgcacctggaggtgaaggccagcctgatgaacgacgacttcgagaagatcaagaactggcagaaggaggccttccacaagcagatgatgggcggcttcaaggagaccaaggaggccgaggacggcttcagaaaggcccagaagccctgggccaagaagctgaaggaggtggaggccgccaagaaggcccaccacgccgcctgcaaggaggagaagctggccatcagcagagaggccaacagcaaggccgaccccagcctgaaccccgagcagctgaagaagctgcaggacaagatcgagaagtgcaagcaggacgtgctgaagaccaaggagaagtacgagaagagcctgaaggagctggaccagggcaccccccagtacatggagaacatggagcaggtgttcgagcagtgccagcagttcgaggagaagagactgagattcttcagagaggtgctgctggaggtgcagaagcacctggacctgagcaacgtggccggctacaaggccatctaccacgacctggagcagagcatcagagccgccgacgccgtggaggacctgagatggttcagagccaaccacggccccggcatggccatgaactggccccagttcgaggagtggagcgccgacctgaacagaaccctgagcagaagagagaagaagaaggccaccgacggcgtgaccctgaccggcatcaaccagaccggcgaccagagcctgcccagcaagcccagcagcaccctgaacgtgcccagcaaccccgcccagagcgcccagagccagagcagctacaaccccttcgaggacgaggacgacaccggcagcaccgtgagcgagaaggacgacaccaaggccaagaacgtgagcagctacgagaagacccagagctaccccaccgactggagcgacgacgagagcaacaaccccttcagcagcaccgacgccaacggcgacagcaaccccttcgacgacgacgccaccagcggcaccgaggtgagagtgagagccctgtacgactacgagggccaggagcacgacgagctgagcttcaaggccggcgacgagctgaccaagatggaggacgaggacgagcagggctggtgcaagggcagactggacaacggccaggtgggcctgtaccccgccaactacgtggaggccatccagtag

SEQ ID NO: 9448 - DNA, 2262 bp, Artificial Sequence
  Description of Artificial Sequence: Synthetic coding sequence
atgatggaggagagagccgccgccgccgtggccgccgccgccagcagctgcagacccctgggcagcggcgccggccccggccccaccggcgccgcccccgtgagcgcccccgcccccggccccggccccgccggcaagggcggcggcggcggcggcagccccggccccaccgccggccccgagcccctgagcctgcccggcatcctgcacttcatccagcacgagtgggccagattcgaggccgagaaggccagatgggaggccgagagagccgagctgcaggcccaggtggccttcctgcagggcgagagaaagggccaggagaacctgaagaccgacctggtgagaagaatcaagatgctggagtacgccctgaagcaggagagagccaagtaccacaagctgaagttcggcaccgacctgaaccagggcgagaagaaggccgacgtgagcgagcaggtgagcaacggccccgtggagagcgtgaccctggagaacagccccctggtgtggaaggagggcagacagctgctgagacagtacctggaggaggtgggctacaccgacaccatcctggacatgagaagcaagagagtgagaagcctgctgggcagaagcctggagctgaacggcgccgtggagcccagcgagggcgcccccagagccccccccggccccgccggcctgagcggcggcgagagcctgctggtgaagcagatcgaggagcagatcaagagaaacgccgccggcaaggacggcaaggagagactgggcggcagcgtgctgggccagatccccttcctgcagaactgcgaggacgaggacagcgacgaggacgacgagctggacagcgtgcagcacaagaagcagagagtgaagctgcccagcaaggccctggtgcccgagatggaggacgaggacgaggaggacgacagcgaggacgccatcaacgagttcgacttcctgggcagcggcgaggacggcgagggcgcccccgaccccagaagatgcaccgtggacggcagcccccacgagctggagagcagaagagtgaagctgcagggcatcctggccgacctgagagacgtggacggcctgccccccaaggtgaccggccccccccccggcaccccccagcccagaccccacgaggacgtgttcatcatggacaccatcggcggcggcgaggtgagcctgggcgacctggccgacctgaccgtgaccaacgacaacgacctgagctgcgacctgagcgacagcaaggacgccttcaagaagacctggaaccccaagttcaccctgagaagccactacgacggcatcagaagcctggccttccaccacagccagagcgccctgctgaccgccagcgaggacggcaccctgaagctgtggaacctgcagaaggccgtgaccgccaagaagaacgccgccctggacgtggagcccatccacgccttcagagcccacagaggccccgtgctggccgtggccatgggcagcaacagcgagtactgctacagcggcggcgccgacgcctgcatccacagctggaagatccccgacctgagcatggacccctacgacggctacgaccccagcgtgctgagccacgtgctggagggccacggcgacgccgtgtggggcctggccttcagccccaccagccagagactggccagctgcagcgccgacggcaccgtgagaatctgggaccccagcagcagcagccccgcctgcctgtgcaccttccccaccgccagcgagcacggcgtgcccaccagcgtggccttcaccagcaccgagcccgcccacatcgtggccagcttcagaagcggcgacaccgtgctgtacgacatggaggtgggcagcgccctgctgaccctggagagcagaggcagcagcggccccacccagatcaaccaggtggtgagccaccccaaccagcccctgaccatcaccgcccacgacgacagaggcatcagattcctggacaacagaaccggcaagcccgtgcacagcatggtggcccacctggacgccgtgacctgcctggccgtggaccccaacggcgccttcctgatgagcggcagccacgactgcagcctgagactgtggagcctggacaacaagacctgcgtgcaggagatcaccgcccacagaaagaagcacgaggaggccatccacgccgtggcctgccaccccagcaaggccctgatcgccagcgccggcgccgacgccctggccaaggtgttcgtgtag

SEQ ID NO: 9449 - DNA, 1596 bp, Artificial Sequence
  Description of Artificial Sequence: Synthetic coding sequence
atgagaatgcacaccagactgagcctgcccggccccccccaccacgtgggcgccgcctacccccccgccggcggcaacagaagcgagaacgccggcagctggggcggcgccggcgccagcagcgtggagcccctggccagaagagtggccagcggcgaggccaccctggccatggaccagcccgccggcctgcaggtggactacgtgttcagaggcgtggagcacgccgtgagagtgatggtgagcggccaggtgctggagctggaggtggaggacagaatgaccgccgaccagtggagaggcgagttcgacgccggcttcatcgaggacctgacccacaagaccggcaacttcaagcagttcaacatcttctgccacatgctggagagcgccctgacccagagcagcgagagcgtgaccctggacctgctgacctacaccgacctggagagcctgagaaacagaaagatgggcggcagacccggcagcctggcccccagaagcgcccagctgaacagcaagagatacctgatcctgatctacagcgtggagttcgacagaatccactaccccctgcccctgccctaccagggcaagcccgaccccgtggtgctgcagggcatcatcagaagcctgaaggaggagctgggcagactgcagggcctggacggccagaacaccagagacaccagagagaacgagatctggcacctgagagagcaggtgagcagactggccagcgagaagagagagctggaggcccagctgggcagaagcagagaggaggccctggccggcagagccgccagacaggaggccgaggccctgagaggcctggtgagaggcctggagctggagctgagacaggagagaggcctgggccacagagtggccggcagaagaggccaggactgcagaagactggccaaggagctggaggaggccaaggccagcgagagaagcctgagagccagactgaagaccctgaccagcgagctggccctgtacaagagaggcggcagaggcagcagaggcagaggcagacccgccagacccagccccagccccaccggcggcagagccctgagattcgaccccaccgccttcgtgaaggccaaggagagaaagcagagagagatccagatgaagcagcagcagagaaacagactgggcagcggcggcagcggcgacggccccagcgtgagctggagcagacagacccagccccccgccgccctgaccggcagaggcgacgcccccaacagaagcagaaacagaagcagcagcgtggacagcttcagaagcagatgcagcagcgccagcagctgcagcgacctggaggacttcagcgagagcctgagcagaggcggccacagaagaagaggcaagccccccagccccaccccctggagcggcagcaacatgaagagcccccccgtggagagaagccaccaccagaagagcctggccaacagcggcggctgggtgcccatcaaggagtacagcagcgagcaccaggccgccgacatggccgagatcgacgccagactgaaggccctgcaggagtacatgaacagactggacatgagaagctag

SEQ ID NO: 9450 - DNA, 1452 bp, Artificial Sequence
  Description of Artificial Sequence: Synthetic coding sequence
atggccagcctgctgtggggcggcgacgccggcgccgccgagagcgagagactgaacagccacttcagcaacctgagccagcccagaaagaacctgtggggcatcaagagcaccgccgtgagaaacatcgacggcagcatcaacaacatcaacgaggacgacgaggaggacgtggtggacctggccgccaacagcctgctgaacaagctgatccaccagagcctggtggagagcagccacagagtggaggtgctgcagaaggaccccagcagccccctgtacagcgtgaagaccttcgaggagctgagactgaaggaggagctgctgaagggcatctacgccatgggcttcaacagacccagcaagatccaggagatggccctgcccatgatgctggcccaccccccccagaacctgatcgcccagagccagagcggcaccggcaagaccgccgccttcgtgctggccatgctgagcagagtgaacgccctggagctgttcccccagtgcctgtgcctggcccccacctacgagctggccctgcagaccggcagagtggtggagcagatgggcaagttctgcgtggacgtgcaggtgatgtacgccatcagaggcaacagaatccccagaggcaccgacatcaccaagcagatcatcatcggcacccccggcaccgtgctggactggtgcttcaagctgaagctgatcgacctgaccaagatcagagtgttcgtgctggacgaggccgacgtgatgatcgacacccagggcttcagcgaccacagcatcagaatccagagagccctgcccagcgagtgccagatgctgctgttcagcgccaccttcgaggacagcgtgtggcacttcgccgagagaatcatccccgaccccaacgtgatcaagctgagaaaggaggagctgaccctgaacaacatcagacagtactacgtgctgtgcgagcacagaaaggacaagtaccaggccctgtgcaacatctacggcagcatcaccatcggccaggccatcatcttctgccagaccagaagaaacgccaagtggctgaccgtggagatgatccaggacggccaccaggtgagcctgctgagcggcgagctgaccgtggagcagagagccagcatcatccagagattcagagacggcaaggagaaggtgctgatcaccaccaacgtgtgcgccagaggcatcgacgtgaagcaggtgaccatcgtggtgaacttcgacctgcccgtgaagcagggcgaggagcccgactacgagacctacctgcacagaatcggcagaaccggcagattcggcaagaagggcctggccttcaacatgatcgaggtggacgagctgcccagcctgatgaagatccaggaccacttcaacagcagcatcaagcagctgaacgccgaggacatggacgagatcgagaagatcgactactag

SEQ ID NO: 9451 - DNA, 1014 bp, Artificial Sequence
  Description of Artificial Sequence: Synthetic coding sequence
atggccgacgccgccccccagctgggcaagagaaagagagagctggacgtggaggaggcccacgccgccagcaccgaggagaaggaggccggcgtgggcaacggcacctgcgcccccgtgagactgcccttcagcggcttcagactgcagaaggtgctgagagagagcgccagagacaagatcatcttcctgcacggcaaggtgaacgaggccagcggcgacggcgacggcgaggacgccgtggtgatcctggagaagacccccttccaggtggagcaggtggcccagctgctgaccggcagccccgagctgcagctgcagttcagcaacgacatctacagcacctaccacctgttcccccccagacagctgaacgacgtgaagaccaccgtggtgtaccccgccaccgagaagcacctgcagaagtacctgagacaggacctgagactgatcagagagaccggcgacgactacagaaacatcaccctgccccacctggagagccagagcctgagcatccagtgggtgtacaacatcctggacaagaaggccgaggccgacagaatcgtgttcgagaaccccgaccccagcgacggcttcgtgctgatccccgacctgaagtggaaccagcagcagctggacgacctgtacctgatcgccatctgccacagaagaggcatcagaagcctgagagacctgacccccgagcacctgcccctgctgagaaacatcctgcaccagggccaggaggccatcctgcagagatacagaatgaagggcgaccacctgagagtgtacctgcactacctgcccagctactaccacctgcacgtgcacttcaccgccctgggcttcgaggcccccggcagcggcgtggagagagcccacctgctggccgaggtgatcgagaacctggagtgcgaccccagacactaccagcagagaaccctgaccttcgccctgagagccgacgaccccctgctgaagctgctgcaggaggcccagcagagctag

SEQ ID NO: 9452 - DNA, 1782 bp, Artificial Sequence
  Description of Artificial Sequence: Synthetic coding sequence
atgaagctgcaggccgtgatggagaccctgctgcagagacagcagagagccagacaggagctggaggccagacagcagctgccccccgacccccccgccgccccccccggcagagccagagccgcccccgacgaggacagagagcccgagagcgccagaatgcagagagcccagatggccgccctggccgccatgagagccgccgccgccggcctgggccaccccgccagccccggcggcagcgaggacggcccccccggcagcgaggaggaggacgccgccagagagggcacccccggcagccccggcagaggcagagagggccccggcgaggagcacttcgaggacatggccagcgacgaggacatgaagcccaagtgggaggaggaggagatggaggaggacctgggcgaggacgaggaggaggaggaggaggactacgaggacgaggaggaggaggaggacgaggagggcctgggcccccccggccccgccagcctgggcaccaccgccctgttccccagaaaggcccagcccccccaggccttcagaggcgacggcgtgcccagagtgctgggcggccaggagagacccggccccggccccgcccaccccggcggcgccgcccacgtggccccccagctgcagccccccgaccacggcgactggacctacgaggagcagttcaagcagctgtacgagctggacggcgaccccaagagaaaggagttcctggacgacctgttcagcttcatgcagaagagaggcacccccgtgaacagaatccccatcatggccaagcaggtgctggacctgttcatgctgtacgtgctggtgaccgagaagggcggcctggtggaggtgatcaacaagaagctgtggagagagatcaccaagggcctgaacctgcccaccagcatcaccagcgccgccttcaccctgagaacccagtacatgaagtacctgtacccctacgagtgcgagaagagaggcctgagcaaccccaacgagctgcaggccgccatcgacagcaacagaagagagggcagaagacagagcttcggcggcagcctgttcgcctacagccccggcggcgcccacggcatgctgagcagccccaagctgcccgtgagcagcctgggcctggccgccagcaccaacggcagcagcatcacccccgcccccaagatcaagaaggaggaggacagcgccatccccatcaccgtgcccggcagactgcccgtgagcctggccggccaccccgtggtggccgcccaggccgccgccgtgcaggccgccgccgcccaggccgccgtggccgcccaggccgccgccctggagcagctgagagagaagctggagagcgccgagccccccgagaagaagatggccctggtggccgacgagcagcagagactgatgcagagagccctgcagcagaacttcctggccatggccgcccagctgcccatgagcatcagaatcaacagccaggccagcgagagcagacaggacagcgccgtgaacctgaccggcaccaacggcagcaacagcatcagcatgagcgtggagatcaacggcatcatgtacaccggcgtgctgttcgcccagccccccgcccccacccccaccagcgcccccaacaagggcggcggcggcggcggcggcagcagcagcaacgccggcggcagaggcggcaacaccggcaccagcggcggccaggccggccccgccggcctgagcacccccagcaccagcaccagcaacaacagcctgccctag

SEQ ID NO: 9453 - DNA, 6192 bp, Artificial Sequence
  Description of Artificial Sequence: Synthetic coding sequence
atggccgacggcgcccccagaccccagctgtacagaagcgtgagcttcaagctgctggagagatggagcggcggccccggcctgagagaggaggacaccgacacccccggcctgagaagaagagccagctgcagacccaccaccgccgccagaggccagcccagcagaagagtgagcaagctggccagcggccccctggccgcccccgcccagcccagacccctgagaagcctgagccccagcgtgagacagctgagcagaagattcgacgcccccagactggacgacggcagcgccggcaccagagacggcggcgtgctgcccgccgccgccgaggaggccgccgagggccccgccagaggcgcctggcccagcgtgaccgagatgagaaagctgttcggcggccccggcagcagaagacccagcgccgacagcgagagccccggcacccccagccccgacggcgccgcctgggagccccccgccagagagagcagacagccccccacccccccccccagaacctgcttccccctggccggcctgagaagcgccagacccctgaccggccccgagaccgagggcagactgagaagaccccagcagcagcaggagagagcccagagacccgccgacggcctgcacagctggcacatcttcagccagccccaggccggcgccagagccagctgcagcagcagcagcatcgccgccagctaccccgtgagcagaagcagagccgccagcagcagcgaggaggaggaggagggccccccccagctgcccggcgcccagagccccgcctaccacggcggccacagcagcggcagcgacgacgacagagacggcgagggcggccacagatggggcggcagacccggcctgagacccggcagcagcctgctggaccaggactgcagacccgacagcgacggcctgaacctgagcagcatgaacagcgccggcgtgagcggcagccccgagccccccaccagccccagagcccccagagaggagggcctgagagagtggggcagcggcagccccccctgcgtgcccggcccccaggagggcctgagacccatgagcgacagcgtgggcggcgccttcagagtggccaaggtgagcttccccagctacctggccagccccgccggcagcagaggcagcagcagatacagcagcaccgagaccctgaaggacgacgacctgtggagcagcagaggcagcggcggctggggcgtgtacagaagccccagcttcggcgccggcgagggcctgctgagaagccaggccagaaccagagccaagggccccggcggcaccagcagagccctgagagacggcggcttcgagcccgagaagagcagacagagaaagagcctgagcaaccccgacatcgccagcgagaccctgaccctgctgagcttcctgagaagcgacctgagcgagctgagagtgagaaagcccggcggcagcagcggcgacagaggcagcaaccccctggacggcagagacagccccagcgccggcggccccgtgggccagctggagcccatccccatccccgcccccgccagccccggcaccagacccaccctgaaggacctgaccgccaccctgagaagagccaagagcttcacctgcagcgagaagcccatggccagaagactgcccagaaccagcgccctgaagagcagcagcagcgagctgctgctgaccggccccggcgccgaggaggaccccctgcccctgatcgtgcaggaccagtacgtgcaggaggccagacaggtgttcgagaagatccagagaatgggcgcccagcaggacgacggcagcgacgccccccccggcagccccgactgggccggcgacgtgaccagaggccagagaagccaggaggagctgagcggccccgagagcagcctgaccgacgagggcatcggcgccgaccccgagccccccgtggccgccttctgcggcctgggcaccaccggcatgtggagacccctgagcagcagcagcgcccagaccaaccaccacggccccggcaccgaggacagcctgggcggctgggccctggtgagccccgagaccccccccacccccggcgccctgagaagaagaagaaaggtgccccccagcggcagcggcggcagcgagctgagcaacggcgaggccggcgaggcctacagaagcctgagcgaccccatcccccagagacacagagccgccaccagcgaggagcccaccggcttcagcgtggacagcaacctgctgggcagcctgagccccaagaccggcctgcccgccaccagcgccatggacgagggcctgaccagcggccacagcgactggagcgtgggcagcgaggagagcaagggctaccaggaggtgatccagagcatcgtgcagggccccggcaccctgggcagagtggtggacgacagaatcgccggcaaggcccccaagaagaagagcctgagcgaccccagcagaagaggcgagctggccggccccggcttcgagggccccggcggcgagcccatcagagaggtggagcccatgctgccccccagcagcagcgagcccatcctggtggagcagagagccgagcccgaggagcccggcgccaccagaagcagagcccagagcgagagagccctgcccgaggccctgcccccccccgccaccgcccacagaaacttccacctggaccccaagctggccgacatcctgagccccagactgatcagaagaggcagcaagaagagacccgccagaagcagccaccaggagctgagaagagacgagggcagccaggaccagaccggcagcctgagcagagccagacccagcagcagacacgtgagacacgccagcgtgcccgccaccttcatgcccatcgtggtgcccgagccccccaccagcgtgggcccccccgtggccgtgcccgagcccatcggcttccccaccagagcccaccccaccctgcaggcccccagcctggaggacgtgaccaagcagtacatgctgaacctgcacagcggcgaggtgcccgcccccgtgcccgtggacatgccctgcctgcccctggccgccccccccagcgccgaggccaagccccccgaggccgccagacccgccgacgagcccacccccgccagcaagtgctgcagcaagccccaggtggacatgagaaagcacgtggccatgaccctgctggacaccgagcagagctacgtggagagcctgagaaccctgatgcagggctacatgcagcccctgaagcagcccgagaacagcgtgctgtgcgaccccagcctggtggacgagatcttcgaccagatccccgagctgctggagcaccacgagcagttcctggagcaggtgagacactgcatgcagacctggcacgcccagcagaaggtgggcgccctgctggtgcagagcttcagcaaggacgtgctggtgaacatctacagcgcctacatcgacaacttcctgaacgccaaggacgccgtgagagtggccaaggaggccagacccgccttcctgaagttcctggagcagagcatgagagagaacaaggagaagcaggccctgagcgacctgatgatcaagcccgtgcagagaatccccagatacgagctgctggtgaaggacctgctgaagcacacccccgaggaccaccccgaccaccccctgctgctggaggcccagagaaacatcaagcaggtggccgagagaatcaacaagggcgtgagaagcgccgaggaggccgagagacacgccagagtgctgcaggagatcgaggcccacatcgagggcatggaggacctgcaggcccccctgagaagattcctgagacaggagatggtgatcgaggtgaaggccatcggcggcaagaaggacagaagcctgttcctgttcaccgacctgatcgtgtgcaccaccctgaagagaaagagcggcagcctgagaagaagcagcatgagcctgtacaccgccgccagcgtgatcgacaccgccagcaagtacaagatgctgtggaagctgcccctggaggacgccgacatcatcaagggcgccagccaggccaccaacagagagaacatccagaaggccatcagcagactggacgaggacctgaccaccctgggccagatgagcaagctgagcgagagcctgggcttcccccaccagagcctggacgacgccctgagagacctgagcgccgccatgcacagagacctgagcgagaagcaggccctgtgctacgccctgagcttcccccccaccaagctggagctgtgcgccaccagacccgagggcaccgacagctacatcttcgagttcccccaccccgacgccagactgggcttcgagcaggccttcgacgaggccaagagaaagctggccagcagcaagagctgcctggaccccgagttcctgaaggccatccccatcatgaagaccagaagcggcatgcagttcagctgcgccgcccccaccctgaacagctgccccgagcccagccccgaggtgtgggtgtgcaacagcgacggctacgtgggccaggtgtgcctgctgagcctgagagccgagcccgacgtggaggcctgcatcgccgtgtgcagcgccagaatcctgtgcatcggcgccgtgcccggcctgcagcccagatgccacagagagcccccccccagcctgagaagcccccccgagaccgcccccgagcccgccggccccgagctggacgtggaggccgccgccgacgaggaggccgccaccctggccgagcccggcccccagccctgcctgcacatcagcatcgccggcagcggcctggagatgacccccggcctgggcgagggcgaccccagacccgagctggtgcccttcgacagcgacagcgacgacgagagcagccccagccccagcggcaccctgcagagccaggccagcagaagcaccatcagcagcagcttcggcaacgaggagacccccagcagcaaggaggccaccgccgagaccaccagcagcgaggaggagcaggagcccggcttcctgcccctgagcggcagcttcggccccggcggcccctgcggcaccagccccatggacggcagagccctgagaagaagcagccacggcagcttcaccagaggcagcctggaggacctgctgagcgtggaccccgaggcctaccagagcagcgtgtggctgggcaccgaggacggctgcgtgcacgtgtaccagagcagcgacagcatcagagacagaagaaacagcatgaagctgcagcacgccgccagcgtgacctgcatcctgtacctgaacaaccaggtgttcgtgagcctggccaacggcgagctggtggtgtaccagagagaggccggccacttctgggacccccagaacttcaagagcgtgaccctgggcacccagggcagccccatcaccaagatggtgagcgtgggcggcagactgtggtgcggctgccagaacagagtgctggtgctgagccccgacaccctgcagctggagcacatgttctacgtgggccaggacagcagcagatgcgtggcctgcatggtggacagcagcctgggcgtgtgggtgaccctgaagggcagcgcccacgtgtgcctgtaccaccccgacaccttcgagcagctggccgaggtggacgtgaccccccccgtgcacagaatgctggccggcagcgacgccatcatcagacagcacaaggccgcctgcctgagaatcaccgccctgctggtgtgcgaggagctgctgtgggtgggcaccagcgccggcgtggtgctgaccatgcccaccagccccggcaccgtgagctgccccagagcccccctgagccccaccggcctgggccagggccacaccggccacgtgagattcctggccgccgtgcagctgcccgacggcttcaacctgctgtgccccacccccccccccccccccgacaccggccccgagaagctgcccagcctggagcacagagacagcccctggcacagaggccccgcccccgccagacccaagatgctggtgatcagcggcggcgacggctacgaggacttcagactgagcagcggcggcggcagcagcagcgagaccgtgggcagagacgacagcaccaaccacctgctgctgtggagagtgtag

SEQ ID NO: 9454 - DNA, 2499 bp, Artificial Sequence
  Description of Artificial Sequence: Synthetic coding sequence
atgagcgaggccggcggcgccggccccggcggctgcggcgccggcgccggcgccggcgccggccccggcgccctgcccccccagcccgccgccctgccccccgcccccccccagggcagcccctgcgccgccgccgccggcggcagcggcgcctgcggccccgccaccgccgtggccgccgccggcaccgccgagggccccggcggcggcggcagcgccagaatcgccgtgaagaaggcccagctgagaagcgcccccagagccaagaagctggagaagctgggcgtgtacagcgcctgcaaggccgaggagagctgcaagtgcaacggctggaagaaccccaaccccagccccaccccccccagagccgacctgcagcagatcatcgtgagcctgaccgagagctgcagaagctgcagccacgccctggccgcccacgtgagccacctggagaacgtgagcgaggaggagatgaacagactgctgggcatcgtgctggacgtggagtacctgttcacctgcgtgcacaaggaggaggacgccgacaccaagcaggtgtacttctacctgttcaagctgctgagaaagagcatcctgcagagaggcaagcccgtggtggagggcagcctggagaagaagccccccttcgagaagcccagcatcgagcagggcgtgaacaacttcgtgcagtacaagttcagccacctgcccgccaaggagagacagaccatcgtggagctggccaagatgttcctgaacagaatcaactactggcacctggaggcccccagccagagaagactgagaagccccaacgacgacatcagcggctacaaggagaactacaccagatggctgtgctactgcaacgtgccccagttctgcgacagcctgcccagatacgagaccacccaggtgttcggcagaaccctgctgagaagcgtgttcaccgtgatgagaagacagctgctggagcaggccagacaggagaaggacaagctgcccctggagaagagaaccctgatcctgacccacttccccaagttcctgagcatgctggaggaggaggtgtacagccagaacagccccatctgggaccaggacttcctgagcgccagcagcagaaccagccagctgggcatccagaccgtgatcaaccccccccccgtggccggcaccatcagctacaacagcaccagcagcagcctggagcagcccaacgccggcagcagcagccccgcctgcaaggccagcagcggcctggaggccaaccccggcgagaagagaaagatgaccgacagccacgtgctggaggaggccaagaagcccagagtgatgggcgacatccccatggagctgatcaacgaggtgatgagcaccatcaccgaccccgccgccatgctgggccccgagaccaacttcctgagcgcccacagcgccagagacgaggccgccagactggaggagagaagaggcgtgatcgagttccacgtggtgggcaacagcctgaaccagaagcccaacaagaagatcctgatgtggctggtgggcctgcagaacgtgttcagccaccagctgcccagaatgcccaaggagtacatcaccagactggtgttcgaccccaagcacaagaccctggccctgatcaaggacggcagagtgatcggcggcatctgcttcagaatgttccccagccagggcttcaccgagatcgtgttctgcgccgtgaccagcaacgagcaggtgaagggctacggcacccacctgatgaaccacctgaaggagtaccacatcaagcacgacatcctgaacttcctgacctacgccgacgagtacgccatcggctacttcaagaagcagggcttcagcaaggagatcaagatccccaagaccaagtacgtgggctacatcaaggactacgagggcgccaccctgatgggctgcgagctgaaccccagaatcccctacaccgagttcagcgtgatcatcaagaagcagaaggagatcatcaagaagctgatcgagagaaagcaggcccagatcagaaaggtgtaccccggcctgagctgcttcaaggacggcgtgagacagatccccatcgagagcatccccggcatcagagagaccggctggaagcccagcggcaaggagaagagcaaggagcccagagaccccgaccagctgtacagcaccctgaagagcatcctgcagcaggtgaagagccaccagagcgcctggcccttcatggagcccgtgaagagaaccgaggcccccggctactacgaggtgatcagattccccatggacctgaagaccatgagcgagagactgaagaacagatactacgtgagcaagaagctgttcatggccgacctgcagagagtgttcaccaactgcaaggagtacaacccccccgagagcgagtactacaagtgcgccaacatcctggagaagttcttcttcagcaagatcaaggaggccggcctgatcgacaagtag

SEQ ID NO: 9455 - DNA, 4950 bp, Artificial Sequence
  Description of Artificial Sequence: Synthetic coding sequence
atggccggcggcagaggcgcccccggcagaggcagagacgagccccccgagagctacccccagagacaggaccacgagctgcaggccctggaggccatctacggcgccgacttccaggacctgagacccgacgcctgcggccccgtgaaggagccccccgagatcaacctggtgctgtacccccagggcctgaccggcgaggaggtgtacgtgaaggtggacctgagagtgaagtgcccccccacctaccccgacgtggtgcccgagatcgagctgaagaacgccaagggcctgagcaacgagagcgtgaacctgctgaagagcagactggaggagctggccaagaagcactgcggcgaggtgatgatcttcgagctggcctaccacgtgcagagcttcctgagcgagcacaacaagcccccccccaagagcttccacgaggagatgctggagagaagagcccaggaggagcagcagagactgctggaggccaagagaaaggaggagcaggagcagagagagatcctgcacgagatccagagaagaaaggaggagatcaaggaggagaagaagagaaaggagatggccaagcaggagagactggagatcgccagcctgagcaaccaggaccacaccagcaagaaggaccccggcggccacagaaccgccgccatcctgcacggcggcagccccgacttcgtgggcaacggcaagcacagagccaacagcagcggcagaagcagaagagagagacagtacagcgtgtgcaacagcgaggacagccccggcagctgcgagatcctgtacttcaacatgggcagccccgaccagctgatggtgcacaagggcaagtgcatcggcagcgacgagcagctgggcaagctggtgtacaacgccctggagaccgccaccggcggcttcgtgctgctgtacgagtgggtgctgcagtggcagaagaagatgggccccttcctgaccagccaggagaaggagaagatcgacaagtgcaagaagcagatccagggcaccgagaccgagttcaacagcctggtgaagctgagccaccccaacgtggtgagatacctggccatgaacctgaaggagcaggacgacagcatcgtggtggacatcctggtggagcacatcagcggcgtgagcctggccgcccacctgagccacagcggccccatccccgtgcaccagctgagaagatacaccgcccagctgctgagcggcctggactacctgcacagcaacagcgtggtgcacaaggtgctgagcgccagcaacgtgctggtggacgccgagggcaccgtgaagatcaccgactacagcatcagcaagagactggccgacatctgcaaggaggacgtgttcgagcagaccagagtgagattcagcgacaacgccctgccctacaagaccggcaagaagggcgacgtgtggagactgggcctgctgctgctgagcctgagccagggccaggagtgcggcgagtaccccgtgaccatccccagcgacctgcccgccgacttccaggacttcctgaagaagtgcgtgtgcctggacgacaaggagagatggagcccccagcagctgctgaagcacagcttcatcaacccccagcccaagatgcccctggtggagcagagccccgaggacagcgagggccaggactacgtggagaccgtgatccccagcaacagactgcccagcgccgccttcttcagcgagacccagagacagttcagcagatacttcatcgagttcgaggagctgcagctgctgggcaagggcgccttcggcgccgtgatcaaggtgcagaacaagctggacggctgctgctacgccgtgaagagaatccccatcaaccccgccagcagacagttcagaagaatcaagggcgaggtgaccctgctgagcagactgcaccacgagaacatcgtgagatactacaacgcctggatcgagagacacgagagacccgccggccccggcacccccccccccgacagcggccccctggccaaggacgacagagccgccagaggccagcccgccagcgacaccgacggcctggacagcgtggaggccgccgcccccccccccatcctgagcagcagcgtggagtggagcaccagcggcgagagaagcgccagcgccagattccccgccaccggccccggcagcagcgacgacgaggacgacgacgaggacgagcacggcggcgtgttcagccagagcttcctgcccgccagcgacagcgagagcgacatcatcttcgacaacgaggacgagaacagcaagagccagaaccaggacgaggactgcaacgagaagaacggctgccacgagagcgagcccagcgtgaccaccgaggccgtgcactacctgtacatccagatggagtactgcgagaagagcaccctgagagacaccatcgaccagggcctgtacagagacaccgtgagactgtggagactgttcagagagatcctggacggcctggcctacatccacgagaagggcatgatccacagagacctgaagcccgtgaacatcttcctggacagcgacgaccacgtgaagatcggcgacttcggcctggccaccgaccacctggccttcagcgccgacagcaagcaggacgaccagaccggcgacctgatcaagagcgaccccagcggccacctgaccggcatggtgggcaccgccctgtacgtgagccccgaggtgcagggcagcaccaagagcgcctacaaccagaaggtggacctgttcagcctgggcatcatcttcttcgagatgagctaccaccccatggtgaccgccagcgagagaatcttcgtgctgaaccagctgagagaccccaccagccccaagttccccgaggacttcgacgacggcgagcacgccaagcagaagagcgtgatcagctggctgctgaaccacgaccccgccaagagacccaccgccaccgagctgctgaagagcgagctgctgccccccccccagatggaggagagcgagctgcacgaggtgctgcaccacaccctgaccaacgtggacggcaaggcctacagaaccatgatggcccagatcttcagccagagaatcagccccgccatcgactacacctacgacagcgacatcctgaagggcaacttcagcatcagaaccgccaagatgcagcagcacgtgtgcgagaccatcatcagaatcttcaagagacacggcgccgtgcagctgtgcacccccctgctgctgcccagaaacagacagatctacgagcacaacgaggccgccctgttcatggaccacagcggcatgctggtgatgctgcccttcgacctgagaatccccttcgccagatacgtggccagaaacaacatcctgaacctgaagagatactgcatcgagagagtgttcagacccagaaagctggacagattccaccccaaggagctgctggagtgcgccttcgacatcgtgaccagcaccaccaacagcttcctgcccaccgccgagatcatctacaccatctacgagatcatccaggagttccccgccctgcaggagagaaactacagcatctacctgaaccacaccatgctgctgaaggccatcctgctgcactgcggcatccccgaggacaagctgagccaggtgtacatcatcctgtacgacgccgtgaccgagaagctgaccagaagagaggtggaggccaagttctgcaacctgagcctgagcagcaacagcctgtgcagactgtacaagttcatcgagcagaagggcgacctgcaggacctgatgcccaccatcaacagcctgatcaagcagaagaccggcatcgcccagctggtgaagtacggcctgaaggacctggaggaggtggtgggcctgctgaagaagctgggcatcaagctgcaggtgctgatcaacctgggcctggtgtacaaggtgcagcagcacaacggcatcatcttccagttcgtggccttcatcaagagaagacagagagccgtgcccgagatcctggccgccggcggcagatacgacctgctgatcccccagttcagaggcccccaggccctgggccccgtgcccaccgccatcggcgtgagcatcgccatcgacaagatcagcgccgccgtgctgaacatggaggagagcgtgaccatcagcagctgcgacctgctggtggtgagcgtgggccagatgagcatgagcagagccatcaacctgacccagaagctgtggaccgccggcatcaccgccgagatcatgtacgactggagccagagccaggaggagctgcaggagtactgcagacaccacgagatcacctacgtggccctggtgagcgacaaggagggcagccacgtgaaggtgaagagcttcgagaaggagagacagaccgagaagagagtgctggagaccgagctggtggaccacgtgctgcagaagctgagaaccaaggtgaccgacgagagaaacggcagagaggccagcgacaacctggccgtgcagaacctgaagggcagcttcagcaacgccagcggcctgttcgagatccacggcgccaccgtggtgcccatcgtgagcgtgctggcccccgagaagctgagcgccagcaccagaagaagatacgagacccaggtgcagaccagactgcagaccagcctggccaacctgcaccagaagagcagcgagatcgagatcctggccgtggacctgcccaaggagaccatcctgcagttcctgagcctggagtgggacgccgacgagcaggccttcaacaccaccgtgaagcagctgctgagcagactgcccaagcagagatacctgaagctggtgtgcgacgagatctacaacatcaaggtggagaagaaggtgagcgtgctgttcctgtacagctacagagacgactactacagaatcctgttctag

SEQ ID NO: 9456 - DNA, 5652 bp, Artificial Sequence
  Description of Artificial Sequence: Synthetic coding sequence
atgcccgtgggcagaatcgagtgccccagcagccccagcttccccagagacatcagccacgagtgcagagtgtgcggcgtgaccgaggtgggcctgagcgcctacgccaagcacatcagcggccagctgcacaaggacaacgtggacgcccaggagagagaggacgacggcaagggcgaggaggaggaggaggactacttcgacaaggagctgatccagctgatcaagcagagaaaggagcagagcagacaggacgagcccagcaacagcaaccaggagatcaacagcgacgacagaagaccccagtggagaagagaggacagaatcccctaccaggacagagagagctacagccagcccgcctggcaccacagaggccccccccagagagactggaagtgggagaaggacggcttcaacaacaccagaaagaacagcttcccccacagcctgagaaacggcggcggccccagaggcagaagcggctggcacaagggcgtggccggcggcagcagcacctggttccacaaccacagcaacagcggcggcggctggctgagcaacagcggcgccgtggactggaaccacaacggcaccggcagaaacagcagctggctgagcgagggcaccggcggcttcagcagctggcacatgaacaacagcaacggcaactggaagagcagcgtgagaagcaccaacaactggaactacagcggccccggcgacaagttccagcccggcagaaacagaaacagcaactgccagatggaggacatgaccatgctgtggaacaagaagagcaacaagagcaacaagtacagccacgacagatacaactggcagagacaggagaacgacaagctgggcaccgtggccacctacagaggccccagcgagggcttcaccagcgacaagttccccagcgagggcctgctggacttcaacttcgagcagctggagagccagaccaccaagcaggccgacaccgccaccagcaaggtgagcggcaagaacggcagcgccgccagagagaagcccagaagatggaccccctaccccagccagaagaccctggacctgcagagcggcctgaaggacatcaccggcaacaagagcgagatgatcgagaagcccctgttcgacttcagcctgatcaccaccggcatccaggagccccagaccgacgagaccagaaacagccccacccagaagacccagaaggagatccacaccggcagcctgaaccacaaggccagcagcgacagcgccgccagcttcgaggtggtgagacagtgccccaccgccgagaagcccgagcaggagcacacccccaacaagatgcccagcctgaagagccccctgctgccctgccccgccaccaagagcctgagccagaagcaggaccccaagaacatcagcaagaacaccaagaccaacttcttcagccccggcgagcacagcaaccccagcaacaagcccaccgtggaggacaaccacggcccctacatcagcaagctgagaagcagctgcccccacgtgctgaagggcaacaagagcaccttcggcagccagaagcagagcggcgacaacctgaacgacaccctgagaaaggccaaggaggtgctgcagtgccacgagagcctgcagaaccccctgctgagcaccagcaagagcaccagaaactacgccaaggccagcagaaacgtggaggagagcgagaagggcagcctgaagatcgagttccaggtgcacgccctggaggacgagagcgacggcgagaccagcgacaccgagaagcacggcaccaagatcggcaccctgggcagcgccaccaccgagctgctgagcggcagcaccagaaccgccgacgagaaggaggaggacgacagaatcctgaagaccagcagagagctgagcaccagcccctgcaaccccatcgtgagacagaaggagagcgagctgcagatgaccagcgccgccagcccccaccccggcctgctgctggacctgaagaccagcctggaggacgcccaggtggacgacagcatcaagagccacgtgagctacgagaccgagggcttcgagagcgccagcctggacgccgagctgcagaagagcgacatcagccagcccagcggccccctgctgcccgagctgagcaagctgggcttccccgccagcctgcagagagacctgaccagacacatcagcctgaagagcaagaccggcgtgcacctgcccgagcccaacctgaacagcgccagaagaatcagaaacatcagcggccacagaaagagcgagaccgagaaggagagcggcctgaagcccaccctgagacagatcctgaacgccagcagaagaaacgtgaactgggagcaggtgatccagcaggtgaccaagaagaagcaggagctgggcaagggcctgcccagattcggcatcgagatggtgcccctggtgcagaacgagcaggaggccctggacctggacggcgagcccgacctgagcagcctggagggcttccagtgggagggcgtgagcatcagcagcagccccggcctggccagaaagagaagcctgagcgagagcagcgtgatcatggacagagcccccagcgtgtacagcttcttcagcgaggagggcaccggcaaggagaacgagccccagcagatggtgagccccagcaacagcctgagagccggccagagccagaaggccaccatgcacctgaagcaggaggtgacccccagagccgccagcctgagaaccggcgagagagccgagaacgtggccacccagagaagacacagcgcccagctgagcagcgaccacatcatccccctgatgcacctggccaaggacctgaacagccaggagagaagcatcccccccagcgagaaccagaacagccaggagagcaacggcgagggcaactgcctgagcagcagcgccagcagcgccctggccatcagcagcctggccgacgccgccaccgacagcagctgcaccagcggcgccgagcagaacgacggccagagcatcagaaagaagagaagagccaccggcgacggcagcagccccgagctgcccagcctggagagaaagaacaagagaagaaagatcaagggcaagaaggagagaagccaggtggaccagctgctgaacatcagcctgagagaggaggagctgagcaagagcctgcagtgcatggacaacaacctgctgcaggccagagccgccctgcagaccgcctacgtggaggtgcagagactgctgatgctgaagcagcagatcaccatggagatgagcgccctgagaacccacagaatccagatcctgcagggcctgcaggagacctacgagcccagcgagcaccccgaccaggtgccctgcagcctgaccagagagagaagaaacagcagaagccagaccagcatcgacgccgccctgctgcccacccccttcttccccctgttcctggagccccccagcagccacgtgagccccagccccaccggcgccagcctgcagatcaccaccagccccaccttccagacccacggcagcgtgcccgcccccgacagcagcgtgcagatcaagcaggagcccatgagccccgagcaggacgagaacgtgaacgccgtgccccccagcagcgcctgcaacgtgagcaaggagctgctggaggccaacagagagatcagcgacagctgccccgtgtaccccgtgatcaccgccagactgagcctgcccgagagcaccgagagcttccacgagcccagccaggagctgaagttcagcgtggagcagagaaacaccagaaacagagagaacagccccagcagccagagcgccggcctgagcagcatcaacaaggagggcgaggagcccaccaagggcaacagcggcagcgaggcctgcaccagcagcttcctgagactgagcttcgccagcgagacccccctggagaaggagccccacagccccgccgaccagcccgagcagcaggccgagagcaccctgaccagcgccgagaccagaggcagcaagaagaagaagaagctgagaaagaagaagagcctgagagccgcccacgtgcccgagaacagcgacaccgagcaggacgtgctgaccgtgaagcccgtgagaaaggtgaaggccggcaagctgatcaagggcggcaaggtgaccaccagcacctgggaggacagcagaaccggcagagagcaggagagcgtgagagacgagcccgacagcgacagcagcctggaggtgctggagatccccaacccccagctggaggtggtggccatcgacagcagcgagagcggcgaggagaagcccgacagccccagcaagaaggacatctggaacagcaccgagcagaaccccctggagaccagcagaagcggctgcgacgaggtgagcagcaccagcgagatcggcaccagatacaaggacggcatccccgtgagcgtggccgagacccagaccgtgatcagcagcatcaagggcagcaagaacagcagcgagatcagcagcgagcccggcgacgacgacgagcccaccgagggcagcttcgagggccaccaggccgccgtgaacgccatccagatcttcggcaacctgctgtacacctgcagcgccgacaagaccgtgagagtgtacaacctggtgagcagaaagtgcatcggcgtgttcgagggccacaccagcaaggtgaactgcctgctggtgacccagaccagcggcaagaacgccgccctgtacaccggcagcagcgaccacaccatcagatgctacaacgtgaagagcagagagtgcgtggagcagctgcagctggaggacagagtgctgtgcctgcacagcagatggagaatcctgtacgccggcctggccaacggcaccgtggtgaccttcaacatcaagaacaacaagagactggagatcttcgagtgccacggccccagagccgtgagctgcctggccaccgcccaggagggcgccagaaagctgctggtggtgggcagctacgactgcaccatcagcgtgagagacgccagaaacggcctgctgctgagaaccctggagggccacagcaagaccatcctgtgcatgaaggtggtgaacgacctggtgttcagcggcagcagcgaccagagcgtgcacgcccacaacatccacaccggcgagctggtgagaatctacaagggccacaaccacgccgtgaccgtggtgaacatcctgggcaaggtgatggtgaccgcctgcctggacaagttcgtgagagtgtacgagctgcagagccacgacagactgcaggtgtacggcggccacaaggacatgatcatgtgcatgaccatccacaagagcatgatctacaccggctgctacgacggcagcatccaggccgtgagactgaacctgatgcagaactacagatgctggtggcacggctgcagcctgatcttcggcgtggtggaccacctgaagcagcacctgctgaccgaccacaccaaccccaacttccagaccctgaagtgcagatggaagaactgcgacgccttcttcaccgccagaaagggcagcaagcaggacgccgccggccacatcgagagacacgccgaggacgacagcaagatcgacagctag

SEQ ID NO: 9457 - DNA, 588 bp, Artificial Sequence
  Description of Artificial Sequence: Synthetic coding sequence
atggccgagcccgtgcaggaggagctgagcgtgctggccgccatcttctgcagaccccacgagtgggaggtgctgagcagaagcgagaccgacggcaccgtgttcagaatccacaccaaggccgagggcttcatggacgtggacatccccctggagctggtgttccacctgcccgtgaactaccccagctgcctgcccggcatcagcatcaacagcgagcagctgaccagagcccagtgcgtgaccgtgaaggagaacctgctggagcaggccgagagcctgctgagcgagcccatggtgcacgagctggtgctgtggatccagcagaacctgagacacatcctgagccagcccgagaccggcagcggcagcgagaagtgcaccttcagcaccagcaccaccatggacgacggcctgtggatcaccctgctgcacctggaccacatgagagccaagaccaagtacgtgaagatcgtggagaagtgggccagcgacctgagactgaccggcagactgatgttcatgggcaagatcatcctgatcctgctgcagggcgacagaaacaacctgaaggtgcccaagagctag

SEQ ID NO: 9458 - DNA, 1119 bp, Artificial Sequence
  Description of Artificial Sequence: Synthetic coding sequence
atgagcagaagaagattcgactgcagaagcatcagcggcctgctgaccaccaccccccagatccccatcaagatggagaacttcaacaacttctacatcctgaccagcaaggagctgggcagaggcaagttcgccgtggtgagacagtgcatcagcaagagcaccggccaggagtacgccgccaagttcctgaagaagagaagaagaggccaggactgcagagccgagatcctgcacgagatcgccgtgctggagctggccaagagctgccccagagtgatcaacctgcacgaggtgtacgagaacaccagcgagatcatcctgatcctggagtacgccgccggcggcgagatcttcagcctgtgcctgcccgagctggccgagatggtgagcgagaacgacgtgatcagactgatcaagcagatcctggagggcgtgtactacctgcaccagaacaacatcgtgcacctggacctgaagccccagaacatcctgctgagcagcatctaccccctgggcgacatcaagatcgtggacttcggcatgagcagaaagatcggccacgcctgcgagctgagagagatcatgggcacccccgagtacctggcccccgagatcctgaactacgaccccatcaccaccgccaccgacatgtggaacatcggcatcatcgcctacatgctgctgacccacaccagccccttcgtgggcgaggacaaccaggagacctacctgaacatcagccaggtgaacgtggactacagcgaggagaccttcagcagcgtgagccagctggccaccgacttcatccagagcctgctggtgaagaaccccgagaagagacccaccgccgagatctgcctgagccacagctggctgcagcagtgggacttcgagaacctgttccaccccgaggagaccagcagcagcagccagacccaggaccacagcgtgagaagcagcgaggacaagaccagcaagagcagctgcaacggcacctgcggcgacagagaggacaaggagaacatccccgaggacagcagcatggtgagcaagagattcagattcgacgacagcctgcccaacccccacgagctggtgagcgacctgctgtgctag

SEQ ID NO: 9459 - DNA, 930 bp, Artificial Sequence
  Description of Artificial Sequence: Synthetic coding sequence
atggaggccgccagaaccgccgtgctgagagtgaagagaaagagaagcgccgagcccgccgaggccctggtgctggcctgcaagagactgagaagcgacgccgtggagagcgccgcccagaagaccagcgagggcctggagagagccgccgagaacaacgtgttccacctggtggccaccgtgtgcagccaggaggagcccgtgcagcccctgctgagagaggtgctgagacccagcagagacagccagcagagagtgagaagaaacctgagagccagcgccagagaggtgagacaggagggcagatacagagtgctgagcagcagaagaagcctgggcaccaccagcagcggccaggagagcgagtacacccccggcaaccccgaggccgccggcaacagcggcttccagctgctggacctggtgcacgaggagggcgagcccgaggccgccagcgccggcagctgcaagaccagcgaccccgacgtgatcctgtgcaacagcgtggagctgatcagagagagactgaccgtgagcgaggacggccccggcgtgagaagacaggaggagcagaagcacgacgactacgtgtacgacatctactacctggagaccgccacccccggctggatcgagaacatcctgagcgtgcagccctacagccaggagtgggagctggtgaacgacgaccaggagcccgaggacatctacgacgacgaggacgacgagaacagcgagaacaactggagaaacgagtaccccgaggaggagagcagcgacggcgacgaggacagcagaggcagcgccgactacaacagcctgagcgaggaggagagaggcagcagcagacagagaatgtggagcaagtaccccctggacgtgcagaaggagttcggctacgacagcccccacgacctggacagcgactag

SEQ ID NO: 9460 - DNA, 1068 bp, Artificial Sequence
  Description of Artificial Sequence: Synthetic coding sequence
atggccgacaacagcagcgacgagtgcgaggaggagaacaacaaggtgctgagagagggcatgccccaggcccccggccacagaggcaaggacatggaccccgtgccccccgcccccgccagcctgaagtgccaccagacccccagccacgtgctggagagagtgggctggtacagagagagccagaagcacagaaaggagaagaagaagaccagccagctgaccccccagagaggcttcagcgagaacgaggacgacgacgacgacgacgacgacagcagcgagaccgacagcgacagcgacgacgacgacgaggagcacggcgcccccctggagggcgcctacgaccccgccgactacgagcacctgcccgtgagcgccgagatcaaggagctgttccagtacatcagcagatacaccccccagctgatcgacctggaccacaagctgaagcccttcatccccgacttcatccccgccgtgggcgacatcgacgccttcctgaaggtgcccagacccgacggcaagcccgacaacctgggcctgctggtgctggacgagcccagcaccaagcagagcgaccccaccgtgctgagcctgtggctgaccgagaacagcaagcagcacaacatcacccagcacatgaaggtgaagagcctggaggacgccgagaagaaccccaaggccatcgacacctggatcgagagcatcagcgagctgcacagaagcaagccccccgccaccgtgcactacaccagacccatgcccgacatcgacaccctgatgcaggagtggagccccgagttcgaggagctgctgggcaaggtgagcctgcccaccgccgagatcgactgcagcctggccgagtacatcgacatgatctgcgccatcctggacatccccgtgtacaagagcagaatccagagcctgcacctgctgttcagcctgtacagcgagttcaagaacagccagcacttcaaggccctggccgagggcaagaaggccttcacccccagcagcaacagcaccagccaggccggcgacatggagaccctgaccttcagctag

SEQ ID NO: 9461 - DNA, 915 bp, Artificial Sequence
  Description of Artificial Sequence: Synthetic coding sequence
atggccgacaacagcagcgacgagtgcgaggaggagaacaacaaggagaagaagaagaccagccagctgaccccccagagaggcttcagcgagaacgaggacgacgacgacgacgacgacgacagcagcgagaccgacagcgacagcgacgacgacgacgaggagcacggcgcccccctggagggcgcctacgaccccgccgactacgagcacctgcccgtgagcgccgagatcaaggagctgttccagtacatcagcagatacaccccccagctgatcgacctggaccacaagctgaagcccttcatccccgacttcatccccgccgtgggcgacatcgacgccttcctgaaggtgcccagacccgacggcaagcccgacaacctgggcctgctggtgctggacgagcccagcaccaagcagagcgaccccaccgtgctgagcctgtggctgaccgagaacagcaagcagcacaacatcacccagcacatgaaggtgaagagcctggaggacgccgagaagaaccccaaggccatcgacacctggatcgagagcatcagcgagctgcacagaagcaagccccccgccaccgtgcactacaccagacccatgcccgacatcgacaccctgatgcaggagtggagccccgagttcgaggagctgctgggcaaggtgagcctgcccaccgccgagatcgactgcagcctggccgagtacatcgacatgatctgcgccatcctggacatccccgtgtacaagagcagaatccagagcctgcacctgctgttcagcctgtacagcgagttcaagaacagccagcacttcaaggccctggccgagggcaagaaggccttcacccccagcagcaacagcaccagccaggccggcgacatggagaccctgaccttcagctag

SEQ ID NO: 9462 - DNA, 1335 bp, Artificial Sequence
  Description of Artificial Sequence: Synthetic coding sequence
atgagagagatcgtgcacctgcaggccggccagtgcggcaaccagatcggcgccaagttctgggaggtgatcagcgacgagcacggcatcgaccccaccggcacctaccacggcgacagcgacctgcagctggagagaatcaacgtgtactacaacgaggccaccggcggcaactacgtgcccagagccgtgctggtggacctggagcccggcaccatggacagcgtgagaagcggccccttcggccagatcttcagacccgacaacttcgtgttcggccagagcggcgccggcaacaactgggccaagggccactacaccgagggcgccgagctggtggacgccgtgctggacgtggtgagaaaggaggccgagagctgcgactgcctgcagggcttccagctgacccacagcctgggcggcggcaccggcagcggcatgggcaccctgctgatcagcaagatcagagaggagttccccgacagaatcatgaacaccttcagcgtggtgcccagccccaaggtgagcgacaccgtggtggagccctacaacgccaccctgagcgtgcaccagctggtggagaacaccgacgagacctactgcatcgacaacgaggccctgtacgacatctgcttcagaaccctgaagctgaccacccccacctacggcgacctgaaccacctggtgagcgccaccatgagcggcgtgaccacctgcctgagattccccggccagctgaacgccgacctgagaaagctggccgtgaacatggtgcccttccccagactgcacttcttcatgcccggcttcgcccccctgaccagcagaggcagccagcagtacagagccctgaccgtgcccgagctgacccagcagatgttcgacgccaagaacatgatggccgcctgcgaccccagacacggcagatacctgaccgtggccgccgtgttcagaggcagaatgagcatgaaggaggtggacgagcagatgctgagcgtgcagagcaagaacagcagctacttcgtggagtggatccccaacaacgtgaagaccgccgtgtgcgacatcccccccagaggcctgaagatggccgccaccttcatcggcaacagcaccgccatccaggagctgttcaagagaatcagcgagcagttcaccgccatgttcagaagaaaggccttcctgcactggtacaccggcgagggcatggacgagatggagttcaccgaggccgagagcaacatgaacgacctggtgagcgagtaccagcagtaccaggacgccaccgccgaggagggcgagttcgaggaggaggccgaggaggaggtggcctag

SEQ ID NO: 9463 - DNA, 1398 bp, Artificial Sequence
  Description of Artificial Sequence: Synthetic coding sequence
atggagcccagcagcctggagctgcccgccgacaccgtgcagagaatcgccgccgagctgaagtgccaccccaccgacgagagagtggccctgcacctggacgaggaggacaagctgagacacttcagagagtgcttctacatccccaagatccaggacctgccccccgtggacctgagcctggtgaacaaggacgagaacgccatctacttcctgggcaacagcctgggcctgcagcccaagatggtgaagacctacctggaggaggagctggacaagtgggccaagatcgccgcctacggccacgaggtgggcaagagaccctggatcaccggcgacgagagcatcgtgggcctgatgaaggacatcgtgggcgccaacgagaaggagatcgccctgatgaacgccctgaccgtgaacctgcacctgctgatgctgagcttcttcaagcccacccccaagagatacaagatcctgctggaggccaaggccttccccagcgaccactacgccatcgagagccagctgcagctgcacggcctgaacatcgaggagagcatgagaatgatcaagcccagagagggcgaggagaccctgagaatcgaggacatcctggaggtgatcgagaaggagggcgacagcatcgccgtgatcctgttcagcggcgtgcacttctacaccggccagcacttcaacatccccgccatcaccaaggccggccaggccaagggctgctacgtgggcttcgacctggcccacgccgtgggcaacgtggagctgtacctgcacgactggggcgtggacttcgcctgctggtgcagctacaagtacctgaacgccggcgccggcggcatcgccggcgccttcatccacgagaagcacgcccacaccatcaagcccgccctggtgggctggttcggccacgagctgagcaccagattcaagatggacaacaagctgcagctgatccccggcgtgtgcggcttcagaatcagcaacccccccatcctgctggtgtgcagcctgcacgccagcctggagatcttcaagcaggccaccatgaaggccctgagaaagaagagcgtgctgctgaccggctacctggagtacctgatcaagcacaactacggcaaggacaaggccgccaccaagaagcccgtggtgaacatcatcacccccagccacgtggaggagagaggctgccagctgaccatcaccttcagcgtgcccaacaaggacgtgttccaggagctggagaagagaggcgtggtgtgcgacaagagaaaccccaacggcatcagagtggcccccgtgcccctgtacaacagcttccacgacgtgtacaagttcaccaacctgctgaccagcatcctggacagcgccgagaccaagaactag

SEQ ID NO: 9464 - DNA, 4758 bp, Artificial Sequence
  Description of Artificial Sequence: Synthetic coding sequence
atgaacagccagccccagaccagaagccccttcttccagagaccccagatccagccccccagagccaccatccccaacagcagccccagcatcagacccggcgcccagacccccaccgccgtgtaccaggccaaccagcacatcatgatggtgaaccacctgcccatgccctaccccgtgccccagggcccccagtactgcatcccccagtacagacacagcggccccccctacgtgggccccccccagcagtaccccgtgcagccccccggccccggccccttctaccccggccccggccccggcgacttccccaacgcctacggcacccccttctaccccagccagcccgtgtaccagagcgcccccatcatcgtgcccacccagcagcagcccccccccgccaagagagagaagaagaccatcagaatcagagaccccaaccagggcggcaaggacatcaccgaggagatcatgagcggcggcggcagcagaaaccccaccccccccatcggcagacccaccagcacccccacccccccccagcagctgcccagccaggtgcccgagcacagccccgtggtgtacggcaccgtggagagcgcccacctggccgccagcacccccgtgaccgccgccagcgaccagaagcaggaggagaagcccaagcccgaccccgtgctgaagagccccagccccgtgctgagactggtgctgagcggcgagaagaaggagcaggagggccagaccagcgagaccaccgccatcgtgagcatcgccgagctgcccctgccccccagccccaccaccgtgagcagcgtggccagaagcaccatcgccgcccccaccagcagcgccctgagcagccagcccatcttcaccaccgccatcgacgacagatgcgagctgagcagccccagagaggacaccatccccatccccagcctgaccagctgcaccgagaccagcgaccccctgcccaccaacgagaacgacgacgacatctgcaagaagccctgcagcgtggcccccaacgacatccccctggtgagcagcaccaacctgatcaacgagatcaacggcgtgagcgagaagctgagcgccaccgagagcatcgtggagatcgtgaagcaggaggtgctgcccctgaccctggagctggagatcctggagaacccccccgaggagatgaagctggagtgcatccccgcccccatcacccccagcaccgtgcccagcttcccccccaccccccccaccccccccgccagccccccccacacccccgtgatcgtgcccgccgccgccaccaccgtgagcagccccagcgccgccatcaccgtgcagagagtgctggaggaggacgagagcatcagaacctgcctgagcgaggacgccaaggagatccagaacaagatcgaggtggaggccgacggccagaccgaggagatcctggacagccagaacctgaacagcagaagaagccccgtgcccgcccagatcgccatcaccgtgcccaagacctggaagaagcccaaggacagaaccagaaccaccgaggagatgctggaggccgagctggagctgaaggccgaggaggagctgagcatcgacaaggtgctggagagcgagcaggacaagatgagccagggcttccaccccgagagagaccccagcgacctgaagaaggtgaaggccgtggaggagaacggcgaggaggccgagcccgtgagaaacggcgccgagagcgtgagcgagggcgagggcatcgacgccaacagcggcagcaccgacagcagcggcgacggcgtgaccttccccttcaagcccgagagctggaagcccaccgacaccgagggcaagaagcagtacgacagagagttcctgctggacttccagttcatgcccgcctgcatccagaagcccgagggcctgccccccatcagcgacgtggtgctggacaagatcaaccagcccaagctgcccatgagaaccctggaccccagaatcctgcccagaggccccgacttcacccccgccttcgccgacttcggcagacagacccccggcggcagaggcgtgcccctgctgaacgtgggcagcagaagaagccagcccggccagagaagagagcccagaaagatcatcaccgtgagcgtgaaggaggacgtgcacctgaagaaggccgagaacgcctggaagcccagccagaagagagacagccaggccgacgaccccgagaacatcaagacccaggagctgttcagaaaggtgagaagcatcctgaacaagctgaccccccagatgttcaaccagctgatgaagcaggtgagcggcctgaccgtggacaccgaggagagactgaagggcgtgatcgacctggtgttcgagaaggccatcgacgagcccagcttcagcgtggcctacgccaacatgtgcagatgcctggtgaccctgaaggtgcccatggccgacaagcccggcaacaccgtgaacttcagaaagctgctgctgaacagatgccagaaggagttcgagaaggacaaggccgacgacgacgtgttcgagaagaagcagaaggagctggaggccgccagcgcccccgaggagagaaccagactgcacgacgagctggaggaggccaaggacaaggccagaagaagaagcatcggcaacatcaagttcatcggcgagctgttcaagctgaagatgctgaccgaggccatcatgcacgactgcgtggtgaagctgctgaagaaccacgacgaggagagcctggagtgcctgtgcagactgctgaccaccatcggcaaggacctggacttcgagaaggccaagcccagaatggaccagtacttcaaccagatggagaagatcgtgaaggagagaaagaccagcagcagaatcagattcatgctgcaggacgtgatcgacctgagactgtgcaactgggtgagcagaagagccgaccagggccccaagaccatcgagcagatccacaaggaggccaagatcgaggagcaggaggagcagagaaaggtgcagcagctgatgaccaaggagaagagaagacccggcgtgcagagagtggacgagggcggctggaacaccgtgcagggcgccaagaacagcagagtgctggaccccagcaagttcctgaagatcaccaagcccaccatcgacgagaagatccagctggtgcccaaggcccagctgggcagctggggcaagggcagcagcggcggcgccaaggccagcgagaccgacgccctgagaagcagcgccagcagcctgaacagattcagcgccctgcagccccccgcccccagcggcagcacccccagcacccccgtggagttcgacagcagaagaaccctgaccagcagaggcagcatgggcagagagaagaacgacaagcccctgcccagcgccaccgccagacccaacaccttcatgagaggcggcagcagcaaggacctgctggacaaccagagccaggaggagcagagaagagagatgctggagaccgtgaagcagctgaccggcggcgtggacgtggagagaaacagcaccgaggccgagagaaacaagaccagagagagcgccaagcccgagatcagcgccatgagcgcccacgacaaggccgccctgagcgaggaggagctggagagaaagagcaagagcatcatcgacgagttcctgcacatcaacgacttcaaggaggccatgcagtgcgtggaggagctgaacgcccagggcctgctgcacgtgttcgtgagagtgggcgtggagagcaccctggagagaagccagatcaccagagaccacatgggccagctgctgtaccagctggtgcagagcgagaagctgagcaagcaggacttcttcaagggcttcagcgagaccctggagctggccgacgacatggccatcgacatcccccacatctggctgtacctggccgagctggtgacccccatgctgaaggagggcggcatcagcatgagagagctgaccatcgagttcagcaagcccctgctgcccgtgggcagagccggcgtgctgctgagcgagatcctgcacctgctgtgcaagcagatgagccacaagaaggtgggcgccctgtggagagaggccgacctgagctggaaggacttcctgcccgagggcgaggacgtgcacaacttcctgctggagcagaagctggacttcatcgagagcgacagcccctgcagcagcgaggccctgagcaagaaggagctgagcgccgaggagctgtacaagagactggagaagctgatcatcgaggacaaggccaacgacgagcagatcttcgactgggtggaggccaacctggacgagatccagatgagcagccccaccttcctgagagccctgatgaccgccgtgtgcaaggccgccatcatcgccgacagcagcaccttcagagtggacaccgccgtgatcaagcagagagtgcccatcctgctgaagtacctggacagcgacaccgagaaggagctgcaggccctgtacgccctgcaggccagcatcgtgaagctggaccagcccgccaacctgctgagaatgttcttcgactgcctgtacgacgaggaggtgatcagcgaggacgccttctacaagtgggagagcagcaaggaccccgccgagcagaacggcaagggcgtggccctgaagagcgtgaccgccttcttcacctggctgagagaggccgaggaggagagcgaggacaactag

SEQ ID NO: 9465 - DNA, 378 bp, Artificial Sequence
  Description of Artificial Sequence: Synthetic coding sequence
atggcccccgccaagaagggcggcgagaagaagaagggcagaagcgccatcaacgaggtggtgaccagagagtacaccatcaacatccacaagagaatccacggcgtgggcttcaagaagagagcccccagagccctgaaggagatcagaaagttcgccatgaaggagatgggcacccccgacgtgagaatcgacaccagactgaacaaggccgtgtgggccaagggcatcagaaacgtgccctacagaatcagagtgagactgagcagaaagagaaacgaggacgaggacagccccaacaagctgtacaccctggtgacctacgtgcccgtgaccaccttcaagaacctgcagaccgtgaacgtggacgagaactag

SEQ ID NO: 9466 - DNA, 1590 bp, Artificial Sequence
  Description of Artificial Sequence: Synthetic coding sequence
atgctggtgctgttcgagaccagcgtgggctacgccatcttcaaggtgctgaacgagaagaagctgcaggaggtggacagcctgtggaaggagttcgagacccccgagaaggccaacaagatcgtgaagctgaagcacttcgagaagttccaggacaccgccgaggccctggccgccttcaccgccctgatggagggcaagatcaacaagcagctgaagaaggtgctgaagaagatcgtgaaggaggcccacgagcccctggccgtggccgacgccaagctgggcggcgtgatcaaggagaagctgaacctgagctgcatccacagccccgtggtgaacgagctgatgagaggcatcagaagccagatggacggcctgatccccggcgtggagcccagagagatggccgccatgtgcctgggcctggcccacagcctgagcagatacagactgaagttcagcgccgacaaggtggacaccatgatcgtgcaggccatcagcctgctggacgacctggacaaggagctgaacaactacatcatgagatgcagagagtggtacggctggcacttccccgagctgggcaagatcatcagcgacaacctgacctactgcaagtgcctgcagaaggtgggcgacagaaagaactacgccagcgccaagctgagcgagctgctgcccgaggaggtggaggccgaggtgaaggccgccgccgagatcagcatgggcaccgaggtgagcgaggaggacatctgcaacatcctgcacctgtgcacccaggtgatcgagatcagcgagtacagaacccagctgtacgagtacctgcagaacagaatgatggccatcgcccccaacgtgaccgtgatggtgggcgagctggtgggcgccagactgatcgcccacgccggcagcctgctgaacctggccaagcacgccgccagcaccgtgcagatcctgggcgccgagaaggccctgttcagagccctgaagagcagaagagacacccccaagtacggcctgatctaccacgccagcctggtgggccagaccagccccaagcacaagggcaagatcagcagaatgctggccgccaagaccgtgctggccatcagatacgacgccttcggcgaggacagcagcagcgccatgggcgtggagaacagagccaagctggaggccagactgagaaccctggaggacagaggcatcagaaagatcagcggcaccggcaaggccctggccaagaccgagaagtacgagcacaagagcgaggtgaagacctacgaccccagcggcgacagcaccctgcccacctgcagcaagaagagaaagatcgagcaggtggacaaggaggacgagatcaccgagaagaaggccaagaaggccaagatcaaggtgaaggtggaggaggaggaggaggagaaggtggccgaggaggaggagaccagcgtgaagaagaagaagaagagaggcaagaagaagcacatcaaggaggagcccctgagcgaggaggagccctgcaccagcaccgccatcgccagccccgagaagaagaagaagaagaagaagaagagagagaacgaggactag

SEQ ID NO: 9467 - DNA, 738 bp, Artificial Sequence
  Description of Artificial Sequence: Synthetic coding sequence
atgaacggcagagccgacttcagagagcccaacgccgaggtgcccagacccatcccccacatcggccccgactacatccccaccgaggaggagagaagagtgttcgccgagtgcaacgacgagagcttctggttcagaagcgtgcccctggccgccaccagcatgctgatcacccagggcctgatcagcaagggcatcctgagcagccaccccaagtacggcagcatccccaagctgatcctggcctgcatcatgggctacttcgccggcaagctgagctacgtgaagacctgccaggagaagttcaagaagctggagaacagccccctgggcgaggccctgagaagcggccaggccagaagaagcagcccccccggccactactaccagaagagcaagtacgacagcagcgtgagcggccagagcagcttcgtgaccagccccgccgccgacaacatcgagatgctgccccactacgagcccatccccttcagcagcagcatgaacgagagcgcccccaccggcatcaccgaccacatcgtgcagggccccgaccccaacctggaggagagccccaagagaaagaacatcacctacgaggagctgagaaacaagaacagagagagctacgaggtgagcctgacccagaagaccgaccccagcgtgagacccatgcacgagagagtgcccaagaaggaggtgaaggtgaacaagtacggcgacacctgggacgagtag

SEQ ID NO: 9468 - DNA, 1746 bp, Artificial Sequence
  Description of Artificial Sequence: Synthetic coding sequence
atggaggacgtgaacagcaacgtgaacgccgaccaggaggtgagaaagctgcaggagctggtgaagaagctggagaagcagaacgagcagctgagaagcagaagcggcgccgtgcagggcgccggcagcctgggccccggcagccccgtgagagccggcgccagcatccccagcagcggcgccgccagccccagaggcttccccctgggcctgagcgccaagagcggcggcggccccggcagcggccccagaagaaccagcagcgaggagctgagagacgccaccagcctgctggccgccggcgagggcggcctgctggacgaggtggagcccctgagacccgacgagctggagagactgagcggctgggaggaggaggaggagagctggctgtacagcagccccaagaagaagctgacccccatgcagaagagcgtgagccccctggtgtggtgcagacaggtgctggactaccccagccccgacgtggagtgcgccaagaagagcctgatccacaagctggaccagaccatgagcgccctgaagagacagaacctgtacaacaaccccttcaacagcatgagctacaccagcccctacagccccaacgccagcagcccctacagcagcggcttcaacagccccagcagcacccccgtgagaccccccatcgtgaagcagctgatcctgcccggcaacagcggcaacctgaagagcagcgacagaaacccccccctgagcccccagagcagcatcgacagcgagctgagcgccagcgagctggacgaggacagcatcggcagcaactacaagctgaacgacgtgaccgacgtgcagatcctggccagaatgcaggaggagagcctgagacaggagtacgccgccaccaccagcagaagaagcagcggcagcagctgcaacagcaccagaagaggcaccttcagcgaccaggagctggacgcccagagcctggacgacgaggacgacaacatgcaccacgccgtgtaccccgccgtgaacagattcagccccagccccagaaacagccccagacccagccccaagcagagccccagaaacagccccagaagcagaagccccgccagaggcatcgagtacagcagagtgagcccccagcccatgatcagcagactgcagcagcccagactgagcctgcagggccaccccaccgacctgcagaccagcaacgtgaagaacgaggagaagctgagaagaagcctgcccaacctgagcagaaccagcaacacccaggtggacagcgtgaagagcagcagaagcgacagcaacttccaggtgcccaacggcggcatccccagaatgcagccccaggccagcgccatccccagccccggcaagttcagaagccccgccgcccccagccccctggccctgagacagcccgtgaaggccttcagcaaccacggcagcggcagccccggcagccaggagatcacccagctgacccagaccaccagcagccccggcccccccatggtgcagagcaccgtgagcgccaacccccccagcaacatcaacagcgccaccctgaccagacccgccggcaccaccgccatgagaagcggcctgcccagacccagcgcccccagcgccggcggcatccccgtgcccagaagcaagctggcccagcccgtgagaagaagcctgcccgcccccaagacctacggcagcatgaaggacgacagctggaaggacggctgctactag

SEQ ID NO: 9469 - DNA, 3153 bp, Artificial Sequence
  Description of Artificial Sequence: Synthetic coding sequence
atgctgtgctggggctactggagcctgggccagcccggcatcagcaccaacctgcagggcatcgtggccgagccccaggtgtgcggcttcatcagcgacagaagcgtgaaggaggtggcctgcggcggcaaccacagcgtgttcctgctggaggacggcgaggtgtacacctgcggcctgaacaccaagggccagctgggccacgagagagagggcaacaagcccgagcagatcggcgccctggccgaccagcacatcatccacgtggcctgcggcgagagccacagcctggccctgagcgacagaggccagctgttcagctggggcgccggcagcgacggccagctgggcctgatgaccaccgaggacagcgtggccgtgcccagactgatccagaagctgaaccagcagaccatcctgcaggtgagctgcggcaactggcactgcctggccctggccgccgacggccagttcttcacctggggcaagaacagccacggccagctgggcctgggcaaggagttccccagccaggccagcccccagagagtgagaagcctggagggcatccccctggcccaggtggccgccggcggcgcccacagcttcgccctgagcctgagcggcgccgtgttcggctggggcatgaacaacgccggccagctgggcctgagcgacgagaaggacagagagagcccctgccacgtgaagctgctgagaacccagaaggtggtgtacatcagctgcggcgaggagcacaccgccgtgctgaccaagagcggcggcgtgttcaccttcggcgccggcagctgcggccagctgggccacgacagcatgaacgacgaggtgaaccccagaagagtgctggagctgatgggcagcgaggtgacccagatcgcctgcggcagacagcacaccctggccttcgtgcccagcagcggcctgatctacgccttcggctgcggcgccagaggccagctgggcaccggccacacctgcaacgtgaagtgccccagccccgtgaagggctactgggccgcccacagcggccagctgagcgccagagccgacagattcaagtaccacatcgtgaagcagatcttcagcggcggcgaccagaccttcgtgctgtgcagcaagtacgagaactacagccccgccgtggacttcagaaccatgaaccaggcccactacaccagcctgatcaacgacgagaccatcgccgtgtggagacagaagctgagcgagcacaacaacgccaacaccatcaacggcgtggtgcagatcctgagcagcgccgcctgctggaacggcagcttcctggagaagaagatcgacgagcacttcaagaccagccccaagatccccggcatcgacctgaacagcaccagagtgctgttcgagaagctgatgaacagccagcacagcatgatcctggagcagatcctgaacagcttcgagagctgcctgatcccccagctgagcagcagcccccccgacgtggaggccatgagaatctacctgatcctgcccgagttccccctgctgcaggacagcaagtactacatcaccctgaccatccccctggccatggccatcctgagactggacaccaaccccagcaaggtgctggacaactggtggagccaggtgtgccccaagtacttcatgaagctggtgaacctgtacaagggcgccgtgctgtacctgctgagaggcagaaagaccttcctgatccccgtgctgttcaacaactacatcaccgccgccctgaagctgctggagaagctgtacaaggtgaacctgaaggtgaagcacgtggagtacgacaccttctacatccccgagatcagcaacctggtggacatccaggaggactacctgatgtggttcctgcaccaggccggcatgaaggccagacccagcatcatccaggacaccgtgaccctgtgcagctaccccttcatcttcgacgcccaggccaagaccaagatgctgcagaccgacgccgagctgcagatgcaggtggccgtgaacggcgccaacctgcagaacgtgttcatgctgctgaccctggagcccctgctggccagaagccccttcctggtgctgcacgtgagaagaaacaacctggtgggcgacgccctgagagagctgagcatccacagcgacatcgacctgaagaagcccctgaaggtgatcttcgacggcgaggaggccgtggacgccggcggcgtgaccaaggagttcttcctgctgctgctgaaggagctgctgaaccccatctacggcatgttcacctactaccaggacagcaacctgctgtggttcagcgacacctgcttcgtggagcacaactggttccacctgatcggcatcacctgcggcctggccatctacaacagcaccgtggtggacctgcacttccccctggccctgtacaagaagctgctgaacgtgaagcccggcctggaggacctgaaggagctgagccccaccgagggcagaagcctgcaggagctgctggactaccccggcgaggacgtggaggagaccttctgcctgaacttcaccatctgcagagagagctacggcgtgatcgagcagaagaagctgatccccggcggcgacaacgtgaccgtgtgcaaggacaacagacaggagttcgtggacgcctacgtgaactacgtgttccagatcagcgtgcacgagtggtacaccgccttcagcagcggcttcctgaaggtgtgcggcggcaaggtgctggagctgttccagcccagcgagctgagagccatgatggtgggcaacagcaactacaactgggaggagctggaggagaccgccatctacaagggcgactacagcgccacccaccccaccgtgaagctgttctgggagaccttccacgagttccccctggagaagaagaagaagttcctgctgttcctgaccggcagcgacagaatccccatctacggcatggccagcctgcagatcgtgatccagagcaccgccagcggcgaggagtacctgcccgtggcccacacctgctacaacctgctggacctgcccaagtacagcagcaaggagatcctgagcgccagactgacccaggccctggacaactacgagggcttcagcctggcctag

SEQ ID NO: 9470 - DNA, 3069 bp, Artificial Sequence
  Description of Artificial Sequence: Synthetic coding sequence
atgtacttctgctggggcgccgacagcagagagctgcagagaagaagaaccgccggcagccccggcgccgagctgctgcaggccgccagcggcgagagacacagcctgctgctgctgaccaaccacagagtgctgagctgcggcgacaacagcagaggccagctgggcagaagaggcgcccagagaggcgagctgcccgagcccatccaggccctggagaccctgatcgtggacctggtgagctgcggcaaggagcacagcctggccgtgtgccacaagggcagagtgttcgcctggggcgccggcagcgagggccagctgggcatcggcgagttcaaggagatcagcttcacccccaagaagatcatgaccctgaacgacatcaagatcatccaggtgagctgcggccactaccacagcctggccctgagcaaggacagccaggtgttcagctggggcaagaacagccacggccagctgggcctgggcaaggagttccccagccaggccagcccccagagagtgagaagcctggagggcatccccctggcccaggtggccgccggcggcgcccacagcttcgccctgagcctgtgcggcaccagcttcggctggggcagcaacagcgccggccagctggccctgagcggcagaaacgtgcccgtgcagagcaacaagcccctgagcgtgggcgccctgaagaacctgggcgtggtgtacatcagctgcggcgacgcccacaccgccgtgctgacccaggacggcaaggtgttcaccttcggcgacaacagaagcggccagctgggctacagccccacccccgagaagagaggcccccagctggtggagagaatcgacggcctggtgagccagatcgactgcggcagctaccacaccctggcctacgtgcacaccaccggccaggtggtgagcttcggccacggccccagcgacaccagcaagcccacccaccccgaggccctgaccgagaacttcgacatcagctgcctgatcagcgccgaggacttcgtggacgtgcaggtgaagcacatcttcgccggcacctacgccaacttcgtgaccacccaccaggacaccagcagcaccagagcccccggcaagaccctgcccgagatcagcagaatcagccagagcatggccgagaagtggatcgccgtgaagagaagaagcaccgagcacgagatggccaagagcgagatcagaatgatcttcagcagccccgcctgcctgaccgccagcttcctgaagaagagaggcaccggcgagaccaccagcatcgacgtggacctggagatggccagagacaccttcaagaagctgaccaagaaggagtggatcagcagcatgatcaccacctgcctggaggacgacctgctgagagccctgccctgccacagcccccaccaggaggccctgagcgtgttcctgctgctgcccgagtgccccgtgatgcacgacagcaagaactggaagaacctggtggtgcccttcgccaaggccgtgtgcgagatgagcaagcagagcctgcaggtgctgaagaagtgctgggccttcctgcaggagagcagcctgaaccccctgatccagatgctgaaggccgccatcatcagccagctgctgcaccagaccaagaccgagcaggaccactgcaacgtgaaggccctgctgggcatgatgaaggagctgcacaaggtgaacaaggccaactgcagactgcccgagaacaccttcaacatcaacgagctgagcaacctgctgaacttctacatcgacagaggcagacagctgttcagagacaaccacctgatccccgccgagacccccagccccgtgatcttcagcgacttccccttcatcttcaacagcctgagcaagatcaagctgctgcaggccgacagccacatcaagatgcagatgagcgagaagaaggcctacatgctgatgcacgagaccatcctgcagaagaaggacgagttcccccccagccccagattcatcctgagagtgagaagaagcagactggtgaaggacgccctgagacagctgagccaggccgaggccaccgacttctgcaaggtgctggtggtggagttcatcaacgagatctgccccgagagcggcggcgtgagcagcgagttcttccactgcatgttcgaggagatgaccaagcccgagtacggcatgttcatgtaccccgagatgggcagctgcatgtggttccccgccaagcccaagcccgagaagaagagatacttcctgttcggcatgctgtgcggcctgagcctgttcaacctgaacgtggccaacctgcccttccccctggccctgtacaagaagctgctggaccagaagcccagcctggaggacctgaaggagctgagccccagactgggcaagagcctgcaggaggtgctggacgacgccgccgacgacatcggcgacgccctgtgcatcagattcagcatccactgggaccagaacgacgtggacctgatccccaacggcatcagcatccccgtggaccagaccaacaagagagactacgtgagcaagtacatcgactacatcttcaacgtgagcgtgaaggccgtgtacgaggagttccagagaggcttctacagagtgtgcgagaaggagatcctgagacacttctaccccgaggagctgatgaccgccatcatcggcaacaccgactacgactggaagcagttcgagcagaacagcaagtacgagcagggctaccagaagagccaccccaccatccagctgttctggaaggccttccacaagctgaccctggacgagaagaagaagttcctgttcttcctgaccggcagagacagactgcacgccagaggcatccagaagatggagatcgtgttcagatgccccgagaccttcagcgagagagaccaccccaccagcatcacctgccacaacatcctgagcctgcccaagtacagcaccatggagagaatggaggaggccctgcaggtggccatcaacaacaacagaggcttcgtgagccccatgctgacccagagctag

SEQ ID NO: 9471 - DNA, 1221 bp, Artificial Sequence
  Description of Artificial Sequence: Synthetic coding sequence
atggccgccgccgtgagacaggacctggcccagctgatgaacagcagcggcagccacaaggacctggccggcaagtacagacagatcctggagaaggccatccagctgagcggcgccgagcagctggaggccctgaaggccttcgtggaggccatggtgaacgagaacgtgagcctggtgatcagcagacagctgctgaccgacttctgcacccacctgcccaacctgcccgacagcaccgccaaggagatctaccacttcaccctggagaagatccagcccagagtgatcagcttcgaggagcaggtggccagcatcagacagcacctggccagcatctacgagaaggaggaggactggagaaacgccgcccaggtgctggtgggcatccccctggagaccggccagaagcagtacaacgtggactacaagctggagacctacctgaagatcgccagactgtacctggaggacgacgaccccgtgcaggccgaggcctacatcaacagagccagcctgctgcagaacgagagcaccaacgagcagctgcagatccactacaaggtgtgctacgccagagtgctggactacagaagaaagttcatcgaggccgcccagagatacaacgagctgagctacaagaccatcgtgcacgagagcgagagactggaggccctgaagcacgccctgcactgcaccatcctggccagcgccggccagcagagaagcagaatgctggccaccctgttcaaggacgagagatgccagcagctggccgcctacggcatcctggagaagatgtacctggacagaatcatcagaggcaaccagctgcaggagttcgccgccatgctgatgccccaccagaaggccaccaccgccgacggcagcagcatcctggacagagccgtgatcgagcacaacctgctgagcgccagcaagctgtacaacaacatcaccttcgaggagctgggcgccctgctggagatccccgccgccaaggccgagaagatcgccagccagatgatcaccgagggcagaatgaacggcttcatcgaccagatcgacggcatcgtgcacttcgagaccagagaggccctgcccacctgggacaagcagatccagagcctgtgcttccaggtgaacaacctgctggagaagatcagccagaccgcccccgagtggaccgcccaggccatggaggcccagatggcccagtag

SEQ ID NO: 9472 - DNA, 1578 bp, Artificial Sequence
  Description of Artificial Sequence: Synthetic coding sequence
atggccgccggcctgctgggcagcgaggaccccccctggagctggaacctgacctgcagagccctgagaacctgccaggtgagaaacatcagagtgctgcagctgctgctgaagccctggtgcatcagcagagccgtgtaccagatgaccgagggcagaagatgccaggtgcacctgctggacgacagaaagctggagctgctggtgcagcccaagctgctggccaaggagctgctggacctggtggccagccacttcaacctgaaggagaaggagtacttcggcatcgccttcaccgacgagaccggccacctgaactggctgcagctggacagaagagtgctggagcacgacttccccaagaagagcggccccgtggtgctgtacttctgcgtgagattctacatcgagagcatcagctacctgaaggacaacgccaccatcgagctgttcttcctgaacgccaagagctgcatctacaaggagctgatcgacgtggacagcgaggtggtgttcgagctggccagctacatcctgcaggaggccaagggcgacttcagcagcaacgaggtggtgagaagcgacctgaagaagctgcccgccctgcccacccaggccctgaaggagcaccccagcctggcctactgcgaggacagagtgatcgagcactacaagaagctgaacggccagaccagaggccaggccatcgtgaactacatgagcatcgtggagagcctgcccacctacggcgtgcactactacgccgtgaaggacaagcagggcatcccctggtggctgggcctgagctacaagggcatcttccagtacgactaccacgacaaggtgaagcccagaaagatcttccagtggagacagctggagaacctgtacttcagagagaagaagttcagcgtggaggtgcacgaccccagaagagccagcgtgaccagaagaaccttcggccacagcggcatcgccgtgcacacctggtacgcctgccccgccctgatcaagagcatctgggccatggccatcagccagcaccagttctacctggacagaaagcagagcaagagcaagatccacgccgccagaagcctgagcgagatcgccatcgacctgaccgagaccggcaccctgaagaccagcaagctggccaacatgggcagcaagggcaagatcatcagcggcagcagcggcagcctgctgagcagcggcagccaggagagcgacagcagccagagcgccaagaaggacatgctggccgccctgaagagcagacaggaggccctggaggagaccctgagacagagactggaggagctgaagaagctgtgcctgagagaggccgagctgaccggcaagctgcccgtggagtaccccctggaccccggcgaggagccccccatcgtgagaagaagaatcggcaccgccttcaagctggacgagcagaagatcctgcccaagggcgaggaggccgagctggagagactggagagagagttcgccatccagagccagatcaccgaggccgccagaagactggccagcgaccccaacgtgagcaagaagctgtag

SEQ ID NO: 9473 - DNA, 1605 bp, Artificial Sequence
  Description of Artificial Sequence: Synthetic coding sequence
atgaagcaggagggcagcgccagaagaagaggcgccgacaaggccaagcccccccccggcggcggcgagcaggagcccccccccccccccgccccccaggacgtggagatgaaggaggaggccgccaccggcggcggcagcaccggcgaggccgacggcaagaccgccgccgccgccgccgagcacagccagagagagctggacaccgtgaccctggaggacatcaaggagcacgtgaagcagctggagaaggccgtgagcggcaaggagcccagattcgtgctgagagccctgagaatgctgcccagcaccagcagaagactgaaccactacgtgctgtacaaggccgtgcagggcttcttcaccagcaacaacgccaccagagacttcctgctgcccttcctggaggagcccatggacaccgaggccgacctgcagttcagacccagaaccggcaaggccgccagcacccccctgctgcccgaggtggaggcctacctgcagctgctggtggtgatcttcatgatgaacagcaagagatacaaggaggcccagaagatcagcgacgacctgatgcagaagatcagcacccagaacagaagagccctggacctggtggccgccaagtgctactactaccacgccagagtgtacgagttcctggacaagctggacgtggtgagaagcttcctgcacgccagactgagaaccgccaccctgagacacgacgccgacggccaggccaccctgctgaacctgctgctgagaaactacctgcactacagcctgtacgaccaggccgagaagctggtgagcaagagcgtgttccccgagcaggccaacaacaacgagtgggccagatacctgtactacaccggcagaatcaaggccatccagctggagtacagcgaggccagaagaaccatgaccaacgccctgagaaaggccccccagcacaccgccgtgggcttcaagcagaccgtgcacaagctgctgatcgtggtggagctgctgctgggcgagatccccgacagactgcagttcagacagcccagcctgaagagaagcctgatgccctacttcctgctgacccaggccgtgagaaccggcaacctggccaagttcaaccaggtgctggaccagttcggcgagaagttccaggccgacggcacctacaccctgatcatcagactgagacacaacgtgatcaagaccggcgtgagaatgatcagcctgagctacagcagaatcagcctggccgacatcgcccagaagctgcagctggacagccccgaggacgccgagttcatcgtggccaaggccatcagagacggcgtgatcgaggccagcatcaaccacgagaagggctacgtgcagagcaaggagatgatcgacatctacagcaccagagagccccagctggccttccaccagagaatcagcttctgcctggacatccacaacatgagcgtgaaggccatgagattcccccccaagagctacaacaaggacctggagagcgccgaggagagaagagagagagagcagcaggacctggagttcgccaaggagatggccgaggacgacgacgacagcttcccctag

SEQ ID NO: 9474 - DNA, 1311 bp, Artificial Sequence
  Description of Artificial Sequence: Synthetic coding sequence
atgagaagagacgtgaacggcgtgaccaagagcagattcgagatgttcagcaacagcgacgaggccgtgatcaacaagaagctgcccaaggagctgctgctgagaatcttcagcttcctggacgtggtgaccctgtgcagatgcgcccaggtgagcagagcctggaacgtgctggccctggacggcagcaactggcagagaatcgacctgttcgacttccagagagacatcgagggcagagtggtggagaacatcagcaagagatgcggcggcttcctgagaaagctgagcctgagaggctgcctgggcgtgggcgacaacgccctgagaaccttcgcccagaactgcagaaacatcgaggtgctgaacctgaacggctgcaccaagaccaccgacgccacctgcaccagcctgagcaagttctgcagcaagctgagacacctggacctggccagctgcaccagcatcaccaacatgagcctgaaggccctgagcgagggctgccccctgctggagcagctgaacatcagctggtgcgaccaggtgaccaaggacggcatccaggccctggtgagaggctgcggcggcctgaaggccctgttcctgaagggctgcacccagctggaggacgaggccctgaagtacatcggcgcccactgccccgagctggtgaccctgaacctgcagacctgcctgcagatcaccgacgagggcctgatcaccatctgcagaggctgccacaagctgcagagcctgtgcgccagcggctgcagcaacatcaccgacgccatcctgaacgccctgggccagaactgccccagactgagaatcctggaggtggccagatgcagccagctgaccgacgtgggcttcaccaccctggccagaaactgccacgagctggagaagatggacctggaggagtgcgtgcagatcaccgacagcaccctgatccagctgagcatccactgccccagactgcaggtgctgagcctgagccactgcgagctgatcaccgacgacggcatcagacacctgggcaacggcgcctgcgcccacgaccagctggaggtgatcgagctggacaactgccccctgatcaccgacgccagcctggagcacctgaagagctgccacagcctggagagaatcgagctgtacgactgccagcagatcaccagagccggcatcaagagactgagaacccacctgcccaacatcaaggtgcacgcctacttcgcccccgtgacccccccccccagcgtgggcggcagcagacagagattctgcagatgctgcatcatcctgtag

SEQ ID NO: 9475 - DNA, 1167 bp, Artificial Sequence
  Description of Artificial Sequence: Synthetic coding sequence
atgagatgcctgtacggcagagtgggcggcgccagaagaaagatggccgccagcgccgccgccgccgagctgcaggccagcggcggccccagacaccccgtgtgcctgctggtgctgggcatggccggcagcggcaagaccaccttcgtgcagagactgaccggccacctgcacgcccagggcacccccccctacgtgatcaacctggaccccgccgtgcacgaggtgcccttccccgccaacatcgacatcagagacaccgtgaagtacaaggaggtgatgaagcagtacggcctgggccccaacggcggcatcgtgaccagcctgaacctgttcgccaccagattcgaccaggtgatgaagttcatcgagaaggcccagaacatgagcaagtacgtgctgatcgacacccccggccagatcgaggtgttcacctggagcgccagcggcaccatcatcaccgaggccctggccagcagcttccccaccgtggtgatctacgtgatggacaccagcagaagcaccaaccccgtgaccttcatgagcaacatgctgtacgcctgcagcatcctgtacaagaccaagctgcccttcatcgtggtgatgaacaagaccgacatcatcgaccacagcttcgccgtggagtggatgcaggacttcgaggccttccaggacgccctgaaccaggagaccacctacgtgagcaacctgaccagaagcatgagcctggtgctggacgagttctacagcagcctgagagtggtgggcgtgagcgccgtgctgggcaccggcctggacgagctgttcgtgcaggtgaccagcgccgccgaggagtacgagagagagtacagacccgagtacgagagactgaagaagagcctggccaacgccgagagccagcagcagagagagcagctggagagactgagaaaggacatgggcagcgtggccctggacgccggcaccgccaaggacagcctgagccccgtgctgcaccccagcgacctgatcctgaccagaggcaccctggacgaggaggacgaggaggccgacagcgacaccgacgacatcgaccacagagtgaccgaggagagccacgaggagcccgccttccagaacttcatgcaggagagcatggcccagtactggaagagaaacaacaagtag

SEQ ID NO: 9476 - DNA, 1668 bp, Artificial Sequence
  Description of Artificial Sequence: Synthetic coding sequence
atgagactgatcggcatgcccaaggagaagtacgacccccccgaccccagaagaatctacaccatcatgagcgccgaggaggtggccaacggcaagaagagccactgggccgagctggagatcagcggcagagtgagaagcctgagcaccagcctgtggagcctgacccacctgaccgccctgcacctgaacgacaactacctgagcagaatcccccccgacatcgccaagctgcacaacctggtgtacctggacctgagcagcaacaagctgagaagcctgcccgccgagctgggcaacatggtgagcctgagagagctgctgctgaacaacaacctgctgagagtgctgccctacgagctgggcagactgttccagctgcagaccctgggcctgaagggcaaccccctgagccaggacatcctgaacctgtaccaggaccccgacggcaccagaaagctgctgaacttcatgctggacaacctggccgtgcaccccgagcagctgccccccagaccctggatcaccctgaaggagagagaccagatcctgcccagcgccagcttcaccgtgatgtgctacaacgtgctgtgcgacaagtacgccaccagacagctgtacggctactgccccagctgggccctgaactgggagtacagaaagaagggcatcatggaggagatcgtgaactgcgacgccgacatcatcagcctgcaggaggtggagaccgagcagtacttcaccctgttcctgcccgccctgaaggagagaggctacgacggcttcttcagccccaagagcagagccaagatcatgagcgagcaggagagaaagcacgtggacggctgcgccatcttcttcaagaccgagaagttcaccctggtgcagaagcacaccgtggagttcaaccaggtggccatggccaacagcgacggcagcgaggccatgctgaacagagtgatgaccaaggacaacatcggcgtggccgtggtgctggaggtgcacaaggagctgttcggcgccggcatgaagcccatccacgccgccgacaagcagctgctgatcgtggccaacgcccacatgcactgggaccccgagtacagcgacgtgaagctgatccagaccatgatgttcgtgagcgaggtgaagaacatcctggagaaggccagcagcagacccggcagccccaccgccgaccccaacagcatccccctggtgctgtgcgccgacctgaacagcctgcccgacagcggcgtggtggagtacctgagcaacggcggcgtggccgacaaccacaaggacttcaaggagctgagatacaacgagtgcctgatgaacttcagctgcaacggcaagaacggcagcagcgagggcagaatcacccacggcttccagctgaagagcgcctacgagaacaacctgatgccctacaccaactacaccttcgacttcaagggcgtgatcgactacatcttctacagcaagacccacatgaacgtgctgggcgtgctgggccccctggacccccagtggctggtggagaacaacatcaccggctgcccccacccccacatccccagcgaccacttcagcctgctgacccagctggagctgcacccccccctgctgcccctggtgaacggcgtgcacctgcccaacagaagatag

SEQ ID NO: 9477 - DNA, 2673 bp, Artificial Sequence
  Description of Artificial Sequence: Synthetic coding sequence
agcagcgacagcgagatcatcggctacgccctggacaccctgtacaacatcatcagcaacgaggaggaggaggaggtggaggagaacagcaccagacagagcgaggacctgggcagccagttcaccgagatcttcatcaagcagcaggagaacgtgaccctgctgctgagcctgctggaggagttcgacttccacgtgagatggcccggcgtgaagctgctgaccagcctgctgaagcagctgggcccccaggtgcagcagatcatcctggtgagccccatgggcgtgagcagactgatggacctgctggccgacagcagagaggtgatcagaaacgacggcgtgctgctgctgcaggccctgaccagaagcaacggcgccatccagaagatcgtggccttcgagaacgccttcgagagactgctggacatcatcagcgaggagggcaacagcgacggcggcatcgtggtggaggactgcctgatcctgctgcagaacctgctgaagaacaacaacagcaaccagaacttcttcaaggagggcagctacatccagagaatgaagccctggttcgaggtgggcgacgagaacagcggctggagcgcccagaaggtgaccaacctgcacctgatgctgcagctggtgagagtgctggtgagccccaccaacccccccggcgccaccagcagctgccagaaggccatgttccagtgcggcctgctgcagcagctgtgcaccatcctgatggccaccggcgtgcccgccgacatcctgaccgagaccatcaacaccgtgagcgaggtgatcagaggctgccaggtgaaccaggactacttcgccagcgtgaacgcccccagcaacccccccagacccgccatcgtggtgctgctgatgagcatggtgaacgagagacagcccttcgtgctgagatgcgccgtgctgtactgcttccagtgcttcctgtacaagaaccagaagggccagggcgagatcgtgagcaccctgctgcccagcaccatcgacgccaccggcaacagcgtgagcgccggccagctgctgtgcggcggcctgttcagcaccgacagcctgagcaactggtgcgccgccgtggccctggcccacgccctgcaggagaacgccacccagaaggagcagctgctgagagtgcagctggccaccagcatcggcaacccccccgtgagcctgctgcagcagtgcaccaacatcctgagccagggcagcaagatccagaccagagtgggcctgctgatgctgctgtgcacctggctgagcaactgccccatcgccgtgacccacttcctgcacaacagcgccaacgtgcccttcctgaccggccagatcgccgagaacctgggcgaggaggagcagctggtgcagggcctgtgcgccctgctgctgggcatcagcatctacttcaacgacaacagcctggagagctacatgaaggagaagctgaagcagctgatcgagaagagaatcggcaaggagaacttcatcgagaagctgggcttcatcagcaagcacgagctgtacagcagagccagccagaagccccagcccaacttccccagccccgagtacatgatcttcgaccacgagttcaccaagctggtgaaggagctggagggcgtgatcaccaaggccatctacaagagcagcgaggaggacaagaaggaggaggaggtgaagaagaccctggagcagcacgacaacatcgtgacccactacaagaacatgatcagagagcaggacctgcagctggaggagctgagacagcaggtgagcaccctgaagtgccagaacgagcagctgcagaccgccgtgacccagcaggtgagccagatccagcagcacaaggaccagtacaacctgctgaagatccagctgggcaaggacaaccagcaccagggcagctacagcgagggcgcccagatgaacggcatccagcccgaggagatcggcagactgagagaggagatcgaggagctgaagagaaaccaggagctgctgcagagccagctgaccgagaaggacagcatgatcgagaacatgaagagcagccagaccagcggcaccaacgagcagagcagcgccatcgtgagcgccagagacagcgagcaggtggccgagctgaagcaggagctggccaccctgaagagccagctgaacagccagagcgtggagatcaccaagctgcagaccgagaagcaggagctgctgcagaagaccgaggccttcgccaagagcgtggaggtgcagggcgagaccgagaccatcatcgccaccaagaccaccgacgtggagggcagactgagcgccctgctgcaggagaccaaggagctgaagaacgagatcaaggccctgagcgaggagagaaccgccatcaaggagcagctggacagcagcaacagcaccatcgccatcctgcagaccgagaaggacaagctggagctggagatcaccgacagcaagaaggagcaggacgacctgctggtgctgctggccgaccaggaccagaagatcctgagcctgaagaacaagctgaaggacctgggccaccccgtggaggaggaggacgagctggagagcggcgaccaggaggacgaggacgacgagagcgaggaccccggcaaggacctggaccacatctag

SEQ ID NO: 9478 - DNA, 1944 bp, Artificial Sequence
  Description of Artificial Sequence: Synthetic coding sequence
atggccagagccggccccagactggtgctgagcgaggaggccgtgagagccaagagcggcctgggcccccacagagacctggccgagctgcagagcctgagcatccccggcacctaccaggagaagatcacccacctgggccacagcctgatgagcctgaccggcctgaagagcctggacctgagcagaaacagcctggtgagcctggagggcatccagtacctgaccgccctggagagcctgaacctgtactacaactgcatcagcagcctggccgaggtgttcagactgcacgccctgaccgagctggtggacgtggacttcagactgaaccccgtggtgaaggtggagcccgactacagactgttcgtggtgcacctgctgcccaagctgcagcagctggacgacagacccgtgagagccagcgagagaaaggccagcagactgcacttcgccagcgaggacagcctggacagcaaggagagcgtgcccgccagcctgaaggagggcagaccccaccaccccagagccaagtgcaccgaggccctggccaagcagagcctggtgatggacgccgacgacgaggccgtgctgaacctgatcgccgagtgcgagtgggacctgggcagaccccccggcagcaccagcttcagccagaagggcagagaggccgacagcagaggcagccaggagagcagacacctgctgagcccccagctggtgcagtaccagtgcggcgacagcggcaagcagggcagagagaccagaagaagcagctgcagaggctgctgcctggagaagatgccctggagccagctgtgcggcgagctgccccccctgtacggcgccgagcccgaggccagcagagcccccagaccccacacctacttcaccccccaccccgacagcatggacaccgaggacagcgccagcagccagaagctggacctgagcggcgagatggtgcccggccccctgcccgcccccggcaagtgcagaaagagaagaatgcccgtgggcagattccagaccttcagcgaccaggagggcctgggctgccccgagagaacccacggcagcagcgtgcccaaggagagcctgagcagacaggacagcagcgagagcagaaacggcagaaccctgagccagcccgaggccagcgagaccgaggagcagagaagcagaggcgtgaccgacaccagagagcccagccccggcagccacagcgccctgcccggcaagaagaccgccctgcaggccgccctgctggagaccctgctggacctggtggacagaagctggggcggctgcagaagcctgcacagcaacgaggccttcctggcccaggccagacacatcctgagcagcgtggaggagttcaccgccgcccaggacagcagcgccatggtgggcgaggacgtgggcagcctggccctggagagcaagagcctgcagagcagactggccgagcagcagcagcagcacgccagagagatgagcgaggtgaccgccgagctgcaccacacccacaaggagctggacgacctgagacagcacctggacaagagcctggaggagaacagcagactgaagagcctgctgctgagcatgaagaaggaggtgaagagcgccgacaccgccgccaccctgaacctgcagatcgccggcctgcagaccagcgtgaagagactgtgcggcgagatcgtggagctgaagcagcacctggagcactacgacaagatccaggagctgacccagatgctgcaggagagccacagcagcctggtgagcaccaacgagcacctgctgcaggagctgagccaggtgagagcccagcacagagccgaggtggagcagatgcactggagctaccaggagctgaagaagaccatggccctgttcccccacagcagcgccagccacggcggctgccaggcctgctag

SEQ ID NO: 9479 - DNA, 777 bp, Artificial Sequence
  Description of Artificial Sequence: Synthetic coding sequence
atggccgagaccgaggagagaagcctggacaacttcttcgccaagagagacaagaagaagaagaaggagagaagcaacagagccgccagcgccgccggcgccgccggcagcgccggcggcagcagcggcgccgccggcgccgccggcggcggcgccggcgccggcaccagacccggcgacggcggcaccgccagcgccggcgccgccggccccggcgccgccaccaaggccgtgaccaaggacgaggacgagtggaaggagctggagcagaaggaggtggactacagcggcctgagagtgcaggccatgcagatcagcagcgagaaggaggaggacgacaacgagaagagacaggaccccggcgacaactgggaggagggcggcggcggcggcggcggcatggagaagagcagcggcccctggaacaagaccgcccccgtgcaggccccccccgcccccgtgatcgtgaccgagacccccgagcccgccatgaccagcggcgtgtacagaccccccggcgccagactgaccaccaccagaaagaccccccagggcccccccgagatctacagcgacacccagttccccagcctgcagagcaccgccaagcacgtggagagcagaaaggacaaggagatggagaagagcttcgaggtggtgagacacaagaacagaggcagagacgaggtgagcaagaaccaggccctgaagctgcagctggacaaccagtacgccgtgctggagaaccagaagagcagccacagccagtacaactag

SEQ ID NO: 9480 - DNA, 1077 bp, Artificial Sequence
  Description of Artificial Sequence: Synthetic coding sequence
atggccccccagaacctgagcaccttctgcctgctgctgctgtacctgatcggcgccgtgatcgccggcagagacttctacaagatcctgggcgtgcccagaagcgccagcatcaaggacatcaagaaggcctacagaaagctggccctgcagctgcaccccgacagaaaccccgacgacccccaggcccaggagaagttccaggacctgggcgccgcctacgaggtgctgagcgacagcgagaagagaaagcagtacgacacctacggcgaggagggcctgaaggacggccaccagagcagccacggcgacatcttcagccacttcttcggcgacttcggcttcatgttcggcggcacccccagacagcaggacagaaacatccccagaggcagcgacatcatcgtggacctggaggtgaccctggaggaggtgtacgccggcaacttcgtggaggtggtgagaaacaagcccgtggccagacaggcccccggcaagagaaagtgcaactgcagacaggagatgagaaccacccagctgggccccggcagattccagatgacccaggaggtggtgtgcgacgagtgccccaacgtgaagctggtgaacgaggagagaaccctggaggtggagatcgagcccggcgtgagagacggcatggagtaccccttcatcggcgagggcgagccccacgtggacggcgagcccggcgacctgagattcagaatcaaggtggtgaagcaccccatcttcgagagaagaggcgacgacctgtacaccaacgtgaccatcagcctggtggagagcctggtgggcttcgagatggacatcacccacctggacggccacaaggtgcacatcagcagagacaagatcaccagacccggcgccaagctgtggaagaagggcgagggcctgcccaacttcgacaacaacaacatcaagggcagcctgatcatcaccttcgacgtggacttccccaaggagcagctgaccgaggaggccagagagggcatcaagcagctgctgaagcagggcagcgtgcagaaggtgtacaacggcctgcagggctactag

SEQ ID NO: 9481 - DNA, 624 bp, Artificial Sequence
  Description of Artificial Sequence: Synthetic coding sequence
atgaccagcagaaagaaggtgctgctgaaggtgatcatcctgggcgacagcggcgtgggcaagaccagcctgatgaaccagtacgtgaacaagaagttcagcaaccagtacaaggccaccatcggcgccgacttcctgaccaaggaggtgatggtggacgacagactggtgaccatgcagatctgggacaccgccggccaggagagattccagagcctgggcgtggccttctacagaggcgccgactgctgcgtgctggtgttcgacgtgaccgcccccaacaccttcaagaccctggacagctggagagacgagttcctgatccaggccagccccagagaccccgagaacttccccttcgtggtgctgggcaacaagatcgacctggagaacagacaggtggccaccaagagagcccaggcctggtgctacagcaagaacaacatcccctacttcgagaccagcgccaaggaggccatcaacgtggagcaggccttccagaccatcgccagaaacgccctgaagcaggagaccgaggtggagctgtacaacgagttccccgagcccatcaagctggacaagaacgacagagccaaggccagcgccgagagctgcagctgctag

SEQ ID NO: 9482 - DNA, 3225 bp, Artificial Sequence
  Description of Artificial Sequence: Synthetic coding sequence
atgatccccatctgccccgtggtgagcttcacctacgtgcccagcagactgggcgaggacgccaagatggccaccggcaactacttcggcttcacccacagcggcgccgccgccgccgccgccgccgcccagtacagccagcagcccgccagcggcgtggcctacagccaccccaccaccgtggccagctacaccgtgcaccaggcccccgtggccgcccacaccgtgaccgccgcctacgcccccgccgccgccaccgtggccgtggccagacccgcccccgtggccgtggccgccgccgccaccgccgccgcctacggcggctaccccaccgcccacaccgccaccgactacggctacacccagagacagcaggaggccccccccccccccccccccgccaccacccagaactaccaggacagctacagctacgtgagaagcaccgcccccgccgtggcctacgacagcaagcagtactaccagcagcccaccgccaccgccgccgccgtggccgccgccgcccagccccagcccagcgtggccgagacctactaccagaccgcccccaaggccggctacagccagggcgccacccagtacacccaggcccagcagaccagacaggtgaccgccatcaagcccgccacccccagccccgccaccaccaccttcagcatctaccccgtgagcagcaccgtgcagcccgtggccgccgccgccaccgtggtgcccagctacacccagagcgccacctacagcaccaccgccgtgacctacagcggcaccagctacagcggctacgaggccgccgtgtacagcgccgccagcagctactaccagcagcagcagcagcagcagaagcaggccgccgccgccgccgccgccgccgccgccaccgccgcctggaccggcaccaccttcaccaagaaggcccccttccagaacaagcagctgaagcccaagcagccccccaagcccccccagatccactactgcgacgtgtgcaagatcagctgcgccggcccccagacctacaaggagcacctggagggccagaagcacaagaagaaggaggccgccctgaaggccagccagaacaccagcagcagcaacagcagcaccagaggcacccagaaccagctgagatgcgagctgtgcgacgtgagctgcaccggcgccgacgcctacgccgcccacatcagaggcgccaagcaccagaaggtggtgaagctgcacaccaagctgggcaagcccatccccagcaccgagcccaacgtggtgagccaggccaccagcagcaccgccgtgagcgccagcaagcccaccgccagccccagcagcatcgccgccaacaactgcaccgtgaacaccagcagcgtggccaccagcagcatgaagggcctgaccaccaccggcaacagcagcctgaacagcaccagcaacaccaaggtgagcgccgtgcccaccaacatggccgccaagaagaccagcacccccaagatcaacttcgtgggcggcaacaagctgcagagcaccggcaacaaggccgaggacatcaagggcaccgagtgcgtgaagagcacccccgtgaccagcgccgtgcagatccccgaggtgaagcaggacaccgtgagcgagcccgtgacccccgccagcctggccgccctgcagagcgacgtgcagcccgtgggccacgactacgtggaggaggtgagaaacgacgagggcaaggtgatcagattccactgcaagctgtgcgagtgcagcttcaacgaccccaacgccaaggagatgcacctgaagggcagaagacacagactgcagtacaagaagaaggtgaaccccgacctgcaggtggaggtgaagcccagcatcagagccagaaagatccaggaggagaagatgagaaagcagatgcagaaggaggagtactggagaagaagagaggaggaggagagatggagaatggagatgagaagatacgaggaggacatgtactggagaagaatggaggaggagcagcaccactgggacgacagaagaagaatgcccgacggcggctacccccacggcccccccggccccctgggcctgctgggcgtgagacccggcatgcccccccagccccagggccccgcccccctgagaagacccgacagcagcgacgacagatacgtgatgaccaagcacgccaccatctaccccaccgaggaggagctgcaggccgtgcagaagatcgtgagcatcaccgagagagccctgaagctggtgagcgacagcctgagcgagcacgagaagaacaagaacaaggagggcgacgacaagaaggagggcggcaaggacagagccctgaagggcgtgctgagagtgggcgtgctggccaagggcctgctgctgagaggcgacagaaacgtgaacctggtgctgctgtgcagcgagaagcccagcaagaccctgctgagcagaatcgccgagaacctgcccaagcagctggccgtgatcagccccgagaagtacgacatcaagtgcgccgtgagcgaggccgccatcatcctgaacagctgcgtggagcccaagatgcaggtgaccatcaccctgaccagccccatcatcagagaggagaacatgagagagggcgacgtgaccagcggcatggtgaaggacccccccgacgtgctggacagacagaagtgcctggacgccctggccgccctgagacacgccaagtggttccaggccagagccaacggcctgcagagctgcgtgatcatcatcagaatcctgagagacctgtgccagagagtgcccacctggagcgacttccccagctgggccatggagctgctggtggagaaggccatcagcagcgccagcagcccccagagccccggcgacgccctgagaagagtgttcgagtgcatcagcagcggcatcatcctgaagggcagccccggcctgctggacccctgcgagaaggaccccttcgacaccctggccaccatgaccgaccagcagagagaggacatcaccagcagcgcccagttcgccctgagactgctggccttcagacagatccacaaggtgctgggcatggaccccctgccccagatgagccagagattcaacatccacaacaacagaaagagaagaagagacagcgacggcgtggacggcttcgaggccgagggcaagaaggacaagaaggactacgacaacttctag

SEQ ID NO: 9483 - DNA, 438 bp, Artificial Sequence
  Description of Artificial Sequence: Synthetic coding sequence
atgaagttcaaccccttcgtgaccagcgacagaagcaagaacagaaagagacacttcaacgcccccagccacgtgagaagaaagatcatgagcagccccctgagcaaggagctgagacagaagtacaacgtgagaagcatgcccatcagaaaggacgacgaggtgcaggtggtgagaggccactacaagggccagcagatcggcaaggtggtgcaggtgtacagaaagaagtacgtgatctacatcgagagagtgcagagagagaaggccaacggcaccaccgtgcacgtgggcatccaccccagcaaggtggtgatcaccagactgaagctggacaaggacagaaagaagatcctggagagaaaggccaagagcagacaggtgggcaaggagaagggcaagtacaaggaggagctgatcgagaagatgcaggagtag

SEQ ID NO: 9484 - DNA, 3177 bp, Artificial Sequence
  Description of Artificial Sequence: Synthetic coding sequence
atggaggacggcacccccaagcacatcatccagatgaccggcttcaagatggaggagaaggaggccctggtgaagctgctgctgaagctggactgcaccttcatcaagagcgagaagtacaagaactgcacccacctgatcgccgagagactgtgcaagagcgagaagttcctggccgcctgcgccgccggcaagtggatcctgaccaaggactacatcatccacagcgccaagagcggcagatggctggacgagaccacctacgagtggggctacaagatcgagaaggacagcagatacagcccccagatgcagagcgcccccaagagatggagagaggagctgaagagaaccggcgcccccggcgccttccacagatggaaggtggtgctgctggtgagaaccgacaagagaagcgacagcctgatcagagtgctggaggccggcaaggccaacgtgatcctgcccaagagcagccccagcggcatcacccacgtgatcgccagcaacgccagaatcaaggccgagaaggagaaggacaacttcaaggcccccttctaccccatccagtacctgggcgacttcctgctggagaaggagatccagaacgacgaggacagccagaccaacagcgtgtggaccgagcacagcaacgaggagaccaacaaggacttcagaaaggacgccggcttcctggagatgaagggcgccctgagagagaccatgtacagaacccagaaggagatgcagaaccacgaggacgtgaacgtgggcagcatcctgatccagcaccacaagaaggagaagttcagcggcagcagcaaggacctgaagttcgtgaagatgagaaacaccttcggcagccacacctacgagaaccagaaggagatcaagaagaaggacgaggacatccagagaagctacaccctgagaagaaagagaaagaagggcaaggagagcaactgcaagaagggcgtggagcacgagaagatcaagagcaccctgagaagacacatctacaacagagaccagaaggagatgaagaacagcatcttcgccgagtacgccaaggagagcaaggccatggccatcaagaccgacgtggacgtggtggagatcaagaacaccctgagaaagcacatctacagagcccaggccgtgagatacaactgcatcagaatcgacaagcagcccgtgtacaacgtggaggtgaagaacgccgagttccccagaggcgtgctgaacctgatcgagagcctgatcgagggccacttcttcaaggaggccatcgaggagctgagcaccctgcaggcccactacatcccccccgtgtgcgtgctgcacgccctgctggagaacgtgctgcaggacaacatcgacaccttcagcggcagatacttccacatcctgagcgccctgctgcacctgcaccccccctggaagagccccgccatgagcagatactacctggagctgttccagtgccccacctgcatgaagggcgcctggagcctggtggaggtgctgatcagaagctgcctgttcaacgagagcttctgccaccagatcagcgagaacatcggcagcaaggtgctgcacctgaccctgctgaagttcttcttcaacctgatcgagagcgaggtgcagcacctgagccagaagctgtacgactggagcgacagccagaacctgaagatcaccggcaaggccatgctgctggagatcttctggagcggcagcgagaccagcggcctgctgaccaagcccgtgaacatgctgctggagtggaccatctacagccacaaggagaagttcaagagcaacgacgtgttcaagcacgagctggcctacctgctggccggcatcctgggcgccgccatcgactactggatcttcctgggcctgaagatgggcagaaacgtgatgagacacatgagcgacgacctgggcagctacgtgagcctgagctgcgacgacttcagcagccaggagctggagatcttcatctgcagcttcagcagcagctggctgcagatgttcgtggccgaggccgtgttcaagaagctgtgcctgcagagcagcggcagcgtgagcagcgagcccctgagcctgcagaagatggtgtacagctacctgcccgccctgggcaagaccggcgtgctgggcagcggcaagatccaggtgagcaagaagatcggccagagaccctgcttcgacagccagagaaccctgctgatgctgaacggcaccaagcagaagcaggtggagggcctgcccgagctgctggacctgaacctggccaagtgcagcagcagcctgaagaagctgaagaagaagagcgagggcgagctgagctgcagcaaggagaactgccccagcgtggtgaagaagatgaacttccacaagaccaacctgaagggcgagaccgccctgcacagagcctgcatcaacaaccaggtggagaagctgatcctgctgctgagcctgcccggcatcgacatcaacgtgaaggacaacgccggctggacccccctgcacgaggcctgcaactacggcaacaccgtgtgcgtgcaggagatcctgcagagatgccccgaggtggacctgctgacccaggtggacggcgtgacccccctgcacgacgccctgagcaacggccacgtggagatcggcaagctgctgctgcagcacggcggccccgtgctgctgcagcagagaaacgccaagggcgagctgcccctggactacgtggtgagcccccagatcaaggaggagctgttcgccatcaccaagatcgaggacaccgtggagaacttccacgcccaggccgagaagcacttccactaccagcagctggagttcggcagcttcctgctgagcagaatgctgctgaacttctgcagcatcttcgacctgagcagcgagttcatcctggccagcaagggcctgacccacctgaacgagctgctgatggcctgcaagagccacaaggagaccaccagcgtgcacaccgactggctgctggacctgtacgccggcaacatcaagaccctgcagaagctgccccacatcctgaaggagctgcccgagaacctgaaggtgtgccccggcgtgcacaccgaggccctgatgatcaccctggagatgatgtgcagaagcgtgatggagttcagctag

SEQ ID NO: 9485 - DNA, 660 bp, Artificial Sequence
  Description of Artificial Sequence: Synthetic coding sequence
atggagcccaaggaggccaccggcaaggagaacatggtgaccaagaagaagaacctggccttcctgagaagcagactgtacatgctggagagaagaaagaccgacaccgtggtggagagcagcgtgagcggcgaccacagcggcaccctgagaagaagccagagcgacagaaccgagtacaaccagaagctgcaggagaagatgaccccccagggcgagtgcagcgtggccgagaccctgacccccgaggaggagcaccacatgaagagaatgatggccaagagagagaagatcatcaaggagctgatccagaccgagaaggactacctgaacgacctggagctgtgcgtgagagaggtggtgcagcccctgagaaacaagaagaccgacagactggacgtggacagcctgttcagcaacatcgagagcgtgcaccagatcagcgccaagctgctgagcctgctggaggaggccaccaccgacgtggagcccgccatgcaggtgatcggcgaggtgttcctgcagatcaagggccccctggaggacatctacaagatctactgctaccaccacgacgaggcccacagcatcctggagagctacgagaaggaggaggagctgaaggagcacctgagccactgcatccagagcctgaagtag

SEQ ID NO: 9486 - DNA, 3183 bp, Artificial Sequence
  Description of Artificial Sequence: Synthetic coding sequence
atgctgatcgaggacgtggacgccctgaagagctggctggccaagctgctggagcccatctgcgacgccgaccccagcgccctggccaactacgtggtggccctggtgaagaaggacaagcccgagaaggagctgaaggccttctgcgccgaccagctggacgtgttcctgcagaaggagaccagcggcttcgtggacaagctgttcgagagcctgtacaccaagaactacctgcccctgctggagcccgtgaagcccgagcccaagcccctggtgcaggagaaggaggagatcaaggaggaggtgttccaggagcccgccgaggaggagagagacggcagaaagaagaagtaccccagcccccagaagaccagaagcgagagcagcgagagaagaaccagagagaagaagagagaggacggcaagtggagagactacgacagatactacgagagaaacgagctgtacagagagaagtacgactggagaagaggcagaagcaagagcagaagcaagagcagaggcctgagcagaagcagaagcagaagcagaggcagaagcaaggacagagaccccaacagaaacgtggagcacagagagagaagcaagttcaagagcgagagaaacgacctggagagcagctacgtgcccgtgagcgcccccccccccaacagcagcgagcagtacagcagcggcgcccagagcatccccagcaccgtgaccgtgatcgcccccgcccaccacagcgagaacaccaccgagagctggagcaactactacaacaaccacagcagcagcaacagcttcggcagaaacctgccccccaagagaagatgcagagactacgacgagagaggcttctgcgtgctgggcgacctgtgccagttcgaccacggcaacgaccccctggtggtggacgaggtggccctgcccagcatgatccccttccccccccccccccccggcctgccccccccccccccccccggcatgctgatgccccccatgcccggccccggccccggccccggccccggccccggccccggccccggccccggccccggccccggccacagcatgagactgcccgtgccccagggccacggccagcccccccccagcgtggtgctgcccatccccagaccccccatcacccagagcagcctgatcaacagcagagaccagcccggcaccagcgccgtgcccaacctggccagcgtgggcaccagactgcccccccccctgccccagaacctgctgtacaccgtgagcgagagacagcccatgtacagcagagagcacggcgccgccgccagcgagagactgcagctgggcacccccccccccctgctggccgccagactggtgccccccagaaacctgatgggcagcagcatcggctaccacaccagcgtgagcagccccacccccctggtgcccgacacctacgagcccgacggctacaaccccgaggcccccagcatcaccagcagcggcagaagccagtacagacagttcttcagcagaacccagacccagagacccaacctgatcggcctgaccagcggcgacatggacgtgaaccccagagccgccaacatcgtgatccagaccgagccccccgtgcccgtgagcatcaacagcaacatcaccagagtggtgctggagcccgacagcagaaagagagccatgagcggcctggagggccccctgaccaagaagccctggctgggcaagcagggcaacaacaaccagaacaagcccggcttcctgagaaagaaccagtacaccaacaccaagctggaggtgaagaagatcccccaggagctgaacaacatcaccaagctgaacgagcacttcagcaagttcggcaccatcgtgaacatccaggtggccttcaagggcgaccccgaggccgccctgatccagtacctgaccaacgaggaggccagaaaggccatcagcagcaccgaggccgtgctgaacaacagattcatcagagtgctgtggcacagagagaacaacgagcagcccaccctgcagagcagcgcccagctgctgctgcagcagcagcagaccctgagccacctgagccagcagcaccaccacctgccccagcacctgcaccagcagcaggtgctggtggcccagagcgcccccagcaccgtgcacggcggcatccagaagatgatgagcaagccccagaccagcggcgcctacgtgctgaacaaggtgcccgtgaagcacagactgggccacgccggcggcaaccagagcgacgccagccacctgctgaaccagagcggcggcgccggcgaggactgccagatcttcagcacccccggccaccccaagatgatctacagcagcagcaacctgaagacccccagcaagctgtgcagcggcagcaagagccacgacgtgcaggaggtgctgaagaagaagcaggaggccatgaagctgcagcaggacatgagaaagaagagacaggaggtgctggagaagcagatcgagtgccagaagatgctgatcagcaagctggagaagaacaagaacatgaagcccgaggagagagccaacatcatgaagaccctgaaggagctgggcgagaagatcagccagctgaaggacgagctgaagaccagcagcgccgtgagcacccccagcaaggtgaagaccaagaccgaggcccagaaggagctgctggacaccgagctggacctgcacaagagactgagcagcggcgaggacaccaccgagctgagaaagaagctgagccagctgcaggtggaggccgccagactgggcatcctgcccgtgggcagaggcaagaccatgagcagccagggcagaggcagaggcagaggcagaggcggcagaggcagaggcagcctgaaccacatggtggtggaccacagacccaaggccctgaccgtgggcggcttcatcgaggaggagaaggaggacctgctgcagcacttcagcaccgccaaccagggccccaagttcaaggacagaagactgcagatcagctggcacaagcccaaggtgcccagcatcagcaccgagaccgaggaggaggaggtgaaggaggaggagaccgagaccagcgacctgttcctgcccgacgacgacgacgaggacgaggacgagtacgagagcagaagctggagaagatag

SEQ ID NO: 9487 - DNA, 1818 bp, Artificial Sequence
  Description of Artificial Sequence: Synthetic coding sequence
atggaggccgacatcatcaccaacctgagatgcagactgaaggaggccgaggaggagagactgaaggccgcccagtacggcctgcagctggtggagagccagaacgagctgcagaaccagctggacaagtgcagaaacgagatgatgaccatgaccgagagctacgagcaggagaagtacaccctgcagagagaggtggagctgaagagcagaatgctggagagcctgagctgcgagtgcgaggccatcaagcagcagcagaagatgcacctggagaagctggaggagcagctgagcagaagccacggccaggaggtgaacgagctgaagaccaagatcgagaagctgaaggtggagctggacgaggccagactgagcgagaagcagctgaagcaccaggtggaccaccagaaggagctgctgagctgcaagagcgaggagctgagagtgatgagcgagagagtgcaggagagcatgagcagcgagatgctggccctgcagatcgagctgaccgagatggagagcatgaagaccaccctgaaggaggaggtgaacgagctgcagtacagacaggagcagctggagctgctgatcaccaacctgatgagacaggtggacagactgaaggaggagaaggaggagagagagaaggaggccgtgagctactacaacgccctggagaaggccagagtggccaaccaggacctgcaggtgcagctggaccaggccctgcagcaggccctggaccccaacagcaagggcaacagcctgttcgccgaggtggaggacagaagagccgccatggagagacagctgatcagcatgaaggtgaagtaccagagcctgaagaagcagaacgtgttcaacagagagcagatgcagagaatgaagctgcagatcgccaccctgctgcagatgaagggcagccagaccgagttcgagcagcaggagagactgctggccatgctggagcagaagaacggcgagatcaagcacctgctgggcgagatcagaaacctggagaagttcaagaacctgtacgacagcatggagagcaagcccagcgtggacagcggcaccctggaggacaacacctactacaccgacctgctgcagatgaagctggacaacctgaacaaggagatcgagagcaccaagggcgagctgagcatccagagaatgaaggccctgttcgagagccagagagccctggacatcgagagaaagctgttcgccaacgagagatgcctgcagctgagcgagagcgagaacatgaagctgagagccaagctggacgagctgaagctgaagtacgagcccgaggagaccgtggaggtgcccgtgctgaagaagagaagagaggtgctgcccgtggacatcaccaccgccaaggacgcctgcgtgaacaacagcgccctgggcggcgaggtgtacagactgcccccccagaaggaggagacccagagctgccccaacagcctggaggacaacaacctgcagctggagaagagcgtgagcatctacacccccgtggtgagcctgagcccccacaagaacctgcccgtggacatgcagctgaagaaggagaagaagtgcgtgaagctgatcggcgtgcccgccgacgccgaggccctgagcgagagaagcggcaacacccccaacagccccagactggccgccgagagcaagctgcagaccgaggtgaaggagggcaaggagaccagcagcaagctggagaaggagacctgcaagaagctgcaccccatcctgtacgtgagcagcaagagcacccccgagacccagtgcccccagcagtag

SEQ ID NO: 9488 - DNA, 888 bp, Artificial Sequence
  Description of Artificial Sequence: Synthetic coding sequence
atgatggccaagaagccccccaagcccgcccccagaagaatcttccaggagagactgaagatcaccgccctgcccctgtacttcgagggcttcctgctgatcaagagaagcggctacagagagtacgagcactactggaccgagctgagaggcaccaccctgttcttctacaccgacaagaagagcatcatctacgtggacaagctggacatcgtggacctgacctgcctgaccgagcagaacagcaccgagaagaactgcgccaagttcaccctggtgctgcccaaggaggaggtgcagctgaagaccgagaacaccgagagcggcgaggagtggagaggcttcatcctgaccgtgaccgagctgagcgtgccccagaacgtgagcctgctgcccggccaggtgatcaagctgcacgaggtgctggagagagagaagaagagaagaatcgagaccgagcagagcaccagcgtggagaaggagaaggagcccaccgaggactacgtggacgtgctgaaccccatgcccgcctgcttctacaccgtgagcagaaaggaggccaccgagatgctgcagaagaaccccagcctgggcaacatgatcctgagacccggcagcgacagcagaaactacagcatcaccatcagacaggagatcgacatccccagaatcaagcactacaaggtgatgagcgtgggccagaactacaccatcgagctggagaagcccgtgaccctgcccaacctgttcagcgtgatcgactacttcgtgaaggagaccagaggcaacctgagacccttcatctgcagcaccgacgagaacaccggccaggagcccagcatggagggcagaagcgagaagctgaagaagaacccccacatcgcctag

SEQ ID NO: 9489 - DNA, 4821 bp, Artificial Sequence
  Description of Artificial Sequence: Synthetic coding sequence
atgttccacatctgccccgccgagaacctgtaccagaacagattcctgggcctggccgccatggccagccccagcagaaacagccagagcagaagaagatgcaaggagcccctgagatacagctacaaccccgaccagttccacaacatggacctgagaggcggcccccacgacggcgtgaccatccccagaagcaccagcgacaccgacctggtgaccagcgacagcagaagcaccctgatggtgagcagcagctactacagcatcggccacagccaggacctggtgatccactgggacatcaaggaggaggtggacgccggcgactggatcggcatgtacctgatcgacgaggtgctgagcgagaacttcctggactacaagaacagaggcgtgaacggcagccacagaggccagatcatctggaagatcgacgccagcagctacttcgtggagcccgagaccaagatctgcttcaagtactaccacggcgtgagcggcgccctgagagccaccacccccagcgtgaccgtgaagaacagcgccgcccccatcttcaagagcatcggcgccgacgagaccgtgcagggccagggcagcagaagactgatcagcttcagcctgagcgacttccaggccatgggcctgaagaagggcatgttcttcaaccccgacccctacctgaagatcagcatccagcccggcaagcacagcatcttccccgccctgccccaccacggccaggagagaagaagcaagatcatcggcaacaccgtgaaccccatctggcaggccgagcagttcagcttcgtgagcctgcccaccgacgtgctggagatcgaggtgaaggacaagttcgccaagagcagacccatcatcaagagattcctgggcaagctgagcatgcccgtgcagagactgctggagagacacgccatcggcgacagagtggtgagctacaccctgggcagaagactgcccaccgaccacgtgagcggccagctgcagttcagattcgagatcaccagcagcatccaccccgccgacgacgaggagatcagcctgagcaccgagcccgagagcgcccagatccaggacagccccatgaacaacctgatggagagcggcagcggcgagcccagaagcgaggcccccgagagcagcgagagctggaagcccgagcagctgggcgagggcagcgtgcccgacggccccggcaaccagagcatcgagctgagcagacccgccgaggaggccgccgtgatcaccgaggccggcgaccagggcatggtgagcgtgggccccgagggcgccggcgagctgctggcccaggtgcagaaggacatccagcccgcccccagcgccgaggagctggccgagcagctggacctgggcgaggaggccagcgccctgctgctggaggacggcgaggcccccgccagcaccaaggaggagcccctggaggaggaggccaccacccagagcagagccggcagagaggaggaggagaaggagcaggaggaggagggcgacgtgagcaccctggagcagggcgagggcagactgcagctgagagccagcgtgaagagaaagagcagaccctgcagcctgcccgtgagcgagctggagaccgtgatcgccagcgcctgcggcgaccccgagacccccagaacccactacatcagaatccacaccctgctgcacagcatgcccagcgcccagggcggcagcgccgccgaggaggaggacggcgccgaggaggagagcaccctgaaggacagcagcgagaaggacggcctgagcgaggtggacaccgtggccgccgaccccagcgccctggaggaggacagagaggagcccgagggcgccacccccggcaccgcccaccccggccacagcggcggccacttccccagcctggccaacggcgccgcccaggacggcgacacccaccccagcaccggcagcgagagcgacagcagccccagacagggcggcgaccacagctgcgagggctgcgacgccagctgctgcagccccagctgctacagcagcagctgctacagcaccagctgctacagcagcagctgctacagcgccagctgctacagccccagctgctacaacggcaacagattcgccagccacaccagattcagcagcgtggacagcgccaagatcagcgagagcaccgtgttcagcagccaggacgacgaggaggaggagaacagcgccttcgagagcgtgcccgacagcatgcagagccccgagctggaccccgagagcaccaacggcgccggcccctggcaggacgagctggccgcccccagcggccacgtggagagaagccccgagggcctggagagccccgtggccggccccagcaacagaagagagggcgagtgccccatcctgcacaacagccagcccgtgagccagctgcccagcctgagacccgagcaccaccactaccccaccatcgacgagcccctgccccccaactgggaggccagaatcgacagccacggcagagtgttctacgtggaccacgtgaacagaaccaccacctggcagagacccaccgccgccgccacccccgacggcatgagaagaagcggcagcatccagcagatggagcagctgaacagaagataccagaacatccagagaaccatcgccaccgagagaagcgaggaggacagcggcagccagagctgcgagcaggcccccgccggcggcggcggcggcggcggcagcgacagcgaggccgagagcagccagagcagcctggacctgagaagagagggcagcctgagccccgtgaacagccagaagatcaccctgctgctgcagagccccgccgtgaagttcatcaccaaccccgagttcttcaccgtgctgcacgccaactacagcgcctacagagtgttcaccagcagcacctgcctgaagcacatgatcctgaaggtgagaagagacgccagaaacttcgagagataccagcacaacagagacctggtgaacttcatcaacatgttcgccgacaccagactggagctgcccagaggctgggagatcaagaccgaccagcagggcaagagcttcttcgtggaccacaacagcagagccaccaccttcatcgaccccagaatccccctgcagaacggcagactgcccaaccacctgacccacagacagcacctgcagagactgagaagctacagcgccggcgaggccagcgaggtgagcagaaacagaggcgccagcctgctggccagacccggccacagcctggtggccgccatcagaagccagcaccagcacgagagcctgcccctggcctacaacgacaagatcgtggccttcctgagacagcccaacatcttcgagatgctgcaggagagacagcccagcctggccagaaaccacaccctgagagagaagatccactacatcagaaccgagggcaaccacggcctggagaagctgagctgcgacgccgacctggtgatcctgctgagcctgttcgaggaggagatcatgagctacgtgcccctgcaggccgccttccaccccggctacagcttcagccccagatgcagcccctgcagcagcccccagaacagccccggcctgcagagagccagcgccagagcccccagcccctacagaagagacttcgaggccaagctgagaaacttctacagaaagctggaggccaagggcttcggccagggccccggcaagatcaagctgatcatcagaagagaccacctgctggagggcaccttcaaccaggtgatggcctacagcagaaaggagctgcagagaaacaagctgtacgtgaccttcgtgggcgaggagggcctggactacagcggccccagcagagagttcttcttcctgctgagccaggagctgttcaacccctactacggcctgttcgagtacagcgccaacgacacctacaccgtgcagatcagccccatgagcgccttcgtggagaaccacctggagtggttcagattcagcggcagaatcctgggcctggccctgatccaccagtacctgctggacgccttcttcaccagacccttctacaaggccctgctgagactgccctgcgacctgagcgacctggagtacctggacgaggagttccaccagagcctgcagtggatgaaggacaacaacatcaccgacatcctggacctgaccttcaccgtgaacgaggaggtgttcggccaggtgaccgagagagagctgaagagcggcggcgccaacacccaggtgaccgagaagaacaagaaggagtacatcgagagaatggtgaagtggagagtggagagaggcgtggtgcagcagaccgaggccctggtgagaggcttctacgaggtggtggacagcagactggtgagcgtgttcgacgccagagagctggagctggtgatcgccggcaccgccgagatcgacctgaacgactggagaaacaacaccgagtacagaggcggctaccacgacggccacctggtgatcagatggttctgggccgccgtggagagattcaacaacgagcagagactgagactgctgcagttcgtgaccggcaccagcagcgtgccctacgagggcttcgccgccctgagaggcagcaacggcctgagaagattctgcatcgagaagtggggcaagatcaccagcctgcccagagcccacacctgcttcaacagactggacctgcccccctaccccagctacagcatgctgtacgagaagctgctgaccgccgtggaggagaccagcaccttcggcctggagtag

SEQ ID NO: 9490 - DNA, 2373 bp, Artificial Sequence
  Description of Artificial Sequence: Synthetic coding sequence
atgggcaccagaaagaaggtgcacgccttcgtgagagtgaagcccaccgacgacttcgcccacgagatgatcagatacggcgacgacaagagaagcatcgacatccacctgaagaaggacatcagaagaggcgtggtgaacaaccagcagaccgactggagcttcaagctggacggcgtgctgcacgacgccagccaggacctggtgtacgagaccgtggccaaggacgtggtgagccaggccctggacggctacaacggcaccatcatgtgctacggccagaccggcgccggcaagacctacaccatgatgggcgccaccgagaactacaagcacagaggcatcctgcccagagccctgcagcaggtgttcagaatgatcgaggagagacccacccacgccatcaccgtgagagtgagctacctggagatctacaacgagagcctgttcgacctgctgagcaccctgccctacgtgggccccagcgtgacccccatgaccatcgtggagaacccccagggcgtgttcatcaagggcctgagcgtgcacctgaccagccaggaggaggacgccttcagcctgctgttcgagggcgagaccaacagaatcatcgccagccacaccatgaacaagaacagcagcagaagccactgcatcttcaccatctacctggaggcccacagcagaaccctgagcgaggagaagtacatcaccagcaagatcaacctggtggacctggccggcagcgagagactgggcaagagcggcagcgagggccaggtgctgaaggaggccacctacatcaacaagagcctgagcttcctggagcaggccatcatcgccctgggcgaccagaagagagaccacatccccttcagacagtgcaagctgacccacgccctgaaggacagcctgggcggcaactgcaacatggtgctggtgaccaacatctacggcgaggccgcccagctggaggagaccctgagcagcctgagattcgccagcagaatgaagctggtgaccaccgagcccgccatcaacgagaagtacgacgccgagagaatggtgaagaacctggagaaggagctggccctgctgaagcaggagctggccatccacgacagcctgaccaacagaaccttcgtgacctacgaccccatggacgagatccagatcgccgagatcaacagccaggtgagaagatacctggagggcaccctggacgagatcgacatcatcagcctgagacagatcaaggaggtgttcaaccagttcagagtggtgctgagccagcaggagcaggaggtggagagcaccctgagaagaaagtacaccctgatcgacagaaacgacttcgccgccatcagcgccatccagaaggccggcctggtggacgtggacggccacctggtgggcgagcccgagggccagaacttcggcctgggcgtggcccccttcagcaccaagcccggcaagaaggccaagagcaagaagaccttcaaggagcccctgagcagcctggccagaaaggagggcgccagcagccccgtgaacggcaaggacctggactacgtgagcaccagcaagacccagctggtgcccagcagcaaggacggcgacgtgaaggacatgctgagcagagacagagagaccagcagcatcgagcccctgcccagcgacagccccaaggaggagctgagacccatcagacccgacaccccccccagcaagcccgtggccttcgaggagttcaagaacgagcagggcagcgagatcaacagaatcttcaaggagaacaagagcatcctgaacgagagaagaaagagagccagcgagaccacccagcacatcaacgccatcaagagagagatcgacgtgaccaaggaggccctgaacttccagaagagcctgagagagaagcagggcaagtacgagaacaagggcctgatgatcatcgacgaggaggagttcctgctgatcctgaagctgaaggacctgaagaagcagtacagaagcgagtaccaggacctgagagacctgagagccgagatccagtactgccagcacctggtggaccagtgcagacacagactgctgatggagttcgacatctggtacaacgagagcttcgtgatccccgaggacatgcagatggccctgaagcccggcggcagcatcagacccggcatggtgcccgtgaacagaatcgtgagcctgggcgaggacgaccaggacaagttcagccagctgcagcagagagtgctgcccgagggccccgacagcatcagcttctacaacgccaaggtgaagatcgagcagaagcacaactacctgaagaccatgatgggcctgcagcaggcccacagaaagtag

SEQ ID NO: 9491 - DNA, 876 bp, Artificial Sequence
  Description of Artificial Sequence: Synthetic coding sequence
atggccagcgtgaccctgagcgaggccgagaaggtgtacatcgtgcacggcgtgcaggaggacctgagagtggacggcagaggctgcgaggactacagatgcgtggaggtggagaccgacgtggtgagcaacaccagcggcagcgccagagtgaagctgggccacaccgacatcctggtgggcgtgaaggccgagatgggcacccccaagctggagaagcccaacgagggctacctggagttcttcgtggactgcagcgccagcgccacccccgagttcgagggcagaggcggcgacgacctgggcaccgagatcgccaacaccctgtacagaatcttcaacaacaagagcagcgtggacctgaagaccctgtgcatcagccccagagagcactgctgggtgctgtacgtggacgtgctgctgctggagtgcggcggcaacctgttcgacgccatcagcatcgccgtgaaggccgccctgttcaacaccagaatccccagagtgagagtgctggaggacgaggagggcagcaaggacatcgagctgagcgacgacccctacgactgcatcagactgagcgtggagaacgtgccctgcatcgtgaccctgtgcaagatcggctacagacacgtggtggacgccaccctgcaggaggaggcctgcagcctggccagcctgctggtgagcgtgaccagcaagggcgtggtgacctgcatgagaaaggtgggcaagggcagcctggaccccgagagcatcttcgagatgatggagaccggcaagagagtgggcaaggtgctgcacgccagcctgcagagcgtggtgcacaaggaggagagcctgggccccaagagacagaaggtgggcttcctgggctag

SEQ ID NO: 9492 - DNA, 2382 bp, Artificial Sequence
  Description of Artificial Sequence: Synthetic coding sequence
atgttctggaagttcgacctgcacagcagcagccacatcgacaccctgctggagagagaggacgtgaccctgaaggagctgatggacgaggaggacgtgctgcaggagtgcaaggcccagaacagaaagctgatcgagttcctgctgaaggccgagtgcctggaggacctggtgagcttcatcatcgaggagcccccccaggacatggacgagaagatcagatacaagtaccccaacatcagctgcgagctgctgaccagcgacgtgagccagatgaacgacagactgggcgaggacgagagcctgctgatgaagctgtacagcttcctgctgaacgacagccccctgaaccccctgctggccagcttcttcagcaaggtgctgagcatcctgatcagcagaaagcccgagcagatcgtggacttcctgaagaagaagcacgacttcgtggacctgatcatcaagcacatcggcaccagcgccatcatggacctgctgctgagactgctgacctgcatcgagcccccccagcccagacaggacgtgctgaactggctgaacgaggagaagatcatccagagactggtggagatcgtgcaccccagccaggaggaggacagacacagcaacgccagccagagcctgtgcgagatcgtgagactgagcagagaccagatgctgcagatccagaacagcaccgagcccgaccccctgctggccaccctggagaagcaggagatcatcgagcagctgctgagcaacatcttccacaaggagaagaacgagagcgccatcgtgagcgccatccagatcctgctgaccctgctggagaccagaagacccaccttcgagggccacatcgagatctgcccccccggcatgagccacagcgcctgcagcgtgaacaagagcgtgctggaggccatcagaggcagactgggcagcttccacgagctgctgctggagccccccaagaacatgttcttcaagtacacctggaacaacttcctgcacacccaggtggagatctgcatcgccctgatcctggccagccccttcgagaacaccgagaacgccaccatcaccgaccaggacagcaccggcgacaacctgctgctgaagcacctgttccagaagtgccagctgatcgagagaatcctggaggcctgggagatgaacgagaagaagcaggccgagggcggcagaagacacggctacatgggccacctgaccagaatcgccaactgcatcgtgcacagcaccgacaagggccccaacagcgccctggtgcagcagctgatcaaggacctgcccgacgaggtgagagagagatgggagaccttctgcaccagcagcctgggcgagaccaacaagagaaacaccgtggacctggccttcagcgactaccagatgcagcagatgaccagcaacttcatcgaccagttcggcttcaacgacgagaagttcgccgaccaggacgacatcggcaacgtgagcttcgacagagtgagcgacatcaacttcaccctgaacaccaacgagagcggcaacatcgccctgttcgaggcctgctgcaaggagagaatccagcagttcgacgacggcggcagcgacgaggaggacatctgggaggagaagcacatcgccttcacccccgagagccagagaagaagcagcagcggcagcaccgacagcgaggagagcaccgacagcgaggaggaggacggcgccaagcaggacctgttcgagcccagcagcgccaacaccgaggacaagatggaggtggacctgagcgagccccccaactggagcgccaacttcgacgtgcccatggagaccacccacggcgcccccctggacagcgtgggcagcgacgtgtggagcaccgaggagcccatgcccaccaaggagaccggctgggccagcttcagcgagttcaccagcagcctgagcaccaaggacagcctgagaagcaacagccccgtggagatggagaccagcaccgagcccatggaccccctgacccccagcgccgccgccctggccgtgcagcccgaggccgccggcagcgtggccatggaggccagcagcgacggcgaggaggacgccgagagcaccgacaaggtgaccgagaccgtgatgaacggcggcatgaaggagaccctgagcctgaccgtggacgccaagaccgagaccgccgtgttcaagagcgaggagggcaagctgagcaccagccaggacgccgcctgcaaggacgccgaggagtgccccgagaccgccgaggccaagtgcgccgcccccagaccccccagcagcagccccgagcagagaaccggccagcccagcgcccccggcgacaccagcgtgaacggccccgtgtag

SEQ ID NO: 9493 - DNA, 3375 bp, Artificial Sequence
  Description of Artificial Sequence: Synthetic coding sequence
atggaccccttcaccgagaagctgctggagagaaccagagccagaagagagaacctgcagagaaagatggccgagagacccaccgccgcccccagaagcatgacccacgccaagagagccagacagcccctgagcgaggccagcaaccagcagcccctgagcggcggcgaggagaagagctgcaccaagcccagccccagcaagaagagatgcagcgacaacaccgaggtggaggtgagcaacctggagaacaagcagcccgtggagagcaccagcgccaagagctgcagccccagccccgtgagcccccaggtgcagccccaggccgccgacaccatcagcgacagcgtggccgtgcccgccagcctgctgggcatgagaagaggcctgaacagcagactggaggccaccgccgccagcagcgtgaagaccagaatgcagaagctggccgagcagagaagaagatgggacaacgacgacatgaccgacgacatccccgagagcagcctgttcagccccatgcccagcgaggagaaggccgccagcccccccagacccctgctgagcaacgccagcgccacccccgtgggcagaagaggcagactggccaacctggccgccaccatctgcagctgggaggacgacgtgaaccacagcttcgccaagcagaacagcgtgcaggagcagcccggcaccgcctgcctgagcaagttcagcagcgccagcggcgccagcgccagaatcaacagcagcagcgtgaagcaggaggccaccttctgcagccagagagacggcgacgccagcctgaacaaggccctgagcagcagcgccgacgacgccagcctggtgaacgccagcatcagcagcagcgtgaaggccaccagccccgtgaagagcaccaccagcatcaccgacgccaagagctgcgagggccagaaccccgagctgctgcccaagacccccatcagccccctgaagaccggcgtgagcaagcccatcgtgaagagcaccctgagccagaccgtgcccagcaagggcgagctgagcagagagatctgcctgcagagccagagcaaggacaagagcaccacccccggcggcaccggcatcaagcccttcctggagagattcggcgagagatgccaggagcacagcaaggagagccccgccagaagcaccccccacagaacccccatcatcacccccaacaccaaggccatccaggagagactgttcaagcaggacaccagcagcagcaccacccacctggcccagcagctgaagcaggagagacagaaggagctggcctgcctgagaggcagattcgacaagggcaacatctggagcgccgagaagggcggcaacagcaagagcaagcagctggagaccaagcaggagacccactgccagagcacccccctgaagaagcaccagggcgtgagcaagacccagagcctgcccgtgaccgagaaggtgaccgagaaccagatccccgccaagaacagcagcaccgagcccaagggcttcaccgagtgcgagatgaccaagagcagccccctgaagatcaccctgttcctggaggaggacaagagcctgaaggtgaccagcgaccccaaggtggagcagaagatcgaggtgatcagagagatcgagatgagcgtggacgacgacgacatcaacagcagcaaggtgatcaacgacctgttcagcgacgtgctggaggagggcgagctggacatggagaagagccaggaggagatggaccaggccctggccgagagcagcgaggagcaggaggacgccctgaacatcagcagcatgagcctgctggcccccctggcccagaccgtgggcgtggtgagccccgagagcctggtgagcacccccagactggagctgaaggacaccagcagaagcgacgagagccccaagcccggcaagttccagagaaccagagtgcccagagccgagagcggcgacagcctgggcagcgaggacagagacctgctgtacagcatcgacgcctacagaagccagagattcaaggagaccgagagacccagcatcaagcaggtgatcgtgagaaaggaggacgtgaccagcaagctggacgagaagaacaacgccttcccctgccaggtgaacatcaagcagaagatgcaggagctgaacaacgagatcaacatgcagcagaccgtgatctaccaggccagccaggccctgaactgctgcgtggacgaggagcacggcaagggcagcctggaggaggccgaggccgagagactgctgctgatcgccaccggcaagagaaccctgctgatcgacgagctgaacaagctgaagaacgagggcccccagagaaagaacaaggccagcccccagagcgagttcatgcccagcaagggcagcgtgaccctgagcgagatcagactgcccctgaaggccgacttcgtgtgcagcaccgtgcagaagcccgacgccgccaactactactacctgatcatcctgaaggccggcgccgagaacatggtggccacccccctggccagcaccagcaacagcctgaacggcgacgccctgaccttcaccaccaccttcaccctgcaggacgtgagcaacgacttcgagatcaacatcgaggtgtacagcctggtgcagaagaaggaccccagcggcctggacaagaagaagaagaccagcaagagcaaggccatcacccccaagagactgctgaccagcatcaccaccaagagcaacatccacagcagcgtgatggccagccccggcggcctgagcgccgtgagaaccagcaacttcgccctggtgggcagctacaccctgagcctgagcagcgtgggcaacaccaagttcgtgctggacaaggtgcccttcctgagcagcctggagggccacatctacctgaagatcaagtgccaggtgaacagcagcgtggaggagagaggcttcctgaccatcttcgaggacgtgagcggcttcggcgcctggcacagaagatggtgcgtgctgagcggcaactgcatcagctactggacctaccccgacgacgagaagagaaagaaccccatcggcagaatcaacctggccaactgcaccagcagacagatcgagcccgccaacagagagttctgcgccagaagaaacaccttcgagctgatcaccgtgagaccccagagagaggacgacagagagaccctggtgagccagtgcagagacaccctgtgcgtgaccaagaactggctgagcgccgacaccaaggaggagagagacctgtggatgcagaagctgaaccaggtgctggtggacatcagactgtggcagcccgacgcctgctacaagcccatcggcaagccctag

SEQ ID NO: 9494 - DNA, 1365 bp, Artificial Sequence
  Description of Artificial Sequence: Synthetic coding sequence
atgctgaagcagatcctgagcgagatgtacatcgaccccgacctgctggccgagctgagcgaggagcagaagcagatcctgttcttcaagatgagagaggagcagatcagaagatggaaggagagagaggccgccatggagagaaaggagagcctgcccgtgaagcccagacccaagaaggagaacggcaagagcgtgcactggaagctgggcgccgacaaggaggtgtgggtgtgggtgatgggcgagcaccacctggacaagccctacgacgtgctgtgcaacgagatcatcgccgagagagccagactgaaggccgagcaggaggccgaggagcccagaaagacccacagcgaggagttcaccaacagcctgaagaccaagagccagtaccacgacctgcaggcccccgacaaccagcagaccaaggacatctggaagaaggtggccgagaaggaggagctggagcagggcagcagacccgcccccaccctggaggaggagaagatcagaagcctgagcagcagcagcagaaacatccagcagatgctggccgacagcatcaacagaatgaaggcctacgccttccaccagaagaaggagagcatgaagaagaagcaggacgaggagatcaaccagatcgaggaggagagaaccaagcagatctgcaagagctggaaggaggacagcgagtggcaggccagcctgagaaagagcaaggccgccgacgagaagagaagaagcctggccaagcaggccagagaggactacaagagactgagcctgggcgcccagaagggcagaggcggcgagagactgcagagccccctgagagtgccccagaagcccgagagaccccccctgccccccaagccccagttcctgaacagcggcgcctacccccagaagcccctgagaaaccagggcgtggtgagaaccctgagcagcagcgcccaggaggacatcatcagatggttcaaggaggagcagctgcccctgagagccggctaccagaagaccagcgacaccatcgccccctggttccacggcatcctgaccctgaagaaggccaacgagctgctgctgagcaccggcatgcccggcagcttcctgatcagagtgagcgagagaatcaagggctacgccctgagctacctgagcgaggacggctgcaagcacttcctgatcgacgccagcgccgacgcctacagcttcctgggcgtggaccagctgcagcacgccaccctggccgacctggtggagtaccacaaggaggagcccatcaccagcctgggcaaggagctgctgctgtacccctgcggccagcaggaccagctgcccgactacctggagctgttcgagtag

SEQ ID NO: 9495 - DNA, 1497 bp, Artificial Sequence
  Description of Artificial Sequence: Synthetic coding sequence
atggacgagaccgagtggatccacagacaccccaaggccgaggacctgagagtgggcctgatcagctgggccggcacctacctgaccttcgaggcctgcaagaacaccgtgaccgccaccgccaagagcctgggcagaagacagacctgggagatcctggtgagcaacgagcacgagacccaggccgtggtgagactgaagagcgtgcagggcctgtacctgctgtgcgagtgcgacggcaccgtgtgctacggcagacccagaaccagccaccacggctgcttcctgctgagattccacagaaacagcaagtggaccctgcagtgcctgatcagcggcagatacctggagagcaacggcaaggacgtgttctgcaccagccacgtgctgagcgcctaccacatgtggacccccagacccgccctgcacgtgcacgtgatcctgtacagccccatccacagatgctacgccagagccgaccccaccatgggcagaatctgggtggacgccgccgtgccctgcctggaggagtgcggcttcctgctgcacttcagagacggctgctaccacctggagaccagcacccaccacttcctgagccacgtggacagactgttcagccagcccagcagccagaccgccttccacatgcaggtgagacccggcggcctggtggccctgtgcgacggcgagggcggcatgctgtacccccagggcacccacctgctgctgggcatgggctgcaaccccatgagaggcgaggagtggttcatcctgcagcactgccccacctgggtgagcctgagaagcaagaccggcagattcatcagcgtgatctacgacggcgaggtgagagccgccagcgagagactgaacagaatgagcctgttccagttcgagtgcgacagcgagagccccaccgtgcagctgagaagcgccaacggctactacctgagccagagaagacacagagccgtgatggccgacggccaccccctggagagcgacaccttcttcagaatgcactggaactgcggcagaatcatcctgcagagctgcagaggcagattcctgggcatcgcccccaacagcctgctgatggccaacgtgatcctgcccggccccaacgaggagttcggcatcctgttcgccaacagaagcttcctggtgctgagaggcagatacggctacgtgggcagcagcagcggccacgacctgatccagtgcaaccaggaccagcccgacagaatccacctgctgccctgcagacccggcatctaccacttccaggcccagggcggcagcttctggagcatcaccagcttcggcaccttcagaccctggggcaagttcgccctgaacttctgcatcgagctgcagggcagcaacctgctgaccgtgctggcccccaacggcttctacatgagagccgaccagagcggcaccctgctggccgacagcgaggacatcaccagagagtgcatctgggagttctag

SEQ ID NO: 9496 - DNA, 1377 bp, Artificial Sequence
  Description of Artificial Sequence: Synthetic coding sequence
atggagagagagcccagcgccagcgaggccgcccccgccgccgccgccctgttcgcctggggcgccaacagctacggccagctgggcctgggccacaaggaggacgtgctgctgccccagcagctgaacgacttctgcaagcccagaagcgtgagaagaatcaccggcggcggcggccacagcgccgtggtgaccgacggcggcgacctgttcgtgtgcggcctgaacaaggacggccagctgggcctgggccacaccgaggacatcccctacttcaccccctgcaagagcctgttcggctgccccatccagcaggtggcctgcggctgggacttcaccatcatgctgaccgagaacggccaggtgctgagctgcggcagcaacagcttcggccagctgggcgtgccccacggccccagaagatgcgtggtgccccaggccatcgagctgcacaaggagaaggtggtgtgcatcgccgccggcctgagacacgccgtggccgccaccgccagcggcatcgtgttccagtggggcaccggcctggccagctgcggcagaagactgtgccccggccagaccctgcccctgttcttcaccgccaaggagcccagcagagtgaccggcctggagaacagcaaggccatgtgcgtgctggccggcagcgaccacagcgccagcctgaccgacgccggcgaggtgtacgtgtggggcagcaacaagcacggccagctggccaacgaggccgccttcctgcccgtgccccagaagatcgaggcccactgcttccagaacgagaaggtgaccgccatctggagcggctggacccacctggtggcccagaccgagaccggcaagatgttcacctggggcagagccgactacggccagctgggcagaaagctggagacctacgagggctggaagctggagaagcaggacagcttcctgccctgcagcagaccccccaacagcatgcccagcagcccccactgcctgaccggcgccaccgaggtgagctgcggcagcgagcacaacctggccatcatcggcggcgtgtgctacagctggggctggaacgagcacggcatgtgcggcgacggcaccgaggccaacgtgtgggcccccaagcccgtgcaggccctgctgagcagcagcggcctgctggtgggctgcggcgccggccacagcctggccctgtgccagctgcccgcccaccccgccctggtgcaggaccccaaggtgacctacctgagccccgacgccatcgaggacaccgagagccagaaggccatggacaaggagagaaactggaaggagagacagagcgagaccagcacccagagccagagcgactggagcagaaacggcggcctgtag

SEQ ID NO: 9497 - DNA, 2961 bp, Artificial Sequence
  Description of Artificial Sequence: Synthetic coding sequence
atggagagaatgaactggctgagcagactggccagcagaggccccggccacagaatcccccagggcgccaacctgcagacccccgtgatggccgaccccgagacctgcctgatggtgttcaagaaccactggagccaggtggtgagaatcctggagagacagggccccagagccgcccccggcggcgccgacgacctgagcgccgtgagaaaccacacctaccagatgctgaccctgctggccgaggacagagccgtgcccagcgcccccaccggccccggccccctgctggagttcgccctgcacgaggacctgctgaccagagtgctgacctggcagctgcagtgggacgagctgggcgacggcgtggaggagagaagagccgagcagctgaagctgttcgagatgctggtgagcgaggccagacagcccctgctgagacacggccccgtgagagaggccctgctgaccctgctggacgcctgcggcagacccgtgcccagcagccccgccctggacgagggcctggtgctgctgctgagccagctgtgcgtgtgcgtggcccaggagcccagcctgctggagttcttcctgcagcccccccccgagcccggcgccgcccccagactgctgctgttcagcagactggtgcccttcgtgcacagagagggcaccctgggccagcaggccagagacgccctgctgctgctgatggccctgagcgccggcagccccaccgtgggcagatacatcgccgaccacagctacttctgccccgtgctggccaccggcctgagcgccctgtacagcagcctgcccagaaagatcgaggtgcccggcgacgactggcactgcctgagaagagaggactggctgggcgtgcccgccctggccctgttcatgagcagcctggagttctgcaacgccgtgatccaggtggcccaccccctggtgcagaagcagctggtggactacatccacaacggcttcctggtgcccgtgatgggccccgccctgcacaagaccagcgtggaggagatgatcgccagcaccgcctacctggagctgttcctgagaagcatcagcgagcccgccctgctgagaaccttcctgagattcctgctgctgcacagacacgacacccacaccatcctggacaccctggtggccagaatcggcagcaacagcagactgtgcatggtgagcctgagcctgttcagaaccctgctgaacctgagctgcgaggacgtgctgctgcagctggtgctgagatacctggtgccctgcaaccacgtgatgctgagccagaagcccgccgtgagagacgtggacctgtacggcagagccgccgacaagttcctgagcctgatccccagatgctgcagacaccacgcccccagcccccccagacccgagcacgccagctgggccagaggcggccccagcagagagaccggcagaagagaggacatcaccggccccggcagccccagcgtggacagcagcagcgtgaccaccgtgcccagacccagcacccccagcagactggccctgttcctgagacagcagagcctgggcggcagcgagagccccggccccgccccctgcagccccggcctgagcgccagccccgccagcagccccggcagaagacccacccccgccgaggagcccggcgagctggaggacaactacctggagtacctgagagaggccagaagaggcgtggacagatgcgtgagagcctgcagaacctggagcgccccctacgacggcgagagacccagccccgagcccagccccttcggcagcagaaccaagaagagaagcctgctgcccgaggaggacagaaacaacgtgggcgagggcgaggaggaggagctgggcagaagaggcagagccggcggcgccggcgagggccccggccacctgccccccccccagctgaacggcgtgcccggcagctggcccgagggcgccaagaaggtgagactggtgcccaaggagggcgccggcgagctgctggagggcatcagcgagggcatggccggcctggagggcttcggccaggagctgagagagctggaggtggccctgagcaacggcggcaccggcagcgagagccccctggagccccccctgcccctggaggaggaggaggcctacgagagcttcacctgcccccccgagccccccggccccttcctgagcagccccctgagaaccctgaaccagctgcccagccagcccttcaccggccccttcatggccgtgctgttcgccaagctggagaacatgctgcagaacagcgtgtacgtgaacttcctgctgaccggcctggtggcccagctggcctgccacccccagcccctgctgagaagcttcctgctgaacaccaacatggtgttccagcccagcgtgaagagcctgctgcaggtgctgggcagcgtgaagaacaagatcgagaacttcgccgccagccaggaggacttccccgccctgctgagcaaggccaagaagtacctgatcgccagaggcaagctggactgggccgagggccccgccgccggccccgcccccagaagaagcgaccccctggtgaagagcagaagacccagcctgggcgagctgctgctgagacacgcccacagccccaccagagccagacaggccgcccagctggtgctgcagcccggcagagacggcgccggcctgggcctgagcggcggcagccccggcgccagcacccccgtgctgctgaccagaggcggcgcccccgagagacagggcgaggccctgagagtgaagaacgccgtgtactgcgccgtgatcttccccgagttcctgaaggagctggccgccatcagccaggcccacgccgtgaccagccccttcctgctggagaccagcgaggagggcagcggccccctgatcagcggctgcggccccctgaacccctag

SEQ ID NO: 9498 - DNA, 6723 bp, Artificial Sequence
  Description of Artificial Sequence: Synthetic coding sequence
atggacgacaagggcgaccccagcaacgaggaggcccccaaggccatcaagcccaccagcaaggagttcagaaagacctggggcttcagaagaaccaccatcgccaagagagagggcgccggcgacgccgaggccgaccccctggagcccccccccccccagcagcagctgggcctgagcctgagaagaagcggcagacagcccaagagaaccgagagagtggagcagttcctgaccatcgccagaagaagaggcagaagaagcatgcccgtgagcctggaggacagcggcgagcccaccagctgccccgccaccgacgccgagaccgccagcgagggcagcgtggagagcgccagcgagaccagaagcggcccccagagcgccagcaccgccgtgaaggagagacccgccagcagcgagaaggtgaagggcggcgacgaccacgacgacaccagcgacagcgacagcgacggcctgaccctgaaggagctgcagaacagactgagaagaaagagagagcaggagcccaccgagagacccctgaagggcatccagagcagactgagaaagaagagaagagaggagggccccgccgagaccgtgggcagcgaggccagcgacaccgtggagggcgtgctgcccagcaagcaggagcccgagaacgaccagggcgtggtgagccaggccggcaaggacgacagagagagcaagctggagggcaaggccgcccaggacatcaaggacgaggagcccggcgacctgggcagacccaagcccgagtgcgagggctacgaccccaacgccctgtactgcatctgcagacagccccacaacaacagattcatgatctgctgcgacagatgcgaggagtggttccacggcgactgcgtgggcatcagcgaggccagaggcagactgctggagagaaacggcgaggactacatctgccccaactgcaccatcctgcaggtgcaggacgagacccacagcgagaccgccgaccagcaggaggccaagtggagacccggcgacgccgacggcaccgactgcaccagcatcggcaccatcgagcagaagagcagcgaggaccagggcatcaagggcagaatcgagaaggccgccaaccccagcggcaagaagaagctgaagatcttccagcccgtgatcgaggcccccggcgccagcaagtgcatcggccccggctgctgccacgtggcccagcccgacagcgtgtactgcagcaacgactgcatcctgaagcacgccgccgccaccatgaagttcctgagcagcggcaaggagcagaagcccaagcccaaggagaagatgaagatgaagcccgagaagcccagcctgcccaagtgcggcgcccaggccggcatcaagatcagcagcgtgcacaagagacccgcccccgagaagaaggagaccaccgtgaagaaggccgtggtggtgcccgccagaagcgaggccctgggcaaggaggccgcctgcgagagcagcacccccagctgggccagcgaccacaactacaacgccgtgaagcccgagaagaccgccgcccccagccccagcctgctgtacaagagcaccaaggaggacagaagaagcgaggagaaggccgccgccatggccgccagcaagaagaccgccccccccggcagcgccgtgggcaagcagcccgcccccagaaacctggtgcccaagaagagcagcttcgccaacgtggccgccgccacccccgccatcaagaagccccccagcggcttcaagggcaccatccccaagagaccctggctgagcgccacccccagcagcggcgccagcgccgccagacaggccggccccgcccccgccgccgccaccgccgccagcaagaagttccccggcagcgccgccctggtgggcgccgtgagaaagcccgtggtgcccagcgtgcccatggccagccccgcccccggcagactgggcgccatgagcgccgcccccagccagcccaacagccagatcagacagaacatcagaagaagcctgaaggagatcctgtggaagagagtgaacgacagcgacgacctgatcatgaccgagaacgaggtgggcaagatcgccctgcacatcgagaaggagatgttcaacctgttccaggtgaccgacaacagatacaagagcaagtacagaagcatcatgttcaacctgaaggaccccaagaaccagggcctgttccacagagtgctgagagaggagatcagcctggccaagctggtgagactgaagcccgaggagctggtgagcaaggagctgagcacctggaaggagagacccgccagaagcgtgatggagagcagaaccaagctgcacaacgagagcaagaagaccgcccccagacaggaggccatccccgacctggaggacagcccccccgtgagcgacagcgaggagcagcaggagagcgccagagccgtgcccgagaagagcaccgcccccctgctggacgtgttcagcagcatgctgaaggacaccaccagccagcacagagcccacctgttcgacctgaactgcaagatctgcaccggccaggtgcccagcgccgaggacgagcccgcccccaagaagcagaagctgagcgccagcgtgaagaaggaggacctgaagagcaagcacgacagcagcgcccccgaccccgcccccgacagcgccgacgaggtgatgcccgaggccgtgcccgaggtggccagcgagcccggcctggagagcgccagccaccccaacgtggacagaacctacttccccggcccccccggcgacggccaccccgagcccagccccctggaggacctgagcccctgccccgccagctgcggcagcggcgtggtgaccaccgtgaccgtgagcggcagagaccccagaaccgcccccagcagcagctgcaccgccgtggccagcgccgccagcagacccgacagcacccacatggtggaggccagacaggacgtgcccaagcccgtgctgaccagcgtgatggtgcccaagagcatcctggccaagcccagcagcagccccgaccccagatacctgagcgtgccccccagccccaacatcagcaccagcgagagcagaagcccccccgagggcgacaccaccctgttcctgagcagactgagcaccatctggaagggcttcatcaacatgcagagcgtggccaagttcgtgaccaaggcctaccccgtgagcggctgcttcgactacctgagcgaggacctgcccgacaccatccacatcggcggcagaatcgcccccaagaccgtgtgggactacgtgggcaagctgaagagcagcgtgagcaaggagctgtgcctgatcagattccaccccgccaccgaggaggaggaggtggcctacatcagcctgtacagctacttcagcagcagaggcagattcggcgtggtggccaacaacaacagacacgtgaaggacctgtacctgatccccctgagcgcccaggaccccgtgcccagcaagctgctgcccttcgagggccccggcctggagagccccagacccaacatcatcctgggcctggtgatctgccagaagatcaagagacccgccaacagcggcgagctggacaagatggacgagaagagaaccagactgcagcccgaggaggccgacgtgcccgcctaccccaaggtggccaccgtgccccagagcgagaagaagcccagcaagtaccccctgtgcagcgccgacgccgccgtgagcaccaccccccccggcagcccccccccccccccccccctgcccgagccccccgtgctgaaggtgctgagcagcctgaagcccgccgcccccagccccgccaccgccgccaccaccgccgccgccgccagcaccgccgccagcagcaccgccagcagcgccagcaagaccgccagccccctggagcacatcctgcagaccctgttcggcaagaagaagagcttcgaccccagcgccagagagccccccggcagcaccgccggcctgccccaggagcccaagaccaccgccgaggacggcgtgcccgccccccccctgctggaccccatcgtgcagcagttcggccagttcagcaaggacaaggccctggaggaggaggaggacgacagaccctacgaccccgaggaggagtacgaccccgagagagccttcgacacccagctggtggagagaggcagaagacacgaggtggagagagcccccgaggccgccgccgccgagagagaggaggtggcctacgaccccgaggacgagaccatcctggaggaggccaaggtgaccgtggacgacctgcccaacagaatgtgcgccgacgtgagaagaaacagcgtggagagacccgccgagcccgtggccggcgccgccacccccagcctggtggagcagcagaagatgctggaggagctgaacaagcagatcgaggagcagaagagacagctggaggagcaggaggaggccctgagacagcagagagccgccgtgggcgtgagcatggcccacttcagcgtgagcgacgccctgatgagccccccccccaagagcagcctgcccaaggccgagctgttccagcaggagcagcagagcgccgacaagcccgccagcctgccccccgccagccaggccagcaaccacagagaccccagacaggccagaagactggccaccgagaccggcgagggcgagggcgagcccctgagcagactgagcgccagaggcgcccagggcgccctgcccgagagagacgccagcagaggcggcctggtgggccaggcccccatgcccgtgcccgaggagaaggagcccgccagcagcccctgggccagcggcgagaagccccccgccggcagcgagcaggacggctggaaggccgagcccggcgagggcaccagacccgccaccgtgggcgacagcagcgccagacccgccagaagagtgctgctgcccacccccccctgcggcgccctgcagcccggcttccccctgcagcacgacggcgagagagaccccttcacctgccccggcttcgccagccaggacaaggccctgggcagcgcccagtacgaggaccccagaaacctgcacagcgccggcagaagcagcagccccgccggcgagaccgagggcgacagagagccccaggccagacccggcgagggcaccgcccccctgcccccccccggccagaaggtgggcggcagccagccccccttccagggccagagagagcccggcccccacgccctgggcatgagcggcctgcacggccccaacttccccggccccagaggccccgccccccccttccccgaggagaacatcgccagcaacgacggccccagaggccccccccccgccagattcggcgcccagaagggccccatccccagcctgttcagcggccagcacggcccccccccctacggcgacagcagaggccccagccccagctacctgggcggccccagaggcgtggcccccagccagttcgaggagagaaaggacccccacggcgagaagagagagttccaggacgccccctacaacgaggtgaccggcgcccccgcccagttcgagggcaccgagcaggcccccttcctgggcagcagaggcggcgcccccttccagttcggcggccagagaagacccctgctgagccagctgaagggccccagaggcggccccccccccagccagttcggcggccagagaggccccccccccggccacttcgtgggccccagaggcccccaccccagccagttcgagaccgccagaggcccccaccccaaccagttcgagggccccagaggccaggcccccaacttcatgcccggccccagaggcatccagccccagcagttcgaggaccagagagtgcacagcccccccagattcaccaaccagagagcccccgcccccctgcagttcggcggcctgagaggcagcgcccccttcagcgagaagaacgagcagacccccagcagattccacttccagggccaggccccccaggtgatgaagcccggccccagacccctgctggagctgcccagccaccccccccagcacagaaaggacagatgggaggaggccggcccccccagcgccctgagcagcagcgcccccggccagggccccgaggccgacggccagtgggccagcgccgacttcagagagggcaagggccacgagtacagaaaccagaccttcgagggcagacagagagagagattcgacgtgggccccaaggagaagcccctggaggagcccgacgcccagggcagagccagcgaggacagaagaagagagagagagagaggcagaaactggagcagagagagagactgggacagacccagagagtgggacagacacagagacaaggacagcagcagagactgggacagaaacagagagagaagcgccaacagagacagagagagagaggccgacagaggcaaggagtgggacagaagcagagagagaagcagaaacagagagagagagagagacagaagaagagacagagacagaagcagaagcagagagagagacagagacaaggccagagacagagagagaggcagagacagaaaggacagaagcaagagcaaggagagcgccagagaccccaagcccgaggccagcagagccagcgacgccggcaccgccagccaggcctag

SEQ ID NO: 9499 - DNA, 1635 bp, Artificial Sequence
  Description of Artificial Sequence: Synthetic coding sequence
atggacgacaagggcgaccccagcaacgaggaggcccccaaggccatcaagcccaccagcaaggagttcagaaagacctggggcttcagaagaaccaccatcgccaagagagagggcgccggcgacgccgaggccgaccccctggagcccccccccccccagcagcagctgggcctgagcctgagaagaagcggcagacagcccaagagaaccgagagagtggagcagttcctgaccatcgccagaagaagaggcagaagaagcatgcccgtgagcctggaggacagcggcgagcccaccagctgccccgccaccgacgccgagaccgccagcgagggcagcgtggagagcgccagcgagaccagaagcggcccccagagcgccagcaccgccgtgaaggagagacccgccagcagcgagaaggtgaagggcggcgacgaccacgacgacaccagcgacagcgacagcgacggcctgaccctgaaggagctgcagaacagactgagaagaaagagagagcaggagcccaccgagagacccctgaagggcatccagagcagactgagaaagaagagaagagaggagggccccgccgagaccgtgggcagcgaggccagcgacaccgtggagggcgtgctgcccagcaagcaggagcccgagaacgaccagggcgtggtgagccaggccggcaaggacgacagagagagcaagctggagggcaaggccgcccaggacatcaaggacgaggagcccggcgacctgggcagacccaagcccgagtgcgagggctacgaccccaacgccctgtactgcatctgcagacagccccacaacaacagattcatgatctgctgcgacagatgcgaggagtggttccacggcgactgcgtgggcatcagcgaggccagaggcagactgctggagagaaacggcgaggactacatctgccccaactgcaccatcctgcaggtgcaggacgagacccacagcgagaccgccgaccagcaggaggccaagtggagacccggcgacgccgacggcaccgactgcaccagcatcggcaccatcgagcagaagagcagcgaggaccagggcatcaagggcagaatcgagaaggccgccaaccccagcggcaagaagaagctgaagatcttccagcccgtgatcgaggcccccggcgccagcaagtgcatcggccccggctgctgccacgtggcccagcccgacagcgtgtactgcagcaacgactgcatcctgaagcacgccgccgccaccatgaagttcctgagcagcggcaaggagcagaagcccaagcccaaggagaagatgaagatgaagcccgagaagcccagcctgcccaagtgcggcgcccaggccggcatcaagatcagcagcgtgcacaagagacccgcccccgagaagaaggagaccaccgtgaagaaggccgtggtggtgcccgccagaagcgaggccctgggcaaggaggccgcctgcgagagcagcacccccagctgggccagcgaccacaactacaacgccgtgaagcccgagaagaccgccgcccccagccccagcctgctgtacaagtgcagcggcaagtacagctacagcctgcaccccagcctgatcgcctag

SEQ ID NO: 9500 - DNA, 1164 bp, Artificial Sequence
  Description of Artificial Sequence: Synthetic coding sequence
atggagagacccccccccagagccgccggcagagaccccagcgccctgagagccgaggccccctggctgagagccgagggccccggccccagagccgcccccgtgaccgtgcccacccccccccagggcagcagcgtgggcggcggcttcgccggcctggagttcgccagaccccaggagagcgagcccagagccagcgacctgggcgcccccagaacctggaccggcgccgccgccggccccagaacccccagcgcccacatccccgtgcccgcccagagagccacccccggcaaggccagactggacgaggtgatggccgccgccgccctgaccagcctgagcaccagccccctgctgctgggcgcccccgtggccgccttcagccccgagcccggcctggagccctggaaggaggccctggtgagaccccccggcagctacagcagcagcagcaacagcggcgactggggctgggacctggccagcgaccagagcagccccagcacccccagcccccccctgccccccgaggccgcccacttcctgttcggcgagcccaccctgagaaagagaaagagccccgcccaggtgatgttccagtgcctgtggaagagctgcggcaaggtgctgagcaccgccagcgccatgcagagacacatcagactggtgcacctgggcagacaggccgagcccgagcagagcgacggcgaggaggacttctactacaccgagctggacgtgggcgtggacaccctgaccgacggcctgagcagcctgacccccgtgagccccaccgccagcatgccccccgccttccccagactggagctgcccgagctgctggagccccccgccctgcccagccccctgagaccccccgccccccccctgccccccccccccgtgctgagcaccgtggccaacccccagagctgccacagcgacagagtgtaccagggctgcctgacccccgccagactggagccccagcccaccgaggtgggcgcctgcccccccgccctgagcagcagaatcggcgtgaccctgagaaagcccagaggcgacgccaagaagtgcagaaaggtgtacggcatggagagaagagacctgtggtgcaccgcctgcagatggaagaaggcctgccagagattcctggactag

SEQ ID NO: 9501 - DNA, 414 bp, Artificial Sequence
  Description of Artificial Sequence: Synthetic coding sequence
atgctgagattctgcgccggcctgagcgacttcgcccccgtggccgtgagaagcctgcaggacctggccagaatcgccatcagaggcaccatcaagaagatcatccaccaggagaccgtgagcaagaacggcaacggcctgaagaacacccccagattcaagagaagaagagtgagaagaagaagaatggagaccatcgtgttcctggacaaggaggtgttcgccagcagaatcagcaaccccagcgacgacaacagctgcgaggacctggaggaggagagaagagaggaggaggagaagaccccccccgagaccaagcccgacccccccgtgaacttcctgagacagaaggtgctgagcctgcccctgcccgaccccctgaagtactacctgctgtactacagagagaagtag

SEQ ID NO: 9502 - DNA, 2505 bp, Artificial Sequence
  Description of Artificial Sequence: Synthetic coding sequence
atgagactgctggacggcaagcagaccagcagatacagcgagaacgcctgcgagaagaagatcttcagcatctacggccactaccccgtggtgagagccgccctgagaagaaagggctgggtggagaagaagttccacttcctgcccaaggtgatccccgacgtggaggacgagggcgccagagtgaacgacgacacctgcgccaaggtgaaggagaaccaggagatggccctggagaagaccgacaacatccacgacgtgatgagcagactggtgaagaacgagatgccctacctgctgtggaccatcaagagagacatcatcgactaccacagcctgacctacgaccagatgctgaaccactacgccaagaccgccagcttcaccaccaagatcggcctgtgcgtgaacatgagaagcctgccctggtacgtgcccgccaaccccgacagcttcttccccagatgctacagcctgtgcaccgagagcgagcagcaggagttcctggaggacttcagaagaaccatggccagcagcatcctgaagtgggtggtgagccaccagagctgcagcagaagcagcagaagcaagcccagagaccagagagaggaggccggcagcagcgacctgagcagcagacaggacgccgagaacgccgaggccaagctgagaggcctgcccggccagctggtggacatcgcctgcaaggtgtgccaggcctacctgggccagctggagcacgaggacatcgacaccagcgccgacgccgtggaggacctgaccgaggccgagtgggaggacctgacccagcagtactacagcctggtgcaggtgcccctgggcagcagcatcgtgctgtgcatcttcaagatccagaaggtgatgatgagcttcgagccccccaccgccagagacagacagtgccaggccctgctgaacagaatcaccagcgtgaacccccagaccgacatcgacggcctgagaaacatctggatcatcaagcccgccgccaagagcagaggcagaggcgagagccccgacatcgtgtgcatggacagagtggaggagatcctggagctggccgccgccgaccaccccctgagcagagacaacaagtgggtggtgcagaagtacatcgagacccccctgctgatctgcgacaccaagttcgacatcagacagtggttcctggtgaccgactggaaccccctgaccatctggttctacaaggagagctacctgagattcagcacccagagattcagcctggacaagctggacagcgccatccacctgtgcaacaacgccgtgcagaagtacctgaagaacgacgtgggcagaagccccctgctgcccgcccacaacatgtggaccagcaccagattccaggagtacctgcagagacagggcagaggcgccgtgtggggcagcgtgatctaccccagcatgaagaaggccatcgcccacgccatgaaggtggcccaggaccacgtggagcccagaaagaacagcttcgagctgtacggcgccgacttcgtgctgggcagagacttcagaccctggctgatcgagatcaacagcagccccaccatgcaccccagcacccccgtgaccgcccagctgtgcgcccaggtgcaggaggacaccatcaaggtggccgtggacagaagctgcgacatcggcaacttcgagctgctgtggagacagcccgtggtggagcccccccccttcagcggcagcgacctgtgcgtggccggcgtgagcgtgagaagagccagaagacaggtgctgcccgtgtgcaacctgaaggccagcgccagcctgctggacgcccagcccctgaaggccagaggccccagcgccatgcccgaccccgcccagggcccccccagccccgccctgcagagagacctgggcctgaaggaggagaagggcctgcccctggccctgctggcccccctgagaggcgccgccgagagcggcggcgccgcccagcccaccagaaccaaggccgccggcaaggtggagctgcccgcctgcccctgcagacacgtggacagccaggcccccaacaccggcgtgcccgtggcccagcccgccaagagctgggaccccaaccagctgaacgcccaccccctggagcccgtgctgagaggcctgaagaccgccgagggcgccctgagacccccccccggcggcaagggcgagggcaccgtgtgcagcagactgccccaccacggccaccacgtggccgcctgccagaccaccggcaccacctgggacggcggccccggcgtgtgcttcctgagacagctgctggccagcgagctgcccatgggccccggcctgcccagagaccccagagcccccccctgcctggtgtgcagaggcctgctgccccccgccggcccctgcaagagatgcagaagcttctgcgccgccgtgctgcagggcgccagcttcgtgagactgggcggcagaagctgcagccccagaaccccctag

SEQ ID NO: 9503 - DNA, 759 bp, Artificial Sequence
  Description of Artificial Sequence: Synthetic coding sequence
atgtgcagcaccagcggctgcgacctggaggagatccccctggacgacgacgacctgaacaccatcgagttcaagatcctggcctactacaccagacaccacgtgttcaagagcacccccgccctgttcagccccaagctgctgagaaccagaagcctgagccagagaggcctgggcaactgcagcgccaacgagagctggaccgaggtgagctggccctgcagaaacagccagagcagcgagaaggccatcaacctgggcaagaagaagagcagctggaaggccttcttcggcgtggtggagaaggaggacagccagagcacccccgccaaggtgagcgcccagggccagagaaccctggagtaccaggacagccacagccagcagtggagcagatgcctgagcaacgtggagcagtgcctggagcacgaggccgtggaccccaaggtgatcagcatcgccaacagagtggccgagatcgtgtacagctggccccccccccaggccacccaggccggcggcttcaagagcaaggagatcttcgtgaccgagggcctgagcttccagctgcagggccacgtgcccgtggccagcagcagcaagaaggacgaggaggagcagatcctggccaagatcgtggagctgctgaagtacagcggcgaccagctggagagaaaggacaccgccttcatccccatccccctggtggacaccagcatccagggcttcccccaggacggcctgatggcctgcatctag

SEQ ID NO: 9504 - DNA, 261 bp, Artificial Sequence
  Description of Artificial Sequence: Synthetic coding sequence
atgagcctgcccctgaaccccaagcccttcctgaacggcctgaccggcaagcccgtgatggtgaagctgaagtggggcatggagtacaagggctacctggtgagcgtggacggctacatgaacatgcagctggccaacaccgaggagtacatcgacggcgccctgagcggccacctgggcgaggtgctgatcagatgcaacaacgtgctgtacatcagaggcgtggaggaggaggaggaggacggcgagatgagagagtag

SEQ ID NO: 9505 - DNA, 1281 bp, Artificial Sequence
  Description of Artificial Sequence: Synthetic coding sequence
atggccagcggccacagcctgctgctggagaacgcccagcaggtggtgctggtgtgcgccagaggcgagagattcctggccagagacgccctgagaagcctggccgtgctggagggcgccagcctggtggtgggcaaggacggcttcatcaaggccatcggccccgccgacgtgatccagagacagttcagcggcgagaccttcgaggagatcatcgactgcagcggcaagtgcatcctgcccggcctggtggacgcccacacccaccccgtgtgggccggcgagagagtgcacgagttcgccatgaagctggccggcgccacctacatggagatccaccaggccggcggcggcatccacttcaccgtggagagaaccagacaggccaccgaggaggagctgttcagaagcctgcagcagagactgcagtgcatgatgagagccggcaccaccctggtggagtgcaagagcggctacggcctggacctggagaccgagctgaagatgctgagagtgatcgagagagccagaagagagctggacatcggcatcagcgccacctactgcggcgcccacagcgtgcccaagggcaagaccgccaccgaggccgccgacgacatcatcaacaaccacctgcccaagctgaaggagctgggcagaaacggcgagatccacgtggacaacatcgacgtgttctgcgagaagggcgtgttcgacctggacagcaccagaagaatcctgcagagaggcaaggacatcggcctgcagatcaacttccacggcgacgagctgcaccccatgaaggccgccgagctgggcgccgagctgggcgcccaggccatcagccacctggaggaggtgagcgacgagggcatcgtggccatggccaccgccagatgcagcgccatcctgctgcccaccaccgcctacatgctgagactgaagcagcccagagccagaaagatgctggacgagggcgtgatcgtggccctgggcagcgacttcaaccccaacgcctactgcttcagcatgcccatggtgatgcacctggcctgcgtgaacatgagaatgagcatgcccgaggccctggccgccgccaccatcaacgccgcctacgccctgggcaagagccacacccacggcagcctggaggtgggcaagcagggcgacctgatcatcatcaacagcagcagatgggagcacctgatctaccagttcggcggccaccacgagctgatcgagtacgtgatcgccaagggcaagctgatctacaagacctag

SEQ ID NO: 9506 - DNA, 1263 bp, Artificial Sequence
  Description of Artificial Sequence: Synthetic coding sequence
atgttcagccccggccaggaggagcactgcgcccccaacaaggagcccgtgaagtacggcgagctggtggtgctgggctacaacggcgccctgcccaacggcgacagaggcagaagaaagagcagattcgccctgtacaagagacccaaggccaacggcgtgaagcccagcaccgtgcacgtgatcagcaccccccaggccagcaaggccatcagctgcaagggccagcacagcatcagctacaccctgagcagaaaccagaccgtggtggtggagtacacccacgacaaggacaccgacatgttccaggtgggcagaagcaccgagagccccatcgacttcgtggtgaccgacaccatcagcggcagccagaacaccgacgaggcccagatcacccagagcaccatcagcagattcgcctgcagaatcgtgtgcgacagaaacgagccctacaccgccagaatcttcgccgccggcttcgacagcagcaagaacatcttcctgggcgagaaggccgccaagtggaagaaccccgacggccacatggacggcctgaccaccaacggcgtgctggtgatgcaccccagaggcggcttcaccgaggagagccagcccggcgtgtggagagagatcagcgtgtgcggcgacgtgtacaccctgagagagaccagaagcgcccagcagagaggcaagctggtggagagcgagaccaacgtgctgcaggacggcagcctgatcgacctgtgcggcgccaccctgctgtggagaaccgccgacggcctgttccacacccccacccagaagcacatcgaggccctgagacaggagatcaacgccgccagaccccagtgccccgtgggcctgaacaccctggccttccccagcatcaacagaaaggaggtggtggaggagaagcagccctgggcctacctgagctgcggccacgtgcacggctaccacaactggggccacagaagcgacaccgaggccaacgagagagagtgccccatgtgcagaaccgtgggcccctacgtgcccctgtggctgggctgcgaggccggcttctacgtggacgccggcccccccacccacgccttcaccccctgcggccacgtgtgcagcgagaagagcgccaagtactggagccagatccccctgccccacggcacccacgccttccacgccgcctgccccttctgcgccacccagctggtgggcgagcagaactgcatcaagctgatcttccagggccccatcgactag

SEQ ID NO: 9507 - DNA, 1056 bp, Artificial Sequence
  Description of Artificial Sequence: Synthetic coding sequence
atgatcgtgcagagagtggtgctgaacagcagacccggcaagaacggcaaccccgtggccgagaacttcagaatggaggaggtgtacctgcccgacaacatcaacgagggccaggtgcaggtgagaaccctgtacctgagcgtggacccctacatgagatgcagaatgaacgaggacaccggcaccgactacatcaccccctggcagctgagccaggtggtggacggcggcggcatcggcatcatcgaggagagcaagcacaccaacctgaccaagggcgacttcgtgaccagcttctactggccctggcagaccaaggtgatcctggacggcaacagcctggagaaggtggacccccagctggtggacggccacctgagctacttcctgggcgccatcggcatgcccggcctgaccagcctgatcggcatccaggagaagggccacatcaccgccggcagcaacaagaccatggtggtgagcggcgccgccggcgcctgcggcagcgtggccggccagatcggccacttcctgggctgcagcagagtggtgggcatctgcggcacccacgagaagtgcatcctgctgaccagcgagctgggcttcgacgccgccatcaactacaagaaggacaacgtggccgagcagctgagagagagctgccccgccggcgtggacgtgtacttcgacaacgtgggcggcaacatcagcgacaccgtgatcagccagatgaacgagaacagccacatcatcctgtgcggccagatcagccagtacaacaaggacgtgccctaccccccccccctgagccccgccatcgaggccatccagaaggagagaaacatcaccagagagagattcctggtgctgaactacaaggacaagttcgagcccggcatcctgcagctgagccagtggttcaaggagggcaagctgaagatcaaggagaccgtgatcaacggcctggagaacatgggcgccgccttccagagcatgatgaccggcggcaacatcggcaagcagatcgtgtgcatcagcgaggagatcagcctgtag

SEQ ID NO: 9508 - DNA, 2172 bp, Artificial Sequence
  Description of Artificial Sequence: Synthetic coding sequence
atggccgaggaggaggagaccgccgccctgaccgagaaggtgatcagaacccagagagtgttcatcaacctgctggacagctacagcagcggcaacatcggcaagttcctgagcaactgcgtggtgggcgccagcctggaggagatcaccgaggaggaggaggaggaggacgagaacaagagcgccatgctggaggccagcagcaccaaggtgaaggagggcaccttccagatcgtgggcaccctgagcaagcccgacagccccagacccgacttcgccgtggagacctacagcgccatcagcagagaggacctgctgatgagactgctggagtgcgacgtgatcatctacaacatcaccgagagcagccagcagatggaggaggccatctgggccgtgagcgccctgagcgaggaggtgagccacttcgagaagagaaagctgttcatcctgctgagcaccgtgatgacctgggccagaagcaaggccctggaccccgaggacagcgaggtgcccttcaccgaggaggactacagaagaagaaagagccaccccaacttcctggaccacatcaacgccgagaagatggtgctgaagttcggcaagaaggccagaaagttcgccgcctacgtggtggccgccggcctgcagtacggcgccgagggcggcatgctgcacaccttcttcaagatggcctggctgggcgagatccccgccctgcccgtgttcggcgacggcaccaacgtgatccccaccatccacgtgctggacctggccggcgtgatccagaacgtgatcgaccacgtgcccaagccccactacctggtggccgtggacgagagcgtgcacaccctggaggacatcgtgaagtgcatcagcaagaacaccggccccggcaagatccagaagatccccagagagaacgcctacctgaccaaggacctgacccaggactgcctggaccacctgctggtgaacctgagaatggaggccctgttcgtgaaggagaacttcaacatcagatgggccgcccagaccggcttcgtggagaacatcaacaccatcctgaaggagtacaagcagagcagaggcctgatgcccatcaagatctgcatcctgggcccccccgccgtgggcaagagcagcatcgccaaggagctggccaactactacaagctgcaccacatccagctgaaggacgtgatcagcgaggccatcgccaagctggaggccatcgtggcccccaacgacgtgggcgagggcgaggaggaggtggaggaggaggaggaggaggagaacgtggaggacgcccaggagctgctggacggcatcaaggagagcatggagcagaacgccggccagctggacgaccagtacatcatcagattcatgaaggagaagctgaagagcatgccctgcagaaaccagggctacatcctggacggcttccccaagacctacgaccaggccaaggacctgttcaaccaggaggacgaggaggaggaggacgacgtgagaggcagaatgttccccttcgacaagctgatcatccccgagttcgtgtgcgccctggacgccagcgacgagttcctgaaggagagagtgatcaacctgcccgagagcatcgtggccggcacccactacagccaggacagattcctgagagccctgagcaactacagagacatcaacatcgacgacgagaccgtgttcaactacttcgacgagctggagatccaccccatccacatcgacgtgggcaagctggaggacgcccagaacagactggccatcaagcagctgatcaaggagatcggcgagcccagaaactacggcctgaccgacgaggagaaggccgaggaggagagaaaggccgccgaggagagactggccagagaggccgccgaggaggccgagagagagcaccaggaggccgtggagatggccgagaagatcgccagatgggaggagtggaacaagagactggaggaggtgaagagagaggagagagagctgctggaggcccagagcatccccctgagaaactacctgatgacctacgtgatgcccaccctgatccagggcctgaacgagtgctgcaacgtgagacccgaggaccccgtggacttcctggccgagtacctgttcaagaacaaccccgaggcccagtag

SEQ ID NO: 9509 - DNA, 1245 bp, Artificial Sequence
  Description of Artificial Sequence: Synthetic coding sequence
atgcagaccttcctgaagggcaagagagtgggctactggctgagcgagaagaagatcaagaagctgaacttccaggccttcgccgagctgtgcagaaagagaggcatggaggtggtgcagctgaacctgagcagacccatcgaggagcagggccccctggacgtgatcatccacaagctgaccgacgtgatcctggaggccgaccagaacgacagccagagcctggagctggtgcacagattccaggagtacatcgacgcccaccccgagaccatcgtgctggaccccctgcccgccatcagaaccctgctggacagaagcaagagctacgagctgatcagaaagatcgaggcctacatggaggacgacagaatctgcagcccccccttcatggagctgaccagcctgtgcggcgacgacaccatgagactgctggagaagaacggcctgaccttccccttcatctgcaagaccagagtggcccacggcaccaacagccacgagatggccatcgtgttcaaccaggagggcctgaacgccatccagcccccctgcgtggtgcagaacttcatcaaccacaacgccgtgctgtacaaggtgttcgtggtgggcgagagctacaccgtggtgcagagacccagcctgaagaacttcagcgccggcaccagcgacagagagagcatcttcttcaacagccacaacgtgagcaagcccgagagcagcagcgtgctgaccgagctggacaagatcgagggcgtgttcgagagacccagcgacgaggtgatcagagagctgagcagagccctgagacaggccctgggcgtgagcctgttcggcatcgacatcatcatcaacaaccagaccggccagcacgccgtgatcgacatcaacgccttccccggctacgagggcgtgagcgagttcttcaccgacctgctgaaccacatcgccaccgtgctgcagggccagagcaccgccatggccgccaccggcgacgtggccctgctgagacacagcaagctgctggccgagcccgccggcggcctggtgggcgagagaacctgcagcgccagccccggctgctgcggcagcatgatgggccaggacgccccctggaaggccgaggccgacgccggcggcaccgccaagctgccccaccagagactgggctgcaacgccggcgtgagccccagcttccagcagcactgcgtggccagcctggccaccaaggccagcagccagtag

SEQ ID NO: 9510 - DNA, 600 bp, Artificial Sequence
  Description of Artificial Sequence: Synthetic coding sequence
atgagattcagattctgcggcgacctggactgccccgactgggtgctggccgagatcagcaccctggccaagatgagcagcgtgaagctgagactgctgtgcagccaggtgctgaaggagctgctgggccagggcatcgactacgagaagatcctgaagctgaccgccgacgccaagttcgagagcggcgacgtgaaggccaccgtggccgtgctgagcttcatcctgagcagcgccgccaagcacagcgtggacggcgagagcctgagcagcgagctgcagcagctgggcctgcccaaggagcacgccgccagcctgtgcagatgctacgaggagaagcagagccccctgcagaagcacctgagagtgtgcagcctgagaatgaacagactggccggcgtgggctggagagtggactacaccctgagcagcagcctgctgcagagcgtggaggagcccatggtgcacctgagactggaggtggccgccgcccccggcacccccgcccagcccgtggccatgagcctgagcgccgacaagttccaggtgctgctggccgagctgaagcaggcccagaccctgatgagcagcctgggctag

SEQ ID NO: 9511 - DNA, 1224 bp, Artificial Sequence
  Description of Artificial Sequence: Synthetic coding sequence
atgagccacagaaagttcagcgcccccagacacggccacctgggcttcctgccccacaagagaagccacagacacagaggcaaggtgaagacctggcccagagacgaccccagccagcccgtgcacctgaccgccttcctgggctacaaggccggcatgacccacaccctgagagaggtgcacagacccggcctgaagatcagcaagagagaggaggtggaggccgtgaccatcgtggagaccccccccctggtggtggtgggcgtggtgggctacgtggccacccccagaggcctgagaagcttcaagaccatcttcgccgagcacctgagcgacgagtgcagaagaagattctacaaggactggcacaagagcaagaagaaggccttcaccaaggcctgcaagagatggagagacaccgacggcaagaagcagctgcagaaggacttcgccgccatgaagaagtactgcaaggtgatcagagtgatcgtgcacacccagatgaagctgctgcccttcagacagaagaaggcccacatcatggagatccagctgaacggcggcaccgtggccgagaaggtggcctgggcccaggccagactggagaagcaggtgcccgtgcacagcgtgttcagccagagcgaggtgatcgacgtgatcgccgtgaccaagggcagaggcgtgaagggcgtgaccagcagatggcacaccaagaagctgcccagaaagacccacaagggcctgagaaaggtggcctgcatcggcgcctggcaccccgccagagtgggctgcagcatcgccagagccggccagaagggctaccaccacagaaccgagctgaacaagaagatcttcagaatcggcagaggcccccacatggaggacggcaagctggtgaagaacaacgccagcaccagctacgacgtgaccgccaagagcatcacccccctgggcggcttcccccactacggcgaggtgaacaacgacttcgtgatgctgaagggctgcatcgccggcaccaagaagagagtgatcaccctgagaaagagcctgctggtgcaccacagcagacaggccgtggagaacatcgagctgaagttcatcgacaccaccagcaagttcggccacggcagattccagaccgcccaggagaagagagccttcatgggcccccagaagaagcacctggagaaggagacccccgagaccagcggcgacctgtag

SEQ ID NO: 9512 - DNA, 7323 bp, Artificial Sequence
  Description of Artificial Sequence: Synthetic coding sequence
atgagcagcagcggctacccccccaaccagggcgccttcagcaccgagcagagcagataccccccccacagcgtgcagtacaccttccccaacaccagacaccagcaggagttcgccgtgcccgactacagaagcagccacctggaggtgagccaggccagccagctgctgcagcagcagcagcagcagcagctgagaagaagacccagcctgctgagcgagttccaccccggcagcgacagaccccaggagagaagaaccagctacgagcccttccaccccggccccagccccgtggaccacgacagcctggagagcaagagacccagactggagcaggtgagcgacagccacttccagagagtgagcgccgccgtgctgcccctggtgcaccccctgcccgagggcctgagagccagcgccgacgccaagaaggaccccgccttcggcggcaagcacgaggcccccagcagccccatcagcggccagccctgcggcgacgaccagaacgccagccccagcaagctgagcaaggaggagctgatccagagcatggacagagtggacagagagatcgccaaggtggagcagcagatcctgaagctgaagaagaagcagcagcagctggaggaggaggccgccaagccccccgagcccgagaagcccgtgagccccccccccgtggagcagaagcacagaagcatcgtgcagatcatctacgacgagaacagaaagaaggccgaggaggcccacaagatcttcgagggcctgggccccaaggtggagctgcccctgtacaaccagcccagcgacaccaaggtgtaccacgagaacatcaagaccaaccaggtgatgagaaagaagctgatcctgttcttcaagagaagaaaccacgccagaaagcagagagagcagaagatctgccagagatacgaccagctgatggaggcctgggagaagaaggtggacagaatcgagaacaaccccagaagaaaggccaaggagagcaagaccagagagtactacgagaagcagttccccgagatcagaaagcagagagagcagcaggagagattccagagagtgggccagagaggcgccggcctgagcgccaccatcgccagaagcgagcacgagatcagcgagatcatcgacggcctgagcgagcaggagaacaacgagaagcagatgagacagctgagcgtgatcccccccatgatgttcgacgccgagcagagaagagtgaagttcatcaacatgaacggcctgatggaggaccccatgaaggtgtacaaggacagacagttcatgaacgtgtggaccgaccacgagaaggagatcttcaaggacaagttcatccagcaccccaagaacttcggcctgatcgccagctacctggagagaaagagcgtgcccgactgcgtgctgtactactacctgaccaagaagaacgagaactacaaggccctggtgagaagaaactacggcaagagaagaggcagaaaccagcagatcgccagacccagccaggaggagaaggtggaggagaaggaggaggacaaggccgagaagaccgagaagaaggaggaggagaagaaggacgaggaggagaaggacgagaaggaggacagcaaggagaacaccaaggagaaggacaagatcgacggcaccgccgaggagaccgaggagagagagcaggccacccccagaggcagaaagaccgccaacagccagggcagaagaaagggcagaatcaccagaagcatgaccaacgaggccgccgccgccagcgccgccgccgccgccgccaccgaggagccccccccccccctgccccccccccccgagcccatcagcaccgagcccgtggagaccagcagatggaccgaggaggagatggaggtggccaagaagggcctggtggagcacggcagaaactgggccgccatcgccaagatggtgggcaccaagagcgaggcccagtgcaagaacttctacttcaactacaagagaagacacaacctggacaacctgctgcagcagcacaagcagaagaccagcagaaagcccagagaggagagagacgtgagccagtgcgagagcgtggccagcaccgtgagcgcccaggaggacgaggacatcgaggccagcaacgaggaggagaaccccgaggacagcgaggtggaggccgtgaagcccagcgaggacagccccgagaacgccaccagcagaggcaacaccgagcccgccgtggagctggagcccaccaccgagaccgcccccagcaccagccccagcctggccgtgcccagcaccaagcccgccgaggacgagagcgtggagacccaggtgaacgacagcatcagcgccgagaccgccgagcagatggacgtggaccagcaggagcacagcgccgaggagggcagcgtgtgcgaccccccccccgccaccaaggccgacagcgtggacgtggaggtgagagtgcccgagaaccacgccagcaaggtggagggcgacaacaccaaggagagagacctggacagagccagcgagaaggtggagcccagagacgaggacctggtggtggcccagcagatcaacgcccagagacccgagccccagagcgacaacgacagcagcgccacctgcagcgccgacgaggacgtggacggcgagcccgagagacagagaatgttccccatggacagcaagcccagcctgctgaaccccaccggcagcatcctggtgagcagccccctgaagcccaaccccctggacctgccccagctgcagcacagagccgccgtgatcccccccatggtgagctgcaccccctgcaacatccccatcggcacccccgtgagcggctacgccctgtaccagagacacatcaaggccatgcacgagagcgccctgctggaggagcagagacagagacaggagcagatcgacctggagtgcagaagcagcaccagcccctgcggcaccagcaagagccccaacagagagtgggaggtgctgcagcccgccccccaccaggtgatcaccaacctgcccgagggcgtgagactgcccaccaccagacccaccagaccccccccccccctgatccccagcagcaagaccaccgtggccagcgagaagcccagcttcatcatgggcggcagcatcagccagggcacccccggcacctacctgaccagccacaaccaggccagctacacccaggagacccccaagcccagcgtgggcagcatcagcctgggcctgcccagacagcaggagagcgccaagagcgccaccctgccctacatcaagcaggaggagttcagccccagaagccagaacagccagcccgagggcctgctggtgagagcccagcacgagggcgtggtgagaggcaccgccggcgccatccaggagggcagcatcaccagaggcacccccaccagcaagatcagcgtggagagcatccccagcctgagaggcagcatcacccagggcacccccgccctgccccagaccggcatccccaccgaggccctggtgaagggcagcatcagcagaatgcccatcgaggacagcagccccgagaagggcagagaggaggccgccagcaagggccacgtgatctacgagggcaagagcggccacatcctgagctacgacaacatcaagaacgccagagagggcaccagaagccccagaaccgcccacgagatcagcctgaagagaagctacgagagcgtggagggcaacatcaagcagggcatgagcatgagagagagccccgtgagcgcccccctggagggcctgatctgcagagccctgcccagaggcagcccccacagcgacctgaaggagagaaccgtgctgagcggcagcatcatgcagggcacccccagagccaccaccgagagcttcgaggacggcctgaagtaccccaagcagatcaagagagagagcccccccatcagagccttcgagggcgccatcaccaagggcaagccctacgacggcatcaccaccatcaaggagatgggcagaagcatccacgagatccccagacaggacatcctgacccaggagagcagaaagacccccgaggtggtgcagagcaccagacccatcatcgagggcagcatcagccagggcacccccatcaagttcgacaacaacagcggccagagcgccatcaagcacaacgtgaagagcctgatcaccggccccagcaagctgagcagaggcatgccccccctggagatcgtgcccgagaacatcaaggtggtggagagaggcaagtacgaggacgtgaaggccggcgagaccgtgagaagcagacacaccagcgtggtgagcagcggccccagcgtgctgagaagcaccctgcacgaggcccccaaggcccagctgagccccggcatctacgacgacaccagcgccagaagaacccccgtgagctaccagaacaccatgagcagaggcagccccatgatgaacagaaccagcgacgtgaccatcagcagcaacaagagcaccaaccacgagagaaagagcaccctgacccccacccagagagagagcatccccgccaagagccccgtgcccggcgtggaccccgtggtgagccacagccccttcgacccccaccacagaggcagcaccgccggcgaggtgtacagaagccacctgcccacccacctggaccccgccatgcccttccacagagccctggaccccgccgccgccgcctacctgttccagagacagctgagccccacccccggctaccccagccagtaccagctgtacgccatggagaacaccagacagaccatcctgaacgactacatcaccagccagcagatgcaggtgaacctgagacccgacgtggccagaggcctgagccccagagagcagcccctgggcctgccctaccccgccaccagaggcatcatcgacctgaccaacatgccccccaccatcctggtgccccaccccggcggcaccagcaccccccccatggacagaatcacctacatccccggcacccagatcaccttcccccccagaccctacaacagcgccagcatgagccccggccaccccacccacctggccgccgccgccagcgccgagagagagagagagagagagagagagaaggagagagagagagagagaatcgccgccgccagcagcgacctgtacctgagacccggcagcgagcagcccggcagacccggcagccacggctacgtgagaagccccagccccagcgtgagaacccaggagaccatgctgcagcagagacccagcgtgttccagggcaccaacggcaccagcgtgatcacccccctggaccccaccgcccagctgagaatcatgcccctgcccgccggcggccccagcatcagccagggcctgcccgccagcagatacaacaccgccgccgacgccctggccgccctggtggacgccgccgccagcgccccccagatggacgtgagcaagaccaaggagagcaagcacgaggccgccagactggaggagaacctgagaagcagaagcgccgccgtgagcgagcagcagcagctggagcagaagaccctggaggtggagaagagaagcgtgcagtgcctgtacaccagcagcgccttccccagcggcaagccccagccccacagcagcgtggtgtacagcgaggccggcaaggacaagggccccccccccaagagcagatacgaggaggagctgagaaccagaggcaagaccaccatcaccgccgccaacttcatcgacgtgatcatcaccagacagatcgccagcgacaaggacgccagagagagaggcagccagagcagcgacagcagcagcagcctgagcagccacagatacgagacccccagcgacgccatcgaggtgatcagccccgccagcagccccgcccccccccaggagaagctgcagacctaccagcccgaggtggtgaaggccaaccaggccgagaacgaccccaccagacagtacgagggccccctgcaccactacagaccccagcaggagagccccagcccccagcagcagctgccccccagcagccaggccgagggcatgggccaggtgcccagaacccacagactgatcaccctggccgaccacatctgccagatcatcacccaggacttcgccagaaaccaggtgagcagccagaccccccagcagccccccaccagcaccttccagaacagccccagcgccctggtgagcacccccgtgagaaccaagaccagcaacagatacagccccgagagccaggcccagagcgtgcaccaccagagacccggcagcagagtgagccccgagaacctggtggacaagagcagaggcagcagacccggcaagagccccgagagaagccacgtgagcagcgagccctacgagcccatcagccccccccaggtgcccgtggtgcacgagaagcaggacagcctgctgctgctgagccagagaggcgccgagcccgccgagcagagaaacgacgccagaagccccggcagcatcagctacctgcccagcttcttcaccaagctggagaacaccagccccatggtgaagagcaagaagcaggagatcttcagaaagctgaacagcagcggcggcggcgacagcgacatggccgccgcccagcccggcaccgagatcttcaacctgcccgccgtgaccaccagcggcagcgtgagcagcagaggccacagcttcgccgaccccgccagcaacctgggcctggaggacatcatcagaaaggccctgatgggcagcttcgacgacaaggtggaggaccacggcgtggtgatgagccagcccatgggcgtggtgcccggcaccgccaacaccagcgtggtgaccagcggcgagaccagaagagaggagggcgaccccagcccccacagcggcggcgtgtgcaagcccaagctgatcagcaagagcaacagcagaaagagcaagagccccatccccggccagggctacctgggcaccgagagacccagcagcgtgagcagcgtgcacagcgagggcgactaccacagacagacccccggctgggcctgggaggacagacccagcagcaccggcagcacccagttcccctacaaccccctgaccatgagaatgctgagcagcaccccccccacccccatcgcctgcgcccccagcgccgtgaaccaggccgccccccaccagcagaacagaatctgggagagagagcccgcccccctgctgagcgcccagtacgagaccctgagcgacagcgacgactag

SEQ ID NO: 9513 - DNA, 2313 bp, Artificial Sequence
  Description of Artificial Sequence: Synthetic coding sequence
atgctgcagcaggtgaacggccacaaccccggcagcgacggccaggccagagagtacctgagagaggacctgcaggagttcctgggcggcgaggtgctgctgtacaagctggacgacctgaccagagtgaaccccgtgaccctggagaccgtgctgagatgcctgcaggccagatacatggccgacaccttctacaccaacgccggctgcaccctggtggccctgaaccccttcaagcccgtgccccagctgtacagccccgagctgatgagagagtaccacgccgccccccagccccagaagctgaagccccacgtgttcaccgtgggcgagcagacctacagaaacgtgaagagcctgatcgagcccgtgaaccagagcatcgtggtgagcggcgagagcggcgccggcaagacctggaccagcagatgcctgatgaagttctacgccgtggtggccaccagccccgccagctgggagagccacaagatcgccgagagaatcgagcagagaatcctgaacagcaaccccgtgatggaggccttcggcaacgcctgcaccctgagaaacaacaacagcagcagattcggcaagttcatccagctgcagctgaacagagcccagcagatgaccggcgccgccgtgcagacctacctgctggagaagaccagagtggcctgccaggccagcagcgagagaaacttccacatcttctaccagatctgcaagggcgccagcgaggacgagagactgcagtggcacctgcccgagggcgccgccttcagctggctgcccaaccccgagagaagcctggaggaggactgcttcgaggtgaccagagaggccatgctgcacctgggcatcgacacccccacccagaacaacatcttcaaggtgctggccggcctgctgcacctgggcaacatccagttcgccgccagcgaggacgaggcccagccctgccagcccatggacgacgccaagtacagcgtgagaaccgccgccagcctgctgggcctgcccgaggacgtgctgctggagatggtgcagatcagaaccatcagagccggcagacagcagcaggtgttcagaaagccctgcgccagagccgagtgcgacaccagaagagactgcctggccaagctgatctacgccagactgttcgactggctggtgagcgtgatcaacagcagcatctgcgccgacaccgacagctggaccaccttcatcggcctgctggacgtgtacggcttcgagagcttccccgacaacagcctggagcagctgtgcatcaactacgccaacgagaagctgcagctggaggcctgcggcctggtggagaccatccacatcagcgccgccggcttccccatcagagtgagccacagaaacttcgtggagagatacaagctgctgagaagactgcacccctgcaccagcagcggccccgacagcccctaccccgccaagggcctgcccgagtggtgcccccacagcgaggaggccaccctggagcccctgatccaggacatcctgcacaccctgcccgtgctgacccaggccgccgccatcaccggcgacagcgccgaggccatgcccgcccccatgcactgcggcagaaccaaggtgttcatgaccgacagcatgctggagctgctggagtgcggcagagccagagtgctggagcagtgcgccagatgcatccagggcggctggagaagacacagacacagagagcaggagagacagtggagagccgtgatgctgatccaggccgccatcagaagctggctgaccagaaagcacatccagagactgcacgccgccgccaccgtgatcaagagagcctggcagaagtggagaatcagaatggcctgcctggccgccaaggagctggacggcgtggaggagaagcacttcagccaggccccctgcagcctgagcaccagccccctgcagaccagactgctggaggccatcatcagactgtggcccctgggcctggtgctggccaacaccgccatgggcgtgggcagcttccagagaaagctggtggtgtgggcctgcctgcagctgcccagaggcagccccagcagctacaccgtgcagaccgcccaggaccaggccggcgtgaccagcatcagagccctgccccagggcagcatcaagttccactgcagaaagagccccctgagatacgccgacatctgccccgagcccagcccctacagcatcaccggcttcaaccagatcctgctggagagacacagactgatccacgtgaccagcagcgccttcaccggcctgggctag

SEQ ID NO: 9514 - DNA, 2796 bp, Artificial Sequence
  Description of Artificial Sequence: Synthetic coding sequence
atggccgaggtggaggccgtgcagctgaaggaggagggcaacagacacttccagctgcaggactacaaggccgccaccaacagctacagccaggccctgaagctgaccaaggacaaggccctgctggccaccctgtacagaaacagagccgcctgcggcctgaagaccgagagctacgtgcaggccgccagcgacgccagcagagccatcgacatcaacagcagcgacatcaaggccctgtacagaagatgccaggccctggagcacctgggcaagctggaccaggccttcaaggacgtgcagagatgcgccaccctggagcccagaaaccagaacttccaggagatgctgagaagactgaacaccagcatccaggagaagctgagagtgcagttcagcaccgacagcagagtgcagaagatgttcgagatcctgctggacgagaacagcgaggccgacaagagagagaaggccgccaacaacctgatcgtgctgggcagagaggaggccggcgccgagaagatcttccagaacaacggcgtggccctgctgctgcagctgctggacaccaagaagcccgagctggtgctggccgccgtgagaaccctgagcggcatgtgcagcggccaccaggccagagccaccgtgatcctgcacgccgtgagaatcgacagaatctgcagcctgatggccgtggagaacgaggagatgagcctggccgtgtgcaacctgctgcaggccatcatcgacagcctgagcggcgaggacaagagagagcacagaggcaaggaggaggccctggtgctggacaccaagaaggacctgaagcagatcaccagccacctgctggacatgctggtgagcaagaaggtgagcggccagggcagagaccaggccctgaacctgctgaacaagaacgtgcccagaaaggacctggccatccacgacaacagcagaaccatctacgtggtggacaacggcctgagaaagatcctgaaggtggtgggccaggtgcccgacctgcccagctgcctgcccctgaccgacaacaccagaatgctggccagcatcctgatcaacaagctgtacgacgacctgagatgcgaccccgagagagaccacttcagaaagatctgcgaggagtacatcaccggcaagttcgacccccaggacatggacaagaacctgaacgccatccagaccgtgagcggcatcctgcagggccccttcgacctgggcaaccagctgctgggcctgaagggcgtgatggagatgatggtggccctgtgcggcagcgagagagagaccgaccagctggtggccgtggaggccctgatccacgccagcaccaagctgagcagagccaccttcatcatcaccaacggcgtgagcctgctgaagcagatctacaagaccaccaagaacgagaagatcaagatcagaaccctggtgggcctgtgcaagctgggcagcgccggcggcaccgactacggcctgagacagttcgccgagggcagcaccgagaagctggccaagcagtgcagaaagtggctgtgcaacatgagcatcgacaccagaaccagaagatgggccgtggagggcctggcctacctgaccctggacgccgacgtgaaggacgacttcgtgcaggacgtgcccgccctgcaggccatgttcgagctggccaaggccggcaccagcgacaagaccatcctgtacagcgtggccaccaccctggtgaactgcaccaacagctacgacgtgaaggaggtgatccccgagctggtgcagctggccaagttcagcaagcagcacgtgcccgaggagcaccccaaggacaagaaggacttcatcgacatgagagtgaagagactgctgaaggccggcgtgatcagcgccctggcctgcatggtgaaggccgacagcgccatcctgaccgaccagaccaaggagctgctggccagagtgttcctggccctgtgcgacaaccccaaggacagaggcaccatcgtggcccagggcggcggcaaggccctgatccccctggccctggagggcaccgacgtgggcaaggtgaaggccgcccacgccctggccaagatcgccgccgtgagcaaccccgacatcgccttccccggcgagagagtgtacgaggtggtgagacccctggtgagactgctggacacccagagagacggcctgcagaactacgaggccctgctgggcctgaccaacctgagcggcagaagcgacaagctgagacagaagatcttcaaggagagagccctgcccgacatcgagaactacatgttcgagaaccacgaccagctgagacaggccgccaccgagtgcatgtgcaacatggtgctgcacaaggaggtgcaggagagattcctggccgacggcaacgacagactgaagctggtggtgctgctgtgcggcgaggacgacgacaaggtgcagaacgccgccgccggcgccctggccatgctgaccgccgcccacaagaagctgtgcctgaagatgacccaggtgaccacccagtggctggagatcctgcagagactgtgcctgcacgaccagctgagcgtgcagcacagaggcctggtgatcgcctacaacctgctggccgccgacgccgagctggccaagaagctggtggagagcgagctgctggagatcctgaccgtggtgggcaagcaggagcccgacgagaagaaggccgaggtggtgcagaccgccagagagtgcctgatcaagtgcatggactacggcttcatcaagcccgtgagctag

SEQ ID NO: 9515 - DNA, 2022 bp, Artificial Sequence
  Description of Artificial Sequence: Synthetic coding sequence
atggccagccagttctgcctgcccgagagcccctgcctgagccccctgaagcccctgaagccccacttcggcgacatccaggagggcatctacgtggccatccagagaagcgacaagagaatccacctggccgtggtgaccgagatcaacagagagaactactgggtgaccgtggagtgggtggagaaggccgtgaagaagggcaagaagatcgacctggagaccatcctgctgctgaaccccgccctggacagcgccgagcaccccatgccccccccccccctgagccccctggccctggcccccagcagcgccatcagagaccagagaaccgccaccaagtgggtggccatgatcccccagaagaaccagaccgccagcggcgacagcctggacgtgagagtgcccagcaagccctgcctgatgaagcagaagaagagcccctgcctgtgggagatccagaagctgcaggagcagagagagaagagaagaagactgcagcaggagatcagagccagaagagccctggacgtgaacaccagaaaccccaactacgagatcatgcacatgatcgaggagtacagaagacacctggacagcagcaagatcagcgtgctggagcccccccaggagcacagaatctgcgtgtgcgtgagaaagagacccctgaaccagagagagaccaccctgaaggacctggacatcatcaccgtgcccagcgacaacgtggtgatggtgcacgagagcaagcagaaggtggacctgaccagatacctgcagaaccagaccttctgcttcgaccacgccttcgacgacaaggccagcaacgagctggtgtaccagttcaccgcccagcccctggtggagagcatcttcagaaagggcatggccacctgcttcgcctacggccagaccggcagcggcaagacctacaccatgggcggcgacttcagcggcaccgcccaggactgcagcaagggcatctacgccctggtggcccaggacgtgttcctgctgctgagaaacagcacctacgagaagctggacctgaaggtgtacggcaccttcttcgagatctacggcggcaaggtgtacgacctgctgaactggaagaagaagctgcaggtgctggaggacggcaaccagcagatccaggtggtgggcctgcaggagaaggaggtgtgctgcgtggaggaggtgctgaacctggtggagatcggcaacagctgcagaaccagcagacagacccccgtgaacgcccacagcagcagaagccacgccgtgttccagatcatcctgaagagcggcagaatcatgcacggcaagttcagcctggtggacctggccggcaacgagagaggcgccgacaccaccaaggccagcagaaagagacagctggagggcgccgagatcaacaagagcctgctggccctgaaggagtgcatcctggccctgggccagaacaagccccacacccccttcagagccagcaagctgaccctggtgctgagagacagcttcatcggccagaacagcagcacctgcatgatcgccaccatcagccccggcatgaccagctgcgagaacaccctgaacaccctgagatacgccaacagagtgaagaagctgaacgtggacgtgagaccctaccacagaggccactaccccatcggccacgaggcccccagaatgctgaagagccacatcggcaacagcgagatgagcctgcagagagacgagttcatcaagatcccctacgtgcagagcgaggagcagaaggagatcgaggaggtggagaccctgcccaccctgctgggcaaggacaccaccatcagcggcaagggcagcagccagtggctggagaacatccaggagagagccggcggcgtgcaccacgacatcgacttctgcatcgccagaagcctgagcatcctggagcagaagatcgacgccctgaccgagatccagaagaagctgaagctgctgctggccgacctgcacgtgaagagcaaggtggagtag

SEQ ID NO: 9516 - DNA, 1236 bp, Artificial Sequence
  Description of Artificial Sequence: Synthetic coding sequence
atggccaccaccgccaccatggccaccagcggcagcgccagaaagagactgctgaaggaggaggacatgaccaaggtggagttcgagaccagcgaggaggtggacgtgacccccaccttcgacaccatgggcctgagagaggacctgctgagaggcatctacgcctacggcttcgagaagcccagcgccatccagcagagagccatcaagcagatcatcaagggcagagacgtgatcgcccagagccagagcggcaccggcaagaccgccaccttcagcatcagcgtgctgcagtgcctggacatccaggtgagagagacccaggccctgatcctggcccccaccagagagctggccgtgcagatccagaagggcctgctggccctgggcgactacatgaacgtgcagtgccacgcctgcatcggcggcaccaacgtgggcgaggacatcagaaagctggactacggccagcacgtggtggccggcacccccggcagagtgttcgacatgatcagaagaagaagcctgagaaccagagccatcaagatgctggtgctggacgaggccgacgagatgctgaacaagggcttcaaggagcagatctacgacgtgtacagatacctgccccccgccacccaggtggtgctgatcagcgccaccctgccccacgagatcctggagatgaccaacaagttcatgaccgaccccatcagaatcctggtgaagagagacgagctgaccctggagggcatcaagcagttcttcgtggccgtggagagagaggagtggaagttcgacaccctgtgcgacctgtacgacaccctgaccatcacccaggccgtgatcttctgcaacaccaagagaaaggtggactggctgaccgagaagatgagagaggccaacttcaccgtgagcagcatgcacggcgacatgccccagaaggagagagagagcatcatgaaggagttcagaagcggcgccagcagagtgctgatcagcaccgacgtgtgggccagaggcctggacgtgccccaggtgagcctgatcatcaactacgacctgcccaacaacagagagctgtacatccacagaatcggcagaagcggcagatacggcagaaagggcgtggccatcaacttcgtgaagaacgacgacatcagaatcctgagagacatcgagcagtactacagcacccagatcgacgagatgcccatgaacgtggccgacctgatctag

SEQ ID NO: 9517 - DNA, 1683 bp, Artificial Sequence
  Description of Artificial Sequence: Synthetic coding sequence
atggagctgcccgccgtgggcgagcacgtgttcgccgtggagagcatcgagaagaagagaatcagaaagggcagagtggagtacctggtgaagtggagaggctggagccccaagtacaacacctgggagcccgaggagaacatcctggaccccagactgctgatcgccttccagaacagagagagacaggagcagctgatgggctacagaaagagaggccccaagcccaagcccctggtggtgcaggtgcccaccttcgccagaagaagcaacgtgctgaccggcctgcaggacagcagcaccgacaacagagccaagctggacctgggcgcccagggcaagggccagggccaccagtacgagctgaacagcaagaagcaccaccagtaccagccccacagcaaggagagagccggcaagccccccccccccggcaagagcggcaagtactactaccagctgaacagcaagaagcaccacccctaccagcccgaccccaagatgtacgacctgcagtaccagggcggccacaaggaggcccccagccccacctgccccgacctgggcgccaagagccacccccccgacaagtgggcccagggcgccggcgccaagggctacctgggcgccgtgaagcccctggccggcgccgccggcgcccccggcaagggcagcgagaagggcccccccaacggcatgatgcccgcccccaaggaggccgtgaccggcaacggcatcggcggcaagatgaagatcgtgaagaacaagaacaagaacggcagaatcgtgatcgtgatgagcaagtacatggagaacggcatgcaggccgtgaagatcaagagcggcgaggtggccgagggcgaggccagaagccccagccacaagaagagagccgccgacgagagacacccccccgccgacagaaccttcaagaaggccgccggcgccgaggagaagaaggtggaggccccccccaagagaagagaggaggaggtgagcggcgtgagcgacccccagccccaggacgccggcagcagaaagctgagccccaccaaggaggccttcggcgagcagcccctgcagctgaccaccaagcccgacctgctggcctgggaccccgccagaaacacccacccccccagccaccacccccacccccacccccaccaccaccaccaccaccaccaccaccaccaccacgccgtgggcctgaacctgagccacgtgagaaagagatgcctgagcgagacccacggcgagagagagccctgcaagaagagactgaccgccagaagcatcagcacccccacctgcctgggcggcagccccgccgccgagagacccgccgacctgccccccgccgccgccctgccccagcccgaggtgatcctgctggacagcgacctggacgagcccatcgacctgagatgcgtgaagaccagaagcgaggccggcgagccccccagcagcctgcaggtgaagcccgagacccccgccagcgccgccgtggccgtggccgccgccgccgcccccaccaccaccgccgagaagccccccgccgaggcccaggacgagcccgccgagagcctgagcgagttcaagcccttcttcggcaacatcatcatcaccgacgtgaccgccaactgcctgaccgtgaccttcaaggagtacgtgaccgtgtag

SEQ ID NO: 9518 - DNA, 1218 bp, Artificial Sequence
  Description of Artificial Sequence: Synthetic coding sequence
atggacagcctggtgaccgccaacaccaagttctgcttcgacctgttccaggagatcggcaaggacgacagacacaagaacatcttcttcagccccctgagcctgagcgccgccctgggcatggtgagactgggcgccagaagcgacagcgcccaccagatcgacgaggtgctgcacttcaacgagttcagccagaacgagagcaaggagcccgacccctgcctgaagagcaacaagcagaaggccggcagcctgaacaacgagagcggcctggtgagctgctacttcggccagctgctgagcaagctggacagaatcaagaccgactacaccctgagcatcgccaacagactgtacggcgagcaggagttccccatctgccaggagtacctggacggcgtgatccagttctaccacaccaccatcgagagcgtggacttccagaagaaccccgagaagagcagacaggagatcaacttctgggtggagtgccagagccagggcaagatcaaggagctgttcagcaaggacgccatcaacgccgagaccgtgctggtgctggtgaacgccgtgtacttcaaggccaagtgggagacctacttcgaccacgagaacaccgtggacgcccccttctgcctgaacgccaacgagaacaagagcgtgaagatgatgacccagaagggcctgtacagaatcggcttcatcgaggaggtgaaggcccagatcctggagatgagatacaccaagggcaagctgagcatgttcgtgctgctgcccagccacagcaaggacaacctgaagggcctggaggagctggagagaaagatcacctacgagaagatggtggcctggagcagcagcgagaacatgagcgaggagagcgtggtgctgagcttccccagattcaccctggaggacagctacgacctgaacagcatcctgcaggacatgggcatcaccgacatcttcgacgagaccagagccgacctgaccggcatcagccccagccccaacctgtacctgagcaagatcatccacaagaccttcgtggaggtggacgagaacggcacccaggccgccgccgccaccggcgccgtggtgagcgagagaagcctgagaagctgggtggagttcaacgccaaccaccccttcctgttcttcatcagacacaacaagacccagaccatcctgttctacggcagagtgtgcagcccctag

SEQ ID NO: 9519 - DNA, 3537 bp, Artificial Sequence
  Description of Artificial Sequence: Synthetic coding sequence
atgctgagaatgaagctgcccctgaagcccacccaccccgccgagcccccccccgaggccgaggagcccgaggccgacgccagacccggcgccaaggcccccagcagaagaagaagagactgcagaccccccccccccccccccccccccgccggccccagcagaggccccctgccccccccccccccccccagaggcctgggcccccccgtggccggcggcgccgccgccggcgccggcatgcccggcggcggcggcggccccagcgccgccctgagagagcaggagagagtgtacgagtggttcggcctggtgctgggcagcgcccagagactggagttcatgtgcggcctgctggacctgtgcaaccccctggagctgagattcctgggcagctgcctggaggacctggccagaaaggactaccactacctgagagacagcgaggccaaggccaacggcctgagcgaccccggccccctggccgacttcagagagcccgccgtgagaagcagactgatcgtgtacctggccctgctgggcagcgagaacagagaggccgccggcagactgcacagactgctgccccaggtggacagcgtgctgaagagcctgagagccgccagaggcgagggcagcagaggcggcgccgaggacgagagaggcgaggacggcgacggcgagcaggacgccgagaaggacggcagcggccccgagggcggcatcgtggagcccagagtgggcggcggcctgggcagcagagcccaggaggagctgctgctgctgttcaccatggccagcctgcaccccgccttcagcttccaccagagagtgaccctgagagagcacctggagagactgagagccgccctgagaggcggccccgaggacgccgaggtggaggtggagccctgcaagttcgccggccccagagcccagaacaacagcgcccacggcgactacatgcagaacaacgagagcagcctgatcgagcaggcccccatcccccaggacggcctgaccgtggccccccacagagcccagagagaggccgtgcacatcgagaagatcatgctgaagggcgtgcagagaaagagagccgacaagtactgggagtacaccttcaaggtgaactggagcgacctgagcgtgaccaccgtgaccaagacccaccaggagctgcaggagttcctgctgaagctgcccaaggagctgagcagcgagaccttcgacaagaccatcctgagagccctgaaccagggcagcctgaagagagaggagagaagacaccccgacctggagcccatcctgagacagctgttcagcagcagcagccaggccttcctgcagagccagaaggtgcacagcttcttccagagcatcagcagcgacagcctgcacagcatcaacaacctgcagagcagcctgaagaccagcaagatcctggagcacctgaaggaggacagcagcgaggccagcagccaggaggaggacgtgctgcagcacgccatcatccacaagaagcacaccggcaagagccccatcgtgaacaacatcggcaccagctgcagccccctggacggcctgaccatgcagtacagcgagcagaacggcatcgtggactggagaaagcagagctgcaccaccatccagcaccccgagcactgcgtgaccagcgccgaccagcacagcgccgagaagagaagcctgagcagcatcaacaagaagaagggcaagccccagaccgagaaggagaagatcaagaagaccgacaacagactgaacagcagaatcaacggcatcagactgagcaccccccagcacgcccacggcggcaccgtgaaggacgtgaacctggacatcggcagcggccacgacacctgcggcgagaccagcagcgagagctacagcagccccagcagccccagacacgacggcagagagagcttcgagagcgaggaggagaaggacagagacaccgacagcaacagcgaggacagcggcaaccccagcaccaccagattcaccggctacggcagcgtgaaccagaccgtgaccgtgaagccccccgtgcagatcgccagcctgggcaacgagaacggcaacctgctggaggaccccctgaacagccccaagtaccagcacatcagcttcatgcccaccctgcactgcgtgatgcacaacggcgcccagaagagcgaggtggtggtgcccgcccccaagcccgccgacggcaagaccatcggcatgctggtgcccagccccgtggccatcagcgccatcagagagagcgccaacagcacccccgtgggcatcctgggccccaccgcctgcaccggcgagagcgagaagcacctggagctgctggccagccccctgcccatccccagcaccttcctgccccacagcagcacccccgccctgcacctgaccgtgcagagactgaagctgccccccccccagggcagcagcgagagctgcaccgtgaacatcccccagcagccccccggcagcctgagcatcgccagccccaacaccgccttcatccccatccacaaccccggcagcttccccggcagccccgtggccaccaccgaccccatcaccaagagcgccagccaggtggtgggcctgaaccagatggtgccccagatcgagggcaacaccggcaccgtgccccagcccaccaacgtgaaggtggtgctgcccgccgccggcctgagcgccgcccagccccccgccagctaccccctgcccggcagccccctggccgccggcgtgctgcccagccagaacagcagcgtgctgagcaccgccgccaccagcccccagcccgccagcgccggcatcagccaggcccaggccaccgtgccccccgccgtgcccacccacacccccggccccgcccccagccccagccccgccctgacccacagcaccgcccagagcgacagcaccagctacatcagcgccgtgggcaacaccaacgccaacggcaccgtggtgcccccccagcagatgggcagcggcccctgcggcagctgcggcagaagatgcagctgcggcaccaacggcaacctgcagctgaacagctactactaccccaaccccatgcccggccccatgtacagagtgcccagcttcttcaccctgcccagcatctgcaacggcagctacctgaaccaggcccaccagagcaacggcaaccagctgcccttcttcctgccccagaccccctacgccaacggcctggtgcacgaccccgtgatgggcagccaggccaactacggcatgcagcagatggccggcttcggcagattctaccccgtgtaccccgcccccaacgtggtggccaacaccagcggcagcggccccaagaagaacggcaacgtgagctgctacaactgcggcgtgagcggccactacgcccaggactgcaagcagagcagcatggaggccaaccagcagggcacctacagactgagatacgccccccccctgccccccagcaacgacaccctggacagcgccgactag

SEQ ID NO: 9520 - DNA, 411 bp, Artificial Sequence
  Description of Artificial Sequence: Synthetic coding sequence
atgcccggcaagaaggccagaaagaacgcccagcccagccccgccagagcccccgccggccccgccggcaccgccggcaccgccagagaccaggccggcttcgccatcggcatgcagctgagattcaccagaggcaagaagctgctgagcagcagcctgagcagcagccccctggccctgcccagaggccacgaggagcaggtgcaggtggccggcagcagagtgtgctacagcacccaggagatctggagacagaccgagctgcccgccgagaccagcgagagcgacatccagaccctgctgctgagaaacctgaccgccagcaagacctgcatgagaggcctgctgcagaagagcttcctgagaagatgcaccttccaccagttcgaggagagactgcactgcaactag

SEQ ID NO: 9521 - DNA, 879 bp, Artificial Sequence
  Description of Artificial Sequence: Synthetic coding sequence
atgaaggccaccgtgctgatgagacagcccggcagagtgcaggagatcgtgggcgccctgagaaagggcggcggcgacagactgcaggtgatcagcgacttcgacatgaccctgagcagattcgcctacaacggcaagagatgccccagcagctacaacatcctggacaacagcaagatcatcagcgaggagtgcagaaaggagctgaccgccctgctgcaccactactaccccatcgagatcgacccccacagaaccgtgaaggagaagctgccccacatggtggagtggtggaccaaggcccacaacctgctgtgccagcagaagatccagaagttccagatcgcccaggtggtgagagagagcaacgccatgctgagagagggctacaagaccttcttcaacaccctgtaccacaacaacatccccctgttcatcttcagcgccggcatcggcgacatcctggaggagatcatcagacagatgaaggtgttccaccccaacatccacatcgtgagcaactacatggacttcaacgaggacggcttcctgcagggcttcaagggccagctgatccacacctacaacaagaacagcagcgcctgcgagaacagcggctacttccagcagctggagggcaagaccaacgtgatcctgctgggcgacagcatcggcgacctgaccatggccgacggcgtgcccggcgtgcagaacatcctgaagatcggcttcctgaacgacaaggtggaggagagaagagagagatacatggacagctacgacatcgtgctggagaaggacgagaccctggacgtggtgaacggcctgctgcagcacatcctgtgccagggcgtgcagctggagatgcagggcccctag

SEQ ID NO: 9522 - DNA, 2010 bp, Artificial Sequence
  Description of Artificial Sequence: Synthetic coding sequence
atggacctgagaaccgccgtgtacaacgccgccagagacggcaagctgcagctgctgcagaagctgctgagcggcagaagcagagaggagctggacgagctgaccggcgaggtggccggcggcggcacccccctgctgatcgccgccagatacggccacctggacgtggtggagtacctggtggacagatgcggcgccagcgtggaggccggcggcagcgtgcacttcgacggcgagaccatcgagggcgccccccccctgtgggccgccagcgccgccggccacctggacgtggtgagaagcctgctgagaagaggcgccagcgtgaacagaaccaccagaaccaacagcacccccctgagagccgcctgcttcgacggccacctggaggtggtgagatacctggtgggcgagcaccaggccgacctggaggtggccaacagacacggccacacctgcctgatgatcagctgctacaagggccacagagagatcgccagatacctgctggagcagggcgcccaggtgaacagaagaagcgccaagggcaacaccgccctgcacgactgcgccgagagcggcagcctggagatcctgcagctgctgctgggctgcaaggccagaatggagagagacggctacggcatgacccccctgctggccgccagcgtgaccggccacaccaacatcgtggagtacctgatccaggagcagcccggccaggagcaggtggccggcggcgaggcccagcccggcctgccccaggaggaccccagcaccagccagggctgcgcccagccccagggcgccccctgctgcagcagcagccccgaggagcccctgaacggcgagagctacgagagctgctgccccaccagcagagaggccgccgtggaggccctggagctgctgggcgccacctacgtggacaagaagagagacctgctgggcgccctgaagcactggagaagagccatggagctgagacaccagggcggcgagtacctgcccaagcccgagcccccccagctggtgctggcctacgactacagcagagaggtgaacaccaccgaggagctggaggccctgatcaccgaccccgacgagatgagaatgcaggccctgctgatcagagagagaatcctgggccccagccaccccgacaccagctactacatcagatacagaggcgccgtgtacgccgacagcggcaacttcgagagatgcatcagactgtggaagtacgccctggacatgcagcagagcaacctggagcccctgagccccatgaccgccagcagcttcctgagcttcgccgagctgttcagctacgtgctgcaggacagagccgccaagggcagcctgggcacccagatcggcttcgccgacctgatgggcgtgctgaccaagggcgtgagagaggtggagagagccctgcagctgcccagagagcccggcgacagcgcccagttcaccaaggccctggccatcatcctgcacctgctgtacctgctggagaaggtggagtgcacccccagccaggagcacctgaagcaccagaccgtgtacagactgctgaagtgcgcccccagaggcaagaacggcttcacccccctgcacatggccgtggacaaggacaccaccaacgtgggcagataccccgtgggcagattccccagcctgcacgtggtgaaggtgctgctggactgcggcgccgaccccgacagcagagacttcgacaacaacacccccctgcacatcgccgcccagaacaactgccccgccatcatgaacgccctgatcgaggccggcgcccacatggacgccaccaacgccttcaagaagaccgcctacgagctgctggacgagaagctgctggccagaggcaccatgcagcccttcaactacgtgaccctgcagtgcctggccgccagagccctggacaagaacaagatcccctacaagggcttcatccccgaggacctggaggccttcatcgagctgcactag

SEQ ID NO: 9523 - DNA, 720 bp, Artificial Sequence
  Description of Artificial Sequence: Synthetic coding sequence
atggccgccaccctgctggccgccagaggcgccggccccgcccccgcctggggccccgaggccttcacccccgactgggagagcagagaggtgagcaccggcaccaccatcatggccgtgcagttcgacggcggcgtggtgctgggcgccgacagcagaaccaccaccggcagctacatcgccaacagagtgaccgacaagctgacccccatccacgacagaatcttctgctgcagaagcggcagcgccgccgacacccaggccgtggccgacgccgtgacctaccagctgggcttccacagcatcgagctgaacgagccccccctggtgcacaccgccgccagcctgttcaaggagatgtgctacagatacagagaggacctgatggccggcatcatcatcgccggctgggacccccaggagggcggccaggtgtacagcgtgcccatgggcggcatgatggtgagacagagcttcgccatcggcggcagcggcagcagctacatctacggctacgtggacgccacctacagagagggcatgaccaaggaggagtgcctgcagttcaccgccaacgccctggccctggccatggagagagacggcagcagcggcggcgtgatcagactggccgccatcgccgagagcggcgtggagagacaggtgctgctgggcgaccagatccccaagttcgccgtggccaccctgccccccgcctag

SEQ ID NO: 9524 - DNA, 1383 bp, Artificial Sequence
  Description of Artificial Sequence: Synthetic coding sequence
atgaacttcagcgaggtgttcaagctgagcagcctgctgtgcaagttcagccccgacggcaagtacctggccagctgcgtgcagtacagactggtggtgagagacgtgaacaccctgcagatcctgcagctgtacacctgcctggaccagatccagcacatcgagtggagcgccgacagcctgttcatcctgtgcgccatgtacaagagaggcctggtgcaggtgtggagcctggagcagcccgagtggcactgcaagatcgacgagggcagcgccggcctggtggccagctgctggagccccgacggcagacacatcctgaacaccaccgagttccacctgagaatcaccgtgtggagcctgtgcaccaagagcgtgagctacatcaagtaccccaaggcctgcctgcagggcatcaccttcaccagagacggcagatacatggccctggccgagagaagagactgcaaggactacgtgagcatcttcgtgtgcagcgactggcagctgctgagacacttcgacaccgacacccaggacctgaccggcatcgagtgggcccccaacggctgcgtgctggccgtgtgggacacctgcctggagtacaagatcctgctgtacagcctggacggcagactgctgagcacctacagcgcctacgagtggagcctgggcatcaagagcgtggcctggagccccagcagccagttcctggccgtgggcagctacgacggcaaggtgagaatcctgaaccacgtgacctggaagatgatcaccgagttcggccaccccgccgccatcaacgaccccaagatcgtggtgtacaaggaggccgagaagagcccccagctgggcctgggctgcctgagcttccccccccccagagccggcgccggccccctgcccagcagcgagagcaagtacgagatcgccagcgtgcccgtgagcctgcagaccctgaagcccgtgaccgacagagccaaccccaagatcggcatcggcatgctggccttcagccccgacagctacttcctggccaccagaaacgacaacatccccaacgccgtgtgggtgtgggacatccagaagctgagactgttcgccgtgctggagcagctgagccccgtgagagccttccagtgggacccccagcagcccagactggccatctgcaccggcggcagcagactgtacctgtggagccccgccggctgcatgagcgtgcaggtgcccggcgagggcgacttcgccgtgctgagcctgtgctggcacctgagcggcgacagcatggccctgctgagcaaggaccacttctgcctgtgcttcctggagaccgaggccgtggtgggcaccgcctgcagacagctgggcggccacacctag

SEQ ID NO: 9525 - DNA, 282 bp, Artificial Sequence
  Description of Artificial Sequence: Synthetic coding sequence
atgagcggcctgagagtgtacagcaccagcgtgaccggcagcagagagatcaagagccagcagagcgaggtgaccagaatcctggacggcaagagaatccagtaccagctggtggacatcagccaggacaacgccctgagagacgagatgagagccctggccggcaaccccaaggccacccccccccagatcgtgaacggcgaccagtactgcggcgactacgagctgttcgtggaggccgtggagcagaacaccctgcaggagttcctgaagctggcctag

SEQ ID NO: 9526 - DNA, 1920 bp, Artificial Sequence
  Description of Artificial Sequence: Synthetic coding sequence
atgaacctggagaagctgagcaagcccgagctgctgaccctgttcagcatcctggagggcgagctggaggccagagacctggtgatcgaggccctgaaggcccagcacagagacaccttcatcgaggagagatacggcaagtacaacatcagcgaccccctgatggccctgcagagagacttcgagaccctgaaggagaagaacgacggcgagaagcagcccgtgtgcaccaaccccctgagcatcctgaaggtggtgatgaagcagtgcaagaacatgcaggagagaatgctgagccagctggccgccgccgagagcagacacagaaaggtgatcctggacctggaggaggagagacagagacacgcccaggacaccgccgagggcgacgacgtgacctacatgctggagaaggagagagagagactgacccagcagctggagttcgagaagagccaggtgaagaagttcgagaaggagcagaagaagctgagcagccagctggaggaggagagaagcagacacaagcagctgagcagcatgctggtgctggagtgcaagaaggccaccaacaaggccgccgaggagggccagaaggccggcgagctgagcctgaagctggagaaggagaagagcagagtgagcaagctggaggaggagctggccgccgagagaaagagaggcctgcagaccgaggcccaggtggagaagcagctgagcgagttcgacatcgagagagagcagctgagagccaagctgaacagagaggagaacagaaccaagaccctgaaggaggagatggagagcctgaagaagatcgtgaaggacctggaggccagccaccagcacagcagccccaacgagcagctgaagaagcccgtgaccgtgagcaagggcaccgccaccgagcccctgatgctgatgagcgtgttctgccagaccgagagcttccccgccgagagaacccacggcagcaacatcgccaagatgaccaacaccggcctgcccggccccgccacccccgcctacagctacgccaagaccaacggccactgcgaccccgagatccagaccaccagagagctgaccgccggcaacaacgtggagaaccaggtgccccccagagagaagagcgtggccctggcccaggagaagcccgtggagaacggcggctgccccgtgggcatcgagacccccgtgcccatgcccagccccctgagcagcagcggcagcagcctgagccccagcagcaccgccagcagcagcctgaccagcagcccctgcagcagccccgtgctgaccaagagactgctgggcagcagcgccagcagccccggctaccagagcagctaccaggtgggcatcaaccagagattccacgccgccagacacaagttccagagccaggccgaccaggaccagcaggccagcggcctgcagagcccccccagcagagacctgagccccaccctgatcgacaacagcgccgccaagcagctggccagaaacaccgtgacccaggtgctgagcagattcaccagccagcagggccccatcaagcccgtgagccccaacagcagccccttcggcaccgactacagaaacctggccaacaccgccaaccccagaggcgacaccagccacagccccacccccggcaaggtgagcagccccctgagccccctgagccccggcatcaagagccccaccatccccagagccgagagaggcaaccccccccccatcccccccaagaagcccggcctgacccccagccccagcgccaccacccccctgaccaagacccacagccaggccgccagcctgaccaccgccgaggacctggccagcagctgcagcagcaacaccgtggtggccaacggcaaggacgtggagctgctgctgcccaccagcagctag

SEQ ID NO: 9527 - DNA, 2487 bp, Artificial Sequence
  Description of Artificial Sequence: Synthetic coding sequence
atgagattcctggaggccagaagcctggccgtggccatgggcgacaccgtggtggagcccgcccccctgaagcccaccagcgagcccaccagcggcccccccggcaacaacggcggcagcctgctgagcgtgatcaccgagggcgtgggcgagctgagcgtgatcgaccccgaggtggcccagaaggcctgccaggaggtgctggagaaggtgaagctgctgcacggcggcgtggccgtgagcagcagaggcacccccctggagctggtgaacggcgacggcgtggacagcgagatcagatgcctggacgacccccccgcccagatcagagaggaggaggacgagatgggcgccgccgtggccagcggcaccgccaagggcgccagaagaagaagacagaacaacagcgccaagcagagctggctgctgagactgttcgagagcaagctgttcgacatcagcatggccatcagctacctgtacaacagcaaggagcccggcgtgcaggcctacatcggcaacagactgttctgcttcagaaacgaggacgtggacttctacctgccccagctgctgaacatgtacatccacatggacgaggacgtgggcgacgccatcaagccctacatcgtgcacagatgcagacagagcatcaacttcagcctgcagtgcgccctgctgctgggcgcctacagcagcgacatgcacatcagcacccagagacacagcagaggcaccaagctgagaaagctgatcctgagcgacgagctgaagcccgcccacagaaagagagagctgcccagcctgagccccgcccccgacaccggcctgagccccagcaagagaacccaccagagaagcaagagcgacgccaccgccagcatcagcctgagcagcaacctgaagagaaccgccagcaaccccaaggtggagaacgaggacgaggagctgagcagcagcaccgagagcatcgacaacagcttcagcagccccgtgagactggcccccgagagagagttcatcaagagcctgatggccatcggcaagagactggccaccctgcccaccaaggagcagaagacccagagactgatcagcgagctgagcctgctgaaccacaagctgcccgccagagtgtggctgcccaccgccggcttcgaccaccacgtggtgagagtgccccacacccaggccgtggtgctgaacagcaaggacaaggccccctacctgatctacgtggaggtgctggagtgcgagaacttcgacaccaccagcgtgcccgccagaatccccgagaacagaatcagaagcaccagaagcgtggagaacctgcccgagtgcggcatcacccacgagcagagagccggcagcttcagcaccgtgcccaactacgacaacgacgacgaggcctggagcgtggacgacatcggcgagctgcaggtggagctgcccgaggtgcacaccaacagctgcgacaacatcagccagttcagcgtggacagcatcaccagccaggagagcaaggagcccgtgttcatcgccgccggcgacatcagaagaagactgagcgagcagctggcccacacccccaccgccttcaagagagaccccgaggaccccagcgccgtggccctgaaggagccctggcaggagaaggtgagaagaatcagagagggcagcccctacggccacctgcccaactggagactgctgagcgtgatcgtgaagtgcggcgacgacctgagacaggagctgctggccttccaggtgctgaagcagctgcagagcatctgggagcaggagagagtgcccctgtggatcaagccctacaagatcctggtgatcagcgccgacagcggcatgatcgagcccgtggtgaacgccgtgagcatccaccaggtgaagaagcagagccagctgagcctgctggactacttcctgcaggagcacggcagctacaccaccgaggccttcctgagcgcccagagaaacttcgtgcagagctgcgccggctactgcctggtgtgctacctgctgcaggtgaaggacagacacaacggcaacatcctgctggacgccgagggccacatcatccacatcgacttcggcttcatcctgagcagcagccccagaaacctgggcttcgagaccagcgccttcaagctgaccaccgagttcgtggacgtgatgggcggcctggacggcgacatgttcaactactacaagatgctgatgctgcagggcctgatcgccgccagaaagcacatggacaaggtggtgcagatcgtggagatcatgcagcagggcagccagctgccctgcttccacggcagcagcaccatcagaaacctgaaggagagattccacatgagcatgaccgaggagcagctgcagctgctggtggagcagatggtggacggcagcatgagaagcatcaccaccaagctgtacgacggcttccagtacctgaccaacggcatcatgtag

SEQ ID NO: 9528 - DNA, 4233 bp, Artificial Sequence
  Description of Artificial Sequence: Synthetic coding sequence
atggccgacaccgacctgttcatggagtgcgaggaggaggagctggagccctggcagaagatcagcgacgtgatcgaggacagcgtggtggaggactacaacagcgtggacaagaccaccaccgtgagcgtgagccagcagcccgtgagcgcccccgtgcccatcgccgcccacgccagcgtggccggccacctgagcaccagcaccaccgtgagcagcagcggcgcccagaacagcgacagcaccaagaagaccctggtgaccctgatcgccaacaacaacgccggcaaccccctggtgcagcagggcggccagcccctgatcctgacccagaaccccgcccccggcctgggcaccatggtgacccagcccgtgctgagacccgtgcaggtgatgcagaacgccaaccacgtgaccagcagccccgtggccagccagcccatcttcatcaccacccagggcttccccgtgagaaacgtgagacccgtgcagaacgccatgaaccaggtgggcatcgtgctgaacgtgcagcagggccagaccgtgagacccatcaccctggtgcccgcccccggcacccagttcgtgaagcccaccgtgggcgtgccccaggtgttcagccagatgacccccgtgagacccggcagcaccatgcccgtgagacccaccaccaacaccttcaccaccgtgatccccgccaccctgaccatcagaagcaccgtgccccagagccagagccagcagaccaagagcacccccagcaccagcaccacccccaccgccacccagcccaccagcctgggccagctggccgtgcagagccccggccagagcaaccagaccaccaaccccaagctggcccccagcttccccagcccccccgccgtgagcatcgccagcttcgtgaccgtgaagagacccggcgtgaccggcgagaacagcaacgaggtggccaagctggtgaacaccctgaacaccatccccagcctgggccagagccccggccccgtggtggtgagcaacaacagcagcgcccacggcagccagagaaccagcggccccgagagcagcatgaaggtgaccagcagcatccccgtgttcgacctgcaggacggcggcagaaagatctgccccagatgcaacgcccagttcagagtgaccgaggccctgagaggccacatgtgctactgctgccccgagatggtggagtaccagaagaagggcaagagcctggacagcgagcccagcgtgcccagcgccgccaagccccccagccccgagaagaccgcccccgtggccagcacccccagcagcacccccatccccgccctgagcccccccaccaaggtgcccgagcccaacgagaacgtgggcgacgccgtgcagaccaagctgatcatgctggtggacgacttctactacggcagagacggcggcaaggtggcccagctgaccaacttccccaaggtggccaccagcttcagatgcccccactgcaccaagagactgaagaacaacatcagattcatgaaccacatgaagcaccacgtggagctggaccagcagaacggcgaggtggacggccacaccatctgccagcactgctacagacagttcagcacccccttccagctgcagtgccacctggagaacgtgcacagcccctacgagagcaccaccaagtgcaagatctgcgagtgggccttcgagagcgagcccctgttcctgcagcacatgaaggacacccacaagcccggcgagatgccctacgtgtgccaggtgtgccagtacagaagcagcctgtacagcgaggtggacgtgcacttcagaatgatccacgaggacaccagacacctgctgtgcccctactgcctgaaggtgttcaagaacggcaacgccttccagcagcactacatgagacaccagaagagaaacgtgtaccactgcaacaagtgcagactgcagttcctgttcgccaaggacaagatcgagcacaagctgcagcaccacaagaccttcagaaagcccaagcagctggagggcctgaagcccggcaccaaggtgaccatcagagccagcagaggccagcccagaaccgtgcccgtgagcagcaacgacaccccccccagcgccctgcaggaggccgcccccctgaccagcagcatggaccccctgcccgtgttcctgtacccccccgtgcagagaagcatccagaagagagccgtgagaaagatgagcgtgatgggcagacagacctgcctggagtgcagcttcgagatccccgacttccccaaccacttccccacctacgtgcactgcagcctgtgcagatacagcacctgctgcagcagagcctacgccaaccacatgatcaacaaccacgtgcccagaaagagccccaagtacctggccctgttcaagaacagcgtgagcggcatcaagctggcctgcaccagctgcaccttcgtgaccagcgtgggcgacgccatggccaagcacctggtgttcaaccccagccacagaagcagcagcatcctgcccagaggcctgacctggatcgcccacagcagacacggccagaccagagacagagtgcacgacagaaacgtgaagaacatgtaccccccccccagcttccccaccaacaaggccgccaccgtgaagagcgccggcgccacccccgccgagcccgaggagctgctgacccccctggcccccgccctgcccagccccgccagcaccgccacccccccccccacccccacccacccccaggccctggccctgccccccctggccaccgagggcgccgagtgcctgaacgtggacgaccaggacgagggcagccccgtgacccaggagcccgagctggccagcggcggcggcggcagcggcggcgtgggcaagaaggagcagctgagcgtgaagaagctgagagtggtgctgttcgccctgtgctgcaacaccgagcaggccgccgagcacttcagaaacccccagagaagaatcagaagatggctgagaagattccaggccagccagggcgagaacctggagggcaagtacctgagcttcgaggccgaggagaagctggccgagtgggtgctgacccagagagagcagcagctgcccgtgaacgaggagaccctgttccagaaggccaccaagatcggcagaagcctggagggcggcttcaagatcagctacgagtgggccgtgagattcatgctgagacaccacctgaccccccacgccagaagagccgtggcccacaccctgcccaaggacgtggccgagaacgccggcctgttcatcgacttcgtgcagagacagatccacaaccaggacctgcccctgagcatgatcgtggccatcgacgagatcagcctgttcctggacaccgaggtgctgagcagcgacgacagaaaggagaacgccctgcagaccgtgggcaccggcgagccctggtgcgacgtggtgctggccatcctggccgacggcaccgtgctgcccaccctggtgttctacagaggccagatggaccagcccgccaacatgcccgacagcatcctgctggaggccaaggagagcggctacagcgacgacgagatcatggagctgtggagcaccagagtgtggcagaagcacaccgcctgccagagaagcaagggcatgctggtgatggactgccacagaacccacctgagcgaggaggtgctggccatgctgagcgccagcagcaccctgcccgccgtggtgcccgccggctgcagcagcaagatccagcccctggacgtgtgcatcaagagaaccgtgaagaacttcctgcacaagaagtggaaggagcaggccagagagatggccgacaccgcctgcgacagcgacgtgctgctgcagctggtgctggtgtggctgggcgaggtgctgggcgtgatcggcgactgccccgagctggtgcagagaagcttcctggtggccagcgtgctgcccggccccgacggcaacatcaacagccccaccagaaacgccgacatgcaggaggagctgatcgccagcctggaggagcagctgaagctgagcggcgagcacagcgagagcagcacccccagacccagaagcagccccgaggagaccatcgagcccgagagcctgcaccagctgttcgagggcgagagcgagaccgagagcttctacggcttcgaggaggccgacctggacctgatggagatctag

SEQ ID NO: 9529 - DNA, 1488 bp, Artificial Sequence
  Description of Artificial Sequence: Synthetic coding sequence
atgccccagctgctgcagaacatcaacggcatcatcgaggccttcagaagatacgccagaaccgagggcaactgcaccgccctgaccagaggcgagctgaagagactgctggagcaggagttcgccgacgtgatcgtgaagccccacgaccccgccaccgtggacgaggtgctgagactgctggacgaggaccacaccggcaccgtggagttcaaggagttcctggtgctggtgttcaaggtggcccaggcctgcttcaagaccctgagcgagagcgccgagggcgcctgcggcagccaggagagcggcagcctgcacagcggcgccagccaggagctgggcgagggccagagaagcggcaccgaggtgggcagagccggcaagggccagcactacgagggcagcagccacagacagagccagcagggcagcagaggccagaacagacccggcgtgcagacccagggccaggccaccggcagcgcctgggtgagcagctacgacagacaggccgagagccagagccaggagagaatcagcccccagatccagctgagcggccagaccgagcagacccagaaggccggcgagggcaagagaaaccagaccaccgagatgagacccgagagacagccccagaccagagagcaggacagagcccaccagaccggcgagaccgtgaccggcagcggcacccagacccaggccggcgccacccagaccgtggagcaggacagcagccaccagaccggcagaaccagcaagcagacccaggaggccaccaacgaccagaacagaggcaccgagacccacggccagggcagaagccagaccagccaggccgtgaccggcggccacgcccagatccaggccggcacccacacccagacccccacccagaccgtggagcaggacagcagccaccagaccggcagcaccagcacccagacccaggagagcaccaacggccagaacagaggcaccgagatccacggccagggcagaagccagaccagccaggccgtgaccggcggccacacccagatccaggccggcagccacaccgagaccgtggagcaggacagaagccagaccgtgagccacggcggcgccagagagcagggccagacccagacccagcccggcagcggccagagatggatgcaggtgagcaaccccgaggccggcgagaccgtgcccggcggccaggcccagaccggcgccagcaccgagagcggcagacaggagtggagcagcacccaccccagaagatgcgtgaccgagggccagggcgacagacagcccaccgtggtgggcgaggagtgggtggacgaccacagcagagagaccgtgatcctgagactggaccagggcaacctgcacaccagcgtgagcagcgcccagggccaggacgccgcccagagcgaggagaagagaggcatcaccgccagagagctgtacagctacctgagaagcaccaagccctag

SEQ ID NO: 9530 - DNA, 1233 bp, Artificial Sequence
  Description of Artificial Sequence: Synthetic coding sequence
atgaacatgcccagcacccccctggcccccaccaccggcaccgccacctgcagctggagcgccagcacctgcaccaccaccagacccgccgtgagaccccccagcttcccccacagaccccccggcaacgccgccctgcccagcctgatgcccagcagacccacccaggtggccggccagtgcggcgccggcaacaactgggccaagggccactacaccgagggcgccgagctgatggagagcgtgatggacgtggtgagaaaggaggccgagagctgcgactgcctgcagggcttccagctgacccacagcctgggcggcggcaccggcagcggcatgggcaccctgctgctgagcaagatcagagaggagtaccccgacagaatcatcaacaccttcagcatcctgcccagccccaaggtgagcgacaccgtggtggagccctacaacgccaccctgagcgtgcaccagctgatcgagaacgccgacgagaccttctgcatcgacaacgaggccctgtacgacatctgcagcaagaccctgaagctgcccacccccacctacggcgacctgaaccacctggtgagcgccaccatgagcggcgtgaccacctgcctgagattccccggccagctgaacgccgacctgagaaagctggccgtgaacatggtgcccttccccagactgcacttcttcatgcccggcttcgcccccctgaccagcagaggcagccagcagtacagagccctgaccgtggccgagctgacccagcagatgttcgacgccaagaacatgatggccgcctgcgaccccagacacggcagatacctgaccgccgccgccatcttcagaggcagaatgcccatgagagaggtggacgagcagatgttcaacatccaggacaagaacagcagctacttcgccgactggctgcccaacaacgtgaagaccgccgtgtgcgacatcccccccagaggcctgaagatgagcgccaccttcatcggcaacaacaccgccatccaggagctgttcaagagagtgagcgagcagttcaccgccatgttcagaagaaaggccttcctgcactggtacaccggcgagggcatggacgagatggagttcaccgaggccgagagcaacatgaacgacctggtgagcgagtaccagcagtaccaggacgccaccgccgaggaggaggaggacgaggagtacgccgaggaggaggtggcctag

SEQ ID NO: 9531 - DNA, 2106 bp, Artificial Sequence
  Description of Artificial Sequence: Synthetic coding sequence
atgggcagcgccgccgacgtgagattcagcctgggcaccaccacccacgccccccccggcgtgcacagaagatacagcgccctgagagaggagagcgccaaggactgggagaccagccccctgcccggcatgctggcccccgccgccggccccgccttcgacagcgaccccgagatcagcgacgtggacgaggacgagcccggcggcctggtgggcagcgccgacgtggtgagccccagcggccacagcgacgcccagaccctggccatgatgctgcaggagcagctggacgccatcaacgaggagatcagaatgatccaggaggagaaggagagcaccgagctgagagccgaggagatcgagaccagagtgaccagcggcagcatggaggccctgaacctgaagcagctgagaaagagaggcagcatccccaccagcctgaccgccctgagcctggccagcgccagcccccccctgagcggcagaagcacccccaagctgaccagcagaagcgccgcccaggacctggacagaatgggcgtgatgaccctgcccagcgacctgagaaagcacagaagaaagctgctgagccccgtgagcagagaggagaacagagaggacaaggccaccatcaagtgcgagaccagcccccccagcagccccagaaccctgagactggagaagctgggccaccccgccctgagccaggaggagggcaagagcgccctggaggaccagggcagcaaccccagcagcagcaacagcagccaggacagcctgcacaagggcgccaagagaaagggcatcaagagcagcatcggcagactgttcggcaagaaggagaagggcagactgatccagctgagcagagacggcgccaccggccacgtgctgctgaccgacagcgagttcagcatgcaggagcccatggtgcccgccaagctgggcacccaggccgagaaggacagaagactgaagaagaagcaccagctgctggaggacgccagaagaaagggcatgcccttcgcccagtgggacggccccaccgtggtgagctggctggagctgtgggtgggcatgcccgcctggtacgtggccgcctgcagagccaacgtgaagagcggcgccatcatgagcgccctgagcgacaccgagatccagagagagatcggcatcagcaacgccctgcacagactgaagctgagactggccatccaggagatggtgagcctgaccagccccagcgccccccccaccagcagaaccagcagcggcaacgtgtgggtgacccacgaggagatggagaccctggagaccagcaccaagaccgacagcgaggagggcagctgggcccagaccctggcctacggcgacatgaaccacgagtggatcggcaacgagtggctgcccagcctgggcctgccccagtacagaagctacttcatggagtgcctggtggacgccagaatgctggaccacctgaccaagaaggacctgagagtgcacctgaagatggtggacagcttccacagaaccagcctgcagtacggcatcatgtgcctgaagagactgaactacgacagaaaggagctggagaagagaagagaggagagccagcacgagatcaaggacgtgctggtgtggaccaacgaccaggtggtgcactgggtgcagagcatcggcctgagagactacgccggcaacctgcacgagagcggcgtgcacggcgccctgctggccctggacgagaacttcgaccacaacaccctggccctgatcctgcagatccccacccagaacacccaggccagacaggtgatggagagagagttcaacaacctgctggccctgggcaccgacagaaagctggacgacggcgacgacaaggtgttcagaagagcccccagctggagaaagagattcagacccagagagcaccacggcagaggcggcatgctgagcgccagcgccgagaccctgcccgccggcttcagagtgagcaccctgggcaccctgcagcccccccccgccccccccaagaagatcatgcccgaggcccacagccactacctgtacggccacatgctgagcgccttcagagactag

SEQ ID NO: 9532 - DNA, 1029 bp, Artificial Sequence
  Description of Artificial Sequence: Synthetic coding sequence
atggccagcgtgaccagagccgtgttcggcgagctgcccagcggcggcggcaccgtggagaagttccagctgcagagcgacctgctgagagtggacatcatcagctggggctgcaccatcaccgccctggaggtgaaggacagacagggcagagccagcgacgtggtgctgggcttcgccgagctggagggctacctgcagaagcagccctacttcggcgccgtgatcggcagagtggccaacagaatcgccaagggcaccttcaaggtggacggcaaggagtaccacctggccatcaacaaggagcccaacagcctgcacggcggcgtgagaggcttcgacaaggtgctgtggacccccagagtgctgagcaacggcgtgcagttcagcagaatcagccccgacggcgaggagggctaccccggcgagctgaaggtgtgggtgacctacaccctggacggcggcgagctgatcgtgaactacagagcccaggccagccaggccacccccgtgaacctgaccaaccacagctacttcaacctggccggccaggccagccccaacatcaacgaccacgaggtgaccatcgaggccgacacctacctgcccgtggacgagaccctgatccccaccggcgaggtggcccccgtgcagggcaccgccttcgacctgagaaagcccgtggagctgggcaagcacctgcaggacttccacctgaacggcttcgaccacaacttctgcctgaagggcagcaaggagaagcacttctgcgccagagtgcaccacgccgccagcggcagagtgctggaggtgtacaccacccagcccggcgtgcagttctacaccggcaacttcctggacggcaccctgaagggcaagaacggcgccgtgtaccccaagcacagcggcttctgcctggagacccagaactggcccgacgccgtgaaccagcccagattcccccccgtgctgctgagacccggcgaggagtacgaccacaccacctggttcaagttcagcgtggcctag

SEQ ID NO: 9533 - DNA, 2295 bp, Artificial Sequence
  Description of Artificial Sequence: Synthetic coding sequence
atgagcgacaccagaagaagagtgaaggtgtacaccctgaacgaggacagacagtgggacgacagaggcaccggccacgtgagcagcacctacgtggaggagctgaagggcatgagcctgctggtgagagccgagagcgacggcagcctgctgctggagagcaagatcaaccccaacaccgcctaccagaagcagcaggacaccctgatcgtgtggagcgaggccgagaactacgacctggccctgagcttccaggagaaggccggctgcgacgagatctgggagaagatctgccaggtgcagggcaaggaccccagcgtggaggtgacccaggacctgatcgacgagagcgaggaggagagattcgaggagatgcccgagaccagccacctgatcgacctgcccacctgcgagctgaacaagctggaggagatcgccgacctggtgaccagcgtgctgagcagccccatcagaagagagaagctggccctggccctggagaacgagggctacatcaagaagctgctgcagctgttccaggcctgcgagaacctggagaacaccgagggcctgcaccacctgtacgagatcatcagaggcatcctgttcctgaacaaggccaccctgttcgaggtgatgttcagcgacgagtgcatcatggacgtggtgggctgcctggagtacgaccccgccctggcccagcccaagagacacagagagttcctgaccaagaccgccaagttcaaggaggtgatccccatcaccgacagcgagctgagacagaagatccaccagacctacagagtgcagtacatccaggacatcatcctgcccacccccagcgtgttcgaggagaacttcctgagcaccctgaccagcttcatcttcttcaacaaggtggagatcgtgagcatgctgcaggaggacgagaagttcctgagcgaggtgttcgcccagctgaccgacgaggccaccgacgacgacaagagaagagagctggtgaacttcttcaaggagttctgcgccttcagccagaccctgcagccccagaacagagacgccttcttcaagaccctggccaagctgggcatcctgcccgccctggagatcgtgatgggcatggacgacctgcaggtgagaagcgccgccaccgacatcttcagctacctggtggagttcagccccagcatggtgagagagttcgtgatgcaggaggcccagcagagcgacgacgacatcctgctgatcaacgtggtgatcgagcagatgatctgcgacaccgaccccgagctgggcggcgccgtgcagctgatgggcctgctgagaaccctgatcgaccccgagaacatgctggccaccaccaacaagaccgagaagagcgagttcctgaacttcttctacaaccactgcatgcacgtgctgaccgcccccctgctgaccaacaccagcgaggacaagtgcgagaaggacaacatcgtgggcagcaacaagaacaacaccatctgccccggcgccctgagattcatgagaagaatcatcggcctgaaggacgagttctacaacagatacatcaccaagggcaacctgttcgagcccgtgatcaacgccctgctggacaacggcaccagatacaacctgctgaacagcgccgtgatcgagctgttcgagttcatcagagtggaggacatcaagagcctgaccgcccacatcgtggagaacttctacaaggccctggagagcatcgagtacgtgcagaccttcaagggcctgaagaccaagtacgagcaggagaaggacagacagaaccagaagctgaacagcgtgcccagcatcctgagaagcaacagattcagaagagacgccaaggccctggaggaggacgaggagatgtggttcaacgaggacgaggaggaggagggcaaggccgtggtggcccccgtggagaagcccaagcccgaggacgacttccccgacaactacgagaagttcatggagaccaagaaggccaaggagagcgaggacaaggagaacctgcccaagagaaccagccccggcggcttcaagttcaccttcagccacagcgccagcgccgccaacggcaccaacagcaagagcgtggtggcccagatcccccccgccaccagcaacggcagcagcagcaagaccaccaacctgcccaccagcgtgaccgccaccaagggcagcctggtgggcctggtggactaccccgacgacgaggaggaggacgaggaggaggagagcagccccagaaagagacccagactgggcagctag

SEQ ID NO: 9534 - DNA, 231 bp, Artificial Sequence
  Description of Artificial Sequence: Synthetic coding sequence
atgagcaaggcccacccccccgagctgaagaagttcatggacaagaagctgagcctgaagctgaacggcggcagacacgtgcagggcatcctgagaggcttcgaccccttcatgaacctggtgatcgacgagtgcgtggagatggccaccagcggccagcagaacaacatcggcatggtggtgatcagaggcaacagcatcatcatgctggaggccctggagagagtgtag

SEQ ID NO: 9535 - DNA, 528 bp, Artificial Sequence
  Description of Artificial Sequence: Synthetic coding sequence
atgcagctgacccaccagctggacctgttccccgagtgcagagtgaccctgctgctgttcaaggacgtgaagaacgccggcgacctgagaagaaaggccatggagggcaccatcgacggcagcctgatcaaccccaccgtgatcgtggaccccttccagatcctggtggccgccaacaaggccgtgcacctgtacaagctgggcaagatgaagaccagaaccctgagcaccgagatcatcttcaacctgagccccaacaacaacatcagcgaggccctgaagaagttcggcatcagcgccaacgacaccagcatcctgatcgtgtacatcgaggagggcgagaagcagatcaaccaggagtacctgatcagccaggtggagggccaccaggtgagcctgaagaacctgcccgagatcatgaacatcaccgaggtgaagaagatctacaagctgagcagccaggaggagagcatcggcaccctgctggacgccatcatctgcagaatgagcaccaaggacgtgctgtag

SEQ ID NO: 9536 - DNA, 909 bp, Artificial Sequence
  Description of Artificial Sequence: Synthetic coding sequence
atggccctgcacgacatggaggacttcaccttcgacggcaccaagagactgagcgtgaactacgtgaagggcatcctgcagcccaccgacacctgcgacatctgggacaagatctggaacttccaggccaagcccgacgacctgctgatcagcacctaccccaaggccggcaccacctggacccaggagatcgtggagctgatccagaacgagggcgacgtggagaagagcaagagagcccccacccaccagagattccccttcctggagatgaagatccccagcctgggcagcggcctggagcaggcccacgccatgcccagccccagaatcctgaagacccacctgcccttccacctgctgccccccagcctgctggagaagaactgcaagatcatctacgtggccagaaaccccaaggacaacatggtgagctactaccacttccagagaatgaacaaggccctgcccgcccccggcacctgggaggagtacttcgagaccttcctggccggcaaggtgtgctggggcagctggcacgagcacgtgaagggctggtgggaggccaaggacaagcacagaatcctgtacctgttctacgaggacatgaagaagaaccccaagcacgagatccagaagctggccgagttcatcggcaagaagctggacgacaaggtgctggacaagatcgtgcactacaccagcttcgacgtgatgaagcagaaccccatggccaactacagcagcatccccgccgagatcatggaccacagcatcagccccttcatgagaaagggcgccgtgggcgactggaagaagcacttcaccgtggcccagaacgagagattcgacgaggactacaagaagaagatgaccgacaccagactgaccttccacttccagttctag

SEQ ID NO: 9537 - DNA, 2892 bp, Artificial Sequence
  Description of Artificial Sequence: Synthetic coding sequence
atgtggtgcctgcactgcaacagcgagagaacccagagcctgctggagctggagctggacagcggcgtggagggcgaggcccccagcagcgagaccggcaccagcctggacagccccagcgcctacccccagggccccctggtgcccggcagcagcctgagccccgaccactacgagcacaccagcgtgggcgcctacggcctgtacagcggcccccccggccagcagcagagaaccagaagacccaagctgcagcacagcaccagcatcctgagaaagcaggccgaggaggaggccatcaagagaagcagaagcctgagcgagagctacgagctgagcagcgacctgcaggacaagcaggtggagatgctggagagaaagtacggcggcagactggtgaccagacacgccgccagaaccatccagaccgccttcagacagtaccagatgaacaagaacttcgagagactgagaagcagcatgagcgagaacagaatgagcagaagaatcgtgctgagcaacatgagaatgcagttcagcttcgagggccccgagaaggtgcacagcagctacttcgagggcaagcaggtgagcgtgaccaacgacggcagccagctgggcgccctggtgagccccgagtgcggcgacctgagcgagcccaccaccctgaagagccccgcccccagcagcgacttcgccgacgccatcaccgagctggaggacgccttcagcagacaggtgaagagcctggccgagagcatcgacgacgccctgaactgcagaagcctgcacaccgaggaggcccccgccctggacgccgccagagccagagacaccgagccccagaccgccctgcacggcatggaccacagaaagctggacgagatgaccgccagctacagcgacgtgaccctgtacatcgacgaggaggagctgagcccccccctgcccctgagccaggccggcgacagacccagcagcaccgagagcgacctgagactgagagccggcggcgccgcccccgactactgggccctggcccacaaggaggacaaggccgacaccgacaccagctgcagaagcacccccagcctggagagacaggagcagagactgagagtggagcacctgcccctgctgaccatcgagccccccagcgacagcagcgtggacctgagcgacagaagcgagagaggcagcctgaagagacagagcgcctacgagagaagcctgggcggccagcagggcagccccaagcacggcccccacagcggcgcccccaagagcctgcccagagaggagcccgagctgagacccagaccccccagacccctggacagccacctggccatcaacggcagcgccaacagacagagcaagagcgagagcgactacagcgacggcgacaacgacagcatcaacagcaccagcaacagcaacgacaccatcaactgcagcagcgagagcagcagcagagacagcctgagagagcagaccctgagcaagcagacctaccacaaggaggccagaaacagctgggacagccccgccttcagcaacgacgtgatcagaaagagacactacagaatcggcctgaacctgttcaacaagaagcccgagaagggcgtgcagtacctgatcgagagaggcttcgtgcccgacacccccgtgggcgtggcccacttcctgctgcagagaaagggcctgagcagacagatgatcggcgagttcctgggcaacagacagaagcagttcaacagagacgtgctggactgcgtggtggacgagatggacttcagcaccatggagctggacgaggccctgagaaagttccaggcccacatcagagtgcagggcgaggcccagaaggtggagagactgatcgaggccttcagccagagatactgcatctgcaaccccggcgtggtgagacagttcagaaaccccgacaccatcttcatcctggccttcgccatcatcctgctgaacaccgacatgtacagccccaacgtgaagcccgagagaaagatgaagctggaggacttcatcaagaacctgagaggcgtggacgacggcgaggacatccccagagagatgctgatgggcatctacgagagaatcagaaagagagagctgaagaccaacgaggaccacgtgagccaggtgcagaaggtggagaagctgatcgtgggcaagaagcccatcggcagcctgcaccccggcctgggctgcgtgctgagcctgccccacagaagactggtgtgctactgcagactgttcgaggtgcccgaccccaacaagccccagaagctgggcctgcaccagagagagatcttcctgttcaacgacctgctggtggtgaccaagatcttccagaagaagaagaacagcgtgacctacagcttcagacagagcttcagcctgtacggcatgcaggtgctgctgttcgagaaccagtactaccccaacggcatcagactgaccagcagcgtgcccggcgccgacatcaaggtgctgatcaacttcaacgcccccaacccccaggacagaaagaagttcaccgacgacctgagagagagcatcgccgaggtgcaggagatggagaagcacagaatcgagagcgagctggagaagcagaagggcgtggtgagacccagcatgagccagtgcagcagcctgaagaaggagagcggcaacggcaccctgagcagagcctgcctggacgacagctacgccagcggcgagggcctgaagagaagcgccctgagcagcagcctgagagacctgagcgaggccggcaagagaggcagaagaagcagcgccggcagcctggagagcaacgtggagttccagcccttcgagcccctgcagcccagcgtgctgtgcagctag

SEQ ID NO: 9538 - DNA, 711 bp, Artificial Sequence
  Description of Artificial Sequence: Synthetic coding sequence
atggccagcctggacagagtgaaggtgctggtgctgggcgacagcggcgtgggcaagagcagcctggtgcacctgctgtgccagaaccaggtgctgggcaaccccagctggaccgtgggctgcagcgtggacgtgagagtgcacgactacaaggagggcacccccgaggagaagacctactacatcgagctgtgggacgtgggcggcagcgtgggcagcgccagcagcgtgaagagcaccagagccgtgttctacaacagcgtgaacggcatcatcttcgtgcacgacctgaccaacaagaagagcagccagaacctgagaagatggagcctggaggccctgaacagagacctggtgcccaccggcgtgctggtgaccaacggcgactacgaccaggagcagttcgccgacaaccagatccccctgctggtgatcggcaccaagctggaccagatccacgagaccaagagacacgaggtgctgaccagaaccgccttcctggccgaggacttcaaccccgaggagatcaacctggactgcaccaaccccagatacctggccgccggcagcagcaacgccgtgaagctgagcagattcttcgacaaggtgatcgagaagagatacttcctgagagagggcaaccagatccccggcttccccgacagaaagagattcggcgccggcaccctgaagagcctgcactacgactag

SEQ ID NO: 9539 - DNA, 2784 bp, Artificial Sequence
  Description of Artificial Sequence: Synthetic coding sequence
atgcagagcatcctgtaccacggcctgatcagagaccaggcctgcagaagacagaccgactactggcagttcgtgaaggacatcagatggctgagcccccacagcgccctgcacgtggagaagttcatcagcgtgcacgagaacgaccagagcagcgccgacggcgccagcgagagagccgtggccgagctgtggctgcagcacagcctgcagtaccactgcctgagcgcccagctgagacccctgctgggcgacagacagtacatcagaaagttctacaccgacgccgccttcctgctgagcgacgcccacgtgaccgccatgctgcagtgcctggaggccgtggagcagaacaaccccagactgctggcccagatcgacgccagcatgttcgccagaaagcacgagagccccctgctggtgaccaagagccagagcctgaccgccctgcccagcagcacctacaccccccccaacagctacgcccagcacagctacttcggcagcttcagcagcctgcaccagagcgtgcccaacaacggcagcgagagaagaagcaccagcttccccctgagcggcccccccagaaagccccaggagagcagaggccacgtgagccccgccgaggaccagaccatccaggccccccccgtgagcgtgagcgccctggccagagacagccccctgacccccaacgagatgagcagcagcaccctgaccagccccatcgaggccagctgggtgagcagccagaacgacagccccggcgacgccagcgagggccccgagtacctggccatcggcaacctggaccccagaggcagaaccgccagctgccagagccacagcagcaacgccgagagcagcagcagcaacctgttcagcagcagcagcagccagaagcccgacagcgccgccagcagcctgggcgaccaggagggcggcggcgagagccagctgagcagcgtgctgagaagaagcagcttcagcgagggccagaccctgaccgtgaccagcggcgccaagaagagccacatcagaagccacagcgacaccagcatcgccagcagaggcgcccccggcggccccagaaacatcaccatcatcgtggaggaccccatcgccgagagctgcaacgacaaggccaagctgagaggccccctgccctacagcggccagagcagcgaggtgagcacccccagcagcctgtacatggagtacgagggcggcagatacctgtgcagcggcgagggcatgttcagaagacccagcgagggccagagcctgatcagctacctgagcgagcaggacttcggcagctgcgccgacctggagaaggagaacgcccacttcagcatcagcgagagcctgatcgccgccatcgagctgatgaagtgcaacatgatgagccagtgcctggaggaggaggaggtggaggaggaggacagcgacagagagatccaggagctgaagcagaagatcagactgagaagacagcagatcagaaccaagaacctgctgcccatgtaccaggaggccgagcacggcagcttcagagtgaccagcagcagcagccagttcagcagcagagacagcgcccagctgagcgacagcggcagcgccgacgaggtggacgagttcgagatccaggacgccgacatcagaagaaacaccgccagcagcagcaagagcttcgtgagcagccagagcttcagccactgcttcctgcacagcaccagcgccgaggccgtggccatgggcctgctgaagcagttcgagggcatgcagctgcccgccgccagcgagctggagtggctggtgcccgagcacgacgccccccagaagctgctgcccatccccgacagcctgcccatcagccccgacgacggccagcacgccgacatctacaagctgagaatcagagtgagaggcaacctggagtgggccccccccagaccccagatcatcttcaacgtgcaccccgcccccaccagaaagatcgccgtggccaagcagaactacagatgcgccggctgcggcatcagaaccgaccccgactacatcaagagactgagatactgcgagtacctgggcaagtacttctgccagtgctgccacgagaacgcccagatggccatccccagcagagtgctgagaaagtgggacttcagcaagtactacgtgagcaacttcagcaaggacctgctgatcaagatctggaacgaccccctgttcaacgtgcaggacatcaacagcgccctgtacagaaaggtgaagctgctgaaccaggtgagactgctgagagtgcagctgtgccacatgaagaacatgttcaagacctgcagactggccaaggagctgctggacagcttcgacaccgtgcccggccacctgaccgaggacctgcacctgtacagcctgaacgacctgaccgccaccagaaagggcgagctgggccccagactggccgagctgaccagagccggcgccacccacgtggagagatgcatgctgtgccaggccaagggcttcatctgcgagttctgccagaacgaggacgacatcatcttccccttcgagctgcacaagtgcagaacctgcgaggagtgcaaggcctgctaccacaaggcctgcttcaagagcggcagctgccccagatgcgagagactgcaggccagaagagaggccctggccagacagagcctggagagctacctgagcgactacgaggaggagcccgccgaggccctggccctggaggccgccgtgctggaggccacctag

SEQ ID NO: 9540 - DNA, 300 bp, Artificial Sequence
  Description of Artificial Sequence: Synthetic coding sequence
atggccagcgccagcgccagaggcaaccaggacaaggacgcccacttccccccccccagcaagcagagcctgctgttctgccccaagagcaagctgcacatccacagagccgagatcagcaagatcatgagagagtgccaggaggagagcttctggaagagagccctgcccttcagcctggtgagcatgctggtgacccagggcctggtgtaccagggctacctggccgccaacagcagattcggcagcctgcccaaggtggccagaaccgccagcctgcccgtgagaaacgccaagtag

SEQ ID NO: 9541 - DNA, 786 bp, Artificial Sequence
  Description of Artificial Sequence: Synthetic coding sequence
atggtggtgctgagcgtgcccgccgaggtgaccgtgatcctgctggacatcgagggcaccaccacccccatcgccttcgtgaaggacatcctgttcccctacatcgaggagaacgtgaaggagtacctgcagacccactgggaggaggaggagtgccagcaggacgtgagcctgctgagaaagcaggccgaggaggacgcccacctggacggcgccgtgcccatccccgccgccagcggcaacggcgtggacgacctgcagcagatgatccaggccgtggtggacaacgtgtgctggcagatgagcctggacagaaagaccaccgccctgaagcagctgcagggccacatgtggagagccgccttcaccgccggcagaatgaaggccgagttcttcgccgacgtggtgcccgccgtgagaaagtggagagaggccggcatgaaggtgtacatctacagcagcggcagcgtggaggcccagaagctgctgttcggccacagcaccgagggcgacatcctggagctggtggacggccacttcgacaccaagatcggccacaaggtggagagcgagagctacagaaagatcgccgacagcatcggctgcagcaccaacaacatcctgttcctgaccgacgtgaccagagaggccagcgccgccgaggaggccgacgtgcacgtggccgtggtggtgagacccggcaacgccggcctgaccgacgacgagaagacctactacagcctgatcaccagcttcagcgagctgtacctgcccagcagcacctag

SEQ ID NO: 9542 - DNA, 1188 bp, Artificial Sequence
  Description of Artificial Sequence: Synthetic coding sequence
atggccgaggacggcctgcccaagatctacagccacccccccaccgagagcagcaagacccccaccgccgccaccatcttcttcggcgccgacaacgccatccccaagagcgagaccaccatcaccagcgagggcgaccacgtgaccagcgtgaacgagtacatgctggagagcgacttcagcaccaccaccgacaacaagctgaccgccaagaaggagaagctgaagagcgaggacgacatgggcaccgacttcatcaagagcaccacccacctgcagaaggagatcaccagcctgaccggcaccaccaacagcatcaccagagacagcatcaccgagcacttcatgcccgtgaagatcggcaacatcagcagccccgtgaccaccgtgagcctgatcgacttcagcaccgacatcgccaaggaggacatcctgctggccaccatcgacaccggcgacgccgagatcagcatcaccagcgaggtgagcggcaccctgaaggacagcagcgccggcgtggccgacgcccccgccttccccagaaagaaggacgaggccgacatgagcaactacaacagcagcatcaagagcaacgtgcccgccgacgaggccgtgcaggtgaccgacagcaccatccccgaggccgagatcccccccgcccccgaggagagcttcaccaccatccccgacatcaccgccctggaggaggagaagatcaccgagatcgacctgagcgtgctggaggacgacaccagcgccgtggccaccctgaccgacagcgacgagaagttcatcaccgtgttcgagctgaccaccagcgccgagaaggacaaggacaagagagaggacaccctgctgaccgacgaggagaccaccgagggcgccagcatctggatggagagagacaccgccaacgaggccgagacccacagcgtgctgctgaccgccgtggagagcagatacgacttcgtggtgcccgccagcatcgccaccaacctggtggaggagagcagcaccgaggaggacctgagcgagaccgacaacaccgagaccgtgcccaagatcaccgagcccttcagcggcaccaccagcgtgctggacacccccgactacaaggaggacaccagcaccaccgagaccgacatcttcgagctgctgaaggaggagcccgacgagttcatgatctag

SEQ ID NO: 9543 - DNA, 921 bp, Artificial Sequence
  Description of Artificial Sequence: Synthetic coding sequence
atgtacttctgctggggcgccgacagcagagagctgcagagaagaagaaccgccggcagccccggcgccgagctgctgcaggccgccagcggcgagagacacagcctgctgctgctgaccaaccacagagtgctgagctgcggcgacaacagcagaggccagctgggcagaagaggcgcccagagaggcgagctgcccgagcccatccaggccctggagaccctgatcgtggacctggtgagctgcggcaaggagcacagcctggccgtgtgccacaagggcagagtgttcgcctggggcgccggcagcgagggccagctgggcatcggcgagttcaaggagatcagcttcacccccaagaagatcatgaccctgaacgacatcaagatcatccaggtgagctgcggccactaccacagcctggccctgagcaaggacagccaggtgttcagctggggcaagaacagccacggccagctgggcctgggcaaggagttccccagccaggccagcccccagagagtgagaagcctggagggcatccccctggcccaggtggccgccggcggcgcccacagcttcgccctgagcctgtgcggcaccagcttcggctggggcagcaacagcgccggccagctggccctgagcggcagaaacgtgcccgtgcagagcaacaagcccctgagcgtgggcgccctgaagaacctgggcgtggtgtacatcagctgcggcgacgcccacaccgccgtgctgacccaggacggcaaggtgttcaccttcggcgacaacagaagcggccagctgggctacagccccacccccgagaagagaggcccccagctggtggagagaatcgacggcctggtgagccagatcgactgcggcagaaacagcaagcacggcttcatgaccttcttctag

SEQ ID NO: 9544 - DNA, 909 bp, Artificial Sequence
  Description of Artificial Sequence: Synthetic coding sequence
atgggcaactgctgctggacccagtgcttcggcctgctgagaaaggaggccggcagactgcagagagtgggcggcggcggcggcagcaagtacttcagaacctgcagcagaggcgagcacctgaccatcgagttcgagaacctggtggagagcgacgagggcgagagccccggcagcagccacagacccctgaccgaggaggagatcgtggacctgagagagagacactacgacagcatcgccgagaagcagaaggacctggacaagaagatccagaaggagctggccctgcaggaggagaagctgagactggaggaggaggccctgtacgccgcccagagagaggccgccagagccgccaagcagagaaagctgctggagcaggagagacagagaatcgtgcagcagtaccaccccagcaacaacggcgagtaccagagcagcggccccgaggacgacttcgagagctgcctgagaaacatgaagagccagtacgaggtgttcagaagcagcagactgagcagcgacgccaccgtgctgacccccaacaccgagagcagctgcgacctgatgaccaagaccaagagcaccagcggcaacgacgacagcaccagcctggacctggagtgggaggacgaggagggcatgaacagaatgctgcccatgagagagagaagcaagaccgaggaggacatcctgagagccgccctgaagtacagcaacaagaagaccggcagcaaccccaccagcgccagcgacgacagcaacggcctggagtgggagaacgacttcgtgagcgccgagatggacgacaacggcaacagcgagtacagcggcttcgtgaaccccgtgctggagctgagcgacagcggcatcagacacagcgacaccgaccagcagaccagatag

SEQ ID NO: 9545 - DNA, 1641 bp, Artificial Sequence
  Description of Artificial Sequence: Synthetic coding sequence
atggccaccctggtggtgaacaagctgggcgccggcgtggacagcggcagacagggcagcagaggcaccgccgtggtgaaggtgctggagtgcggcgtgtgcgaggacgtgttcagcctgcagggcgacaaggtgcccagactgctgctgtgcggccacaccgtgtgccacgactgcctgaccagactgcccctgcacggcagagccatcagatgccccttcgacagacaggtgaccgacctgggcgacagcggcgtgtggggcctgaagaagaacttcgccctgctggagctgctggagagactgcagaacggccccatcggccagtacggcgccgccgaggagagcatcggcatcagcggcgagagcatcatcagatgcgacgaggacgaggcccacctggccagcgtgtactgcaccgtgtgcgccacccacctgtgcagcgagtgcagccaggtgacccacagcaccaagaccctggccaagcacagaagagtgcccctggccgacaagccccacgagaagaccatgtgcagccagcaccaggtgcacgccatcgagttcgtgtgcctggaggagggctgccagaccagccccctgatgtgctgcgtgtgcaaggagtacggcaagcaccagggccacaagcacagcgtgctggagcccgaggccaaccagatcagagccagcatcctggacatggcccactgcatcagaaccttcaccgaggagatcagcgactacagcagaaagctggtgggcatcgtgcagcacatcgagggcggcgagcagatcgtggaggacggcatcggcatggcccacaccgagcacgtgcccggcaccgccgagaacgccagaagctgcatcagagcctacttctacgacctgcacgagaccctgtgcagacaggaggagatggccctgagcgtggtggacgcccacgtgagagagaagctgatctggctgagacagcagcaggaggacatgaccatcctgctgagcgaggtgagcgccgcctgcctgcactgcgagaagaccctgcagcaggacgactgcagagtggtgctggccaagcaggagatcaccagactgctggagaccctgcagaagcagcagcagcagttcaccgaggtggccgaccacatccagctggacgccagcatccccgtgaccttcaccaaggacaacagagtgcacatcggccccaagatggagatcagagtggtgaccctgggcctggacggcgccggcaagaccaccatcctgttcaagctgaagcaggacgagttcatgcagcccatccccaccatcggcttcaacgtggagaccgtggagtacaagaacctgaagttcaccatctgggacgtgggcggcaagcacaagctgagacccctgtggaagcactactacctgaacacccaggccgtggtgttcgtggtggacagcagccacagagacagaatcagcgaggcccacagcgagctggccaagctgctgaccgagaaggagctgagagacgccctgctgctgatcttcgccaacaagcaggacgtggccggcgccctgagcgtggaggagatcaccgagctgctgagcctgcacaagctgtgctgcggcagaagctgcttcagcgacaacatgtag

SEQ ID NO: 9546 - DNA, 609 bp, Artificial Sequence
  Description of Artificial Sequence: Synthetic coding sequence
atggccgtgcccgccgccctgatcctgagagagagccccagcatgaagaaggccgtgagcctgatcaacgccatcgacaccggcagattccccagactgctgaccagaatcctgcagaagctgcacctgaaggccgagagcagcttcagcgaggaggaggaggagaagctgcaggccgccttcagcctggagaagcaggacctgcacctggtgctggagaccatcagcttcatcctggagcaggccgtgtaccacaacgtgaagcccgccgccctgcagcagcagctggagaacatccacctgagacaggacaaggccgaggccttcgtgaacacctggagcagcatgggccaggagaccgtggagaagttcagacagagaatcctggccccctgcaagctggagaccgtgggctggcagctgaacctgcagatggcccacagcgcccaggccaagctgaagagcccccaggccgtgctgcagctgggcgtgaacaacgaggacagcaagagcctggagaaggtgctggtggagttcagccacaaggagctgttcgacttctacaacaagctggagaccatccaggcccagctggacagcctgacctag

SEQ ID NO: 9547 - DNA, 1521 bp, Artificial Sequence
  Description of Artificial Sequence: Synthetic coding sequence
atggaggccgacatcatcaccaacctgagatgcagactgaaggaggccgaggaggagagactgaaggccgcccagtacggcctgcagctggtggagagccagaacgagctgcagaaccagctggacaagtgcagaaacgagatgatgaccatgaccgagagctacgagcaggagaagtacaccctgcagagagaggtggagctgaagagcagaatgctggagagcctgagctgcgagtgcgaggccatcaagcagcagcagaagatgcacctggagaagctggaggagcagctgagcagaagccacggccaggaggtgaacgagctgaagaccaagatcgagaagctgaaggtggagctggacgaggccagactgagcgagaagcagctgaagcaccaggtggaccaccagaaggagctgctgagctgcaagagcgaggagctgagagtgatgagcgagagagtgcaggagagcatgagcagcgagatgctggccctgcagatcgagctgaccgagatggagagcatgaaggtgaagtaccagagcctgaagaagcagaacgtgttcaacagagagcagatgcagagaatgaagctgcagatcgccaccctgctgcagatgaagggcagccagaccgagttcgagcagcaggagagactgctggccatgctggagcagaagaacggcgagatcaagcacctgctgggcgagatcagaaacctggagaagttcaagaacctgtacgacagcatggagagcaagcccagcgtggacagcggcaccctggaggacaacacctactacaccgacctgctgcagatgaagctggacaacctgaacaaggagatcgagagcaccaagggcgagctgagcatccagagaatgaaggccctgttcgagagccagagagccctggacatcgagagaaagctgttcgccaacgagagatgcctgcagctgagcgagagcgagaacatgaagctgagagccaagctggacgagctgaagctgaagtacgagcccgaggagaccgtggaggtgcccgtgctgaagaagagaagagaggtgctgcccgtggacatcaccaccgccaaggacgcctgcgtgaacaacagcgccctgggcggcgaggtgtacagactgcccccccagaaggaggagacccagagctgccccaacagcctggaggacaacaacctgcagctggagaagagcgtgagcatctacacccccgtggtgagcctgagcccccacaagaacctgcccgtggacatgcagctgaagaaggagaagaagtgcgtgaagctgatcggcgtgcccgccgacgccgaggccctgagcgagagaagcggcaacacccccaacagccccagactggccgccgagagcaagctgcagaccgaggtgaaggagggcaaggagaccagcagcaagctggagaaggagacctgcaagaagctgcaccccatcctgtacgtgagcagcaagagcacccccgagacccagtgcccccagcagtag

SEQ ID NO: 9548 - DNA, 1842 bp, Artificial Sequence
  Description of Artificial Sequence: Synthetic coding sequence
atggccaccatccccgactggaagctgcagctgctggccagaagaagacaggaggaggccagcgtgagaggcagagagaaggccgagagagagagactgagccagatgcccgcctggaagagaggcctgctggagagaagaagagccaagctgggcctgagccccggcgagcccagccccgtgctgggcaccgtggaggccggcccccccgaccccgacgagagcgccgtgctgctggaggccatcggccccgtgcaccagaacagattcatcagacaggagagacagcagcagcagcagcagcagcagagaagcgaggagctgctggccgagagaaagcccggccccctggaggccagagagagaagacccagccccggcgagatgagagaccagagccccaagggcagagagagcagagaggagagactgagccccagagagaccagagagagaagactgggcatcggcggcgcccaggagctgagcctgagacccctggaggccagagactggagacagagccccggcgaggtgggcgacagaagcagcagactgagcgaggcctggaagtggagactgagccccggcgagacccccgagagaagcctgagactggccgagagcagagagcagagccccagaagaaaggaggtggagagcagactgagccccggcgagagcgcctaccagaagctgggcctgaccgaggcccacaagtggagacccgacagcagagagagccaggagcagagcctggtgcagctggaggccaccgagtggagactgagaagcggcgaggagagacaggactacagcgaggagtgcggcagaaaggaggagtggcccgtgcccggcgtggcccccaaggagaccgccgagctgagcgagaccctgaccagagaggcccagggcaacagcagcgccggcgtggaggccgccgagcagagacccgtggaggacggcgagagaggcatgaagcccaccgagggctggaagtggaccctgaacagcggcaaggccagagagtggacccccagagacatcgaggcccagacccagaagcccgagccccccgagagcgccgagaagctgctggagagccccggcgtggaggccggcgagggcgaggccgagaaggaggaggccggcgcccagggcagacccctgagagccctgcagaactgctgcagcgtgcccagccccctgccccccgaggacgccggcaccggcggcctgagacagcaggaggaggaggccgtggagctgcagccccccccccccgcccccctgagcccccccccccccgcccccaccgccccccagccccccggcgaccccctgatgagcagactgttctacggcgtgaaggccggccccggcgtgggcgcccccagaagaagcggccacaccttcaccgtgaaccccagaagaagcgtgccccccgccacccccgccacccccaccagccccgccaccgtggacgccgccgtgcccggcgccggcaagaagagataccccaccgccgaggagatcctggtgctgggcggctacctgagactgagcagaagctgcctggccaagggcagccccgagagacaccacaagcagctgaagatcagcttcagcgagaccgccctggagaccacctaccagtaccccagcgagagcagcgtgctggaggagctgggccccgagcccgaggtgcccagcgcccccaacccccccgccgcccagcccgacgacgaggaggacgaggaggagctgctgctgctgcagcccgagctgcagggcggcctgagaaccaaggccctgatcgtggacgagagctgcagaagatag

SEQ ID NO: 9549 - DNA, 654 bp, Artificial Sequence
  Description of Artificial Sequence: Synthetic coding sequence
atgagctggacctgccccagatgccagcagcccgtgttcttcgccgagaaggtgagcagcctgggcaagaactggcacagattctgcctgaagtgcgagagatgccacagcatcctgagccccggcggccacgccgagcacaacggcagaccctactgccacaagccctgctacggcgccctgttcggccccagaggcgtgaacatcggcggcgtgggcagctacctgtacaacccccccacccccagccccggctgcaccacccccctgagccccagcagcttcagcccccccagacccagaaccggcctgccccagggcaagaagagccccccccacatgaagaccttcaccggcgagaccagcctgtgccccggctgcggcgagcccgtgtacttcgccgagaaggtgatgagcctgggcagaaactggcacagaccctgcctgagatgccagagatgccacaagaccctgaccgccggcagccacgccgagcacgacggcgtgccctactgccacgtgccctgctacggctacctgttcggccccaagggcggccagccccaccccagacactgggacggcatgtacatgcccgaggtgtggcacgtgcacggcctgtgggtgtgcgtggacaacttcccctgcggctag

SEQ ID NO: 9550 - DNA, 1503 bp, Artificial Sequence
  Description of Artificial Sequence: Synthetic coding sequence
atgaaccagagaagaagcgagagcagacccggcaaccacagactgcaggcctacgccgagcccggcaagggcgacagcggcggcgccggccccctgagcggcagcgccagaagaggcagaggcggcggcggcgccatcagagtgagaagaccctgctggagcggcggcgccggcagaggcggcggccccgcctgggccgtgagactgcccaccgtgaccgccggctggacctggcccgccctgagaaccctgagcagcctgagagccggccccagcgagccccacagccccggcagaagaccccccagagccggcagacccctgtgccaggccgacccccagcccggcaaggccgccagaagaagcctggagcccgaccccgcccagaccggccccagacccgccagagccgccggcatgagcgaggccagaaagggccccgacgaggccgaggagagccagtacgacagcggcatcgagagcctgagaagcctgagaagcctgcccgagagcaccagcgcccccgccagcggccccagcgacggcagcccccagccctgcacccacccccccggccccgtgaaggagccccaggagaaggaggacgccgacggcgagagagccgacagcacctacggcagcagcagcctgacctacaccctgagcctgctgggcggccccgaggccgaggaccccgcccccagactgcccctgccccacgtgggcgccctgagcccccagcagctggaggccctgacctacatcagcgaggacggcgacaccctggtgcacctggccgtgatccacgaggcccccgccgtgctgctgtgctgcctggccctgctgccccaggaggtgctggacatccagaacaacctgtaccagaccgccctgcacctggccgtgcacctggaccagcccggcgccgtgagagccctggtgctgaagggcgccagcagagccctgcaggacagacacggcgacaccgccctgcacgtggcctgccagagacagcacctggcctgcgccagatgcctgctggagggcagacccgagcccggcagaggcaccagccacagcctggacctgcagctgcagaactggcagggcctggcctgcctgcacatcgccaccctgcagaagaaccagcccctgatggagctgctgctgagaaacggcgccgacatcgacgtgcaggagggcaccagcggcaagaccgccctgcacctggccgtggagacccaggagagaggcctggtgcagttcctgctgcaggccggcgcccaggtggacgccagaatgctgaacggctgcacccccctgcacctggccgccggcagaggcctgatgggcatcagcagcaccctgtgcaaggccggcgccgacagcctgctgagaaacgtggaggacgagaccccccaggacctgaccgaggagagcctggtgctgctgcccttcgacgacctgaagatcagcggcaagctgctgctgtgcaccgactag

SEQ ID NO: 9551 - DNA, 1881 bp, Artificial Sequence
  Description of Artificial Sequence: Synthetic coding sequence
atggagggccccagagagaaccaggaccccccccccagaagcctggccagacacctgagcgacgccgacagactgagaaaggtgatccaggagctggtggacaccgagaagagctacgtgaaggacctgagctgcctgttcgagctgtacctggagcccctgcagaacgagaccttcctgacccaggacgagatggagagcctgttcggcagcctgcccgagatgctggagttccagaaggtgttcctggagaccctggaggacggcatcagcgccagcagcgacttcaacaccctggagacccccagccagttcagaaagctgctgttcagcctgggcggcagcttcctgtactacgccgaccacttcaagctgtacagcggcttctgcgccaaccacatcaaggtgcagaaggtgctggagagagccaagaccgacaaggccttcaaggccttcctggacgccagaaaccccaccaagcagcacagcagcaccctggagagctacctgatcaagcccgtgcagagagtgctgaagtaccccctgctgctgaaggagctggtgagcctgaccgaccaggagagcgaggagcactaccacctgaccgaggccctgaaggccatggagaaggtggccagccacatcaacgagatgcagaagatctacgaggactacggcaccgtgttcgaccagctggtggccgagcagagcggcaccgagaaggaggtgaccgagctgagcatgggcgagctgctgatgcacagcaccgtgagctggctgaaccccttcctgagcctgggcaaggccagaaaggacctggagctgaccgtgttcgtgttcaagagagccgtgatcctggtgtacaaggagaactgcaagctgaagaagaagctgcccagcaacagcagacccgcccacaacagcaccgacctggaccccttcaagttcagatggctgatccccatcagcgccctgcaggtgagactgggcaaccccgccggcaccgagaacaacagcatctgggagctgatccacaccaagagcgagatcgagggcagacccgagaccatcttccagctgtgctgcagcgacagcgagagcaagaccaacatcgtgaaggtgatcagaagcatcctgagagagaacttcagaagacacatcaagtgcgagctgcccctggagaagacctgcaaggacagactggtgcccctgaagaacagagtgcccgtgagcgccaagctggccagcagcagaagcctgaaggtgctgaagaacagcagcagcaacgagtggaccggcgagaccggcaagggcaccctgctggacagcgacgagggcagcctgagcagcggcacccagagcagcggctgccccaccgccgagggcagacaggacagcaagagcaccagccccggcaagtacccccaccccggcctggccgacttcgccgacaacctgatcaaggagagcgacatcctgagcgacgaggacgacgaccacagacagaccgtgaagcagggcagccccaccaaggacatcgagatccagttccagagactgagaatcagcgaggaccccgacgtgcaccccgaggccgagcagcagcccggccccgagagcggcgagggccagaagggcggcgagcagcccaagctggtgagaggccacttctgccccatcaagagaaaggccaacagcaccaagagagacagaggcaccctgctgaaggcccagatcagacaccagagcctggacagccagagcgagaacgccaccatcgacctgaacagcgtgctggagagagagttcagcgtgcagagcctgaccagcgtggtgagcgaggagtgcttctacgagaccgagagccacggcaagagctag

SEQ ID NO: 9552 - DNA, 1596 bp, Artificial Sequence
  Description of Artificial Sequence: Synthetic coding sequence
atggccgccgtgaagaccctgaaccccaaggccgaggtggccagagcccaggccgccctggccgtgaacatcagcgccgccagaggcctgcaggacgtgctgagaaccaacctgggccccaagggcaccatgaagatgctggtgagcggcgccggcgacatcaagctgaccaaggacggcaacgtgctgctgcacgagatgcagatccagcaccccaccgccagcctgatcgccaaggtggccaccgcccaggacgacatcaccggcgacggcaccaccagcaacgtgctgatcatcggcgagctgctgaagcaggccgacctgtacatcagcgagggcctgcaccccagaatcatcaccgagggcttcgaggccgccaaggagaaggccctgcagttcctggaggaggtgaaggtgagcagagagatggacagagagaccctgatcgacgtggccagaaccagcctgagaaccaaggtgcacgccgagctggccgacgtgctgaccgaggccgtggtggacagcatcctggccatcaagaagcaggacgagcccatcgacctgttcatgatcgagatcatggagatgaagcacaagagcgagaccgacaccagcctgatcagaggcctggtgctggaccacggcgccagacaccccgacatgaagaagagagtggaggacgcctacatcctgacctgcaacgtgagcctggagtacgagaagaccgaggtgaacagcggcttcttctacaagagcgccgaggagagagagaagctggtgaaggccgagagaaagttcatcgaggacagagtgaagaagatcatcgagctgaagagaaaggtgtgcggcgacagcgacaagggcttcgtggtgatcaaccagaagggcatcgaccccttcagcctggacgccctgagcaaggagggcatcgtggccctgagaagagccaagagaagaaacatggagagactgaccctggcctgcggcggcgtggccctgaacagcttcgacgacctgagccccgactgcctgggccacgccggcctggtgtacgagtacaccctgggcgaggagaagttcaccttcatcgagaagtgcaacaaccccagaagcgtgaccctgctgatcaagggccccaacaagcacaccctgacccagatcaaggacgccgtgagagacggcctgagagccgtgaagaacgccatcgacgacggctgcgtggtgcccggcgccggcgccgtggaggtggccatggccgaggccctgatcaagcacaagcccagcgtgaagggcagagcccagctgggcgtgcaggccttcgccgacgccctgctgatcatccccaaggtgctggcccagaacagcggcttcgacctgcaggagaccctggtgaagatccaggccgagcacagcgagagcggccagctggtgggcgtggacctgaacaccggcgagcccatggtggccgccgaggtgggcgtgtgggacaactactgcgtgaagaagcagctgctgcacagctgcaccgtgatcgccaccaacatcctgctggtggacgagatcatgagagccggcatgagcagcctgaagggctag

SEQ ID NO: 9553 - DNA, 666 bp, Artificial Sequence
  Description of Artificial Sequence: Synthetic coding sequence
atgagcgccttcggccacgacgaggcctggatggaggccggcggcttcggcctggaggccgccgagagaaccgagtaccagagcctgtgcaagagcaagctgctgttcctgggcgagcagagcggcaagaccagcatcatcagcagattcatgtacaacagcttcggctgcgcctgccaggccaccgtgggcatcgacttcctgagcaagaccatgtacctggaggaccagatcgtgcagctgcagctgtgggacaccgccggccaggagagattccacagcctgatccccagctacatcagagacagcaccatcgccgtggtggtgtacgacatcaccaacatcaacagcttcaaggagaccgacaagtgggtggagcacgtgagagccgagagaggcgacgacgtggtgatcatgctgctgggcaacaagatcgacctggacaacaagagacaggtgaccgccgagcagggcgaggagaagagcagaaacctgaacgtgatgttcatcgagaccagcgccaagaccggctacaacgtgaagaagctgttcagaagagtggccagcgccctgctgagcaccagaaccagccccccccccaaggagggcaccgtggagatcgagctggagagcttcgaggagagcggcaacagaagctactgctag

SEQ ID NO: 9554 - DNA, 6222 bp, Artificial Sequence
  Description of Artificial Sequence: Synthetic coding sequence
atggccgaggtgagaaagttcaccaagagactgagcaagcccggcaccgccgccgagctgagacagagcgtgagcgaggccgtgagaggcagcgtggtgctggagaaggccaaggtggtggagcccctggactacgagaacgtgatcgcccagagaaagacccagatctacagcgaccccctgagagacctgctgatgttccccatggaggacatcagcatcagcgtgatcggcagacagagaagaaccgtgcagagcaccgtgcccgaggacgccgagaagagagcccagagcctgttcgtgaaggagtgcatcaagacctacagcaccgactggcacgtggtgaactacaagtacgaggacttcagcggcgacttcagaatgctgccctgcaagagcctgagacccgagaagatccccaaccacgtgttcgagatcgacgaggactgcgagaaggacgaggacagcagcagcctgtgcagccagaagggcggcgtgatcaagcagggctggctgcacaaggccaacgtgaacagcaccatcaccgtgaccatgaaggtgttcaagagaagatacttctacctgacccagctgcccgacggcagctacatcctgaacagctacaaggacgagaagaacagcaaggagagcaagggctgcatctacctggacgcctgcatcgacgtggtgcagtgccccaagatgagaagacacgccttcgagctgaagatgctggacaagtacagccactacctggccgccgagaccgagcaggagatggaggagtggctgatcaccctgaagaagatcatccagatcaacaccgacagcctggtgcaggagaagaaggagaccgtggagaccgcccaggacgacgagaccagcagccagggcaaggccgagaacatcatggccagcctggagagaagcatgcaccccgagctgatgaagtacggcagagagaccgagcagctgaacaagctgagcagaggcgacggcagacagaacctgttcagcttcgacagcgaggtgcagagactggacttcagcggcatcgagcccgacatcaagcccttcgaggagaagtgcaacaagagattcctggtgaactgccacgacctgaccttcaacatcctgggccagatcggcgacaacgccaagggcccccccaccaacgtggagcccttcttcatcaacctggccctgttcgacgtgaagaacaactgcaagatcagcgccgacttccacgtggacctgaacccccccagcgtgagagagatgctgtggggcagcagcacccagctggccagcgacggcagccccaagggcagcagccccgagagctacatccacggcatcgccgagagccagctgagatacatccagcagggcatcttcagcgtgaccaacccccaccccgagatcttcctggtggccagaatcgagaaggtgctgcagggcaacatcacccactgcgccgagccctacatcaagaacagcgaccccgtgaagaccgcccagaaggtgcacagaaccgccaagcaggtgtgcagcagactgggccagtacagaatgcccttcgcctgggccgccagacccatcttcaaggacacccagggcagcctggacctggacggcagattcagccccctgtacaagcaggacagcagcaagctgagcagcgaggacatcctgaagctgctgagcgagtacaagaagcccgagaagaccaagctgcagatcatccccggccagctgaacatcaccgtggagtgcgtgcccgtggacctgagcaactgcatcaccagcagctacgtgcccctgaagcccttcgagaagaactgccagaacatcaccgtggaggtggaggagttcgtgcccgagatgaccaagtactgctaccccttcaccatctacaagaaccacctgtacgtgtaccccctgcagctgaagtacgacagccagaagaccttcgccaaggccagaaacatcgccgtgtgcgtggagttcagagacagcgacgagagcgacgccagcgccctgaagtgcatctacggcaagcccgccggcagcgtgttcaccaccaacgcctacgccgtggtgagccaccacaaccagaaccccgagttctacgacgagatcaagatcgagctgcccatccacctgcaccagaagcaccacctgctgttcaccttctaccacgtgagctgcgagatcaacaccaagggcaccaccaagaagcaggacaccgtggagacccccgtgggcttcgcctgggtgcccctgctgaaggacggcagaatcatcaccttcgagcagcagctgcccgtgagcgccaacctgccccccggctacctgaacctgaacgacgccgagagcagaagacagtgcaacgtggacatcaagtgggtggacggcgccaagcccctgctgaagatcaagagccacctggagagcaccatctacacccaggacctgcacgtgcacaagttcttccaccactgccagctgatccagagcggcagcaaggaggtgcccggcgagctgatcaagtacctgaagtgcctgcacgccatggagatccaggtgatgatccagttcctgcccgtgatcctgatgcagctgttcagagtgctgaccaacatgacccacgaggacgacgtgcccatcaactgcaccatggtgctgctgcacatcgtgagcaagtgccacgaggagggcctggacagctacctgagaagcttcatcaagtacagcttcagacccgagaagcccagcgccccccaggcccagctgatccacgagaccctggccaccaccatgatcgccatcctgaagcagagcgccgacttcctgagcatcaacaagctgctgaagtacagctggttcttcttcgagatcatcgccaagagcatggccacctacctgctggaggagaacaagatcaagctgcccagaggccagagattccccgagacctaccaccacgtgctgcacagcctgctgctggccatcatcccccacgtgaccatcagatacgccgagatccccgacgagagcagaaacgtgaactacagcctggccagcttcctgaagagatgcctgaccctgatggacagaggcttcatcttcaacctgatcaacgactacatcagcggcttcagccccaaggaccccaaggtgctggccgagtacaagttcgagttcctgcagaccatctgcaaccacgagcactacatccccctgaacctgcccatggccttcgccaagcccaagctgcagagagtgcaggacagcaacctggagtacagcctgagcgacgagtactgcaagcaccacttcctggtgggcctgctgctgagagagaccagcatcgccctgcaggacaactacgagatcagatacaccgccatcagcgtgatcaagaacctgctgatcaagcacgccttcgacaccagataccagcacaagaaccagcaggccaagatcgcccagctgtacctgcccttcgtgggcctgctgctggagaacatccagagactggccggcagagacaccctgtacagctgcgccgccatgcccaacagcgccagcagagacgagttcccctgcggcttcaccagccccgccaacagaggcagcctgagcaccgacaaggacaccgcctacggcagcttccagaacggccacggcatcaagagagaggacagcagaggcagcctgatccccgagggcgccaccggcttccccgaccagggcaacaccggcgagaacaccagacagagcagcaccagaagcagcgtgagccagtacaacagactggaccagtacgagatcagaagcctgctgatgtgctacctgtacatcgtgaagatgatcagcgaggacaccctgctgacctactggaacaaggtgagcccccaggagctgatcaacatcctgatcctgctggaggtgtgcctgttccacttcagatacatgggcaagagaaacatcgccagagtgcacgacgcctggctgagcaagcacttcggcatcgacagaaagagccagaccatgcccgccctgagaaacagaagcggcgtgatgcaggccagactgcagcacctgagcagcctggagagcagcttcaccctgaaccacagcagcaccaccaccgaggccgacatcttccaccaggccctgctggagggcaacaccgccaccgaggtgagcctgaccgtgctggacaccatcagcttcttcacccagtgcttcaagacccagctgctgaacaacgacggccacaaccccctgatgaagaaggtgttcgacatccacctggccttcctgaagaacggccagagcgaggtgagcctgaagcacgtgttcgccagcctgagagccttcatcagcaagttccccagcgccttcttcaagggcagagtgaacatgtgcgccgccttctgctacgaggtgctgaagtgctgcaccagcaagatcagcagcaccagaaacgaggccagcgccctgctgtacctgctgatgagaaacaacttcgagtacaccaagagaaagaccttcctgagaacccacctgcagatcatcatcgccgtgagccagctgatcgccgacgtggccctgagcggcggcagcagattccaggagagcctgttcatcatcaacaacttcgccaacagcgacagacccatgaaggccaccgccttccccgccgaggtgaaggacctgaccaagagaatcagaaccgtgctgatggccaccgcccagatgaaggagcacgagaaggaccccgagatgctgatcgacctgcagtacagcctggccaagagctacgccagcacccccgagctgagaaagacctggctggacagcatggccaagatccacgtgaagaacggcgacttcagcgaggccgccatgtgctacgtgcacgtggccgccctggtggccgagttcctgcacagaaagaagctgttccccaacggctgcagcgccttcaagaagatcacccccaacatcgacgaggagggcgccatgaaggaggacgccggcatgatggacgtgcactacagcgaggaggtgctgctggagctgctggagcagtgcgtggacggcctgtggaaggccgagagatacgagatcatcagcgagatcagcaagctgatcgtgcccatctacgagaagagaagagagttcgagaagctgacccaggtgtacagaaccctgcacggcgcctacaccaagatcctggaggtgatgcacaccaagaagagactgctgggcaccttcttcagagtggccttctacggccagagcttcttcgaggaggaggacggcaaggagtacatctacaaggagcccaagctgaccggcctgagcgagatcagcctgagactggtgaagctgtacggcgagaagttcggcaccgagaacgtgaagatcatccaggacagcgacaaggtgaacgccaaggagctggaccccaagtacgcccacatccaggtgacctacgtgaagccctacttcgacgacaaggagctgaccgagagaaagaccgagttcgagagaaaccacaacatcagcagattcgtgttcgaggccccctacaccctgagcggcaagaagcagggctgcatcgaggagcagtgcaagagaagaaccatcctgaccaccagcaacagcttcccctacgtgaagaagagaatccccatcaactgcgagcagcagatcaacctgaagcccatcgacgtggccaccgacgagatcaaggacaagaccgccgagctgcagaagctgtgcagcagcaccgacgtggacatgatccagctgcagctgaagctgcagggctgcgtgagcgtgcaggtgaacgccggccccctggcctacgccagagccttcctgaacgacagccaggccagcaagtacccccccaagaaggtgagcgagctgaaggacatgttcagaaagttcatccaggcctgcagcatcgccctggagctgaacgagagactgatcaaggaggaccaggtggagtaccacgagggcctgaagagcaacttcagagacatggtgaaggagctgagcgacatcatccacgagcagatcctgcaggaggacaccatgcacagcccctggatgagcaacaccctgcacgtgttctgcgccatcagcggcaccagcagcgacagaggctacggcagccccagatacgccgaggtgtag

SEQ ID NO: 9555 - DNA, 1644 bp, Artificial Sequence
  Description of Artificial Sequence: Synthetic coding sequence
atgggcggctgcatccccttcctgaaggccgccagagccctgtgccccagaatcatgccccccctgctgctgctgagcgccttcatcttcctggtgagcgtgctgggcggcgcccccggccacaaccccgacagaagaaccaagatggtgagcatccacagcctgagcgagctggagagactgaagctgcaggagaccgcctaccacgagctggtggccagacacttcctgagcgagttcaagcccgacagagccctgcccatcgacagacccaacaccctggacaagtggttcctgatcctgagaggccagcagagagccgtgagccacaagaccttcggcatcagcctggaggaggtgctggtgaacgagttcaccagaagaaagcacctggagctgaccgccaccatgcaggtggaggaggccaccggccaggccgccggcagaagaagaggcaacgtggtgagaagagtgttcggcagaatcagaagattcttcagcagaagaagaaacgagcccaccctgcccagagagttcaccagaagaggcagaagaggcgccgtgagcgtggacagcctggccgagctggaggacggcgccctgctgctgcagaccctgcagctgagcaagatcagcttccccatcggccagagactgctgggcagcaagagaaagatgagcctgaaccccatcgccaagcagatcccccaggtggtggaggcctgctgccagttcatcgagaagcacggcctgagcgccgtgggcatcttcaccctggagtacagcgtgcagagagtgagacagctgagagaggagttcgaccagggcctggacgtggtgctggacgacaaccagaacgtgcacgacgtggccgccctgctgaaggagttcttcagagacatgaaggacagcctgctgcccgacgacctgtacatgagcttcctgctgaccgccaccctgaagccccaggaccagctgagcgccctgcagctgctggtgtacctgatgcccccctgccacagcgacaccctggagagactgctgaaggccctgcacaagatcaccgagaactgcgaggacagcatcggcatcgacggccagctggtgcccggcaacagaatgaccagcaccaacctggccctggtgttcggcagcgccctgctgaagaagggcaagttcggcaagagagagagcagaaagaccaagctgggcatcgaccactacgtggccagcgtgaacgtggtgagagccatgatcgacaactgggacgtgctgttccaggtgcccccccacatccagagacaggtggccaagagagtgtggaagagcagccccgaggccctggacttcatcagaagaagaaacctgagaaagatccagagcgccagaatcaagatggaggaggacgccctgctgagcgaccccgtggagaccagcgccgaggccagagccgccgtgctggcccagagcaagcccagcgacgagggcagcagcgaggagcccgccgtgcccagcggcaccgccagaagccacgacgacgaggagggcgccggcaacccccccatccccgagcaggacagacccctgctgagagtgcccagagagaaggaggccaagaccggcgtgagctacttcttcccctag

SEQ ID NO: 9556 - DNA, 5613 bp, Artificial Sequence
  Description of Artificial Sequence: Synthetic coding sequence
atggccagatggatccccaccaagagacagaagtacggcgtggccatctacaactacaacgccagccaggacgtggagctgagcctgcagatcggcgacaccgtgcacatcctggagatgtacgagggctggtacagaggctacaccctgcagaacaagagcaagaagggcatcttccccgagacctacatccacctgaaggaggccaccgtggaggacctgggccagcacgagaccgtgatccccggcgagctgcccctggtgcaggagctgaccagcaccctgagagagtgggccgtgatctggagaaagctgtacgtgaacaacaagctgaccctgttcagacagctgcagcagatgacctacagcctgatcgagtggagaagccagatcctgagcggcaccctgcccaaggacgagctggccgagctgaagaagaaggtgaccgccaagatcgaccacggcaacagaatgctgggcctggacctggtggtgagagacgacaacggcaacatcctggaccccgacgagaccagcaccatcgccctgttcaaggcccacgaggtggccagcaagagaatcgaggagaagatccaggaggagaagagcatcctgcagaacctggacctgagaggccagagcatcttcagcaccatccacacctacggcctgtacgtgaacttcaagaacttcgtgtgcaacatcggcgaggacgccgagctgttcatggccctgtacgaccccgaccagagcaccttcatcagcgagaactacctgatcagatggggcagcaacggcatgcccaaggagatcgagaagctgaacaacctgcaggccgtgttcaccgacctgagcagcatggacctgatcagacccagagtgagcctggtgtgccagatcgtgagagtgggccacatggagctgaaggagggcaagaagcacacctgcggcctgagaagacccttcggcgtggccgtgatggacatcaccgacatcatccacggcaaggtggacgacgaggagaagcagcacttcatccccttccagcagatcgccatggagacctacatcagacagagacagctgatcatgagccccctgatcaccagccacgtgatcggcgagaacgagcccctgaccagcgtgctgaacaaggtgatcgccgccaaggaggtgaaccacaagggccagggcctgtgggtgagcctgaagctgctgcccggcgacctgacccaggtgcagaagaacttcagccacctggtggacagaagcaccgccatcgccagaaagatgggcttccccgagatcatcctgcccggcgacgtgagaaacgacatctacgtgaccctgatccacggcgagttcgacaagggcaagaagaagacccccaagaacgtggaggtgaccatgagcgtgcacgacgaggagggcaagctgctggagaaggccatccaccccggcgccggctacgagggcatcagcgagtacaagagcgtggtgtactaccaggtgaagcagccctgctggtacgagaccgtgaaggtgagcatcgccatcgaggaggtgaccagatgccacatcagattcaccttcagacacagaagcagccaggagaccagagacaagagcgagagagccttcggcgtggccttcgtgaagctgatgaaccccgacggcaccaccctgcaggacggcagacacgacctggtggtgtacaagggcgacaacaagaagatggaggacgccaagttctacctgaccctgcccggcaccaagatggagatggaggagaaggagctgcaggccagcaagaacctggtgaccttcacccccagcaaggacagcaccaaggacagcttccagatcgccaccctgatctgcagcaccaagctgacccagaacgtggacctgctgggcctgctgaactggagaagcaacagccagaacatcaagcacaacctgaagaagctgatggaggtggacggcggcgagatcgtgaagttcctgcaggacaccctggacgccctgttcaacatcatgatggagatgagcgacagcgagacctacgacttcctggtgttcgacgccctggtgttcatcatcagcctgatcggcgacatcaagttccagcacttcaaccccgtgctggagacctacatctacaagcacttcagcgccaccctggcctacgtgaagctgagcaaggtgctgaacttctacgtggccaacgccgacgacagcagcaagaccgagctgctgttcgccgccctgaaggccctgaagtacctgttcagattcatcatccagagcagagtgctgtacctgagattctacggccagagcaaggacggcgacgagttcaacaacagcatcagacagctgttcctggccttcaacatgctgatggacagacccctggaggaggccgtgaagatcaagggcgccgccctgaagtacctgcccagcatcatcaacgacgtgaagctggtgttcgaccccgtggagctgagcgtgctgttctgcaagttcatccagagcatccccgacaaccagctggtgagacagaagctgaactgcatgaccaagatcgtggagagcaccctgttcagacagagcgagtgcagagaggtgctgctgcccctgctgaccgaccagctgagcggccagctggacgacaacagcaacaagcccgaccacgaggccagcagccagctgctgagcaacatcctggaggtgctggacagaaaggacgtgggcgccaccgccgtgcacatccagctgatcatggagagactgctgagaagaatcaacagaaccgtgatcggcatgaacagacagagcccccacatcggcagcttcgtggcctgcatgatcgccctgctgcagcagatggacgacagccactacagccactacatcagcaccttcaagaccagacaggacatcatcgacttcctgatggagaccttcatcatgttcaaggacctgatcggcaagaacgtgtacgccaaggactggatggtgatgaacatgacccagaacagagtgttcctgagagccatcaaccagttcgccgaggtgctgaccagattcttcatggaccaggccagcttcgagctgcagctgtggaacaactacttccacctggccgtggccttcctgacccacgagagcctgcagctggagaccttcagccaggccaagagaaacaagatcgtgaagaagtacggcgacatgagaaaggagatcggcttcagaatcagagacatgtggtacaacctgggcccccacaagatcaagttcatccccagcatggtgggccccatcctggaggtgaccctgacccccgaggtggagctgagaaaggccaccatccccatcttcttcgacatgatgcagtgcgagttcaacttcagcggcaacggcaacttccacatgttcgagaacgagctgatcaccaagctggaccaggaggtggagggcggcagaggcgacgagcagtacaaggtgctgctggagaagctgctgctggagcactgcagaaagcacaagtacctgagcagcagcggcgaggtgttcgccctgctggtgagcagcctgctggagaacctgctggactacagaaccatcatcatgcaggacgagagcaaggagaacagaatgagctgcaccgtgaacgtgctgaacttctacaaggagaagaagagagaggacatctacatcagatacctgtacaagctgagagacctgcacagagactgcgagaactacaccgaggccgcctacaccctgctgctgcacgccgagctgctgcagtggagcgacaagccctgcgtgccccacctgctgcagaaggacagctactacgtgtacacccagcaggagctgaaggagaagctgtaccaggagatcatcagctacttcgacaagggcaagatgtgggagaaggccatcaagctgagcaaggagctggccgagacctacgagagcaaggtgttcgactacgagggcctgggcaacctgctgaagaagagagccagcttctacgagaacatcatcaaggccatgagaccccagcccgagtacttcgccgtgggctactacggccagggcttccccagcttcctgagaaacaagatcttcatctacagaggcaaggagtacgagagaagagaggacttcagcctgagactgctgacccagttccccaacgccgagaagatgaccagcaccaccccccccggcgaggacatcaagagcagccccaagcagtacatgcagtgcttcaccgtgaagcccgtgatgagcctgccccccagctacaaggacaagcccgtgcccgagcagatcctgaactactacagagccaacgaggtgcagcagttcagatacagcagacccttcagaaagggcgagaaggaccccgacaacgagttcgccaccatgtggatcgagagaaccacctacaccaccgcctacaccttccccggcatcctgaagtggttcgaggtgaagcagatcagcaccgaggagatcagccccctggagaacgccatcgagaccatggagctgaccaacgagagaatcagcaactgcgtgcagcagcacgcctgggacagaagcctgagcgtgcaccccctgagcatgctgctgagcggcatcgtggaccccgccgtgatgggcggcttcagcaactacgagaaggccttcttcaccgagaagtacctgcaggagcaccccgaggaccaggagaaggtggagctgctgaagagactgatcgccctgcagatgcccctgctgaccgagggcatcagaatccacggcgagaagctgaccgagcagctgaagcccctgcacgagagactgagcagctgcttcagagagctgaaggagaaggtggagaagcactacggcgtgatcaccctgccccccaacctgaccgagagaaagcagagcagaaccggcagcatcgtgctgccctacatcatgagcagcaccctgagaagactgagcatcaccagcgtgaccagcagcgtggtgagcaccagcagcaacagcagcgacaacgcccccagcagacccggcagcgacggcagcatcctggagcccctgctggagagaagagccagcagcggcgccagagtggaggacctgagcctgagagaggagaacagcgagaacagaatcagcaagttcaagagaaaggactggagcctgagcaagagccaggtgatcgccgagaaggcccccgagcccgacctgatgagccccaccagaaaggcccagagacccaagagcctgcagctgatggacaacagactgagccccttccacggcagcagccccccccagagcacccccctgagccccccccccctgacccccaaggccaccagaaccctgagcagccccagcctgcagaccgacggcatcgccgccacccccgtgccccccccccccccccccaagagcaagccctacgagggcagccagagaaacagcaccgagctggccccccccctgcccgtgagaagagaggccaaggccccccccccccccccccccaaggccagaaagagcggcatccccaccagcgagcccggcagccagtag

SEQ ID NO: 9557 - DNA, 1623 bp, Artificial Sequence
  Description of Artificial Sequence: Synthetic coding sequence
atgagcgccagcctgaactacaagagcttcagcaaggagcagcagaccatggacaacctggagaagcagctgatctgccccatctgcctggagatgttcaccaagcccgtggtgatcctgccctgccagcacaacctgtgcagaaagtgcgccagcgacatcttccaggccagcaacccctacctgcccaccagaggcggcaccaccatggccagcggcggcagattcagatgccccagctgcagacacgaggtggtgctggacagacacggcgtgtacggcctgcagagaaacctgctggtggagaacatcatcgacatctacaagcaggagagcaccagacccgagaagaagagcgaccagcccatgtgcgaggagcacgaggaggagagaatcaacatctactgcctgaactgcgaggtgcccacctgcagcctgtgcaaggtgttcggcgcccacaaggactgccaggtggcccccctgacccacgtgttccagagacagaagagcgagctgagcgacggcatcgccatcctggtgggcagcaacgacagagtgcagggcgtgatcagccagctggaggacacctgcaagaccatcgaggagtgctgcagaaagcagaagcaggagctgtgcgagaagttcgactacctgtacggcatcctggaggagagaaagaacgagatgacccaggtgatcaccagaacccaggaggagaagctggagcacgtgagagccctgatcaagaagtacagcgaccacctggagaacgtgagcaagctggtggagagcggcatccagttcatggacgagcccgagatggccgtgttcctgcagaacgccaagaccctgctgaagaagatcagcgaggccagcaaggccttccagatggagaagatcgagcacggctacgagaacatgaaccacttcaccgtgaacctgaacagagaggagaagatcatcagagagatcgacttctacagagaggacgaggacgaggaggaggaggagggcggcgagggcgagaaggagggcgagggcgaggtgggcggcgaggccgtggaggtggaggaggtggagaacgtgcagaccgagttccccggcgaggacgagaaccccgagaaggccagcgagctgagccaggtggagctgcaggccgcccccggcgccctgcccgtgagcagccccgagcccccccccgccctgccccccgccgccgacgcccccgtgacccagggcgaggtggtgcccaccggcagcgagcagaccaccgagagcgagacccccgtgcccgccgccgccgagaccgccgaccccctgttctaccccagctggtacaagggccagaccagaaaggccaccaccaaccccccctgcacccccggcagcgagggcctgggccagatcggcccccccggcagcgaggacagcaacgtgagaaaggccgaggtggccgccgccgccgccagcgagagagccgccgtgagcggcaaggagaccagcgcccccgccgccaccagccaggagctggtgatctgcctggccctgctggccttcctgatcctgcactacatctggagccagatccagtgcctgatcttcaccctgatggactggatctag

SEQ ID NO: 9558 - DNA, 3252 bp, Artificial Sequence
  Description of Artificial Sequence: Synthetic coding sequence
atgagccagacccaggactacgagtgcagaagccacaacgtggacctgcccgagagcagaatccccggcagcaacaccagactggagtgggtggagatcatcgagcccagaaccagagagagaatgtacgccaacctggtgaccggcgagtgcgtgtgggacccccccgccggcgtgagaatcaagagaaccagcgagaaccagtggtgggagctgttcgaccccaacaccagcagattctactactacaacgccagcacccagagaaccgtgtggcacagaccccagggctgcgacatcatccccctggccaagctgcagaccctgaagcagaacaccgagagccccagagccagcgccgagagcagccccggcagaggcagcagcgtgagcagagagggcagcaccagcagcagcctggagcccgagcccgacaccgagaaggcccaggagctgcccgccagagccggcagacccgccgccttcggcaccgtgaaggaggacagcggcagcagcagcccccccggcgtgttcctggagaaggactacgagatctacagagactacagcgccgacggccagctgctgcactacagaaccagcagcctgagatggaacagcggcgccaaggagagaatgctgatcaaggtggccgacagagagcccagcttcctggccgcccagggcaacggctacgcccccgacggcccccccggcgtgagaagcagaagacccagcggcagccagcacagccccagcctgcagaccttcgcccccgaggccgacggcaccatcttcttccccgagagaagacccagccccttcctgaagagagccgagctgcccggcagcagcagccccctgctggcccagcccagaaagcccagcggcgacagccagcccagcagccccagatacggctacgagccccccctgtacgaggagccccccgtggagtaccaggcccccatctacgacgagccccccatggacgtgcagttcgaggccggcggcggctaccaggccggcagcccccagagaagccccggcagaaagcccagacccttcctgcagcccaacaagcagggcccccccagcccctgccagcagctggtgctgaccaagcagaagtgccccgagagattcctgagcctggagtacagccccgccggcaaggagtacgtgagacagctggtgtacgtggagcaggccggcagcagccccaagctgagagccggccccagacacaagtacgcccccaaccccggcggcggcagctacagcctgcagcccagcccctgcctgctgagagaccagagactgggcgtgaagagcggcgactacagcaccatggagggccccgagctgagacacagccagccccccacccccctgccccaggcccaggaggacgccatgagctggagcagccagcaggacaccctgagcagcaccggctacagccccggcaccagaaagagaaagagcagaaagcccagcctgtgccaggccaccagcgccacccccaccgagggccccggcgacctgctggtggagcagcccctggccgaggagcagcccccctgcggcaccagcctggcccccgtgaagagagccgagggcgaggccgagggcgccagaggcgccgccgagcccttcctggcccaggccagactggcctgggaggcccagcaggcccacttccacatgaagcagagaagcagctgggacagccagcaggacggcagcggctacgagagcgacggcgccctgcccctgcccatgcccggccccgtggtgagagccttcagcgaggacgaggccctggcccagcaggagaacagacactggagaagaggcaccttcgagaagctgggcttcccccagatcctgctggagaagagcgtgagcgtgcagaccaacctggccagccccgagccctacctgcaccccagccagagcgaggacctggccgcctgcgcccagttcgagagcagcagacagagcagaagcggcgtgcccagcagcagctgcgtgttccccaccttcaccctgagaaagcccagcagcgagaccgacatcgagaactgggccagcaagcacttcaacaagcacacccagggcctgttcagaagaaaggtgagcatcgccaacatgctggcctggagcagcgagagcatcaagaagcccatgatcgtgaccagcgacagacacgtgaagaaggaggcctgcgagctgttcaagctgatccagatgtacatgggcgacagaagagccaaggccgaccccctgcacgtggccctggaggtggccaccaagggctggagcgtgcagggcctgagagacgagctgtacatccagctgtgcagacagaccaccgagaacttcagactggagagcctggccagaggctgggagctgatggccatctgcctggccttcttcccccccacccccaagttccacagctacctggagggctacatctacagacacatggaccccgtgaacgacaccaagggcgtggccatcagcacctacgccaagtactgctaccacaagctgcagaaggccgccctgaccggcgccaagaagggcctgaagaagcccaacgtggaggagatcagacacgccaagaacgccgtgttcagccccagcatgttcggcagcgccctgcaggaggtgatgggcatgcagagagagagataccccgagagacagctgccctgggtgcagaccagactgagcgaggaggtgctggccctgaacggcgaccagaccgagggcatcttcagagtgcccggcgacatcgacgaggtgaacgccctgaagctgcaggtggaccagtggaaggtgcccaccggcctggaggacccccacgtgcccgccagcctgctgaagctgtggtacagagagctggaggagcccctgatcccccacgagttctacgagcagtgcatcgcccactacgacagccccgaggccgccgtggccgtggtgcacgccctgcccagaatcaacagaatggtgctgtgctacctgatcagattcctgcaggtgttcgtgcagcccgccaacgtggccgtgaccaagatggacgtgagcaacctggccatggtgatggcccccaactgcctgagatgccagagcgacgaccccagagtgatcttcgagaacaccagaaaggagatgagcttcctgagagtgctgatccagcacctggacaccagcttcatggagggcgtgctgtag

SEQ ID NO: 9559 - DNA, 426 bp, Artificial Sequence
  Description of Artificial Sequence: Synthetic coding sequence
atgggcaagggcatccccctgaacgaccaggacagaatcccctggctgtgcaacctgcacgacatcctgctgagagacgtggccagcggccagagagtggtgctggcctgcagcgccctgaagaagacctacagagacatcctgacccagggcaaggacggcgtggccctgaagtgcgaggagagcggcaaggaggccaagcaggccgagatgcagctgctggtggtgcacctgagcggcagcttcgaggtgatcagcggcagactgctgaagagagagggccacttcatgccccccgagctgctgcagagccagttcgagaccctggagccccccgccgcccccgagaacttcatccagatcagcgtggacaagaacgtgagcgagatcatcgccaccatcatggagaccctgaagatgaagtag

SEQ ID NO: 9560 - DNA, 1701 bp, Artificial Sequence
  Description of Artificial Sequence: Synthetic coding sequence
atggacatccagctggaccccgccagagacgacctgcccctgatggccaacaccagccacatcctggtgaagcactacgtgctggacctggacgtggacttcgagagccaggtgatcgagggcaccatcgtgctgttcctggaggacggcaacagattcaagaagcagaacagcagcatcgaggaggcctgccagagcgagagcaacaaggcctgcaagttcggcatgcccgagccctgccacatccccgtgaccaacgccagaaccttcagcagcgagatggagtacaacgacttcgccatctgcagcaagggcgagaaggacaccagcgacaaggacggcaaccacgacaaccaggagcacgccagcggcatcagcagcagcaagtactgctgcgacaccggcaaccacggcagcgaggacttcctgctggtgctggactgctgcgacctgagcgtgctgaaggtggaggaggtggacgtggccgccgtgcccggcctggagaagttcaccagaagccccgagctgaccgtggtgagcgaggagttcagaaaccagatcgtgagagagctggtgaccctgcccgccaacagatggagagagcagctggactactacgccagatgcagccaggcccccggctgcggcgagctgctgttcgacaccgacacctggagcctgcagatcagaaagaccggcgcccagaccgccaccgacttcccccacgccatcagaatctggtacaagaccaagcccgagggcagaagcgtgacctggaccagcgaccagagcggcagaccctgcgtgtacaccgtgggcagccccatcaacaacagagccctgttcccctgccaggagccccccgtggccatgagcacctggcaggccaccgtgagagccgccgccagcttcgtggtgctgatgagcggcgagaacagcgccaagcccacccagctgtgggaggagtgcagcagctggtactactacgtgaccatgcccatgcccgccagcaccttcaccatcgccgtgggctgctggaccgagatgaagatggagacctggagcagcaacgacctggccaccgagagacccttcagccccagcgaggccaacttcagacacgtgggcgtgtgcagccacatggagtacccctgcagattccagaacgccagcgccaccacccaggagatcatcccccacagagtgttcgcccccgtgtgcctgaccggcgcctgccaggagaccctgctgagactgatccccccctgcctgagcgccgcccacagcgtgctgggcgcccaccccttcagcagactggacgtgctgatcgtgcccgccaacttccccagcctgggcatggccagcccccacatcatgttcctgagccagagcatcctgaccggcggcaaccacctgtgcggcaccagactgtgccacgagatcgcccacgcctggttcggcctggccatcggcgccagagactggaccgaggagtggctgagcgagggcttcgccacccacctggaggacgtgttctgggccaccgcccagcagctggccccctacgaggccagagagcagcaggagctgagagcctgcctgagatggagaagactgcaggacgagatgcagtgcagccccgaggagatgcaggtgctgagattcccccacgtgggcggctgcagcggcagcttcagctag

SEQ ID NO: 9561 - DNA, 1266 bp, Artificial Sequence
  Description of Artificial Sequence: Synthetic coding sequence
atgcccttcctgcacggcttcagaagaatcatcttcgagtaccagcccctggtggacgccatcctgggcagcctgggcatccaggaccccgagagacaggagagcctggacagacccagctacgtggccagcgaggagagcagaatcctggtgctgaccgagctgctggagagaaaggcccacagccccttctaccaggagggcgtgagcaacgccctgctgaagatggccgagctgggcctgaccagagccgccgacgtgctgctgagacacggcgccaacctgaacttcgaggaccccgtgacctactacaccgccctgcacatcgccgtgctgagaaaccagcccgacatggtggagctgctggtgcaccacggcgccgacgtgaacagaagagacagaatccacgagagcagccccctggacctggccagcgaggagcccgagagactgccctgcctgcagagactgctggacctgggcgccgacgtgaacgccgccgacaagcacggcaagaccgccctgctgcacgccctggccagcagcgacggcgtgcagatccacaacaccgagaacatcagactgctgctggagggcggcgccgacgtgaaggccaccaccaaggacggcgacaccgtgttcacctgcatcatcttcctgctgggcgagaccgtgggcggcgacaaggaggaggcccagatgatcaacagattctgcttccaggtgaccagactgctgctggcccacggcgccgaccccagcgagtgccccgcccacgagagcctgacccacatctgcctgaagagcttcaagctgcacttccccctgctgagattcctgctggagagcggcgccgcctacaactgcagcctgcacggcgccagctgctggagcggcttccacatcatcttcgagagactgtgcagccaccccggctgcaccgaggacgagagccacgccgacctgctgagaaaggccgagaccgtgctggacctgatggtgaccaacagccagaagctgcagctgcccgagaacttcgacatccaccccgtgggcagcctggccgagaagatccaggccctgcacttcagcctgagacagctggagagctaccccccccccctgaagcacctgtgcagagtggccatcagactgtacctgcagccctggcccgtggacgtgaaggtgaaggccctgcccctgcccgacagactgaagtggtacctgctgagcgagcacagcggcagcgtggaggacgacatctag

SEQ ID NO: 9562 - DNA, 594 bp, Artificial Sequence
  Description of Artificial Sequence: Synthetic coding sequence
atgcccttcctgcacggcttcagaagaatcatcttcgagtaccagcccctggtggacgccatcctgggcagcctgggcatccaggaccccgagagacaggagagcctggacagacccagctacgtggccagcgaggagagcagaatcctggtgctgaccgagctgctggagagaaaggcccacagccccttctaccaggagggcgtgagcaacgccctgctgaagatggccgagctgggcctgaccagagccgccgacgtgctgctgagacacggcgccaacctgaacttcgaggaccccgtgacctactacaccgccctgcacatcgccgtgctgagaaaccagcccgacatggtggagctgctggtgcaccacggcgccgacgtgaacagaagagacagagagaagctgctgtgcagcatgctgtggcccgccgccaccggctgcagaagcaccatcctgagaaccttcgtgagctactggaaggagggccagaccagcagacccccccccaagatgggcacccagtgcagccccgccagcagcagctgcctggtgagaccctgggagggcaccaagagaagacccagatag

SEQ ID NO: 9563 - DNA, 684 bp, Artificial Sequence
  Description of Artificial Sequence: Synthetic coding sequence
atgagcgacatcaacctggactgggtggacagaagacagctgcagagactggaggagatgctgatcgtggtggacgagaacgacaaggtgatcggcgccgacaccaagagaaactgccacctgaacgagaacatcgagaagggcctgctgcacagagccttcagcgtggtgctgttcaacaccaagaacagaatcctgatccagcagagaagcgacaccaaggtgaccttccccggctacttcaccgacagctgcagcagccaccccctgtacaaccccgccgagctggaggagaaggacgccatcggcgtgagaagagccgcccagagaagactgcaggccgagctgggcatccccggcgagcagatcagccccgaggacatcgtgttcatgaccatctaccaccacaaggccaagagcgacagaatctggggcgagcacgagatctgctacctgctgctggtgagaaagaacgtgaccctgaaccccgaccccagcgagaccaagagcatcctgtacctgagccaggaggagctgtgggagctgctggagagagaggccagaggcgaggtgaaggtgaccccctggctgagaaccatcgccgagagattcctgtacagatggtggccccacctggacgacgtgacccccttcgtggagctgcacaagatccacagagtgtag

SEQ ID NO: 9564 - DNA, 864 bp, Artificial Sequence
  Description of Artificial Sequence: Synthetic coding sequence
atggaggtgatggagggccccctgaacctggcccaccagcagagcagaagagccgacagactgctggccgccggcaagtacgaggaggccatcagctgccacaagaaggccgccgcctacctgagcgaggccatgaagctgacccagagcgagcaggcccacctgagcctggagctgcagagagacagccacatgaagcagctgctgctgatccaggagagatggaagagagcccagagagaggagagactgaaggcccagcagaacaccgacaaggacgccgccgcccacctgcagaccagccacaagcccagcgccgaggacgccgagggccagagccccctgagccagaagtacagccccagcaccgagaagtgcctgcccgagatccagggcatcttcgacagagaccccgacaccctgctgtacctgctgcagcagaagagcgagcccgccgagccctgcatcggcagcaaggcccccaaggacgacaagaccatcatcgaggagcaggccaccaagatcgccgacctgaagagacacgtggagttcctggtggccgagaacgagagactgagaaaggagaacaagcagctgaaggccgagaaggccagactgctgaagggccccatcgagaaggagctggacgtggacgccgacttcgtggagaccagcgagctgtggagcctgcccccccacgccgagaccgccaccgccagcagcacctggcagaagttcgccgccaacaccggcaaggccaaggacatccccatccccaacctgccccccctggacttccccagccccgagctgcccctgatggagctgagcgaggacatcctgaagggcttcatgaacaactag

SEQ ID NO: 9565 - DNA, 2844 bp, Artificial Sequence
  Description of Artificial Sequence: Synthetic coding sequence
atgtgcgtggacagcctggtgagaatctgcagcggcctgagctacggcagaatcagaaacatcaagagcctgagcgacatccagatcgtgcaggtggcctgcggctactaccacagcctggccctgagcaaggccagcgaggtgttctgctggggccagaacaagtacggccagctgggcctgggcaccgactgcaagaagcagaccagcccccagctgctgaagagcctgctgggcatccccttcatgcaggtggccgccggcggcgcccacagcttcgtgctgaccctgagcggcgccatcttcggctggggcagaaacaagttcggccagctgggcctgaacgacgagaacgacagatacgtgcccaacctgctgaagagcctgagaagccagaagatcgtgtacatctgctgcggcgaggaccacaccgccgccctgaccaaggagggcggcgtgttcaccttcggcgccggcggctacggccagctgggccacaacagcaccagccacgagatcaaccccagaaaggtgttcgagctgatgggcagcatcgtgaccgagatcgcctgcggcagacagcacaccagcgccttcgtgcccagcagcggcagaatctacagcttcggcctgggcggcaacggccagctgggcaccggcagcaccagcaacagaaagagccccttcaccgtgaagggcaactggtacccctacaacggccagtgcctgcccgacatcgacagcgaggagtacttctgcgtgaagagaatcttcagcggcggcgaccagagcttcagccactacagcagcccccagaactgcggcccccccgacgacttcagatgccccaaccccaccaagcagatctggaccgtgaacgaggccctgatccagaagtggctgagctaccccagcggcagattccccgtggagatcgccaacgagatcgacggcaccttcagcagcagcggctgcctgaacggcagcttcctggccgtgagcaacgacgaccactacagaaccggcaccagattcagcggcgtggacatgaacgccgccagactgctgttccacaagctgatccagcccgaccacccccagatcagccagcaggtggccgccagcctggagaagaacctgatccccaagctgaccagcagcctgcccgacgtggaggccctgagattctacctgaccctgcccgagtgccccctgatgagcgacagcaacaacttcaccaccatcgccatccccttcggcaccgccctggtgaacctggagaaggcccccctgaaggtgctggagaactggtggagcgtgctggagccccccctgttcctgaagatcgtggagctgttcaaggaggtggtggtgcacctgctgaagctgtacaagatcggcatcccccccagcgagagaagaatcttcaacagcttcctgcacaccgccctgaaggtgctggagatcctgcacagagtgaacgagaagatgggccagatcatccagtacgacaagttctacatccacgaggtgcaggagctgatcgacatcagaaacgactacatcaactgggtgcagcagcaggcctacggcatggacgtgaaccacggcctgaccgagctggccgacatccccgtgaccatctgcacctaccccttcgtgttcgacgcccaggccaagaccaccctgctgcagaccgacgccgtgctgcagatgcagatggccatcgaccaggcccacagacagaacgtgagcagcctgttcctgcccgtgatcgagagcgtgaacccctgcctgatcctggtggtgagaagagagaacatcgtgggcgacgccatggaggtgctgagaaagaccaagaacatcgactacaagaagcccctgaaggtgatcttcgtgggcgaggacgccgtggacgccggcggcgtgagaaaggagttcttcctgctgatcatgagagagctgctggaccccaagtacggcatgttcagatactacgaggacagcagactgatctggttcagcgacaagaccttcgaggacagcgacctgttccacctgatcggcgtgatctgcggcctggccatctacaactgcaccatcgtggacctgcacttccccctggccctgtacaagaagctgctgaagaagaagcccagcctggacgacctgaaggagctgatgcccgacgtgggcagaagcatgcagcagctgctggactaccccgaggacgacatcgaggagaccttctgcctgaacttcaccatcaccgtggagaacttcggcgccaccgaggtgaaggagctggtgctgaacggcgccgacaccgccgtgaacaagcagaacagacaggagttcgtggacgcctacgtggactacatcttcaacaagagcgtggccagcctgttcgacgccttccacgccggcttccacaaggtgtgcggcggcaaggtgctgctgctgttccagcccaacgagctgcaggccatggtgatcggcaacaccaactacgactggaaggagctggagaagaacaccgagtacaagggcgagtactgggccgagcaccccaccatcaagatcttctgggaggtgttccacgagctgcccctggagaagaagaagcagttcctgctgttcctgaccggcagcgacagaatccccatcctgggcatgaagagcctgaagctggtgatccagagcaccggcggcggcgaggagtacctgcccgtgagccacacctgcttcaacctgctggacctgcccaagtacaccgagaaggagaccctgagaagcaagctgatccaggccatcgaccacaacgagggcttcagcctgatctag

SEQ ID NO: 9566 - DNA, 2541 bp, Artificial Sequence
  Description of Artificial Sequence: Synthetic coding sequence
atgcccgccttcctgggcctgaagtgcctgggcaagctgtgcagcagcgagaagagcaaggtgaccagcagcgagagaaccagcgccagaggcagcaacagaaagagactgatcgtggaggacagaagagtgagcggcaccagcttcaccgcccacagaagagccaccatcacccacctgctgtacctgtgccccaaggactactgccccagaggcagagtgtgcaacagcgtggaccccttcgtggcccacccccaggacccccaccaccccagcgagaagcccgtgatccactgccacaagtgcggcgagccctgcaagggcgaggtgctgagagtgcagaccaagcacttccacatcaagtgcttcacctgcaaggtgtgcggctgcgacctggcccagggcggcttcttcatcaagaacggcgagtacctgtgcaccctggactaccagagaatgtacggcaccagatgccacggctgcggcgagttcgtggagggcgaggtggtgaccgccctgggcaagacctaccaccccaactgcttcgcctgcaccatctgcaagagacccttcccccccggcgacagagtgaccttcaacggcagagactgcctgtgccagctgtgcgcccagcccatgagcagcagccccaaggagaccaccttcagcagcaactgcgccggctgcggcagagacatcaagaacggccaggccctgctggccctggacaagcagtggcacctgggctgcttcaagtgcaagagctgcggcaaggtgctgaccggcgagtacatcagcaaggacggcgccccctactgcgagaaggactaccagggcctgttcggcgtgaagtgcgaggcctgccaccagttcatcaccggcaaggtgctggaggccggcgacaagcactaccaccccagctgcgccagatgcagcagatgcaaccagatgttcaccgagggcgaggagatgtacctgcagggcagcaccgtgtggcaccccgactgcaagcagagcaccaagaccgaggagaagctgagactgcccaacatcagaagaagcagcagcgacttcttctacagcaagagcctgatcagaagaaccggcagaagccccagcctgcagcccaccagaaccagcagcgagagcatctacagcagacccggcagcagcatccccggcagccccggccacaccatctacgccaaggtggacaacgagatcctggactacaaggacctggccgccatccccaaggtgaaggccatctacgacatcgagagacccgacctgatcacctacgagcccttctacaccagcggctacgacgacaagcaggagagacagagcctgggcgagagccccagaaccctgagccccacccccagcgccgagggctaccaggacgtgagagacagaatgatccacagaagcaccagccagggcagcatcaacagccccgtgtacagcagacacagctacacccccaccaccagcagaagcccccagcacttccacagacccgagctgctgagccccggcgtgcagagactgagctacctgagaaccagcagcctgagccccacccacagcgacagcagacccaacccccccttcagacaccacttcatcccccacatcaagggcaacgagcccagcagcggcagaaacagccccctgccctacagacccgacagcagacccctgacccccacctacgcccaggcccccaagcacttccacgtgcccgaccagggcatcaacatctacagaaagccccccatctacaagcagcacgccgccctggccgcccagagcaagagcagcgaggacatcatcaagttcagcaagttccccgccgcccaggcccccgaccccagcgagacccccaagatcgagaccgaccactggcccggcccccccagcttcgccgtggtgggccccgacatgaagagaagaagcagcggcagagaggaggacgacgaggagctgctgagaagaagacagctgcaggaggagcagctgatgaagctgaacagcggcctgggccagctgatcctgaaggaggagatggagaaggagagcagagagagaagcagcctgctggccagcagatacgacagccccatcaacagcgccagccacatccccagcagcaagaccgccagcctgcccggctacggcagaaacggcctgcacagacccgtgagcaccgacttcgcccagtacaacagctacggcgacgtgagcggcggcgtgagagactaccagaccctgcccgacggccacatgcccgccatgagaatggacagaggcgtgagcatgcccaacatgctggagcccaagatcttcccctacgagatgctgatggtgaccaacagaggcagaaacaagatcctgagagaggtggacagaaccagactggagagacacctggcccccgaggtgttcagagagatcttcggcatgagcatccaggagttcgacagactgcccctgtggagaagaaacgacatgaagaagaaggccaagctgttctag

SEQ ID NO: 9567 - DNA, 594 bp, Artificial Sequence
  Description of Artificial Sequence: Synthetic coding sequence
atgttcggctgcctggtggccggcagactggtgcagaccgccgcccagcaggtggccgaggacaagttcgtgttcgacctgcccgactacgagagcatcaaccacgtggtggtgttcatgctgggcaccatccccttccccgagggcatgggcggcagcgtgtacttcagctaccccgacagcaacggcatgcccgtgtggcagctgctgggcttcgtgaccaacggcaagcccagcgccatcttcaagatcagcggcctgaagagcggcgagggcagccagcaccccttcggcgccatgaacatcgtgagaacccccagcgtggcccagatcggcatcagcgtggagctgctggacagcatggcccagcagacccccgtgggcaacgccgccgtgagcagcgtggacagcttcacccagttcacccagaagatgctggacaacttctacaacttcgccagcagcttcgccgtgagccaggcccagatgacccccagccccagcgagatgttcatccccgccaacgtggtgctgaagtggtacgagaacttccagagaagactggcccagaaccccctgttctggaagacctag

SEQ ID NO: 9568 - DNA, 930 bp, Artificial Sequence
  Description of Artificial Sequence: Synthetic coding sequence
atggtgttccccgccaagagattctgcctggtgcccagcatggagggcgtgagatgggccttcagctgcggcacctggctgcccagcagagccgagtggctgctggccgtgagaagcatccagcccgaggagaaggagagaatcggccagttcgtgttcgccagagacgccaaggccgccatggccggcagactgatgatcagaaagctggtggccgagaagctgaacatcccctggaaccacatcagactgcagagaaccgccaagggcaagcccgtgctggccaaggacagcagcaacccctaccccaacttcaacttcaacatcagccaccagggcgactacgccgtgctggccgccgagcccgagctgcaggtgggcatcgacatcatgaagaccagcttccccggcagaggcagcatccccgagttcttccacatcatgaagagaaagttcaccaacaaggagtgggagaccatcagaagcttcaaggacgagtggacccagctggacatgttctacagaaactgggccctgaaggagagcttcatcaaggccatcggcgtgggcctgggcttcgagctgcagagactggagttcgacctgagccccctgaacctggacatcggccaggtgtacaaggagaccagactgttcctggacggcgaggaggagaaggagtgggccttcgaggagagcaagatcgacgagcaccacttcgtggccgtggccctgagaaagcccgacggcagcagacaccaggacgtgcccagccaggacgacagcaagcccacccagagacagttcaccatcctgaacttcaacgacctgatgagcagcgccgtgcccatgacccccgaggaccccagcttctgggactgcttctgcttcaccgaggagatccccatcagaaacggcaccaagagctag

SEQ ID NO: 9569 - DNA, 1599 bp, Artificial Sequence
  Description of Artificial Sequence: Synthetic coding sequence
atgcagagctgcgagagcagcggcgacagcgccgacgaccccctgagcagaggcctgagaagaagaggccagcccagagtggtggtgatcggcgccggcctggccggcctggccgccgccaaggccctgctggagcagggcttcaccgacgtgaccgtgctggaggccagcagccacatcggcggcagagtgcagagcgtgaagctgggccacgccaccttcgagctgggcgccacctggatccacggcagccacggcaaccccatctaccacctggccgaggccaacggcctgctggaggagaccaccgacggcgagagaagcgtgggcagaatcagcctgtacagcaagaacggcgtggcctgctacctgaccaaccacggcagaagaatccccaaggacgtggtggaggagttcagcgacctgtacaacgaggtgtacaacctgacccaggagttcttcagacacgacaagcccgtgaacgccgagagccagaacagcgtgggcgtgttcaccagagaggaggtgagaaacagaatcagaaacgaccccgacgaccccgaggccaccaagagactgaagctggccatgatccagcagtacctgaaggtggagagctgcgagagcagcagccacagcatggacgaggtgagcctgagcgccttcggcgagtggaccgagatccccggcgcccaccacatcatccccagcggcttcatgagagtggtggagctgctggccgagggcatccccgcccacgtgatccagctgggcaagcccgtgagatgcatccactgggaccaggccagcgccagacccagaggccccgagatcgagcccagaggcgtgctgaagagacagtacaccagcttcttcagacccggcctgcccaccgagaaggtggccgccatccacagactgggcatcggcaccaccgacaagatcttcctggagttcgaggagcccttctggggccccgagtgcaacagcctgcagttcgtgtgggaggacgaggccgagagccacaccctgacctacccccccgagctgtggtacagaaagatctgcggcttcgacgtgctgtacccccccgagagatacggccacgtgctgagcggctggatctgcggcgaggaggccctggtgatggagaagtgcgacgacgaggccgtggccgagatctgcaccgagatgctgagacagttcaccggcaaccccaacatccccaagcccagaagaatcctgagaagcgcctggggcagcaacccctacttcagaggcagctacagctacacccaggtgggcagcagcggcgccgacgtggagaagctggccaagcccctgccctacaccgagagcagcaagaccgcccacggcagcagcaccaagcagcagcccggccacctgttcagcagcaagtgccccgagcagcccctggacgccaacagaggcgccgtgaagcccatgcaggtgctgttcagcggcgaggccacccacagaaagtactacagcaccacccacggcgccctgctgagcggccagagagaggccgccagactgatcgagatgtacagagacctgttccagcagggcacctag

SEQ ID NO: 9570 - DNA, 2349 bp, Artificial Sequence
  Description of Artificial Sequence: Synthetic coding sequence
atggacagcagcatccacctgagcagcctgatcagcagacacgacgacgaggccaccagaaccagcaccagcgagggcctggaggagggcgaggtggagggcgagaccctgctgatcgtggagagcgaggaccaggccagcgtggacctgagccacgaccagagcggcgacagcctgaacagcgacgagggcgacgtgagctggatggaggagcagctgagctacttctgcgacaagtgccagaagtggatccccgccagccagctgagagagcagctgagctacctgaagggcgacaacttcttcagattcacctgcagcgactgcagcgccgacggcaaggagcagtacgagagactgaagctgacctggcagcaggtggtgatgctggccatgtacaacctgagcctggagggcagcggcagacagggctacttcagatggaaggaggacatctgcgccttcatcgagaagcactggaccttcctgctgggcaacagaaagaagaccagcacctggtggagcaccgtggccggctgcctgagcgtgggcagccccatgtacttcagaagcggcgcccaggagttcggcgagcccggctggtggaagctggtgcacaacaagccccccaccatgaagcccgagggcgagaagctgagcgccagcaccctgaagatcaaggccgccagcaagcccaccctggaccccatcatcaccgtggagggcctgagaaagagagccagcagaaaccccgtggagagcgccatggagctgaaggagaagagaagcagaacccaggaggccaaggacatcagaagagcccagaaggaggccgccggcttcctggacagaagcaccagcagcacccccgtgaagttcatcagcagaggcagaagacccgacgtgatcctggagaagggcgaggtgatcgacttcagcagcctgagcagcagcgacagaacccccctgaccagccccagccccagccccagcctggacttcagcgcccccggcacccccgccagccacagcgccacccccagcctgctgagcgaggccgacctgatccccgacgtgatgcccccccaggccctgttccacgacgacgacgagatggagggcgacggcgtgatcgaccccggcatggagtacgtgcccccccccgccggcagcgtggccagcggccccgtggtgggcgtgagaaagaaggtgagaggccccgagcagatcaagcaggaggtggagagcgaggaggagaagcccgacagaatggacatcgacagcgaggacaccgacagcaacaccagcctgcagaccagagccagagagaagagaaagccccagctggagaaggacaccaagcccaaggagcccagatacacccccgtgagcatctacgaggagaagctgctgctgaagagactggaggcctgccccggcgccgtggccatgacccccgaggccagaagactgaagagaaagctgatcgtgagacaggccaagagagacagaggcctgcccctgttcgacctggaccaggtggtgaacgccgccctgctgctggtggacggcatctacggcgccaaggagggcggcatcagcagactgcccgccggccaggccacctacagaaccacctgccaggacttcagaatcctggacagataccagaccagcctgcccagcagaaagggcttcagacaccagaccaccaagttcctgtacagactggtgggcagcgaggacatggccgtggaccagagcatcgtgagcccctacaccagcagaatcctgaagccctacatcagaagagactacgagaccaagccccccaagctgcagctgctgagccagatcagaagccacctgcacagaagcgacccccactggacccccgagcccgacgcccccctggactactgctacgtgagacccaaccacatccccaccatcaacagcatgtgccaggagttcttctggcccggcatcgacctgagcgagtgcctgcagtaccccgacttcagcgtggtggtgctgtacaagaaggtgatcatcgccttcggcttcatggtgcccgacgtgaagtacaacgaggcctacatcagcttcctgttcgtgcaccccgagtggagaagagccggcatcgccaccttcatgatctaccacctgatccagacctgcatgggcaaggacgtgaccctgcacgtgagcgccagcaaccccgccatgctgctgtaccagaagttcggcttcaagaccgaggagtacgtgctggacttctacgacaagtactaccccctggagagcaccgagtgcaagcacgccttcttcctgagactgagaagatag

SEQ ID NO: 9571 - DNA, 2745 bp, Artificial Sequence
  Description of Artificial Sequence: Synthetic coding sequence
atgggcaccaccgcccccggccccatccacctgctggagctgtgcgaccagaagctgatggagttcctgtgcaacatggacaacaaggacctggtgtggctggaggagatccaggaggaggccgagagaatgttcaccagagagttcagcaaggagcccgagctgatgcccaagacccccagccagaagaacagaagaaagaagagaagaatcagctacgtgcaggacgagaacagagaccccatcagaagaagactgagcagaagaaagagcagaagcagccagctgagcagcagaagactgagaagcaaggacagcgtggagaagctggccaccgtggtgggcgagaacggcagcgtgctgagaagagtgaccagagccgccgccgccgccgccgccgccaccatggccctggccgcccccagcagccccacccccgagagccccaccatgctgaccaagaagcccgaggacaaccacacccagtgccagctggtgcccgtggtggagatcggcatcagcgagagacagaacgccgagcagcacgtgacccagctgatgagcaccgagcccctgcccagaaccctgagccccacccccgccagcgccaccgcccccaccagccagggcatccccaccagcgacgaggagagcacccccaagaagagcaaggccagaatcctggagagcatcaccgtgagcagcctgatggccaccccccaggaccccaagggccagggcgtgggcaccggcagaagcgccagcaagctgagaatcgcccaggtgagccccggccccagagacagccccgccttccccgacagcccctggagagagagagtgctggcccccatcctgcccgacaacttcagcacccccaccggcagcagaaccgacagccagagcgtgagacacagccccatcgcccccagcagccccagcccccaggtgctggcccagaagtacagcctggtggccaagcaggagagcgtggtgagaagagccagcagaagactggccaagaagaccgccgaggagcccgccgccagcggcagaatcatctgccacagctacctggagagactgctgaacgtggaggtgccccagaaggtgggcagcgagcagaaggagccccccgaggaggccgagcccgtggccgccgccgagcccgaggtgcccgagaacaacggcaacaacagctggccccacaacgacaccgagatcgccaacagcacccccaaccccaagcccgccgccagcagccccgagacccccagcgccggccagcaggaggccaagaccgaccaggccgacggccccagagagcccccccagagcgccagaagaaagagaagctacaagcaggccgtgagcgagctggacgaggagcagcacctggaggacgaggagctgcagccccccagaagcaagacccccagcagcccctgccccgccagcaaggtggtgagacccctgagaaccttcctgcacaccgtgcagagaaaccagatgctgatgacccccaccagcgcccccagaagcgtgatgaagagcttcatcaagagaaacacccccctgagaatggaccccaaggagaaggagagacagagactggagaacctgagaagaaaggaggaggccgagcagctgagaagacagaaggtggaggaggacaagagaagaagactggaggaggtgaagctgaagagagaggagagactgagaaaggtgctgcaggccagagagagagtggagcagatgaaggaggagaagaagaagcagatcgagcagaagttcgcccagatcgacgagaagaccgagaaggccaaggaggagagactggccgaggagaaggccaagaagaaggccgccgccaagaagatggaggaggtggaggccagaagaaagcaggaggaggaggccagaagactgagatggctgcagcaggaggaggaggagagaagacaccaggagctgctgcagaagaagaaggaggaggagcaggagagactgagaaaggccgccgaggccaagagactggccgagcagagagagcaggagagaagagagcaggagagaagagagcaggagagaagagagcaggagagaagagagcaggagagaagagagcaggagagacagctggccgagcaggagagaagaagagagcaggagagactgcaggccgagagagagctgcaggagagagagaaggccctgagactgcagaaggagcagctgcagagagagctggaggagaagaagaagaaggaggagcagcagagactggccgagagacagctgcaggaggagcaggagaagaaggccaaggaggccgccggcgccagcaaggccctgaacgtgaccgtggacgtgcagagccccgcctgcaccagctaccagatgaccccccagggccacagagccccccccaagatcaaccccgacaactacggcatggacctgaacagcgacgacagcaccgacgacgaggcccaccccagaaagcccatccccacctgggccagaggcacccccctgagccaggccatcatccaccagtactaccacccccccaacctgctggagctgttcggcaccatcctgcccctggacctggaggacatcttcaagaagagcaagcccagataccacaagagaaccagcagcgccgtgtggaacagcccccccctgcagggcgccagagtgcccagcagcctggcctacagcctgaagaagcactag

SEQ ID NO: 9572 - DNA, 4149 bp, Artificial Sequence
  Description of Artificial Sequence: Synthetic coding sequence
atggacgaggaggagaaccactacgtgagccagctgagagaggtgtacagcagctgcgacaccaccggcaccggcttcctggacagacaggagctgacccagctgtgcctgaagctgcacctggagcagcagctgcccgtgctgctgcagaccctgctgggcaacgaccacttcgccagagtgaacttcgaggagttcaaggagggcttcgtggccgtgctgagcagcaacgccggcgtgagacccagcgacgaggacagcagcagcctggagagcgccgccagcagcgccatcccccccaagtacgtgaacggcagcaagtggtacggcagaagaagcagacccgagctgtgcgacgccgccaccgaggccagaagagtgcccgagcagcagacccaggccagcctgaagagccacctgtggagaagcgccagcctggagagcgtggagagccccaagagcgacgaggaggccgagagcaccaaggaggcccagaacgagctgttcgaggcccagggccagctgcagacctgggacagcgaggacttcggcagcccccagaagagctgcagccccagcttcgacacccccgagagccagatcagaggcgtgtgggaggagctgggcgtgggcagcagcggccacctgagcgagcaggagctggccgtggtgtgccagagcgtgggcctgcagggcctggagaaggaggagctggaggacctgttcaacaagctggaccaggacggcgacggcaaggtgagcctggaggagttccagctgggcctgttcagccacgagcccgccctgctgctggagagcagcaccagagtgaagcccagcaaggcctggagccactaccaggtgcccgaggagagcggctgccacaccaccaccaccagcagcctggtgagcctgtgcagcagcctgagactgttcagcagcatcgacgacggcagcggcttcgccttccccgaccaggtgctggccatgtggacccaggagggcatccagaacggcagagagatcctgcagagcctggacttcagcgtggacgagaaggtgaacctgctggagctgacctgggccctggacaacgagctgatgaccgtggacagcgccgtgcagcaggccgccctggcctgctaccaccaggagctgagctaccagcagggccaggtggagcagctggccagagagagagacaaggccagacaggacctggagagagccgagaagagaaacctggagttcgtgaaggagatggacgactgccacagcaccctggagcagctgaccgagaagaagatcaagcacctggagcagggctacagagagagactgagcctgctgagaagcgaggtggaggccgagagagagctgttctgggagcaggcccacagacagagagccgccctggagtgggacgtgggcagactgcaggccgaggaggccggcctgagagagaagctgaccctggccctgaaggagaacagcagactgcagaaggagatcgtggaggtggtggagaagctgagcgacagcgagagactggccctgaagctgcagaaggacctggagttcgtgctgaaggacaagctggagccccagagcgccgagctgctggcccaggaggagagattcgccgccgtgctgaaggagtacgagctgaagtgcagagacctgcaggacagaaacgacgagctgcaggccgagctggagggcctgtgggccagactgcccaagaacagacacagccccagctggagccccgacggcagaagaagacagctgcccggcctgggccccgccggcatcagcttcctgggcaacagcgcccccgtgagcatcgagaccgagctgatgatggagcaggtgaaggagcactaccaggacctgagaacccagctggagaccaaggtgaactactacgagagagagatcgccgccctgaagagaaacttcgagaaggagagaaaggacatggagcaggccagaagaagagaggtgagcgtgctggagggccagaaggccgacctggaggagctgcacgagaagagccaggaggtgatctggggcctgcaggagcagctgcaggacaccgccagaggccccgagcccgagcagatgggcctggccccctgctgcacccaggccctgtgcggcctggccctgagacaccacagccacctgcagcagatcagaagagaggccgaggccgagctgagcggcgagctgagcggcctgggcgccctgcccgccagaagagacctgaccctggagctggaggagcccccccagggccccctgcccagaggcagccagagaagcgagcagctggagctggagagagccctgaagctgcagccctgcgccagcgagaagagagcccagatgtgcgtgagcctggccctggaggaggaggagctggagctggccagaggcaagagagtggacggccccagcctggaggccgagatgcaggccctgcccaaggacggcctggtggccggcagcggccaggagggcaccagaggcctgctgcccctgagacccggctgcggcgagagacccctggcctggctggcccccggcgacggcagagagagcgaggaggccgccggcgccggccccagaagaagacaggcccaggacaccgaggccacccagagccccgcccccgcccccgcccccgccagccacggccccagcgagagatggagcagaatgcagccctgcggcgtggacggcgacatcgtgcccaaggagcccgagcccttcggcgccagcgccgccggcctggagcagcccggcgccagagagctgcccctgctgggcaccgagagagacgccagccagacccagcccagaatgtgggagccccccctgagacccgccgccagctgcagaggccaggccgagagactgcaggccatccaggaggagagagccagaagctggagcagaggcacccaggagcaggccagcgagcagcaggccagagccgagggcgccctggagcccggctgccacaagcacagcgtggaggtggccagaagaggcagcctgcccagccacctgcagctggccgacccccagggcagctggcaggagcagctggccgcccccgaggagggcgagaccaagatcgccctggagagagagaaggacgacatggagaccaagctgctgcacctggaggacgtggtgagagccctggagaagcacgtggacctgagagagaacgacagactggagttccacagactgagcgaggagaacaccctgctgaagaacgacctgggcagagtgagacaggagctggaggccgccgagagcacccacgacgcccagagaaaggagatcgaggtgctgaagaaggacaaggagaaggcctgcagcgagatggaggtgctgaacagacagaaccagaactacaaggaccagctgagccagctgaacgtgagagtgctgcagctgggccaggaggccagcacccaccaggcccagaacgaggagcacagagtgaccatccagatgctgacccagagcctggaggaggtggtgagaagcggccagcagcagagcgaccagatccagaagctgagagtggagctggagtgcctgaaccaggagcaccagagcctgcagctgccctggagcgagctgacccagaccctggaggagagccaggaccaggtgcagggcgcccacctgagactgagacaggcccaggcccagcacctgcaggaggtgagactggtgccccaggacagagtggccgagctgcacagactgctgagcctgcagggcgagcaggccagaagaagactggacgcccagagagaggagcacgagaagcagctgaaggccaccgaggagagagtggaggaggccgagatgatcctgaagaacatggagatgctgctgcaggagaaggtggacaagctgaaggagcagttcgagaagaacaccaagagcgacctgctgctgaaggagctgtacgtggagaacgcccacctggtgagagccctgcaggccaccgaggagaagcagagaggcgccgagaagcagagcagactgctggaggagaaggtgagagccctgaacaagctggtgagcagaatcgcccccgccgccctgagcgtgtag

SEQ ID NO: 9573 - DNA, 4383 bp, Artificial Sequence
  Description of Artificial Sequence: Synthetic coding sequence
atggccggcagacccctgagaatcggcgaccagctggtgctggaggaggactacgacgagacctacatccccagcgagcaggagatcctggagttcgccagagagatcggcatcgaccccatcaaggagcccgagctgatgtggctggccagagagggcatcgtggcccccctgcccggcgagtggaagccctgccaggacatcaccggcgacatctactacttcaacttcgccaacggccagagcatgtgggaccacccctgcgacgagcactacagaagcctggtgatccaggagagagccaagctgagcaccagcggcgccatcaagaagaagaagaagaagaaggagaagaaggacaagaaggacagagacccccccaagagcagcctggccctgggcagcagcctggcccccgtgcacgtgcccctgggcggcctggcccccctgagaggcctggtggacaccccccccagcgccctgagaggcagccagagcgtgagcctgggcagcagcgtggagagcggcagacagctgggcgagctgatgctgcccagccagggcctgaagaccagcgcctacaccaagggcctgctgggcagcatctacgaggacaagaccgccctgagcctgctgggcctgggcgaggagaccaacgaggaggacgaggaggagagcgacaaccagagcgtgcacagcagcagcgagcccctgagaaacctgcacctggacatcggcgccctgggcggcgacttcgagtacgaggagagcctgagaaccagccagcccgaggagaagaaggacgtgagcctggacagcgacgccgccggcccccccaccccctgcaagcccagcagccccggcgccgacagcagcctgagcagcgccgtgggcaagggcagacagggcagcggcgccagacccggcctgcccgagaaggaggagaacgagaagagcgagcccaagatctgcagaaacctggtgacccccaaggccgaccccaccggcagcgagcccgccaaggccagcgagaaggaggcccccgaggacaccgtggacgccggcgaggagggcagcagaagagaggaggccgccaaggagcccaagaagaaggccagcgccctggaggagggcagcagcgacgccagccaggagctggagatcagcgagcacatgaaggagccccagctgagcgacagcatcgccagcgaccccaagagcttccacggcctggacttcggcttcagaagcagaatcagcgagcacctgctggacgtggacgtgctgagccccgtgctgggcggcgcctgcagacaggcccagcagcccctgggcatcgaggacaaggacgacagccagagcagccaggacgagctgcagagcaagcagagcaagggcctggaggagagactgagcccccccctgccccacgaggagagagcccagagcccccccagaagcctggccaccgaggaggagcccccccagggccccgagggccagcccgagtggaaggaggccgaggagctgggcgaggacagcgccgccagcctgagcctgcagctgagcctgcagagagagcaggcccccagcccccccgccgcctgcgagaagggcaaggagcagcacagccaggccgaggagctgggccccggccaggaggaggccgaggaccccgaggagaaggtggccgtgagccccaccccccccgtgagccccgaggtgagaagcaccgagcccgtggccccccccgagcagctgagcgaggccgccctgaaggccatggaggaggccgtggcccaggtgctggagcaggaccagagacacctgctggagagcaagcaggagaagatgcagcagctgagagagaagctgtgccaggaggaggaggaggagatcctgagactgcaccagcagaaggagcagagcctgagcagcctgagagagagactgcagaaggccatcgaggaggaggaggccagaatgagagaggaggagagccagagactgagctggctgagagcccaggtgcagagcagcacccaggccgacgaggaccagatcagagccgagcaggaggccagcctgcagaagctgagagaggagctggagagccagcagaaggccgagagagccagcctggagcagaagaacagacagatgctggagcagctgaaggaggagatcgaggccagcgagaagagcgagcaggccgccctgaacgccgccaaggagaaggccctgcagcagctgagagagcagctggagggcgagagaaaggaggccgtggccaccctggagaaggagcacagcgccgagctggagagactgtgcagcagcctggaggccaagcacagagaggtggtgagcagcctgcagaagaagatccaggaggcccagcagaaggaggaggcccagctgcagaagtgcctgggccaggtggagcacagagtgcaccagaagagctaccacgtggccggctacgagcacgagctgagcagcctgctgagagagaagagacaggaggtggagggcgagcacgagagaagactggacaagatgaaggaggagcaccagcaggtgatggccaaggccagagagcagtacgaggccgaggagagaaagcagagagccgagctgctgggccacctgaccggcgagctggagagactgcagagagcccacgagagagagctggagaccgtgagacaggagcagcacaagagactggaggacctgagaagaagacacagagagcaggagagaaagctgcaggacctggagctggacctggagaccagagccaaggacgtgaaggccagactggccctgctggaggtgcaggaggagaccgccagaagagagaagcagcagctgctggacgtgcagagacaggtggccctgaagagcgaggaggccaccgccacccaccagcagctggaggaggcccagaaggagcacacccacctgctgcagagcaaccagcagctgagagagatcctggacgagctgcaggccagaaagctgaagctggagagccaggtggacctgctgcaggcccagagccagcagctgcagaagcacttcagcagcctggaggccgaggcccagaagaagcagcacctgctgagagaggtgaccgtggaggagaacaacgccagcccccacttcgagcccgacctgcacatcgaggacctgagaaagagcctgggcaccaaccagaccaaggaggtgagcagcagcctgagccagagcaaggaggacctgtacctggacagcctgagcagccacaacgtgtggcacctgctgagcgccgagggcgtggccctgagaagcgccaaggagttcctggtgcagcagaccagaagcatgagaagaagacagaccgccctgaaggccgcccagcagcactggagacacgagctggccagcgcccaggaggtggccaaggacccccccggcatcaaggccctggaggacatgagaaagaacctggagaaggagaccagacacctggacgagatgaagagcgccatgagaaagggccacaacctgctgaagaagaaggaggagaagctgaaccagctggagagcagcctgtgggaggaggccagcgacgagggcaccctgggcggcagccccaccaagaaggccgtgaccttcgacctgagcgacatggacagcctgagcagcgagagcagcgagagcttcagccccccccacagagagtggtggagacagcagagaatcgacagcacccccagcctgaccagcagaaagatccacggcctgagccacagcctgagacagatcagcagccagctgagcagcgtgctgagcatcctggacagcctgaacccccagagccccccccccctgctggccagcatgcccgcccagctgccccccagagaccccaagagcacccccacccccacctactacggcagcctggccagattcagcgccctgagcagcgccacccccaccagcacccagtgggcctgggacagcggccagggccccagactgcccagcagcgtggcccagaccgtggacgacttcctgctggagaagtggagaaagtacttccccagcggcatccccctgctgagcaacagccccacccccctggagagcagactgggctacatgagcgccagcgagcagctgagactgctgcagcacagccacagccaggtgcccgaggccggcagcaccaccttccagggcatcatcgaggccaacagaagatggctggagagagtgaagaacgaccccagactgcccctgttcagcagcacccccaagcccaaggccaccctgagcctgctgcagctgggcctggacgagcacaacagagtgaaggtgtacagattctag

SEQ ID NO: 9574 - DNA, 1881 bp, Artificial Sequence
  Description of Artificial Sequence: Synthetic coding sequence
atgatggccaacgacgccaagcccgacgtgaagaccgtgcaggtgctgagagacaccgccaacagactgagaatccacagcatcagagccacctgcgccagcggcagcggccagctgaccagctgctgcagcgccgccgaggtggtgagcgtgctgttcttccacaccatgaagtacaagcagaccgaccccgagcaccccgacaacgacagattcatcctgagcagaggccacgccgcccccatcctgtacgccgcctgggtggaggtgggcgacatcagcgagagcgacctgctgaacctgagaaagctgcacagcgacctggagagacaccccacccccagactgcccttcgtggacgtggccaccggcagcctgggccagggcctgggcaccgcctgcggcatggcctacaccggcaagtacctggacaaggccagctacagagtgttctgcctgatgggcgacggcgagagcagcgagggcagcgtgtgggaggccttcgccttcgccagccactacaacctggacaacctggtggccgtgttcgacgtgaacagactgggccagagcggccccgcccccctggagcacggcgccgacatctaccagaactgctgcgaggccttcggctggaacacctacctggtggacggccacgacgtggaggccctgtgccaggccttctggcaggccagccaggtgaagaacaagcccaccgccatcgtggccaagaccttcaagggcagaggcatccccaacatcgaggacgccgagaactggcacggcaagcccgtgcccaaggagagagccgacgccatcgtgaagctgatcgagagccagatccagaccaacgagaacctgatccccaagagccccgtggaggacagcccccagatcagcatcaccgacatcaagatgaccagcccccccgcctacaaggtgggcgacaagatcgccacccagaagacctacggcctggccctggccaagctgggcagagccaacgagagagtgatcgtgctgagcggcgacaccatgaacagcaccttcagcgagatcttcagaaaggagcaccccgagagattcatcgagtgcatcatcgccgagcagaacatggtgagcgtggccctgggctgcgccaccagaggcagaaccatcgccttcgccggcgccttcgccgccttcttcaccagagccttcgaccagctgagaatgggcgccatcagccaggccaacatcaacctgatcggcagccactgcggcgtgagcaccggcgaggacggcgtgagccagatggccctggaggacctggccatgttcagaagcatccccaactgcaccgtgttctaccccagcgacgccatcagcaccgagcacgccatctacctggccgccaacaccaagggcatgtgcttcatcagaaccagccagcccgagaccgccgtgatctacaccccccaggagaacttcgagatcggccaggccaaggtggtgagacacggcgtgaacgacaaggtgaccgtgatcggcgccggcgtgaccctgcacgaggccctggaggccgccgaccacctgagccagcagggcatcagcgtgagagtgatcgaccccttcaccatcaagcccctggacgccgccaccatcatcagcagcgccaaggccaccggcggcagagtgatcaccgtggaggaccactacagagagggcggcatcggcgaggccgtgtgcgccgccgtgagcagagagcccgacatcctggtgcaccagctggccgtgagcggcgtgccccagagaggcaagaccagcgagctgctggacatgttcggcatcagcaccagacacatcatcgccgccgtgaccctgaccctgatgaagtag

SEQ ID NO: 9575 - DNA, 999 bp, Artificial Sequence
  Description of Artificial Sequence: Synthetic coding sequence
atggccaccatcaagagcgagctgatcaagaacttcgccgaggaggaggccatccaccacaacaagatcagcatcgtgggcaccggcagcgtgggcgtggcctgcgccatcagcatcctgctgaagggcctgagcgacgagctggtgctggtggacgtggacgagggcaagctgaagggcgagaccatggacctgcagcacggcagccccttcatgaagatgcccaacatcgtgagcagcaaggactacctggtgaccgccaacagcaacctggtgatcatcaccgccggcgccagacagaagaagggcgagaccagactggacctggtgcagagaaacgtgagcatcttcaagctgatgatccccaacatcacccagtacagcccccactgcaagctgctgatcgtgaccaaccccgtggacatcctgacctacgtggcctggaagctgagcggcttccccaagaacagagtgatcggcagcggctgcaacctggacagcgccagattcagatacttcatcggccagagactgggcatccacagcgagagctgccacggcctgatcctgggcgagcacggcgacagcagcgtgcccgtgtggagcggcgtgaacatcgccggcgtgcccctgaaggacctgaaccccgacatcggcaccgacaaggaccccgagcagtgggagaacgtgcacaagaaggtgatcagcagcggctacgagatggtgaagatgaagggctacaccagctggggcatcagcctgagcgtggccgacctgaccgagagcatcctgaagaacctgagaagagtgcaccccgtgagcaccctgagcaagggcctgtacggcatcaacgaggacatcttcctgagcgtgccctgcatcctgggcgagaacggcatcaccgacctgatcaaggtgaagctgaccctggaggaggaggcctgcctgcagaagagcgccgagaccctgtgggagatccagaaggagctgaagctgtag

SEQ ID NO: 9576 - DNA, 972 bp, Artificial Sequence
  Description of Artificial Sequence: Synthetic coding sequence
atgcccgagatgcccgaggacatggagcaggaggaggtgaacatccccaacagaagagtgctggtgaccggcgccaccggcctgctgggcagagccgtgcacaaggagttccagcagaacaactggcacgccgtgggctgcggcttcagaagagccagacccaagttcgagcaggtgaacctgctggacagcaacgccgtgcaccacatcatccacgacttccagccccacgtgatcgtgcactgcgccgccgagagaagacccgacgtggtggagaaccagcccgacgccgccagccagctgaacgtggacgccagcggcaacctggccaaggaggccgccgccgtgggcgccttcctgatctacatcagcagcgactacgtgttcgacggcaccaaccccccctacagagaggaggacatccccgcccccctgaacctgtacggcaagaccaagctggacggcgagaaggccgtgctggagaacaacctgggcgccgccgtgctgagaatccccatcctgtacggcgaggtggagaagctggaggagagcgccgtgaccgtgatgttcgacaaggtgcagttcagcaacaagagcgccaacatggaccactggcagcagagattccccacccacgtgaaggacgtggccaccgtgtgcagacagctggccgagaagagaatgctggaccccagcatcaagggcaccttccactggagcggcaacgagcagatgaccaagtacgagatggcctgcgccatcgccgacgccttcaacctgcccagcagccacctgagacccatcaccgacagccccgtgctgggcgcccagagacccagaaacgcccagctggactgcagcaagctggagaccctgggcatcggccagagaacccccttcagaatcggcatcaaggagagcctgtggcccttcctgatcgacaagagatggagacagaccgtgttccactag

SEQ ID NO: 9577 - DNA, 3285 bp, Artificial Sequence
  Description of Artificial Sequence: Synthetic coding sequence
atggccgagagcagcagcgagagcgaccacttcagatgcagagacagactgagcccctgggccgccagaagcacccacagaggcaccagaagcctgcccaccgtggaggtgaccgagaaggtgaacaccatcaccagcaccctgcaggacaccagcagaaacctgagacaggtggaccagatgctgggcagatacagagagtacagcaacggccaggccggcgccatcgagcacctgaaggagagcctggagcagagcatcgaccagctgagaagccagagactgctgagaaacagcggcggcagaagcatcagcgtgaccagcctgagcgccagcgacctggacggcggcaccggcagcgagctgcaccacttcccccccaccagccccctgaaggactacggcgacccccagggcatcaagagaatgagaagcagaaccggcgtgagattcgtgcaggagaccgacgacatgacccagctgcacggcttccaccagagcctgagagacctgagcagcgagcagatcagactgggcgacgacttcaacagagagctgagcagaagaagcagaagcgacgccgagaccaagagagccctggaggagctgaccgagaagctgaacgaggcccagaagcaggaggtggtgagcgacagagtggagagaagactgcaggagctggagagagagatgagaaccgagagagagctggtggagagaagacaggaccagctgggcctgatgagcctgcagctgcaggaggccctgaagaagcaggaggccaaggccgacgagcacgagggcgccatcaagaacaagctgagacagaccgagaccgagaagaaccagctggagcaggagctggagctgagcagaagactgctgaaccagagcgagggcagcagagagaccctgctgcaccaggtggaggagctgagaacccagctgaccaaggccgagggcgacagaaagggcctgcagcaccaggtgagccagatcagcaagcagcagagcaactaccaggacgagcagggcgaggactggagattcagaagaggcgtggagagagagaagcaggacctggagaagcagatgagcgacctgagagtgcagctgaacttcagcgccatggccagcgagctggaggaggtgaagagatgcatggagagaaaggacaaggagaaggcccacctggccagccaggtggagaacctgaccagagagctggagaacggcgagaagcagcagctgcagatgctggacagactgaaggagatccagaaccacttcgacacctgcgaggccgagagaaagcacgccgacctgcagatcagcgagctgaccagacacgccgaggacgccaccaagcaggccgagagatacctgagcgagctgcagcagagcgaggccctgaaggaggaggccgagaagagaagagaggacctgaagctgaaggcccaggagagcatcagacagtggaagctgaagcacaagaagctggagagagccctggagaagcagagcgagaccgtggacgagctgaccggcaagaacaaccagatcctgaaggagaaggacgagctgaagacccagctgtacgccgccctgcagcagatcgagaacctgagaaaggagctgaacgacgtgctgaccaagagagccctgcaggaggaggagctgcacagcaaggaggagaagctgagagacatcaagagccaccaggccgacctggagctggaggtgaagaacagcctggacaccatccacagactggagagcgagctgaagaagcagagcaagatccagagccagatgaaggtggagaaggcccacctggaggaggagatcgccgagctgaagaagagccaggcccaggacaaggccaagctgctggagatgcaggagagcatcaaggacctgagcgccatcagagccgacctggccaacaagctggccgaggaggagagagccaagaaggccgtgctgaaggacctgagcgacctgaccgcccaggccaagagcagagacgaggagaccgccaccatcatcacccagctgaagctggagagagacgtgcaccagagagagctgaaggacctgaccagcagcctgcagagcgtgaagaccaagcacgagcagaacatccaggagctgatgaagcacttcaagaaggagaagagcgaggccgagaaccacatcagaaccctgaaggccgagagcctggaggagaagaacatggccaagatccacagaggccagctggagaagctgaagagccagtgcgacagactgaccgaggagctgacccagaacgagaacgagaacaagaagctgaagctgaagtaccagtgcctgaaggaccagctggaggagagagagaagcacatcagcatcgaggaggagcacctgagaagaatggaggaggccagactgcagctgaaggaccagctgctgtgcctggagaccgagcaggagagcatcctgggcgtgatcggcaaggagatcgacgccgcctgcaagaccttcagcaaggacagcgtggagaagctgaaggtgttcagcagcggccccgacatccactacgacccccacagatggctggccgagagcaagaccaagctgcagtggctgtgcgaggagctgaaggagagagagaacagagagaagaacctgagacaccagctgatgctgtgcagacagcagctgagaaacctgaccgagaacaaggagagcgagctgcagtgcctgttccagcagatcgagagacaggagcagctgctggacgagatccacagagagaagagagacctgctggaggagacccagagaaaggacgaggagatgggcagcctgcaggacagagtgatcgccctggagaccagcacccaggtggccctggaccacctggagagcgtgcccgagaagctgagcctgctggaggacttcaaggacttcagagacagctgcagcagcagcgagagaaccgacggcagatacagcaagtacagagtgagaagaaacagcctgcagcaccaccaggacgacaccaagtacagaaccaagagcttcaagggcgacagaaccttcctggagggcagccacaccagaggcctggaccacagcagcagctggcaggaccacagcagattcctgagcagccccagattcagctacgtgaacagcttcaccaagagaaccgtggcccccgacagcgccagcaacaaggaggacgccaccatgaacggcaccagcagccagcccaagaaggaggagtacggcagctag

SEQ ID NO: 9578 - DNA, 1011 bp, Artificial Sequence
  Description of Artificial Sequence: Synthetic coding sequence
atgaagaaggagcacgtgctgcactgccagttcagcgcctggtaccccttcttcagaggcgtgaccatcaagagcgtgatcctgcccctgccccagaacgtgaaggactacctgctggacgacggcaccctggtggtgagcggcagagacgacccccccacccacagccagcccgacagcgacgacgaggccgaggagatccagtggagcgacgacgagaacaccgccaccctgaccgcccccgagttccccgagttcgccaccaaggtgcaggaggccatcaacagcctgggcggcagcgtgttccccaagctgaactggagcgcccccagagacgcctactggatcgccatgaacagcagcctgaagtgcaagaccctgagcgacatcttcctgctgttcaagagcagcgacttcatcaccagagacttcacccagcccttcatccactgcaccgacgacagccccgacccctgcatcgagtacgagctggtgctgagaaagtggtgcgagctgatccccggcgccgagttcagatgcttcgtgaaggagaacaagctgatcggcatcagccagagagactacacccagtactacgaccacatcagcaagcagaaggaggagatcagaagatgcatccaggacttcttcaagaagcacatccagtacaagttcctggacgaggacttcgtgttcgacatctacagagacagcagaggcaaggtgtggctgatcgacttcaaccccttcggcgaggtgaccgacagcctgctgttcacctgggaggagctgatcagcgagaacaacctgaacggcgacttcagcgaggtggacgcccaggagcaggacagccccgccttcagatgcaccaacagcgaggtgaccgtgcagcccagcccctacctgagctacagactgcccaaggacttcgtggacctgagcaccggcgaggacgcccacaagctgatcgacttcctgaagctgaagagaaaccagcaggaggacgactag

SEQ ID NO: 9579 - DNA, 1248 bp, Artificial Sequence
  Description of Artificial Sequence: Synthetic coding sequence
atgaagctgagcctgaccaaggtggtgaacggctgcagactgggcaagatcaagaacctgggcaagaccggcgaccacaccatggacatccccggctgcctgctgtacaccaagaccggcagcgccccccacctgacccaccacaccctgcacaacatccacggcgtgcccgccatggcccagctgaccctgagcagcctggccgagcaccacgaggtgctgaccgagtacaaggagggcgtgggcaagttcatcggcatgcccgagagcctgctgtactgcagcctgcacgaccccgtgagcccctgccccgccggctacgtgaccaacaagagcgtgagcgtgtggagcgtggccggcagagtggagatgaccgtgagcaagttcatggccatccagaaggccctgcagcccgactggttccagtgcctgagcgacggcgaggtgagctgcaaggaggccaccagcatcaagagagtgagaaagagcgtggacagaagcctgctgttcctggacaactgcctgagactgcaggaggagagcgaggtgctgcagaagagcgtgatcatcggcgtgatcgagggcggcgacgtgatggaggagagactgagaagcgccagagagaccgccaagagacccgtgggcggcttcctgctggacggcttccagggcaaccccaccaccctggaggccagactgagactgctgagcagcgtgaccgccgagctgcccgaggacaagcccagactgatcagcggcgtgagcagacccgacgaggtgctggagtgcatcgagagaggcgtggacctgttcgagagcttcttcccctaccaggtgaccgagagaggctgcgccctgaccttcagcttcgactaccagcccaaccccgaggagaccctgctgcagcagaacggcacccaggaggagatcaagtgcatggaccagatcaagaagatcgagaccaccggctgcaaccaggagatcaccagcttcgagatcaacctgaaggagaagaagtaccaggaggacttcaaccccctggtgagaggctgcagctgctactgctgcaagaaccacaccagagcctacatccaccacctgctggtgaccaacgagctgctggccggcgtgctgctgatgatgcacaacttcgagcactacttcggcttcttccactacatcagagaggccctgaagagcgacaagctggcccagctgaaggagctgatccacagacaggccagctag

SEQ ID NO: 9580 - DNA, 1770 bp, Artificial Sequence
  Description of Artificial Sequence: Synthetic coding sequence
atgcccaccgtgagcgtgaagagagacctgctgttccaggccctgggcagaacctacaccgacgaggagttcgacgagctgtgcttcgagttcggcctggagctggacgagatcaccagcgagaaggagatcatcagcaaggagcagggcaacgtgaaggccgccggcgccagcgacgtggtgctgtacaagatcgacgtgcccgccaacagatacgacctgctgtgcctggagggcctggtgagaggcctgcaggtgttcaaggagagaatcaaggcccccgtgtacaagagagtgatgcccgacggcaagatccagaagctgatcatcaccgaggagaccgccaagatcagacccttcgccgtggccgccgtgctgagaaacatcaagttcaccaaggacagatacgacagcttcatcgagctgcaggagaagctgcaccagaacatctgcagaaagagagccctggtggccatcggcacccacgacctggacaccctgagcggccccttcacctacaccgccaagagacccagcgacatcaagttcaagcccctgaacaagaccaaggagtacaccgcctgcgagctgatgaacatctacaagaccgacaaccacctgaagcactacctgcacatcatcgagaacaagcccctgtaccccgtgatctacgacagcaacggcgtggtgctgagcatgccccccatcatcaacggcgaccacagcagaatcaccgtgaacaccagaaacatcttcatcgagtgcaccggcaccgacttcaccaaggccaagatcgtgctggacatcatcgtgaccatgttcagcgagtactgcgagaaccagttcaccgtggaggccgccgaggtggtgttccccaacggcaagagccacaccttccccgagctggcctacagaaaggagatggtgagagccgacctgatcaacaagaaggtgggcatcagagagacccccgagaacctggccaagctgctgaccagaatgtacctgaagagcgaggtgatcggcgacggcaaccagatcgagatcgagatcccccccaccagagccgacatcatccacgcctgcgacatcgtggaggacgccgccatcgcctacggctacaacaacatccagatgaccctgcccaagacctacaccatcgccaaccagttccccctgaacaagctgaccgagctgctgagacacgacatggccgccgccggcttcaccgaggccctgaccttcgccctgtgcagccaggaggacatcgccgacaagctgggcgtggacatcagcgccaccaaggccgtgcacatcagcaaccccaagaccgccgagttccaggtggccagaaccaccctgctgcccggcctgctgaagaccatcgccgccaacagaaagatgcccctgcccctgaagctgttcgagatcagcgacatcgtgatcaaggacagcaacaccgacgtgggcgccaagaactacagacacctgtgcgccgtgtactacaacaagaaccccggcttcgagatcatccacggcctgctggacagaatcatgcagctgctggacgtgccccccggcgaggacaagggcggctacgtgatcaaggccagcgagggccccgccttcttccccggcagatgcgccgagatcttcgccagaggccagagcgtgggcaagctgggcgtgctgcaccccgacgtgatcaccaagttcgagctgaccatgccctgcagcagcctggagatcaacgtgggccccttcctgtag

SEQ ID NO: 9581 - DNA, 477 bp, Artificial Sequence
  Description of Artificial Sequence: Synthetic coding sequence
atggccgcccagggcgtgggccccggccccggcagcgccgccccccccggcctggaggccgccagacagaagctggccctgagaagaaagaaggtgctgagcaccgaggagatggagctgtacgagctggcccaggccgccggcggcgccatcgaccccgacgtgttcaagatcctggtggacctgctgaagctgaacgtggcccccctggccgtgttccagatgctgaagagcatgtgcgccggccagagactggccagcgagccccaggaccccgccgccgtgagcctgcccaccagcagcgtgcccgagaccagaggcagaaacaagggcagcgccgccctgggcggcgccctggccctggccgagagaagcagcagagagggcagcagccagagaatgcccagacagcccagcgccaccagactgcccaagggcggcggccccggcaagagccccaccagaggcagcacctag

SEQ ID NO: 9582 - DNA, 675 bp, Artificial Sequence
  Description of Artificial Sequence: Synthetic coding sequence
atggtggaggacgagctggccctgttcgacaagagcatcaacgagttctggaacaagttcaagagcaccgacaccagctgccagatggccggcctgagagacacctacaaggacagcatcaaggccttcgccgagaagctgagcgtgaagctgaaggaggaggagagaatggtggagatgttcctggagtaccagaaccagatcagcagacagaacaagctgatccaggagaagaaggacaacctgctgaagctgatcgccgaggtgaagggcaagaagcaggagctggaggtgctgaccgccaacatccaggacctgaaggaggagtacagcagaaagaaggagaccatcagcaccgccaacaaggccaacgccgagagactgaagagactgcagaagagcgccgacctgtacaaggacagactgggcctggagatcagaaagatctacggcgagaagctgcagttcatcttcaccaacatcgaccccaagaaccccgagagccccttcatgttcagcctgcacctgaacgaggccagagactacgaggtgagcgacagcgccccccacctggagggcctggccgagttccaggagaacgtgagaaagaccaacaacttcagcgccttcctggccaacgtgagaaaggccttcaccgccaccgtgtacaactag

SEQ ID NO: 9583 - DNA, 1728 bp, Artificial Sequence
  Description of Artificial Sequence: Synthetic coding sequence
atgaagctgaccgacagcaccaagggctggatcgtgtgggccgccctggacagcagcatgagaggcatgagcctgagcgccggcagcagccccctgcacagccccaagatcaccccccacaccagccccgcccccagaagaagaagccacacccccaaccccgccagctacatggtgcccagcagcgccagcaccagcgtgaacaaccccgtgagccagacccccagcagcggccaggtgatccagaaggagaccgtgggcggcaccacctacttctacaccgacaccacccccgcccccctgaccggcatggtgttccccaactaccacatctacccccccaccgccccccacgtggcctacatgcagcccaaggccaacgcccccagcttcttcatggccgacgagctgagacaggagctgatcaacagacacctgatcaccatggcccagatcgaccaggccgacatgcccgccgtgcccaccgaggtggacagctaccacagcctgttccccctggagcccctgcccccccccaacagaatccagaagagcagcaacttcggctacatcaccagctgctacaaggccgtgaacagcaaggacgacctgccctactgcctgagaagaatccacggcttcagactggtgaacaccaagtgcatggtgctggtggacatgtggaagaagatccagcacagcaacatcgtgaccctgagagaggtgttcaccaccaaggccttcgccgagcccagcctggtgttcgcctacgacttccacgccggcggcgagaccatgatgagcagacacttcaacgaccccaacgccgacgcctacttcaccaagagaaagtggggccagcacgagggccccctgcccagacagcacgccggcctgctgcccgagagcctgatctgggcctacatcgtgcagctgagcagcgccctgagaaccatccacaccgccggcctggcctgcagagtgatggaccccaccaagatcctgatcaccggcaagaccagactgagagtgaactgcgtgggcgtgttcgacgtgctgaccttcgacaacagccagaacaacaaccccctggccctgatggcccagtaccagcaggccgacctgatcagcctgggcaaggtggtgctggccctggcctgcaacagcctggccggcatccagagagagaacctgcagaaggccatggagctggtgaccatcaactacagcagcgacctgaagaacctgatcctgtacctgctgaccgaccagaacagaatgagaagcgtgaacgacatcatgcccatgatcggcgccagattctacacccagctggacgccgcccagatgagaaacgacgtgatcgaggaggacctggccaaggaggtgcagaacggcagactgttcagactgctggccaagctgggcaccatcaacgagagacccgagttccagaaggaccccacctggagcgagaccggcgacagatacctgctgaagctgttcagagaccacctgttccaccaggtgaccgaggccggcgccccctggatcgacctgagccacatcatcagctgcctgaacaagctggacgccggcgtgcccgagaagatcagcctgatcagcagagacgagaagagcgtgctggtggtgacctacagcgacctgaagagatgcttcgagaacaccttccaggagctgatcgccgccgccaacggccagctgtag

SEQ ID NO: 9584 - DNA, 1785 bp, Artificial Sequence
  Description of Artificial Sequence: Synthetic coding sequence
atggagagcaaccacaagagcggcgacggcctgagcggcacccagaaggaggccgccctgagagccctggtgcagagaaccggctacagcctggtgcaggagaacggccagagaaagtacggcggccccccccccggctgggacgccgccccccccgagagaggctgcgagatcttcatcggcaagctgcccagagacctgttcgaggacgagctgatccccctgtgcgagaagatcggcaagatctacgagatgagaatgatgatggacttcaacggcaacaacagaggctacgccttcgtgaccttcagcaacaaggtggaggccaagaacgccatcaagcagctgaacaactacgagatcagaaacggcagactgctgggcgtgtgcgccagcgtggacaactgcagactgttcgtgggcggcatccccaagaccaagaagagagaggagatcctgagcgagatgaagaaggtgaccgagggcgtggtggacgtgatcgtgtaccccagcgccgccgacaagaccaagaacagaggcttcgccttcgtggagtacgagagccacagagccgccgccatggccagaagaaagctgctgcccggcagaatccagctgtggggccacggcatcgccgtggactgggccgagcccgaggtggaggtggacgaggacaccatgagcagcgtgaagatcctgtacgtgagaaacctgatgctgagcaccagcgaggagatgatcgagaaggagttcaacaacatcaagcccggcgccgtggagagagtgaagaagatcagagactacgccttcgtgcacttcagcaacagagaggacgccgtggaggccatgaaggccctgaacggcaaggtgctggacggcagccccatcgaggtgaccctggccaagcccgtggacaaggacagctacgtgagatacaccagaggcaccggcggcagaggcaccatgctgcagggcgagtacacctacagcctgggccaggtgtacgaccccaccaccacctacctgggcgcccccgtgttctacgccccccagacctacgccgccatccccagcctgcacttccccgccaccaagggccacctgagcaacagagccatcatcagagcccccagcgtgagagagatctacatgaacgtgcccgtgggcgccgccggcgtgagaggcctgggcggcagaggctacctggcctacaccggcctgggcagaggctaccaggtgaagggcgacaagagagaggacaagctgtacgacatcctgcccggcatggagctgacccccatgaaccccgtgaccctgaagccccagggcatcaagctggccccccagatcctggaggagatctgccagaagaacaactggggccagcccgtgtaccagctgcacagcgccatcggccaggaccagagacagctgttcctgtacaagatcaccatccccgccctggccagccagaaccccgccatccaccccttcaccccccccaagctgagcgccttcgtggacgaggccaagacctacgccgccgagtacaccctgcagaccctgggcatccccaccgacggcggcgacggcaccatggccaccgccgccgccgccgccaccgccttccccggctacgccgtgcccaacgccaccgcccccgtgagcgccgcccagctgaagcaggccgtgaccctgggccaggacctggccgcctacaccacctacgaggtgtaccccaccttcgccgtgaccgccagaggcgacggctacggcaccttctag

SEQ ID NO: 9585 - DNA, 1167 bp, Artificial Sequence
  Description of Artificial Sequence: Synthetic coding sequence
atgctggagggcagctggatcaacagaagagaggacaagctgggcgtgtacagcctggtgcacttcagccccaagatgctgggcagcgtggccaccaccctgcccctgagcagcagcaacagcagcggcatgcccctgggctactacctgagcagcccccagatcagcagagtgaccatcagcaccaccggccagctgaccagcaaggccaccgtgggcagctgcagcagagtggagaacagcctggacgccagccccttcagcgtgcccaagaagcaggacgagagccccatgatcggcgacggcgaggactacttcctgagcctgttcggcgacagcaagaagctgaccgcccacagcaactacacccagaagaccctgaagtacttcagcatgatcctggaggaggtgggccagttcaccagcagcagcctgggcgacgtggagatcgccgaggtgaacgtgaagggcctgttcgtgaagctgatcaacagcagcctggacaaggagatggccatcggcgaccacatcctgcagcagaacgtgaacggccagaccatcagcctgtacagattcctgcccaacatcgtgatgcaggccaacagcaccgtgaccgtgtgggccgccgccagcgaggccaagcaccagccccccagcgacttcctgtggaaggagcaggacaagttcagagccagccccgactgcatcaccatcctgtgcaagcccaacggccaggccatcgcctggtacacccccatccactggaagcaggcctgggagaagctggacgccgacgtggagttcaacagatgcagcgtggtgagccccaccttcagaaagagagtgttccagtggaccgccagcaccgccaccatcaccaaggagaagcaggaccagcccaagaaggacatcagcaactaccaggtggagcaggcccaggtgctgctgaagagagagaaggagatcccccccaccgtgttccccaacagaagcccctggtgccagaacccctacgtgagcgcccacccctactgccccctgatcgagccccacaacaccagcaccgccggcggcagactggacagacagcccagaaccagaagcaccagacccaacagagccagcggcagcaagaagaagaagaccagcgagagccagaagcagtag

SEQ ID NO: 9586 - DNA, 744 bp, Artificial Sequence
  Description of Artificial Sequence: Synthetic coding sequence
atggaggagcagccccagatgcaggacgccgacgagcccgccgacagcggcggcgagggcagagccggcggccccccccaggtggccggcgcccaggccgcctgcagcgaggacagaatgaccctgctgctgagactgagagcccagaccaagcagcagctgctggagtacaagagcatggtggacgccagcgaggagaagacccccgagcagatcatgcaggagaagcagatcgaggccaagatcgaggacctggagaacgagatcgaggaggtgaaggtggccttcgagatcaagaagctggccctggacagaatgagactgagcaccgccctgaagaagaacctggagaagatcagcagacagagcagcgtgctgatggacaacatgaagcacctgctggagctgaacaagctgatcatgaagagccagcaggagagctgggacctggaggagaagctgctggacatcagaaagaagagactgcagctgaagcaggccagcgagagcaagctgctggagatccagaccgagaagaacaagcagaagatcgacctggacagcatggagaacagcgagagaatcaagatcatcagacagaacctgcagatggagatcaagatcaccaccgtgatccagcacgtgttccagaacctgatcctgggcagcaaggtgaactgggccgaggaccccgccctgaaggagatcgtgctgcagctggagaagaacgtggacatgatgtag

SEQ ID NO: 9587 - DNA, 1458 bp, Artificial Sequence
  Description of Artificial Sequence: Synthetic coding sequence
atggagttcctgggcaccacccagaccgccagctactgcggccccaagaagtgctgcggcctgaccagcctgcccgccgtgcaggcccccgtgatccaggagtgctaccagccctactacctgcccggctacagatacctgaacagctggagacccagcctgttctacaagatcgccaacgtgcagacctgccccgacgagagcaccagcaccctgagaccccccaccatcctgcccaccctgagaagcgccctgttcagcagatacagcccccacgactgggaccagagcaaccagctgcaggtgagaggcgccgaggccagcagactgtgggccagcagactgaccgacgacagcatgagactgctgcaggacaaggaccagctgacccaccagatgcaggagggcacctgcagaaacctgggccagagactgagcgacatcggcttctggaagagcgagctgagctacgagctggacagactgctgaccgagaaccagaacctggagaccgtgaagagaagactggagtgcgccgccaacgaggtgaactgccccctgcaggtggccctggagtgcctgtaccacagagagaagagaatcggcatcgacctggtgcacgacaacgtggagaagaacctgatcagagaggtggacctgctgaagtgctgccaggagcagatgagaaagctggcccagagaatcgacatccagatgagagacaacagagacgcccagcacgtgctggagagagacctggaggacaagagcagcgcccagtgcatcgacgagaagtgcttcaacctgagaaacaccagcgactgcatcagcttcttccacggcatggagaagatcgacggcaccatcagcgtgcccgagacctgggccaagttcagcaacgacaacatcaagcacagccagaacatgagagccaacagcatccagctgagagaggaggccgagcacctgttcgagaccctgagcgaccagatgtggagacagttcaccgacaccaacctggccttcaacgccagaatcagcgaggtgaccgacgtgaagaacaagctgcagacccagctggccaagaccctgcaggagatcttccaggccgagaacaccatcatgctgctggagagaagcatcatggccaaggagggccccctgaaggtggcccagaccagactggagtgcagaaccagaagacccaacatggagctgtgcagagacatcccccagctgaagctggtgaacgaggtgttcaccatcgacgacaccctgcagaccctgaagctgagactgagagagacccaggacaccctgcagctgctggtgatgaccaagtgcagactggagcacgagctggccatcaaggccaacaccctgtgcatcgacaaggagaagtgcatgggcatgagaaagaccttcccctgcacccccagactggtgggccacacctag

SEQ ID NO: 9588 - DNA, 837 bp, Artificial Sequence
  Description of Artificial Sequence: Synthetic coding sequence
atgggcaagagcagcgagtggtgcgagagaatcgccggcatccagaagttcgtgctggagaagtggaccaagaaggccaagcccgaggacaccctgaacctgtgccagctgctgaacaacgacctggccagcaccgtggtgagctaccccagaagattcgtgggcctgggcaccctgcccatgcaggcccccgagctggccgtgaaggagatggagagatgcgtgaaggagctgggcttccccggcgtgcagatcggcacccacgtgaacgagtgggacctgaacgcccaggagctgttccccgtgtacgccgccgccgagagactgaagtgcagcctgttcgtgcacccctgggacatgcagatggacggcagaatggccaagtactggctgccctggctggtgggcatgcccgccgagaccaccatcgccatctgcagcatgatcatgggcggcgtgttcgagaagttccccaagctgaaggtgtgcttcgcccacggcggcggcgccttccccttcaccgtgggcagaatcagccacggcttcagcatgagacccgacctgtgcgcccaggacaaccccatgaaccccaagaagtacctgggcagcttctacaccgacgccctggtgcacgaccccctgagcctgaagctgctgaccgacgtgatcggcaaggacaaggtgatcctgggcaccgactaccccttccccctgggcgagctggagcccggcaagctgatcgagagcatggaggagttcgacgaggagaccaagaacaagctgaaggccggcaacgccctggccttcctgggcctggagagaaagcagttcgagtag

SEQ ID NO: 9589 - DNA, 2478 bp, Artificial Sequence
  Description of Artificial Sequence: Synthetic coding sequence
atgagcagcagccccgtgaacgtgaagaagctgaaggtgagcgagctgaaggaggagctgaagaagagaagactgagcgacaagggcctgaaggccgagctgatggagagactgcaggccgccctggacgacgaggaggccggcggcagacccgccatggagcccggcaacggcagcctggacctgggcggcgacagcgccggcagaagcggcgccggcctggagcaggaggccgccgccggcggcgacgaggaggaggaggaggaggaggaggaggaggagggcatcagcgccctggacggcgaccagatggagctgggcgaggagaacggcgccgccggcgccgccgacagcggccccatggaggaggaggaggccgccagcgaggacgagaacggcgacgaccagggcttccaggagggcgaggacgagctgggcgacgaggaggagggcgccggcgacgagaacggccacggcgagcagcagccccagccccccgccacccagcagcagcagccccagcagcagagaggcgccgccaaggaggccgccggcaagagcagcggccccaccagcctgttcgccgtgaccgtggccccccccggcgccagacagggccagcagcaggccggcggcaagaagaaggccgagggcggcggcggcggcggcagacccggcgcccccgccgccggcgacggcaagaccgagcagaagggcggcgacaagaagagaggcgtgaagagacccagagaggaccacggcagaggctacttcgagtacatcgaggagaacaagtacagcagagccaagagcccccagccccccgtggaggaggaggacgagcacttcgacgacaccgtggtgtgcctggacacctacaactgcgacctgcacttcaagatcagcagagacagactgagcgccagcagcctgaccatggagagcttcgccttcctgtgggccggcggcagagccagctacggcgtgagcaagggcaaggtgtgcttcgagatgaaggtgaccgagaagatccccgtgagacacctgtacaccaaggacatcgacatccacgaggtgagaatcggctggagcctgaccaccagcggcatgctgctgggcgaggaggagttcagctacggctacagcctgaagggcatcaagacctgcaactgcgagaccgaggactacggcgagaagttcgacgagaacgacgtgatcacctgcttcgccaacttcgagagcgacgaggtggagctgagctacgccaagaacggccaggacctgggcgtggccttcaagatcagcaaggaggtgctggccggcagacccctgttcccccacgtgctgtgccacaactgcgccgtggagttcaacttcggccagaaggagaagccctacttccccatccccgaggagtacaccttcatccagaacgtgcccctggaggacagagtgagaggccccaagggccccgaggagaagaaggactgcgaggtggtgatgatgatcggcctgcccggcgccggcaagaccacctgggtgaccaagcacgccgccgagaaccccggcaagtacaacatcctgggcaccaacaccatcatggacaagatgatggtggccggcttcaagaagcagatggccgacaccggcaagctgaacaccctgctgcagagagccccccagtgcctgggcaagttcatcgagatcgccgccagaaagaagagaaacttcatcctggaccagaccaacgtgagcgccgccgcccagagaagaaagatgtgcctgttcgccggcttccagagaaaggccgtggtggtgtgccccaaggacgaggactacaagcagagaacccagaagaaggccgaggtggagggcaaggacctgcccgagcacgccgtgctgaagatgaagggcaacttcaccctgcccgaggtggccgagtgcttcgacgagatcacctacgtggagctgcagaaggaggaggcccagaagctgctggagcagtacaaggaggagagcaagaaggccctgccccccgagaagaagcagaacaccggcagcaagaagagcaacaagaacaagagcggcaagaaccagttcaacagaggcggcggccacagaggcagaggcggcttcaacatgagaggcggcaacttcagaggcggcgcccccggcaacagaggcggctacaacagaagaggcaacatgccccagagaggcggcggcggcggcggcagcggcggcatcggctacccctaccccagagcccccgtgttccccggcagaggcagctacagcaacagaggcaactacaacagaggcggcatgcccaacagaggcaactacaaccagaacttcagaggcagaggcaacaacagaggctacaagaaccagagccagggctacaaccagtggcagcagggccagttctggggccagaagccctggagccagcactaccaccagggctactactag

SEQ ID NO: 9590 - DNA, 945 bp, Artificial Sequence
  Description of Artificial Sequence: Synthetic coding sequence
atgcagaacgtgatcaacaccgtgaagggcaaggccctggaggtggccgagtacctgacccccgtgctgaaggagagcaagttcaaggagaccggcgtgatcacccccgaggagttcgtggccgccggcgaccacctggtgcaccactgccccacctggcagtgggccaccggcgaggagctgaaggtgaaggcctacctgcccaccggcaagcagttcctggtgaccaagaacgtgccctgctacaagagatgcaagcagatggagtacagcgacgagctggaggccatcatcgaggaggacgacggcgacggcggctgggtggacacctaccacaacaccggcatcaccggcatcaccgaggccgtgaaggagatcaccctggagaacaaggacaacatcagactgcaggactgcagcgccctgtgcgaggaggaggaggacgaggacgagggcgaggccgccgacatggaggagtacgaggagagcggcctgctggagaccgacgaggccaccctggacaccagaaagatcgtggaggcctgcaaggccaagaccgacgccggcggcgaggacgccatcctgcagaccagaacctacgacctgtacatcacctacgacaagtactaccagacccccagactgtggctgttcggctacgacgagcagagacagcccctgaccgtggagcacatgtacgaggacatcagccaggaccacgtgaagaagaccgtgaccatcgagaaccacccccacctgccccccccccccatgtgcagcgtgcacccctgcagacacgccgaggtgatgaagaagatcatcgagaccgtggccgagggcggcggcgagctgggcgtgcacatgtacctgctgatcttcctgaagttcgtgcaggccgtgatccccaccatcgagtacgactacaccagacacttcaccatgtag

SEQ ID NO: 9591 - DNA, 900 bp, Artificial Sequence
  Description of Artificial Sequence: Synthetic coding sequence
atggtggacaagaagctggtggtggtgttcggcggcaccggcgcccagggcggcagcgtggccagaaccctgctggaggacggcaccttcaaggtgagagtggtgaccagaaaccccagaaagaaggccgccaaggagctgagactgcagggcgccgaggtggtgcagggcgaccaggacgaccaggtgatcatggagctggccctgaacggcgcctacgccaccttcatcgtgaccaactactgggagagctgcagccaggagcaggaggtgaagcagggcaagctgctggccgacctggccagaagactgggcctgcactacgtggtgtacagcggcctggagaacatcaagaagctgaccgccggcagactggccgccgcccacttcgacggcaagggcgaggtggaggagtacttcagagacatcggcgtgcccatgaccagcgtgagactgccctgctacttcgagaacctgctgagccacttcctgccccagaaggcccccgacggcaagagctacctgctgagcctgcccaccggcgacgtgcccatggacggcatgagcgtgagcgacctgggccccgtggtgctgagcctgctgaagatgcccgagaagtacgtgggccagaacatcggcctgagcacctgcagacacaccgccgaggagtacgccgccctgctgaccaagcacaccagaaaggtggtgcacgacgccaagatgacccccgaggactacgagaagctgggcttccccggcgccagagacctggccaacatgttcagattctacgccctgagacccgacagagacatcgagctgaccctgagactgaaccccaaggccctgaccctggaccagtggctggagcagcacaagggcgacttcaacctgctgtag

SEQ ID NO: 9592 - DNA, 2571 bp, Artificial Sequence
  Description of Artificial Sequence: Synthetic coding sequence
atggacatcagcaagggcctgcccggcatgcagggcggcctgcacatctggatcagcgagaacagaaagatggtgcccgtgcccgagggcgcctacggcaacttcttcgaggagcactgctacgtgatcctgcacgtgccccagagccccaaggccacccagggcgccagcagcgacctgcactactgggtgggcaagcaggccggcgccgaggcccagggcgccgccgaggccttccagcagagactgcaggacgagctgggcggccagaccgtgctgcacagagaggcccagggccacgagagcgactgcttctgcagctacttcagacccggcatcatctacagaaagggcggcctggccagcgacctgaagcacgtggagaccaacctgttcaacatccagagactgctgcacatcaagggcagaaagcacgtgagcgccaccgaggtggagctgagctggaacagcttcaacaagggcgacatcttcctgctggacctgggcaagatgatgatccagtggaacggccccaagaccagcatcagcgagaaggccagaggcctggccctgacctacagcctgagagacagagagagaggcggcggcagagcccagatcggcgtggtggacgacgaggccaaggcccccgacctgatgcagatcatggaggccgtgctgggcagaagagtgggcagcctgagagccgccacccccagcaaggacatcaaccagctgcagaaggccaacgtgagactgtaccacgtgtacgagaagggcaaggacctggtggtgctggagctggccaccccccccctgacccaggacctgctgcaggaggaggacttctacatcctggaccagggcggcttcaagatctacgtgtggcagggcagaatgagcagcctgcaggagagaaaggccgccttcagcagagccgtgggcttcatccaggccaagggctaccccacctacaccaacgtggaggtggtgaacgacggcgccgagagcgccgccttcaagcagctgttcagaacctggagcgagaagagaagaagaaaccagaagctgggcggcagagacaagagcatccacgtgaagctggacgtgggcaagctgcacacccagcccaagctggccgcccagctgagaatggtggacgacggcagcggcaaggtggaggtgtggtgcatccaggacctgcacagacagcccgtggaccccaagagacacggccagctgtgcgccggcaactgctacctggtgctgtacacctaccagagactgggcagagtgcagtacatcctgtacctgtggcagggccaccaggccaccgccgacgagatcgaggccctgaacagcaacgccgaggagctggacgtgatgtacggcggcgtgctggtgcaggagcacgtgaccatgggcagcgagcccccccacttcctggccatcttccagggccagctggtgatcttccaggagagagccggccaccacggcaagggccagagcgccagcaccaccagactgttccaggtgcagggcaccgacagccacaacaccagaaccatggaggtgcccgccagagccagcagcctgaacagcagcgacatcttcctgctggtgaccgccagcgtgtgctacctgtggttcggcaagggctgcaacggcgaccagagagagatggccagagtggtggtgaccgtgatcagcagaaagaacgaggagaccgtgctggagggccaggagcccccccacttctgggaggccctgggcggcagagccccctaccccagcaacaagagactgcccgaggaggtgcccagcttccagcccagactgttcgagtgcagcagccacatgggctgcctggtgctggccgaggtgggcttcttcagccaggaggacctggacaagtacgacatcatgctgctggacacctggcaggagatcttcctgtggctgggcgaggccgccagcgagtggaaggaggccgtggcctggggccaggagtacctgaagacccaccccgccggcagaagccccgccacccccatcgtgctggtgaagcagggccacgagccccccaccttcatcggctggttcttcacctgggacccctacaagtggaccagccaccccagccacaaggaggtggtggacggcagccccgccgccgccagcaccatcagcgagatcaccgccgaggtgaacaacctgagactgagcagatggcccggcaacggcagagccggcgccgtggccctgcaggccctgaagggcagccaggacagcagcgagaacgacctggtgagaagccccaagagcgccggcagcagaaccagcagcagcgtgagcagcaccagcgccaccatcaacggcggcctgagaagagagcagctgatgcaccaggccgtggaggacctgcccgagggcgtggaccccgccagaagagagttctacctgagcgacagcgacttccaggacatcttcggcaagagcaaggaggagttctacagcatggccacctggagacagagacaggagaagaagcagctgggcttcttctag

SEQ ID NO: 9593 - DNA, 987 bp, Artificial Sequence
  Description of Artificial Sequence: Synthetic coding sequence
atggaggccaacggcagccagggcaccagcggcagcgccaacgacagccagcacgaccccggcaagatgttcatcggcggcctgagctggcagaccagccccgacagcctgagagactacttcagcaagttcggcgagatcagagagtgcatggtgatgagagaccccaccaccaagagaagcagaggcttcggcttcgtgaccttcgccgaccccgccagcgtggacaaggtgctgggccagccccaccacgagctggacagcaagaccatcgaccccaaggtggccttccccagaagagcccagcccaagatggtgaccagaaccaagaagatcttcgtgggcggcctgagcgccaacaccgtggtggaggacgtgaagcagtacttcgagcagttcggcaaggtggaggacgccatgctgatgttcgacaagaccaccaacagacacagaggcttcggcttcgtgaccttcgagaacgaggacgtggtggagaaggtgtgcgagatccacttccacgagatcaacaacaagatggtggagtgcaagaaggcccagcccaaggaggtgatgttcccccccggcaccagaggcagagccagaggcctgccctacaccatggacgccttcatgctgggcatgggcatgctgggctaccccaacttcgtggccacctacggcagaggctaccccggcttcgcccccagctacggctaccagttccccggcttccccgccgccgcctacggccccgtggccgccgccgccgtggccgccgccagaggcagcggcagcaaccccgccagacccggcggcttccccggcgccaacagccccggccccgtggccgacctgtacggccccgccagccaggacagcggcgtgggcaactacatcagcgccgccagcccccagcccggcagcggcttcggccacggcatcgccggccccctgatcgccaccgccttcaccaacggctaccactag

SEQ ID NO: 9594 - DNA, 654 bp, Artificial Sequence
  Description of Artificial Sequence: Synthetic coding sequence
atggagagcgtggccctgtacagcttccaggccaccgagagcgacgagctggccttcaacaagggcgacaccctgaagatcctgaacatggaggacgaccagaactggtacaaggccgagctgagaggcgtggagggcttcatccccaagaactacatcagagtgaagccccacccctggtacagcggcagaatcagcagacagctggccgaggagatcctgatgaagagaaaccacctgggcgccttcctgatcagagagagcgagagcagccccggcgagttcagcgtgagcgtgaactacggcgaccaggtgcagcacttcaaggtgctgagagaggccagcggcaagtacttcctgtgggaggagaagttcaacagcctgaacgagctggtggacttctacagaaccaccaccatcgccaagaagagacagatcttcctgagagacgaggagcccctgctgaagagccccggcgcctgcttcgcccaggcccagttcgacttcagcgcccaggaccccagccagctgagcttcagaagaggcgacatcatcgaggtgctggagagacccgacccccactggtggagaggcagaagctgcggcagagtgggcttcttccccagaagctacgtgcagcccgtgcacctgtag

SEQ ID NO: 9595 - DNA, 231 bp, Artificial Sequence
  Description of Artificial Sequence: Synthetic coding sequence
atgggcctgaagatgagctgcctgaagggcttccagatgtgcgtgagcagcagcagcagcagccacgacgaggcccccgtgctgaacgacaagcacctggacgtgcccgacatcatcatcaccccccccacccccaccggcatgatgctgcccagagacctgggcagcaccgtgtggctggacgagaccggcagctgccccgacgacggcgagatcgaccccgaggcctag

SEQ ID NO: 9596 - DNA, 19863 bp, Artificial Sequence
  Description of Artificial Sequence: Synthetic coding sequence
atggaccagccccagttcagcggcgcccccagattcctgaccagacccaaggccttcgtggtgagcgtgggcaaggacgccaccctgagctgccagatcgtgggcaaccccaccccccaggtgagctgggagaaggaccagcagcccgtggccgccggcgccagattcagactggcccaggacggcgacctgtacagactgaccatcctggacctggccctgggcgacagcggccagtacgtgtgcagagccagaaacgccatcggcgaggccttcgccgccgtgggcctgcaggtggacgccgaggccgcctgcgccgagcaggccccccacttcctgctgagacccaccagcatcagagtgagagagggcagcgaggccaccttcagatgcagagtgggcggcagccccagacccgccgtgagctggagcaaggacggcagaagactgggcgagcccgacggccccagagtgagagtggaggagctgggcgaggccagcgccctgagaatcagagccgccagacccagagacggcggcacctacgaggtgagagccgagaaccccctgggcgccgccagcgccgccgccgccctggtggtggacagcgacgccgccgacaccgccagcagacccggcaccagcaccgccgccctgctggcccacctgcagagaagaagagaggccatgagagccgagggcgcccccgccagcccccccagcaccggcaccagaacctgcaccgtgaccgagggcaagcacgccagactgagctgctacgtgaccggcgagcccaagcccgagaccgtgtggaagaaggacggccagctggtgaccgagggcagaagacacgtggtgtacgaggacgcccaggagaacttcgtgctgaagatcctgttctgcaagcagagcgacagaggcctgtacacctgcaccgccagcaacctggtgggccagacctacagcagcgtgctggtggtggtgagagagcccgccgtgcccttcaagaagagactgcaggacctggaggtgagagagaaggagagcgccaccttcctgtgcgaggtgccccagcccagcaccgaggccgcctggttcaaggaggagaccagactgtgggccagcgccaagtacggcatcgaggaggagggcaccgagagaagactgaccgtgagaaacgtgagcgccgacgacgacgccgtgtacatctgcgagacccccgagggcagcagaaccgtggccgagctggccgtgcagggcaacctgctgagaaagctgcccagaaagaccgccgtgagagtgggcgacaccgccatgttctgcgtggagctggccgtgcccgtgggccccgtgcactggctgagaaaccaggaggaggtggtggccggcggcagagtggccatcagcgccgagggcaccagacacaccctgaccatcagccagtgctgcctggaggacgtgggccaggtggccttcatggccggcgactgccagaccagcacccagttctgcgtgagcgcccccagaaagccccccctgcagccccccgtggaccccgtggtgaaggccagaatggagagcagcgtgatcctgagctggagcccccccccccacggcgagagacccgtgaccatcgacggctacctggtggagaagaagaagctgggcacctacacctggatcagatgccacgaggccgagtgggtggccacccccgagctgaccgtggccgacgtggccgaggagggcaacttccagttcagagtgagcgccctgaacagcttcggccagagcccctacctggagttccccggcaccgtgcacctggcccccaagctggccgtgagaacccccctgaaggccgtgcaggccgtggagggcggcgaggtgaccttcagcgtggacctgaccgtggccagcgccggcgagtggttcctggacggccaggccctgaaggccagcagcgtgtacgagatccactgcgacagaaccagacacaccctgaccatcagagaggtgcccgccagcctgcacggcgcccagctgaagttcgtggccaacggcatcgagagcagcatcagaatggaggtgagagccgcccccggcctgaccgccaacaagccccccgccgccgccgccagagaggtgctggccagactgcacgaggaggcccagctgctggccgagctgagcgaccaggccgccgccgtgacctggctgaaggacggcagaaccctgagccccggccccaagtacgaggtgcaggccagcgccggcagaagagtgctgctggtgagagacgtggccagagacgacgccggcctgtacgagtgcgtgagcagaggcggcagaatcgcctaccagctgagcgtgcagggcctggccagattcctgcacaaggacatggccggcagctgcgtggacgccgtggccggcggccccgcccagttcgagtgcgagaccagcgaggcccacgtgcacgtgcactggtacaaggacggcatggagctgggccacagcggcgagagattcctgcaggaggacgtgggcaccagacacagactggtggccgccaccgtgaccagacaggacgagggcacctacagctgcagagtgggcgaggacagcgtggacttcagactgagagtgagcgagcccaaggtggtgttcgccaaggagcagctggccagaagaaagctgcaggccgaggccggcgccagcgccaccctgagctgcgaggtggcccaggcccagaccgaggtgacctggtacaaggacggcaagaagctgagcagcagcagcaaggtgtgcatggaggccaccggctgcaccagaagactggtggtgcagcaggccggccaggccgacgccggcgagtacagctgcgaggccggcggccagagactgagcttccacctggacgtgaaggagcccaaggtggtgttcgccaaggaccaggtggcccacagcgaggtgcaggccgaggccggcgccagcgccaccctgagctgcgaggtggcccaggcccagaccgaggtgatgtggtacaaggacggcaagaagctgagcagcagcctgaaggtgcacgtggaggccaagggctgcagaagaagactggtggtgcagcaggccggcaagaccgacgccggcgactacagctgcgaggccagaggccagagagtgagcttcagactgcacatcaccgagcccaagatgatgttcgccaaggagcagagcgtgcacaacgaggtgcaggccgaggccggcgccagcgccatgctgagctgcgaggtggcccaggcccagaccgaggtgacctggtacaaggacggcaagaagctgagcagcagcagcaaggtgggcatggaggtgaagggctgcaccagaagactggtgctgccccaggccggcaaggccgacgccggcgagtacagctgcgaggccggcggccagagagtgagcttccacctgcacatcaccgagcccaagggcgtgttcgccaaggagcagagcgtgcacaacgaggtgcaggccgaggccggcaccaccgccatgctgagctgcgaggtggcccagccccagaccgaggtgacctggtacaaggacggcaagaagctgagcagcagcagcaaggtgagaatggaggtgaagggctgcaccagaagactggtggtgcagcaggtgggcaaggccgacgccggcgagtacagctgcgaggccggcggccagagagtgagcttccagctgcacatcaccgagcccaaggccgtgttcgccaaggagcagctggtgcacaacgaggtgagaaccgaggccggcgccagcgccaccctgagctgcgaggtggcccaggcccagaccgaggtgacctggtacaaggacggcaagaagctgagcagcagcagcaaggtgagaatcgaggccgccggctgcatgagacagctggtggtgcagcaggccggccaggccgacgccggcgagtacacctgcgaggccggcggccagagactgagcttccacctggacgtgagcgagcccaaggccgtgttcgccaaggagcagctggcccacagaaaggtgcaggccgaggccggcgccatcgccaccctgagctgcgaggtggcccaggcccagaccgaggtgacctggtacaaggacggcaagaagctgagcagcagcagcaaggtgagaatggaggccgtgggctgcaccagaagactggtggtgcagcaggcctgccaggccgacaccggcgagtacagctgcgaggccggcggccagagactgagcttcagcctggacgtggccgagcccaaggtggtgttcgccaaggagcagcccgtgcacagagaggtgcaggcccaggccggcgccagcaccaccctgagctgcgaggtggcccaggcccagaccgaggtgatgtggtacaaggacggcaagaagctgagcttcagcagcaaggtgagaatggaggccgtgggctgcaccagaagactggtggtgcagcaggccggccaggccgtggccggcgagtacagctgcgaggccggcagccagagactgagcttccacctgcacgtggccgagcccaaggccgtgttcgccaaggagcagcccgccagcagagaggtgcaggccgaggccggcaccagcgccaccctgagctgcgaggtggcccaggcccagaccgaggtgacctggtacaaggacggcaagaagctgagcagcagcagcaaggtgagaatggaggccgtgggctgcaccagaagactggtggtgcaggaggccggccaggccgacgccggcgagtacagctgcaaggccggcgaccagagactgagcttccacctgcacgtggccgagcccaaggtggtgttcgccaaggagcagcccgcccacagagaggtgcaggccgaggccggcgccagcgccaccctgagctgcgaggtggcccaggcccagaccgaggtgacctggtacaaggacggcaagaagctgagcagcagcagcaaggtgagagtggaggccgtgggctgcaccagaagactggtggtgcagcaggccggccaggccgaggccggcgagtacagctgcgaggccggcggccagcagctgagcttcagactgcaggtggccgagctggagccccagatcagcgagagaccctgcagaagagagcccctggtggtgaaggagcacgaggacatcatcctgaccgccaccctggccacccccagcgccgccaccgtgacctggctgaaggacggcgtggagatcagaagaagcaagagacacgagaccgccagccagggcgacacccacaccctgaccgtgcacggcgcccaggtgctggacagcgccatctacagctgcagagtgggcgccgagggccaggacttccccgtgcaggtggaggaggtggccgccaagttctgcagactgctggagcccgtgtgcggcgagctgggcggcaccgtgaccctggcctgcgagctgagccccgcctgcgccgaggtggtgtggagatgcggcaacacccagctgagagtgggcaagagattccagatggtggccgagggccccgtgagaagcctgaccgtgctgggcctgagagccgaggacgccggcgagtacgtgtgcgagagcagagacgaccacaccagcgcccagctgaccgtgagcgtgcccagagtggtgaagttcatgagcggcctgagcaccgtggtggccgaggagggcggcgaggccaccttccagtgcgtggtgagccccagcgacgtggccgtggtgtggttcagagacggcgccctgctgcagcccagcgagaagttcgccatcagccagagcggcgccagccacagcctgaccatcagcgacctggtgctggaggacgccggccagatcaccgtggaggccgagggcgccagcagcagcgccgccctgagagtgagagaggcccccgtgctgttcaagaagaagctggagccccagaccgtggaggagagaagcagcgtgaccctggaggtggagctgaccagaccctggcccgagctgagatggaccagaaacgccaccgccctggcccccggcaagaacgtggagatccacgccgagggcgccagacacagactggtgctgcacaacgtgggcttcgccgacagaggcttcttcggctgcgagacccccgacgacaagacccaggccaagctgaccgtggagatgagacaggtgagactggtgagaggcctgcaggccgtggaggccagagagcagggcaccgccaccatggaggtgcagctgagccacgccgacgtggacggcagctggaccagagacggcctgagattccagcagggccccacctgccacctggccgtgagaggccccatgcacaccctgaccctgagcggcctgagacccgaggacagcggcctgatggtgttcaaggccgagggcgtgcacaccagcgccagactggtggtgaccgagctgcccgtgagcttcagcagacccctgcaggacgtggtgaccaccgagaaggagaaggtgaccctggagtgcgagctgagcagacccaacgtggacgtgagatggctgaaggacggcgtggagctgagagccggcaagaccatggccatcgccgcccagggcgcctgcagaagcctgaccatctacagatgcgagttcgccgaccagggcgtgtacgtgtgcgacgcccacgacgcccagagcagcgccagcgtgaaggtgcagggcagaacctacaccctgatctacagaagagtgctggccgaggacgccggcgagatccagttcgtggccgagaacgccgagagcagagcccagctgagagtgaaggagctgcccgtgaccctggtgagacccctgagagacaagatcgccatggagaagcacagaggcgtgctggagtgccaggtgagcagagccagcgcccaggtgagatggttcaagggcagccaggagctgcagcccggccccaagtacgagctggtgagcgacggcctgtacagaaagctgatcatcagcgacgtgcacgccgaggacgaggacacctacacctgcgacgccggcgacgtgaagaccagcgcccagttcttcgtggaggagcagagcatcaccatcgtgagaggcctgcaggacgtgaccgtgatggagcccgcccccgcctggttcgagtgcgagaccagcatccccagcgtgagaccccccaagtggctgctgggcaagaccgtgctgcaggccggcggcaacgtgggcctggagcaggagggcaccgtgcacagactgatgctgagaagaacctgcagcaccatgaccggccccgtgcacttcaccgtgggcaagagcagaagcagcgccagactggtggtgagcgacatccccgtggtgctgaccagacccctggagcccaagaccggcagagagctgcagagcgtggtgctgagctgcgacttcagacccgcccccaaggccgtgcagtggtacaaggacgacacccccctgagccccagcgagaagttcaagatgagcctggagggccagatggccgagctgagaatcctgagactgatgcccgccgacgccggcgtgtacagatgccaggccggcagcgcccacagcagcaccgaggtgaccgtggaggccagagaggtgaccgtgaccggccccctgcaggacgccgaggccaccgaggagggctgggccagcttcagctgcgagctgagccacgaggacgaggaggtggagtggagcctgaacggcatgcccctgtacaacgacagcttccacgagatcagccacaagggcagaagacacaccctggtgctgaagagcatccagagagccgacgccggcatcgtgagagccagcagcctgaaggtgagcaccagcgccagactggaggtgagagtgaagcccgtggtgttcctgaaggccctggacgacctgagcgccgaggagagaggcaccctggccctgcagtgcgaggtgagcgaccccgaggcccacgtggtgtggagaaaggacggcgtgcagctgggccccagcgacaagtacgacttcctgcacaccgccggcaccagaggcctggtggtgcacgacgtgagccccgaggacgccggcctgtacacctgccacgtgggcagcgaggagaccagagccagagtgagagtgcacgacctgcacgtgggcatcaccaagagactgaagaccatggaggtgctggagggcgagagctgcagcttcgagtgcgtgctgagccacgagagcgccagcgaccccgccatgtggaccgtgggcggcaagaccgtgggcagcagcagcagattccaggccaccagacagggcagaaagtacatcctggtggtgagagaggccgcccccagcgacgccggcgaggtggtgttcagcgtgagaggcctgaccagcaaggccagcctgatcgtgagagagagacccgccgccatcatcaagcccctggaggaccagtgggtggcccccggcgaggacgtggagctgagatgcgagctgagcagagccggcacccccgtgcactggctgaaggacagaaaggccatcagaaagagccagaagtacgacgtggtgtgcgagggcaccatggccatgctggtgatcagaggcgccagcctgaaggacgccggcgagtacacctgcgaggtggaggccagcaagagcaccgccagcctgcacgtggaggagaaggccaactgcttcaccgaggagctgaccaacctgcaggtggaggagaagggcaccgccgtgttcacctgcaagaccgagcaccccgccgccaccgtgacctggagaaagggcctgctggagctgagagccagcggcaagcaccagcccagccaggagggcctgaccctgagactgaccatcagcgccctggagaaggccgacagcgacacctacacctgcgacatcggccaggcccagagcagagcccagctgctggtgcagggcagaagagtgcacatcatcgaggacctggaggacgtggacgtgcaggagggcagcagcgccaccttcagatgcagaatcagccccgccaactacgagcccgtgcactggttcctggacaagacccccctgcacgccaacgagctgaacgagatcgacgcccagcccggcggctaccacgtgctgaccctgagacagctggccctgaaggacagcggcaccatctacttcgaggccggcgaccagagagccagcgccgccctgagagtgaccgagaagcccagcgtgttcagcagagagctgaccgacgccaccatcaccgagggcgaggacctgaccctggtgtgcgagaccagcacctgcgacatccccgtgtgctggaccaaggacggcaagaccctgagaggcagcgccagatgccagctgagccacgagggccacagagcccagctgctgatcaccggcgccaccctgcaggacagcggcagatacaagtgcgaggccggcggcgcctgcagcagcagcatcgtgagagtgcacgccagacccgtgagattccaggaggccctgaaggacctggaggtgctggagggcggcgccgccaccctgagatgcgtgctgagcagcgtggccgcccccgtgaagtggtgctacggcaacaacgtgctgagacccggcgacaagtacagcctgagacaggagggcgccatgctggagctggtggtgagaaacctgagaccccaggacagcggcagatacagctgcagcttcggcgaccagaccaccagcgccaccctgaccgtgaccgccctgcccgcccagttcatcggcaagctgagaaacaaggaggccaccgagggcgccaccgccaccctgagatgcgagctgagcaaggccgcccccgtggagtggagaaagggcagcgagaccctgagagacggcgacagatactgcctgagacaggacggcgccatgtgcgagctgcagatcagaggcctggccatggtggacgccgccgagtacagctgcgtgtgcggcgaggagagaaccagcgccagcctgaccatcagacccatgcccgcccacttcatcggcagactgagacaccaggagagcatcgagggcgccaccgccaccctgagatgcgagctgagcaaggccgcccccgtggagtggagaaagggcagagagagcctgagagacggcgacagacacagcctgagacaggacggcgccgtgtgcgagctgcagatctgcggcctggccgtggccgacgccggcgagtacagctgcgtgtgcggcgaggagagaaccagcgccaccctgaccgtgaaggccctgcccgccaagttcaccgagggcctgagaaacgaggaggccgtggagggcgccaccgccatgctgtggtgcgagctgagcaaggtggcccccgtggagtggagaaagggccccgagaacctgagagacggcgacagatacatcctgagacaggagggcaccagatgcgagctgcagatctgcggcctggccatggccgacgccggcgagtacctgtgcgtgtgcggccaggagagaaccagcgccaccctgaccatcagagccctgcccgccagattcatcgaggacgtgaagaaccaggaggccagagagggcgccaccgccgtgctgcagtgcgagctgaacagcgccgcccccgtggagtggagaaagggcagcgagaccctgagagacggcgacagatacagcctgagacaggacggcaccaagtgcgagctgcagatcagaggcctggccatggccgacaccggcgagtacagctgcgtgtgcggccaggagagaaccagcgccatgctgaccgtgagagccctgcccatcaagttcaccgagggcctgagaaacgaggaggccaccgagggcgccaccgccgtgctgagatgcgagctgagcaagatggcccccgtggagtggtggaagggccacgagaccctgagagacggcgacagacacagcctgagacaggacggcgccagatgcgagctgcagatcagaggcctggtggccgaggacgccggcgagtacctgtgcatgtgcggcaaggagagaaccagcgccatgctgaccgtgagagccatgcccagcaagttcatcgagggcctgagaaacgaggaggccaccgagggcgacaccgccaccctgtggtgcgagctgagcaaggccgcccccgtggagtggagaaagggccacgagaccctgagagacggcgacagacacagcctgagacaggacggcagcagatgcgagctgcagatcagaggcctggccgtggtggacgccggcgagtacagctgcgtgtgcggccaggagagaaccagcgccaccctgaccgtgagagccctgcccgccagattcatcgaggacgtgaagaaccaggaggccagagagggcgccaccgccgtgctgcagtgcgagctgagcaaggccgcccccgtggagtggagaaagggcagcgagaccctgagaggcggcgacagatacagcctgagacaggacggcaccagatgcgagctgcagatccacggcctgagcgtggccgacaccggcgagtacagctgcgtgtgcggccaggagagaaccagcgccaccctgaccgtgagagccccccagcccgtgttcagagagcccctgcagagcctgcaggccgaggagggcagcaccgccaccctgcagtgcgagctgagcgagcccaccgccaccgtggtgtggagcaagggcggcctgcagctgcaggccaacggcagaagagagcccagactgcagggctgcaccgccgagctggtgctgcaggacctgcagagagaggacaccggcgagtacacctgcacctgcggcagccaggccaccagcgccaccctgaccgtgaccgccgcccccgtgagattcctgagagagctgcagcaccaggaggtggacgagggcggcaccgcccacctgtgctgcgagctgagcagagccggcgccagcgtggagtggagaaagggcagcctgcagctgttcccctgcgccaagtaccagatggtgcaggacggcgccgccgccgagctgctggtgagaggcgtggagcaggaggacgccggcgactacacctgcgacaccggccacacccagagcatggccagcctgagcgtgagagtgcccagacccaagttcaagaccagactgcagagcctggagcaggagaccggcgacatcgccagactgtgctgccagctgagcgacgccgagagcggcgccgtggtgcagtggctgaaggagggcgtggagctgcacgccggccccaagtacgagatgagaagccagggcgccaccagagagctgctgatccaccagctggaggccaaggacaccggcgagtacgcctgcgtgaccggcggccagaagaccgccgccagcctgagagtgaccgagcccgaggtgaccatcgtgagaggcctggtggacgccgaggtgaccgccgacgaggacgtggagttcagctgcgaggtgagcagagccggcgccaccggcgtgcagtggtgcctgcagggcctgcccctgcagagcaacgaggtgaccgaggtggccgtgagagacggcagaatccacaccctgagactgaagggcgtgacccccgaggacgccggcaccgtgagcttccacctgggcaaccacgccagcagcgcccagctgaccgtgagagcccccgaggtgaccatcctggagcccctgcaggacgtgcagctgagcgagggccaggacgccagcttccagtgcagactgagcagagccagcggccaggaggccagatgggccctgggcggcgtgcccctgcaggccaacgagatgaacgacatcaccgtggagcagggcaccctgcacctgctgaccctgcacaaggtgaccctggaggacgccggcaccgtgagcttccacgtgggcacctgcagcagcgaggcccagctgaaggtgaccgccaagaacaccgtggtgagaggcctggagaacgtggaggccctggagggcggcgaggccctgttcgagtgccagctgagccagcccgaggtggccgcccacacctggctgctggacgacgagcccgtgcacaccagcgagaacgccgaggtggtgttcttcgagaacggcctgagacacctgctgctgctgaagaacctgagaccccaggacagctgcagagtgaccttcctggccggcgacatggtgaccagcgccttcctgaccgtgagaggctggagactggagatcctggagcccctgaagaacgccgccgtgagagccggcgcccaggcctgcttcacctgcaccctgagcgaggccgtgcccgtgggcgaggccagctggtacatcaacggcgccgccgtgcagcccgacgacagcgactggaccgtgaccgccgacggcagccaccacgccctgctgctgagaagcgcccagccccaccacgccggcgaggtgaccttcgcctgcagagacgccgtggccagcgccagactgaccgtgctgggcctgcccgacccccccgaggacgccgaggtggtggccagaagcagccacaccgtgaccctgagctgggccgcccccatgagcgacggcggcggcggcctgtgcggctacagagtggaggtgaaggagggcgccaccggccagtggagactgtgccacgagctggtgcccggccccgagtgcgtggtggacggcctggcccccggcgagacctacagattcagagtggccgccgtgggccccgtgggcgccggcgagcccgtgcacctgccccagaccgtgagactggccgagccccccaagcccgtgcccccccagcccagcgcccccgagagcagacaggtggccgccggcgaggacgtgagcctggagctggaggtggtggccgaggccggcgaggtgatctggcacaagggcatggagagaatccagcccggcggcagattcgaggtggtgagccagggcagacagcagatgctggtgatcaagggcttcaccgccgaggaccagggcgagtaccactgcggcctggcccagggcagcatctgccccgccgccgccaccttccaggtggccctgagccccgccagcgtggacgaggccccccagcccagcctgccccccgaggccgcccaggagggcgacctgcacctgctgtgggaggccctggccagaaagagaagaatgagcagagagcccaccctggacagcatcagcgagctgcccgaggaggacggcagaagccagagactgccccaggaggccgaggaggtggcccccgacctgagcgagggctacagcaccgccgacgagctggccagaaccggcgacgccgacctgagccacaccagcagcgacgacgagagcagagccggcacccccagcctggtgacctacctgaagaaggccggcagacccggcaccagccccctggccagcaaggtgggcgcccccgccgcccccagcgtgaagccccagcagcagcaggagcccctggccgccgtgagaccccccctgggcgacctgagcaccaaggacctgggcgaccccagcatggacaaggccgccgtgaagatccaggccgccttcaagggctacaaggtgagaaaggagatgaagcagcaggagggccccatgttcagccacaccttcggcgacaccgaggcccaggtgggcgacgccctgagactggagtgcgtggtggccagcaaggccgacgtgagagccagatggctgaaggacggcgtggagctgaccgacggcagacaccaccacatcgaccagctgggcgacggcacctgcagcctgctgatcaccggcctggacagagccgacgccggctgctacacctgccaggtgagcaacaagttcggccaggtgacccacagcgcctgcgtggtggtgagcggcagcgagagcgaggccgagagcagcagcggcggcgagctggacgacgccttcagaagagccgccagaagactgcacagactgttcagaaccaagagccccgccgaggtgagcgacgaggagctgttcctgagcgccgacgagggccccgccgagcccgaggagcccgccgactggcagacctacagagaggacgagcacttcatctgcatcagattcgaggccctgaccgaggccagacaggccgtgaccagattccaggagatgttcgccaccctgggcatcggcgtggagatcaagctggtggagcagggccccagaagagtggagatgtgcatcagcaaggagacccccgcccccgtggtgccccccgagcccctgcccagcctgctgaccagcgacgccgcccccgtgttcctgaccgagctgcagaaccaggaggtgcaggacggctaccccgtgagcttcgactgcgtggtgaccggccagcccatgcccagcgtgagatggttcaaggacggcaagctgctggaggaggacgaccactacatgatcaacgaggaccagcagggcggccaccagctgatcatcaccgccgtggtgcccgccgacatgggcgtgtacagatgcctggccgagaacagcatgggcgtgagcagcaccaaggccgagctgagagtggacctgaccagcaccgactacgacaccgccgccgacgccaccgagagcagcagctacttcagcgcccagggctacctgagcagcagagagcaggagggcaccgagagcaccaccgacgagggccagctgccccaggtggtggaggagctgagagacctgcaggtggcccccggcaccagactggccaagttccagctgaaggtgaagggctaccccgcccccagactgtactggttcaaggacggccagcccctgaccgccagcgcccacatcagaatgaccgacaagaagatcctgcacaccctggagatcatcagcgtgaccagagaggacagcggccagtacgccgcctacatcagcaacgccatgggcgccgcctacagcagcgccagactgctggtgagaggccccgacgagcccgaggagaagcccgccagcgacgtgcacgagcagctggtgccccccagaatgctggagagattcacccccaagaaggtgaagaagggcagcagcatcaccttcagcgtgaaggtggagggcagacccgtgcccaccgtgcactggctgagagaggaggccgagagaggcgtgctgtggatcggccccgacacccccggctacaccgtggccagcagcgcccagcagcacagcctggtgctgctggacgtgggcagacagcaccagggcacctacacctgcatcgccagcaacgccgccggccaggccctgtgcagcgccagcctgcacgtgagcggcctgcccaaggtggaggagcaggagaaggtgaaggaggccctgatcagcaccttcctgcagggcaccacccaggccatcagcgcccagggcctggagaccgccagcttcgccgacctgggcggccagagaaaggaggagcccctggccgccaaggaggccctgggccacctgagcctggccgaggtgggcaccgaggagttcctgcagaagctgaccagccagatcaccgagatggtgagcgccaagatcacccaggccaagctgcaggtgcccggcggcgacagcgacgaggacagcaagacccccagcgccagccccagacacggcagaagcagacccagcagcagcatccaggagagcagcagcgagagcgaggacggcgacgccagaggcgagatcttcgacatctacgtggtgaccgccgactacctgcccctgggcgccgagcaggacgccatcaccctgagagagggccagtacgtggaggtgctggacgccgcccaccccctgagatggctggtgagaaccaagcccaccaagagcagccccagcagacagggctgggtgagccccgcctacctggacagaagactgaagctgagccccgagtggggcgccgccgaggcccccgagttccccggcgaggccgtgagcgaggacgagtacaaggccagactgagcagcgtgatccaggagctgctgagcagcgagcaggccttcgtggaggagctgcagttcctgcagagccaccacctgcagcacctggagagatgcccccacgtgcccatcgccgtggccggccagaaggccgtgatcttcagaaacgtgagagacatcggcagattccacagcagcttcctgcaggagctgcagcagtgcgacaccgacgacgacgtggccatgtgcttcatcaagaaccaggccgccttcgagcagtacctggagttcctggtgggcagagtgcaggccgagagcgtggtggtgagcaccgccatccaggagttctacaagaagtacgccgaggaggccctgctggccggcgaccccagccagcccccccccccccccctgcagcactacctggagcagcccgtggagagagtgcagagataccaggccctgctgaaggagctgatcagaaacaaggccagaaacagacagaactgcgccctgctggagcaggcctacgccgtggtgagcgccctgccccagagagccgagaacaagctgcacgtgagcctgatggagaactaccccggcaccctgcaggccctgggcgagcccatcagacagggccacttcatcgtgtgggagggcgcccccggcgccagaatgccctggaagggccacaacagacacgtgttcctgttcagaaaccacctggtgatctgcaagcccagaagagacagcagaaccgacaccgtgagctacgtgttcagaaacatgatgaagctgagcagcatcgacctgaacgaccaggtggagggcgacgacagagccttcgaggtgtggcaggagagagaggacagcgtgagaaagtacctgctgcaggccagaaccgccatcatcaagagcagctgggtgaaggagatctgcggcatccagcagagactggccctgcccgtgtggagaccccccgacttcgaggaggagctggccgactgcaccgccgagctgggcgagaccgtgaagctggcctgcagagtgaccggcacccccaagcccgtgatcagctggtacaaggacggcaaggccgtgcaggtggacccccaccacatcctgatcgaggaccccgacggcagctgcgccctgatcctggacagcctgaccggcgtggacagcggccagtacatgtgcttcgccgccagcgccgccggcaactgcagcaccctgggcaagatcctggtgcaggtgccccccagattcgtgaacaaggtgagagccagccccttcgtggagggcgaggacgcccagttcacctgcaccatcgagggcgccccctacccccagatcagatggtacaaggacggcgccctgctgaccaccggcaacaagttccagaccctgagcgagcccagaagcggcctgctggtgctggtgatcagagccgccagcaaggaggacctgggcctgtacgagtgcgagctggtgaacagactgggcagcgccagagccagcgccgagctgagaatccagagccccatgctgcaggcccaggagcagtgccacagagagcagctggtggccgccgtggaggtgaccgagcaggagaccaaggtgcccaagaagaccgtgatcatcgaggagaccatcaccaccgtggtgaagagccccagaggccagagaagaagccccagcaagagccccagcagaagccccagcagatgcagcgccagccccctgagacccggcctgctggcccccgacctgctgtacctgcccggcgccggccagcccagaagacccgaggccgagcccggccagaagcccgtggtgcccaccctgtacgtgaccgaggccgaggcccacagccccgccctgcccggcctgagcggcccccagcccaagtgggtggaggtggaggagaccatcgaggtgagagtgaagaagatgggcccccagggcgtgagccccaccaccgaggtgcccagaagcagcagcggccacctgttcaccctgcccggcgccacccccggcggcgaccccaacagcaacaacagcaacaacaagctgctggcccaggaggcctgggcccagggcaccgccatggtgggcgtgagagagcccctggtgttcagagtggacgccagaggcagcgtggactgggccgccagcggcatgggcagcctggaggaggagggcaccatggaggaggccggcgaggaggagggcgaggacggcgacgccttcgtgaccgaggagagccaggacacccacagcctgggcgacagagaccccaagatcctgacccacaacggcagaatgctgaccctggccgacctggaggactacgtgcccggcgagggcgagaccttccactgcggcggccccggccccggcgcccccgacgaccccccctgcgaggtgagcgtgatccagagagagatcggcgagcccaccgtgggccagcccgtgctgctgagcgtgggccacgccctgggccccagaggccccctgggcctgttcagacccgagcccagaggcgccagcccccccggcccccaggtgagaagcctggagggcaccagcttcctgctgagagaggcccccgccagacccgtgggcagcgccccctggacccagagcttctgcaccagaatcagaagaagcgccgacagcggccagagcagcttcaccaccgagctgagcacccagaccgtgaacttcggcaccgtgggcgagaccgtgaccctgcacatctgccccgacagagacggcgacgaggccgcccagccctag

SEQ ID NO: 9597 - DNA, 1407 bp, Artificial Sequence
  Description of Artificial Sequence: Synthetic coding sequence
atggccgcccccgacctgagcaccaacctgcaggaggaggccacctgcgccatctgcctggactacttcaccgaccccgtgatgaccgactgcggccacaacttctgcagagagtgcatcagaagatgctggggccagcccgagggcccctacgcctgccccgagtgcagagagctgagcccccagagaaacctgagacccaacagacccctggccaagatggccgagatggccagaagactgcacccccccagccccgtgccccagggcgtgtgccccgcccacagagagcccctggccgccttctgcggcgacgagctgagactgctgtgcgccgcctgcgagagaagcggcgagcactgggcccacagagtgagacccctgcaggacgccgccgaggacctgaaggccaagctggagaagagcctggagcacctgagaaagcagatgcaggacgccctgctgttccaggcccaggccgacgagacctgcgtgctgtggcagaagatggtggagagccagagacagaacgtgctgggcgagttcgagagactgagaagactgctggccgaggaggagcagcagctgctgcagagactggaggaggaggagctggaggtgctgcccagactgagagagggcgccgcccacctgggccagcagagcgcccacctggccgagctgatcgccgagctggagggcagatgccagctgcccgccctgggcctgctgcaggacatcaaggacgccctgagaagagtgcaggacgtgaagctgcagccccccgaggtggtgcccatggagctgagaaccgtgtgcagagtgcccggcctggtggagaccctgagaagattcagaggcgacgtgaccctggaccccgacaccgccaaccccgagctgatcctgagcgaggacagaagaagcgtgcagagaggcgacctgagacaggccctgcccgacagccccgagagattcgaccccggcccctgcgtgctgggccaggagagattcaccagcggcagacactactgggaggtggaggtgggcgacagaaccagctgggccctgggcgtgtgcagagagaacgtgaacagaaaggagaagggcgagctgagcgccggcaacggcttctggatcctggtgttcctgggcagctactacaacagcagcgagagagccctggcccccctgagagacccccccagaagagtgggcatcttcctggactacgaggccggccacctgagcttctacagcgccaccgacggcagcctgctgttcatcttccccgagatccccttcagcggcaccctgagacccctgttcagccccctgagcagcagccccacccccatgaccatctgcagacccaagggcggcagcggcgacaccctggccccccagtag

SEQ ID NO: 9598 - DNA, 813 bp, Artificial Sequence
  Description of Artificial Sequence: Synthetic coding sequence
atgagccccggcagcggcgtgaagagcgagtacatgaagagataccaggagcccagatgggaggagtacggcccctgctacagagagctgctgcactacagactgggcagaagactgctggagcaggcccacgccccctggctgtgggacgactggggccccgccggcagcagcgaggacagcgccagcagcgagagcagcggcgccggcggccccgcccccagatgcgccccccccagcccccccccccccgtggagcccgccacccaggaggaggccgagagaagagccagaggcgcccccgaggagcaggacgccgaggccggcgacgccgaggccgaggacgccgaggacgccgccctgcccgccctgcccgtgaaggacgtggaggacaagcccgagcagcagaccagaaccagagagaccgacaagagccccaccagcaccgagcccagacagcagcccagcgccctgttcgccagaggcaacagaaaggccgtgaagagcccccagagaagcagcagcaagatcaaggagaacaagcaccccttcgccctgtacggctggggcgagaagcagaccgacaccggcagccagaagacccacaacgtgtgcgccagcgcccccgtgcacgagatccacgagagcgccctgagagccaagaacagaagacaggtggagaagagaaagctggtggcccagagacagagagcccacagcgtggacgtggagaagaacagaaagatgaaggccagcagcagcgagaacccctggatgaccgagtacatgagatgctacagcgccagagcctag

SEQ ID NO: 9599 - DNA, 2667 bp, Artificial Sequence
  Description of Artificial Sequence: Synthetic coding sequence
atggacgagagcgccctgctggacctgctggagtgccccgtgtgcctggagagactggacgccagcgccaaggtgctgccctgccagcacaccttctgcaagagatgcctgctgggcatcgtgggcagcagaaacgagctgagatgccccgagtgcagaaccctggtgggcagcggcgtggaggagctgcccagcaacatcctgctggtgagactgctggacggcatcaagcagagaccctggaagcccggccccggcggcggcagcggcaccaactgcaccaacgccctgagaagccagagcagcaccgtggccaactgcagcagcaaggacctgcagagcagccagggcggccagcagcccagagtgcagagctggagcccccccgtgagaggcatcccccagctgccctgcgccaaggccctgtacaactacgagggcaaggagcccggcgacctgaagttcagcaagggcgacatcatcatcctgagaagacaggtggacgagaactggtaccacggcgaggtgaacggcatccacggcttcttccccaccaacttcgtgcagatcatcaagcccctgccccagccccccccccagtgcaaggccctgtacgacttcgaggtgaaggacaaggaggccgacaaggactgcctgcccttcgccaaggacgacgtgctgaccgtgatcagaagagtggacgagaactgggccgagggcatgctggccgacaagatcggcatcttccccatcagctacgtggagttcaacagcgccgccaagcagctgatcgagtgggacaagccccccgtgcccggcgtggacgccggcgagtgcagcagcgccgccgcccagagcagcaccgcccccaagcacagcgacaccaagaagaacaccaagaagagacacagcttcaccagcctgaccatggccaacaagagcagccaggccagccagaacagacacagcatggagatcagcccccccgtgctgatcagcagcagcaaccccaccgccgccgccagaatcagcgagctgagcggcctgagctgcagcgcccccagccaggtgcacatcagcaccaccggcctgatcgtgacccccccccccagcagccccgtgaccaccggccccagcttcaccttccccagcgacgtgccctaccaggccgccctgggcaccctgaacccccccctgccccccccccccctgctggccgccaccgtgctggccagcaccccccccggcgccaccgccgccgccgccgccgccggcatgggccccagacccatggccggcagcaccgaccagatcgcccacctgagaccccagaccagacccagcgtgtacgtggccatctacccctacacccccagaaaggaggacgagctggagctgagaaagggcgagatgttcctggtgttcgagagatgccaggacggctggttcaagggcaccagcatgcacaccagcaagatcggcgtgttccccggcaactacgtggcccccgtgaccagagccgtgaccaacgccagccaggccaaggtgcccatgagcaccgccggccagaccagcagaggcgtgaccatggtgagccccagcaccgccggcggccccgcccagaagctgcagggcaacggcgtggccggcagccccagcgtggtgcccgccgccgtggtgagcgccgcccacatccagaccagcccccaggccaaggtgctgctgcacatgaccggccagatgaccgtgaaccaggccagaaacgccgtgagaaccgtggccgcccacaaccaggagagacccaccgccgccgtgacccccatccaggtgcagaacgccgccggcctgagccccgccagcgtgggcctgagccaccacagcctggccagcccccagcccgcccccctgatgcccggcagcgccacccacaccgccgccatcagcatcagcagagccagcgcccccctggcctgcgccgccgccgcccccctgaccagccccagcatcaccagcgccagcctggaggccgagcccagcggcagaatcgtgaccgtgctgcccggcctgcccaccagccccgacagcgccagcagcgcctgcggcaacagcagcgccaccaagcccgacaaggacagcaagaaggagaagaagggcctgctgaagctgctgagcggcgccagcaccaagagaaagcccagagtgagcccccccgccagccccaccctggaggtggagctgggcagcgccgagctgcccctgcagggcgccgtgggccccgagctgccccccggcggcggccacggcagagccggcagctgccccgtggacggcgacggccccgtgaccaccgccgtggccggcgccgccctggcccaggacgccttccacagaaaggccagcagcctggacagcgccgtgcccatcgcccccccccccagacaggcctgcagcagcctgggccccgtgctgaacgagagcagacccgtggtgtgcgagagacacagagtggtggtgagctaccccccccagagcgaggccgagctggagctgaaggagggcgacatcgtgttcgtgcacaagaagagagaggacggctggttcaagggcaccctgcagagaaacggcaagaccggcctgttccccggcagcttcgtggagaacatctag

SEQ ID NO: 9600 - DNA, 570 bp, Artificial Sequence
  Description of Artificial Sequence: Synthetic coding sequence
atgccccagaccgtgatcctgcccggccccgccccctggggcttcagactgagcggcggcatcgacttcaaccagcccctggtgatcaccagaatcacccccggcagcaaggccgccgccgccaacctgtgccccggcgacgtgatcctggccatcgacggcttcggcaccgagagcatgacccacgccgacgcccaggacagaatcaaggccgccgcccaccagctgtgcctgaagatcgacagaggcgagacccacctgtggagcccccaggtgagcgaggacggcaaggcccaccccttcaagatcaacctggagagcgagccccaggagttcaagcccatcggcaccgcccacaacagaagagcccagcccttcgtggccgccgccaacatcgacgacaagagacaggtggtgagcgccagctacaacagccccatcggcctgtacagcaccagcaacatccaggacgccctgcacggccagctgagaggcctgatccccagcagcccccagaagaccggcaccaccctgaacaccagcatcatcttcggccccaacctgagctag

SEQ ID NO: 9601 - DNA, 1095 bp, Artificial Sequence
  Description of Artificial Sequence: Synthetic coding sequence
atgccccagaccgtgatcctgcccggccccgccccctggggcttcagactgagcggcggcatcgacttcaaccagcccctggtgatcaccagaatcacccccggcagcaaggccgccgccgccaacctgtgccccggcgacgtgatcctggccatcgacggcttcggcaccgagagcatgacccacgccgacgcccaggacagaatcaaggccgccgcccaccagctgtgcctgaagatcgacagaggcgagacccacctgtggagcccccaggtgagcgaggacggcaaggcccaccccttcaagatcaacctggagagcgagccccaggacggcaactacttcgagcacaagcacaacatcagacccaagcccttcgtgatccccggcagaagcagcggctgcagcacccccagcggcatcgactgcggcagcggcagaagcacccccagcagcgtgagcaccgtgagcaccatctgccccggcgacctgaaggtggccgccaagctggcccccaacatccccctggagatggagctgcccggcgtgaagatcgtgcacgcccagttcaacacccccatgcagctgtacagcgacgacaacatcatggagaccctgcagggccaggtgagcaccgccctgggcgagacccccctgatgagcgagcccaccgccagcgtgccccccgagagcgacgtgtacagaatgctgcacgacaacagaaacgagcccacccagcccagacagagcggcagcttcagagtgctgcagggcatggtggacgacggcagcgacgacagacccgccggcaccagaagcgtgagagcccccgtgaccaaggtgcacggcggcagcggcggcgcccagagaatgcccctgtgcgacaagtgcggcagcggcatcgtgggcgccgtggtgaaggccagagacaagtacagacaccccgagtgcttcgtgtgcgccgactgcaacctgaacctgaagcagaagggctacttcttcatcgagggcgagctgtactgcgagacccacgccagagccagaaccaagccccccgagggctacgacaccgtgaccctgtaccccaaggcctag

SEQ ID NO: 9602 - DNA, 951 bp, Artificial Sequence
  Description of Artificial Sequence: Synthetic coding sequence
atgccccagaccgtgatcctgcccggccccgccccctggggcttcagactgagcggcggcatcgacttcaaccagcccctggtgatcaccagaatcacccccggcagcaaggccgccgccgccaacctgtgccccggcgacgtgatcctggccatcgacggcttcggcaccgagagcatgacccacgccgacgcccaggacagaatcaaggccgccgcccaccagctgtgcctgaagatcgacagaggcgagacccacctgtggagcccccaggtgagcgaggacggcaaggcccaccccttcaagatcaacctggagagcgagccccaggagttcaagcccatcggcaccgcccacaacagaagagcccagcccttcgtggccgccgccaacatcgacgacaagagacaggtggtgagcgccagctacaacagccccatcggcctgtacagcaccagcaacatccaggacgccctgcacggccagctgagaggcctgatccccagcagcccccagaacgagcccaccgccagcgtgccccccgagagcgacgtgtacagaatgctgcacgacaacagaaacgagcccacccagcccagacagagcggcagcttcagagtgctgcagggcatggtggacgacggcagcgacgacagacccgccggcaccagaagcgtgagagcccccgtgaccaaggtgcacggcggcagcggcggcgcccagagaatgcccctgtgcgacaagtgcggcagcggcatcgtgggcgccgtggtgaaggccagagacaagtacagacaccccgagtgcttcgtgtgcgccgactgcaacctgaacctgaagcagaagggctacttcttcatcgagggcgagctgtactgcgagacccacgccagagccagaaccaagccccccgagggctacgacaccgtgaccctgtaccccaaggcctag

SEQ ID NO: 9603 - DNA, 3303 bp, Artificial Sequence
  Description of Artificial Sequence: Synthetic coding sequence
atgagctactaccagagacccttcagccccagcgcctacagcctgcccgccagcctgaacagcagcatcgtgatgcagcacggcaccagcctggacagcaccgacacctacccccagcacgcccagagcctggacggcaccaccagcagcagcatccccctgtacagaagcagcgaggaggagaagagagtgaccgtgatcaaggccccccactaccccggcatcggccccgtggacgagagcggcatccccaccgccatcagaaccaccgtggacagacccaaggactggtacaagaccatgttcaagcagatccacatggtgcacaagcccgacgacgacaccgacatgtacaacaccccctacacctacaacgccggcctgtacaaccccccctacagcgcccagagccaccccgccgccaagacccagacctacagacccctgagcaagagccacagcgacaacagccccaacgccttcaaggacgccagcagccccgtgccccccccccacgtgcccccccccgtgccccccctgagacccagagacagaagcagcaccgagaagcacgactgggacccccccgacagaaaggtggacaccagaaagttcagaagcgagcccagaagcatcttcgagtacgagcccggcaagagcagcatcctgcagcacgagagacccgccagcctgtaccagagcagcatcgacagaagcctggagagacccatgagcagcgccagcatggccagcgacttcagaaagagaagaaagagcgagcccgccgtgggcccccccagaggcctgggcgaccagagcgccagcagaaccagccccggcagagtggacctgcccggcagcagcaccaccctgaccaagagcttcaccagcagcagccccagcagccccagcagagccaagggcggcgacgacagcaagatctgccccagcctgtgcagctacagcggcctgaacggcaaccccagcagcgagctggactactgcagcacctacagacagcacctggacgtgcccagagacagccccagagccatcagcttcaagaacggctggcagatggccagacagaacgccgagatctggagcagcaccgaggagaccgtgagccccaagatcaagagcagaagctgcgacgacctgctgaacgacgactgcgacagcttccccgaccccaaggtgaagagcgagagcatgggcagcctgctgtgcgaggaggacagcaaggagagctgccccatggcctggggcagcccctacgtgcccgaggtgagaagcaacggcagaagcagaatcagacacagaagcgccagaaacgcccccggcttcctgaagatgtacaagaagatgcacagaatcaacagaaaggacctgatgaacagcgaggtgatctgcagcgtgaagagcagaatcctgcagtacgagagcgagcagcagcacaaggacctgctgagagcctggagccagtgcagcaccgaggaggtgcccagagacatggtgcccaccagaatcagcgagttcgagaagctgatccagaagagcaagagcatgcccaacctgggcgacgacatgctgagccccgtgaccctggagcccccccagaacggcctgtgccccaagagaagattcagcatcgagtacctgctggaggaggagaaccagagcggcccccccgccagaggcagaagaggctgccagagcaacgccctggtgcccatccacatcgaggtgaccagcgacgagcagcccagagcccacgtggagttcagcgacagcgaccaggacggcgtggtgagcgaccacagcgactacatccacctggagggcagcagcttctgcagcgagagcgacttcgaccacttcagcttcaccagcagcgagagcttctacggcagcagccaccaccaccaccaccaccaccaccaccaccacagacacctgatcagcagctgcaagggcagatgccccgccagctacaccagattcaccaccatgctgaagcacgagagagccagacacgagaacaccgaggagcccagaagacaggagatggaccccggcctgagcaagctggccttcctggtgagccccgtgcccttcagaagaaagaagaacagcgcccccaagaagcagaccgagaaggccaagtgcaaggccagcgtgttcgaggccctggacagcgccctgaaggacatctgcgaccagatcaaggccgagaagaagagaggcagcctgcccgacaacagcatcctgcacagactgatcagcgagctgctgcccgacgtgcccgagagaaacagcagcctgagagccctgagaagaagccccctgcaccagcccctgcaccccctgccccccgacggcgccatccactgccccccctaccagaacgactgcggcagaatgcccagaagcgccagcttccaggacgtggacaccgccaacagcagctgccaccaccaggacagaggcggcgccctgcaggacagagagagccccagaagctacagcagcaccctgaccgacatgggcagaagcgcccccagagagagaagaggcacccccgagaaggagaagctgcccgccaaggccgtgtacgacttcaaggcccagaccagcaaggagctgagcttcaagaagggcgacaccgtgtacatcctgagaaagatcgaccagaactggtacgagggcgagcaccacggcagagtgggcatcttccccatcagctacgtggagaagctgaccccccccgagaaggcccagcccgccagaccccccccccccgcccagcccggcgagatcggcgaggccatcgccaagtacaacttcaacgccgacaccaacgtggagctgagcctgagaaagggcgacagagtgatcctgctgaagagagtggaccagaactggtacgagggcaagatccccggcaccaacagacagggcatcttccccgtgagctacgtggaggtggtgaagaagaacaccaagggcgccgaggactaccccgacccccccatcccccacagctacagcagcgacagaatccacagcctgagcagcaacaagccccagagacccgtgttcacccacgagaacatccagggcggcggcgagcccttccaggccctgtacaactacacccccagaaacgaggacgagctggagctgagagagagcgacgtgatcgacgtgatggagaagtgcgacgacggctggttcgtgggcaccagcagaagaaccaagttcttcggcaccttccccggcaactacgtgaagagactgtag

SEQ ID NO: 9604 - DNA, 4389 bp, Artificial Sequence
  Description of Artificial Sequence: Synthetic coding sequence
atgttcagaggccccaagccccccatcgcccccaagcccagactgaccgcccccaacgagtggagagccagcgtgtacctgaacgacagcctgaacaagtgcagcaacggcagactgccctgcgtggacagaggcctggacgagggccccagaagcatccccaagtgcagcgagagcgagaccgacgaggactacatcgtggtgcccagagtgcccctgagagaggacgagcccaaggacgagggcagcgtgggcaacaaggccctggtgagccccgagagcagcgccgaggaggaggaggagagagaggagggcggcgaggcctgcggcctggagggcaccggcgccggcgaggacagcgtggcccccgccgcccccggcgccggcgccctgagcagagagggcgaggagggcaccgacctggccctggaggacgagggcgagggctgcgccgacgagcccggcaccctggagcaggtgagcagaagcgaggaggaggagaagctggtgcagccccacagagagtgcagcctggaggacagcggcccctgggccggcgagggcgtgttccagagcgacctgctgctgccccacatccacggcgaggaccaggagccccccgacacccccggcgaggccgaggaggacgacgaggagggctgcgccagcaccgaccccgccggcgccgacgagggcagcggccccgacagacccaccgaggacatgggccaggacgccgaggacaccagcgaggagccccccgagaaggaggagctggccggcgtgcaggaggccgagaccgccaccgactgccccgaggtgctggaggagggctgcgaggaggccaccggcgtgaccggcggcgagcaggtggacctgagcgagccccccgaccacgagaagaagaccaaccaggaggtggccgccgccaccctggaggaccacgcccaggacgagagcgccgaggagagctgccagatcgtgcccttcgagaacgactgcatggaggacttcgtgaccagcctgaccggcagcccctacgagttcttccccaccgagagcaccagcttctgcagcgagagctgcagccccctgagcgagagcgccaagggcctggagagcgagcaggcccccaagctgggcctgagagccgaggagaaccccatggtgggcgccctgtgcggccagtgcggcagcctgcagggcggcgccgccgagggccccgccgcccccgacgtggtggtggtgctggaggaggaggccctggacgacgccctggccaacccctacgtgatgggcgtgggcctgcccggccaggccgcccccggcgagggcggccaggccgccagcgacgccctgggcggctacggcagcaaggaggagctgaactgcgaggccgagggcggcctggtgcccgccgacagaaagaacaccagcaccagagtgagaccccacagcggcaaggtggccggctacgtgcccgagaccgtgcccgaggagaccggccccgaggccggcagcagcgcccccggcatcggcggcgccgccgaggaggtgggcaagaccctgctgagcctggagggcaagcccctggaggccagcagagccctgcccgccaagcccagagccttcaccctgtaccccagaagcttcagcgtggagggcagagagatccccgtgagcgtgtaccaggagcccgagggcagcggcctggacgaccacagaatcaagagaaaggaggacaacctgagcctgagctgcgtgatcggcagcagcggcagcttcagccagagaaaccacctgcccagcagcggcaccagcacccccagcagcatggtggacatccccccccccttcgacctggcctgcatcaccaagaagcccatcaccaagagcagccccagcctgctgatcgagagcgacagccccgacaagtacaagaagaagaagagcagcttcaagagattcctggccctgaccttcaagaagaagaccgagaacaagctgcacgtggacgtgaacgtgagcagcagcagaagcagcagcgagagcagctaccacggccccagcagaatcctggaggtggacagaagaagcctgagcaacagcccccagctgaagagcagaaccggcaagctgagagccagcgagagccccagcagcctgatcttctacagagacggcaagagaaagggcgtgcccttcagcagaaccgtgagcagagtggagagcttcgaggacagaagcagaccccccttcctgcccctgcccctgaccaagcccagaagcatcagcttccccagcgccgacaccagcgactacgagaacatccccgccatgaacagcgactacgagaacatccagatcccccccagaagacccgccagagccggcgccttcaccaagctgttcgaggaccagagcagagccctgagcaccgccaacgagaacgacggctacgtggacatgagcagcttcaacgccttcgagagcaagcagcagagcgccgaccaggacgccgagagcgcctacaccgagccctacaaggtgtgccccatcagcagcgccgcccccaaggaggacctgaccagcgacgaggagcagagaagcagcgaggaggaggacagcgccagcagagaccccagcgtgacccacaaggtggagggccagagcagagccctggtgatcgcccaggagctgctgagcagcgagaaggcctacgtggagatgctgcagcacctgaacctggacttccacggcgccgtgatgagagccctggacgacatggaccacgagggcagagacaccctggccagagaggagctgagacagggcctgagcgagctgcccgccatccacgacctgcaccagggcatcctggaggagctggaggagagactgagcaactgggagagccagcagaaggtggccgacgtgttcctggccagagagcagggcttcgaccaccacgccacccacatcctgcagttcgacagatacctgggcctgctgagcgagaactgcctgcacagccccagactggccgccgccgtgagagagttcgagcagagcgtgcagggcggcagccagaccgccaagcacagactgctgagagtggtgcagagactgttccagtaccaggtgctgctgaccgactacctgaacaacctgtgccccgacagcgccgagtacgacaacacccagggcgccctgagcctgatcagcaaggtgaccgacagagccaacgacagcatggagcagggcgagaacctgcagaagctggtgcacatcgagcacagcgtgagaggccagggcgacctgctgcagcccggcagagagttcctgaaggagggcaccctgatgaaggtgaccggcaagaacagaagacccagacacctgttcctgatgaacgacgtgctgctgtacacctacccccagaaggacggcaagtacagactgaagaacaccctggccgtggccaacatgaaggtgagcagacccgtgatggagaaggtgccctacgccctgaagatcgagaccagcgagagctgcctgatgctgagcgccagcagctgcgccgagagagacgagtggtacggctgcctgagcagagccctgcccgaggactacaaggcccaggccctggccgccttccaccacagcgtggagatcagagagagactgggcgtgagcctgggcgagagaccccccaccctggtgcccgtgacccacgtgatgatgtgcatgaactgcggctgcgacttcagcctgaccctgagaagacaccactgccacgcctgcggcaagatcgtgtgcagaaactgcagcagaaacaagtaccccctgaagtacctgaaggacagaatggccaaggtgtgcgacggctgcttcggcgagctgaagaagagaggcagagccgtgcccggcctgatgagagagagacccgtgagcatgagcttccccctgagcagccccagattcagcggcagcgccttcagcagcgtgttccagagcatcaaccccagcaccttcaagaagcagaagaaggtgcccagcgccctgaccgaggtggccgccagcggcgagggcagcgccatcagcggctacctgagcagatgcaagagaggcaagagacactggaagaagctgtggttcgtgatcaagggcaaggtgctgtacacctacatggccagcgaggacaaggtggccctggagagcatgcccctgctgggcttcaccatcgcccccgagaaggaggagggcagcagcgaggtgggccccatcttccacctgtaccacaagaagaccctgttctacagcttcaaggccgaggacaccaacagcgcccagagatggatcgaggccatggaggacgccagcgtgctgtag

SEQ ID NO: 9605 - DNA, 768 bp, Artificial Sequence
  Description of Artificial Sequence: Synthetic coding sequence
atggccagcagcgacctggagcagctgtgcagccacgtgaacgagaagatcggcaacatcaagaagaccctgagcctgagaaactgcggccaggagcccaccctgaagaccgtgctgaacaagatcggcgacgagatcatcgtgatcaacgagctgctgaacaagctggagctggagatccagtaccaggagcagaccaacaacagcctgaaggagctgtgcgagagcctggaggaggactacaaggacatcgagcacctgaaggagaacgtgcccagccacctgccccaggtgaccgtgacccagagctgcgtgaagggcagcgacctggaccccgaggagcccatcaaggtggaggagcccgagcccgtgaagaagccccccaaggagcagagaagcatcaaggagatgcccttcatcacctgcgacgagttcaacggcgtgcccagctacatgaagagcagactgacctacaaccagatcaacgacgtgatcaaggagatcaacaaggccgtgatcagcaagtacaagatcctgcaccagcccaagaagagcatgaacagcgtgaccagaaacctgtaccacagattcatcgacgaggagaccaaggacaccaagggcagatacttcatcgtggaggccgacatcaaggagttcaccaccctgaaggccgacaagaagttccacgtgctgctgaacatcctgagacactgcagaagactgagcgaggtgagaggcggcggcctgaccagatacgtgatcacctag

SEQ ID NO: 9606 - DNA, 627 bp, Artificial Sequence
  Description of Artificial Sequence: Synthetic coding sequence
atgagcgccggcggcgacttcggcaaccccctgagaaagttcaagctggtgttcctgggcgagcagagcgtgggcaagaccagcctgatcaccagattcatgtacgacagcttcgacaacacctaccaggccaccatcggcatcgacttcctgagcaagaccatgtacctggaggacagaaccgtgagactgcagctgtgggacaccgccggccaggagagattcagaagcctgatccccagctacatcagagacagcaccgtggccgtggtggtgtacgacatcaccaacctgaacagcttccagcagaccagcaagtggatcgacgacgtgagaaccgagagaggcagcgacgtgatcatcatgctggtgggcaacaagaccgacctggccgacaagagacagatcaccatcgaggagggcgagcagagagccaaggagctgagcgtgatgttcatcgagaccagcgccaagaccggctacaacgtgaagcagctgttcagaagagtggccagcgccctgcccggcatggagaacgtgcaggagaagagcaaggagggcatgatcgacatcaagctggacaagccccaggagccccccgccagcgagggcggctgcagctgctag

SEQ ID NO: 9607 - DNA, 3168 bp, Artificial Sequence
  Description of Artificial Sequence: Synthetic coding sequence
atgaccgtggagcagaacgtgctgcagcagagcgccgcccagaagcaccagcagaccttcctgaaccagctgagagagatcaccggcatcaacgacacccagatcctgcagcaggccctgaaggacagcaacggcaacctggagctggccgtggccttcctgaccgccaagaacgccaagaccccccagcaggaggagaccacctactaccagaccgccctgcccggcaacgacagatacatcagcgtgggcagccaggccgacaccaacgtgatcgacctgaccggcgacgacaaggacgacctgcagagagccatcgccctgagcctggccgagagcaacagagccttcagagagaccggcatcaccgacgaggagcaggccatcagcagagtgctggaggccagcatcgccgagaacaaggcctgcctgaagagaacccccaccgaggtgtggagagacagcagaaacccctacgacagaaagagacaggacaaggcccccgtgggcctgaagaacgtgggcaacacctgctggttcagcgccgtgatccagagcctgttcaacctgctggagttcagaagactggtgctgaactacaagccccccagcaacgcccaggacctgcccagaaaccagaaggagcacagaaacctgcccttcatgagagagctgagatacctgttcgccctgctggtgggcaccaagagaaagtacgtggaccccagcagagccgtggagatcctgaaggacgccttcaagagcaacgacagccagcagcaggacgtgagcgagttcacccacaagctgctggactggctggaggacgccttccagatgaaggccgaggaggagaccgacgaggagaagcccaagaaccccatggtggagctgttctacggcagattcctggccgtgggcgtgctggagggcaagaagttcgagaacaccgagatgttcggccagtaccccctgcaggtgaacggcttcaaggacctgcacgagtgcctggaggccgccatgatcgagggcgagatcgagagcctgcacagcgagaacagcggcaagagcggccaggagcactggttcaccgagctgccccccgtgctgaccttcgagctgagcagattcgagttcaaccaggccctgggcagacccgagaagatccacaacaagctggagttcccccaggtgctgtacctggacagatacatgcacagaaacagagagatcaccagaatcaagagagaggagatcaagagactgaaggactacctgaccgtgctgcagcagagactggagagatacctgagctacggcagcggccccaagagattccccctggtggacgtgctgcagtacgccctggagttcgccagcagcaagcccgtgtgcaccagccccgtggacgacatcgacgccagcagcccccccagcggcagcatccccagccagaccctgcccagcaccaccgagcagcagggcgccctgagcagcgagctgcccagcaccagccccagcagcgtggccgccatcagcagcagaagcgtgatccacaagcccttcacccagagcagaatcccccccgacctgcccatgcaccccgcccccagacacatcaccgaggaggagctgagcgtgctggagagctgcctgcacagatggagaaccgagatcgagaacgacaccagagacctgcaggagagcatcagcagaatccacagaaccatcgagctgatgtacagcgacaagagcatgatccaggtgccctacagactgcacgccgtgctggtgcacgagggccaggccaacgccggccactactgggcctacatcttcgaccacagagagagcagatggatgaagtacaacgacatcgccgtgaccaagagcagctgggaggagctggtgagagacagcttcggcggctacagaaacgccagcgcctactgcctgatgtacatcaacgacaaggcccagttcctgatccaggaggagttcaacaaggagaccggccagcccctggtgggcatcgagaccctgccccccgacctgagagacttcgtggaggaggacaaccagagattcgagaaggagctggaggagtgggacgcccagctggcccagaaggccctgcaggagaagctgctggccagccagaagctgagagagagcgagaccagcgtgaccaccgcccaggccgccggcgaccccgagtacctggagcagcccagcagaagcgacttcagcaagcacctgaaggaggagaccatccagatcatcaccaaggccagccacgagcacgaggacaagagccccgagaccgtgctgcagagcgccatcaagctggagtacgccagactggtgaagctggcccaggaggacaccccccccgagaccgactacagactgcaccacgtggtggtgtacttcatccagaaccaggcccccaagaagatcatcgagaagaccctgctggagcagttcggcgacagaaacctgagcttcgacgagagatgccacaacatcatgaaggtggcccaggccaagctggagatgatcaagcccgaggaggtgaacctggaggagtacgaggagtggcaccaggactacagaaagttcagagagaccaccatgtacctgatcatcggcctggagaacttccagagagagagctacatcgacagcctgctgttcctgatctgcgcctaccagaacaacaaggagctgctgagcaagggcctgtacagaggccacgacgaggagctgatcagccactacagaagagagtgcctgctgaagctgaacgagcaggccgccgagctgttcgagagcggcgaggacagagaggtgaacaacggcctgatcatcatgaacgagttcatcgtgcccttcctgcccctgctgctggtggacgagatggaggagaaggacatcctggccgtggaggacatgagaaacagatggtgcagctacctgggccaggagatggagccccacctgcaggagaagctgaccgacttcctgcccaagctgctggactgcagcatggagatcaagagcttccacgagccccccaagctgcccagctacagcacccacgagctgtgcgagagattcgccagaatcatgctgagcctgagcagaacccccgccgacggcagatag

SEQ ID NO: 9608 - DNA, 3264 bp, Artificial Sequence
  Description of Artificial Sequence: Synthetic coding sequence
atgaccgtggagcagaacgtgctgcagcagagcgccgcccagaagcaccagcagaccttcctgaaccagctgagagagatcaccggcatcaacgacacccagatcctgcagcaggccctgaaggacagcaacggcaacctggagctggccgtggccttcctgaccgccaagaacgccaagaccccccagcaggaggagaccacctactaccagaccgccctgcccggcaacgacagatacatcagcgtgggcagccaggccgacaccaacgtgatcgacctgaccggcgacgacaaggacgacctgcagagagccatcgccctgagcctggccgagagcaacagagccttcagagagaccggcatcaccgacgaggagcaggccatcagcagagtgctggaggccagcatcgccgagaacaaggcctgcctgaagagaacccccaccgaggtgtggagagacagcagaaacccctacgacagaaagagacaggacaaggcccccgtgggcctgaagaacgtgggcaacacctgctggttcagcgccgtgatccagagcctgttcaacctgctggagttcagaagactggtgctgaactacaagccccccagcaacgcccaggacctgcccagaaaccagaaggagcacagaaacctgcccttcatgagagagctgagatacctgttcgccctgctggtgggcaccaagagaaagtacgtggaccccagcagagccgtggagatcctgaaggacgccttcaagagcaacgacagccagcagcaggacgtgagcgagttcacccacaagctgctggactggctggaggacgccttccagatgaaggccgaggaggagaccgacgaggagaagcccaagaaccccatggtggagctgttctacggcagattcctggccgtgggcgtgctggagggcaagaagttcgagaacaccgagatgttcggccagtaccccctgcaggtgaacggcttcaaggacctgcacgagtgcctggaggccgccatgatcgagggcgagatcgagagcctgcacagcgagaacagcggcaagagcggccaggagcactggttcaccgagctgccccccgtgctgaccttcgagctgagcagattcgagttcaaccaggccctgggcagacccgagaagatccacaacaagctggagttcccccaggtgctgtacctggacagatacatgcacagaaacagagagatcaccagaatcaagagagaggagatcaagagactgaaggactacctgaccgtgctgcagcagagactggagagatacctgagctacggcagcggccccaagagattccccctggtggacgtgctgcagtacgccctggagttcgccagcagcaagcccgtgtgcaccagccccgtggacgacatcgacgccagcagcccccccagcggcagcatccccagccagaccctgcccagcaccaccgagcagcagggcgccctgagcagcgagctgcccagcaccagccccagcagcgtggccgccatcagcagcagaagcgtgatccacaagcccttcacccagagcagaatcccccccgacctgcccatgcaccccgcccccagacacatcaccgaggaggagctgagcgtgctggagagctgcctgcacagatggagaaccgagatcgagaacgacaccagagacctgcaggagagcatcagcagaatccacagaaccatcgagctgatgtacagcgacaagagcatgatccaggtgccctacagactgcacgccgtgctggtgcacgagggccaggccaacgccggccactactgggcctacatcttcgaccacagagagagcagatggatgaagtacaacgacatcgccgtgaccaagagcagctgggaggagctggtgagagacagcttcggcggctacagaaacgccagcgcctactgcctgatgtacatcaacgacaaggcccagttcctgatccaggaggagttcaacaaggagaccggccagcccctggtgggcatcgagaccctgccccccgacctgagagacttcgtggaggaggacaaccagagattcgagaaggagctggaggagtgggacgcccagctggcccagaaggccctgcaggagaagctgctggccagccagaagctgagagagagcgagaccagcgtgaccaccgcccaggccgccggcgaccccgagtacctggagcagcccagcagaagcgacttcagcaagcacctgaaggaggagaccatccagatcatcaccaaggccagccacgagcacgaggacaagagccccgagaccgtgctgcagagcatcatgatgacccccaacatgcagggcatcatcatggccatcggcaagagcagaagcgtgtacgacagatgcggccccgaggccggcttcttcaaggccatcaagctggagtacgccagactggtgaagctggcccaggaggacaccccccccgagaccgactacagactgcaccacgtggtggtgtacttcatccagaaccaggcccccaagaagatcatcgagaagaccctgctggagcagttcggcgacagaaacctgagcttcgacgagagatgccacaacatcatgaaggtggcccaggccaagctggagatgatcaagcccgaggaggtgaacctggaggagtacgaggagtggcaccaggactacagaaagttcagagagaccaccatgtacctgatcatcggcctggagaacttccagagagagagctacatcgacagcctgctgttcctgatctgcgcctaccagaacaacaaggagctgctgagcaagggcctgtacagaggccacgacgaggagctgatcagccactacagaagagagtgcctgctgaagctgaacgagcaggccgccgagctgttcgagagcggcgaggacagagaggtgaacaacggcctgatcatcatgaacgagttcatcgtgcccttcctgcccctgctgctggtggacgagatggaggagaaggacatcctggccgtggaggacatgagaaacagatggtgcagctacctgggccaggagatggagccccacctgcaggagaagctgaccgacttcctgcccaagctgctggactgcagcatggagatcaagagcttccacgagccccccaagctgcccagctacagcacccacgagctgtgcgagagattcgccagaatcatgctgagcctgagcagaacccccgccgacggcagatag

SEQ ID NO: 9609 - DNA, 2559 bp, Artificial Sequence
  Description of Artificial Sequence: Synthetic coding sequence
atgagcagcgtgagccccatccagatccccagcagactgcccctgctgctgacccacgagggcgtgctgctgcccggcagcaccatgagaaccagcgtggacagcgccagaaacctgcagctggtgagaagcagactgctgaagggcaccagcctgcagagcaccatcctgggcgtgatccccaacacccccgaccccgccagcgacgcccaggacctgccccccctgcacagaatcggcaccgccgccctggccgtgcaggtggtgggcagcaactggcccaagccccactacaccctgctgatcaccggcctgtgcagattccagatcgtgcaggtgctgaaggagaagccctaccccatcgccgaggtggagcagctggacagactggaggagttccccaacacctgcaagatgagagaggagctgggcgagctgagcgagcagttctacaagtacgccgtgcagctggtggagatgctggacatgagcgtgcccgccgtggccaagctgagaagactgctggacagcctgcccagagaggccctgcccgacatcctgaccagcatcatcagaaccagcaacaaggagaagctgcagatcctggacgccgtgagcctggaggagagattcaagatgaccatccccctgctggtgagacagatcgagggcctgaagctgctgcagaagaccagaaagcccaagcaggacgacgacaagagagtgatcgccatcagacccatcagaagaatcacccacatcagcggcaccctggaggacgaggacgaggacgaggacaacgacgacatcgtgatgctggagaagaagatcagaaccagcagcatgcccgagcaggcccacaaggtgtgcgtgaaggagatcaagagactgaagaagatgccccagagcatgcccgagtacgccctgaccagaaactacctggagctgatggtggagctgccctggaacaagagcaccaccgacagactggacatcagagccgccagaatcctgctggacaacgaccactacgccatggagaagctgaagaagagagtgctggagtacctggccgtgagacagctgaagaacaacctgaagggccccatcctgtgcttcgtgggcccccccggcgtgggcaagaccagcgtgggcagaagcgtggccaagaccctgggcagagagttccacagaatcgccctgggcggcgtgtgcgaccagagcgacatcagaggccacagaagaacctacgtgggcagcatgcccggcagaatcatcaacggcctgaagaccgtgggcgtgaacaaccccgtgttcctgctggacgaggtggacaagctgggcaagagcctgcagggcgaccccgccgccgccctgctggaggtgctggaccccgagcagaaccacaacttcaccgaccactacctgaacgtggccttcgacctgagccaggtgctgttcatcgccaccgccaacaccaccgccaccatccccgccgccctgctggacagaatggagatcatccaggtgcccggctacacccaggaggagaagatcgagatcgcccacagacacctgatccccaagcagctggagcagcacggcctgaccccccagcagatccagatcccccaggtgaccaccctggacatcatcaccagatacaccagagaggccggcgtgagaagcctggacagaaagctgggcgccatctgcagagccgtggccgtgaaggtggccgagggccagcacaaggaggccaagctggacagaagcgacgtgaccgagagagagggctgcagagagcacatcctggaggacgagaagcccgagagcatcagcgacaccaccgacctggccctgccccccgagatgcccatcctgatcgacttccacgccctgaaggacatcctgggcccccccatgtacgagatggaggtgagccagagactgagccagcccggcgtggccatcggcctggcctggacccccctgggcggcgagatcatgttcgtggaggccagcagaatggacggcgagggccagctgaccctgaccggccagctgggcgacgtgatgaaggagagcgcccacctggccatcagctggctgagaagcaacgccaagaagtaccagctgaccaacgccttcggcagcttcgacctgctggacaacaccgacatccacctgcacttccccgccggcgccgtgaccaaggacggccccagcgccggcgtgaccatcgtgacctgcctggccagcctgttcagcggcagactggtgagaagcgacgtggccatgaccggcgagatcaccctgagaggcctggtgctgcccgtgggcggcatcaaggacaaggtgctggccgcccacagagccggcctgaagcaggtgatcatccccagaagaaacgagaaggacctggagggcatccccggcaacgtgagacaggacctgagcttcgtgaccgccagctgcctggacgaggtgctgaacgccgccttcgacggcggcttcaccgtgaagaccagacccggcctgctgaacagcaagctgtag

SEQ ID NO: 9610 - DNA, 390 bp, Artificial Sequence
  Description of Artificial Sequence: Synthetic coding sequence
atggccgacggcggcggcggcggcggcaccggcgccgtgggcggcggcggcaccagccaggccagcgccggcgccgccaccggcgccaccggcgccagcggcggcggcggccccatcaaccccgccagcctgccccccggcgacccccagctgatcgccctgatcgtggagcagctgaagagcagaggcctgttcgacagcttcagaagagactgcctggccgacgtggacaccaagcccgcctaccagaacctgagacagaaggtggacaacttcgtgagcacccacctggacaagcaggagtggaaccccaccatgaacaagaaccagctgagaaacggcctgagacagagcgtggtgcagatcagacagacccccttcgagagctag

SEQ ID NO: 9611 - DNA, 1425 bp, Artificial Sequence
  Description of Artificial Sequence: Synthetic coding sequence
atggacgaggccggcagcagcgccagcggcggcggcttcagacccggcgtggacagcctggacgagccccccaacagcagaatcttcctggtgatcagcaagtacacccccgagagcgtgctgagagagagattcagccccttcggcgacatccaggacatctgggtggtgagagacaagcacaccaaggagagcaagggcatcgccttcgtgaagttcgccagaagcagccaggcctgcagagccatggaggagatgcacggccagtgcctgggccccaacgacaccaagcccatcaaggtgttcatcgcccagagcagaagcagcggcagccacagagacgtggaggacgaggagctgaccagaatcttcgtgatgatccccaagagctacaccgaggaggacctgagagagaagttcaaggtgtacggcgacatcgagtactgcagcatcatcaagaacaaggtgaccggcgagagcaagggcctgggctacgtgagatacctgaagcccagccaggccgcccaggccatcgagaactgcgacagaagcttcagagccatcctggccgagcccaagaacaaggccagcgagagcagcgagcaggactactacagcaacatgagacaggaggccctgggccacgagcccagagtgaacatgttccccttcgagcagcagagcgagttcagcagcttcgacaagaacgacagcagaggccaggaggccatcagcaagagactgagcgtggtgagcagagtgcccttcaccgaggagcagctgttcagcatcttcgacatcgtgcccggcctggagtactgcgaggtgcagagagacccctacagcaactacggccacggcgtggtgcagtacttcaacgtggccagcgccatctacgccaagtacaagctgcacggcttccagtacccccccggcaacagaatcggcgtgagcttcatcgacgacggcagcaacgccaccgacctgctgagaaagatggccacccagatggtggccgcccagctggccagcatggtgtggaacaaccccagccagcagcagttcatgcagttcggcggcagcagcggcagccagctgccccagatccagaccgacgtggtgctgcccagctgcaagaagaaggcccccgccgagacccccgtgaaggagagactgttcatcgtgttcaacccccaccccctgcccctggacgtgctggaggacatcttctgcagattcggcaacctgatcgaggtgtacctggtgagcggcaagaacgtgggctacgccaagtacgccgacagaatcagcgccaacgacgccatcgccaccctgcacggcaagatcctgaacggcgtgagactgaaggtgatgctggccgacagccccagagaggagagcaacaagagacagagaacctactag

SEQ ID NO: 9612 - DNA, 1938 bp, Artificial Sequence
  Description of Artificial Sequence: Synthetic coding sequence
atgagacccagaaaggccttcctgctgctgctgctgctgggcctggtgcagctgctggccgtggccggcgccgagggccccgacgaggacagcagcaacagagagaacgccatcgaggacgaggaggaggaggaggaggaggacgacgacgaggaggaggacgacctggaggtgaaggaggagaacggcgtgctggtgctgaacgacgccaacttcgacaacttcgtggccgacaaggacaccgtgctgctggagttctacgccccctggtgcggccactgcaagcagttcgcccccgagtacgagaagatcgccaacatcctgaaggacaaggacccccccatccccgtggccaagatcgacgccaccagcgccagcgtgctggccagcagattcgacgtgagcggctaccccaccatcaagatcctgaagaagggccaggccgtggactacgagggcagcagaacccaggaggagatcgtggccaaggtgagagaggtgagccagcccgactggacccccccccccgaggtgaccctggtgctgaccaaggagaacttcgacgaggtggtgaacgacgccgacatcatcctggtggagttctacgccccctggtgcggccactgcaagaagctggcccccgagtacgagaaggccgccaaggagctgagcaagagaagcccccccatccccctggccaaggtggacgccaccgccgagaccgacctggccaagagattcgacgtgagcggctaccccaccctgaagatcttcagaaagggcagaccctacgactacaacggccccagagagaagtacggcatcgtggactacatgatcgagcagagcggcccccccagcaaggagatcctgaccctgaagcaggtgcaggagttcctgaaggacggcgacgacgtgatcatcatcggcgtgttcaagggcgagagcgaccccgcctaccagcagtaccaggacgccgccaacaacctgagagaggactacaagttccaccacaccttcagcaccgagatcgccaagttcctgaaggtgagccagggccagctggtggtgatgcagcccgagaagttccagagcaagtacgagcccagaagccacatgatggacgtgcagggcagcacccaggacagcgccatcaaggacttcgtgctgaagtacgccctgcccctggtgggccacagaaaggtgagcaacgacgccaagagatacaccagaagacccctggtggtggtgtactacagcgtggacttcagcttcgactacagagccgccacccagttctggagaagcaaggtgctggaggtggccaaggacttccccgagtacaccttcgccatcgccgacgaggaggactacgccggcgaggtgaaggacctgggcctgagcgagagcggcgaggacgtgaacgccgccatcctggacgagagcggcaagaagttcgccatggagcccgaggagttcgacagcgacaccctgagagagttcgtgaccgccttcaagaagggcaagctgaagcccgtgatcaagagccagcccgtgcccaagaacaacaagggccccgtgaaggtggtggtgggcaagaccttcgacagcatcgtgatggaccccaagaaggacgtgctgatcgagttctacgccccctggtgcggccactgcaagcagctggagcccgtgtacaacagcctggccaagaagtacaagggccagaagggcctggtgatcgccaagatggacgccaccgccaacgacgtgcccagcgacagatacaaggtggagggcttccccaccatctacttcgcccccagcggcgacaagaagaaccccgtgaagttcgagggcggcgacagagacctggagcacctgagcaagttcatcgaggagcacgccaccaagctgagcagaaccaaggaggagctgtag

SEQ ID NO: 9613 - DNA, 1338 bp, Artificial Sequence
  Description of Artificial Sequence: Synthetic coding sequence
atgtaccccaaccccctgatctactgcacctgctgggacccctggaacctgggccccagaaagctgatcaagaccccccagctgcccagaaagaacagcaccggcagcagcaagctgacccccctggtgcccgcccccaagaaccacaactacctgcagcccaccaagcccgtggtgagccccaagatgaagatccacagcgccagacaggaggagaccaacaagagcttctacgaggtgatcaacgtgagccccggctaccagctggtgagaaacagagagcagatcagcgtgaccctgggcgacgagatgttcgacagaaagaagagatgggagagcgagatccccgacaagggcagattcagcagaaccaacatcatcagcgacctggaggagcagatcagcgagctgaccgccatcatcgagcagatgaacagagaccaccagagcgcccagaagctgctgagcagcgagatggacctgagatgcgccgagatgaagcagaacttcgagaacaagaacagagagctgaaggaggcccacgaggccgagctgagcgagctggagaacaactacaaggccgccctgaaggccgagaagctggccgcccaggagaagctggaggagatgggcaaggagtacaagtacctgaagaacatgttcagaacctaccaggacagcatctacgacgagatggaggagaagtggagcaagcagaaggccaagtggaagaaggacgagaagttcgagagagagaacatcctgctgcagcagaagaagaagatgaccaagaagttcgagatggagagcggcgaggaggacaagaagatcaacgagagctgcagcgccgtgttcgagaacttcatccaggagaaggaggagctgctgaagcagcaccagagcgacaccctgcagctggaggagctgagaaagaccaaggaggtgccctggagaagagaccagatcaacagacactggcacgacgtgctgcagcagctgctgctgatgcaggtgatgcaggaggagctgcacgcccaggccctgatcctggagagcctgaacaccaacctgtactacacccagctggagctgcagaaggagaaggccatcgtgggcaacctggagaagatgctgcagaccaagttcgccgagaccgaggagaagtacaagcacaccatccagatcctgaccgaggagaacatccacctgaagcagaagatcatcagcaagaacgaggagatctgcgagggctgcagcggcagactggccagcatcaccgtgagcaaggacgacagcgacaccgtgcaggacggcagcaagaagggccaggagagctag

SEQ ID NO: 9614 - DNA, 1872 bp, Artificial Sequence
  Description of Artificial Sequence: Synthetic coding sequence
atggagcccccccaggagaccaacagacccttcagcaccctggacaacagaagcggccaggtgcaggtgctgagcgccacccccctgctgcagagaaacccctacagcagccccgacatcatgcacatcaagggcagcgaggccagcagcgtgccctacgccctgaaccagggcaccaccgccctgcccaagaacaagaaccaggagggcaccggccacagactgctgaacatgctgagaaagaccctgaaggagagcgacagcgaggagctggagatcacccaggagacccccaacctggtgcccttcggcgacgtggtgggctgcctgggcatccacatcaagaactgcagacacttcatgcccaagatcagcctgcagcactacgccaacctgttcatcagaatcagcatcaacaaggccgtgaagtgcaccaagatgtgcagcctgctgagcaagaacgacgagaagaacaccgtgatcaagttcgacgaggtgaagtacttcagcgtgcaggtgcccagaagatacgacgacaagagaaacaacatcctgctggagctgatccagtacgacaacagagagaagagagccttcctgctgggcagcgtgcagatccacctgtacgaggtgatccagaagggctgcttcatcgaggaggtgcaggtgctgcacggcaacatcttcgtgtgcagactggaggtggagttcatgttcagctacggcaacttcggctacggcttcagccaccagctgaagcccctgcagaagatcaccgagcccagcatgttcatgaacctggcccccccccccgagagaaccgaccccgtgaccaaggtgatcaccccccagaccgtggagtaccccgccttcctgagccccgacctgaacgtgaccgtgggcacccccgccgtgcagagcagcaaccagcccagcgtggtgagactggagaagctgcagcagcagcccagagagagactggagaagatgaagaaggagtacagaaacctgaacacctggatcgacaaggccaactacctggagagcatcctgatgcccaagctggagcacaaggacagcgaggagaccaacatcgacgaggccagcgagaacaccaagagcaaccaccccgaggaggagctggagaacatcgtgggcgtggacatccccctggtgaacgaggaggccgagaccaccgccaacgagctgctggacaacgacagcgagaagggcctgaccatccccaccctgaaccagagcgaccaggacaacagcaccgccgacgccagcaagaacgacgagagcacccccagccccaccgaggtgcacagcctgtgcaccatcagcaaccaggagaccatcaaggccggcagaatcccccccctgggcgagagacagagcgagagcatgcccgacagaaagatgaagaacgtgttcttccccctggaggtgaagctgaaggacaactaccccagcatcctgaaggccgacagcagcctgagcgaggtggccttcagccccaaggagtacaacagccccagcttcagacccgagtacatcgagttcaagcccaagttccaggactgcagcgacaagttcgaggacctgcacgacatgaccagcttcacccacctgaagaaggtgaagagcagaagcagactgctgggcaagagcagcgacgacatccacaaccacgccagacacagcgccagaccctacaccgcccccgaggtgaacaagcagagagagagctacagcggcaagttcaccagcagaagaatggtgagcagcggcctggtgcacatcaacgacaagaccagcgactacgagatgcacaagatgagacccaagaagatcaagagaggctactag

SEQ ID NO: 9615 - DNA, 3594 bp, Artificial Sequence
  Description of Artificial Sequence: Synthetic coding sequence
atgcacatcaagagcatcatcctggagggcttcaagagctacgcccagagaaccgaggtgaacggcttcgaccccctgttcaacgccatcaccggcctgaacggcagcggcaagagcaacatcctggacagcatctgcttcctgctgggcatcagcaacctgagccaggtgagagccagcaacctgcaggacctggtgtacaagaacggccaggccggcatcaccaaggccagcgtgagcatcaccttcgacaacagcgacaagaagcagagccccctgggcttcgaggtgcacgacgagatcaccgtgaccagacaggtggtgatcggcggcagaaacaagtacctgatcaacggcgtgaacgccaacaacaccagagtgcaggacctgttctgcagcgtgggcctgaacgtgaacaacccccacttcctgatcatgcagggcagaatcaccaaggtgctgaacatgaagccccccgagatcctgagcatgatcgaggaggccgccggcaccagaatgtacgagtacaagaagatcgccgcccagaagaccatcgagaagaaggaggccaagctgaaggagatcaagaccatcctggaggaggagatcacccccaccatccagaagctgaaggaggagagaagcagctacctggagtaccagaaggtgatgagagagatcgagcacctgagcagactgtacatcgcctaccagttcctgctggccgaggacaccaaggtgagaagcgccgaggagctgaaggagatgcaggacaaggtgatcaagctgcaggaggagctgagcgagaacgacaagaagatcaaggccctgaaccacgagatcgaggagctggagaagagaaaggacaaggagaccggcggcatcctgagaagcctggaggacgccctggccgaggcccagagagtgaacaccaagagccagagcgccttcgacctgaagaagaagaacctggcctgcgaggagagcaagagaaaggagctggagaagaacatggtggaggacagcaagaccctggccgccaaggagaaggaggtgaagaagatcaccgacggcctgcacgccctgcaggaggccagcaacaaggacgccgaggccctggccgccgcccagcagcacttcaacgccgtgagcgccggcctgagcagcaacgaggacggcgccgaggccaccctggccggccagatgatggcctgcaagaacgacatcagcaaggcccagaccgaggccaagcaggcccagatgaagctgaagcacgcccagcaggagctgaagaacaagcaggccgaggtgaagaagatggacagcggctacagaaaggaccaggaggccctggaggccgtgaagagactgaaggagaagctggaggccgagatgaagaagctgaactacgaggagaacaaggaggagagcctgctggagaagagaagacagctgagcagagacatcggcagactgaaggagacctacgaggccctgctggccagattccccaacctgagattcgcctacaaggaccccgagaagaactggaacagaaactgcgtgaagggcctggtggccagcctgatcagcgtgaaggacaccagcgccaccaccgccctggagctggtggccggcgagagactgtacaacgtggtggtggacaccgaggtgaccggcaagaagctgctggagagaggcgagctgaagagaagatacaccatcatccccctgaacaagatcagcgccagatgcatcgcccccgagaccctgagagtggcccagaacctggtgggccccgacaacgtgcacgtggccctgagcctggtggagtacaagcccgagctgcagaaggccatggagttcgtgttcggcaccaccttcgtgtgcgacaacatggacaacgccaagaaggtggccttcgacaagagaatcatgaccagaaccgtgaccctgggcggcgacgtgttcgacccccacggcaccctgagcggcggcgccagaagccaggccgccagcatcctgaccaagttccaggagctgaaggacgtgcaggacgagctgagaatcaaggagaacgagctgagagccctggaggaggagctggccggcctgaagaacaccgccgagaagtacagacagctgaagcagcagtgggagatgaagaccgaggaggccgacctgctgcagaccaagctgcagcagagcagctaccacaagcagcaggaggagctggacgccctgaagaagaccatcgaggagagcgaggagaccctgaagaacaccaaggagatccagagaaaggccgaggagaagtacgaggtgctggagaacaagatgaagaacgccgaggccgagagagagagagagctgaaggacgcccagaagaagctggactgcgccaagaccaaggccgacgccagcagcaagaagatgaaggagaagcagcaggaggtggaggccatcaccctggagctggaggagctgaagagagagcacaccagctacaagcagcagctggaggccgtgaacgaggccatcaagagctacgagagccagatcgaggtgatggccgccgaggtggccaagaacaaggagagcgtgaacaaggcccaggaggaggtgaccaagcagaaggaggtgatcaccgcccaggacaccgtgatcaaggccaagtacgccgaggtggccaagcacaaggagcagaacaacgacagccagctgaagatcaaggagctggaccacaacatcagcaagcacaagagagaggccgaggacggcgccgccaaggtgagcaagatgctgaaggactacgactggatcaacgccgagagacacctgttcggccagcccaacagcgcctacgacttcaagaccaacaaccccaaggaggccggccagagactgcagaagctgcaggagatgaaggagaagctgggcagaaacgtgaacatgagagccatgaacgtgctgaccgaggccgaggagagatacaacgacctgatgaagaagaagagaatcgtggagaacgacaagagcaagatcctgaccaccatcgaggacctggaccagaagaagaaccaggccctgaacatcgcctggcagaaggtgaacaaggacttcggcagcatcttcagcaccctgctgcccggcgccaacgccatgctggccccccccgagggccagaccgtgctggacggcctggagttcaaggtggccctgggcaacacctggaaggagaacctgaccgagctgagcggcggccagagaagcctggtggccctgagcctgatcctgagcatgctgctgttcaagcccgcccccatctacatcctggacgaggtggacgccgccctggacctgagccacacccagaacatcggccagatgctgagaacccacttcacccacagccagttcatcgtggtgagcctgaaggagggcatgttcaacaacgccaacgtgctgttcaagaccaagttcgtggacggcgtgagcaccgtggccagattcacccagtgccagaacggcaagatcagcaaggaggccaagagcaaggccaagccccccaagggcgcccacgtggaggtgtag

SEQ ID NO: 9616 - DNA, 1080 bp, Artificial Sequence
  Description of Artificial Sequence: Synthetic coding sequence
atgagaaccgccgacagagaggccagacccggcctgcccagcctgctgctgctgctgctggccggcgccggcctgagcgccgccagcccccccgccgcccccagattcaacgtgagcctggacagcgtgcccgagctgagatggctgcccgtgctgagacactacgacctggacctggtgagagccgccatggcccaggtgatcggcgacagagtgcccaagtgggtgcacgtgctgatcggcaaggtggtgctggagctggagagattcctgccccagcccttcaccggcgagatcagaggcatgtgcgacttcatgaacctgagcctggccgactgcctgctggtgaacctggcctacgagagcagcgtgttctgcaccagcatcgtggcccaggacagcagaggccacatctaccacggcagaaacctggactaccccttcggcaacgtgctgagaaagctgaccgtggacgtgcagttcctgaagaacggccagatcgccttcaccggcaccaccttcatcggctacgtgggcctgtggaccggccagagcccccacaagttcaccgtgagcggcgacgagagagacaagggctggtggtgggagaacgccatcgccgccctgttcagaagacacatccccgtgagctggctgatcagagccaccctgagcgagagcgagaacttcgaggccgccgtgggcaagctggccaagacccccctgatcgccgacgtgtactacatcgtgggcggcaccagccccagagagggcgtggtgatcaccagaaacagagacggccccgccgacatctggcccctggaccccctgaacggcgcctggttcagagtggagaccaactacgaccactggaagcccgcccccaaggaggacgacagaagaaccagcgccatcaaggccctgaacgccaccggccaggccaacctgagcctggaggccctgttccagatcctgagcgtggtgcccgtgtacaacaacttcaccatctacaccaccgtgatgagcgccggcagccccgacaagtacatgaccagaatcagaaaccccagcagaaagtag

SEQ ID NO: 9617 - DNA, 1647 bp, Artificial Sequence
  Description of Artificial Sequence: Synthetic coding sequence
atggccctgcacgtgcccaaggcccccggcttcgcccagatgctgaaggagggcgccaagcacttcagcggcctggaggaggccgtgtacagaaacatccaggcctgcaaggagctggcccagaccaccagaaccgcctacggccccaacggcatgaacaagatggtgatcaaccacctggagaagctgttcgtgaccaacgacgccgccaccatcctgagagagctggaggtgcagcaccccgccgccaagatgatcgtgatggccagccacatgcaggagcaggaggtgggcgacggcaccaacttcgtgctggtgttcgccggcgccctgctggagctggccgaggagctgctgagaatcggcctgagcgtgagcgaggtgatcgagggctacgagatcgcctgcagaaaggcccacgagatcctgcccaacctggtgtgctgcagcgccaagaacctgagagacatcgacgaggtgagcagcctgctgagaaccagcatcatgagcaagcagtacggcaacgaggtgttcctggccaagctgatcgcccaggcctgcgtgagcatcttccccgacagcggccacttcaacgtggacaacatcagagtgtgcaagatcctgggcagcggcatcagcagcagcagcgtgctgcacggcatggtgttcaagaaggagaccgagggcgacgtgaccagcgtgaaggacgccaagatcgccgtgtacagctgccccttcgacggcatgatcaccgagaccaagggcaccgtgctgatcaagaccgccgaggagctgatgaacttcagcaagggcgaggagaacctgatggacgcccaggtgaaggccatcgccgacaccggcgccaacgtggtggtgaccggcggcaaggtggccgacatggccctgcactacgccaacaagtacaacatcatgctggtgagactgaacagcaagtgggacctgagaagactgtgcaagaccgtgggcgccaccgccctgcccagactgaccccccccgtgctggaggagatgggccactgcgacagcgtgtacctgagcgaggtgggcgacacccaggtggtggtgttcaagcacgagaaggaggacggcgccatcagcaccatcgtgctgagaggcagcaccgacaacctgatggacgacatcgagagagccgtggacgacggcgtgaacaccttcaaggtgctgaccagagacaagagactggtgcccggcggcggcgccaccgagatcgagctggccaagcagatcaccagctacggcgagacctgccccggcctggagcagtacgccatcaagaagttcgccgaggccttcgaggccatccccagagccctggccgagaacagcggcgtgaaggccaacgaggtgatcagcaagctgtacgccgtgcaccaggagggcaacaagaacgtgggcctggacatcgaggccgaggtgcccgccgtgaaggacatgctggaggccggcatcctggacacctacctgggcaagtactgggccatcaagctggccaccaacgccgccgtgaccgtgctgagagtggaccagatcatcatggccaagcccgccggcggccccaagccccccagcggcaagaaggactgggacgacgaccagaacgactag

SEQ ID NO: 9618 - DNA, 690 bp, Artificial Sequence
  Description of Artificial Sequence: Synthetic coding sequence
atgaacatcagaaacgcccagcccgacgacctgatgaacatgcagcactgcaacctgctgtgcctgcccgagaactaccagatgaagtactacctgtaccacggcctgagctggccccagctgagctacatcgccgaggacgaggacggcaagatcgtgggctacgtgctggccaagatggaggaggagcccgacgacgtgccccacggccacatcaccagcctggccgtgaagagaagccacagaagactgggcctggcccagaagctgatggaccaggccagcagagccatgatcgagaacttcaacgccaagtacgtgagcctgcacgtgagaaagagcaacagacccgccctgcacctgtacagcaacaccctgaacttccagatcagcgaggtggagcccaagtactacgccgacggcgaggacgcctacgccatgaagagagacctgagccagatggccgacgagctgagaagacagatggacctgaagaagggcggctacgtggtgctgggcagcagagagaaccaggagacccagggcagcaccctgagcgacagcgaggaggcctgccagcagaagaaccccgccaccgaggagagcggcagcgacagcaaggagcccaaggagagcgtggagagcaccaacgtgcaggacagcagcgagagcagcgacagcaccagctag

SEQ ID NO: 9619 - DNA, 1374 bp, Artificial Sequence
  Description of Artificial Sequence: Synthetic coding sequence
atgagcgccctgagaagaagcggctacggccccagcgacggccccagctacggcagatactacggccccggcggcggcgacgtgcccgtgcacccccccccccccctgtaccccctgagacccgagcccccccagccccccatcagctggagagtgagaggcggcggccccgccgagaccacctggctgggcgagggcggcggcggcgacggctactaccccagcggcggcgcctggcccgagcccggcagagccggcggcagccaccaggagcagcccccctaccccagctacaacagcaactactggaacagcaccgccagaagcagagccccctaccccagcacctaccccgtgagacccgagctgcagggccagagcctgaacagctacaccaacggcgcctacggccccacctacccccccggccccggcgccaacaccgccagctacagcggcgcctactacgcccccggctacacccagaccagctacagcaccgaggtgcccagcacctacagaagcagcggcaacagccccacccccgtgagcagatggatctacccccagcaggactgccagaccgaggccccccccctgagaggccaggtgcccggctacccccccagccagaaccccggcatgaccctgccccactacccctacggcgacggcaacagaagcgtgccccagagcggccccaccgtgagaccccaggaggacgcctgggccagccccggcgcctacggcatgggcggcagatacccctggcccagcagcgcccccagcgccccccccggcaacctgtacatgaccgagagcaccagcccctggcccagcagcggcagcccccagagcccccccagcccccccgtgcagcagcccaaggacagcagctacccctacagccagagcgaccagagcatgaacagacacaacttcccctgcagcgtgcaccagtacgagagcagcggcaccgtgaacaacgacgacagcgacctgctggacagccaggtgcagtacagcgccgagccccagctgtacggcaacgccaccagcgaccaccccaacaaccaggaccagagcagcagcctgcccgaggagtgcgtgcccagcgacgagagcaccccccccagcatcaagaagatcatccacgtgctggagaaggtgcagtacctggagcaggaggtggaggagttcgtgggcaagaagaccgacaaggcctactggctgctggaggagatgctgaccaaggagctgctggagctggacagcgtggagaccggcggccaggacagcgtgagacaggccagaaaggaggccgtgtgcaagatccaggccatcctggagaagctggagaagaagggcctgtag

SEQ ID NO: 9620 - DNA, 3201 bp, Artificial Sequence
  Description of Artificial Sequence: Synthetic coding sequence
atgcagagcaccgacctgggcaacaaggagagcggcaagatctggcacagaaagcccagccccgccaccagagacggcatcatcgtgaacatcatccacaacaccagcgactaccaccccaaggtgctgagattcctgaacgtggccttcgacggcaccggcgactgcctgatcgccggcgaccaccagggcaacatctacgtgttcgacctgcacggcaacagattcaacctggtgcagagaaccgcccaggcctgcaccgccctggccttcaacctgagaagaaagagcgagttcctggtggccctggccgactacagcatcaagtgcttcgacaccgtgaccaaggagctggtgagctggatgagaggccacgagagcagcgtgttcagcatcagcgtgcacgccagcggcaagtacgccatcaccaccagcagcgacaccgcccagctgtgggacctggacaccttccagagaaagagaaagctgaacatcagacagagcgtgggcatccagaaggtgttcttcctgcccctgagcaacaccatcctgagctgcttcaaggacaacagcatcttcgcctgggagtgcgacaccctgttctgcaagtaccagctgcccgccccccccgagagcagcagcatcctgtacaaggtgttcgccgtgaccagagacggcagaatcctggccgccggcggcaagagcaaccacctgcacctgtggtgcctggaggccagacagctgttcagaatcatccagatgcccaccaaggtgagagccatcagacacctggagttcctgcccgacagcttcgacgccggcagcaaccaggtgctgggcgtgctgagccaggacggcatcatgagattcatcaacatgcagacctgcaagctgctgttcgagatcggcagcctggacgagggcatcagcagcagcgccatcagcccccacggcagatacatcgccagcatcatggagaacggcagcctgaacatctacagcgtgcaggccctgacccaggagatcaacaagccccccccccccctggtgaaggtgatcgaggacctgcccaagaacaagctgagcagcagcgacctgaagatgaaggtgaccagcggcagagtgcagcagcccgccaagagcagagagagcaagatgcagaccagaatcctgaagcaggacctgaccggcgacttcgagagcaagaagaacgagctgcccgacggcctgaacaagaagagactgcagatcctgctgaagggctacggcgagtaccccaccaagtacagaatgttcatctggagaagcctgctgcagctgcccgagaaccacaccgccttcagcaccctgatcgacaagggcacccacgtggccttcctgaacctgcagaagaagtaccccatcaagagcagaaagctgctgagagtgctgcagagaaccctgagcgccctggcccactggagcgtgatcttcagcgacaccccctacctgcccctgctggccttccccttcgtgaagctgttccagaacaaccagctgatctgcttcgaggtgatcgccaccctgatcatcaactggtgccagcactggttcgagtacttccccaacccccccatcaacatcctgagcatgatcgagaacgtgctggccttccacgacaaggagctgctgcagcacttcatcgaccacgacatcaccagccagctgtacgcctggcccctgctggagaccgtgttcagcgaggtgctgaccagagaggagtggctgaagctgttcgacaacatcttcagcaaccaccccagcttcctgctgatgaccgtggtggcctacaacatctgcagcagaacccccctgctgagctgcaacctgaaggacgacttcgagttcttcttccaccacagaaacaacctggacatcaacgtggtgatcagacaggtgtaccacctgatggagaccacccccaccgacatccaccccgacagcatgctgaacgtgttcgtggccctgaccaagggccagtaccccgtgttcaaccagtaccccaagttcatcgtggactaccagacccaggagagagagagaatcagaaacgacgagctggactacctgagagagagacagaccgtggaggacatgcaggccaaggtggaccagcagagagtggaggacgaggcctggtaccagaagcaggagctgctgagaaaggccgaggagaccagaagagagatgctgctgcaggaggaggagaagatgatccagcagagacagagactggccgccgtgaagagagagctgaaggtgaaggagatgcacctgcaggacgccgccagaagaagattcctgaagctgcagcaggaccagcaggagatggagctgagaagactggacgacgagatcggcagaaaggtgtacatgagagacagagagatcgccgccaccgccagagacctggagatgagacagctggagctggagagccagaagagactgtacgagaagaacctgaccgagaaccaggaggccctggccaaggagatgagagccgacgccgacgcctacagaagaaaggtggacctggaggagcacatgttccacaagctgatcgaggccggcgagacccagagccagaagacccagaaggtgatcaaggagaacctggccaaggccgagcaggcctgcctgaacaccgactggcagatccagagcctgcacaagcagaagtgcgacgacctgcagagaaacaagtgctaccaggaggtggccaagctgctgagagagaacagaagaaaggagatcgagatcatcaacgccatggtggaggaggaggccaagaagtggaaggaggccgagggcaaggagttcagactgagaagcgccaagaaggccagcgccctgagcgacgccagcagaaagtggttcctgaagcaggagatcaacgccgccgtggagcacgccgagaacccctgccacaaggaggagcccagattccagaacgagcaggacagcagctgcctgcccagaaccagccagctgaacgacagcagcgagatggaccccagcacccagatcagcctgaacagaagagccgtggagtgggacaccaccggccagaacctgatcaagaaggtgagaaacctgagacagagactgaccgccagagccagacacagatgccagaccccccacctgctggccgcctag

SEQ ID NO: 9621 - DNA, 618 bp, Artificial Sequence
  Description of Artificial Sequence: Synthetic coding sequence
atggagggcaacggccccgccgccgtgcactaccagcccgccagcccccccagagacgcctgcgtgtacagcagctgctactgcgaggagaacatctggaagctgtgcgagtacatcaagaaccacgaccagtaccccctggaggagtgctacgccgtgttcatcagcaacgagagaaagatgatccccatctggaagcagcaggccagacccggcgacggccccgtgatctgggactaccacgtggtgctgctgcacgtgagcagcggcggccagaacttcatctacgacctggacaccgtgctgcccttcccctgcctgttcgacacctacgtggaggacgccttcaagagcgacgacgacatccacccccagttcagaagaaagttcagagtgatcagagccgacagctacctgaagaacttcgccagcgacagaagccacatgaaggacagcagcggcaactggagagagcccccccccccctacccctgcatcgagaccggcgacagcaagatgaacctgaacgacttcatcagcatggaccccaaggtgggctggggcgccgtgtacaccctgagcgagttcacccacagattcggcagcaagaactgctag

SEQ ID NO: 9622 - DNA, 1974 bp, Artificial Sequence
  Description of Artificial Sequence: Synthetic coding sequence
atgagccaggtgctgttccaccagctggtgcccctgcaggtgaagtgcaaggactgcgaggagagaagagtgagcatcagaatgagcatcgagctgcagagcgtgagcaaccccgtgcacagaaaggacctggtgatcagactgaccgacgacaccgaccccttcttcctgtacaacctggtgatcagcgaggaggacttccagagcctgaagttccagcagggcctgctggtggacttcctggccttcccccagaagttcatcgacctgctgcagcagtgcacccaggagcacgccaaggagatccccagattcctgctgcagctggtgagccccgccgccatcctggacaacagccccgccttcctgaacgtggtggagaccaaccccttcaagcacctgacccacctgagcctgaagctgctgcccggcaacgacgtggagatcaagaagttcctggccggctgcctgaagtgcagcaaggaggagaagctgagcctgatgcagagcctggacgacgccaccaagcagctggacttcaccagaaagaccctggccgagaagaagcaggagctggacaagctgagaaacgagtgggccagccacaccgccgccctgaccaacaagcacagccaggagctgaccaacgagaaggagaaggccctgcaggcccaggtgcagtaccagcagcagcacgagcagcagaagaaggacctggagatcctgcaccagcagaacatccaccagctgcagaacagactgagcgagctggaggccgccaacaaggacctgaccgagagaaagtacaagggcgacagcaccatcagagagctgaaggccaagctgagcggcgtggaggaggagctgcagagaaccaagcaggaggtgctgagcctgagaagagagaacagcaccctggacgtggagtgccacgagaaggagaagcacgtgaaccagctgcagaccaaggtggccgtgctggagcaggagatcaaggacaaggaccagctggtgctgagaaccaaggaggccttcgacaccatccaggagcagaaggtggtgctggaggagaacggcgagaagaaccaggtgcagctgggcaagctggaggccaccatcaagagcctgagcgccgagctgctgaaggccaacgagatcatcaagaagctgcagggcgacctgaagaccctgatgggcaagctgaagctgaagaacaccgtgaccatccagcaggagaagctgctggccgagaaggaggagaagctgcagaaggagcagaaggagctgcaggacgtgggccagagcctgagaatcaaggagcaggaggtgtgcaagctgcaggagcagctggaggccaccgtgaagaagctggaggagagcaagcagctgctgaagaacaacgagaagctgatcacctggctgaacaaggagctgaacgagaaccagctggtgagaaagcaggacgtgctgggccccagcaccaccccccccgcccacagcagcagcaacaccatcagaagcggcatcagccccaacctgaacgtggtggacggcagactgacctaccccacctgcggcatcggctaccccgtgagcagcgccttcgccttccagaacaccttcccccacagcatcagcgccaagaacaccagccaccccggcagcggcaccaaggtgcagttcaacctgcagttcaccaagcccaacgccagcctgggcgacgtgcagagcggcgccaccatcagcatgccctgcagcaccgacaaggagaacggcgagaacgtgggcctggagagcaagtacctgaagaagagagaggacagcatccccctgagaggcctgagccagaacctgttcagcaacagcgaccaccagagagacggcaccctgggcgccctgcacaccagcagcaagcccaccgccctgcccagcgccagcagcgcctacttccccggccagctgcccaacagctag

SEQ ID NO: 9623 - DNA, 237 bp, Artificial Sequence
  Description of Artificial Sequence: Synthetic coding sequence
atgagattcatgatgatgagagccgagaacttcttcatcctgagaagaaagcccgtggagggctacgacatcagcttcctgatcaccaacttccacaccgagcagatgtacaagcacaagctggtggacttcgtgatccacttcatggaggagatcgacaaggagatcagcgagatgaagctgagcgtgaacgccagagccagaatcgtggccgaggagttcctgaagaacttctag

SEQ ID NO: 9624 - DNA, 933 bp, Artificial Sequence
  Description of Artificial Sequence: Synthetic coding sequence
atgcccctgctggtggagggcagaagagtgagactgccccagagcgccggcgacctggtgagagcccacccccccctggaggagagagccagactgctgagaggccagagcgtgcagcaggtgggcccccagggcctgctgtacgtgcagcagagagagctggccgtgaccagccccaaggacggcagcatcagcatcctgggcagcgacgacgccaccacctgccacatcgtggtgctgagacacaccggcaacggcgccacctgcctgacccactgcgacggcaccgacaccaaggccgaggtgcccctgatcatgaacagcatcaagagcttcagcgaccacgcccagtgcggcagactggaggtgcacctggtgggcggcttcagcgacgacagacagctgagccagaagctgacccaccagctgctgagcgagttcgacagacaggaggacgacatccacctggtgaccctgtgcgtgaccgagctgaacgacagagaggagaacgagaaccacttccccgtgatctacggcatcgccgtgaacatcaagaccgccgagatctacagagccagcttccaggacagaggccccgaggagcagctgagagccgccagaaccctggccggcggccccatgatcagcatctacgacgccgagaccgagcagctgagaatcggcccctacagctggacccccttcccccacgtggacttctggctgcaccaggacgacaagcagatcctggagaacctgagcaccagccccctggccgagcccccccacttcgtggagcacatcagaagcaccctgatgttcctgaagaagcaccccagccccgcccacaccctgttcagcggcaacaaggccctgctgtacaagaagaacgaggacggcctgtgggagaagatcagcagccccggcagctag

SEQ ID NO: 9625 - DNA, 924 bp, Artificial Sequence
  Description of Artificial Sequence: Synthetic coding sequence
atgaccgagaccaccaagacccacgtgatcctgctggcctgcggcagcttcaaccccatcaccaagggccacatccagatgttcgagagagccagagactacctgcacaagaccggcagattcatcgtgatcggcggcatcgtgagccccgtgcacgacagctacggcaagcagggcctggtgagcagcagacacagactgatcatgtgccagctggccgtgcagaacagcgactggatcagagtggacccctgggagtgctaccaggacacctggcagaccacctgcagcgtgctggagcaccacagagacctgatgaagagagtgaccggctgcatcctgagcaacgtgaacacccccagcatgacccccgtgatcggccagccccagaacgagaccccccagcccatctaccagaacagcaacgtggccaccaagcccaccgccgccaagatcctgggcaaggtgggcgagagcctgagcagaatctgctgcgtgagaccccccgtggagagattcaccttcgtggacgagaacgccaacctgggcaccgtgatgagatacgaggagatcgagctgagaatcctgctgctgtgcggcagcgacctgctggagagcttctgcatccccggcctgtggaacgaggccgacatggaggtgatcgtgggcgacttcggcatcgtggtggtgcccagagacgccgccgacaccgacagaatcatgaaccacagcagcatcctgagaaagtacaagaacaacatcatggtggtgaaggacgacatcaaccaccccatgagcgtggtgagcagcaccaagagcagactggccctgcagcacggcgacggccacgtggtggactacctgagccagcccgtgatcgactacatcctgaagagccagctgtacatcaacgccagcggctag

SEQ ID NO: 9626 - DNA, 1476 bp, Artificial Sequence
  Description of Artificial Sequence: Synthetic coding sequence
atggaggagggcaagatggacgagaacgagtggggctaccacggcgagggcaacaagagcctggtggtggcccacgcccagagatgcgtggtgctgagattcctgaagttcccccccaacagaaagaagaccagcgaggagatcttccagcacctgcagaacatcgtggacttcggcaagaacgtgatgaaggagttcctgggcgagaactacgtgcactacggcgaggtggtgcagctgcccctggagttcgtgaagcagctgtgcctgaagatccagagcgagagacccgagagcagatgcgacaaggacctggacaccctgagcggctacgccatgtgcctgcccaacctgaccagactgcagacctacagattcgccgagcacagacccatcctgtgcgtggagatcaagcccaagtgcggcttcatccccttcagcagcgacgtgacccacgagatgaagcacaaggtgtgcagatactgcatgcaccagcacctgaaggtggccaccggcaagtggaagcagatcagcaagtactgccccctggacctgtacagcggcaacaagcagagaatgcacttcgccctgaagagcctgctgcaggaggcccagaacaacctgaagatcttcaagaacggcgagctgatctacggctgcaaggacgccagaagccccgtggccgactggagcgagctggcccaccacctgaagcccttcttcttccccagcaacggcctggccagcggcccccactgcaccagagccgtgatcagagagctggtgcacgtgatcaccagagtgctgctgagcggcagcgacaagggcagagccggcaccctgagccccggcctgggcccccagggccccagagtgtgcgaggccagccccttcagcagaagcctgagatgccagggcaagaacacccccgagagaagcggcctgcccaagggctgcctgctgtacaagaccctgcaggtgcagatgctggacctgctggacatcgagggcctgtaccccctgtacaacagagtggagagatacctggaggagttccccgaggagagaaagaccctgcagatcgacggcccctacgacgaggccttctaccagaagctgctggacctgagcaccgaggacgacggcaccgtggccttcgccctgaccaaggtgcagcagtacagagtggccatgaccgccaaggactgcagcatcatgatcgccctgagcccctgcctgcaggacgccagcagcgaccagagacccgtggtgcccagcagcagaagcagattcgccttcagcgtgagcgtgctggacctggacctgaagccctacgagagcatcccccaccagtacaagctggacggcaagatcgtgaactactacagcaagaccgtgagagccaaggacaacgccgtgatgagcaccagattcaaggagagcgaggactgcaccctggtgctgcacaaggtgtag

SEQ ID NO: 9627 - DNA, 2640 bp, Artificial Sequence
  Description of Artificial Sequence: Synthetic coding sequence
atgatgttctacagactgctgagcatcgtgggcagacagagagccagccccggctggcagaactggagcagcgccagaaacagcaccagcgccgccgaggccagaagcatggccctgcccacccaggcccaggtggtgatctgcggcggcggcatcaccggcaccagcgtggcctaccacctgagcaagatgggctggaaggacatcgtgctgctggagcagggcagactggccgccggcagcaccagattctgcgccggcatcctgagcaccgccagacacctgaccatcgagcagaagatggccgactacagcaacaagctgtactaccagctggagcaggagaccggcatccagaccggctacaccagaaccggcagcatcttcctggcccagacccaggacagactgatcagcctgaagagaatcaacgccggcctgaacgtgatcggcatccccagcgagatcatcagccccaagaaggtggccgagctgcaccacctgctgaacgtgcacgacctggtgggcgccatgcacgtgcccgaggacgccgtggtgagcagcgccgacgtggccctggccctggccagcgccgccagccagaacggcgtgcagatctacgacagaaccagcgtgctgcacgtgatggtgaagaagggccaggtgaccggcgtggagaccgacaagggccagatcgagtgccagtacttcgtgaactgcgccggccagtgggcctacgagctgggcctgagcaacgaggagcccgtgagcatccccctgcacgcctgcgagcacttctacctgctgaccagacccctggagacccccctgcagagcagcacccccaccatcgtggacgccgacggcagaatctacatcagaaactggcagggcggcatcctgagcggcggcttcgagaagaaccccaagcccatcttcaccgagggcaagaaccagctggagatccagaacctgcaggaggactgggaccacttcgagcccctgctgagcagcctgctgagaagaatgcccgagctggagaccctggagatcatgaagctggtgaactgccccgagaccttcacccccgacatgagatgcatcatgggcgagagccccgccgtgcagggctacttcgtgctggccggcatgaacagcgccggcctgagcttcggcggcggcgccggcaagtacctggccgagtggatggtgcacggctaccccagcgagaacgtgtgggagctggacctgaagagattcggcgccctgcagagcagcagaaccttcctgagacacagagtgatggaggtgatgcccctgatgtacgacctgaaggtgcccagatgggacttccagaccggcagacagctgagaaccagccccctgtacgacagactggacgcccagggcgccagatggatggagaagcacggcttcgagagacccaagtacttcgtgccccccgacaaggacctgctggccctggagcagagcaagaccttctacaagcccgactggttcgacatcgtggagagcgaggtgaagtgctgcaaggaggccgtgtgcgtgatcgacatgagcagcttcaccaagttcgagatcaccagcaccggcgaccaggccctggaggtgctgcagtacctgttcagcaacgacctggacgtgcccgtgggccacatcgtgcacaccggcatgctgaacgagggcggcggctacgagaacgactgcagcatcgccagactgaacaagagaagcttcttcatgatcagccccaccgaccagcaggtgcactgctgggcctggctgaagaagcacatgcccaaggacagcaacctgctgctggaggacgtgacctggaagtacaccgccctgaacctgatcggccccagagccgtggacgtgctgagcgagctgagctacgcccccatgacccccgaccacttccccagcctgttctgcaaggagatgagcgtgggctacgccaacggcatcagagtgatgagcatgacccacaccggcgagcccggcttcatgctgtacatccccatcgagtacgccctgcacgtgtacaacgaggtgatgagcgtgggccagaagtacggcatcagaaacgccggctactacgccctgagaagcctgagaatcgagaagttcttcgccttctggggccaggacatcaacaacctgaccacccccctggagtgcggcagagagagcagagtgaagctggagaagggcatggacttcatcggcagagacgccctgctgcagcagaagcagaacggcgtgtacaagagactgaccatgttcatcctggacgaccacgacagcgacctggacctgtggccctggtggggcgagcccatctacagaaacggccagtacgtgggcaagaccaccagcagcgcctacagctacagcctggagagacacgtgtgcctgggcttcgtgcacaacttcagcgaggacaccggcgaggagcaggtggtgaccgccgacttcatcaacagaggcgagtacgagatcgacatcgccggctacagattccaggccaaggccaagctgtaccccgtggccagcctgttcacccagaagagaagaaaggacgacatggagctgagcgacctgcacggcaagtag

SEQ ID NO: 9628 - DNA, 1440 bp, Artificial Sequence
  Description of Artificial Sequence: Synthetic coding sequence
atggccaccgacagctgggccctggccgtggacgagcaggaggccgccgccgagagcctgagcaacctgcacctgaaggaggagaagatcaagcccgacaccaacggcgccgtggtgaagaccaacgccaacgccgagaagaccgacgaggaggagaaggaggacagagccgcccagagcctgctgaacaagctgatcagaagcaacctggtggacaacaccaaccaggtggaggtgctgcagagagaccccaacagccccctgtacagcgtgaagagcttcgaggagctgagactgaagccccagctgctgcagggcgtgtacgccatgggcttcaacagacccagcaagatccaggagaacgccctgcccctgatgctggccgagcccccccagaacctgatcgcccagagccagagcggcaccggcaagaccgccgccttcgtgctggccatgctgagccaggtggagcccgccaacaagtacccccagtgcctgtgcctgagccccacctacgagctggccctgcagaccggcaaggtgatcgagcagatgggcaagttctaccccgagctgaagctggcctacgccgtgagaggcaacaagctggagagaggccagaagatcagcgagcagatcgtgatcggcacccccggcaccgtgctggactggtgcagcaagctgaagttcatcgaccccaagaagatcaaggtgttcgtgctggacgaggccgacgtgatgatcgccacccagggccaccaggaccagagcatcagaatccagagaatgctgcccagaaactgccagatgctgctgttcagcgccaccttcgaggacagcgtgtggaagttcgcccagaaggtggtgcccgaccccaacgtgatcaagctgaagagagaggaggagaccctggacaccatcaagcagtactacgtgctgtgcagcagcagagacgagaagttccaggccctgtgcaacctgtacggcgccatcaccatcgcccaggccatgatcttctgccacaccagaaagaccgccagctggctggccgccgagctgagcaaggagggccaccaggtggccctgctgagcggcgagatgatggtggagcagagagccgccgtgatcgagagattcagagagggcaaggagaaggtgctggtgaccaccaacgtgtgcgccagaggcatcgacgtggagcaggtgagcgtggtgatcaacttcgacctgcccgtggacaaggacggcaaccccgacaacgagacctacctgcacagaatcggcagaaccggcagattcggcaagagaggcctggccgtgaacatggtggacagcaagcacagcatgaacatcctgaacagaatccaggagcacttcaacaagaagatcgagagactggacaccgacgacctggacgagatcgagaagatcgccaactag

SEQ ID NO: 9629 - DNA, 3255 bp, Artificial Sequence
  Description of Artificial Sequence: Synthetic coding sequence
atggagcagcccaagggcgtggactggaccgtgatcatcctgacctgccagtacaaggacagcgtgcaggtgttccagagagagctggaggtgagacagaagagagagcagatccccgccggcaccctgctgctggccgtggaggaccccgagaagagagtgggcagcggcggcgccaccctgaacgccctgctggtggccgccgagcacctgagcgccagagccggcttcaccgtggtgaccagcgacgtgctgcacagcgcctggatcctgatcctgcacatgggcagagacttccccttcgacgactgcggcagagccttcacctgcctgcccgtggagaaccccgaggcccccgtggaggccctggtgtgcaacctggactgcctgctggacatcatgacctacagactgggccccggcagcccccccggcgtgtgggtgtgcagcaccgacatgctgctgagcgtgcccgccaaccccggcatcagctgggacagcttcagaggcgccagagtgatcgccctgcccggcagccccgcctacgcccagaaccacggcgtgtacctgaccgacccccagggcctggtgctggacatctactaccagggcaccgaggccgagatccagagatgcgtgagacccgacggcagagtgcccctggtgagcggcgtggtgttcttcagcgtggagaccgccgagagactgctggccacccacgtgagcccccccctggacgcctgcacctacctgggcctggacagcggcgccagacccgtgcagctgagcctgttcttcgacatcctgcactgcatggccgagaacgtgaccagagaggacttcctggtgggcagaccccccgagctgggccagggcgacgccgacgtggccggctacctgcagagcgccagagcccagctgtggagagagctgagagaccagcccctgaccatggcctacgtgagcagcggcagctacagctacatgaccagcagcgccagcgagttcctgctgagcctgaccctgcccggcgcccccggcgcccagatcgtgcacagccaggtggaggagcagcagctgctggccgccggcagcagcgtggtgagctgcctgctggagggccccgtgcagctgggccccggcagcgtgctgcagcactgccacctgcagggccccatccacatcggcgccggctgcctggtgaccggcctggacaccgcccacagcaaggccctgcacggcagagagctgagagacctggtgctgcagggccaccacaccagactgcacggcagccccggccacgccttcaccctggtgggcagactggacagctgggagagacagggcgccggcacctacctgaacgtgccctggagcgagttcttcaagagaaccggcgtgagagcctgggacctgtgggaccccgagaccctgcccgccgagtactgcctgcccagcgccagactgttccccgtgctgcaccccagcagagagctgggcccccaggacctgctgtggatgctggaccaccaggaggacggcggcgaggccctgagagcctggagagccagctggagactgagctgggagcagctgcagccctgcctggacagagccgccaccctggccagcagaagagacctgttcttcagacaggccctgcacaaggccagacacgtgctggaggccagacaggacctgagcctgagacccctgatctgggccgccgtgagagagggctgccccggccccctgctggccaccctggaccaggtggccgccggcgccggcgaccccggcgtggccgccagagccctggcctgcgtggccgacgtgctgggctgcatggccgagggcagaggcggcctgagaagcggccccgccgccaaccccgagtggatgagacccttcagctacctggagtgcggcgacctggccgccggcgtggaggccctggcccaggagagagacaagtggctgagcagacccgccctgctggtgagagccgccagacactacgagggcgccggccagatcctgatcagacaggccgtgatgagcgcccagcacttcgtgagcaccgagcaggtggagctgcccggccccggccagtgggtggtggccgagtgccccgccagagtggacttcagcggcggctggagcgacaccccccccctggcctacgagctgggcggcgccgtgctgggcctggccgtgagagtggacggcagaagacccatcggcgccagagccagaagaatccccgagcccgagctgtggctggccgtgggccccagacaggacgagatgaccgtgaagatcgtgtgcagatgcctggccgacctgagagactactgccagccccacgcccccggcgccctgctgaaggccgccttcatctgcgccggcatcgtgcacgtgcacagcgagctgcagctgagcgagcagctgctgagaaccttcggcggcggcttcgagctgcacacctggagcgagctgccccacggcagcggcctgggcaccagcagcatcctggccggcaccgccctggccgccctgcagagagccgccggcagagtggtgggcaccgaggccctgatccacgccgtgctgcacctggagcaggtgctgaccaccggcggcggctggcaggaccaggtgggcggcctgatgcccggcatcaaggtgggcagaagcagagcccagctgcccctgaaggtggaggtggaggaggtgaccgtgcccgagggcttcgtgcagaagctgaacgaccacctgctgctggtgtacaccggcaagaccagactggccagaaacctgctgcaggacgtgctgagaagctggtacgccagactgcccgccgtggtgcagaacgcccacagcctggtgagacagaccgaggagtgcgccgagggcttcagacagggcagcctgcccctgctgggccagtgcctgaccagctactgggagcagaagaagctgatggcccccggctgcgagcccctgaccgtgagaagaatgatggacgtgctggccccccacgtgcacggccagagcctggccggcgccggcggcggcggcttcctgtacctgctgaccaaggagccccagcagaaggaggccctggaggccgtgctggccaagaccgagggcctgggcaactacagcatccacctggtggaggtggacacccagggcctgagcctgaagctgctgggcaccgaggccagcacctgctgccccttcccctag

SEQ ID NO: 9630 - DNA, 2139 bp, Artificial Sequence
  Description of Artificial Sequence: Synthetic coding sequence
atgcagcccggcagcgcccccccccccggcagaatggaccccagcgccccccagcccagagccgagaccagcggcaaggacatctggcaccccggcgagagatgcctggcccccagccccgacaacggcaagctgtgcgaggccagcatcaagagcatcaccgtggacgagaacggcaagagcttcgccgtggtgctgtacgccgacttccaggagagaaagatccccctgaagcagctgcaggaggtgaagttcgtgaaggactgccccagaaacctgatcttcgacgacgaggacctggagaagccctacttccccaacagaaagttccccagcagcagcgtggccttcaagctgagcgacaacggcgacagcatcccctacaccatcaacagatacctgagagactaccagagagagggcaccagattcctgtacggccactacatccacggcggcggctgcatcctgggcgacgacatgggcctgggcaagaccgtgcaggtgatcagcttcctggccgccgtgctgcacaagaagggcaccagagaggacatcgagaacaacatgcccgagttcctgctgagaagcatgaagaaggagcccctgagcagcaccgccaagaagatgttcctgatcgtggcccccctgagcgtgctgtacaactggaaggacgagctggacacctggggctacttcagagtgaccgtgctgcacggcaacagaaaggacaacgagctgatcagagtgaagcagagaaagtgcgagatcgccctgaccacctacgagaccctgagactgtgcctggacgagctgaacagcctggagtggagcgccgtgatcgtggacgaggcccacagaatcaagaaccccaaggccagagtgaccgaggtgatgaaggccctgaagtgcaacgtgagaatcggcctgaccggcaccatcctgcagaacaacatgaaggagctgtggtgcgtgatggactgggccgtgcccggcctgctgggcagcggcacctacttcaagaagcagttcagcgaccccgtggagcacggccagagacacaccgccaccaagagagagctggccaccggcagaaaggccatgcagagactggccaagaagatgagcggctggttcctgagaagaaccaagaccctgatcaaggaccagctgcccaagaaggaggacagaatggtgtactgcagcctgaccgacttccagaaggccgtgtaccagaccgtgctggagaccgaggacgtgaccctgatcctgcagagcagcgagccctgcacctgcagaagcggccagaagagaagaaactgctgctacaagaccaacagccacggcgagaccgtgaagaccctgtacctgagctacctgaccgtgctgcagaaggtggccaaccacgtggccctgctgcaggccgccagcaccagcaagcagcaggagaccctgatcaagagaatctgcgaccaggtgttcagcagattccccgacttcgtgcagaagagcaaggacgccgccttcgagaccctgagcgaccccaagtacagcggcaagatgaaggtgctgcagcagctgctgaaccactgcagaaagaacagagacaaggtgctgctgttcagcttcagcaccaagctgctggacgtgctgcagcagtactgcatggccagcggcctggactacagaagactggacggcagcaccaagagcgaggagagactgaagatcgtgaaggagttcaacagcacccaggacgtgaacatctgcctggtgagcaccatggccggcggcctgggcctgaacttcgtgggcgccaacgtggtggtgctgttcgaccccacctggaaccccgccaacgacctgcaggccatcgacagagcctacagaatcggccagtgcagagacgtgaaggtgctgagactgatcagcctgggcaccgtggaggagatcatgtacctgagacagatctacaagcagcagctgcactgcgtggtggtgggcagcgagaacgccaagagatacttcgaggccgtgcagggcagcaaggagcaccagggcgagctgttcggcatccacaacctgttcaagttcagaagccagggcagctgcctgaccaaggacatcctggaggtgtag

SEQ ID NO: 9631 - DNA, 1212 bp, Artificial Sequence
  Description of Artificial Sequence: Synthetic coding sequence
atgaagcagagaaagggccagggcagcggcggcagcagaggcagaaagaagagaggcctgagcgacatcagccccagcaccagcctgccccccctggtggagggccagctgagatgcttcctgaagctgaccgtgaacagagtgatctggaagatcgccaagccccccacctgcgtgctggtgagagtgagatggtggggcgagaccagcgacggcaccctgttctgccccagagacgccctgcagaccgagcccaaggccgtgagaaccaccaccagatacgccatcagatgcggccccaagcagttcaccagctacctgaccgacatggccgtgctggtgctggaggtgatcaccaagctggacggcctgcccatcggcagagtgcagatcaacggcctggcccagctgagccccacccaccagatcaacggcttcttcaccatcgtgagcagcaccagcaagaagctgggcgagctgcaggtgagcctggccctggagcccctgagcgagacctacgacagctaccaccccctgcccaccaccgacatgaccgagaacgtgctgctgagcaagcagggcttcagagagaacaccgagcccagcagcacccagttccaggtgcccagcagacccagagacatccacaccatcaagatcgacggcaaggagctggccgccaacagcagcagaagcaccacccccagaggcaaggaccacgtgtgcttcgccgagaaccccgacaccatcaaggacagcagcttcggcctgcagcacagcctgaacagcggccagagcctggagagcgtgaccctgaagggcagagcccccagaaagcagatgagcctgctgaacagcagcgagttccagccccagatcagaaccgtggccaagagccacagcgacagctgcatcctgagcagcaacaacctgcccaccaaggacctgctgagcgccctgctggagcagggcaacaagctgagaaacgccatggtgatcagcgccatgaagagcagccccgagaccagcatgctgctggaccaggtgcaccccctgctgatgaagatcctgctggagcaccagcacagaagcgagcccttcctgggcatcggcctgaagaccaccctgaagatcaccagcagcctgcagctgagaatccacttcggcgacatgacccagaagctgatccccgagctgtacagctgctactag

SEQ ID NO: 9632 - DNA, 3663 bp, Artificial Sequence
  Description of Artificial Sequence: Synthetic coding sequence
atgggcaagaagcagaagaacaagagcgaggacagcaccaaggacgacatcgacctggacgccctggccgccgagatcgagggcgccggcgccgccaaggagcaggagccccagaagagcaagggcaagaagaagaaggagaagaagaagcaggacttcgacgaggacgacatcctgaaggagctggaggagctgagcctggaggcccagggcatcaaggccgacagagagaccgtggccgtgaagcccaccgagaacaacgaggaggagttcaccagcaaggacaagaagaagaagggccagaagggcaagaagcagagcttcgacgacaacgacagcgaggagctggaggacaaggacagcaagagcaagaagaccgccaagcccaaggtggagatgtacagcggcagcgacgacgacgacgacttcaacaagctgcccaagaaggccaagggcaaggcccagaagagcaacaagaagtgggacggcagcgaggaggacgaggacaacagcaagaagatcaaggagagaagcagaatcaacagcagcggcgagagcggcgacgagagcgacgagttcctgcagagcagaaagggccagaagaagaaccagaagaacaagcccggccccaacatcgagagcggcaacgaggacgacgacgccagcttcaagatcaagaccgtggcccagaagaaggccgagaagaaggagagagagagaaagaagagagacgaggagaaggccaagctgagaaagctgaaggagaaggaggagctggagaccggcaagaaggaccagagcaagcagaaggagagccagagaaagttcgaggaggagaccgtgaagagcaaggtgaccgtggacaccggcgtgatccccgccagcgaggagaaggccgagacccccaccgccgccgaggacgacaacgagggcgacaagaagaagaaggacaagaagaagaagaagggcgagaaggaggagaaggagaaggagaagaagaagggccccagcaaggccaccgtgaaggccatgcaggaggccctggccaagctgaaggaggaggaggagagacagaagagagaggaggaggagagaatcaagagactggaggagctggaggccaagagaaaggaggaggagagactggagcaggagaagagagagagaaagaagcagaaggagaaggagagaaaggagagactgaagaaggagggcaagctgctgaccaagagccagagagaggccagagccagagccgaggccaccctgaagctgctgcaggcccagggcgtggaggtgcccagcaaggacagcctgcccaagaagagacccatctacgaggacaagaagagaaagaagatcccccagcagctggagagcaaggaggtgagcgagagcatggagctgtgcgccgccgtggaggtgatggagcagggcgtgcccgagaaggaggagacccccccccccgtggagcccgaggaggaggaggacaccgaggacgccggcctggacgactgggaggccatggccagcgacgaggagaccgagaaggtggagggcaacaaggtgcacatcgaggtgaaggagaaccccgaggaggaggaggaggaggaggaggaggaggaggaggacgaggagagcgaggaggaggaggaggaggagggcgagagcgagggcagcgagggcgacgaggaggacgagaaggtgagcgacgagaaggacagcggcaagaccctggacaagaagcccagcaaggagatgagcagcgacagcgagtacgacagcgacgacgacagaaccaaggaggagagagcctacgacaaggccaagagaagaatcgagaagagaagactggagcacagcaagaacgtgaacaccgagaagctgagagcccccatcatctgcgtgctgggccacgtggacaccggcaagaccaagatcctggacaagctgagacacacccacgtgcaggacggcgaggccggcggcatcacccagcagatcggcgccaccaacgtgcccctggaggccatcaacgagcagaccaagatgatcaagaacttcgacagagagaacgtgagaatccccggcatgctgatcatcgacacccccggccacgagagcttcagcaacctgagaaacagaggcagcagcctgtgcgacatcgccatcctggtggtggacatcatgcacggcctggagccccagaccatcgagagcatcaacctgctgaagagcaagaagtgccccttcatcgtggccctgaacaagatcgacagactgtacgactggaagaagagccccgacagcgacgtggccgccaccctgaagaagcagaagaagaacaccaaggacgagttcgaggagagagccaaggccatcatcgtggagttcgcccagcagggcctgaacgccgccctgttctacgagaacaaggaccccagaaccttcgtgagcctggtgcccaccagcgcccacaccggcgacggcatgggcagcctgatctacctgctggtggagctgacccagaccatgctgagcaagagactggcccactgcgaggagctgagagcccaggtgatggaggtgaaggccctgcccggcatgggcaccaccatcgacgtgatcctgatcaacggcagactgaaggagggcgacaccatcatcgtgcccggcgtggagggccccatcgtgacccagatcagaggcctgctgctgcccccccccatgaaggagctgagagtgaagaaccagtacgagaagcacaaggaggtggaggccgcccagggcgtgaagatcctgggcaaggacctggagaagaccctggccggcctgcccctgctggtggcctacaaggaggacgagatccccgtgctgaaggacgagctgatccacgagctgaagcagaccctgaacgccatcaagctggaggagaagggcgtgtacgtgcaggccagcaccctgggcagcctggaggccctgctggagttcctgaagaccagcgaggtgccctacgccggcatcaacatcggccccgtgcacaagaaggacgtgatgaaggccagcgtgatgctggagcacgacccccagtacgccgtgatcctggccttcgacgtgagaatcgagagagacgcccaggagatggccgacagcctgggcgtgagaatcttcagcgccgagatcatctaccacctgttcgacgccttcaccaagtacagacaggactacaagaagcagaagcaggaggagttcaagcacatcgccgtgttcccctgcaagatcaagatcctgccccagtacatcttcaacagcagagaccccatcgtgatgggcgtgaccgtggaggccggccaggtgaagcagggcacccccatgtgcgtgcccagcaagaacttcgtggacatcggcatcgtgaccagcatcgagatcaaccacaagcaggtggacgtggccaagaagggccaggaggtgtgcgtgaagatcgagcccatccccggcgagagccccaagatgttcggcagacacttcgaggccaccgacatcctggtgagcaagatcagcagacagagcatcgacgccctgaaggactggttcagagacgagatgcagaagagcgactggcagctgatcgtggagctgaagaaggtgttcgagatcatctag

SEQ ID NO: 9633 - DNA, 138 bp, Artificial Sequence
  Description of Artificial Sequence: Synthetic coding sequence
atgagcgacaagcccgacctgagcgaggtggagaagttcgacagaagcaagctgaagaagaccaacaccgaggagaagaacaccctgcccagcaaggagaccatccagcaggagaaggagtgcgtgcagaccagctag

SEQ ID NO: 9634 - DNA, 1533 bp, Artificial Sequence
  Description of Artificial Sequence: Synthetic coding sequence
atgcccggcggcggcgccagcgccgccagcggcagactgctgaccgccgccgagcagagaggcagcagagaggccgccggcagcgccagcagaagcggcttcggcggcagcggcggcggcagaggcggcgccagcggccccggcagcggcagcggcggccccggcggccccgccggcagaatgagcctgacccccaaggagctgagcagcctgctgagcatcatcagcgaggaggccggcggcggcagcaccttcgagggcctgagcaccgccttccaccactacttcagcaaggccgaccacttcagactgggcagcgtgctggtgatgctgctgcagcagcccgacctgctgcccagcgccgcccagagactgaccgccctgtacctgctgtgggagatgtacagaaccgagcccctggccgccaaccccttcgccgccagcttcgcccacctgctgaaccccgccccccccgccagaggcggccaggagcccgacagaccccccctgagcggcttcctgccccccatcaccccccccgagaagttcttcctgagccagctgatgctggccccccccagagagctgttcaagaagacccccagacagatcgccctgatggacgtgggcaacatgggccagagcgtggacatcagcggcctgcagctggccctggccgagagacagagcgagctgcccacccagagcaaggccagcttccccagcatcctgagcgaccccgaccccgacagcagcaacagcggcttcgacagcagcgtggccagccagatcaccgaggccctggtgagcggccccaagccccccatcgagagccacttcagacccgagttcatcagaccccccccccccctgcacatctgcgaggacgagctggcctggctgaaccccaccgagcccgaccacgccatccagtgggacaagagcatgtgcgtgaagaacagcaccggcgtggagatcaagagaatcatggccaaggccttcaagagccccctgagcagcccccagcagacccagctgctgggcgagctggagaaggaccccaagctggtgtaccacatcggcctgacccccgccaagctgcccgacctggtggagaacaaccccctggtggccatcgagatgctgctgaagctgatgcagagcagccagatcaccgagtacttcagcgtgctggtgaacatggacatgagcctgcacagcatggaggtggtgaacagactgaccaccgccgtggacctgccccccgagttcatccacctgtacatcagcaactgcatcagcacctgcgagcagatcaaggacaagtacatgcagaacagactggtgagactggtgtgcgtgttcctgcagagcctgatcagaaacaagatcatcaacgtgcaggacctgttcatcgaggtgcaggccttctgcatcgagttcagcagaatcagagaggccgccggcctgttcagactgctgaagaccctggacaccggcgagacccccagcgagaccaagatgagcaagtag

SEQ ID NO: 9635 - DNA, 2184 bp, Artificial Sequence
  Description of Artificial Sequence: Synthetic coding sequence
atgagcggcagaaagagaagcttcaccttcggcgcctacggcggcgtggacaagagcttcaccagcagaagaagcgtgtggagaagcgacggccagaaccagcacttcccccaggccctggacctgagcagagtgaacctggtgcccagctacacccccagcctgtaccccaagaacaccgacctgttcgagatgatcgagaagatgcagggcagcagaatggacgagcagagatgcagcttccccccccccctgaagaccgaggaggactacatcccctaccccagcgtgcacgaggtgctgggcagagagggccccttccccctgatcctgctgccccagttcggcggctactggatcgagggcaccaaccacgagatcaccagcatccccgagaccgagcccctgcagagccccaccaccaaggtgaagctggagtgcaaccccaccgccagaatctacagaaagcacttcctgggcaaggagcacttcaactactacagcctggacgccgccctgggccacctggtgttcagcctgaagtacgacgtgatcggcgaccaggagcacctgagactgctgctgagaaccaagtgcagaacctaccacgacgtgatccccatcagctgcctgaccgagttccccaacgtggtgcagatggccaagctggtgtgcgaggacgtgaacgtggacagattctaccccgtgctgtaccccaaggccagcagactgatcgtgaccttcgacgagcacgtgatcagcaacaacttcaagttcggcgtgatctaccagaagctgggccagaccagcgaggaggagctgttcagcaccaacgaggagagccccgccttcgtggagttcctggagttcctgggccagaaggtgaagctgcaggacttcaagggcttcagaggcggcctggacgtgacccacggccagaccggcaccgagagcgtgtactgcaacttcagaaacaaggagatcatgttccacgtgagcaccaagctgccctacaccgagggcgacgcccagcagctgcagagaaagagacacatcggcaacgacatcgtggccgtggtgttccaggacgagaacacccccttcgtgcccgacatgatcgccagcaacttcctgcacgcctacgtggtggtgcaggccgagggcggcggccccgacggccccctgtacaaggtgagcgtgaccgccagagacgacgtgcccttcttcggcccccccctgcccgaccccgccgtgttcagaaagggccccgagttccaggagttcctgctgaccaagctgatcaacgccgagtacgcctgctacaaggccgagaagttcgccaagctggaggagagaaccagagccgccctgctggagaccctgtacgaggagctgcacatccacagccagagcatgatgggcctgggcggcgacgaggacaagatggagaacggcagcggcggcggcggcttcttcgagagcttcaagagagtgatcagaagcagaagccagagcatggacgccatgggcctgagcaacaagaagcccaacaccgtgagcaccagccacagcggcagcttcgcccccaacaaccccgacctggccaaggccgccggcatcagcctgatcgtgcccggcaagagccccaccagaaagaagagcggccccttcggcagcagaagaagcagcgccatcggcatcgagaacatccaggaggtgcaggagaagagagagagcccccccgccggccagaagacccccgacagcggccacgtgagccaggagcccaagagcgagaacagcagcacccagagcagccccgagatgcccaccaccaagaacagagccgagaccgccgcccagagagccgaggccctgaaggacttcagcagaagcagcagcagcgccagcagcttcgccagcgtggtggaggagaccgagggcgtggacggcgaggacaccggcctggagagcgtgagcagcagcggcaccccccacaagagagacagcttcatctacagcacctggctggaggacagcgtgagcaccaccagcggcggcagcagccccggccccagcagaagcccccaccccgacgccggcaagctgggcgaccccgcctgccccgagatcaagatccagctggaggccagcgagcagcacatgccccagctgggctgctag

SEQ ID NO: 9636 - DNA, 873 bp, Artificial Sequence
  Description of Artificial Sequence: Synthetic coding sequence
atggtgctgctgcacgtgaagagaggcgacgagagccagttcctgctgcaggcccccggcagcaccgagctggaggagctgaccgtgcaggtggccagagtgtacaacggcagactgaaggtgcagagactgtgcagcgagatggaggagctggccgagcacggcatcttcctgccccccaacatgcagggcctgaccgacgaccagatcgaggagctgaagctgaaggacgagtggggcgagaagtgcgtgcccagcggcggcgccgtgttcaagaaggacgacatcggcagaagaaacggccaggcccccaacgagaagatgaagcaggtgctgaagaagaccatcgaggaggccaaggccatcatcagcaagaagcaggtggaggccggcgtgtgcgtgaccatggagatggtgaaggacgccctggaccagctgagaggcgccgtgatgatcgtgtaccccatgggcctgcccccctacgaccccatcagaatggagttcgagaacaaggaggacctgagcggcacccaggccggcctgaacgtgatcaaggaggccgaggcccagctgtggtgggccgccaaggagctgagaagaaccaagaagctgagcgactacgtgggcaagaacgagaagaccaagatcatcgccaagatccagcagagaggccagggcgcccccgccagagagcccatcatcagcagcgaggagcagaagcagctgatgctgtactaccacagaagacaggaggagctgaagagactggaggagaacgacgacgacgcctacctgaacagcccctgggccgacaacaccgccctgaagagacacttccacggcgtgaaggacatcaagtggagacccagatag

SEQ ID NO: 9637 - DNA, 567 bp, Artificial Sequence
  Description of Artificial Sequence: Synthetic coding sequence
atggagccccccagaggcccccccgccaacggcgccgagcccagcagagccgtgggcaccgtgaaggtgtacctgcccaacaagcagagaaccgtggtgaccgtgagagacggcatgagcgtgtacgacagcctggacaaggccctgaaggtgagaggcctgaaccaggactgctgcgtggtgtacagactgatcaagggcagaaagaccgtgaccgcctgggacaccgccatcgcccccctggacggcgaggagctgatcgtggaggtgctggaggacgtgcccctgaccatgcacaacttcgtgagaaagaccttcttcagcctggccttctgcgacttctgcctgaagttcctgttccacggcttcagatgccagacctgcggctacaagttccaccagcactgcagcagcaaggtgcccaccgtgtgcgtggacatgagcaccaacagacagcagttctaccacagcgtgcaggacctgagcggcggcagcagacagcacgaggcccccagcaacagacccctgaacgagctgctgaccccccagggccccagctgcagatag

SEQ ID NO: 9638 - DNA, 2034 bp, Artificial Sequence
  Description of Artificial Sequence: Synthetic coding sequence
atggacgaccccgactgcgacagcacctgggaggaggacgaggaggacgccgaggacgccgaggacgaggactgcgaggacggcgaggccgccggcgccagagacgccgacgccggcgacgaggacgaggagagcgaggagcccagagccgccagacccagcagcttccagagcagaatgaccggcagcagaaactggagagccaccagagacatgtgcagatacagacacaactaccccgacctggtggagagagactgcaacggcgacacccccaacctgagcttctacagaaacgagatcagattcctgcccaacggctgcttcatcgaggacatcctgcagaactggaccgacaactacgacctgctggaggacaaccacagctacatccagtggctgttccccctgagagagcccggcgtgaactggcacgccaagcccctgaccctgagagaggtggaggtgttcaagagcagccaggagatccaggagagactggtgagagcctacgagctgatgctgggcttctacggcatcagactggaggacagaggcaccggcaccgtgggcagagcccagaactaccagaagagattccagaacctgaactggagaagccacaacaacctgagaatcaccagaatcctgaagagcctgggcgagctgggcctggagcacttccaggcccccctggtgagattcttcctggaggagaccctggtgagaagagagctgcccggcgtgagacagagcgccctggactacttcatgttcgccgtgagatgcagacaccagagaagacagctggtgcacttcgcctgggagcacttcagacccagatgcaagttcgtgtggggcccccaggacaagctgagaagattcaagcccagcagcctgccccaccccctggagggcagcagaaaggtggaggaggagggcagccccggcgaccccgaccacgaggccagcacccagggcagaacctgcggccccgagcacagcaagggcggcggcagagtggacgagggcccccagcccagaagcgtggagccccaggacgccggccccctggagagaagccagggcgacgaggccggcggccacggcgaggacagacccgagcccctgagccccaaggagagcaagaagagaaagctggagctgagcagaagagagcagccccccaccgagcccggcccccagagcgccagcgaggtggagaagatcgccctgaacctggagggctgcgccctgagccagggcagcctgagaaccggcacccaggaggtgggcggccaggaccccggcgaggccgtgcagccctgcagacagcccctgggcgccagagtggccgacaaggtgagaaagagaagaaaggtggacgagggcgccggcgacagcgccgccgtggccagcggcggcgcccagaccctggccctggccggcagccccgcccccagcggccaccccaaggccggccacagcgagaacggcgtggaggaggacaccgagggcagaaccggccccaaggagggcacccccggcagccccagcgagacccccggccccagccccgccggccccgccggcgacgagcccgccgagagccccagcgagacccccggccccagacccgccggccccgccggcgacgagcccgccgagagccccagcgagacccccggccccagacccgccggccccgccggcgacgagcccgccgagagccccagcgagacccccggccccagccccgccggccccaccagagacgagcccgccgagagccccagcgagacccccggccccagacccgccggccccgccggcgacgagcccgccgagagccccagcgagacccccggccccagacccgccggccccgccggcgacgagcccgccgagagccccagcgagacccccggccccagccccgccggccccaccagagacgagcccgccaaggccggcgaggccgccgagctgcaggacgccgaggtggagagcagcgccaagagcggcaagccctag

SEQ ID NO: 9639 - DNA, 735 bp, Artificial Sequence
  Description of Artificial Sequence: Synthetic coding sequence
atgggcctggagctgttcctggacctggtgagccagcccagcagagccgtgtacatcttcgccaagaagaacggcatccccctggagctgagaaccgtggacctggtgaagggccagcacaagagcaaggagttcctgcagatcaacagcctgggcaagctgcccaccctgaaggacggcgacttcatcctgaccgagagcagcgccatcctgatctacctgagctgcaagtaccagacccccgaccactggtaccccagcgacctgcaggccagagccagagtgcacgagtacctgggctggcacgccgactgcatcagaggcaccttcggcatccccctgtgggtgcaggtgctgggccccctgatcggcgtgcaggtgcccgaggagaaggtggagagaaacagaaccgccatggaccaggccctgcagtggctggaggacaagttcctgggcgacagacccttcctggccggccagcaggtgaccctggccgacctgatggccctggaggagctgatgcagcccgtggccctgggctacgagctgttcgagggcagacccagactggccgcctggagaggcagagtggaggccttcctgggcgccgagctgtgccaggaggcccacagcatcatcctgagcatcctggagcaggccgccaagaagaccctgcccacccccagccccgaggcctaccaggccatgctgctgagaatcgccagaatcccctag

SEQ ID NO: 9640 - DNA, 531 bp, Artificial Sequence
  Description of Artificial Sequence: Synthetic coding sequence
atggccgccagcaccgacatggccggcctggaggagagcttcagaaagttcgccatccacggcgaccccaaggccagcggccaggagatgaacggcaagaactgggccaagctgtgcaaggactgcaaggtggccgacggcaagagcgtgaccggcaccgacgtggacatcgtgttcagcaaggtgaagggcaagagcgccagagtgatcaactacgaggagttcaagaaggccctggaggagctggccaccaagagattcaagggcaagagcaaggaggaggccttcgacgccatctgccagctggtggccggcaaggagcccgccaacgtgggcgtgaccaaggccaagaccggcggcgccgtggacagactgaccgacaccagcagatacaccggcagccacaaggagagattcgacgagagcggcaagggcaagggcatcgccggcagacaggacatcctggacgacagcggctacgtgagcgcctacaagaacgccggcacctacgacgccaaggtgaagaagtag

SEQ ID NO: 9641 - DNA, 930 bp, Artificial Sequence
  Description of Artificial Sequence: Synthetic coding sequence
atgagcgacctgggcagcgaggagctggaggaggagggcgagaacgacatcggcgagtacgagggcggcagaaacgaggccggcgagagacacggcagaggcagagccagactgcccaacggcgacacctacgagggcagctacgagttcggcaagagacacggccagggcatctacaagttcaagaacggcgccagatacatcggcgagtacgtgagaaacaagaagcacggccagggcaccttcatctaccccgacggcagcagatacgagggcgagtgggccaacgacctgagacacggccacggcgtgtactactacatcaacaacgacacctacaccggcgagtggttcgcccaccagagacacggccagggcacctacctgtacgccgagaccggcagcaagtacgtgggcacctgggtgaacggccagcaggagggcaccgccgagctgatccacctgaaccacagataccagggcaagttcctgaacaagaaccccgtgggccccggcaagtacgtgttcgacgtgggctgcgagcagcacggcgagtacagactgaccgacatggagagaggcgaggaggaggaggaggaggagctggtgaccgtggtgcccaagtggaaggccacccagatcaccgagctggccctgtggacccccaccctgcccaagaagcccaccagcaccgacggccccggccaggacgcccccggcgccgagagcgccggcgagcccggcgaggaggcccaggccctgctggagggcttcgagggcgagatggacatgagacccggcgacgaggacgccgacgtgctgagagaggagagcagagagtacgaccaggaggagttcagatacgacatggacgagggcaacatcaacagcgaggaggaggagaccagacagagcgacctgcaggactag

SEQ ID NO: 9642 - DNA, 5943 bp, Artificial Sequence
  Description of Artificial Sequence: Synthetic coding sequence
atgaaccccaccaaccccttcagcggccagcagcccagcgccttcagcgccagcagcagcaacgtgggcaccctgcccagcaagccccccttcagattcggccagcccagcctgttcggccagaacagcaccctgagcggcaagagcagcggcttcagccaggtgagcagcttccccgccagcagcggcgtgagccacagcagcagcgtgcagaccctgggcttcacccagaccagcagcgtgggccccttcagcggcctggagcacaccagcaccttcgtggccaccagcggccccagcagcagcagcgtgctgggcaacaccggcttcagcttcaagagccccaccagcgtgggcgccttccccagcaccagcgccttcggccaggaggccggcgagatcgtgaacagcggcttcggcaagaccgagttcagcttcaagcccctggagaacgccgtgttcaagcccatcctgggcgccgagagcgagcccgagaagacccagagccagatcgccagcggcttcttcaccttcagccaccccatcagcagcgcccccggcggcctggcccccttcagcttcccccaggtgaccagcagcagcgccaccaccagcaacttcaccttcagcaagcccgtgagcagcaacaacagcctgagcgccttcacccccgccctgagcaaccagaacgtggaggaggagaagagaggccccaagagcatcttcggcagcagcaacaacagcttcagcagcttccccgtgagcagcgccgtgctgggcgagcccttccaggccagcaaggccggcgtgagacagggctgcgaggaggccgtgagccaggtggagcccctgcccagcctgatgaagggcctgaagagaaaggaggaccaggacagaagccccagaagacacggccacgagcccgccgaggacagcgaccccctgagcagaggcgaccacccccccgacaagagacccgtgagactgaacagacccagaggcggcaccctgttcggcagaaccatccaggacgtgttcaagagcaacaaggaggtgggcagactgggcaacaaggaggccaagaaggagaccggcttcgtggagagcgccgagagcgaccacatggccatccccggcggcaaccagagcgtgctggcccccagcagaatccccggcgtgaacaaggaggaggagaccgagagcagagagaagaaggaggacagcctgagaggcacccccgccagacagagcaacagaagcgagagcaccgacagcctgggcggcctgagccccagcgaggtgaccgccatccagtgcaagaacatccccgactacctgaacgacagaaccatcctggagaaccacttcggcaagatcgccaaggtgcagagaatcttcaccagaagaagcaagaagctggccgtggtgcacttcttcgaccacgccagcgccgccctggccagaaagaagggcaagagcctgcacaaggacatggccatcttctggcacagaaagaagatcagccccaacaagaagcccttcagcctgaaggagaagaagcccggcgacggcgaggtgagccccagcaccgaggacgcccccttccagcacagccccctgggcaaggccgccggcagaaccggcgccagcagcctgctgaacaagagcagccccgtgaagaagcccagcctgctgaaggcccaccagttcgagggcgacagcttcgacagcgccagcgagggcagcgagggcctgggcccctgcgtgctgagcctgagcaccctgatcggcaccgtggccgagaccagcaaggagaagtacagactgctggaccagagagacagaatcatgagacaggccagagtgaagagaaccgacctggacaaggccagaaccttcgtgggcacctgcctggacatgtgccccgagaaggagagatacatgagagagaccagaagccagctgagcgtgttcgaggtggtgcccggcaccgaccaggtggaccacgccgccgccgtgaaggagtacagcagaagcagcgccgaccaggaggagcccctgccccacgagctgagacccctgcccgtgctgagcagaaccatggactacctggtgacccagatcatggaccagaaggagggcagcctgagagactggtacgacttcgtgtggaacagaaccagaggcatcagaaaggacatcacccagcagcacctgtgcgaccccctgaccgtgagcctgatcgagaagtgcaccagattccacatccactgcgcccacttcatgtgcgaggagcccatgagcagcttcgacgccaagatcaacaacgagaacatgaccaagtgcctgcagagcctgaaggagatgtaccaggacctgagaaacaagggcgtgttctgcgccagcgaggccgagttccagggctacaacgtgctgctgagcctgaacaagggcgacatcctgagagaggtgcagcagttccaccccgccgtgagaaacagcagcgaggtgaagttcgccgtgcaggccttcgccgccctgaacagcaacaacttcgtgagattcttcaagctggtgcagagcgccagctacctgaacgcctgcctgctgcactgctacttcagccagatcagaaaggacgccctgagagccctgaacttcgcctacaccgtgagcacccagagaagcaccatcttccccctggacggcgtggtgagaatgctgctgttcagagactgcgaggaggccaccgacttcctgacctgccacggcctgaccgtgagcgacggctgcgtggagctgaacagaagcgccttcctggagcccgagggcctgagcaagaccagaaagagcgtgttcatcaccagaaagctgaccgtgagcgtgggcgagatcgtgaacggcggccccctgccccccgtgcccagacacacccccgtgtgcagcttcaacagccagaacaagtacatcggcgagagcctggccgccgagctgcccgtgagcacccagagacccggcagcgacaccgtgggcggcggcagaggcgaggagtgcggcgtggagcccgacgcccccctgagcagcctgccccagagcctgcccgcccccgcccccagccccgtgcccctgccccccgtgctggccctgacccccagcgtggcccccagcctgttccagctgagcgtgcagcccgagccccccccccccgagcccgtgcccatgtacagcgacgaggacctggcccaggtggtggacgagctgatccaggaggccctgcagagagactgcgaggaggtgggcagcgccggcgccgcctacgccgccgccgccctgggcgtgagcaacgccgccatggaggacctgctgaccgccgccaccaccggcatcctgagacacatcgccgccgaggaggtgagcaaggagagagagagaagagagcaggagagacagagagccgaggaggagagactgaagcaggagagagagctggtgctgagcgagctgagccagggcctggccgtggagctgatggagagagtgatgatggagttcgtgagagagacctgcagccaggagctgaagaacgccgtggagaccgaccagagagtgagagtggccagatgctgcgaggacgtgtgcgcccacctggtggacctgttcctggtggaggagatcttccagaccgccaaggagaccctgcaggagctgcagtgcttctgcaagtacctgcagagatggagagaggccgtgaccgccagaaagaagctgagaagacagatgagagccttccccgccgccccctgctgcgtggacgtgagcgacagactgagagccctggcccccagcgccgagtgccccatcgccgaggagaacctggccagaggcctgctggacctgggccacgccggcagactgggcatcagctgcaccagactgagaagactgagaaacaagaccgcccaccagatgaaggtgcagcacttctaccagcagctgctgagcgacgtggcctgggccagcctggacctgcccagcctggtggccgagcacctgcccggcagacaggagcacgtgttctggaagctggtgctggtgctgcccgacgtggaggagcagagccccgagagctgcggcagaatcctggccaactggctgaaggtgaagttcatgggcgacgagggcagcgtggacgacaccagcagcgacgccggcggcatccagaccctgagcctgttcaacagcctgagcagcaagggcgaccagatgatcagcgtgaacgtgtgcatcaaggtggcccacggcgccctgagcgacggcgccatcgacgccgtggagacccagaaggacctgctgggcgccagcggcctgatgctgctgctgccccccaagatgaagagcgaggacatggccgaggaggacgtgtactggctgagcgccctgctgcagctgaagcagctgctgcaggccaagcccttccagcccgccctgcccctggtggtgctggtgcccagccccggcggcgacgccgtggagaaggaggtggaggacggcctgatgctgcaggacctggtgagcgccaagctgatcagcgactacaccgtgaccgagatccccgacaccatcaacgacctgcagggcagcaccaaggtgctgcaggccgtgcagtggctggtgagccactgcccccacagcctggacctgtgctgccagaccctgatccagtacgtggaggacggcatcggccacgagttcagcggcagattcttccacgacagaagagagagaagactgggcggcctggccagccaggagcccggcgccatcatcgagctgttcaacagcgtgctgcagttcctggccagcgtggtgagcagcgagcagctgtgcgacctgagctggcccgtgaccgagttcgccgaggccggcggcagcagactgctgccccacctgcactggaacgcccccgagcacctggcctggctgaagcaggccgtgctgggcttccagctgccccagatggacctgccccccctgggcgccccctggctgcccgtgtgcagcatggtggtgcagtacgccagccagatccccagcagcagacagacccagcccgtgctgcagagccaggtggagaacctgctgcacagaacctactgcagatggaagagcaagagccccagccccgtgcacggcgccggccccagcgtgatggagatcccctgggacgacctgatcgccctgtgcatcaaccacaagctgagagactggaccccccccagactgcccgtgaccagcgaggccctgagcgaggacggccagatctgcgtgtacttcttcaagaacgacctgaagaagtacgacgtgcccctgagctgggagcaggccagactgcagacccagaaggagctgcagctgagagagggcagactggccatcaagcccttccaccccagcgccaacaacttccccatccccctgctgcacatgcacagaaactggaagagaagcaccgagtgcgcccaggagggcagaatccccagcaccgaggacctgatgagaggcgccagcgccgaggagctgctggcccagtgcctgagcagcagcctgctgctggagaaggaggagaacaagagattcgaggaccagctgcagcagtggctgagcgaggacagcggcgccttcaccgacctgaccagcctgcccctgtacctgccccagaccctggtgagcctgagccacaccatcgagcccgtgatgaagaccagcgtgaccaccagcccccagagcgacatgatgagagagcagctgcagctgagcgaggccaccggcacctgcctgggcgagagactgaagcacctggagagactgatcagaagcagcagagaggaggaggtggccagcgagctgcacctgagcgccctgctggacatggtggacatctag

SEQ ID NO: 9643 - DNA, 3147 bp, Artificial Sequence
  Description of Artificial Sequence: Synthetic coding sequence
atgagcgacgtgaacccccccagcgacacccccatccccttcagcagcagcagcacccacagcagccacatccccccctggaccttcagctgctaccccggcagcccctgcgagaacggcgtgatgctgtacatgagaaacgtgagccacgaggagctgcagagattcaagcagctgctgctgaccgagctgagcaccggcaccatgcccatcacctgggaccaggtggagaccgccagctgggccgaggtggtgcacctgctgatcgagagattccccggcagaagagcctgggacgtgaccagcaacatcttcgccatcatgaactgcgacaagatgtgcgtggtggtgagaagagagatcaacgccatcctgcccaccctggagcccgaggacctgaacgtgggcgagacccaggtgaacctggaggagggcgagagcggcaagatcagaagatacaagagcaacgtgatggagaagttcttccccatctgggacatcaccacctggcccggcaaccagagagacttcttctaccagggcgtgcacagacacgaggagtacctgccctgcctgctgctgcccaagagaccccagggcagacagcccaagaccgtggccatccagggcgcccccggcatcggcaagaccatcctggccaagaaggtgatgttcgagtgggccagaaacaagttctacgcccacaagagatggtgcgccttctacttccactgccaggaggtgaaccagaccaccgaccagagcttcagcgagctgatcgagcagaagtggcccggcagccaggacctggtgagcaagatcatgagcaagcccgaccagctgctgctgctgctggacggcttcgaggagctgaccagcaccctgatcgacagactggaggacctgagcgaggactggagacagaagctgcccggcagcgtgctgctgagcagcctgctgagcaagaccatgctgcccgaggccaccctgctgatcatgatcagattcaccagctggcagacctgcaagcccctgctgaagtgccccagcctggtgaccctgcccggcttcaacaccatggagaagatcaagtacttccagatgtacttcggccacaccgaggagggcgaccaggtgctgagcttcgccatggagaacaccatcctgttcagcatgtgcagagtgcccgtggtgtgctggatggtgtgcagcggcctgaagcagcagatggagagaggcaacaacctgacccagagctgccccaacgccaccagcgtgttcgtgagatacatcagcagcctgttccccaccagagccgagaacttcagcagaaagatccaccaggcccagctggagggcctgtgccacctggccgccgacagcatgtggcacagaaagtgggtgctgggcaaggaggacctggaggaggccaagctggaccagaccggcgtgaccgccttcctgggcatgagcatcctgagaagaatcgccggcgaggaggaccactacgtgttcaccctggtgaccttccaggagttcttcgccgccctgttctacgtgctgtgcttcccccagagactgaagaacttccacgtgctgagccacgtgaacatccagagactgatcgccagccccagaggcagcaagagctacctgagccacatgggcctgttcctgttcggcttcctgaacgaggcctgcgccagcgccgtggagcagagcttccagtgcaaggtgagcttcggcaacaagagaaagctgctgaaggtgatccccctgctgcacaagtgcgacccccccagccccggcagcggcgtgccccagctgttctactgcctgcacgagatcagagaggaggccttcgtgagccaggccctgaacgactaccacaaggtggtgctgagaatcggcaacaacaaggaggtgcaggtgagcgccttctgcctgaagagatgccagtacctgcacgaggtggagctgaccgtgaccctgaacttcatgaacgtgtggaagctgagcagcagcagccaccccggcagcgaggcccccgagagcaacggcctgcacagatggtggcaggacctgtgcagcgtgttcgccaccaacgacaagctggaggtgctgaccatgaccaacagcgtgctgggcccccccttcctgaaggccctggccgccgccctgagacacccccagtgcaagctgcagaagctgctgctgagaagagtgaacagcaccatgctgaaccaggacctgatcggcgtgctgaccggcaaccagcacctgagatacctggagatccagcacgtggaggtggagagcaaggccgtgaagctgctgtgcagagtgctgagaagccccagatgcagactgcagtgcctgagactggaggactgcctggccacccccagaatctggaccgacctgggcaacaacctgcagggcaacggccacctgaagaccctgatcctgagaaagaacagcctggagaactgcggcgcctactacctgagcgtggcccagctggagagactgagcatcgagaactgcaacctgacccagctgacctgcgagagcctggccagctgcctgagacagagcaagatgctgacccacctgagcctggccgagaacgccctgaaggacgagggcgccaagcacatctggaacgccctgccccacctgagatgccccctgcagagactggtgctgagaaagtgcgacctgaccttcaactgctgccaggacatgatcagcgccctgtgcaagaacaagaccctgaagagcctggacctgagcttcaacagcctgaaggacgacggcgtgatcctgctgtgcgaggccctgaagaaccccgactgcaccctgcagatcctggagctggagaactgcctgttcaccagcatctgctgccaggccatggccagcatgctgagaaagaaccagcacctgagacacctggacctgagcaagaacgccatcggcgtgtacggcatcctgaccctgtgcgaggccttcagcagccagaagaagagagaggaggtgatcttctgcatccccgcctggaccagaatcaccagcttcagccccaccccccacccccccgacttcaccggcaagagcgactgcctgagccagatcaacccctag

SEQ ID NO: 9644 - DNA, 3792 bp, Artificial Sequence
  Description of Artificial Sequence: Synthetic coding sequence
atgcccgccagaatcggctactacgagatcgacagaaccatcggcaagggcaacttcgccgtggtgaagagagccacccacctggtgaccaaggccaaggtggccatcaagatcatcgacaagacccagctggacgaggagaacctgaagaagatcttcagagaggtgcagatcatgaagatgctgtgccacccccacatcatcagactgtaccaggtgatggagaccgagagaatgatctacctggtgaccgagtacgccagcggcggcgagatcttcgaccacctggtggcccacggcagaatggccgagaaggaggccagaagaaagttcaagcagatcgtgaccgccgtgtacttctgccactgcagaaacatcgtgcacagagacctgaaggccgagaacctgctgctggacgccaacctgaacatcaagatcgccgacttcggcttcagcaacctgttcacccccggccagctgctgaagacctggtgcggcagccccccctacgccgcccccgagctgttcgagggcaaggagtacgacggccccaaggtggacatctggagcctgggcgtggtgctgtacgtgctggtgtgcggcgccctgcccttcgacggcagcaccctgcagaacctgagagccagagtgctgagcggcaagttcagaatccccttcttcatgagcaccgagtgcgagcacctgatcagacacatgctggtgctggaccccaacaagagactgagcatggagcagatctgcaagcacaagtggatgaagctgggcgacgccgaccccaacttcgacagactgatcgccgagtgccagcagctgaaggaggagagacaggtggaccccctgaacgaggacgtgctgctggccatggaggacatgggcctggacaaggagcagaccctgcagagcctgagaagcgacgcctacgaccactacagcgccatctacagcctgctgtgcgacagacacaagagacacaagaccctgagactgggcgccctgcccagcatgcccagagccctggccttccaggcccccgtgaacatccaggccgagcaggccggcaccgccatgaacatcagcgtgccccaggtgcagctgatcaaccccgagaaccagatcgtggagcccgacggcaccctgaacctggacagcgacgagggcgaggagcccagccccgaggccctggtgagatacctgagcatgagaagacacaccgtgggcgtggccgaccccagaaccgaggtgatggaggacctgcagaagctgctgcccggcttccccggcgtgaacccccaggcccccttcctgcaggtggcccccaacgtgaacttcatgcacaacctgctgcccatgcagaacctgcagcccaccggccagctggagtacaaggagcagagcctgctgcagccccccaccctgcagctgctgaacggcatgggccccctgggcagaagagccagcgacggcggcgccaacatccagctgcacgcccagcagctgctgaagagacccagaggccccagccccctggtgaccatgacccccgccgtgcccgccgtgacccccgtggacgaggagagcagcgacggcgagcccgaccaggaggccgtgcagagcagcacctacaaggacagcaacaccctgcacctgcccaccgagagattcagccccgtgagaagattcagcgacggcgccgccagcatccaggccttcaaggcccacctggagaagatgggcaacaacagcagcatcaagcagctgcagcaggagtgcgagcagctgcagaagatgtacggcggccagatcgacgagagaaccctggagaagacccagcagcagcacatgctgtaccagcaggagcagcaccaccagatcctgcagcagcagatccaggacagcatctgccccccccagcccagcccccccctgcaggccgcctgcgagaaccagcccgccctgctgacccaccagctgcagagactgagaatccagcccagcagccccccccccaaccaccccaacaaccacctgttcagacagcccagcaacagccccccccccatgagcagcgccatgatccagccccacggcgccgccagcagcagccagttccagggcctgcccagcagaagcgccatcttccagcagcagcccgagaactgcagcagcccccccaacgtggccctgacctgcctgggcatgcagcagcccgcccagagccagcaggtgaccatccaggtgcaggagcccgtggacatgctgagcaacatgcccggcaccgccgccggcagcagcggcagaggcatcagcatcagccccagcgccggccagatgcagatgcagcacagaaccaacctgatggccaccctgagctacggccacagacccctgagcaagcagctgagcgccgacagcgccgaggcccacagcctgaacgtgaacagattcagccccgccaactacgaccaggcccacctgcacccccacctgttcagcgaccagagcagaggcagccccagcagctacagccccagcaccggcgtgggcttcagccccacccaggccctgaaggtgccccccctggaccagttccccaccttcccccccagcgcccaccagcagcccccccactacaccaccagcgccctgcagcaggccctgctgagccccaccccccccgactacaccagacaccagcaggtgccccacatcctgcagggcctgctgagccccagacacagcctgaccggccacagcgacatcagactgccccccaccgagttcgcccagctgatcaagagacagcagcagcagagacagcagcagcagcagcagcagcagcagcaggagtaccaggagctgttcagacacatgaaccagggcgacgccggcagcctggcccccagcctgggcggccagagcatgaccgagagacaggccctgagctaccagaacgccgacagctaccaccaccacaccagcccccagcacctgctgcagatcagagcccaggagtgcgtgagccaggccagcagccccacccccccccacggctacgcccaccagcccgccctgatgcacagcgagagcatggaggaggactgcagctgcgagggcgccaaggacggcttccaggacagcaagagcagcagcaccctgaccaagggctgccacgacagccccctgctgctgagcaccggcggccccggcgaccccgagagcctgctgggcaccgtgagccacgcccaggagctgggcatccacccctacggccaccagcccaccgccgccttcagcaagaacaaggtgcccagcagagagcccgtgatcggcaactgcatggacagaagcagccccggccaggccgtggagctgcccgaccacaacggcctgggctaccccgccagacccagcgtgcacgagcaccacagacccagagccctgcagagacaccacaccatccagaacagcgacgacgcctacgtgcagctggacaacctgcccggcatgagcctggtggccggcaaggccctgagcagcgccagaatgagcgacgccgtgctgagccagagcagcctgatgggcagccagcagttccaggacggcgagaacgaggagtgcggcgccagcctgggcggccacgagcaccccgacctgagcgacggcagccagcacctgaacagcagctgctaccccagcacctgcatcaccgacatcctgctgagctacaagcaccccgaggtgagcttcagcatggagcaggccggcgtgtag

SEQ ID NO: 9645 - DNA, 4395 bp, Artificial Sequence
  Description of Artificial Sequence: Synthetic coding sequence
atgtaccagcccgaggacgacaacaacagcgacgtgaccagcgacgacgacatgaccagaaacagaagagagagcagccccccccacagcgtgcacagcttcagcggcgacagagactgggacagaagaggcagaagcagagacatggagcccagagacagatggagccacaccagaaaccccagaagcagaatgccccccagagacctgagcctgcccgtggtggccaagaccagcttcgagatggacagagaggacgacagagacagcagagcctacgagagcagaagccaggacgccgagagctaccagaacgtggtggacctggccgaggacagaaagccccacaacaccatccaggacaacatggagaactacagaaagctgctgagcctgggcgtgcagctggccgaggacgacggccacagccacatgacccagggccacagcagcagaagcaagagaagcgcctaccccagcaccagcagaggcctgaagaccatgcccgaggccaagaagagcacccacagaagaggcatctgcgaggacgagagcagccacggcgtgatcatggagaagttcatcaaggacgtgagcagaagcagcaagagcggcagagccagagagagcagcgacagaagccagagattccccagaatgagcgacgacaactggaaggacatcagcctgaacaagagagagagcgtgatccagcagagagtgtacgagggcaacgccttcagaggcggcttcagattcaacagcaccctggtgagcagaaagagagtgctggagagaaagagaagataccacttcgacaccgacggcaagggcagcatccacgaccagaagggctgccccagaaagaagcccttcgagtgcggcagcgagatgagaaaggccatgagcgtgagcagcctgagcagcctgagcagccccagcttcaccgagagccagcccatcgacttcggcgccatgccctacgtgtgcgacgagtgcggcagaagcttcagcgtgatcagcgagttcgtggagcaccagatcatgcacaccagagagaacctgtacgagtacggcgagagcttcatccacagcgtggccgtgagcgaggtgcagaagagccaggtgggcggcaagagattcgagtgcaaggactgcggcgagaccttcaacaagagcgccgccctggccgagcacagaaagatccacgccagaggctacctggtggagtgcaagaaccaggagtgcgaggaggccttcatgcccagccccaccttcagcgagctgcagaagatctacggcaaggacaagttctacgagtgcagagtgtgcaaggagaccttcctgcacagcagcgccctgatcgagcaccagaagatccacttcggcgacgacaaggacaacgagagagagcacgagagagagagagagagagagagaggcgagaccttcagacccagccccgccctgaacgagttccagaagatgtacggcaaggagaagatgtacgagtgcaaggtgtgcggcgagaccttcctgcacagcagcagcctgaaggagcaccagaagatccacaccagaggcaaccccttcgagaacaagggcaaggtgtgcgaggagaccttcatccccggccagagcctgaagagaagacagaagacctacaacaaggagaagctgtgcgacttcaccgacggcagagacgccttcatgcagagcagcgagctgagcgagcaccagaagatccacagcagaaagaacctgttcgagggcagaggctacgagaagagcgtgatccacagcggccccttcaccgagagccagaagagccacaccatcaccagacccctggagagcgacgaggacgagaaggccttcaccatcagcagcaacccctacgagaaccagaagatccccaccaaggagaacgtgtacgaggccaagagctacgagagaagcgtgatccacagcctggccagcgtggaggcccagaagagccacagcgtggccggccccagcaagcccaaggtgatggccgagagcaccatccagagcttcgacgccatcaaccaccagagagtgagagccggcggcaacaccagcgagggcagagagtacagcagaagcgtgatccacagcctggtggccagcaagccccccagaagccacaacggcaacgagctggtggagagcaacgagaagggcgagagcagcatctacatcagcgacctgaacgacaagagacagaagatccccgccagagagaacccctgcgagggcggcagcaagaacagaaactacgaggacagcgtgatccagagcgtgttcagagccaagccccagaagagcgtgcccggcgagggcagcggcgagttcaagaaggacggcgagttcagcgtgcccagcagcaacgtgagagagtaccagaaggccagagccaagaagaagtacatcgagcacagaagcaacgagaccagcgtgatccacagcctgcccttcggcgagcagaccttcagacccagaggcatgctgtacgagtgccaggagtgcggcgagtgcttcgcccacagcagcgacctgaccgagcaccagaagatccacgacagagagaagcccagcggcagcagaaactacgagtggagcgtgatcagaagcctggcccccaccgacccccagaccagctacgcccaggagcagtacgccaaggagcaggccagaaacaagtgcaaggacttcagacagttcttcgccaccagcgaggacctgaacaccaaccagaagatctacgaccaggagaagagccacggcgaggagagccagggcgagaacaccgacggcgaggagacccacagcgaggagacccacggccaggagaccatcgaggaccccgtgatccagggcagcgacatggaggacccccagaaggacgaccccgacgacaagatctacgagtgcgaggactgcggcctgggcttcgtggacctgaccgacctgaccgaccaccagaaggtgcacagcagaaagtgcctggtggacagcagagagtacacccacagcgtgatccacacccacagcatcagcgagtaccagagagactacaccggcgagcagctgtacgagtgccccaagtgcggcgagagcttcatccacagcagcttcctgttcgagcaccagagaatccacgagcaggaccagctgtacagcatgaagggctgcgacgacggcttcatcgccctgctgcccatgaagcccagaagaaacagagccgccgagagaaaccccgccctggccggcagcgccatcagatgcctgctgtgcggccagggcttcatccacagcagcgccctgaacgagcacatgagactgcacagagaggacgacctgctggagcagagccagatggccgaggaggccatcatccccggcctggccctgaccgagttccagagaagccagaccgaggagagactgttcgagtgcgccgtgtgcggcgagagcttcgtgaaccccgccgagctggccgaccacgtgaccgtgcacaagaacgagccctacgagtacggcagcagctacacccacaccagcttcctgaccgagcccctgaagggcgccatccccttctacgagtgcaaggactgcggcaagagcttcatccacagcaccgtgctgaccaagcacaaggagctgcacctggaggaggaggaggaggacgaggccgccgccgccgccgccgccgccgcccaggaggtggaggccaacgtgcacgtgccccaggtggtgctgagaatccagggcctgaacgtggaggccgccgagcccgaggtggaggccgccgagcccgaggtggaggccgccgagcccgaggtggaggccgccgagcccaacggcgaggccgagggccccgacggcgaggccgccgagcccatcggcgaggccggccagcccaacggcgaggccgagcagcccaacggcgacgccgacgagcccgacggcgccggcatcgaggaccccgaggagagagccgaggagcccgagggcaaggccgaggagcccgagggcgacgccgacgagcccgacggcgtgggcatcgaggaccccgaggagggcgaggaccaggagatccaggtggaggagccctactacgactgccacgagtgcaccgagaccttcaccagcagcaccgccttcagcgagcacctgaagacccacgccagcatgatcatcttcgagcccgccaacgccttcggcgagtgcagcggctacatcgagagagccagcaccagcaccggcggcgccaaccaggccgacgagaagtacttcaagtgcgacgtgtgcggccagctgttcaacgacagactgagcctggccagacaccagaacacccacaccggctag

SEQ ID NO: 9646 - DNA, 1302 bp, Artificial Sequence
  Description of Artificial Sequence: Synthetic coding sequence
atggccgaggcccagagcggcaccggccagctgcaggagcagaagaagggcctgctgatcgccgtgagcgtgagcgtggacaagatcatcagccacttcggcgccgccagaaacctggtgcagaaggcccagctgggcgacagcagactgagccccgacgtgggccacctggtgctgaccaccctgtgccccgccctgcacgccctggtggccgacggcctgaagcccttcagaaaggacctgatcaccggccagagaagaagcagcccctggagcgtggtggaggccagcgtgaagcccggcagcagcaccagaagcctgggcaccctgtacagccaggtgagcagactggcccccctgagcagcagcagaagcagattccacgccttcatcctgggcctgctgaacaccaagcagctggagctgtggttcagcagcctgcaggaggacgccggcctgctgagcctgctgtacctgcccaccggcttcttcagcctggccagaggcggctgccccagcctgagcaccgagctgctgctgctgctgcagcccctgagcgtgctgaccttccacctggacctgctgttcgagcaccaccaccacctgcccctgggccccccccaggcccccgccccccccggccccccccccgccctgcagcagaccatgcaggccatgctgcacttcggcggcagactggcccagagcctgagaggcaccagcaaggaggccgccagcgaccccagcgacagccccaacctgcccacccccggcagctggtgggagcagctgacccaggccagcagagtgtacgccagcggcggcaccgagggcttccccctgagcagatgggcccccggcagacacggcaccgccgccgaggagggcgcccaggagagacccctgcccaccgacgagatggcccccggcagaggcctgtggctgggcagactgttcggcgtgcccggcggccccgccgagaacgagaacggcgccctgaagagcagaagacccagcagctggctgccccccaccgtgagcgtgctggccctggtgaagagaggcgccccccccgagatgcccagcccccaggagctggaggccagcgcccccagaatggtgcagacccacagagccgtgagagccctgtgcgaccacaccgccgccagacccgaccagctgagcttcagaagaggcgaggtgctgagagtgatcaccaccgtggacgaggactggctgagatgcggcagagacggcatggagggcctggtgcccgtgggctacaccagcctggtgctgtag

SEQ ID NO: 9647 - DNA, 1584 bp, Artificial Sequence
  Description of Artificial Sequence: Synthetic coding sequence
atggcccagaccctgcagatggagatccccaacttcggcaacagcatcctggagtgcctgaacgagcagagactgcagggcctgtactgcgacgtgagcgtggtggtgaagggccacgccttcaaggcccacagagccgtgctggccgccagcagcagctacttcagagacctgttcaacaacagcagaagcgccgtggtggagctgcccgccgccgtgcagccccagagcttccagcagatcctgagcttctgctacaccggcagactgagcatgaacgtgggcgaccagttcctgctgatgtacaccgccggcttcctgcagatccaggagatcatggagaagggcaccgagttcttcctgaaggtgagcagccccagctgcgacagccagggcctgcacgccgaggaggcccccagcagcgagccccagagccccgtggcccagaccagcggctggcccgcctgcagcacccccctgcccctggtgagcagagtgaagaccgagcagcaggagagcgacagcgtgcagtgcatgcccgtggccaagagactgtgggacagcggccagaaggaggccggcggcggcggcaacggcagcagaaagatggccaagttcagcacccccgacctggccgccaacagaccccaccagcccccccccccccagcaggcccccgtggtggccgccgcccagcccgccgtggccgccggcgccggccagcccgccggcggcgtggccgccgccggcggcgtggtgagcggccccagcaccagcgagagaaccagccccggcaccagcagcgcctacaccagcgacagccccggcagctaccacaacgaggaggacgaggaggaggacggcggcgaggagggcatggacgagcagtacagacagatctgcaacatgtacaccatgtacagcatgatgaacgtgggccagaccgccgagaaggtggaggccctgcccgagcaggtggcccccgagagcagaaacagaatcagagtgagacaggacctggccagcctgcccgccgagctgatcaaccagatcggcaacagatgccaccccaagctgtacgacgagggcgaccccagcgagaagctggagctggtgaccggcaccaacgtgtacatcaccagagcccagctgatgaactgccacgtgagcgccggcaccagacacaaggtgctgctgagaagactgctggccagcttcttcgacagaaacaccctggccaacagctgcggcaccggcatcagaagcagcaccaacgaccccagaagaaagcccctggacagcagagtgctgcacgccgtgaagtactactgccagaacttcgcccccaacttcaaggagagcgagatgaacgccatcgccgccgacatgtgcaccaacgccagaagagtggtgagaaagagctggatgcccaaggtgaaggtgctgaaggccgaggacgacgcctacaccaccttcatcagcgagaccggcaagatcgagcccgacatgatgggcgtggagcacggcttcgagaccgccagccacgagggcgaggccggccccagcgccgaggccctgcagtag

SEQ ID NO: 9648 - DNA, 672 bp, Artificial Sequence
  Description of Artificial Sequence: Synthetic coding sequence
atggaggtgcagaaggaggcccagagaatcatgaccctgagcgtgtggaagatgtaccacagcagaatgcagagaggcggcctgagactgcacagaagcctgcagctgagcctggtgatgagaagcgccagagagctgtacctgagcgccaaggtggaggccctggagcccgaggtgagcctgcccgccgccctgcccagcgaccccagactgcacccccccagagaggccgagagcaccgccgagaccgccacccccgacggcgagcaccccttccccgagcccatggacacccaggaggcccccaccgccgaggagaccagcgcctgctgcgcccccagacccgccaaggtgagcagaaagagaagaagcagcagcctgagcgacggcggcgacgccggcctggtgcccagcaagaaggccagactggaggagaaggaggaggaggagggcgccagcagcgaggtggccgacagactgcagcccccccccgcccaggccgagggcgccttccccaacctggccagagtgctgcagagaagattcagcggcctgctgaactgcagccccgccgccccccccaccgccccccccgcctgcgaggccaagcccgcctgcagacccgccgacagcatgctgaacgtgctggtgagagccgtggtggccttctag

SEQ ID NO: 9649 - DNA, 1500 bp, Artificial Sequence
  Description of Artificial Sequence: Synthetic coding sequence
atgagagtgctggtgccccccgccgagagaagccaggacaccagagtgggcgcccccgcctggagagaggccgcccaggccatggccagaaccgcccacatcctgaccgacagatgcggccaggaggccgtgaccatgtggcagcccaaggacagcgtgctggaccccaacgtggcccaccacctgggcagagccgcctacatccagccctggagattcagagtggagatgatcaagggcggcggcaccctggagaagcccccccccggcgagggcgtgaccctgtggaagggcaagatgaagccccccgcctggtacgccagactgcccctgcccctgcacagaaaggccagagccctgcagaccaccgaggtggtgcacgcccacgccagaggcgccagactgaccgccgccagactgggcagagcccagcaccagatcaacggcagagtgagacagctgctgagacagagagaggtgaccgaccacagactgagcgaggtgagaaagggcctgctgatcaaccagcagagcgtgaagctgagaggctacagacccaagagcgagaaggtgcccgacaaggccgacagcatgctgacctgggagaaggaggagctgaagagcatgaagagaaagatggagagagacatggagaagagcgaggtgctgctgaagaccctggccagctgcagagacaccctgaacttctgcttcaaggagagactgcaggccgtggacctgatgaaccagcccctggacaaggtgctggagcaggccagaagacacagctgggtgaacctgagcagagcccccacccccagaacccagggccagaagacccccccccccgaccccgtgggcacctacaaccccgcctgcgccctggccctgaacgaggccaagagactgctggtggagagcaaggacaccctggtggagatggccaagaacgaggtggacgtgagagagcagcagctgcagatcagcgacagagtgtgcgccagcctggcccagaaggccagcgagaccctggagctgaaggagagactgaacatgaccctgggcctgatgagaggcaccatcctgagatgcaccaagtacaaccaggagctgtacaccacccacggcctgatcaagggccccctgagcaaggtgcacctggagaccgccgagaagctggacagacccctggtgagaatgtaccagagacacgtgggcacccagctgcccgaggccgccagactggcccagggcaccgacaagctgcagtgccacatcacctacctggagaagaacctggacgagctgctggccacccacaagaacctgagctggggcctgaactgcaagaacatcggccacgaggtggacggcaacgtggtgagactgagactgagacagagacagccccacgtgtgctacgagcaggcccagagactggtgaaggactgggaccccagaacccccccccccagaagcaagagcagcgccgacccctag

SEQ ID NO: 9650 - DNA, 1827 bp, Artificial Sequence
  Description of Artificial Sequence: Synthetic coding sequence
atggagatggagagcgccgccgccagcaccagattccaccagccccacatggagagaaagatgagcgccatggcctgcgagatcttcaacgagctgagactggagggcaagctgtgcgacgtggtgatcaaggtgaacggcttcgagttcagcgcccacaagaacatcctgtgcagctgcagcagctacttcagagccctgttcaccagcggctggaacaacaccgagaagaaggtgtacaacatccccggcatcagccccgacatgatgaagctgatcatcgagtacgcctacaccagaaccgtgcccatcacccccgacaacgtggagaagctgctggccgccgccgaccagttcaacatcatgggcatcgtgagaggctgctgcgagttcctgaagagcgagctgtgcctggacaactgcatcggcatctgcaagttcaccgactactactactgccccgagctgagacagaaggcctacatgttcatcctgcacaacttcgaggagatggtgaaggtgagcgccgagttcctggagctgagcgtgaccgagctgaaggacatcatcgagaaggacgagctgaacgtgaagcaggaggacgccgtgttcgaggccatcctgaagtggatcagccacgacccccagaacagaaagcagcacatcagcatcctgctgcccaaggtgagactggccctgatgcacgccgagtacttcatgaacaacgtgaagatgaacgactacgtgaaggacagcgaggagtgcaagcccgtgatcatcaacgccctgaaggccatgtacgacctgaacatgaacggccccagcaacagcgacttcaccaaccccctgaccagacccagactgccctacgccatcctgttcgccatcggcggctggagcggcggcagccccaccaacgccatcgaggcctacgacgccagagccgacagatgggtgaacgtgacctgcgaggaggagagccccagagcctaccacggcgccgcctacctgaagggctacgtgtacatcatcggcggcttcgacagcgtggactacttcaacagcgtgaagagattcgaccccgtgaagaagacctggcaccaggtggcccccatgcacagcagaagatgctacgtgagcgtgaccgtgctgggcaacttcatctacgccatgggcggcttcgacggctacgtgagactgaacaccgccgagagatacgagcccgagaccaaccagtggaccctgatcgcccccatgcacgagcagagaagcgacgccagcgccaccaccctgtacggcaaggtgtacatctgcggcggcttcaacggcaacgagtgcctgttcaccgccgaggtgtacaacaccgagagcaaccagtggaccgtgatcgcccccatgagaagcagaagaagcggcatcggcgtgatcgcctacggcgagcacgtgtacgccgtgggcggcttcgacggcgccaacagactgagaagcgccgaggcctacagccccgtggccaacacctggagaaccatccccaccatgttcaaccccagaagcaacttcggcatcgaggtggtggacgacctgctgttcgtggtgggcggcttcaacggcttcaccaccaccttcaacgtggagtgctacgacgagaagaccgacgagtggtacgacgcccacgacatgagcatctacagaagcgccctgagctgctgcgtggtgcccggcctggccaacgtggaggagtacgccgccagaagagacaacttccccggcctggccctgagagacgaggtgaagtacagcgccagcaccagcaccctgcccgtgtag

SEQ ID NO: 9651 - DNA, 942 bp, Artificial Sequence
  Description of Artificial Sequence: Synthetic coding sequence
atggccgccctgaccgacctgagcttcatgtacagatggttcaagaactgcaacctggtgggcaacctgagcgagaagtacgtgttcatcaccggctgcgacagcggcttcggcaacctgctggccaagcagctggtggacagaggcatgcaggtgctggccgcctgcttcaccgaggagggcagccagaagctgcagagagacaccagctacagactgcagaccaccctgctggacgtgaccaagagcgagagcatcaaggccgccgcccagtgggtgagagacaaggtgggcgagcagggcctgtgggccctggtgaacaacgccggcgtgggcctgcccagcggccccaacgagtggctgaccaaggacgacttcgtgaaggtgatcaacgtgaacctggtgggcctgatcgaggtgaccctgcacatgctgcccatggtgaagagagccagaggcagagtggtgaacatgagcagcagcggcggcagagtggccgtgatcggcggcggctactgcgtgagcaagttcggcgtggaggccttcagcgacagcatcagaagagagctgtactacttcggcgtgaaggtgtgcatcatcgagcccggcaactacagaaccgccatcctgggcaaggagaacctggagagcagaatgagaaagctgtgggagagactgccccaggagaccagagacagctacggcgaggactacttcagaatctacaccgacaagctgaagaacatcatgcaggtggccgagcccagagtgagagacgtgatcaacagcatggagcacgccatcgtgagcagaagccccagaatcagatacaaccccggcctggacgccaagctgctgtacatccccctggccaagctgcccacccccgtgaccgacttcatcctgagcagatacctgcccagacccgccgacagcgtgtag

SEQ ID NO: 9652 - DNA, 1461 bp, Artificial Sequence
  Description of Artificial Sequence: Synthetic coding sequence
atgacctgcggcagctactgcggcggcagagccttcagctgcatcagcgcctgcggccccagacccggcagatgctgcatcaccgccgccccctacagaggcatcagctgctacagaggcctgaccggcggcttcggcagccacagcgtgtgcggcggcttcagagccggcagctgcggcagaagcttcggctacagaagcggcggcgtgtgcggccccagccccccctgcatcaccaccgtgagcgtgaacgagagcctgctgacccccctgaacctggagatcgaccccaacgcccagtgcgtgaagcaggaggagaaggagcagatcaagagcctgaacagcagattcgccgccttcatcgacaaggtgagattcctggagcagcagaacaagctgctggagaccaagctgcagttctaccagaacagagagtgctgccagagcaacctggagcccctgttcgagggctacatcgagaccctgagaagagaggccgagtgcgtggaggccgacagcggcagactggccagcgagctgaaccacgtgcaggaggtgctggagggctacaagaagaagtacgaggaggaggtgagcctgagagccaccgccgagaacgagttcgtggccctgaagaaggacgtggactgcgcctacctgagaaagagcgacctggaggccaacgtggaggccctgatccaggagatcgacttcctgagaagactgtacgaggaggagatcagagtgctgcagagccacatcagcgacaccagcgtggtggtgaagctggacaacagcagagacctgaacatggactgcatcatcgccgagatcaaggcccagtacgacgacatcgtgaccagaagcagagccgaggccgagagctggtacagaagcaagtgcgaggagatgaaggccaccgtgatcagacacggcgagaccctgagaagaaccaaggaggagatcaacgagctgaacagaatgatccagagactgaccgccgaggtggagaacgccaagtgccagaacagcaagctggaggccgccgtggcccagagcgagcagcagggcgaggccgccctgagcgacgccagatgcaagctggccgagctggagggcgccctgcagaaggccaagcaggacatggcctgcctgatcagagagtaccaggaggtgatgaacagcaagctgggcctggacatcgagatcgccacctacagaagactgctggagggcgaggagcagagactgtgcgagggcgtgggcagcgtgaacgtgtgcgtgagcagcagcagaggcggcgtggtgtgcggcgacctgtgcgccagcaccaccgcccccgtggtgagcaccagagtgagcagcgtgcccagcaacagcaacgtggtggtgggcaccaccaacgcctgcgcccccagcgccagagtgggcgtgtgcggcggcagctgcaagagatgctag

SEQ ID NO: 9653 - DNA, 939 bp, Artificial Sequence
  Description of Artificial Sequence: Synthetic coding sequence
atggccgagctgaccgccctggagagcctgatcgagatgggcttccccagaggcagagccgagaaggccctggccctgaccggcaaccagggcatcgaggccgccatggactggctgatggagcacgaggacgaccccgacgtggacgagcccctggagacccccctgggccacatcctgggcagagagcccaccagcagcgagcagggcggcctggagggcagcggcagcgccgccggcgagggcaagcccgccctgagcgaggaggagagacaggagcagaccaagagaatgctggagctggtggcccagaagcagagagagagagaggagagagaggagagagaggccctggagagagagagacagagaagaagacagggccaggagctgagcgccgccagacagagactgcaggaggacgagatgagaagagccgccgaggagagaagaagagagaaggccgaggagctggccgccagacagagagtgagagagaagatcgagagagacaaggccgagagagccaagaagtacggcggcagcgtgggcagccagcccccccccgtggcccccgagcccggccccgtgcccagcagccccagccaggagccccccaccaagagagagtacgaccagtgcagaatccaggtgagactgcccgacggcaccagcctgacccagaccttcagagccagagagcagctggccgccgtgagactgtacgtggagctgcacagaggcgaggagctgggcggcggccaggaccccgtgcagctgctgagcggcttccccagaagagccttcagcgaggccgacatggagagacccctgcaggagctgggcatggccgccagactggagaccagaaccagaaactggggcagcagagaggcctgcctgggcaagggcggcatgcagagagagggcgccctgtag

SEQ ID NO: 9654 - DNA, 405 bp, Artificial Sequence
  Description of Artificial Sequence: Synthetic coding sequence
atgcccgccgacctgagcggcacctggaccctgctgagcagcgacaacttcgagggctacatgctggccctgggcatcgacttcgccaccagaaagatcgccaagctgctgaagccccagaaggtgatcgagcagaacggcgacagcttcaccatccacaccaacagcagcctgagaaactacttcgtgaagttcaaggtgggcgaggagttcgacgaggacaacagaggcctggacaacagaaagtgcaagagcctggtgatctgggacaacgacagactgacctgcatccagaagggcgagaagaagaacagaggctggacccactggatcgagggcgacaagctgcacctggagatgttctgcgagggccaggtgtgcaagcagaccttccagagagcctag

SEQ ID NO: 9655 - DNA, 1383 bp, Artificial Sequence
  Description of Artificial Sequence: Synthetic coding sequence
atggccggctacctgagcgagagcgacttcgtgatggtggaggagggcttcagcaccagagacctgctgaaggagctgaccctgggcgccagccaggccaccaccgacgaggtggccgccttcttcgtggccgacctgggcgccatcgtgagaaagcacttctgcttcctgaagtgcctgcccagagtgagacccttctacgccgtgaagtgcaacagcagccccggcgtgctgaaggtgctggcccagctgggcctgggcttcagctgcgccaacaaggccgagatggagctggtgcagcacatcggcatccccgccagcaagatcatctgcgccaacccctgcaagcagatcgcccagatcaagtacgccgccaagcacggcatccagctgctgagcttcgacaacgagatggagctggccaaggtggtgaagagccaccccagcgccaagatggtgctgtgcatcgccaccgacgacagccacagcctgagctgcctgagcctgaagttcggcgtgagcctgaagagctgcagacacctgctggagaacgccaagaagcaccacgtggaggtggtgggcgtgagcttccacatcggcagcggctgccccgacccccaggcctacgcccagagcatcgccgacgccagactggtgttcgagatgggcaccgagctgggccacaagatgcacgtgctggacctgggcggcggcttccccggcaccgagggcgccaaggtgagattcgaggagatcgccagcgtgatcaacagcgccctggacctgtacttccccgagggctgcggcgtggacatcttcgccgagctgggcagatactacgtgaccagcgccttcaccgtggccgtgagcatcatcgccaagaaggaggtgctgctggaccagcccggcagagaggaggagaacggcagcaccagcaagaccatcgtgtaccacctggacgagggcgtgtacggcatcttcaacagcgtgctgttcgacaacatctgccccacccccatcctgcagaagaagcccagcaccgagcagcccctgtacagcagcagcctgtggggccccgccgtggacggctgcgactgcgtggccgagggcctgtggctgccccagctgcacgtgggcgactggctggtgttcgacaacatgggcgcctacaccgtgggcatgggcagccccttctggggcacccaggcctgccacatcacctacgccatgagcagagtggcctgggaggccctgagaagacagctgatggccgccgagcaggaggacgacgtggagggcgtgtgcaagcccctgagctgcggctgggagatcaccgacaccctgtgcgtgggccccgtgttcacccccgccagcatcatgtag

SEQ ID NO: 9656 - DNA, 1209 bp, Artificial Sequence
  Description of Artificial Sequence: Synthetic coding sequence
ggcggccccagaggcagcggcagcgccgccgagaccatgcccgagatcagagtgacccccctgggcgccggccaggacgtgggcagaagctgcatcctggtgagcatcgccggcaagaacgtgatgctggactgcggcatgcacatgggcttcaacgacgacagaagattccccgacttcagctacatcacccagaacggcagactgaccgacttcctggactgcgtgatcatcagccacttccacctggaccactgcggcgccctgccctacttcagcgagatggtgggctacgacggccccatctacatgacccaccccacccaggccatctgccccatcctgctggaggactacagaaagatcgccgtggacaagaagggcgaggccaacttcttcaccagccagatgatcaaggactgcatgaacctgctggagaccttctgggagagaatgaacctgaaggtgcccatctacttcagcaccggcctgaccgagaaggccaaccactactacaagctgttcatcccctggaccaaccagaagatcagaaagaccttcgtgcagagaaacatgttcgagttcaagcacatcaaggccttcgacagagccttcgccgacaaccccggccccatggtggtgttcgccacccccggcatgctgcacgccggccagagcctgcagatcttcagaaagtgggccggcaacgagaagaacatggtgatcatgcccggctactgcgtgcagggcaccgtgggccacaagatcctgagcggccagagaaagctggagatggagggcagacaggtgctggaggtgaagatgcaggtggagtacatgagcttcagcgcccacgccgacgccaagggcatcatgcagctggtgagcagcgagcaggccctgaaggagctgggcctggccgagcaccagctgagattcacctgcagagtgcacctgcacgacaccagaaaggagcaggagaccgccctgagagtgtacagccacctgaagagcgtgctgaaggaccactgcgtgcagcacctgcccgacggcagcgtgaccgtggagagcgtgctgctgcaggccgccgcccccagcgaggaccccggcaccaaggtgctgctggtgagctggacctaccaggacgaggagctgggcagcttcctgaccagcctgctgaagaagggcctgccccaggcccccagctag

SEQ ID NO: 9657 - DNA, 1863 bp, Artificial Sequence
  Description of Artificial Sequence: Synthetic coding sequence
atggagaaggccgtgaacgacggcagccacagcgaggagctgttctgccacctgaagaccatcagcgagaaggaggacctgcccagatgcaccagcgagagccacctgagctgcctgaagcaggacatcctgaacgagaagaccgagctggaggccaccctgaaggaggccgagctggtgacccacagcgtggagctgctgctgcccctgttcaaggacaccatcgagaagatcaacttcgagaacgccaacctgagcgccctgaacctgaagatcagcgagcagaaggagatcctgatcaaggagctggacaccttcaagagcgtgaagctggccctggagcacctgctgagaaagagagactacaagcagaccggcgacaacctgagcagcatgctgctggagaacctgaccgacaacgagagcgagaacaccaacctgaagaagaaggtgttcgagaaggaggcccacatccaggagctgagctgcctgttccagagcgagaaggccaacaccctgaaggccaacagattcagccagagcgtgaaggtggtgcacgagagactgcagatccagatccacaagagagaggccgagaacgacaagctgaaggagtacgtgaagagcctggagaccaagatcgccaagtggaacctgcagagcagaatgaacaagaacgaggccatcgtgatgaaggaggccagcagacagaagaccgtggccctgaagaaggccagcaaggtgtacaagcagagactggaccacttcaccggcgccatcgagaagctgaccagccagatcagagaccaggaggccaagctgagcgagaccatcagcgccagcaacgcctggaagagccactacgagaagatcgtgatcgagaagaccgagctggaggtgcagatcgagaccatgaagaagcagatcatcaacctgctggaggacctgaagaagatggaggaccacggcaagaacagctgcgaggagatcctgagaaaggtgcacagcatcgagtacgagaacgagaccctgaacctggagaacaccaagctgaagaccaccctggccgccctgaaggacgaggtggtgagcgtggagaacgagctgagcgagctgcaggaggtggagaagaagcagaagaccctgatcgagatgtacaagacccaggtgcagaagctgcaggaggccgccgagatcgtgaagagcagatgcgagaacctgctgcacaagaacaaccagatcaccaagaccaagaacaagaacgtggagaagatgagaggccagatggagagccacctgaaggagctggagagagtgtgcgacagcctgaccgccgccgagagaagactgcacgagtgccaggagagcctgcagtgctgcaagggcaagtgcgccgaccaggagcacaccatcagagagctgcagggccagatcctgaagcagtgggaggagtacagcgtgctggcctgggtggacggcaaccacaacctgctgaccaagctgagcctggaggaggagaactgcctgatccagctgaagtgcgagaacctgcagcagaagctggagcagatggacgccgagaacaaggagctggagaagaagctggccaaccaggaggagtgcctgaagcacagcaacctgaagttcaaggagaagagcgccgagtacaccgccctggccagacagctggaggccgccctggaggagggcagacagaaggtggccgaggagatcgagaagatgagcagcagagagagcgccctgcagatcaagatcctggacctggagaccgagctgagaaagaagaacgaggagcagaaccagctggtgtgcaagatgaacagcgaccccgagaccccctag

SEQ ID NO: 9658 - DNA, 465 bp, Artificial Sequence
  Description of Artificial Sequence: Synthetic coding sequence
atgagcaagaacaccgtgagcagcgccagattcagaaaggtggacgtggacgagtacgacgagaacaagttcgtggacgaggaggacggcggcgacggccaggccggccccgacgagggcgaggtggacagctgcctgagacacagcatcaccggcaacatgaccgccgccctgcaggccgccctgaagaacccccccatcaacaccaagagccaggccgtgaaggacagagccggcagcatcgtgctgaaggtgctgatcagcttcaaggccaacgacatcgagaaggccgtgcagagcctggacaagaacggcgtggacctgctgatgaagtacatctacaagggcttcgagagccccagcgacaacagcagcgccatgctgctgcagtggcacgagaaggccctggccgccggcggcgtgggcagcatcgtgagagtgctgaccgccagaaagaccgtgtag

SEQ ID NO: 9659 - DNA, 2946 bp, Artificial Sequence
  Description of Artificial Sequence: Synthetic coding sequence
atgagcgagcaggagagaatccaggagtgcctgagaaaggagatcagaagcctgctgatcagcaccaaggacggcctgagcccccaggagctggagaaggagtacctgctgatggtgggcaaccacctgcccctgagaatcctgggctacagaagcaccatggagctggtgctggacatgcccgacgtggtgagagtgtgccccggcgccggcggcaccgtgatcctgaaggccatccccgacgagagcaccaagggcatcgccagcctggtggccaagcagagaagcagccacaagctgagaaacagcatgcacaagggcagacccagcatctacagcggccccagaagccacagaagagtgccctacagaggcagagtggcccccatcctgcccgccgtggtgaagagcgagctgaaggacctgctggccctgagccccgtgctgctgagcgacttcgagaaggccttcgccaagagattcggcagaagcttccagtacatgcagtacggcttcctgagcatgttcgaggtgctgaacgccgccagcgacgtgatcagcgtggagcagaccagagccggcagcctgctgatgctgaagaagagcgtgaccgaggagaagcccagaggctgccccgccggcaagatcttcacccagcccttcagaatgaagcagggcagctacagcaccggcttccccgtggccaagccctgcttcagccagcccaccagcaacatggagccccccaagcagatcatgagcatggagaagaccagcaagctgaacgtggtggagaccagcagactgaaccacaccgagaagctgaaccagctggagaacaccttcaagagcgtgatcgcccagatcggccccggcggcaccatcagcagcgagctgaagcacaagatcaagttcgtggtgagcaagttccccgagggcctgttcatcagcaagctgctgggcgagtacgaggtgatcttcaaggagcagctgagccccaagaagctgggcttcctgaacgtgaccgagctggtgggcgccctgagcgacatcctgcacgtggagttcagaaagggccaccaggacctgctggtgttcgacgccgacaagaagcccctgccccccgtgcagagcgacaagaagatcgaggccaaggcctgcgtgagcagcccccccagaaacagcctgagcaccgccgccgtgaaggagaccgtgtggaactgccccagcaagaagcagaaggagccccagcagaagatctgcaagaagcccaacctggtggtgaagcccctgcagctgcaggtggagaccaacaagagcgagctgaacctggccatggccaaccacgacatcccccccgacgccgtgcccaacaagaagctgtgcagactgccccccctggacaccagcagcctgatcggcgtgttcgtggagtacatcatcagccccagccagttctacatcagaatctacagcagagacagcagcgagctgctggaggacatgatgatcgagatgagaagatgctacagcaaccagctggtgagcgacagatacgtgatgcccgagtgcttcatccagcccggccacctgtgctgcgtgagaatcagcgaggacaagtggtggtacagagtgatcatccacagagtgctggagaagcaggaggtggaggtgttctaccccgacttcggcaacatcggcatcgtgcagaagagcagcctgagattcctgaagtgctgctacaccaagctgcccgcccaggccatcccctgcagcctggcctgggtgagacccgtggaggagcactggaccagcaaggccatcctgcagttccagaagctgtgcggcctgaagcccctggtgggcgtggtggacgagtacgtggacggcatcctgaacatcttcctgtgcgacaccagcagcaacgaggacgtgtacttccaccacgtgctgagaaccgagggccacgccatcgtgtgcagagagaacatcagcagcaagggcttcagcgagctgaaccccctggccctgtacaccaccagcagcggcggccccgaggacatcgtgctgaccgagctgggctaccccagccagcagcactacttcaacgaggacagaaagatcagcccccagagcaaggagagcgagctgagaatcctggacgagatccccaccggcatgccctgcctggagagcgtgaccatcggcgacgacatctgggacgagaactggctgcccctgcaggccaagatgggcaagggcggcgacgccgccagccacctgttcaccgccagcctgggcggcaagaaccagtacagcagctgcaaggagatgccccagaaggactggtgcttcagcacccccaaggacacctgggacgacagctggcagcccagcggcctggtgaacggcaccaaggtggaggtgcacaagcccgaggtgctgggcgcccaggagaagaacaccggcaccaacagaacccagaagcagctggacatcaacggcagcagcgacagcagcaccctgcccaagctggaggagttctgcaccagcctgacccagagcgagcagagcgccgacggcagccagagcgagcccaacaacagccagacccagcccaagcagatccagctgagcaccgccgccccctgcagcaccaccgccgtggacgacagcgccgagaagcccagcggcagcgtggagagcagccccgagatcctgaagaacgaggacttcagcagcagcagagccatcaccctgtacaaggacaagagacaggagagcgtggaccagctgagcctgatcctgagctacgagtgccagatcagccagaagctgtacatccccagaagcaccgccaccgccgccctgggcgccgccgccagactggccaccagcagaagcctgctgcactggtaccccagcgtgaagagaatggaggcctag

SEQ ID NO: 9660 - DNA, 909 bp, Artificial Sequence
  Description of Artificial Sequence: Synthetic coding sequence
atggagatccaggagctggaggagatccaggcctgccagggcctgtgggaggtgttcgtgaccctgagcgagagagccagagactacctgcacaagaccggcagattcatcgtgatcggcggcatcgtgagccccgtgcacgacagctacggcaagcagggcctggtgagcagcagacacagactgatcatgtgccagctggccgtgcagaacagcgactggatcagagtggacccctgggagtgctaccaggacacctggcagaccacctgcagcgtgctggagcaccacagagacctgatgaagagagtgaccggctgcatcctgagcaacgtgaacacccccagcatgacccccgtgatcggccagccccagaacgagaccccccagcccatctaccagaacagcaacgtggccaccaagcccaccgccgccaagatcctgggcaaggtgggcgagagcctgagcagaatctgctgcgtgagaccccccgtggagagattcaccttcgtggacgagaacgccaacctgggcaccgtgatgagatacgaggagatcgagctgagaatcctgctgctgtgcggcagcgacctgctggagagcttctgcatccccggcctgtggaacgaggccgacatggaggtgatcgtgggcgacttcggcatcgtggtggtgcccagagacgccgccgacaccgacagaatcatgaaccacagcagcatcctgagaaagtacaagaacaacatcatggtggtgaaggacgacatcaaccaccccatgagcgtggtgagcagcaccaagagcagactggccctgcagcacggcgacggccacgtggtggactacctgagccagcccgtgatcgactacatcctgaagagccagctgtacatcaacgccagcggctag

SEQ ID NO: 9661 - DNA, 861 bp, Artificial Sequence
  Description of Artificial Sequence: Synthetic coding sequence
atggagagaagactgggcgtgagagcctgggtgaaggagaacagaggcagcttccagccccccgtgtgcaacaagctgatgcaccaggagcagctgaaggtgatgttcatcggcggccccaacaccagaaaggactaccacatcgaggagggcgaggaggtgttctaccagctggagggcgacatggtgctgagagtgctggagcagggcaagcacagagacgtggtgatcagacagggcgagatcttcctgctgcccgccagagtgccccacagcccccagagattcgccaacaccgtgggcctggtggtggagagaagaagactggagaccgagctggacggcctgagatactacgtgggcgacaccatggacgtgctgttcgagaagtggttctactgcaaggacctgggcacccagctggcccccatcatccaggagttcttcagcagcgagcagtacagaaccggcaagcccatccccgaccagctgctgaaggagccccccttccccctgagcaccagaagcatcatggagcccatgagcctggacgcctggctggacagccaccacagagagctgcaggccggcacccccctgagcctgttcggcgacacctacgagacccaggtgatcgcctacggccagggcagcagcgagggcctgagacagaacgtggacgtgtggctgtggcagctggagggcagcagcgtggtgaccatgggcggcagaagactgagcctggcccccgacgacagcctgctggtgctggccggcaccagctacgcctgggagagaacccagggcagcgtggccctgagcgtgacccaggaccccgcctgcaagaagcccctgggctag

SEQ ID NO: 9662 - DNA, 1545 bp, Artificial Sequence
  Description of Artificial Sequence: Synthetic coding sequence
atgcaggagagcggctgcagactggagcaccccagcgccaccaagttcagaaaccacgtgatggagggcgactgggacaaggccgagaacgacctgaacgagctgaagcccctggtgcacagcccccacgccatcgtggtgagaggcgccctggagatcagccagaccctgctgggcatcatcgtgagaatgaagttcctgctgctgcagcagaagtacctggagtacctggaggacggcaaggtgctggaggccctgcaggtgctgagatgcgagctgacccccctgaagtacaacaccgagagaatccacgtgctgagcggctacctgatgtgcagccacgccgaggacctgagagccaaggccgagtgggagggcaagggcaccgccagcagaagcaagctgctggacaagctgcagacctacctgccccccagcgtgatgctgccccccagaagactgcagaccctgctgagacaggccgtggagctgcagagagacagatgcctgtaccacaacaccaagctggacaacaacctggacagcgtgagcctgctgatcgaccacgtgtgcagcagaagacagttcccctgctacacccagcagatcctgaccgagcactgcaacgaggtgtggttctgcaagttcagcaacgacggcaccaagctggccaccggcagcaaggacaccaccgtgatcatctggcaggtggaccccgacacccacctgctgaagctgctgaagaccctggagggccacgcctacggcgtgagctacatcgcctggagccccgacgacaactacctggtggcctgcggccccgacgactgcagcgagctgtggctgtggaacgtgcagaccggcgagctgagaaccaagatgagccagagccacgaggacagcctgaccagcgtggcctggaaccccgacggcaagagattcgtgaccggcggccagagaggccagttctaccagtgcgacctggacggcaacctgctggacagctgggagggcgtgagagtgcagtgcctgtggtgcctgagcgacggcaagaccgtgctggccagcgacacccaccagagaatcagaggctacaacttcgaggacctgaccgacagaaacatcgtgcaggaggaccaccccatcatgagcttcaccatcagcaagaacggcagactggccctgctgaacgtggccacccagggcgtgcacctgtgggacctgcaggacagagtgctggtgagaaagtaccagggcgtgacccagggcttctacaccatccacagctgcttcggcggccacaacgaggacttcatcgccagcggcagcgaggaccacaaggtgtacatctggcacaagagaagcgagctgcccatcgccgagctgaccggccacaccagaaccgtgaactgcgtgagctggaacccccagatccccagcatgatggccagcgccagcgacgacggcaccgtgagaatctggggccccgcccccttcatcgaccaccagaacatcgaggaggagtgcagcagcatggacagctag

SEQ ID NO: 9663 - DNA, 540 bp, Artificial Sequence
  Description of Artificial Sequence: Synthetic coding sequence
atgggcatcctgttcaccagaatctggagactgttcaaccaccaggagcacaaggtgatcatcgtgggcctggacaacgccggcaagaccaccatcctgtaccagttcagcatgaacgaggtggtgcacaccagccccaccatcggcagcaacgtggaggagatcgtgatcaacaacaccagattcctgatgtgggacatcggcggccaggagagcctgagaagcagctggaacacctactacaccaacaccgagttcgtgatcgtggtggtggacagcaccgacagagagagaatcagcgtgaccagagaggagctgtacaagatgctggcccacgaggacctgagaaaggccggcctgctgatcttcgccaacaagcaggacgtgaaggagtgcatgaccgtggccgagatcagccagttcctgaagctgaccagcatcaaggaccaccagtggcacatccaggcctgctgcgccctgaccggcgagggcctgtgccagggcctggagtggatgatgagcagactgaagatcagatag

SEQ ID NO: 9664 - DNA, 1428 bp, Artificial Sequence
  Description of Artificial Sequence: Synthetic coding sequence
atgcagaagagcaccaacagcgacaccagcgtggagaccctgaacagcaccagacagggcaccggcgccgtgcagatgagaatcaagaacgccaacagccaccacgacagactgagccagagcaagagcatgatcctgaccgacgtgggcaaggtgaccgagcccatcagcagacacagaagaaaccacagccagcacatcctgaaggacgtgatcccccccctggagcagctgatggtggagaaggagggctacctgcagaaggccaagatcgccgacggcggcaagaagctgagaaagaactggagcaccagctggatcgtgctgagcagcagaagaatcgagttctacaaggagagcaagcagcaggccctgagcaacatgaagaccggccacaagcccgagagcgtggacctgtgcggcgcccacatcgagtgggccaaggagaagagcagcagaaagaacgtgttccagatcaccaccgtgagcggcaacgagttcctgctgcagagcgacatcgacttcatcatcctggactggttccacgccatcaagaacgccatcgacagactgcccaaggacagcagctgccccagcagaaacctggagctgttcaagatccagagaagcagcagcaccgagctgctgagccactacgacagcgacatcaaggagcagaagcccgagcacagaaagagcctgatgttcagactgcaccacagcgccagcgacaccagcgacaagaacagagtgaagagcagactgaagaagttcatcaccagaagacccagcctgaagaccctgcaggagaagggcctgatcaaggaccagatcttcggcagccacctgcacaaggtgtgcgagagagagaacagcaccgtgccctggttcgtgaagcagtgcatcgaggccgtggagaagagaggcctggacgtggacggcatctacagagtgagcggcaacctggccaccatccagaagctgagattcatcgtgaaccaggaggagaagctgaacctggacgacagccagtgggaggacatccacgtggtgaccggcgccctgaagatgttcttcagagagctgcccgagcccctgttcccctacagcttcttcgagcagttcgtggaggccatcaagaagcaggacaacaacaccagaatcgaggccgtgaagagcctggtgcagaagctgcccccccccaacagagacaccatgaaggtgctgttcggccacctgaccaagatcgtggccaaggccagcaagaacctgatgagcacccagagcctgggcatcgtgttcggccccaccctgctgagagccgagaacgagaccggcaacatggccatccacatggtgtaccagaaccagatcgccgagctgatgctgagcgagtacagcaagatcttcggcagcgaggaggactag

SEQ ID NO: 9665 - DNA, 1308 bp, Artificial Sequence
  Description of Artificial Sequence: Synthetic coding sequence
atggcccagaccgtgcccccctgcgagctgccctgcaaggagtacgacgtggccagaaacaccggcgcctacaccagcagcggcctggccaccgccagcttcagaaccagcaagtacctgctggaggagtggttccagaactgctacgccagataccaccaggccttcgccgacagagaccagagcgagagacagagacacgagagccagcagctggccaccgagacccaggccctggcccagagaacccagcaggacagcaccagaaccgtgggcgagagactgcaggacacccacagctggaagagcgagctgcagagagagatggaggccctggccgccgagaccaacctgctgctggcccagaagcagagactggagagagccctggacgccaccgaggtgcccttcagcatcaccaccgacaacctgcagtgcagagagagaagagagcaccccaacctggtgagagaccacgtggagaccgagctgctgaaggaggccgagctgatcagaaacatccaggagctgctgaagagaaccatcatgcaggccgtgagccagatcagactgaacagagagcacaaggagacctgcgagatggactggagcgacaagatggaggcctacaacatcgacgagacctgcggcagacaccacagccagagcaccgaggtgcaggcccacccctacagcaccaccttccaggagagcgccagcacccccgagaccagagccaagttcacccaggacaacctgtgcagagcccagagagagagactggccagcgccaacctgagagtgctggtggactgcatcctgagagacaccagcgaggacctgagactgcagtgcgacgccgtgaacctggccttcggcagaagatgcgaggagctggaggacgccagatacaagctgcaccaccacctgcacaagaccctgagagagatcaccgaccaggagcacaacgtggccgccctgaagcaggccatcaaggacaaggaggcccccctgcacgtggcccagaccagactgtacctgagaagccacagacccaacatggagctgtgcagagacgccgcccagttcagactgctgagcgaggtggaggagctgaacatgagcctgaccgccctgagagagaagctgctggaggccgagcagagcctgagaaacctggaggacatccacatgagcctggagaaggacatcgccgccatgaccaacagcctgttcatcgacagacagaagtgcatggcccacagaaccagataccccaccatcctgcagctggccggctaccagtag

SEQ ID NO: 9666 - DNA, 828 bp, Artificial Sequence
  Description of Artificial Sequence: Synthetic coding sequence
atgagaaagagactgagcgcccccgagctgagactgagcctgaccaagggccccggcaacgacggcgccagccccacccagagcgcccccagcagccccgacggcagcagcgacctggagatcgacgagctggagacccccagcgacagcgagcagctggacagcggccacgagttcgagtgggaggacgagctgcccagagccgagggcctgggcaccagcgagaccgccgagagactgggcagaggctgcatgtgggacgtgaccggcgaggacggccaccactggagagtgttcagaatgggccccagagagcagagagtggacatgaccgtgatcgagccctacaagaaggtgctgagccacggcggctaccacggcgacggcctgaacgccgtgatcctgttcgccagctgctacctgcccagaagcagcatccccaactacacctacgtgatggagcacctgttcagatacatggtgggcaccctggagctgctggtggccgagaactacctgctggtgcacctgagcggcggcaccagcagagcccaggtgccccccctgagctggatcagacagtgctacagaaccctggacagaagactgagaaagaacctgagagccctggtggtggtgcacgccacctggtacgtgaaggccttcctggccctgctgagacccttcatcagcagcaagttcaccagaaagatcagattcctggacagcctgggcgagctggcccagctgatcagcctggaccaggtgcacatccccgaggccgtgagacagctggacagagacctgcacggcagcggcggcacctag

SEQ ID NO: 9667 - DNA, 2391 bp, Artificial Sequence
  Description of Artificial Sequence: Synthetic coding sequence
atggaggaggaggccagcagaagcgccgccgccaccaaccccggcagcagactgaccagatggcccccccccgacaagagagagggcagcgccgtggaccccggcaagagaagaagcctggccgccacccccagcagcagcctgccctgcaccctgatcgccctgggcctgagacacgagaaggaggccaacgagctgatggaggacctgttcgagaccttccaggacgagatgggcttcagcaacatggaggacgacggccccgaggaggaggagagagtggccgagccccaggccaacttcaacaccccccaggccctgagattcgaggagctgctggccaacctgctgaacgagcagcaccagatcgccaaggagctgttcgagcagctgaagatgaagaagcccagcgccaagcagcagaaggaggtggagaaggtgaagccccagtgcaaggaggtgcaccagaccctgatcctggaccccgcccagagaaagagactgcagcagcagatgcagcagcacgtgcagctgctgacccagatccacctgctggccacctgcaaccccaacctgaaccccgaggccagcagcaccagaatctgcctgaaggagctgggcaccttcgcccagagcagcatcgccctgcaccaccagtacaaccccaagttccagaccctgttccagccctgcaacctgatgggcgccatgcagctgatcgaggacttcagcacccacgtgagcatcgactgcagcccccacaagaccgtgaagaagaccgccaacgagttcccctgcctgcccaagcaggtggcctggatcctggccaccagcaaggtgttcatgtaccccgagctgctgcccgtgtgcagcctgaaggccaagaacccccaggacaagatcctgttcaccaaggccgaggacaacaagtacctgctgacctgcaagaccgccagacagctgaccgtgagaatcaagaacctgaacatgaacagagcccccgacaacatcatcaagttctacaagaagaccaagcagctgcccgtgctgggcaagtgctgcgaggagatccagccccaccagtggaagccccccatcgagagagaggagcacagactgcccttctggctgaaggccagcctgcccagcatccaggaggagctgagacacatggccgacggcgccagagaggtgggcaacatgaccggcaccaccgagatcaacagcgaccagggcctggagaaggacaacagcgagctgggcagcgagaccagataccccctgctgctgcccaagggcgtggtgctgaagctgaagcccgtggccgacagattccccaagaaggcctggagacagaagagaagcagcgtgctgaagcccctgctgatccagcccagccccagcctgcagcccagcttcaaccccggcaagacccccgcccagagcacccacagcgaggccccccccagcaagatggtgctgagaatcccccaccccatccagcccgccaccgtgctgcagaccgtgcccggcgtgccccccctgggcgtgagcggcggcgagagcttcgagagccccgccgccctgcccgccatgccccccgaggccagaaccagcttccccctgagcgagagccagaccctgctgagcagcgcccccgtgcccaaggtgatgatgcccagccccgccagcagcatgttcagaaagccctacgtgagaagaagacccagcaagagaagaggcgccagagccttcagatgcatcaagcccgcccccgtgatccaccccgccagcgtgatcttcaccgtgcccgccaccaccgtgaagatcgtgagcctgggcggcggctgcaacatgatccagcccgtgaacgccgccgtggcccagagcccccagaccatccccatcgccaccctgctggtgaaccccaccagcttcccctgccccctgaaccagcccctggtggccagcagcgtgagccccctgatcgtgagcggcaacagcgtgaacctgcccatccccagcacccccgaggacaaggcccacatgaacgtggacatcgcctgcgccgtggccgacggcgagaacgccttccagggcctggagcccaagctggagccccaggagctgagccccctgagcgccaccgtgttccccaaggtggagcacagccccggccccccccccgtggacaagcagtgccaggagggcctgagcgagaacagcgcctacagatggaccgtggtgaagaccgaggagggcagacaggccctggagcccctgccccagggcatccaggagagcctgaacaacagcagccccggcgacctggaggaggtggtgaagatggagcccgaggacgccaccgaggagatcagcggcttcctgtag

SEQ ID NO: 9668 - DNA, 1380 bp, Artificial Sequence
  Description of Artificial Sequence: Synthetic coding sequence
atggccgccagcgccagcgccgccgccggcgaggaggactgggtgctgcccagcgaggtggaggtgctggagagcatctacctggacgagctgcaggtgatcaagggcaacggcagaaccagcccctgggagatctacatcaccctgcaccccgccaccgccgaggaccaggacagccagtacgtgtgcttcaccctggtgctgcaggtgcccgccgagtacccccacgaggtgccccagatcagcatcagaaaccccagaggcctgagcgacgagcagatccacaccatcctgcaggtgctgggccacgtggccaaggccggcctgggcaccgccatgctgtacgagctgatcgagaagggcaaggagatcctgaccgacaacaacatcccccacggccagtgcgtgatctgcctgtacggcttccaggagaaggaggccttcaccaagaccccctgctaccactacttccactgccactgcctggccagatacatccagcacatggagcaggagctgaaggcccagggccaggagcaggagcaggagagacagcacgccaccaccaagcagaaggccgtgggcgtgcagtgccccgtgtgcagagagcccctggtgtacgacctggccagcctgaaggccgcccccgagccccagcagcccatggagctgtaccagcccagcgccgagagcctgagacagcaggaggagagaaagagactgtaccagagacagcaggagagaggcggcatcatcgacctggaggccgagagaaacagatacttcatcagcctgcagcagccccccgcccccgccgagcccgagagcgccgtggacgtgagcaagggcagccagccccccagcaccctggccgccgagctgagcaccagccccgccgtgcagagcaccctgcccccccccctgcccgtggccacccagcacatctgcgagaagatccccggcaccagaagcaaccagcagagactgggcgagacccagaaggccatgctggacccccccaagcccagcagaggcccctggagacagcccgagagaagacaccccaagggcggcgagtgccacgcccccaagggcaccagagacacccaggagctgcccccccccgagggccccctgaaggagcccatggacctgaagcccgagccccacagccagggcgtggagggccccccccaggagaagggccccggcagctggcagggccccccccccagaagaaccagagactgcgtgagatgggagagaagcaagggcagaacccccggcagcagctaccccagactgcccagaggccagggcgcctacagacccggcaccagaagagagagcctgggcctggagagcaaggacggcagctag

SEQ ID NO: 9669 - DNA, 2079 bp, Artificial Sequence
  Description of Artificial Sequence: Synthetic coding sequence
atgggcagcgccgccgacgtgagattcagcctgggcaccaccacccacgccccccccggcgtgcacagaagatacagcgccctgagagaggagagcgccaaggactgggagaccagccccctgcccggcatgctggcccccgccgccggccccgccttcgacagcgaccccgagatcagcgacgtggacgaggacgagcccggcggcctggtgggcagcgccgacgtggtgagccccagcggccacagcgacgcccagaccctggccatgatgctgcaggagcagctggacgccatcaacgaggagatcagaatgatccaggaggagaaggagagcaccgagctgagagccgaggagatcgagaccagagtgaccagcggcagcatggaggccctgaacctgaagcagctgagaaagagaggcagcatccccaccagcctgaccgccctgagcctggccagcgccagcccccccctgagcggcagaagcacccccaagctgaccagcagaagcgccgcccaggacctggacagaatgggcgtgatgaccctgcccagcgacctgagaaagcacagaagaaagctgctgagccccgtgagcagagaggagaacagagaggacaaggccaccatcaagtgcgagaccagcccccccagcagccccagaaccctgagactggagaagctgggccaccccgccctgagccaggaggagggcaagagcgccctggaggaccagggcagcaaccccagcagcagcaacagcagccaggacagcctgcacaagggcgccaagagaaagggcatcaagagcagcatcggcagactgttcggcaagaaggagaagggcagactgatccagctgagcagagacggcgccaccggccacgtgctgctgaccgacagcgagttcagcatgcaggagcccatggtgcccgccaagctgggcacccaggccgagaaggacagaagactgaagaagaagcaccagctgctggaggacgccagaagaaagggcatgcccttcgcccagtgggacggccccaccgtggtgagctggctggagctgtgggtgggcatgcccgcctggtacgtggccgcctgcagagccaacgtgaagagcggcgccatcatgagcgccctgagcgacaccgagatccagagagagatcggcatcagcaacgccctgcacagactgaagctgagactggccatccaggagatggtgagcctgaccagccccagcgccccccccaccagcagaaccagcagcggcaacgtgtgggtgacccacgaggagatggagaccctggagaccagcaccaagaccaccctggcctacggcgacatgaaccacgagtggatcggcaacgagtggctgcccagcctgggcctgccccagtacagaagctacttcatggagtgcctggtggacgccagaatgctggaccacctgaccaagaaggacctgagagtgcacctgaagatggtggacagcttccacagaaccagcctgcagtacggcatcatgtgcctgaagagactgaactacgacagaaaggagctggagaagagaagagaggagagccagcacgagatcaaggacgtgctggtgtggaccaacgaccaggtggtgcactgggtgcagagcatcggcctgagagactacgccggcaacctgcacgagagcggcgtgcacggcgccctgctggccctggacgagaacttcgaccacaacaccctggccctgatcctgcagatccccacccagaacacccaggccagacaggtgatggagagagagttcaacaacctgctggccctgggcaccgacagaaagctggacgacggcgacgacaaggtgttcagaagagcccccagctggagaaagagattcagacccagagagcaccacggcagaggcggcatgctgagcgccagcgccgagaccctgcccgccggcttcagagtgagcaccctgggcaccctgcagcccccccccgccccccccaagaagatcatgcccgaggcccacagccactacctgtacggccacatgctgagcgccttcagagactag

SEQ ID NO: 9670 - DNA, 369 bp, Artificial Sequence
  Description of Artificial Sequence: Synthetic coding sequence
atggccccccagaaggacagaaagcccaagagaagcacctggagattcaacctggacctgacccaccccgtggaggacggcatcttcgacagcggcaacttcgagcagttcctgagagagaaggtgaaggtgaacggcaagaccggcaacctgggcaacgtggtgcacatcgagagattcaagaacaagatcaccgtggtgagcgagaagcagttcagcaagagatacctgaagtacctgaccaagaagtacctgaagaagaacaacctgagagactggctgagagtggtggccagcgacaaggagacctacgagctgagatacttccagatcagccaggacgaggacgagagcgagagcgaggactag

SEQ ID NO: 9671 - DNA, 936 bp, Artificial Sequence
  Description of Artificial Sequence: Synthetic coding sequence
atgcagtacatcagccacatcttcggcgtgatcaactgcaacggcttcaccctgagcgaccagagaggcctgcaggccgtgggcgtgggcatcttccccaacctgggcctggtgaaccacgactgctggcccaactgcaccgtgatcttcaacaacggcaagatcgagctgagagccctgggcaagatcagcgagggcgaggagctgaccgtgagctacatcgacttcctgaacgtgagcgaggagagaaagagacagctgaagaagcagtactacttcgactgcacctgcgagcactgccagaagaagctgaaggacgacctgttcctgggcgtgaaggacaaccccaagcccagccaggaggtggtgaaggagatgatccagttcagcaaggacaccctggagaagatcgacaaggccagaagcgagggcctgtaccacgaggtggtgaagctgtgcagagagtgcctggagaagcaggagcccgtgttcgccgacaccaacatctacatgctgagaatgctgagcatcgtgagcgaggtgctgagctacctgcaggccttcgaggaggccagcttctacgccagaagaatggtggacggctacatgaagctgtaccaccccaacaacgcccagctgggcatggccgtgatgagagccggcctgaccaactggcacgccggcaacatcgaggtgggccacggcatgatctgcaaggcctacgccatcctgctggtgacccacggccccagccaccccatcaccaaggacctggaggccatgagagtgcagaccgagatggagctgagaatgttcagacagaacgagttcatgtactacaagatgagagaggccgccctgaacaaccagcccatgcaggtgatggccgagcccagcaacgagcccagccccgccctgttccacaagaagcagtag

SEQ ID NO: 9672 - DNA, 1542 bp, Artificial Sequence
  Description of Artificial Sequence: Synthetic coding sequence
atggccgagctgcagatgctgctggaggaggagatccccggcggcagaagagccctgttcgacagctacaccaacctggagagagtggccgactactgcgagaacaactacatccagagcgccgacaagcagagagccctggaggagaccaaggcctacaccacccagagcctggccagcgtggcctacctgatcaacaccctggccaacaacgtgctgcagatgctggacatccaggccagccagctgagaagaatggagagcagcatcaaccacatcagccagaccgtggacatccacaaggagaaggtggccagaagagagatcggcatcctgaccaccaacaagaacaccagcagaacccacaagatcatcgcccccgccaacctggagagacccgtgagatacatcagaaagcccatcgactacaccatcctggacgacatcggccacggcgtgaagtggctgctgagattcaaggtgagcacccagaacatgaagatgggcggcctgcccagaaccaccccccccacccagaagccccccagcccccccatgagcggcaagggcaccctgggcagacacagcccctacagaaccctggagcccgtgagaccccccgtggtgcccaacgactacgtgcccagccccaccagaaacatggcccccagccagcagagccccgtgagaaccgccagcgtgaaccagagaaacagaacctacagcagcagcggcagcagcggcggcagccaccccagcagcagaagcagcagcagagagaacagcggcagcggcagcgtgggcgtgcccatcgccgtgcccacccccagcccccccagcgtgttccccgcccccgccggcagcgccggcaccccccccctgcccgccaccagcgccagcgcccccgcccccctggtgcccgccaccgtgcccagcagcaccgcccccgacgccgccgccggcggcgcccagaccctggccgacggcttcaccagccccaccccccccgtggtgagcagcaccccccccaccggccaccccgtgcagttctacagcatgaacagacccgccagcagacacaccccccccaccatcggcggcagcctgccctacagaagaccccccagcatcaccagccagaccagcctgcagaaccagatgaacggcggccccttctacagccagaaccccgtgagcgacaccccccccccccccccccccgtggaggagcccgtgttcgacgagagccccccccccccccccccccccgaggactacgaggaggaggaggccgccgtggtggagtacagcgacccctacgccgaggaggaccccccctgggcccccagaagctacctggagaaggtggtggccatctacgactacaccaaggacaaggaggacgagctgagcttccaggagggcgccatcatctacgtgatcaagaagaacgacgacggctggtacgagggcgtgatgaacggcgtgaccggcctgttccccggcaactacgtggagagcatcatgcactacagcgagtag

SEQ ID NO: 9673 - DNA, 1170 bp, Artificial Sequence
  Description of Artificial Sequence: Synthetic coding sequence
atgcccctggagaacctggaggaggagggcctgcccaagaaccccgacctgagaatcgcccagctgagattcctgctgagcctgcccgagcacagaggcgacgccgccgtgagagacgagctgatggccgccgtgagagacaacaacatggccccctactacgaggccctgtgcaagagcctggactggcagatcgacgtggacctgctgaacaagatgaagaaggccaacgaggacgagctgaagagactggacgaggagctggaggacgccgagaagaacctgggcgagagcgagatcagagacgccatgatggccaaggccgagtacctgtgcagaatcggcgacaaggagggcgccctgaccgccttcagaaagacctacgacaagaccgtggccctgggccacagactggacatcgtgttctacctgctgagaatcggcctgttctacatggacaacgacctgatcaccagaaacaccgagaaggccaagagcctgatcgaggagggcggcgactgggacagaagaaacagactgaaggtgtaccagggcctgtactgcgtggccatcagagacttcaagcaggccgccgagctgttcctggacaccgtgagcaccttcaccagctacgagctgatggactacaagaccttcgtgacctacaccgtgtacgtgagcatgatcgccctggagagacccgacctgagagagaaggtgatcaagggcgccgagatcctggaggtgctgcacagcctgcccgccgtgagacagtacctgttcagcctgtacgagtgcagatacagcgtgttcttccagagcctggccgtggtggagcaggagatgaagaaggactggctgttcgccccccactacagatactacgtgagagagatgagaatccacgcctacagccagctgctggagagctacagaagcctgaccctgggctacatggccgaggccttcggcgtgggcgtggagttcatcgaccaggagctgagcagattcatcgccgccggcagactgcactgcaagatcgacaaggtgaacgagatcgtggagaccaacagacccgacagcaagaactggcagtaccaggagaccatcaagaagggcgacctgctgctgaacagagtgcagaagctgagcagagtgatcaacatgtag

SEQ ID NO: 9674 - DNA, 420 bp, Artificial Sequence
  Description of Artificial Sequence: Synthetic coding sequence
atggccaacatcgccgtgcagagaatcaagagagagttcaaggaggtgctgaagagcgaggagaccagcaagaaccagatcaaggtggacctggtggacgagaacttcaccgagctgagaggcgagatcgccggcccccccgacaccccctacgagggcggcagataccagctggagatcaagatccccgagacctaccccttcaacccccccaagtacaagcagaaccccgagatgttcaagcagaccgccagactgtgggcccacgtgtacgccggcgcccccgtgagcagccccgagtacaccaagaagatcgagaacctgtgcgccatgggcttcgacagaaacgccgtgatcgtggccctgagcagcaagagctgggacgtggagaccgccaccgagctgctgctgagcaactag

SEQ ID NO: 9675 - DNA, 1203 bp, Artificial Sequence
  Description of Artificial Sequence: Synthetic coding sequence
atgaacttcaccgtgggcttcaagcccctgctgggcgacgcccacagcatggacaacctggagaagcagctgatctgccccatctgcctggagatgttcagcaagcccgtggtgatcctgccctgccagcacaacctgtgcagaaagtgcgccaacgacgtgttccaggccagcaaccccctgtggcagagcagaggcagcaccaccgtgagcagcggcggcagattcagatgccccagctgcagacacgaggtggtgctggacagacacggcgtgtacggcctgcagagaaacctgctggtggagaacatcatcgacatctacaagcaggagagcagcagacccctgcacagcaaggccgagcagcacctgatgtgcgaggagcacgaggaggagaagatcaacatctactgcctgagctgcgaggtgcccacctgcagcctgtgcaaggtgttcggcgcccacaaggactgcgaggtggcccccctgcccaccatctacaagagacagaagaagcaggacctgaccctgctgcccagactggagtgcagcggcaccaacaccacctactgcagcctggacctgcccagcagcagcgacccccccatcctggccagccagaacaccaagatcatcgacagcgagctgagcgacggcatcgccatgctggtggccggcaacgacagagtgcaggccgtgatcacccagatggaggaggtgtgccagaccatcgaggacaacagcagaagacagaagcagctgctgaaccagagattcgagagcctgtgcgccgtgctggaggagagaaagggcgagctgctgcaggccctggccagagagcaggaggagaagctgcagagagtgagaggcctgatcagacagtacggcgaccacctggaggccagcagcaagctggtggagagcgccatccagagcatggaggagccccagatggccctgtacctgcagcaggccaaggagctgatcaacaaggtgggcgccatgagcaaggtggagctggccggcagacccgagcccggctacgagagcatggagcagttcaccgtgagagtggagcacgtggccgagatgctgagaaccatcgacttccagcccggcgccagcggcgaggaggaggaggtggcccccgacggcgaggagggcagcgccggccccgaggaggagagacccgacggcccctag

SEQ ID NO: 9676 - DNA, 198 bp, Artificial Sequence
  Description of Artificial Sequence: Synthetic coding sequence
atgttcctgagcgccgtgttcttcgccaagagcaagagcaagaacatcctggtgagaatggtgagcgaggccggcaccggcttctgcttcaacaccaagagaaacagactgagagagaagctgaccctgctgcactacgaccccgtggtgaagcagagagtgctgttcgtggagaagaagaagatcagaagcctgtag

SEQ ID NO: 9677 - DNA, 2919 bp, Artificial Sequence
  Description of Artificial Sequence: Synthetic coding sequence
atgagacccgagggcgccggcatggagctgggcggcggcgaggagagactgcccgaggagagcagaagagagcactggcagctgctgggcaacctgaagaccaccgtggagggcctggtgagcaccaacagccccaacgtgtggagcaagtacggcggcctggagagactgtgcagagacatgcagagcatcctgtaccacggcctgatcagagaccaggcctgcagaagacagaccgactactggcagttcgtgaaggacatcagatggctgagcccccacagcgccctgcacgtggagaagttcatcagcgtgcacgagaacgaccagagcagcgccgacggcgccagcgagagagccgtggccgagctgtggctgcagcacagcctgcagtaccactgcctgagcgcccagctgagacccctgctgggcgacagacagtacatcagaaagttctacaccgacgccgccttcctgctgagcgacgcccacgtgaccgccatgctgcagtgcctggaggccgtggagcagaacaaccccagactgctggcccagatcgacgccagcatgttcgccagaaagcacgagagccccctgctggtgaccaagagccagagcctgaccgccctgcccagcagcacctacaccccccccaacagctacgcccagcacagctacttcggcagcttcagcagcctgcaccagagcgtgcccaacaacggcagcgagagaagaagcaccagcttccccctgagcggcccccccagaaagccccaggagagcagaggccacgtgagccccgccgaggaccagaccatccaggccccccccgtgagcgtgagcgccctggccagagacagccccctgacccccaacgagatgagcagcagcaccctgaccagccccatcgaggccagctgggtgagcagccagaacgacagccccggcgacgccagcgagggccccgagtacctggccatcggcaacctggaccccagaggcagaaccgccagctgccagagccacagcagcaacgccgagagcagcagcagcaacctgttcagcagcagcagcagccagaagcccgacagcgccgccagcagcctgggcgaccaggagggcggcggcgagagccagctgagcagcgtgctgagaagaagcagcttcagcgagggccagaccctgaccgtgaccagcggcgccaagaagagccacatcagaagccacagcgacaccagcatcgccagcagaggcgcccccgagagctgcaacgacaaggccaagctgagaggccccctgccctacagcggccagagcagcgaggtgagcacccccagcagcctgtacatggagtacgagggcggcagatacctgtgcagcggcgagggcatgttcagaagacccagcgagggccagagcctgatcagctacctgagcgagcaggacttcggcagctgcgccgacctggagaaggagaacgcccacttcagcatcagcgagagcctgatcgccgccatcgagctgatgaagtgcaacatgatgagccagtgcctggaggaggaggaggtggaggaggaggacagcgacagagagatccaggagctgaagcagaagatcagactgagaagacagcagatcagaaccaagaacctgctgcccatgtaccaggaggccgagcacggcagcttcagagtgaccagcagcagcagccagttcagcagcagagacagcgcccagctgagcgacagcggcagcgccgacgaggtggacgagttcgagatccaggacgccgacatcagaagaaacaccgccagcagcagcaagagcttcgtgagcagccagagcttcagccactgcttcctgcacagcaccagcgccgaggccgtggccatgggcctgctgaagcagttcgagggcatgcagctgcccgccgccagcgagctggagtggctggtgcccgagcacgacgccccccagaagctgctgcccatccccgacagcctgcccatcagccccgacgacggccagcacgccgacatctacaagctgagaatcagagtgagaggcaacctggagtgggccccccccagaccccagatcatcttcaacgtgcaccccgcccccaccagaaagatcgccgtggccaagcagaactacagatgcgccggctgcggcatcagaaccgaccccgactacatcaagagactgagatactgcgagtacctgggcaagtacttctgccagtgctgccacgagaacgcccagatggccatccccagcagagtgctgagaaagtgggacttcagcaagtactacgtgagcaacttcagcaaggacctgctgatcaagatctggaacgaccccctgttcaacgtgcaggacatcaacagcgccctgtacagaaaggtgaagctgctgaaccaggtgagactgctgagagtgcagctgtgccacatgaagaacatgttcaagacctgcagactggccaaggagctgctggacagcttcgacaccgtgcccggccacctgaccgaggacctgcacctgtacagcctgaacgacctgaccgccaccagaaagggcgagctgggccccagactggccgagctgaccagagccggcgccacccacgtggagagatgcatgctgtgccaggccaagggcttcatctgcgagttctgccagaacgaggacgacatcatcttccccttcgagctgcacaagtgcagaacctgcgaggagtgcaaggcctgctaccacaaggcctgcttcaagagcggcagctgccccagatgcgagagactgcaggccagaagagaggccctggccagacagagcctggagagctacctgagcgactacgaggaggagcccgccgaggccctggccctggaggccgccgtgctggaggccacctag

SEQ ID NO: 9678 - DNA, 1161 bp, Artificial Sequence
  Description of Artificial Sequence: Synthetic coding sequence
atggccgccgtggagaccagagtgtgcgagaccgacggctgcagcagcgaggccaagctgcagtgccccacctgcatcaagctgggcatccagggcagctacttctgcagccaggagtgcttcaagggcagctgggccacccacaagctgctgcacaagaaggccaaggacgagaaggccaagagagaggtgagcagctggaccgtggagggcgacatcaacaccgacccctgggccggctacagatacaccggcaagctgagaccccactaccccctgatgcccaccagacccgtgcccagctacatccagagacccgactacgccgaccaccccctgggcatgagcgagagcgagcaggccctgaagggcaccagccagatcaagctgctgagcagcgaggacatcgagggcatgagactggtgtgcagactggccagagaggtgctggacgtggccgccggcatgatcaagcccggcgtgaccaccgaggagatcgaccacgccgtgcacctggcctgcatcgccagaaactgctaccccagccccctgaactactacaacttccccaagagctgctgcaccagcgtgaacgaggtgatctgccacggcatccccgacagaagacccctgcaggagggcgacatcgtgaacgtggacatcaccctgtacagaaacggctaccacggcgacctgaacgagaccttcttcgtgggcgaggtggacgacggcgccagaaagctggtgcagaccacctacgagtgcctgatgcaggccatcgacgccgtgaagcccggcgtgagatacagagagctgggcaacatcatccagaagcacgcccaggccaacggcttcagcgtggtgagaagctactgcggccacggcatccacaagctgttccacaccgcccccaacgtgccccactacgccaagaacaaggccgtgggcgtgatgaagagcggccacgtgttcaccatcgagcccatgatctgcgagggcggctggcaggacgagacctggcccgacggctggaccgccgtgaccagagacggcaagagaagcgcccagttcgagcacaccctgctggtgaccgacaccggctgcgagatcctgaccagaagactggacagcgccagaccccacttcatgagccagttctag

SEQ ID NO: 9679 - DNA, 738 bp, Artificial Sequence
  Description of Artificial Sequence: Synthetic coding sequence
atgggcagactggacggcaaggtgatcatcctgaccgccgccgcccagggcatcggccaggccgccgccctggccttcgccagagagggcgccaaggtgatcgccaccgacatcaacgagagcaagctgcaggagctggagaagtaccccggcatccagaccagagtgctggacgtgaccaagaagaagcagatcgaccagttcgccaacgaggtggagagactggacgtgctgttcaacgtggccggcttcgtgcaccacggcaccgtgctggactgcgaggagaaggactgggacttcagcatgaacctgaacgtgagaagcatgtacctgatgatcaaggccttcctgcccaagatgctggcccagaagagcggcaacatcatcaacatgagcagcgtggccagcagcgtgaagggcgtggtgaacagatgcgtgtacagcaccaccaaggccgccgtgatcggcctgaccaagagcgtggccgccgacttcatccagcagggcatcagatgcaactgcgtgtgccccggcaccgtggacacccccagcctgcaggagagaatccaggccagaggcaaccccgaggaggccagaaacgacttcctgaagagacagaagaccggcagattcgccaccgccgaggagatcgccatgctgtgcgtgtacctggccagcgacgagagcgcctacgtgaccggcaaccccgtgatcatcgacggcggctggagcctgtag

SEQ ID NO: 9680 - DNA, 2520 bp, Artificial Sequence
  Description of Artificial Sequence: Synthetic coding sequence
atgagcgtggtgggcatcgacctgggcttcctgaactgctacatcgccgtggccagaagcggcggcatcgagaccatcgccaacgagtacagcgacagatgcacccccgcctgcatcagcctgggcagcagaaccagagccatcggcaacgccgccaagagccagatcgtgaccaacgtgagaaacaccatccacggcttcaagaagctgcacggcagaagcttcgacgaccccatcgtgcagaccgagagaatcagactgccctacgagctgcagaagatgcccaacggcagcgccggcgtgaaggtgagatacctggaggaggagagacccttcgccatcgagcaggtgaccggcatgctgctggccaagctgaaggagaccagcgagaacgccctgaagaagcccgtggccgactgcgtgatcagcatccccagcttcttcaccgacgccgagagaagaagcgtgatggccgccgcccaggtggccggcctgaactgcctgagactgatgaacgagaccaccgccgtggccctggcctacggcatctacaagcaggacctgccccccctggacgagaagcccagaaacgtggtgttcatcgacatgggccacagcgcctaccaggtgctggtgtgcgccttcaacaagggcaagctgaaggtgctggccaccaccttcgacccctacctgggcggcagaaacttcgacgaggccctggtggactacttctgcgacgagttcaagaccaagtacaagatcaacgtgaaggagaacagcagagccctgctgagactgtaccaggagtgcgagaagctgaagaagctgatgagcgccaacgccagcgacctgcccctgaacatcgagtgcttcatgaacgacctggacgtgagcagcaagatgaacagagcccagttcgagcagctgtgcgccagcctgctggccagagtggagccccccctgaaggccgtgatggagcaggccaacctgcagagagaggacatcagcagcatcgagatcgtgggcggcgccaccagaatccccgccgtgaaggagcagatcaccaagttcttcctgaaggacatcagcaccaccctgaacgccgacgaggccgtggccagaggctgcgccctgcagtgcgccatcctgagccccgccttcaaggtgagagagttcagcatcaccgacctggtgccctacagcatcaccctgagatggaagaccagcttcgaggacggcagcggcgagtgcgaggtgttctgcaagaaccaccccgcccccttcagcaaggtgatcaccttccacaagaaggagcccttcgagctggaggccttctacaccaacctgcacgaggtgccctaccccgacgccagaatcggcagcttcaccatccagaacgtgttcccccagagcgacggcgacagcagcaaggtgaaggtgaaggtgagagtgaacatccacggcatcttcagcgtggccagcgccagcgtgatcgagaagcagaacctggagggcgaccacagcgacgcccccatggagaccgagaccagcttcaagaacgagaacaaggacaacatggacaagatgcaggtggaccaggaggagggccaccagaagtgccacgccgagcacacccccgaggaggagatcgaccacaccggcgccaagaccaagagcgccgtgagcgacaagcaggacagactgaaccagaccctgaagaagggcaaggtgaagagcatcgacctgcccatccagagcagcctgtgcagacagctgggccaggacctgctgaacagctacatcgagaacgagggcaagatgatcatgcaggacaagctggagaaggagagaaacgacgccaagaacgccgtggaggagtacgtgtacgacttcagagacagactgggcaccgtgtacgagaagttcatcacccccgaggacctgagcaagctgagcgccgtgctggaggacaccgagaactggctgtacgaggacggcgaggaccagcccaagcaggtgtacgtggacaagctgcaggagctgaagaagtacggccagcccatccagatgaagtacatggagcacgaggagagacccaaggccctgaacgacctgggcaagaagatccagctggtgatgaaggtgatcgaggcctacagaaacaaggacgagagatacgaccacctggaccccaccgagatggagaaggtggagaagtgcatcagcgacgccatgagctggctgaacagcaagatgaacgcccagaacaagctgagcctgacccaggaccccgtggtgaaggtgagcgagatcgtggccaagagcaaggagctggacaacttctgcaaccccatcatctacaagcccaagcccaaggccgaggtgcccgaggacaagcccaaggccaacagcgagcacaacggccccatggacggccagagcggcaccgagaccaagagcgacagcaccaaggacagcagccagcacaccaagagcagcggcgagatggaggtggactag

SEQ ID NO: 9681 - DNA, 1224 bp, Artificial Sequence
  Description of Artificial Sequence: Synthetic coding sequence
atggccgccccctgcgccgaggaccccagcctggagagacacttcaagggccacagagacgccgtgacctgcgtggacttcagcatcaacaccaagcagctggccagcggcagcatggacagctgcctgatggtgtggcacatgaagccccagagcagagcctacagattcaccggccacaaggacgccgtgacctgcgtgaacttcagccccagcggccacctgctggccagcggcagcagagacaagaccgtgagaatctgggtgcccaacgtgaagggcgagagcaccgtgttcagagcccacaccgccaccgtgagaagcgtgcacttctgcagcgacggccagagcttcgtgaccgccagcgacgacaagaccgtgaaggtgtgggccacccacagacagaagttcctgttcagcctgagccagcacatcaactgggtgagatgcgccaagttcagccccgacggcagactgatcgtgagcgccagcgacgacaagaccgtgaagctgtgggacaagagcagcagagagtgcgtgcacagctactgcgagcacggcggcttcgtgacctacgtggacttccaccccagcggcacctgcatcgccgccgccggcatggacaacaccgtgaaggtgtgggacgtgagaacccacagactgctgcagcactaccagctgcacagcgccgccgtgaacggcctgagcttccaccccagcggcaactacctgatcaccgccagcagcgacagcaccctgaagatcctggacctgatggagggcagactgctgtacaccctgcacggccaccagggccccgccaccaccgtggccttcagcagaaccggcgagtacttcgccagcggcggcagcgacgagcaggtgatggtgtggaagagcaacttcgacatcgtggaccacggcgaggtgaccaaggtgcccagaccccccgccaccctggccagcagcatgggcaacctgcccgaggtggacttccccgtgccccccggcagaggcagaagcgtggagagcgtgcagagccagccccaggagcccgtgagcgtgccccagaccctgaccagcaccctggagcacatcgtgggccagctggacgtgctgacccagaccgtgagcatcctggagcagagactgaccctgaccgaggacaagctgaagcagtgcctggagaaccagcagctgatcatgcagagagccaccccctag

SEQ ID NO: 9682 - DNA, 1173 bp, Artificial Sequence
  Description of Artificial Sequence: Synthetic coding sequence
atggccaccggcgacctgaagagaagcctgagaaacctggagcaggtgctgagactgctgaactaccccgaggaggtggactgcgtgggcctgatcaagggcgaccccgccgccagcctgcccatcatcagctacagcttcaccagctacagcccctacgtgaccgagctgatcatggagagcaacgtggagctgatcgccaagaacgacctgagattcatcgacgccgtgtacaagctgctgagagaccagttcaactacaagcccatcctgaccaagaagcagttcatccagtgcggcttcgccgagtggaagatccagatcgtgtgcgacatcctgaactgcgtgatgaagaagcacaaggagctgagcagcctgcagaagatccccagccagcagagaaagaagatcagcagcggcaagagcgagccccccctgggcaacgagaagatcagcgccgaggccgtgggcgtggacatcagcggcagattcatgaccagcggcaagaagaaggccgtggtgatcagacacctgtacaacgaggacaacgtggacatcagcgaggacaccctgagccccatcaccgacgtgaacgaggccgtggacgtgagcgacctgaacgccaccgagatcaagatgcccgaggtgaaggtgcccgagatcaaggccgagcagcaggacgtgaacgtgaaccccgagatcaccgccctgcagaccatgctggccgagtgccaggagaacctgaagaagctgaccagcatcgagaagagactggactgcctggagcagaagatgaagggcaaggtgatggtggacgagaacacctggaccaacctgctgagcagagtgaccctgctggagaccgagatgctgctgagcaagaagaacgacgagttcatcgagttcaacgaggtgagcgaggactacgccagctgcagcgacatggacctgctgaacccccacagaaagagcgaggtggagagacccgccagcatccccctgagcagcggctacagcaccgccagcagcgacagcacccccagagccagcaccgtgaactactgcggcctgaacgagatcagcgaggagaccaccatccagaagatggagagaatgaagaagatgttcgaggagaccgccgagctgctgaagtgccccaaccactacctgtag

SEQ ID NO: 9683 - DNA, 2601 bp, Artificial Sequence
  Description of Artificial Sequence: Synthetic coding sequence
atgcccgccgtgagcctgccccccaaggagaacgccctgttcaagagaatcctgagatgctacgagcacaagcagtacagaaacggcctgaagttctgcaagcagatcctgagcaaccccaagttcgccgagcacggcgagaccctggccatgaagggcctgaccctgaactgcctgggcaagaaggaggaggcctacgagctggtgagaagaggcctgagaaacgacctgaagagccacgtgtgctggcacgtgtacggcctgctgcagagaagcgacaagaagtacgacgaggccatcaagtgctacagaaacgccctgaagtgggacaaggacaacctgcagatcctgagagacctgagcctgctgcagatccagatgagagacctggagggctacagagagaccagataccagctgctgcagctgagacccgcccagagagccagctggatcggctacgccatcgcctaccacctgctggaggactacgagatggccgccaagatcctggaggagttcagaaagacccagcagaccagccccgacaaggtggactacgagtacagcgagctgctgctgtaccagaaccaggtgctgagagaggccggcctgtacagagaggccctggagcacctgtgcacctacgagaagcagatctgcgacaagctggccgtggaggagaccaagggcgagctgctgctgcagctgtgcagactggaggacgccgccgacgtgtacagaggcctgcaggagagaaaccccgagaactgggcctactacaagggcctggagaaggccctgaagcccgccaacatgctggagagactgaagatctacgaggaggcctggaccaagtaccccagaggcctggtgcccagaagactgcccctgaacttcctgagcggcgagaagttcaaggagtgcctggacaagttcctgagaatgaacttcagcaagggctgcccccccgtgttcaacaccctgagaagcctgtacaaggacaaggagaaggtggccatcatcgaggagctggtggtgggctacgagaccagcctgaagagctgcagactgttcaaccccaacgacgacggcaaggaggagccccccaccaccctgctgtgggtgcagtactacctggcccagcactacgacaagatcggccagcccagcatcgccctggagtacatcaacaccgccatcgagagcacccccaccctgatcgagctgttcctggtgaaggccaagatctacaagcacgccggcaacatcaaggaggccgccagatggatggacgaggcccaggccctggacaccgccgacagattcatcaacagcaagtgcgccaagtacatgctgaaggccaacctgatcaaggaggccgaggagatgtgcagcaagttcaccagagagggcaccagcgccgtggagaacctgaacgagatgcagtgcatgtggttccagaccgagtgcgcccaggcctacaaggccatgaacaagttcggcgaggccctgaagaagtgccacgagatcgagagacacttcatcgagatcaccgacgaccagttcgacttccacacctactgcatgagaaagatcaccctgagaagctacgtggacctgctgaagctggaggacgtgctgagacagcaccccttctacttcaaggccgccagaatcgccatcgagatctacctgaagctgcacgacaaccccctgaccgacgagaacaaggagcacgaggccgacaccgccaacatgagcgacaaggagctgaagaagctgagaaacaagcagagaagagcccagaagaaggcccagatcgaggaggagaagaagaacgccgagaaggagaagcagcagagaaaccagaagaagaagaaggacgacgacgacgaggagatcggcggccccaaggaggagctgatccccgagaagctggccaaggtggagacccccctggaggaggccatcaagttcctgacccccctgaagaacctggtgaagaacaagatcgagacccacctgttcgccttcgagatctacttcagaaaggagaagttcctgctgatgctgcagagcgtgaagagagccttcgccatcgacagcagccacccctggctgcacgagtgcatgatcagactgttcaacaccgccgtgtgcgagagcaaggacctgagcgacaccgtgagaaccgtgctgaagcaggagatgaacagactgttcggcgccaccaaccccaagaacttcaacgagaccttcctgaagagaaacagcgacagcctgccccacagactgagcgccgccaagatggtgtactacctggaccccagcagccagaagagagccatcgagctggccaccaccctggacgagagcctgaccaacagaaacctgcagacctgcatggaggtgctggaggccctgtacgacggcagcctgggcgactgcaaggaggccgccgagatctacagagccaactgccacaagctgttcccctacgccctggccttcatgccccccggctacgaggaggacatgaagatcaccgtgaacggcgacagcagcgccgaggccgaggagctggccaacgagatctag

SEQ ID NO: 9684 - DNA, 1293 bp, Artificial Sequence
  Description of Artificial Sequence: Synthetic coding sequence
atggccagcagcgccaagagcgccgagatgcccaccatcagcaagaccgtgaaccccacccccgacccccaccaggagtacctggaccccagaatcaccatcgccctgttcgagatcggcagccacagccccagcagctggggcagcctgcccttcctgaagaacagcagccaccaggtgaccgagcagcagaccgcccagaagttcaacaacctgctgaaggagatcaaggacatcctgaagaacatggccggcttcgaggagaagatcaccgaggccaaggagctgttcgaggagaccaacatcaccgaggacgtgagcgcccacaaggagaacatcagaggcctggacaagatcaacgagatgctgagcaccaacctgcccgtgagcctggcccccgagaaggaggacaacgagaagaagcaggagatgatcctggagaccaacatcaccgaggacgtgagcgcccacaaggagaacatcagaggcctggacaagatcaacgagatgctgagcaccaacctgcccgtgagcctggcccccgagaaggaggacaacgagaagaagcagcagatgatcatggagaaccagaacagcgagaacaccgcccaggtgttcgccagagacctggtgaacagactggaggagaagaaggtgctgaacgagacccagcagagccaggagaaggccaagaacagactgaacgtgcaggaggagaccatgaagatcagaaacaacatggagcagctgctgcaggaggccgagcactggagcaagcagcacaccgagctgagcaagctgatcaagagctaccagaagagccagaaggacatcagcgagaccctgggcaacaacggcgtgggcttccagacccagcccaacaacgaggtgagcgccaagcacgagctggaggagcaggtgaagaagctgagccacgacacctacagcctgcagctgatggccgccctgctggagaacgagtgccagatcctgcagcagagagtggagatcctgaaggagctgcaccaccagaagcagggcaccctgcaggagaagcccatccagatcaactacaagcaggacaagaagaaccagaagcccagcgaggccaagaaggtggagatgtacaagcagaacaagcaggccatgaagggcaccttctggaagaaggacagaagctgcagaagcctggacgtgtgcctgaacaagaaggcctgcaacacccagttcaacatccacgtggccagaaaggccctgagaggcaagatgagaagcgccagcagcctgagatag

SEQ ID NO: 9685 - DNA, 5199 bp, Artificial Sequence
  Description of Artificial Sequence: Synthetic coding sequence
atggccgccatcggcagaggcagaagcctgaagaacctgagagtgagaggcagaaacgacagcggcgaggagaacgtgcccctggacctgaccagagagcccagcgacaacctgagagagatcctgcagaacgtggccagactgcagggcgtgagcaacatgagaaagctgggccacctgaacaacttcaccaagctgctgtgcgacatcggccacagcgaggagaagctgggcttccactacgaggacatcatcatctgcctgagactggccctgctgaacgaggccaaggaggtgagagccgccggcctgagagccctgagatacctgatccaggacagcagcatcctgcagaaggtgctgaagctgaaggtggactacctgatcgccagatgcatcgacatccagcagagcaacgaggtggagagaacccaggccctgagactggtgagaaagatgatcaccgtgaacgccagcctgttccccagcagcgtgaccaacagcctgatcgccgtgggcaacgacggcctgcaggagagagacagaatggtgagagcctgcatcgccatcatctgcgagctggccctgcagaaccccgaggtggtggccctgagaggcggcctgaacaccatcctgaagaacgtgatcgactgccagctgagcagaatcaacgaggccctgatcaccaccatcctgcacctgctgaaccaccccaagaccagacagtacgtgagagccgacgtggagctggagagaatcctggccccctacaccgacttccactacagacacagccccgacaccgccgagggccagctgaaggaggacagagaggccagattcctggccagcaagatgggcatcatcgccaccttcagaagctgggccggcatcatcaacctgtgcaagcccggcaacagcggcatccagagcctgatcggcgtgctgtgcatccccaacatggagatcagaagaggcctgctggaggtgctgtacgacatcttcagactgcccctgcccgtggtgaccgaggagttcatcgaggccctgctgagcgtggaccccggcagattccaggacagctggagactgagcgacggcttcgtggccgccgaggccaagaccatcctgccccacagagccagaagcagacccgacctgatggacaactacctggccctgatcctgagcgccttcatcagaaacggcctgctggagggcctggtggaggtgatcaccaacagcgacgaccacatcagcgtgagagccaccatcctgctgggcgagctgctgcacatggccaacaccatcctgccccacagccacagccaccacctgcactgcctgcccaccctgatgaacatggccgccagcttcgacatccccaaggagaagagactgagagccagcgccgccctgaactgcctgaagagattccacgagatgaagaagagaggccccaagccctacagcctgcacctggaccacatcatccagaaggccatcgccacccaccagaagagagaccagtacctgagagtgcagaaggacatcttcatcctgaaggacaccgaggaggccctgctgatcaacctgagagacagccaggtgctgcagcacaaggagaacctggagtggaactggaacctgatcggcaccatcctgaagtggcccaacgtgaacctgagaaactacaaggacgagcagctgcacagattcgtgagaagactgctgtacttctacaagcccagcagcaagctgtacgccaacctggacctggacttcgccaaggccaagcagctgaccgtggtgggctgccagttcaccgagttcctgctggagagcgaggaggacggccagggctacctggaggacctggtgaaggacatcgtgcagtggctgaacgccagcagcggcatgaagcccgagagaagcctgcagaacaacggcctgctgaccaccctgagccagcactacttcctgttcatcggcaccctgagctgccacccccacggcgtgaagatgctggagaagtgcagcgtgttccagtgcctgctgaacctgtgcagcctgaagaaccaggaccacctgctgaagctgaccgtgagcagcctggactacagcagagacggcctggccagagtgatcctgagcaagatcctgaccgccgccaccgacgcctgcagactgtacgccaccaagcacctgagagtgctgctgagagccaacgtggagttcttcaacaactggggcatcgagctgctggtgacccagctgcacgacaagaacaagaccatcagcagcgaggccctggacatcctggacgaggcctgcgaggacaaggccaacctgcacgccctgatccagatgaagcccgccctgagccacctgggcgacaagggcctgctgctgctgctgagattcctgagcatccccaagggcttcagctacctgaacgagagaggctacgtggccaagcagctggagaagtggcacagagagtacaacagcaagtacgtggacctgatcgaggagcagctgaacgaggccctgaccacctacagaaagcccgtggacggcgacaactacgtgagaagaagcaaccagagactgcagagaccccacgtgtacctgcccatccacctgtacggccagctggtgcaccacaagaccggctgccacctgctggaggtgcagaacatcatcaccgagctgtgcagaaacgtgagaacccccgacctggacaagtgggaggagatcaagaagctgaaggccagcctgtgggccctgggcaacatcggcagcagcaactggggcctgaacctgctgcaggaggagaacgtgatccccgacatcctgaagctggccaagcagtgcgaggtgctgagcatcagaggcacctgcgtgtacgtgctgggcctgatcgccaagaccaagcagggctgcgacatcctgaagtgccacaactgggacgccgtgagacacagcagaaagcacctgtggcccgtggtgcccgacgacgtggagcagctgtgcaacgagctgagcagcatccccagcaccctgagcctgaacagcgagagcaccagcagcagacacaacagcgagagcgagagcgtgcccagcagcatgttcatcctggaggacgacagattcggcagcagcagcaccagcaccttcttcctggacatcaacgaggacaccgagcccaccttctacgacagaagcggccccatcaaggacaagaacagcttccccttcttcgccagcagcaagctggtgaagaacagaatcctgaacagcctgaccctgcccaacaagaagcacagaagcagcagcgaccccaagggcggcaagctgagcagcgagagcaagaccagcaacagaagaatcagaaccctgaccgagcccagcgtggacttcaaccacagcgacgacttcacccccatcagcaccgtgcagaagaccctgcagctggagaccagcttcatgggcaacaagcacatcgaggacaccggcagcacccccagcatcggcgagaacgacctgaagttcaccaagaacttcggcaccgagaaccacagagagaacaccagcagagagagactggtggtggagagcagcaccagcagccacatgaagatcagaagccagagcttcaacaccgacaccaccaccagcggcatcagcagcatgagcagcagccccagcagagagaccgtgggcgtggacgccaccaccatggacaccgactgcggcagcatgagcaccgtggtgagcaccaagaccatcaagaccagccactacctgaccccccagagcaaccacctgagcctgagcaagagcaacagcgtgagcctggtgccccccggcagcagccacaccctgcccagaagagcccagagcctgaaggcccccagcatcgccaccatcaagagcctggccgactgcaacttcagctacaccagcagcagagacgccttcggctacgccaccctgaagagactgcagcagcagagaatgcaccccagcctgagccacagcgaggccctggccagccccgccaaggacgtgctgttcaccgacaccatcaccatgaaggccaacagcttcgagagcagactgacccccagcagaatcgacttcaagaagaagcacgtgggcggcatcagaagcctgagacccaccatcaccaacaacctgttcagattcatgaaggccctgagctacgccagcctggacaaggaggacctgctgagccccatcaaccagaacaccctgcagagaagcagcagcgtgagaagcatggtgagcagcgccacctacggcggcagcgacgactacatcggcctggccctgcccgtggacatcaacgacatcttccaggtgaaggacatcccctacttccagaccaagaacatccccccccacgacgacagaggcgccagagccttcgcccacgacgccggcggcctgcccagcggcaccggcggcctggtgaagaacagcttccacctgctgagacagcagatgagcctgaccgagatcatgaacagcatccacagcgacgccagcctgttcctggagagcaccgaggacaccggcctgcaggagcacaccgacgacaactgcctgtactgcgtgtgcatcgagatcctgggcttccagcccagcaaccagctgagcgccatctgcagccacagcgacttccaggacatcccctacagcgactggtgcgagcagaccatccacaaccccctggaggtggtgcccagcaagttcagcggcatcagcggctgcagcgacggcgtgagccaggagggcagcgccagcagcaccaagagcaccgagctgctgctgggcgtgaagaccatccccgacgacacccccatgtgcagaatcctgctgagaaaggaggtgctgagactggtgatcaacctgagcagcagcgtgagcaccaagtgccacgagaccggcctgctgaccatcaaggagaagtacccccagaccttcgacgacatctgcctgtacagcgaggtgagccacctgctgagccactgcaccttcagactgccctgcagaagattcatccaggagctgttccaggacgtgcagttcctgcagatgcacgaggaggccgaggccgtgctggccaccccccccaagcagcccatcgtggacaccagcgccgagagctag

SEQ ID NO: 9686 - DNA, 1761 bp, Artificial Sequence
  Description of Artificial Sequence: Synthetic coding sequence
atgagcgccaccgtggtggacgccgtgaacgccgcccccctgagcggcagcaaggagatgagcctggaggagcccaagaagatgaccagagaggactggagaaagaagaaggagctggaggagcagagaaagctgggcaacgcccccgccgaggtggacgaggagggcaaggacatcaacccccacatcccccagtacatcagcagcgtgccctggtacatcgaccccagcaagagacccaccctgaagcaccagagaccccagcccgagaagcagaagcagttcagcagcagcggcgagtggtacaagagaggcgtgaaggagaacagcatcatcaccaagtacagaaagggcgcctgcgagaactgcggcgccatgacccacaagaagaaggactgcttcgagagacccagaagagtgggcgccaagttcaccggcaccaacatcgcccccgacgagcacgtgcagccccagctgatgttcgactacgacggcaagagagacagatggaacggctacaaccccgaggagcacatgaagatcgtggaggagtacgccaaggtggacctggccaagagaaccctgaaggcccagaagctgcaggaggagctggccagcggcaagctggtggagcaggccaacagccccaagcaccagtggggcgaggaggagcccaacagccagatggagaaggaccacaacagcgaggacgaggacgaggacaagtacgccgacgacatcgacatgcccggccagaacttcgacagcaagagaagaatcaccgtgagaaacctgagaatcagagaggacatcgccaagtacctgagaaacctggaccccaacagcgcctactacgaccccaagaccagagccatgagagagaacccctacgccaacgccggcaagaaccccgacgaggtgagctacgccggcgacaacttcgtgagatacaccggcgacaccatcagcatggcccagacccagctgttcgcctgggaggcctacgacaagggcagcgaggtgcacctgcaggccgaccccaccaagctggagctgctgtacaagagcttcaaggtgaagaaggaggacttcaaggagcagcagaaggagagcatcctggagaagtacggcggccaggagcacctggacgccccccccgccgagctgctgctggcccagaccgaggactacgtggagtacagcagacacggcaccgtgatcaagggccaggagagagccgtggcctgcagcaagtacgaggaggacgtgaagatccacaaccacacccacatctggggcagctactggaaggagggcagatggggctacaagtgctgccacagcttcttcaagtacagctactgcaccggcgaggccggcaaggagatcgtgaacagcgaggagtgcatcatcaacgagatcaccggcgaggagagcgtgaagaagccccagaccctgatggagctgcaccaggagaagctgaaggaggagaagaagaagaagaagaagaagaagaagaagcacagaaagagcagcagcgacagcgacgacgaggagaagaagcacgagaagctgaagaaggccctgaacgccgaggaggccagactgctgcacgtgaaggagaccatgcagatcgacgagagaaagagaccctacaacagcatgtacgagaccagagagcccaccgaggaggagatggaggcctacagaatgaagagacagagacccgacgaccccatggccagcttcctgggccagtag

SEQ ID NO: 9687 - DNA, 1185 bp, Artificial Sequence
  Description of Artificial Sequence: Synthetic coding sequence
atggccctggaggtgggcgacatggaggacggccagctgagcgacagcgacagcgacatgaccgtggcccccagcgacagacccctgcagctgcccaaggtgctgggcggcgacagcgccatgagagccttccagaacaccgccaccgcctgcgcccccgtgagccactacagagccgtggagagcgtggacagcagcgaggagagcttcagcgacagcgacgacgacagctgcctgtggaagagaaagagacagaagtgcttcaaccccccccccaagcccgagcccttccagttcggccagagcagccagaagccccccgtggccggcggcaagaagatcaacaacatctggggcgccgtgctgcaggagcagaaccaggacgccgtggccaccgagctgggcatcctgggcatggagggcaccatcgacagaagcagacagagcgagacctacaactacctgctggccaagaagctgagaaaggagagccaggagcacaccaaggacctggacaaggagctggacgagtacatgcacggcggcaagaagatgggcagcaaggaggaggagaacggccagggccacctgaagagaaagagacccgtgaaggacagactgggcaacagacccgagatgaactacaagggcagatacgagatcaccgccgaggacagccaggagaaggtggccgacgagatcagcttcagactgcaggagcccaagaaggacctgatcgccagagtggtgagaatcatcggcaacaagaaggccatcgagctgctgatggagaccgccgaggtggagcagaacggcggcctgttcatcatgaacggcagcagaagaagaacccccggcggcgtgttcctgaacctgctgaagaacacccccagcatcagcgaggagcagatcaaggacatcttctacatcgagaaccagaaggagtacgagaacaagaaggccgccagaaagagaagaacccaggtgctgggcaagaagatgaagcaggccatcaagagcctgaacttccaggaggacgacgacaccagcagagagaccttcgccagcgacaccaacgaggccctggccagcctggacgagagccaggagggccacgccgaggccaagctggaggccgaggaggccatcgaggtggaccacagccacgacctggacatcttctag

SEQ ID NO: 9688 - DNA, 789 bp, Artificial Sequence
  Description of Artificial Sequence: Synthetic coding sequence
atgttcctgttcagcagaaagaccagaacccccatcagcacctacagcgacagctacagagcccccaccagcatcaaggaggtgtacaaggacccccccctgtgcgcctgggaggccaacaagttcctgacccccggcctgacccacaccatggagagacacgtggaccccgaggccctgcagaagatggccaagtgcgccgtgcaggactacacctacagaggcagcatcagcggccacccctacctgcccgagaagtactggctgagccaggaggaggccgacaagtgcagccccaactacctgggcagcgactggtacaacacctggagaatggagccctacaacagcagctgctgcaacaagtacaccacctacctgcccagactgcccaaggaggccagaatggagaccgccgtgagaggcatgcccctggagtgcccccccagacccgagagactgaacgcctacgagagagaggtgatggtgaacatgctgaacagcctgagcagaaaccagcagctgcccagaatcacccccagatgcggctgcgtggaccccctgcccggcagactgcccttccacggctacgagagcgcctgcagcggcagacactactgcctgagaggcatggactactacgccagcggcgccccctgcaccgacagaagactgagaccctggtgcagagagcagcccaccatgtgcaccagcctgagagcccccgccagaaacgccgtgtgctgctacaacagccccgccgtgatcctgcccatcagcgagccctag

SEQ ID NO: 9689 - DNA, 4206 bp, Artificial Sequence
  Description of Artificial Sequence: Synthetic coding sequence
atggaggagatccccgtgaaggtggccgtgagaatcagacccctgctgtgcaaggaggccctgcacaaccaccaggtgtgcgtgagagtgatccccaacagccagcaggtgatcatcggcagagacagagtgttcaccttcgacttcgtgttcggcaagaacagcacccaggacgaggtgtacaacacctgcatcaagcccctggtgctgagcctgatcgagggctacaacgccaccgtgttcgcctacggccagaccggcagcggcaagacctacaccatcggcggcggccacatcgccagcgtggtggagggccagaagggcatcatccccagagccatccaggagatcttccagagcatcagcgagcaccccagcatcgacttcaacgtgaaggtgagctacatcgaggtgtacaaggaggacctgagagacctgctggagctggagaccagcatgaaggacctgcacatcagagaggacgagaagggcaacaccgtgatcgtgggcgccaaggagtgccacgtggagagcgccggcgaggtgatgagcctgctggagatgggcaacgccgccagacacaccggcaccacccagatgaacgagcacagcagcagaagccacgccatcttcaccatcagcatctgccaggtgcacaagaacatggaggccgccgaggacggcagctggtacagccccagacacatcgtgagcaagttccacttcgtggacctggccggcagcgagagagtgaccaagaccggcaacaccggcgagagattcaaggagagcatccagatcaacagcggcctgctggccctgggcaacgtgatcagcgccctgggcgaccccagaagaaagagcagccacatcccctacagagacgccaagatcaccagactgctgaaggacagcctgggcggcagcgccaagaccgtgatgatcacctgcgtgagccccagcagcagcaacttcgacgagagcctgaacagcctgaagtacgccaacagagccagaaacatcagaaacaagcccaccgtgaacttcagccccgagagcgacagaatcgacgagatggagttcgagatcaagctgctgagagaggccctgcagagccagcaggccggcgtgagccagaccacccagatcaacagagagggcagccccgacaccaacagaatccacagcctggaggagcaggtggcccagctgcagggcgagtgcctgggctaccagtgctgcgtggaggaggccttcaccttcctggtggacctgaaggacaccgtgagactgaacgagaagcagcagcacaagctgcaggagtggttcaacatgatccaggaggtgagaaaggccgtgctgaccagcttcagaggcatcggcggcaccgccagcctggaggagggcccccagcacgtgaccgtgctgcagctgaagagagagctgaagaagtgccagtgcgtgctggccgccgacgaggtggtgttcaaccagaaggagctggaggtgaaggagctgaagaaccaggtgcagatgatggtgcaggagaacaagggccacgccgtgagcctgaaggaggcccagaaggtgaacagactgcagaacgagaagatcatcgagcagcagctgctggtggaccagctgagcgaggagctgaccaagctgaacctgagcgtgaccagcagcgccaaggagaactgcggcgacggccccgacgccagaatccccgagagaagaccctacaccgtgcccttcgacacccacctgggccactacatctacatccccagcagacaggacagcagaaaggtgcacaccagcccccccatgtacagcctggacagaatcttcgccggcttcagaaccagaagccagatgctgctgggccacatcgaggagcaggacaaggtgctgcactgccagttcagcgacaacagcgacgacgaggagagcgagggccaggagaagagcggcaccagatgcagaagcagaagctggatccagaagcccgacagcgtgtgcagcctggtggagctgagcgacacccaggacgagacccagaagagcgacctggagaacgaggacctgaagatcgactgcctgcaggagagccaggagctgaacctgcagaagctgaagaacagcgagagaatcctgaccgaggccaagcagaagatgagagagctgaccatcaacatcaagatgaaggaggacctgatcaaggagctgatcaagaccggcaacgacgccaagagcgtgagcaagcagtacagcctgaaggtgaccaagctggagcacgacgccgagcaggccaaggtggagctgatcgagacccagaagcagctgcaggagctggagaacaaggacctgagcgacgtggccatgaaggtgaagctgcagaaggagttcagaaagaagatggacgccgccaagctgagagtgcaggtgctgcagaagaagcagcaggacagcaagaagctggccagcctgagcatccagaacgagaagagagccaacgagctggagcagagcgtggaccacatgaagtaccagaagatccagctgcagagaaagctgagagaggagaacgagaagagaaagcagctggacgccgtgatcaagagagaccagcagaagatcaaggagatccagctgaagaccggccaggaggagggcctgaagcccaaggccgaggacctggacgcctgcaacctgaagagaagaaagggcagcttcggcagcatcgaccacctgcagaagctggacgagcagaagaagtggctggacgaggaggtggagaaggtgctgaaccagagacaggagctggaggagctggaggccgacctgaagaagagagaggccatcgtgagcaagaaggaggccctgctgcaggagaagagccacctggagaacaagaagctgagaagcagccaggccctgaacaccgacagcctgaagatcagcaccagactgaacctgctggagcaggagctgagcgagaagaacgtgcagctgcagaccagcaccgccgaggagaagaccaagatcagcgagcaggtggaggtgctgcagaaggagaaggaccagctgcagaagagaagacacaacgtggacgagaagctgaagaacggcagagtgctgagccccgaggaggagcacgtgctgttccagctggaggagggcatcgaggccctggaggccgccatcgagtacagaaacgagagcatccagaacagacagaagagcctgagagccagcttccacaacctgagcagaggcgaggccaacgtgctggagaagctggcctgcctgagccccgtggagatcagaaccatcctgttcagatacttcaacaaggtggtgaacctgagagaggccgagagaaagcagcagctgtacaacgaggagatgaagatgaaggtgctggagagagacaacatggtgagagagctggagagcgccctggaccacctgaagctgcagtgcgacagaagactgaccctgcagcagaaggagcacgagcagaagatgcagctgctgctgcaccacttcaaggagcaggacggcgagggcatcatggagaccttcaagacctacgaggacaagatccagcagctggagaaggacctgtacttctacaagaagaccagcagagaccacaagaagaagctgaaggagctggtgggcgaggccatcagaagacagctggcccccagcgagtaccaggaggccggcgacggcgtgctgaagcccgagggcggcggcatgctgagcgaggagctgaagtgggccagcagacccgagagcatgaagctgagcggcagagagagagagatggacagcagcgccagcagcctgagaacccagcccaacccccagaagctgtgggaggacatccccgagctgccccccatccacagcagcctggccccccccagcggccacatgctgggcaacgagaacaagaccgagaccgacgacaaccagttcaccaagagccacagcagactgagcagccagatccaggtggtgggcaacgtgggcagactgcacggcgtgacccccgtgaagctgtgcagaaaggagctgagacagatcagcgccctggagctgagcctgagaagaagcagcctgggcgtgggcatcggcagcatggccgccgacagcatcgaggtgagcagaaagcccagagacctgaagacctag

SEQ ID NO: 9690 - DNA, 768 bp, Artificial Sequence
  Description of Artificial Sequence: Synthetic coding sequence
atggtgaagggcgagaagggccccaagggcaagaagatcaccctgaaggtggccagaaactgcatcaagatcaccttcgacggcaagaagagactggacctgagcaagatgggcatcaccaccttccccaagtgcatcctgagactgagcgacatggacgagctggacctgagcagaaacctgatcagaaagatccccgacagcatcagcaagttccagaacctgagatggctggacctgcacagcaactacatcgacaagctgcccgagagcatcggccagatgaccagcctgctgtacctgaacgtgagcaacaacagactgaccagcaacggcctgcccgtggagctgaagcagctgaagaacatcagagccgtgaacctgggcctgaaccacctggacagcgtgcccaccaccctgggcgccctgaaggagctgcacgaggtgggcctgcacgacaacctgctgaacaacatccccgtgagcatcagcaagctgcccaagctgaagaagctgaacatcaagagaaaccccttccccaagcccggcgagagcgagatcttcatcgacagcatcagaagactggagaacctgtacgtggtggaggagaaggacctgtgcgccgcctgcctgagaaagtgccagaacgccagagacaacctgaacagaatcaagaacatggccaccaccacccccagaaagaccatcttccccaacctgatcagccccaacagcatggccaaggacagctgggaggactggagatag

SEQ ID NO: 9691 - DNA, 645 bp, Artificial Sequence
  Description of Artificial Sequence: Synthetic coding sequence
atgggcagaagacccgccagatgctacagatactgcaagaacaagccctaccccaagagcagattctgcagaggcgtgcccgacgccaagatcagaatcttcgacctgggcagaaagaaggccaaggtggacgagttccccctgggcggccacatggtgagcgacgagtacgagcagctgagcagcgaggccctggaggccgccagaatctgcgccaacaagtacatggtgaagagctgcggcagagacggcttccacatgagagtgagactgcaccccttccacgtgatcagaatcaacaagatgctgagctgcgccggcgccgacagactgcagaccggcatgagaggcgccttcggcaagccccagggcaccgtggccagagtgcacatcggccaggtgatcatgagcatcagaaccaagctgcagaacgaggagcacgtgatcgaggccctgagaagagccaagttcaagttccccggcagacagaagatccacatcagcaagaagtggggcttcaccaagttcaacgccgacgagttcgaggacatggtggccaagaagtgcctgatccccgacggctgcggcgtgaagtacgtgcccagccacggccccctggacaagtggagagtgctgcacagctag

SEQ ID NO: 9692 - DNA, 3231 bp, Artificial Sequence
  Description of Artificial Sequence: Synthetic coding sequence
atgaagagcagattcagcaccatcgacctgagagccgtgctggccgagctgaacgccagcctgctgggcatgagagtgaacaacgtgtacgacgtggacaacaagacctacctgatcagactgcagaagcccgacttcaaggccaccctgctgctggagagcggcatcagaatccacaccaccgagttcgagtggcccaagaacatgatgcccagcagcttcgccatgaagtgcagaaagcacctgaagagcagaagactggtgagcgccaagcagctgggcgtggacagaatcgtggacttccagttcggcagcgacgaggccgcctaccacctgatcatcgagctgtacgacagaggcaacatcgtgctgaccgactacgagtacgtgatcctgaacatcctgagattcagaaccgacgaggccgacgacgtgaagttcgccgtgagagagagataccccctggaccacgccagagccgccgagcccctgctgaccctggagagactgaccgagatcgtggccagcgcccccaagggcgagctgctgaagagagtgctgaaccccctgctgccctacggccccgccctgatcgagcactgcctgctggagaacggcttcagcggcaacgtgaaggtggacgagaagctggagaccaaggacatcgagaaggtgctggtgagcctgcagaaggccgaggactacatgaagaccaccagcaacttcagcggcaagggctacatcatccagaagagagagatcaagcccagcctggaggccgacaagcccgtggaggacatcctgacctacgaggagttccaccccttcctgttcagccagcacagccagtgcccctacatcgagttcgagagcttcgacaaggccgtggacgagttctacagcaagatcgagggccagaagatcgacctgaaggccctgcagcaggagaagcaggccctgaagaagctggacaacgtgagaaaggaccacgagaacagactggaggccctgcagcaggcccaggagatcgacaagctgaagggcgagctgatcgagatgaacctgcagatcgtggacagagccatccaggtggtgagaagcgccctggccaaccagatcgactggaccgagatcggcctgatcgtgaaggaggcccaggcccagggcgaccccgtggccagcgccatcaaggagctgaagctgcagaccaaccacgtgaccatgctgctgagaaacccctacctgctgagcgaggaggaggacgacgacgtggacggcgacgtgaacgtggagaagaacgagaccgagccccccaagggcaagaagaagaagcagaagaacaagcagctgcagaagccccagaagaacaagcccctgctggtggacgtggacctgagcctgagcgcctacgccaacgccaagaagtactacgaccacaagagatacgccgccaagaagacccagaagaccgtggaggccgccgagaaggccttcaagagcgccgagaagaagaccaagcagaccctgaaggaggtgcagaccgtgaccagcatccagaaggccagaaaggtgtactggttcgagaagttcctgtggttcatcagcagcgagaactacctgatcatcggcggcagagaccagcagcagaacgagatcatcgtgaagagatacctgacccccggcgacatctacgtgcacgccgacctgcacggcgccaccagctgcgtgatcaagaaccccaccggcgagcccatcccccccagaaccctgaccgaggccggcaccatggccctgtgctacagcgccgcctgggacgccagagtgatcaccagcgcctggtgggtgtaccaccaccaggtgagcaagaccgcccccaccggcgagtacctgaccaccggcagcttcatgatcagaggcaagaagaacttcctgccccccagctacctgatgatgggcttcagcttcctgttcaaggtggacgagagctgcgtgtggagacaccagggcgagagaaaggtgagagtgcaggacgaggacatggagaccctggccagctgcaccagcgagctgatcagcgaggagatggagcagctggacggcggcgacaccagcagcgacgaggacaaggaggagcacgagacccccgtggaggtggagctgatgacccaggtggaccaggaggacatcaccctgcagagcggcagagacgagctgaacgaggagctgatccaggaggagagcagcgaggacgagggcgagtacgaggaggtgagaaaggaccaggacagcgtgggcgagatgaaggacgagggcgaggagaccctgaactaccccgacaccaccatcgacctgagccacctgcagccccagagaagcatccagaagctggccagcaaggaggagagcagcaacagcagcgacagcaagagccagagcagaagacacctgagcgccaaggagagaagagagatgaagaagaagaagctgcccagcgacagcggcgacctggaggccctggagggcaaggacaaggagaaggagagcaccgtgcacatcgagacccaccagaacaccagcaagaacgtggccgccgtgcagcccatgaagagaggccagaagagcaagatgaagaagatgaaggagaagtacaaggaccaggacgaggaggacagagagctgatcatgaagctgctgggcagcgccggcagcaacaaggaggagaagggcaagaagggcaagaagggcaagaccaaggacgagcccgtgaagaagcagccccagaagcccagaggcggccagagagtgagcgacaacatcaagaaggagacccccttcctggaggtgatcacccacgagctgcaggacttcgccgtggacgacccccacgacgacaaggaggagcaggacctggaccagcagggcaacgaggagaacctgttcgacagcctgaccggccagccccaccccgaggacgtgctgctgttcgccatccccatctgcgccccctacaccaccatgaccaactacaagtacaaggtgaagctgacccccggcgtgcagaagaagggcaaggccgccaagaccgccctgaacagcttcatgcacagcaaggaggccaccgccagagagaaggacctgttcagaagcgtgaaggacaccgacctgagcagaaacatccccggcaaggtgaaggtgagcgcccccaacctgctgaacgtgaagagaaagtag

SEQ ID NO: 9693 - DNA, 963 bp, Artificial Sequence
  Description of Artificial Sequence: Synthetic coding sequence
atgggcgacatccccgccgtgggcctgagcagctggaaggccagccccggcaaggtgaccgaggccgtgaaggaggccatcgacgccggctacagacacttcgactgcgcctacttctaccacaacgagagagaggtgggcgccggcatcagatgcaagatcaaggagggcgccgtgagaagagaggacctgttcatcgccaccaagctgtggtgcacctgccacaagaagagcctggtggagaccgcctgcagaaagagcctgaaggccctgaagctgaactacctggacctgtacctgatccactggcccatgggcttcaagcccccccaccccgagtggatcatgagctgcagcgagctgagcttctgcctgagccaccccagagtgcaggacctgcccctggacgagagcaacatggtgatccccagcgacaccgacttcctggacacctgggaggccatggaggacctggtgatcaccggcctggtgaagaacatcggcgtgagcaacttcaaccacgagcagctggagagactgctgaacaagcccggcctgagattcaagcccctgaccaaccagatcgagtgccacccctacctgacccagaagaacctgatcagcttctgccagagcagagacgtgagcgtgaccgcctacagacccctgggcggcagctgcgagggcgtggacctgatcgacaaccccgtgatcaagagaatcgccaaggagcacggcaagagccccgcccagatcctgatcagattccagatccagagaaacgtgatcgtgatccccggcagcatcacccccagccacatcaaggagaacatccaggtgttcgacttcgagctgacccagcacgacatggacaacatcctgagcctgaacagaaacctgagactggccatgttccccatcaccaagaaccacaaggactaccccttccacatcgagtactag

SEQ ID NO: 9694 - DNA, 1239 bp, Artificial Sequence
  Description of Artificial Sequence: Synthetic coding sequence
atgagcggctaccagagaagacccggcgccacccccctgagcagagccagaagcctggccatccccgacgcccccgccttctacgagagaagaagctgcctgccccagctgaactgcgagagaccccacggcagagacctggacagccccttcttcggcatcagacccgccttcatgtgctacgtgcccagccccgtgctggccagcgtgggcgacaccgacgacagattcgaggacctggaggaggccaaccccttcagcttcagagagttcctgaagaccaagaacctgggcctgagcaaggaggaccccgccagcagaatctacgccaaggaggccagcagacacagcctgggcctggaccacaacagcccccccagccagaccggcggctacggcctggagtaccagcagcccttcttcgaggaccccaccggcgccggcgacctgctggacgaggaggaggacgaggacaccggctggagcggcgcctacctgcccagcgccatcgagcagacccaccccgagagagtgcccgccggcaccagcccctgcagcacctacctgagcttcttcagcacccccagcgagctggccggccccgagagcctgcccagctgggccctgagcgacaccgacagcagagtgagccccgccagccccgccggcagccccagcgccgacttcgccgtgcacggcgagagcctgggcgacagacacctgagaaccctgcagatcagctacgacgccctgaaggacgagaacagcaagctgagaagaaagctgaacgaggtgcagagcttcagcgaggcccagaccgagatggtgagaaccctggagagaaagctggaggccaagatgatcaaggaggagagcgactaccacgacctggagagcgtggtgcagcaggtggagcagaacctggagctgatgaccaagagagccgtgaaggccgagaaccacgtggtgaagctgaagcaggagatcagcctgctgcaggcccaggtgagcaacttccagagagagaacgaggccctgagatgcggccagggcgccagcctgaccgtggtgaagcagaacgccgacgtggccctgcagaacctgagagtggtgatgaacagcgcccaggccagcatcaagcagctggtgagcggcgccgagaccctgaacctggtggccgagatcctgaagagcatcgacagaatcagcgaggtgaaggacgaggaggaggacagctag

SEQ ID NO: 9695 - DNA, 1440 bp, Artificial Sequence
  Description of Artificial Sequence: Synthetic coding sequence
atggacgccaccatcgccccccacagaatcccccccgagatgccccagtacggcgaggagaaccacatcttcgagctgatgcagaacatgctggagcagctgctgatccaccagcccgaggaccccatccccttcatgatccagcacctgcacagagacaacgacaacgtgcccagaatcgtgatcctgggcccccccgccagcggcaagaccaccatcgccatgtggctgtgcaagcacctgaacagcagcctgctgaccctggagaacctgatcctgaacgagttcagctacaccgccaccgaggccagaagactgtacctgcagagaaagaccgtgcccagcgccctgctggtgcagctgatccaggagagactggccgaggaggactgcatcaagcagggctggatcctggacggcatccccgagaccagagagcaggccctgagaatccagaccctgggcatcacccccagacacgtgatcgtgctgagcgcccccgacaccgtgctgatcgagagaaacctgggcaagagaatcgacccccagaccggcgagatctaccacaccaccttcgactggccccccgagagcgagatccagaacagactgatggtgcccgaggacatcagcgagctggagaccgcccagaagctgctggagtaccacagaaacatcgtgagagtgatccccagctaccccaagatcctgaaggtgatcagcgccgaccagccctgcgtggacgtgttctaccaggccctgacctacgtgcagagcaaccacagaaccaacgcccccttcacccccagagtgctgctgctgggccccgtgggcagcggcaagagcctgcaggccgccctgctggcccagaagtacagactggtgaacgtgtgctgcggccagctgctgaaggaggccgtggccgacagaaccaccttcggcgagctgatccagcccttcttcgagaaggagatggccgtgcccgacagcctgctgatgaaggtgctgagccagagactggaccagcaggactgcatccagaagggctgggtgctgcacggcgtgcccagagacctggaccaggcccacctgctgaacagactgggctacaaccccaacagagtgttcttcctgaacgtgcccttcgacagcatcatggagagactgaccctgagaagaatcgaccccgtgaccggcgagagataccacctgatgtacaagcccccccccaccatggagatccaggccagactgctgcagaaccccaaggacgccgaggagcaggtgaagctgaagatggacctgttctacagaaacagcgccgacctggagcagctgtacggcagcgccatcaccctgaacggcgaccaggacccctacaccgtgttcgagtacatcgagagcggcatcatcaaccccctgcccaagaagatcccctag

SEQ ID NO: 9696 - DNA, 432 bp, Artificial Sequence
  Description of Artificial Sequence: Synthetic coding sequence
atggcccacgagatgatcggcacccagatcgtgaccgagagactggtggccctgctggagagcggcaccgagaaggtgctgctgatcgacagcagacccttcgtggagtacaacaccagccacatcctggaggccatcaacatcaactgcagcaagctgatgaagagaagactgcagcaggacaaggtgctgatcaccgagctgatccagcacagcgccaagcacaaggtggacatcgactgcagccagaaggtggtggtgtacgaccagagcagccaggacgtggccagcctgagcagcgactgcttcctgaccgtgctgctgggcaagctggagaagagcttcaacagcgtgcacctgctggccggcgccgacgccgccgagtgggactggctgtgcgtgaagtgccagcagtacctgagcaaggcctag

SEQ ID NO: 9697 - DNA, 1191 bp, Artificial Sequence
  Description of Artificial Sequence: Synthetic coding sequence
atggccagcctgagcagagccctgagagtggccgccgcccaccccagacagagccccaccagaggcatgggcccctgcaacctgagcagcgccgccggccccaccgccgagaagagcgtgccctaccagagaaccctgaaggagggccagggcaccagcgtggtggcccagggccccagcagacccctgcccagcaccgccaacgtggtggtgatcggcggcggcagcctgggctgccagaccctgtaccacctggccaagctgggcatgagcggcgccgtgctgctggagagagagagactgaccagcggcaccacctggcacaccgccggcctgctgtggcagctgagacccagcgacgtggaggtggagctgctggcccacaccagaagagtggtgagcagagagctggaggaggagaccggcctgcacaccggctggatccagaacggcggcctgttcatcgccagcaacagacagagactggacgagtacaagagactgatgagcctgggcaaggcctacggcgtggagagccacgtgctgagccccgccgagaccaagaccctgtaccccctgatgaacgtggacgacctgtacggcaccctgtacgtgccccacgacggcaccatggaccccgccggcacctgcaccaccctggccagagccgccagcgccagaggcgcccaggtgatcgagaactgccccgtgaccggcatcagagtgtggaccgacgacttcggcgtgagaagagtggccggcgtggagacccagcacggcagcatccagaccccctgcgtggtgaactgcgccggcgtgtgggccagcgccgtgggcagaatggccggcgtgaaggtgcccctggtggccatgcaccacgcctacgtggtgaccgagagaatcgagggcatccagagcttcaccctgctgcccaccctggagtacagcggcaccgtgagcgcccactgcaacctgagactgcccggcagcagcaacagcagagccagcgccagccacgtggccggcatcaagtgcgccagacaccacaccagactgatcttcttctgcatcctggtggagaccgagttccaccacgtggccaaggccggcctggagctgctgagcagcggcaacccccccatcagcgacttccagagcgccagaatcaccggcgtgagccaccacgcctag

SEQ ID NO: 9698 - DNA, 4416 bp, Artificial Sequence
  Description of Artificial Sequence: Synthetic coding sequence
atggagcccgagcccgtggaggactgcgtgcagagcaccctggccgccctgtacccccccttcgaggccaccgcccccaccctgctgggccaggtgttccaggtggtggagagaacctacagagaggacgccctgagatacaccctggacttcctggtgcccgccaagcacctgctggccaaggtgcagcaggaggcctgcgcccagtacagcggcttcctgttcttccacgagggctggcccctgtgcctgcacgagcaggtggtggtgcagctggccgccctgccctggcagctgctgagacccggcgacttctacctgcaggtggtgcccagcgccgcccaggcccccagactggccctgaagtgcctggcccccggcggcggcagagtgcaggaggtgcccgtgcccaacgaggcctgcgcctacctgttcacccccgagtggctgcagggcatcaacaaggacagacccaccggcagactgagcacctgcctgctgagcgcccccagcggcatccagagactgccctgggccgagctgatctgccccagattcgtgcacaaggagggcctgatggtgggccaccagcccagcaccctgccccccgagctgcccagcggcccccccggcctgcccagcccccccctgcccgaggaggccctgggcaccagaagccccggcgacggccacaacgcccccgtggagggccccgagggcgagtacgtggagctgctggaggtgaccctgcccgtgagaggcagccccaccgacgccgagggcagccccggcctgagcagagtgagaaccgtgcccaccagaaagggcgccggcggcaagggcagacacagaagacacagagcctggatgcaccagaagggcctgggccccagaggccaggacggcgccagaccccccggcgagggcagcagcaccggcgccagccccgagagcccccccggcgccgaggccgtgcccgaggccgccgtgctggaggtgagcgagccccccgccgaggccgtgggcgaggccagcggcagctgccccctgagacccggcgagctgagaggcggcggcggcggcggccagggcgccgagggcccccccggcacccccagaagaaccggcaagggcaacagaagaaagaagagagccgccggcagaggcgccctgagcagaggcggcgacagcgcccccctgagccccggcgacaaggaggacgccagccaccaggaggccctgggcaacctgcccagccccagcgagcacaagctgcccgagtgccacctggtgaaggaggagtacgagggcagcggcaagcccgagagcgagcccaaggagctgaagaccgccggcgagaaggagccccagctgagcgaggcctgcggccccaccgaggagggcgccggcgagagagagctggagggccccggcctgctgtgcatggccggccacaccggccccgagggccccctgagcgacacccccaccccccccctggagaccgtgcaggagggcaagggcgacaacatccccgaggaggccctggccgtgagcgtgagcgaccaccccgacgtggcctgggacctgatggccagcggcttcctgatcctgaccggcggcgtggaccagagcggcagagccctgctgaccatcacccccccctgcccccccgaggagcccccccccagcagagacaccctgaacaccaccctgcactacctgcacagcctgctgagacccgacctgcagaccctgggcctgagcgtgctgctggacctgagacaggccccccccctgccccccgccctgatccccgccctgagccagctgcaggacagcggcgacccccccctggtgcagagactgctgatcctgatccacgacgacctgcccaccgagctgtgcggcttccagggcgccgaggtgctgagcgagaacgacctgaagagagtggccaagcccgaggagctgcagtgggagctgggcggccacagagaccccagccccagccactgggtggagatccaccaggaggtggtgagactgtgcagactgtgccagggcgtgctgggcagcgtgagacaggccatcgaggagctggagggcgccgccgagcccgaggaggaggaggccgtgggcatgcccaagcccctgcagaaggtgctggccgaccccagactgaccgccctgcagagagacggcggcgccatcctgatgagactgagaagcacccccagcagcaagctggagggccagggccccgccaccctgtaccaggaggtggacgaggccatccaccagctggtgagactgagcaacctgcacgtgcagcagcaggagcagagacagtgcctgagaagactgcagcaggtgctgcagtggctgagcggccccggcgaggagcagctggccagcttcgccatgcccggcgacaccctgagcgccctgcaggagaccgagctgagattcagagccttcagcgccgaggtgcaggagagactggcccaggccagagaggccctggccctggaggagaacgccaccagccagaaggtgctggacatcttcgagcagagactggagcaggtggagagcggcctgcacagagccctgagactgcagagattcttccagcaggcccacgagtgggtggacgagggcttcgccagactggccggcgccggccccggcagagaggccgtgctggccgccctggccctgagaagagcccccgagcccagcgccggcaccttccaggagatgagagccctggccctggacctgggcagccccgccgccctgagagagtggggcagatgccaggccagatgccaggagctggagagaagaatccagcagcacgtgggcgaggaggccagccccagaggctacagaagaagaagagccgacggcgccagcagcggcggcgcccagtggggccccagaagccccagccccagcctgagcagcctgctgctgcccagcagccccggccccagacccgcccccagccactgcagcctggccccctgcggcgaggactacgaggaggagggccccgagctggcccccgaggccgagggcagaccccccagagccgtgctgatcagaggcctggaggtgaccagcaccgaggtggtggacagaacctgcagccccagagagcacgtgctgctgggcagagccagaggccccgacggcccctggggcgtgggcacccccagaatggagagaaagagaagcatcagcgcccagcagagactggtgagcgagctgatcgcctgcgagcaggactacgtggccaccctgagcgagcccgtgcccccccccggccccgagctgacccccgagctgagaggcacctgggccgccgccctgagcgccagagagagactgagaagcttccacagaacccacttcctgagagagctgcagggctgcgccacccaccccctgagaatcggcgcctgcttcctgagacacggcgaccagttcagcctgtacgcccagtacgtgaagcacagacacaagctggagaacggcctggccgccctgagccccctgagcaagggcagcatggaggccggcccctacctgcccagagccctgcagcagcccctggagcagctgaccagatacggcagactgctggaggagctgctgagagaggccggccccgagctgagcagcgagtgcagagccctgggcgccgccgtgcagctgctgagagagcaggaggccagaggcagagacctgctggccgtggaggccgtgagaggctgcgagatcgacctgaaggagcagggccagctgctgcacagagaccccttcaccgtgatctgcggcagaaagaagtgcctgagacacgtgttcctgttcgagcacctgctgctgttcagcaagctgaagggccccgagggcggcagcgagatgttcgtgtacaagcaggccttcaagaccgccgacatgggcctgaccgagaacatcggcgacagcggcctgtgcttcgagctgtggttcagaagaagaagagccagagaggcctacaccctgcaggccaccagccccgagatcaagctgaagtggaccagcagcatcgcccagctgctgtggagacaggccgcccacaacaaggagctgagagtgcagcagatggtgagcatgggcatcggcaacaagcccttcctggacatcaaggccctgggcgagagaaccctgagcgccctgctgaccggcagagcccccgagaccctggacagcagcggcgacgtgagccccggccccagaaacagccccagcctgcagcccccccaccccggcagcagcacccccaccctggccagcagaggcatcctgggcctgagcagacagagccacgccagagccctgagcgaccccaccacccccctgtag

SEQ ID NO: 9699 - DNA, 4560 bp, Artificial Sequence
  Description of Artificial Sequence: Synthetic coding sequence
atggagcccgagcccgtggaggactgcgtgcagagcaccctggccgccctgtacccccccttcgaggccaccgcccccaccctgctgggccaggtgttccaggtggtggagagaacctacagagaggacgccctgagatacaccctggacttcctggtgcccgccaagcacctgctggccaaggtgcagcaggaggcctgcgcccagtacagcggcttcctgttcttccacgagggctggcccctgtgcctgcacgagcaggtggtggtgcagctggccgccctgccctggcagctgctgagacccggcgacttctacctgcaggtggtgcccagcgccgcccaggcccccagactggccctgaagtgcctggcccccggcggcggcagagtgcaggaggtgcccgtgcccaacgaggcctgcgcctacctgttcacccccgagtggctgcagggcatcaacaaggacagacccaccggcagactgagcacctgcctgctgagcgcccccagcggcatccagagactgccctgggccgagctgatctgccccagattcgtgcacaaggagggcctgatggtgggccaccagcccagcaccctgccccccgagctgcccagcggcccccccggcctgcccagcccccccctgcccgaggaggccctgggcaccagaagccccggcgacggccacaacgcccccgtggagggccccgagggcgagtacgtggagctgctggaggtgaccctgcccgtgagaggcagccccaccgacgccgagggcagccccggcctgagcagagtgagaaccgtgcccaccagaaagggcgccggcggcaagggcagacacagaagacacagagcctggatgcaccagaagggcctgggccccagaggccaggacggcgccagaccccccggcgagggcagcagcaccggcgccagccccgagagcccccccggcgccgaggccgtgcccgaggccgccgtgctggaggtgagcgagccccccgccgaggccgtgggcgaggccagcggcagctgccccctgagacccggcgagctgagaggcggcggcggcggcggccagggcgccgagggcccccccggcacccccagaagaaccggcaagggcaacagaagaaagaagagagccgccggcagaggcgccctgagcagaggcggcgacagcgcccccctgagccccggcgacaaggaggacgccagccaccaggaggccctgggcaacctgcccagccccagcgagcacaagctgcccgagtgccacctggtgaaggaggagtacgagggcagcggcaagcccgagagcgagcccaaggagctgaagaccgccggcgagaaggagccccagctgagcgaggcctgcggccccaccgaggagggcgccggcgagagagagctggagggccccggcctgctgtgcatggccggccacaccggccccgagggccccctgagcgacacccccaccccccccctggagaccgtgcaggagggcaagggcgacaacatccccgaggaggccctggccgtgagcgtgagcgaccaccccgacgtggcctgggacctgatggccagcggcttcctgatcctgaccggcggcgtggaccagagcggcagagccctgctgaccatcacccccccctgcccccccgaggagcccccccccagcagagacaccctgaacaccaccctgcactacctgcacagcctgctgagacccgacctgcagaccctgggcctgagcgtgctgctggacctgagacaggccccccccctgccccccgccctgatccccgccctgagccagctgcaggacagcggcgacccccccctggtgcagagactgctgatcctgatccacgacgacctgcccaccgagctgtgcggcttccagggcgccgaggtgctgagcgagaacgacctgaagagagtggccaagcccgaggagctgcagtgggagctgggcggccacagagaccccagccccagccactgggtggagatccaccaggaggtggtgagactgtgcagactgtgccagggcgtgctgggcagcgtgagacaggccatcgaggagctggagggcgccgccgagcccgaggaggaggaggccgtgggcatgcccaagcccctgcagaaggtgctggccgaccccagactgaccgccctgcagagagacggcggcgccatcctgatgagactgagaagcacccccagcagcaagctggagggccagggccccgccaccctgtaccaggaggtggacgaggccatccaccagctggtgagactgagcaacctgcacgtgcagcagcaggagcagagacagtgcctgagaagactgcagcaggtgctgcagtggctgagcggccccggcgaggagcagctggccagcttcgccatgcccggcgacaccctgagcgccctgcaggagaccgagctgagattcagagccttcagcgccgaggtgcaggagagactggcccaggccagagaggccctggccctggaggagaacgccaccagccagaaggtgctggacatcttcgagcagagactggagcaggtggagagcggcctgcacagagccctgagactgcagagattcttccagcaggcccacgagtgggtggacgagggcttcgccagactggccggcgccggccccggcagagaggccgtgctggccgccctggccctgagaagagcccccgagcccagcgccggcaccttccaggagatgagagccctggccctggacctgggcagccccgccgccctgagagagtggggcagatgccaggccagatgccaggagctggagagaagaatccagcagcacgtgggcgaggaggccagccccagaggctacagaagaagaagagccgacggcgccagcagcggcggcgcccagtggggccccagaagccccagccccagcctgagcagcctgctgctgcccagcagccccggccccagacccgcccccagccactgcagcctggccccctgcggcgaggactacgaggaggagggccccgagctggcccccgaggccgagggcagaccccccagagccgtgctgatcagaggcctggaggtgaccagcaccgaggtggtggacagaacctgcagccccagagagcacgtgctgctgggcagagccagaggccccgacggcccctggggcgtgggcacccccagaatggagagaaagagaagcatcagcgcccagcagagactggtgagcgagctgatcgcctgcgagcaggactacgtggccaccctgagcgagcccgtgcccccccccggccccgagctgacccccgagctgagaggcacctgggccgccgccctgagcgccagagagagactgagaagcttccacagaacccacttcctgagagagctgcagggctgcgccacccaccccctgagaatcggcgcctgcttcctgagacacggcgaccagttcagcctgtacgcccagtacgtgaagcacagacacaagctggagaacggcctggccgccctgagccccctgagcaagggcagcatggaggccggcccctacctgcccagagccctgcagcagcccctggagcagctgaccagatacggcagactgctggaggagctgctgagagaggccggccccgagctgagcagcgagtgcagagccctgggcgccgccgtgcagctgctgagagagcaggaggccagaggcagagacctgctggccgtggaggccgtgagaggctgcgagatcgacctgaaggagcagggccagctgctgcacagagaccccttcaccgtgatctgcggcagaaagaagtgcctgagacacgtgttcctgttcgagcacctgctgctgttcagcaagctgaagggccccgagggcggcagcgagatgttcgtgtacaagcaggccttcaagaccgccgacatgggcctgaccgagaacatcggcgacagcggcctgtgcttcgagctgtggttcagaagaagaagagccagagaggcctacaccctgcaggccaccagccccgagatcaagctgaagtggaccagcagcatcgcccagctgctgtggagacaggccgcccacaacaaggagctgagagtgcagcagatggtgagcatgggcatcggcaacaagcccttcctggacatcaaggccctgggcgagagaaccctgagcgccctgctgaccggcagagccgccagaaccagagccagcgtggccgtgagcagcttcgagcacgccggccccagcctgcccggcctgagccccggcgcctgcagcctgcccgccagagtggaggaggaggcctgggacctggacgtgaagcagatcagcctggcccccgagaccctggacagcagcggcgacgtgagccccggccccagaaacagccccagcctgcagcccccccaccccggcagcagcacccccaccctggccagcagaggcatcctgggcctgagcagacagagccacgccagagccctgagcgaccccaccacccccctgtag

SEQ ID NO: 9700 - DNA, 2709 bp, Artificial Sequence
  Description of Artificial Sequence: Synthetic coding sequence
atgttccccgccctggagacccacctgaagcagaccatccccgacccctacgaggacttcatgtacagacacctgcagtactacggctacttcaaggcccagagaggcagcctgcccaacagcgccacccaccagcacgtgagaaagaacaacccccagtgcctgctgaacggcagcctgggcgagaaggacgacctgatccccgacaccctgcagaaggagaagctgctgtggcccatcagcctgagcagcgccgtgcacagacagatcgaggccatcaacagagacttccacagctgcctgggctggatgcagtggagaggcctgagcagcctgcagccccccccccccagattcaaggacagccccgccagcgccttcagagtggccggcatcaccgacagccacatgctgagcctgccccacctgagaagcagacagctgctgtacgacgagctggacgaggtgaaccccagactgagagagccccaggagctgttcagcatcctgagcaccaagagacccctgcaggcccccagatggcccatcgagtgcgaggtgatcaaggagaacatccaccacatcgagtgggcccccccccagcccgagtacttctaccagcccaagggcaacgagaaggtgcccgagatcgtgggcgagaagaagggcaccgtggtgtaccagctggacagcgtgcccatcgagggcagctacttcaccagcagcagagtgggcggcaagagaggcatcgtgaaggagctggccgtgaccctgcagggccccgaggacaacaccctgctgttcgagagcagattcgagagcggcaacctgcagaaggccgtgagagtggacacctacgagtacgagctgaccctgagaaccgacctgtacaccaacaagcacacccagtggttctacttcagagtgcagaacaccagaaaggacgccacctacagattcaccatcgtgaacctgctgaagcccaagagcctgtacaccgtgggcatgaagcccctgctgtacagccagctggacgccaacaccagaaacatcggctggagaagagagggcaacgagatcaagtactacaagaacaacaccgacgacggccagcagcccttctactgcctgacctggaccatccagttcccctacgaccaggacacctgcttcttcgcccacttctacccctacacctacaccgacctgcagtgctacctgctgagcgtggccaacaaccccatccagagccagttctgcaagctgcagaccctgtgcagaagcctggccggcaacaccgtgtacctgctgaccatcaccaaccccagccagaccccccaggaggccgccgccaagaaggccgtggtgctgagcgccagagtgcaccccggcgagagcaacggcagctgggtgatgaagggcttcctggacttcatcctgagcaacagccccgacgcccagctgctgagagacatcttcgtgttcaaggtgctgcccatgctgaaccccgacggcgtgatcgtgggcaactacagatgcagcctggccggcagagacctgaacagacactacaagaccatcctgaaggagagcttcccctgcatctggtacaccagaaacatgatcaagagactgctggaggagagagaggtgctgctgtactgcgacttccacggccacagcagaaagaacaacatcttcctgtacggctgcaacaacaacaacagaaagtactggctgcacgagagagtgttccccctgatgctgtgcaagaacgcccccgacaagttcagcttccacagctgcaacttcaaggtgcagaagtgcaaggagggcaccggcagagtggtgatgtggagaatgggcatcctgaacagctacaccatggagagcaccttcggcggcagcaccctgggcaacaagagagacacccacttcaccatcgaggacctgaagagcctgggctaccacgtgtgcgacaccctgctggacttctgcgaccccgaccagatgaagttcacccagtgcctggccgagctgaaggagctgctgagacaggagatccacaagaagttccacgagctgggccaggacgtggacctggagggcagctggagcgacatcagcctgagcgacatcgagagcagcaccagcggcagcgacagcagcctgagcgacggcctgcccgtgcacctggccaacatcgccgacgagctgacccagaagaagaagatgttcaagaagaagaagaagaagagcctgcagaccagaaagcagagaaacgagcagtaccagaagaagaacctgatgcagaagctgaagctgaccgaggacaccagcgagaaggccggcttcgccagcaccctgcagaagcagcccaccttcttcaagaacagcgagaacagcagcttcctgcccatgaagaacgagaaccccagactgaacgagaccaacctgaacagaagagacaaggacacccccctggaccccagcatggccaccctgatcctgcccaagaacaagggcagaatgcagaacaagaagcccggcttcaccgtgagctgcagccccaagagaaccatcaacagcagccaggagcccgcccccggcatgaagcccaactggcccagaagcagataccccgccaccaagagaggctgcgccgccatggccgcctaccccagcctgcacatctacacctacccctag

SEQ ID NO: 9701 - DNA, 3234 bp, Artificial Sequence
  Description of Artificial Sequence: Synthetic coding sequence
atggaggtgcaggtgagccaggccagcctgggcttcgagctgaccagcgtggagaagagcctgagagagtggagcagactgagcagagaggtgatcgcctggctgtgccccagcagccccaacttcatcctgaacttcccccccccccccagcgccagcagcgtgagcatggtgcagctgttcagcagccccttcggctaccagagccccagcggccacagcgaggaggagagagagggcaacatgaagagcgccaagccccaggtgaaccacagccagcacggcgagagccagagagccctgagccccctgcagagcaccctgagcagcgccgccagccccagccaggcctacgagacctacatcgagaacggcctgatctgcctgaagcacaagatcagaaacatcgagaagaagaagctgaagctggaggactacaaggacagactgaagagcggcgagcacctgaaccccgaccagctggaggccgtggagaagtacgaggaggtgctgcacaacctggagttcgccaaggagctgcagaagaccttcagcggcctgagcctggacctgctgaaggcccagaagaaggcccagagaagagagcacatgctgaagctggaggccgagaagaagaagctgagaaccatcctgcaggtgcagtacgtgctgcagaacctgacccaggagcacgtgcagaaggacttcaagggcggcctgaacggcgccgtgtacctgcccagcaaggagctggactacctgatcaagttcagcaagctgacctgccccgagagaaacgagagcctgagcgtggaggaccagatggagcagagcagcctgtacttctgggacctgctggagggcagcgagaaggccgtggtgggcaccacctacaagcacctgaaggacctgctgagcaagctgctgaacagcggctacttcgagagcatccccgtgcccaagaacgccaaggagaaggaggtgcccctggaggaggagatgctgatccagagcgagaagaagacccagctgagcaagaccgagagcgtgaaggagagcgagagcctgatggagttcgcccagcccgagatccagccccaggagttcctgaacagaagatacatgaccgaggtggactacagcaacaagcagggcgaggagcagccctgggaggccgactacgccagaaagcccaacctgcccaagagatgggacatgctgaccgagcccgacggccaggagaagaagcaggagagcttcaagagctgggaggccagcggcaagcaccaggaggtgagcaagcccgccgtgagcctggagcagagaaagcaggacaccagcaagctgagaagcaccctgcccgaggagcagaagaagcaggagatcagcaagagcaagcccagccccagccagtggaagcaggacacccccaagagcaaggccggctacgtgcaggaggagcagaagaagcaggagacccccaagctgtggcccgtgcagctgcagaaggagcaggaccccaagaagcagacccccaagagctggacccccagcatgcagagcgagcagaacaccaccaagagctggaccacccccatgtgcgaggagcaggacagcaagcagcccgagacccccaagagctgggagaacaacgtggagagccagaagcacagcctgaccagccagagccagatcagccccaagagctggggcgtggccaccgccagcctgatccccaacgaccagctgctgcccagaaagctgaacaccgagcccaaggacgtgcccaagcccgtgcaccagcccgtgggcagcagcagcaccctgcccaaggaccccgtgctgagaaaggagaagctgcaggacctgatgacccagatccagggcacctgcaacttcatgcaggagagcgtgctggacttcgacaagcccagcagcgccatccccaccagccagccccccagcgccacccccggcagccccgtggccagcaaggagcagaacctgagcagccagagcgacttcctgcaggagcccctgcaggccaccagcagccccgtgacctgcagcagcaacgcctgcctggtgaccaccgaccaggccagcagcggcagcgagaccgagttcatgaccagcgagacccccgaggtgttcaacgtgaacgcccccctgccccccagaaaggagcaggagatcaaggagagcccctacagccccggctacaaccagagcttcaccaccgccagcacccagacccccccccagtgccagctgcccagcatccacgtggagcagaccgtgcacagccaggagaccgccaactaccaccccgacggcaccatccaggtgagcaacggcagcctggccttctaccccgcccagaccaacgtgttccccagacccacccagcccttcgtgaacagcagaggcagcgtgagaggctgcaccagaggcggcagactgatcaccaacagctacagaagccccggcggctacaagggcttcgacacctacagaggcctgcccagcatcagcaacggcaactacagccagctgcagttccaggccagagagtacagcggcgccccctacagccagagagacaacttccagcagtgctacaagagaggcggcaccagcggcggccccagagccaacagcagagccggctggagcgacagcagccaggtgagcagccccgagagagacaacgagaccttcaacagcggcgacagcggccagggcgacagcagaagcatgacccccgtggacgtgcccgtgaccaaccccgccgccaccatcctgcccgtgcacgtgtaccccctgccccagcagatgagagtggccttcagcgccgccagaaccagcaacctggcccccggcaccctggaccagcccatcgtgttcgacctgctgctgaacaacctgggcgagaccttcgacctgcagctgggcagattcaactgccccgtgaacggcacctacgtgttcatcttccacatgctgaagctggccgtgaacgtgcccctgtacgtgaacctgatgaagaacgaggaggtgctggtgagcgcctacgccaacgacggcgcccccgaccacgagaccgccagcaaccacgccatcctgcagctgttccagggcgaccagatctggctgagactgcacagaggcgccatctacggcagcagctggaagtacagcaccttcagcggctacctgctgtaccaggactag

SEQ ID NO: 9702 - DNA, 1056 bp, Artificial Sequence
  Description of Artificial Sequence: Synthetic coding sequence
atgaccctgagactgctggaggactggtgcagaggcatggacatgaaccccagaaaggccctgctgatcgccggcatcagccagagctgcagcgtggccgagatcgaggaggccctgcaggccggcctggcccccctgggcgagtacagactgctgggcagaatgttcagaagagacgagaacagaaaggtggccctggtgggcctgaccgccgagaccagccacgccctggtgcccaaggagatccccggcaagggcggcatctggagagtgatcttcaagccccccgaccccgacaacaccttcctgagcagactgaacgagttcctggccggcgagggcatgaccgtgggcgagctgagcagagccctgggccacgagaacggcagcctggaccccgagcagggcatgatccccgagatgtgggcccccatgctggcccaggccctggaggccctgcagcccgccctgcagtgcctgaagtacaagaagctgagagtgttcagcggcagagagagccccgagcccggcgaggaggagttcggcagatggatgttccacaccacccagatgatcaaggcctggcaggtgcccgacgtggagaagagaagaagactgctggagagcctgagaggccccgccctggacgtgatcagagtgctgaagatcaacaaccccctgatcaccgtggacgagtgcctgcaggccctggaggaggtgttcggcgtgaccgacaaccccagagagctgcaggtgaagtacctgaccacctaccagaaggacgaggagaagctgagcgcctacgtgctgagactggagcccctgctgcagaagctggtgcagagaggcgccatcgagagagacgccgtgaaccaggccagactggaccaggtgatcgccggcgccgtgcacaagaccatcagaagagagctgaacctgcccgaggacggccccgcccccggcttcctgcagctgctggtgctgatcaaggactacgaggccgccgaggaggaggaggccctgctgcaggccatcctggagggcaacttcacctag

SEQ ID NO: 9703 - DNA, 2559 bp, Artificial Sequence
  Description of Artificial Sequence: Synthetic coding sequence
atgagcggcagagccagagtgaaggccagaggcatcgccagaagccccagcgccaccgaggtgggcagaatccaggccagccccctgcccagaagcgtggacctgagcaacaacgaggccagcagcagcaacggcttcctgggcaccagcagaatcagcaccaacgacaagtacggcatcagcagcggcgacgccggcagcaccttcatggagagaggcgtgaagaacaagcaggacttcatggacctgagcatctgcaccagagagaagctggcccacgtgagaaactgcaagaccggcagcagcggcatccccgtgaagctggtgaccaacctgttcaacctggacttcccccaggactggcagctgtaccagtaccacgtgacctacatccccgacctggccagcagaagactgagaatcgccctgctgtacagccacagcgagctgagcaacaaggccaaggccttcgacggcgccatcctgttcctgagccagaagctggaggagaaggtgaccgagctgagcagcgagacccagagaggcgagaccatcaagatgaccatcaccctgaagagagagctgcccagcagcagccccgtgtgcatccaggtgttcaacatcatcttcagaaagatcctgaagaagctgagcatgtaccagatcggcagaaacttctacaaccccagcgagcccatggagatcccccagcacaagctgagcctgtggcccggcttcgccatcagcgtgagctacttcgagagaaagctgctgttcagcgccgacgtgagctacaaggtgctgagaaacgagaccgtgctggagttcatgaccgccctgtgccagagaaccggcctgagctgcttcacccagacctgcgagaagcagctgatcggcctgatcgtgctgaccagatacaacaacagaacctacagcatcgacgacatcgactggagcgtgaagcccacccacaccttccagaagagagacggcaccgagatcacctacgtggactactacaagcagcagtacgacatcaccgtgagcgacctgaaccagcccatgctggtgagcctgctgaagaagaagagaaacgacaacagcgaggcccagctggcccacctgatccccgagctgtgcttcctgaccggcctgaccgaccaggccaccagcgacttccagctgatgaaggccgtggccgagaagaccagactgagccccagcggcagacagcagagactggccagactggtggacaacatccagagaaacaccaacgccagattcgagctggagacctggggcctgcacttcggcagccagatcagcctgaccggcagaatcgtgcccagcgagaagatcctgatgcaggaccacatctgccagcccgtgagcgccgccgactggagcaaggacatcagaacctgcaagatcctgaacgcccagagcctgaacacctggctgatcctgtgcagcgacagaaccgagtacgtggccgagagcttcctgaactgcctgagaagagtggccggcagcatgggcttcaacgtggactaccccaagatcatcaaggtgcaggagaaccccgccgccttcgtgagagccatccagcagtacgtggaccccgacgtgcagctggtgatgtgcatcctgcccagcaaccagaagacctactacgacagcatcaagaagtacctgagcagcgactgccccgtgcccagccagtgcgtgctggccagaaccctgaacaagcagggcatgatgatgagcatcgccaccaagatcgccatgcagatgacctgcaagctgggcggcgagctgtgggccgtggagatccccctgaagagcctgatggtggtgggcatcgacgtgtgcaaggacgccctgagcaaggacgtgatggtggtgggctgcgtggccagcgtgaaccccagaatcaccagatggttcagcagatgcatcctgcagagaaccatgaccgacgtggccgactgcctgaaggtgttcatgaccggcgccctgaacaagtggtacaagtacaaccacgacctgcccgccagaatcatcgtgtacagagccggcgtgggcgacggccagctgaagaccctgatcgagtacgaggtgccccagctgctgagcagcgtggccgagagcagcagcaacaccagcagcagactgagcgtgatcgtggtgagaaagaagtgcatgcccagattcttcaccgagatgaacagaaccgtgcagaacccccccctgggcaccgtggtggacagcgaggccaccagaaacgagtggtacgacttctacctgatcagccaggtggcctgcagaggcaccgtgagccccacctactacaacgtgatctacgacgacaacggcctgaagcccgaccacatgcagagactgaccttcaagctgtgccacctgtactacaactggcccggcatcgtgagcgtgcccgccccctgccagtacgcccacaagctgaccttcctggtggcccagagcatccacaaggagcccagcctggagctggccaaccacctgttctacctgtag

SEQ ID NO: 9704 - DNA, 2163 bp, Artificial Sequence
  Description of Artificial Sequence: Synthetic coding sequence
atgtacggcagcgccagaagcgtgggcaaggtggagcccagcagccagagccccggcagaagccccagactgcccagaagccccagactgggccacagaagaaccaacagcaccggcggcagcagcggcagcagcgtgggcggcggcagcggcaagaccctgagcatggagaacatccagagcctgaacgccgcctacgccaccagcggccccatgtacctgagcgaccacgagaacgtgggcagcgagacccccaagagcaccatgaccctgggcagaagcggcggcagactgccctacggcgtgagaatgaccgccatgggcagcagccccaacatcgccagcagcggcgtggccagcgacaccatcgccttcggcgagcaccacctgccccccgtgagcatggccagcaccgtgccccacagcctgagacaggccagagacaacaccatcatggacctgcagacccagctgaaggaggtgctgagagagaacgacctgctgagaaaggacgtggaggtgaaggagagcaagctgagcagcagcatgaacagcatcaagaccttctggagccccgagctgaagaaggagagagccctgagaaaggacgaggccagcaagatcaccatctggaaggagcagtacagagtggtgcaggaggagaaccaggtggacgccctgagactgagactggaggagaaggagaccatgctgaacaagaagaccaagcagatccaggacatggccgaggagaagggcacccaggccggcgagatccacgacctgaaggacatgctggacgtgaaggagagaaaggtgaacgtgctgcagaagaagatcgagaacctgcaggagcagctgagagacaaggagaagcagatgagcagcctgaaggagagagtgaagagcctgcaggccgacaccaccaacaccgacaccgccctgaccaccctggaggaggccctggccgagaaggagagaaccatcgagagactgaaggagcagagagacagagacgagagagagaagcaggaggagatcgacaactacaagaaggacctgaaggacctgaaggagaaggtgagcctgctgcagggcgacctgagcgagaaggaggccagcctgctggacctgaaggagcacgccagcagcctggccagcagcggcctgaagaaggacagcagactgaagaccctggagatcgccctggagcagaagaaggaggagtgcctgaagatggagagccagctgaagaaggcccacgaggccgccctggaggccagagccagccccgagatgagcgacagaatccagcacctggagagagagatcaccagatacaaggacgagagcagcaaggcccaggccgaggtggacagactgctggagatcctgaaggaggtggagaacgagaagaacgacaaggacaagaagatcgccgagctggagagcctgttcagcagacaggtgaaggaccagaacaagaaggtggccaacctgaagcacaaggagcaggtggagaagaagaagagcgcccagatgctggaggaggccagaagaagagaggacaacctgaacgacagcagccagcagctgcaggacagcctgagaaagaaggacgacagaatcgaggagctggaggaggccctgagagagagcgtgcagatcaccgccgagagagagatggtgctggcccaggaggagagcgccagaaccaacgccgagaagcaggtggaggagctgctgatggccatggagaaggtgaagcaggagctggagagcatgaaggccaagctgagcagcacccagcagagcctggccgagaaggagacccacctgaccaacctgagagccgagagaagaaagcacctggaggaggtgctggagatgaagcaggaggccctgctggccgccatcagcgagaaggacgccaacatcgccctgctggagctgagcagcagcaagaagaagacccaggaggaggtggccgccctgaagagagagaaggacagactggtgcagcagctgaagcagcagacccagaacagaatgaagctgatggccgacaactacgaggacgaccacttcaagagcagccacagcaaccagaccaaccacaagcccagccccgaccaggacgaggaggagggcatctgggcctag

SEQ ID NO: 9705 - DNA, 1344 bp, Artificial Sequence
  Description of Artificial Sequence: Synthetic coding sequence
atggacatgggcaaccagcaccccagcatcagcagactgcaggagatccagaaggaggtgaagagcgtggagcagcaggtgatcggcttcagcggcctgagcgacgacaagaactacaagaagctggagagaatcctgaccaagcagctgttcgagatcgacagcgtggacaccgagggcaagggcgacatccagcaggccagaaagagagccgcccaggagaccgagagactgctgaaggagctggagcagaacgccaaccacccccacagaatcgagatccagaacatcttcgaggaggcccagagcctggtgagagagaagatcgtgcccttctacaacggcggcaactgcgtgaccgacgagttcgaggagggcatccaggacatcatcctgagactgacccacgtgaagaccggcggcaagatcagcctgagaaaggccagataccacaccctgaccaagatctgcgccgtgcaggagatcatcgaggactgcatgaagaagcagcccagcctgcccctgagcgaggacgcccaccccagcgtggccaagatcaacttcgtgatgtgcgaggtgaacaaggccagaggcgtgctgatcgccctgctgatgggcgtgaacaacaacgagacctgcagacacctgagctgcgtgctgagcggcctgatcgccgacctggacgccctggacgtgtgcggcagaaccgagatcagaaactacagaagagaggtggtggaggacatcaacaagctgctgaagtacctggacctggaggaggaggccgacaccaccaaggccttcgacctgagacagaaccacagcatcctgaagatcgagaaggtgctgaagagaatgagagagatcaagaacgagctgctgcaggcccagaaccccagcgagctgtacctgagcagcaagaccgagctgcagggcctgatcggccagctggacgaggtgagcctggagaagaacccctgcatcagagaggccagaagaagagccgtgatcgaggtgcagaccctgatcacctacatcgacctgaaggaggccctggagaagagaaagctgttcgcctgcgaggagcaccccagccacaaggccgtgtggaacgtgctgggcaacctgagcgagatccagggcgaggtgctgagcttcgacggcaacagaaccgacaagaactacatcagactggaggagctgctgaccaagcagctgctggccctggacgccgtggacccccagggcgaggagaagtgcaaggccgccagaaagcaggccgtgagactggcccagaacatcctgagctacctggacctgaagagcgacgagtgggagtactag

SEQ ID NO: 9706 - DNA, 1476 bp, Artificial Sequence
  Description of Artificial Sequence: Synthetic coding sequence
atggcccagagcggcggcgaggccagacccggccccaagaccgccgtgcagatcagagtggccatccaggaggccgaggacgtggacgagctggaggacgaggaggagggcgccgagaccagaggcgccggcgaccccgccagatacctgagccccggctggggcagcgccagcgaggaggagcccagcagaggccacagcggcaccaccgccagcggcggcgagaacgagagagaggacctggagcaggagtggaagccccccgacgaggagctgatcaagaagctggtggaccagatcgagttctacttcagcgacgagaacctggagaaggacgccttcctgctgaagcacgtgagaagaaacaagctgggctacgtgagcgtgaagctgctgaccagcttcaagaaggtgaagcacctgaccagagactggagaaccaccgcccacgccctgaagtacagcgtggtgctggagctgaacgaggaccacagaaaggtgagaagaaccacccccgtgcccctgttccccaacgagaacctgcccagcaagatgctgctggtgtacgacctgtacctgagccccaagctgtgggccctggccaccccccagaagaacggcagagtgcaggagaaggtgatggagcacctgctgaagctgttcggcaccttcggcgtgatcagcagcgtgagaatcctgaagcccggcagagagctgccccccgacatcagaagaatcagcagcagatacagccaggtgggcacccaggagtgcgccatcgtggagttcgaggaggtggaggccgccatcaaggcccacgagttcatgatcaccgagagccagggcaaggagaacatgaaggccgtgctgatcggcatgaagccccccaagaagaagcccgccaaggacaagaaccacgacgaggagcccaccgccagcatccacctgaacaagagcctgaacaagagagtggaggagctgcagtacatgggcgacgagagcagcgccaacagcagcagcgaccccgagagcaaccccaccagccccatggccggcagaagacacgccgccaccaacaagctgagccccagcggccaccagaacctgttcctgagccccaacgccagcccctgcaccagcccctggagcagccccctggcccagagaaagggcgtgagcagaaagagccccctggccgaggagggcagactgaactgcagcaccagccccgagatcttcagaaagtgcatggactacagcagcgacagcagcgtgacccccagcggcagcccctgggtgagaagaagaagacaggccgagatgggcacccaggagaagagccccggcaccagccccctgctgagcagaaagatgcagaccgccgacggcctgcccgtgggcgtgctgagactgcccagaggccccgacaacaccagaggcttccacggccacgagagaagcagagcctgcgtgtag

SEQ ID NO: 9707 - DNA, 315 bp, Artificial Sequence
  Description of Artificial Sequence: Synthetic coding sequence
atggccggcaaggcccacagactgagcgccgaggagagagaccagctgctgcccaacctgagagccgtgggctggaacgagctggagggcagagacgccatcttcaagcagttccacttcaaggacttcaacagagccttcggcttcatgaccagagtggccctgcaggccgagaagctggaccaccaccccgagtggttcaacgtgtacaacaaggtgcacatcaccctgagcacccacgagtgcgccggcctgagcgagagagacatcaacctggccagcttcatcgagcaggtggccgtgagcatgacctag

SEQ ID NO: 9708 - DNA, 738 bp, Artificial Sequence
  Description of Artificial Sequence: Synthetic coding sequence
atgatcggcgtgagcttcgaggaggccaagagcatcatcaccggcgccaagctgagcaccagactggagagcgcctgggagatcgccttcatcagacagaagagcgacaacatccagcccgagaacctgagctgcaccagcctgatcgaggccagcggcgagtacggcccccaggccagcaccctgagcctgttcagcagcccccccgagatcctgatccccaagaccagcagcacccccaagaccaacaacgacatcctgagcagctgcgagatcaagaccggctacaacaagaccgtgcagatccccatcaccagcgagaacagcaccgtgggcctgagcaacaccgacgtggccagcgcctggaccgagaactacggcctgcaggagaagatcagcctgaaccccagcgtgagattcaaggccgagaagctggagatggccctgaactacctgggcatccagcccaccaaggagcagcaccaggccctgagacagcaggtgcaggccgacagcaagggcaccgtgagcttcggcgacttcgtgcaggtggccagaaacctgttctgcctgcagctggacgaggtgaacgtgggcgcccacgagatcagcaacatcctggacagccagctgctgccctgcgacagcagcgaggccgacgagatggagagactgaagtgcgagagagacgacgccctgaaggaggtgaacaccctgaagtggcccggccagaactag

SEQ ID NO: 9709 - DNA, 849 bp, Artificial Sequence
  Description of Artificial Sequence: Synthetic coding sequence
atgggcggcgccgtgagcgccggcgaggacaacgacgagctgatcgacaacctgaaggaggcccagtacatcagaaccgagctggtggagcaggccttcagagccatcgacagagccgactactacctggaggagttcaaggagaacgcctacaaggacctggcctggaagcacggcaacatccacctgagcgccccctgcatctacagcgaggtgatggaggccctggacctgcagcccggcctgagcttcctgaacctgggcagcggcaccggctacctgagcagcatggtgggcctgatcctgggccccttcggcgtgaaccacggcgtggagctgcacagcgacgtgatcgagtacgccaagcagaagctggacttcttcatcagaaccagcgacagcttcgacaagttcgacttctgcgagcccagcttcgtgaccggcaactgcctggagatcagccccgactgcagccagtacgacagagtgtactgcggcgccggcgtgcagaaggagcacgaggagtacatgaagaacctgctgaaggtgggcggcatcctggtgatgcccctggaggagaagctgaccaagatcaccagaaccggccccagcgcctgggagaccaagaagatcctggccgtgagcttcgcccccctgatccagccctgccacagcgagagcggcaagagcagactggtgcagctgagaagccccagcttcgtgcagggctggagcgtggtggtgctgagccagctgaccgccgccagcaccttccaggccgaggccatcctgcccagccagagccccacctggctgaccctgcaggtgctggccaccatgcccaactag

SEQ ID NO: 9710 - DNA, 612 bp, Artificial Sequence
  Description of Artificial Sequence: Synthetic coding sequence
atggccagacccagacccagagagtacaaggccggcgacctggtgttcgccaagatgaagggctacccccactggcccgccagaatcgacgagctgcccgagggcgccgtgaagccccccgccaacaagtaccccatcttcttcttcggcacccacgagaccgccttcctgggccccaaggacctgttcccctacaaggagtacaaggacaagttcggcaagagcaacaagagaaagggcttcaacgagggcctgtgggagatcgagaacaaccccggcgtgaagttcaccggctaccaggccatccagcagcagagcagcagcgagaccgagggcgagggcggcaacaccgccgacgccagcagcgaggaggagggcgacagagtggaggaggacggcaagggcaagagaaagaacgagaaggccggcagcaagagaaagaagagctacaccagcaagaagagcagcaagcagagcagaaagagccccggcgacgaggacgacaaggactgcaaggaggaggagaacaagagcagcagcgagggcggcgacgccggcaacgacaccagaaacaccaccagcgacctgcagaagaccagcgagggcacctag

SEQ ID NO: 9711 - DNA, 540 bp, Artificial Sequence
  Description of Artificial Sequence: Synthetic coding sequence
atgaagacccccgtggagctggccgtgagcggcatgcagaccctgggcctgcagcacagatgcagaggcggctacagagtgaaggccagaaccagctacgtggacgagaccctgttcggcagccccgccggcaccagacccaccccccccgacttcgaccccccctgggtggagaaggccaacagaaccagaggcgtgggcaaggaggccagcaaggccctgggcgccaagggcagctgcgagaccacccccagcagaggcagcacccccaccctgacccccagaaagaagaacaagtacagacccatcagccacacccccagctactgcgacgagagcctgttcggcagcagaagcgagggcgccagcttcggcgcccccagaatggccaagggcgacgccgccaagctgagagccctgctgtggacccccccccccacccccagaggcagccacagccccagacccagagaggcccccccccccgtgccccccacccagatgggcctgagaatcagcggcctgcccagacagggctag

SEQ ID NO: 9712 - DNA, 1104 bp, Artificial Sequence
  Description of Artificial Sequence: Synthetic coding sequence
atggacggcgaggacatccccgacttcagcagcctgaaggaggagaccgcctactggaaggagctgagcctgaagtacaagcagagcttccaggaggccagagacgagctggtggagttccaggagggcagcagagagctggaggccgagctggaggcccagctggtgcaggccgagcagagaaacagagacctgcaggccgacaaccagagactgaagtacgaggtggaggccctgaaggagaagctggagcaccagtacgcccagagctacaagcaggtgagcgtgctggaggacgacctgagccagaccagagccatcaaggagcagctgcacaagtacgtgagagagctggagcaggccaacgacgacctggagagagccaagagagccaccatcgtgagcctggaggacttcgagcagagactgaaccaggccatcgagagaaacgccttcctggagagcgagctggacgagaaggagagcctgctggtgagcgtgcagagactgaaggacgaggccagagacctgagacaggagctggccgtgagagagagacagcaggaggtgaccagaaagagcgcccccagcagccccaccctggactgcgagaagatggacagcgccgtgcaggccagcctgagcctgcccgccacccccgtgggcaagggcaccgagaacaccttccccagccccaaggccatccccaacggcttcggcaccagccccctgacccccagcgccagaatcagcgccctgaacatcgtgggcgacctgctgagaaaggtgggcgccctggagagcaagctggccgcctgcagaaacttcgccaaggaccaggccagcagaaagagctacatcagcggcaacgtgaactgcggcgtgctgaacggcaacggcaccaagttcagcagaagcggccacaccagcttcttcgacaagggcagcagcagcagctgcgccatcagagccagcagaagaagattcagcagcagcagcgccgacctggccggcagaggcggcggcgacggcagcatccccgcccagcacagcaccggcgccagcggcaaggcccccccccccaccctgctgctggagacctag

SEQ ID NO: 9713 - DNA, 591 bp, Artificial Sequence
  Description of Artificial Sequence: Synthetic coding sequence
atgggcagcagaagcagccacgccgccgtgatccccgacggcgacagcatcagaagagagaccggcttcagccaggccagcctgctgagactgcaccacagattcagagccctggacagaaacaagaagggctacctgagcagaatggacctgcagcagatcggcgccctggccgtgaaccccctgggcgacagaatcatcgagagcttcttccccgacggcagccagagagtggacttccccggcttcgtgagagtgctggcccacttcagacccgtggaggacgaggacaccgagacccaggaccccaagaagcccgagcccctgaacagcagaagaaacaagctgcactacgccttccagctgtacgacctggacagagacggcaagatcagcagacacgagatgctgcaggtgctgagactgatggtgggcgtgcaggtgaccgaggagcagctggagaacatcgccgacagaaccgtgcaggaggccgacgaggacggcgacggcgccgtgagcttcgtggagttcaccaagagcctggagaagatggacgtggagcagaagatgagcatcagaatcctgaagtag

SEQ ID NO: 9714 - DNA, 2313 bp, Artificial Sequence
  Description of Artificial Sequence: Synthetic coding sequence
atgttcagatacgagagcctggaggactgccccctggacgaggacgaggacgccttccagggcctgggcgaggaggacgaggagatcgaccagttcaacgacgacaccttcggcagcggcgccgtggacgacgactggcaggaggcccacgagagactggccgagctggaggagaagctgcccgtggccgtgaacgagcagaccggcaacggcgagagagacgagatggacctgctgggcgaccacgaggagaacctggccgagagactgagcaagatggtgatcgagaacgagctggaggaccccgccatcatgagagccgtgcagaccagacccgtgctgcagccccagcccggcagcctgaacagcagcatctgggacggcagcgaggtgctgagaagaatcagaggccccctgctggcccaggagatgcccaccgtgagcgtgctggagtacgccctgccccagagacccccccagggccccgaggacgacagagacctgagcgagagagccctgcccagaagaagcaccagccccatcatcggcagcccccccgtgagagccgtgcccatcggcaccccccccaagcagatggccgtgcccagcttcacccagcagatcctgtgccccaagcccgtgcacgtgagaccccccatgccccccagataccccgccccctacggcgagagaatgagccccaaccagctgtgcagcgtgcccaacagcagcctgctgggccaccccttcccccccagcgtgccccccgtgctgagccccctgcagagagcccagctgctgggcggcgcccagctgcagcccggcagaatgagccccagccagttcgccagagtgcccggcttcgtgggcagccccctggccgccatgaaccccaagctgctgcagggcagagtgggccagatgctgccccccgcccccggcttcagagccttcttcagcgccccccccagcgccaccccccccccccagcagcacccccccggccccggcccccacctgcagaacctgagaagccaggcccccatgttcagacccgacaccacccacctgcacccccagcacagaagactgctgcaccagagacagcagcagaacagaagccagcacagaaacctgaacggcgccggcgacagaggcagccacagaagcagccaccaggaccacctgagaaaggacccctacgccaacctgatgctgcagagagagaaggactgggtgagcaagatccagatgatgcagctgcagagcaccgacccctacctggacgacttctactaccagaactacttcgagaagctggagaagctgagcgccgccgaggagatccagggcgacggccccaagaaggagagaaccaagctgatcaccccccaggtggccaagctggagcacgcctacaagcccgtgcagttcgagggcagcctgggcaagctgaccgtgagcagcgtgaacaaccccagaaagatgatcgacgccgtggtgaccagcagaagcgaggacgacgagaccaaggagaagcaggtgagagacaagagaagaaagaccctggtgatcatcgagaagacctacagcctgctgctggacgtggaggactacgagagaagatacctgctgagcctggaggaggagagacccgccctgatggacgacagaaagcacaagatctgcagcatgtacgacaacctgagaggcaagctgcccggccaggagagacccagcgacgaccacttcgtgcagatcatgtgcatcagaaagggcaagagaatggtggccagaatcctgcccttcctgagcaccgagcaggccgccgacatcctgatgaccaccgccagaaacctgcccttcctgatcaagaaggacgcccaggacgaggtgctgccctgcctgctgagccccttcagcctgctgctgtaccacctgcccagcgtgagcatcaccagcctgctgagacagctgatgaacctgccccagagcgccgccacccccgccctgagcaacccccacctgaccgccgtgctgcagaacaagttcggcctgagcctgctgctgatcctgctgagcagaggcgaggacctgcagagcagcgaccccgccaccgagagcacccagaacaaccagtggaccgaggtgatgttcatggccaccagagagctgctgagaatcccccaggccgccctggccaagcccatcagcatccccaccaacctggtgagcctgttcagcagatacgtggacagacagaagctgaacctgctggagaccaagctgcagctggtgcagggcatcagatag

SEQ ID NO: 9715 - DNA, 1518 bp, Artificial Sequence
  Description of Artificial Sequence: Synthetic coding sequence
atgagactgagaagactggccctgttccccggcgtggccctgctgctggccgccgccagactggccgccgccagcgacgtgctggagctgaccgacgacaacttcgagagcagaatcagcgacaccggcagcgccggcctgatgctggtggagttcttcgccccctggtgcggccactgcaagagactggcccccgagtacgaggccgccgccaccagactgaagggcatcgtgcccctggccaaggtggactgcaccgccaacaccaacacctgcaacaagtacggcgtgagcggctaccccaccctgaagatcttcagagacggcgaggaggccggcgcctacgacggccccagaaccgccgacggcatcgtgagccacctgaagaagcaggccggccccgccagcgtgcccctgagaaccgaggaggagttcaagaagttcatcagcgacaaggacgccagcatcgtgggcttcttcgacgacagcttcagcgaggcccacagcgagttcctgaaggccgccagcaacctgagagacaactacagattcgcccacaccaacgtggagagcctggtgaacgagtacgacgacaacggcgagggcatcatcctgttcagacccagccacctgaccaacaagttcgaggacaagaccgtggcctacaccgagcagaagatgaccagcggcaagatcaagaagttcatccaggagaacatcttcggcatctgcccccacatgaccgaggacaacaaggacctgatccagggcaaggacctgctgatcgcctactacgacgtggactacgagaagaacgccaagggcagcaactactggagaaacagagtgatgatggtggccaagaagttcctggacgccggccacaagctgaacttcgccgtggccagcagaaagaccttcagccacgagctgagcgacttcggcctggagagcaccgccggcgagatccccgtggtggccatcagaaccgccaagggcgagaagttcgtgatgcaggaggagttcagcagagacggcaaggccctggagagattcctgcaggactacttcgacggcaacctgaagagatacctgaagagcgagcccatccccgagagcaacgacggccccgtgaaggtggtggtggccgagaacttcgacgagatcgtgaacaacgagaacaaggacgtgctgatcgagttctacgccccctggtgcggccactgcaagaacctggagcccaagtacaaggagctgggcgagaagctgagcaaggaccccaacatcgtgatcgccaagatggacgccaccgccaacgacgtgcccagcccctacgaggtgagaggcttccccaccatctacttcagccccgccaacaagaagctgaaccccaagaagtacgagggcggcagagagctgagcgacttcatcagctacctgcagagagaggccaccaacccccccgtgatccaggaggagaagcccaagaagaagaagaaggcccaggaggacctgtag

SEQ ID NO: 9716 - DNA, 684 bp, Artificial Sequence
  Description of Artificial Sequence: Synthetic coding sequence
atgagcgtggtgccccccaacagaagccagaccggctggcccagaggcgtgacccagttcggcaacaagtacatccagcagaccaagcccctgaccctggagagaaccatcaacctgtaccccctgaccaactacaccttcggcaccaaggagcccctgtacgagaaggacagcagcgtggccgccagattccagagaatgagagaggagttcgacaagatcggcatgagaagaaccgtggagggcgtgctgatcgtgcacgagcacagactgccccacgtgctgctgctgcagctgggcaccaccttcttcaagctgcccggcggcgagctgaaccccggcgaggacgaggtggagggcctgaagagactgatgaccgagatcctgggcagacaggacggcgtgctgcaggactgggtgatcgacgactgcatcggcaactggtggagacccaacttcgagcccccccagtacccctacatccccgcccacatcaccaagcccaaggagcacaagaagctgttcctggtgcagctgcaggagaaggccctgttcgccgtgcccaagaactacaagctggtggccgcccccctgttcgagctgtacgacaacgcccccggctacggccccatcatcagcagcctgccccagctgctgagcagattcaacttcatctacaactag

SEQ ID NO: 9717 - DNA, 2244 bp, Artificial Sequence
  Description of Artificial Sequence: Synthetic coding sequence
atgagccaggtgaagagcagctacagctacgacgcccccagcgacttcatcaacttcagcagcctggacgacgagggcgacacccagaacatcgacagctggttcgaggagaaggccaacctggagaacaagctgctgggcaagaacggcaccggcggcctgttccagggcaagacccccctgagaaaggccaacctgcagcaggccatcgtgacccccctgaagcccgtggacaacacctactacaaggaggccgagaaggagaacctggtggagcagagcatccccagcaacgcctgcagcagcctggaggtggaggccgccatcagcagaaagacccccgcccagccccagagaagaagcctgagactgagcgcccagaaggacctggagcagaaggagaagcaccacgtgaagatgaaggccaagagatgcgccacccccgtgatcatcgacgagatcctgcccagcaagaagatgaaggtgagcaacaacaagaagaagcccgaggaggagggcagcgcccaccaggacaccgccgagaagaacgccagcagccccgagaaggccaagggcagacacaccgtgccctgcatgccccccgccaagcagaagttcctgaagagcaccgaggagcaggagctggagaagagcatgaagatgcagcaggaggtggtggagatgagaaagaagaacgaggagttcaagaagctggccctggccggcatcggccagcccgtgaagaagagcgtgagccaggtgaccaagagcgtggacttccacttcagaaccgacgagagaatcaagcagcaccccaagaaccaggaggagtacaaggaggtgaacttcaccagcgagctgagaaagcaccccagcagccccgccagagtgaccaagggctgcaccatcgtgaagcccttcaacctgagccagggcaagaagagaaccttcgacgagaccgtgagcacctacgtgcccctggcccagcaggtggaggacttccacaagagaacccccaacagataccacctgagaagcaagaaggacgacatcaacctgctgcccagcaagagcagcgtgaccaagatctgcagagacccccagacccccgtgctgcagaccaagcacagagccagagccgtgacctgcaagagcaccgccgagctggaggccgaggagctggagaagctgcagcagtacaagttcaaggccagagagctggaccccagaatcctggagggcggccccatcctgcccaagaagccccccgtgaagccccccaccgagcccatcggcttcgacctggagatcgagaagagaatccaggagagagagagcaagaagaagaccgaggacgagcacttcgagttccacagcagaccctgccccaccaagatcctggaggacgtggtgggcgtgcccgagaagaaggtgctgcccatcaccgtgcccaagagccccgccttcgccctgaagaacagaatcagaatgcccaccaaggaggacgaggaggaggacgagcccgtggtgatcaaggcccagcccgtgccccactacggcgtgcccttcaagccccagatccccgaggccagaaccgtggagatctgccccttcagcttcgacagcagagacaaggagagacagctgcagaaggagaagaagatcaaggagctgcagaagggcgaggtgcccaagttcaaggccctgcccctgccccacttcgacaccatcaacctgcccgagaagaaggtgaagaacgtgacccagatcgagcccttctgcctggagaccgacagaagaggcgccctgaaggcccagacctggaagcaccagctggaggaggagctgagacagcagaaggaggccgcctgcttcaaggccagacccaacaccgtgatcagccaggagcccttcgtgcccaagaaggagaagaagagcgtggccgagggcctgagcggcagcctggtgcaggagcccttccagctggccaccgagaagagagccaaggagagacaggagctggagaagagaatggccgaggtggaggcccagaaggcccagcagctggaggaggccagactgcaggaggaggagcagaagaaggaggagctggccagactgagaagagagctggtgcacaaggccaaccccatcagaaagtaccagggcctggagatcaagagcagcgaccagcccctgaccgtgcccgtgagccccaagttcagcaccagattccactgctag

SEQ ID NO: 9718 - DNA, 360 bp, Artificial Sequence
  Description of Artificial Sequence: Synthetic coding sequence
atgaagctggtgagattcctgatgaagctgagccacgagaccgtgaccatcgagctgaagaacggcacccaggtgcacggcaccatcaccggcgtggacgtgagcatgaacacccacctgaaggccgtgaagatgaccctgaagaacagagagcccgtgcagctggagaccctgagcatcagaggcaacaacatcagatacttcatcctgcccgacagcctgcccctggacaccctgctggtggacgtggagcccaaggtgaagagcaagaagagagaggccgtggccggcagaggcagaggcagaggcagaggcagaggcagaggcagaggcagaggcagaggcggccccagaagatag

SEQ ID NO: 9719 - DNA, 555 bp, Artificial Sequence
  Description of Artificial Sequence: Synthetic coding sequence
atgatgggcgccagcaccctgcaggagcccgccctgagccccggcagatgccccagacagcccctgagaagcaagttcggccaccagggcagcaccgtgcagagaaagtgcagcaagaccaacgccctgaacgtgagccagaagatgatcgagatgttcgtgagaaccaagcacaagatcgacaagagccacgagttcgccctggtggtggtgaacgacgacaccgcctggctgagcggcctgaccagcgaccccagagagctgtgcagctgcctgtacgacctggagaccgccagctgcagcaccttcaacatcagcggcgccagccccgccagacagcagaagaccgagctgcccgtgaccgagaacgtgcagaccatcccccccccctacgtggtgagaaccatcctggtgtacagcagacccccctgccagccccagttcagcctgaccgagcccatgaagaagatgttccagtgcccctacttcttcttcgacgtggtgtacatccacaacggcaccgaggagaaggaggaggagatgagctggaagtag

SEQ ID NO: 9720 - DNA, 1203 bp, Artificial Sequence
  Description of Artificial Sequence: Synthetic coding sequence
atggccagcgagaagcccctggccgccgtgacctgcaccgcccccgtgaacatcgccgtgatcaagtactggggcaagagagacgaggagctggtgctgcccatcaacagcagcctgagcgtgaccctgcaccaggaccagctgaagaccaccaccaccgccgtgatcagcaaggacttcaccgaggacagaatctggctgaacggcagagaggaggacgtgggccagcccagactgcaggcctgcctgagagagatcagatgcctggccagaaagagaagaaacagcagagacggcgaccccctgcccagcagcctgagctgcaaggtgcacgtggccagcgtgaacaacttccccaccgccgccggcctggccagcagcgccgccggctacgcctgcctggcctacaccctggccagagtgtacggcgtggagagcgacctgagcgaggtggccagaagaggcagcggcagcgcctgcagaagcctgtacggcggcttcgtggagtggcagatgggcgagcaggccgacggcaaggacagcatcgccagacaggtggcccccgagagccactggcccgagctgagagtgctgatcctggtggtgagcgccgagaagaagctgaccggcagcaccgtgggcatgagagccagcgtggagaccagccccctgctgagattcagagccgagagcgtggtgcccgccagaatggccgagatggccagatgcatcagagagagagacttccccagcttcgcccagctgaccatgaaggacagcaaccagttccacgccacctgcctggacaccttcccccccatcagctacctgaacgccatcagctggagaatcatccacctggtgcacagattcaacgcccaccacggcgacaccaaggtggcctacaccttcgacgccggccccaacgccgtgatcttcaccctggacgacaccgtggccgagttcgtggccgccgtgtggcacggcttcccccccggcagcaacggcgacaccttcctgaagggcctgcaggtgagacccgcccccctgagcgccgagctgcaggccgccctggccatggagcccacccccggcggcgtgaagtacatcatcgtgacccaggtgggccccggcccccagatcctggacgacccctgcgcccacctgctgggccccgacggcctgcccaagcccgccgcctag

SEQ ID NO: 9721 - DNA, 1350 bp, Artificial Sequence
  Description of Artificial Sequence: Synthetic coding sequence
atgagagagtgcatcagcatccacgtgggccaggccggcgtgcagatcggcaacgcctgctgggagctgtactgcctggagcacggcatccagcccgacggccagatgcccagcgacaagaccatcggcggcggcgacgacagcttcaacaccttcttcagcgagaccggcgccggcaagcacgtgcccagagccgtgttcgtggacctggagcccaccgtgatcgacgaggtgagaaccggcacctacagacagctgttccaccccgagcagctgatcaccggcaaggaggacgccgccaacaactacgccagaggccactacaccatcggcaaggagatcatcgacctggtgctggacagaatcagaaagctggccgaccagtgcaccggcctgcagggcttcctggtgttccacagcttcggcggcggcaccggcagcggcttcaccagcctgctgatggagagactgagcgtggactacggcaagaagagcaagctggagttcagcatctaccccgccccccaggtgagcaccgccgtggtggagccctacaacagcatcctgaccacccacaccaccctggagcacagcgactgcgccttcatggtggacaacgaggccatctacgacatctgcagaagaaacctggacatcgagagacccacctacaccaacctgaacagactgatcagccagatcgtgagcagcatcaccgccagcctgagattcgacggcgccctgaacgtggacctgaccgagttccagaccaacctggtgccctaccccagaatccacttccccctggccacctacgcccccgtgatcagcgccgagaaggcctaccacgagcagctgaccgtggccgagatcaccaacgcctgcttcgagcccgccaaccagatggtgaagtgcgaccccagacacggcaagtacatggcctgctgcctgctgtacagaggcgacgtggtgcccaaggacgtgaacgccgccatcgccaccatcaagaccaagagaaccatccagttcgtggactggtgccccaccggcttcaaggtgggcatcaactaccagccccccaccgtggtgcccggcggcgacctggccaaggtgcagagagccgtgtgcatgctgagcaacaccaccgccgtggccgaggcctgggccagactggaccacaagttcgacctgatgtacgccaagagagccttcgtgcactggtacgtgggcgagggcatggaggagggcgagttcagcgaggccagagaggacatggccgccctggagaaggactacgaggaggtgggcgccgacagcgccgacggcgaggacgagggcgaggagtactag

SEQ ID NO: 9722 - DNA, 1365 bp, Artificial Sequence
  Description of Artificial Sequence: Synthetic coding sequence
atgagcaccttcagacaggaggacgtggaggaccactacgagatgggcgaggagctgggcagcggccagttcgccatcgtgagaaagtgcagacagaagggcaccggcaaggagtacgccgccaagttcatcaagaagagaagactgagcagcagcagaagaggcgtgagcagagaggagatcgagagagaggtgaacatcctgagagagatcagacaccccaacatcatcaccctgcacgacatcttcgagaacaagaccgacgtggtgctgatcctggagctggtgagcggcggcgagctgttcgacttcctggccgagaaggagagcctgaccgaggacgaggccacccagttcctgaagcagatcctggacggcgtgcactacctgcacagcaagagaatcgcccacttcgacctgaagcccgagaacatcatgctgctggacaagaacgtgcccaaccccagaatcaagctgatcgacttcggcatcgcccacaagatcgaggccggcaacgagttcaagaacatcttcggcacccccgagttcgtggcccccgagatcgtgaactacgagcccctgggcctggaggccgacatgtggagcatcggcgtgatcacctacatcctgctgagcggcgccagccccttcctgggcgagaccaagcaggagaccctgaccaacatcagcgccgtgaactacgacttcgacgaggagtacttcagcaacaccagcgagctggccaaggacttcatcagaagactgctggtgaaggaccccaagagaagaatgaccatcgcccagagcctggagcacagctggatcaaggccatcagaagaagaaacgtgagaggcgaggacagcggcagaaagcccgagagaagaagactgaagaccaccagactgaaggagtacaccatcaagagccacagcagcctgccccccaacaacagctacgccgacttcgagagattcagcaaggtgctggaggaggccgccgccgccgaggagggcctgagagagctgcagagaagcagaagactgtgccacgaggacgtggaggccctggccgccatctacgaggagaaggaggcctggtacagagaggagagcgacagcctgggccaggacctgagaagactgagacaggagctgctgaagaccgaggccctgaagagacaggcccaggaggaggccaagggcgccctgctgggcaccagcggcctgaagagaagattcagcagactggagaacagatacgaggccctggccaagcaggtggccagcgagatgagattcgtgcaggacctggtgagagccctggagcaggagaagctgcagggcgtggagtgcggcctgagatag

SEQ ID NO: 9723 - DNA, 1326 bp, Artificial Sequence
  Description of Artificial Sequence: Synthetic coding sequence
atgaagaagttcttccaggagttcaaggccgacatcaagttcaagagcgccggccccggccagaagctgaaggagagcgtgggcgagaaggcccacaaggagaagcccaaccagcccgcccccagaccccccagacagggccccaccaacgaggcccagatggccgccgccgccgccctggccagactggagcagaagcagagcagagcctggggccccaccagccaggacaccatcagaaaccaggtgagaaaggagctgcaggccgaggccaccgtgagcggcagccccgaggcccccggcaccaacgtggtgagcgagcccagagaggagggcagcgcccacctggccgtgcccggcgtgtacttcacctgccccctgaccggcgccaccctgagaaaggaccagagagacgcctgcatcaaggaggccatcctgctgcacttcagcaccgaccccgtggccgccagcatcatgaagatctacaccttcaacaaggaccaggacagagtgaagctgggcgtggacaccatcgccaagtacctggacaacatccacctgcaccccgaggaggagaagtacagaaagatcaagctgcagaacaaggtgttccaggagagaatcaactgcctggagggcacccacgagttcttcgaggccatcggcttccagaaggtgctgctgcccgcccaggaccaggaggaccccgaggagttctacgtgctgagcgagaccaccctggcccagccccagagcctggagagacacaaggagcagctgctggccgccgagcccgtgagagccaagctggacagacagagaagagtgttccagcccagccccctggccagccagttcgagctgcccggcgacttcttcaacctgaccgccgaggagatcaagagagagcagagactgagaagcgaggccgtggagagactgagcgtgctgagaaccaaggccatgagagagaaggaggagcagagaggcctgagaaagtacaactacaccctgctgagagtgagactgcccgacggctgcctgctgcagggcaccttctacgccagagagagactgggcgccgtgtacggcttcgtgagagaggccctgcagagcgactggctgcccttcgagctgctggccagcggcggccagaagctgagcgaggacgagaacctggccctgaacgagtgcggcctggtgcccagcgccctgctgaccttcagctgggacatggccgtgctggaggacatcaaggccgccggcgccgagcccgacagcatcctgaagcccgagctgctgagcgccatcgagaagctgctgtag

SEQ ID NO: 9724 - DNA, 900 bp, Artificial Sequence
  Description of Artificial Sequence: Synthetic coding sequence
atgagagacctgctgctgcactggggccccggcccccccatcagagccccccaggaggaggccgaggccctgctggagctgcagggcagactgcaggaggcccaggacaccaccgaggccctgagagcccagctgggcgtgcaggaggtgcagctgcagggcctgcagggcgccctgcagcagctgcagcaggagaccgagcagaactgcagaagagagctgcagcagatgcacggccagctggccggcctgagagccagaatggccagcctgagacagggctgcggcgacctgagaggcctggtgagcaccttcacccagagctgccagggcagcctgagcgaggccagaggccaggtgagctgggccctgggcgccctgagcagcggcggccccggcacccagctgcccgagggccagcagggcccccccgccggctgccccggcagactgcccgagctgaagggcaacatcagagtgctgtgcagactgagacccggcaccagcagcagcctggtgagcgtggagcccggccccggcggcaccgtgaccacctgctacagaggcagacacagaagattcagactggactgggtgttcccccccgacgccagccaggaggaggtgttcagagagctggagcccgccgtgctgagctgcctgagaggctacagcgtgtgcatcttcacctacggccagaccggcaccggcaagacctacagcatggagggcccccccgaggaccccggcatcgtgcccagagccctgcagagcctgttcagagagatgggcgccggcagacagcacagaagataccacggcagatgcctgagccccgccgagagccccgagcaccccagacccggcctgcccccctgcagagccagaagccccctgtag

SEQ ID NO: 9725 - DNA, 2517 bp, Artificial Sequence
  Description of Artificial Sequence: Synthetic coding sequence
atgtacgccttctacagcctgctgatctacatcttctacagcctgttcagaagagacggcggcgccgccgccgccgccgagcccggcgaccccgcccagagagccagaaagcccagaggcagaagaagacccgacctgcccgcccccgagctgtggaccgagctgaccggcctggccgccagcagcgagcccgaggacggcagcgagggcgccgccgagggcagagccgccgccgtgagcctggaggaggccctgctgagactggccgagttcctgagcgtgcagctgggcgccgaggagagctgcggcggccccgccgacctgggccagagcggcgaggtgcccagcctgctgaccgtgaccagccagctgctggccctgctggcctggctgagaagccccagaggcagacaggccctgctgcagggcacccagcccgcccccagagtgagaccccccagccccgacggcagcaccagccaggaggagagccccagccacttcaccgccgtgcccggcgagcccctgggcgacgagacccagggccagcagcccctgcagctggaggaggaccagagagcctggcagagactggagcagctgatcctgggccagctggaggagctgaagcagcagctggagcagcaggaggaggagctgggcagactgagactgggcgtgggcgccaccgacagcgagaagagagtgcagcacctgaccctggagaacgaggccctgaagcagagcctgagcctgatgagagacctgctgctgcactggggccccggcccccccatcagagccccccaggaggaggccgaggccctgctggagctgcagggcagactgcaggaggcccaggacaccaccgaggccctgagagcccagctgggcgtgcaggaggtgcagctgcagggcctgcagggcgccctgcagcagctgcagcaggagaccgagcagaactgcagaagagagctgcagcagatgcacggccagctggccggcctgagagccagaatggccagcctgagacagggctgcggcgacctgagaggcctggtgagcaccttcacccagagctgccagggcagcctgagcgaggccagaggccaggtgagctgggccctgggcgccctgagcagcggcggccccggcacccagctgcccgagggccagcagggcccccccgccggctgccccggcagactgcccgagctgaagggcaacatcagagtgctgtgcagactgagacccggcaccagcagcagcctggtgagcgtggagcccggccccggcggcaccgtgaccacctgctacagaggcagacacagaagattcagactggactgggtgttcccccccgacgccagccaggaggaggtgttcagagagctggagcccgccgtgctgagctgcctgagaggctacagcgtgtgcatcttcacctacggccagaccggcaccggcaagacctacagcatggagggcccccccgaggaccccggcatcgtgcccagagccctgcagagcctgttcagagagatgggcgccggcagacagcacagagtgaccctgagcatggtggagatctacaacgaggccgtgagagacctgctggcccccggcccccccgagagactggccgtgagacagggccccgagggccagggcggcatccaggtggccggcctgacccactgggacgtgcccaacctggagaccctgcaccagatgctgaagctgggcagaagcaacagagccaccgccgccaccgccatgaaccagagaagcagcagaagccacgccctggtgaccctgaccctgagagccgccagcccccccagagcccccggcaccgccggcaccctgcacctggtggacctggccggcagcgagagagccagaaaggccggcgccgccggcccccccagaggcgaccccgacggcgccagaagactgagagaggcccagaccatcaacagaagcctgctggccctgggcggcgtgatggccgccctgagagcccacagaccccacgtgcccttcagagacagccagctgaccagactgctgcagcccgccctgggccccggcaccaccgccgtgctgctgctgcaggtgggcgccggcgccggccaggtgtgcgcctgcagaagcccccccaccagagccagaccccccgcccccctggccagaagaagccccagaggcagaagaatcagcggcagacagagcgcccccagcagcagccccaccgagtgggtgaagtggagctggggccagcccggcgccgccggcagcagagccccccccggcagactgctgcccagcgcccccaccctgagaagccccggcccccccgcccccctgagaagacccctggccgtgctgcacgcccccgtgcccaccaccgccagagccagactgagcagaccccagagagcctgccccagcagccccggcagcagaccctgcccctggggcctgagacccggcctgtgctggcagagaagatag

SEQ ID NO: 9726 - DNA, 597 bp, Artificial Sequence
  Description of Artificial Sequence: Synthetic coding sequence
atggccagcggcaacgccagaatcggcaagcccgcccccgacttcaaggccaccgccgtggtggacggcgccttcaaggaggtgaagctgagcgactacaagggcaagtacgtggtgctgttcttctaccccctggacttcaccttcgtgtgccccaccgagatcatcgccttcagcaacagagccgaggacttcagaaagctgggctgcgaggtgctgggcgtgagcgtggacagccagttcacccacctggcctggatcaacacccccagaaaggagggcggcctgggccccctgaacatccccctgctggccgacgtgaccagaagactgagcgaggactacggcgtgctgaagaccgacgagggcatcgcctacagaggcctgttcatcatcgacggcaagggcgtgctgagacagatcaccgtgaacgacctgcccgtgggcagaagcgtggacgaggccctgagactggtgcaggccttccagtacaccgacgagcacggcgaggtgtgccccgccggctggaagcccggcagcgacaccatcaagcccaacgtggacgacagcaaggagtacttcagcaagcacaactag

SEQ ID NO: 9727 - DNA, 1380 bp, Artificial Sequence
  Description of Artificial Sequence: Synthetic coding sequence
atgagcgtgagattcagcagcaccagcagaagactgggcagctgcggcggcaccggcagcgtgagactgagcagcggcggcgccggcttcggcgccggcaacacctgcggcgtgcccggcatcggcagcggcttcagctgcgccttcggcggcagcagcagcgccggcggctacggcggcggcctgggcggcggcagcgccagctgcgccgccttcaccggcaacgagcacggcctgctgagcggcaacgagaaggtgaccatgcagaacctgaacgacagactggccagctacctggagaacgtgagagccctggaggaggccaacgccgacctggagcagaagatcaagggctggtacgagaagttcggccccggcagctgcagaggcctggaccacgactacagcagatacttccccatcatcgacgagctgaagaaccagatcatcagcgccaccaccagcaacgcccacgtggtgctgcagaacgacaacgccagactgaccgccgacgacttcagactgaagttcgagaacgagctggccctgcaccagagcgtggaggccgacatcaacggcctgagaagagtgctggacgagctgaccctgtgcagaaccgacctggagatccagctggagaccctgagcgaggagctggcctacctgaagaagaaccacgaggaggagatgaaggccctgcagtgcgccgccggcggcaacgtgaacgtggagatgaacgccgcccccggcgtggacctgaccgtgctgctgaacaacatgagagccgagtacgaggccctggccgagcagaacagaagagacgccgaggcctggttcaacgagaagagcgccagcctgcagcagcagatcagcgacgacgccggcgccaccaccagcgccagaaacgagctgatcgagatgaagagaaccctgcagaccctggagatcgagctgcagagcctgctggccaccaagcacagcctggagtgcagcctgaccgagaccgagagcaactactgcgcccagctggcccagatccaggcccagatcggcgccctggaggagcagctgcaccaggtgagaaccgagaccgagggccagaagctggagtacgagcagctgctggacatcaaggtgcacctggagaaggagatcgagacctactgcctgctgatcgacggcgaggacggcagctgcagcaagagcaagggctacggcggccccggcaaccagaccaaggacagcagcaagaccaccatcgtgaagaccgtggtggaggagatcgaccccagaggcaaggtgctgagcagcagagtgcacaccgtggaggagaagagcaccaaggtgaacaacaagaacgagcagagagtgagcagctag

SEQ ID NO: 9728 - DNA, 834 bp, Artificial Sequence
  Description of Artificial Sequence: Synthetic coding sequence
atgcccagcgtgagcaaggccgccgccgccgccctgagcggcagccccccccagaccgagaagcccacccactacagatacctgaaggagttcagaaccgagcagtgccccctgttcagccagcacaagtgcgcccagcacagacccttcacctgcttccactggcacttcctgaaccagagaagaagaagacccctgagaagaagagacggcaccttcaactacagccccgacgtgtactgcagcaagtacaacgaggccaccggcgtgtgccccgacggcgacgagtgcccctacctgcacagaaccaccggcgacaccgagagaaagtaccacctgagatactacaagaccggcacctgcatccacgagaccgacgccagaggccactgcgtgaagaacggcctgcactgcgccttcgcccacggccccctggacctgagaccccccgtgtgcgacgtgagagagctgcaggcccaggaggccctgcagaacggccagctgggcggcggcgagggcgtgcccgacctgcagcccggcgtgctggccagccaggccatgatcgagaagatcctgagcgaggaccccagatggcaggacgccaacttcgtgctgggcagctacaagaccgagcagtgccccaagccccccagactgtgcagacagggctacgcctgcccccactaccacaacagcagagacagaagaagaaaccccagaagattccagtacagctggcagctgggcagaagagtgctgagactgagccccagagccaacaaccccagagtggccctgcccagagtgcacaccggccccagcagcaccgcctag

SEQ ID NO: 9729 - DNA, 918 bp, Artificial Sequence
  Description of Artificial Sequence: Synthetic coding sequence
atggacctgagcggcgtgaagaagaagagcctgctgggcgtgaaggagaacaacaagaagagcagcaccagagcccccagccccaccaagagaaaggacagaagcgacgagaagagcaaggacagaagcaaggacaagggcgccaccaaggagagcagcgagaaggacagaggcagagacaagaccagaaagagaagaagcgccagcagcggcagcagcagcaccagaagcagaagcagcagcaccagcagcagcggcagcagcaccagcaccggcagcagcagcggcagcagcagcagcagcgccagcagcagaagcggcagcagcagcaccagcagaagcagcagcagcagcagcagcagcggcagccccagccccagcagaagaagacacgacaacagaagaagaagcagaagcaagagcaagccccccaagagagacgagaaggagagaaagagaagaagccccagccccaagcccaccaaggtgcacatcggcagactgaccagaaacgtgaccaaggaccacatcatggagatcttcagcacctacggcaagatcaagatgatcgacatgcccgtggagagaatgcacccccacctgagcaagggctacgcctacgtggagttcgagaaccccgacgaggccgagaaggccctgaagcacatggacggcggccagatcgacggccaggagatcaccgccaccgccgtgctggccccctggcccagacccccccccagaagattcagcccccccagaagaatgctgccccccccccccatgtggagaagaagcccccccagaatgagaagaagaagcagaagccccagaagaagaagccccgtgagaagaagaagcagaagccccggcagaagaagacacagaagcagaagcagcagcaacagcagcagatag

SEQ ID NO: 9730 - DNA, 3198 bp, Artificial Sequence
  Description of Artificial Sequence: Synthetic coding sequence
atgagaaagcaggaggtgagaaccggcagagaggccggccagggccacggcaccggcagccccgccgagcaggtgaaggccctgatggacctgctggccggcaagggcagccagggcagccaggccccccaggccctggacagaacccccgacgcccccctgggcccctgcagcaacgacagcagaatccagagacacagaaaggccctgctgagcaaggtgggcggcggccccgagctgggcggcccctggcacagactggccagcctgctgctggtggagggcctgaccgacctgcagctgagagagcacgacttcacccaggtggaggccaccagaggcggcggccaccccgccagaaccgtggccctggacagactgttcctgcccctgagcagagtgagcgtgccccccagagtgagcatcaccatcggcgtggccggcatgggcaagaccaccctggtgagacacttcgtgagactgtgggcccacggccaggtgggcaaggacttcagcctggtgctgcccctgaccttcagagacctgaacacccacgagaagctgtgcgccgacagactgatctgcagcgtgttcccccacgtgggcgagcccagcctggccgtggccgtgcccgccagagccctgctgatcctggacggcctggacgagtgcagaacccccctggacttcagcaacaccgtggcctgcaccgaccccaagaaggagatccccgtggaccacctgatcaccaacatcatcagaggcaacctgttccccgaggtgagcatctggatcaccagcagacccagcgccagcggccagatccccggcggcctggtggacagaatgaccgagatcagaggcttcaacgaggaggagatcaaggtgtgcctggagcagatgttccccgaggaccaggccctgctgggctggatgctgagccaggtgcaggccgacagagccctgtacctgatgtgcaccgtgcccgccttctgcagactgaccggcatggccctgggccacctgtggagaagcagaaccggcccccaggacgccgagctgtggccccccagaaccctgtgcgagctgtacagctggtacttcagaatggccctgagcggcgagggccaggagaagggcaaggccagccccagaatcgagcaggtggcccacggcggcagaaagatggtgggcaccctgggcagactggccttccacggcctgctgaagaagaagtacgtgttctacgagcaggacatgaaggccttcggcgtggacctggccctgctgcagggcgccccctgcagctgcttcctgcagagagaggagaccctggccagcagcgtggcctactgcttcacccacctgagcctgcaggagttcgtggccgccgcctactactacggcgccagcagaagagccatcttcgacctgttcaccgagagcggcgtgagctggcccagactgggcttcctgacccacttcagaagcgccgcccagagagccatgcaggccgaggacggcagactggacgtgttcctgagattcctgagcggcctgctgagccccagagtgaacgccctgctggccggcagcctgctggcccagggcgagcaccaggcctacagaacccaggtggccgagctgctgcagggctgcctgagacccgacgccgccgtgtgcgccagagccatcaacgtgctgcactgcctgcacgagctgcagcacaccgagctggccagaagcgtggaggaggccatggagagcggcgccctggccagactgaccggccccgcccacagagccgccctggcctacctgctgcaggtgagcgacgcctgcgcccaggaggccaacctgagcctgagcctgagccagggcgtgctgcagagcctgctgccccagctgctgtactgcagaaagctgagactggacaccaaccagttccaggaccccgtgatggagctgctgggcagcgtgctgagcggcaaggactgcagaatccagaagatcagcctggccgagaaccagatcagcaacaagggcgccaaggccctggccagaagcctgctggtgaacagaagcctgaccagcctggacctgagaggcaacagcatcggcccccagggcgccaaggccctggccgacgccctgaagatcaacagaaccctgaccagcctgagcctgcagggcaacaccgtgagagacgacggcgccagaagcatggccgaggccctggccagcaacagaaccctgagcatgctgcacctgcagaagaacagcatcggccccatgggcgcccagagaatggccgacgccctgaagcagaacagaagcctgaaggagctgatgttcagcagcaacagcatcggcgacggcggcgccaaggccctggccgaggccctgaaggtgaaccagggcctggagagcctggacctgcagagcaacagcatcagcgacgccggcgtggccgccctgatgggcgccctgtgcaccaaccagaccctgctgagcctgagcctgagagagaacagcatcagccccgagggcgcccaggccatcgcccacgccctgtgcgccaacagcaccctgaagaacctggacctgaccgccaacctgctgcacgaccagggcgccagagccatcgccgtggccgtgagagagaacagaaccctgaccagcctgcacctgcagtggaacttcatccaggccggcgccgcccaggccctgggccaggccctgcagctgaacagaagcctgaccagcctggacctgcaggagaacgccatcggcgacgacggcgcctgcgccgtggccagagccctgaaggtgaacaccgccctgaccgccctgtacctgcaggtggccagcatcggcgccagcggcgcccaggtgctgggcgaggccctggccgtgaacagaaccctggagatcctggacctgagaggcaacgccatcggcgtggccggcgccaaggccctggccaacgccctgaaggtgaacagcagcctgagaagactgaacctgcaggagaacagcctgggcatggacggcgccatctgcatcgccaccgccctgagcggcaaccacagactgcagcacatcaacctgcagggcaaccacatcggcgacagcggcgccagaatgatcagcgaggccatcaagaccaacgcccccacctgcaccgtggagatgtag

SEQ ID NO: 9731 - DNA, 927 bp, Artificial Sequence
  Description of Artificial Sequence: Synthetic coding sequence
atgaaccccatcgtggtggtgcacggcggcggcgccggccccatcagcaaggacagaaaggagagagtgcaccagggcatggtgagagccgccaccgtgggctacggcatcctgagagagggcggcagcgccgtggacgccgtggagggcgccgtggtggccctggaggacgaccccgagttcaacgccggctgcggcagcgtgctgaacaccaacggcgaggtggagatggacgccagcatcatggacggcaaggacctgagcgccggcgccgtgagcgccgtgcagtgcatcgccaaccccatcaagctggccagactggtgatggagaagaccccccactgcttcctgaccgaccagggcgccgcccagttcgccgccgccatgggcgtgcccgagatccccggcgagaagctggtgaccgagagaaacaagaagagactggagaaggagaagcacgagaagggcgcccagaagaccgactgccagaagaacctgggcaccgtgggcgccgtggccctggactgcaagggcaacgtggcctacgccaccagcaccggcggcatcgtgaacaagatggtgggcagagtgggcgacagcccctgcctgggcgccggcggctacgccgacaacgacatcggcgccgtgagcaccaccggccacggcgagagcatcctgaaggtgaacctggccagactgaccctgttccacatcgagcagggcaagaccgtggaggaggccgccgacctgagcctgggctacatgaagagcagagtgaagggcctgggcggcctgatcgtggtgagcaagaccggcgactgggtggccaagtggaccagcaccagcatgccctgggccgccgccaaggacggcaagctgcacttcggcatcgaccccgacgacaccaccatcaccgacctgccctag

SEQ ID NO: 9732 - DNA, 1212 bp, Artificial Sequence
  Description of Artificial Sequence: Synthetic coding sequence
atggccggcagaagagcccagaccggcagcgccccccccagacccgccgccccccacccccccgccagcagagccttcccccagcactgcagacccagagacgccgagagaccccccagccccagaagccccctgatgcccggctgcgagctgcccgtgggcacctgccccgacatgtgccccgccgccgagagagcccagagagagagagagcacagactgcacagactggaggtggtgcccggctgcagacaggacccccccagagccgacccccagagagccgtgaaggagtacagcagacccgccgccggcaagcccagacccccccccagccagctgagaccccccagcgtgctgctggccaccgtgagatacctggccggcgaggtggccgagagcgccgacatcgccagagccgaggtggccagcttcgtggccgacagactgagagccgtgctgctggacctggccctgcagggcgccggcgacgccgaggccgccgtggtgctggaggccgccctggccaccctgctgaccgtggtggccagactgggccccgacgccgccagaggccccgccgaccccgtgctgctgcaggcccaggtgcaggagggcttcggcagcctgagaagatgctacgccagaggcgccggcccccaccccagacagcccgccttccagggcctgttcctgctgtacaacctgggcagcgtggaggccctgcacgaggtgctgcagctgcccgccgccctgagagcctgcccccccctgagaaaggccctggccgtggacgccgccttcagagagggcaacgccgccagactgttcagactgctgcagaccctgccctacctgcccagctgcgccgtgcagtgccacgtgggccacgccagaagagaggccctggccagattcgccagagccttcagcacccccaagggccagaccctgcccctgggcttcatggtgaacctgctggccctggacggcctgagagaggccagagacctgtgccaggcccacggcctgcccctggacggcgaggagagagtggtgttcctgagaggcagatacgtggaggagggcctgccccccgccagcacctgcaaggtgctggtggagagcaagctgagaggcagaaccctggaggaggtggtgatggccgaggaggaggacgagggcaccgacagacccggcagccccgcctag

SEQ ID NO: 9733 - DNA, 894 bp, Artificial Sequence
  Description of Artificial Sequence: Synthetic coding sequence
atggccgagctgaccgccctggagagcctgatcgagatgggcttccccagaggcagagccgagaaggccctggccctgaccggcaaccagggcatcgaggccgccatggactggctgatggagcacgaggacgaccccgacgtggacgagcccctggagacccccctgggccacatcctgggcagagagcccaccagcagcgagcagggcggcctggagggcagcggcagcgccgccggcgagggcaagcccgccctgagcgaggaggagagacaggagcagaccaagagaatgctggagctggtggcccagaagcagagagagagagaggagagagaggagagagaggccctggagagagagagacagagaagaagacagggccaggagctgagcgccgccagacagagactgcaggaggacgagatgagaagagccgccgaggagagaagaagagagaaggccgaggagctggccgccagacagagagtgagagagaagatcgagagagacaaggccgagagagccaagaagtacggcggcagcgtgggcagccagcccccccccgtggcccccgagcccggccccgtgcccagcagccccagccaggagccccccaccaagagagagtacgaccagtgcagaatccaggtgagactgcccgacggcaccagcctgacccagaccttcagagccagagagcagctggccgccgtgagactgtacgtggagctgcacagaggcgaggagctgggcggcggccaggaccccgtgcagctgctgagcggcttccccagaagagccttcagcgaggccgacatggagagacccctgcaggagctgggcctggtgcccagcgccgtgctgatcgtggccaagaagtgccccagctag

SEQ ID NO: 9734 - DNA, 570 bp, Artificial Sequence
  Description of Artificial Sequence: Synthetic coding sequence
atgagactgagcctgcccctgctgctgctgctgctgggcgcctgggccatccccggcggcctgggcgacagagcccccctgaccgccaccgccccccagctggacgacgaggagatgtacagcgcccacatgcccgcccacctgagatgcgacgcctgcagagccgtggcctaccagatgtggcagaacctggccaaggccgagaccaagctgcacaccagcaacagcggcggcagaagagagctgagcgagctggtgtacaccgacgtgctggacagaagctgcagcagaaactggcaggactacggcgtgagagaggtggaccaggtgaagagactgaccggccccggcctgagcgagggccccgagcccagcatcagcgtgatggtgaccggcggcccctggcccaccagactgagcagaacctgcctgcactacctgggcgagttcggcgaggaccagatctacgaggcccaccagcagggcagaggcgccctggaggccctgctgtgcggcggcccccagggcgcctgcagcgagaaggtgagcgccaccagagaggagctgtag

SEQ ID NO: 9735 - DNA, 3129 bp, Artificial Sequence
  Description of Artificial Sequence: Synthetic coding sequence
atggccaacgacagccccgccaagagcctggtggacatcgacctgagcagcctgagagaccccgccggcatcttcgagctggtggaggtggtgggcaacggcacctacggccaggtgtacaagggcagacacgtgaagaccggccagctggccgccatcaaggtgatggacgtgaccgaggacgaggaggaggagatcaagctggagatcaacatgctgaagaagtacagccaccacagaaacatcgccacctactacggcgccttcatcaagaagagcccccccggccacgacgaccagctgtggctggtgatggagttctgcggcgccggcagcatcaccgacctggtgaagaacaccaagggcaacaccctgaaggaggactggatcgcctacatcagcagagagatcctgagaggcctggcccacctgcacatccaccacgtgatccacagagacatcaagggccagaacgtgctgctgaccgagaacgccgaggtgaagctggacgagaccgagtacgagtacagcggcagcgaggaggaggaggaggaggtgcccgagcaggagggcgagcccagcagcatcgtgaacgtgcccggcgagagcaccctgagaagagacttcctgagactgcagcaggagaacaaggagagaagcgaggccctgagaagacagcagctgctgcaggagcagcagctgagagagcaggaggagtacaagagacagctgctggccgagagacagaagagaatcgagcagcagaaggagcagagaagaagactggaggagcagcagagaagagagagagaggccagaagacagcaggagagagagcagagaagaagagagcaggaggagaagagaagactggaggagctggagagaagaagaaaggaggaggaggagagaagaagagccgaggaggagaagagaagagtggagagagagcaggagtacatcagaagacagctggaggaggagcagagacacctggaggtgctgcagcagcagctgctgcaggagcaggccatgctgctggagtgcagatggagagagatggaggagcacagacaggccgagagactgcagagacagctgcagcaggagcaggcctacctgctgagcctgcagcacgaccacagaagaccccacccccagcacagccagcagcccccccccccccagcaggagagaagcaagcccagcttccacgcccccgagcccaaggcccactacgagcccgccgacagagccagagaggtgcccgtgagaaccaccagcagaagccccgtgctgagcagaagagacagccccctgcagggcagcggccagcagaacagccaggccggccagagaaacagcaccagcagcatcgagcccagactgctgtgggagagagtggagaagctggtgcccagacccggcagcggcagcagcagcggcagcagcaacagcggcagccagcccggcagccaccccggcagccagagcggcagcggcgagagattcagagtgagaagcagcagcaagagcgagggcagccccagccagagactggagaacgccgtgaagaagcccgaggacaagaaggaggtgttcagacccctgaagcccgccgtgagaatcgacctgaccgccctggccaaggagctgagagccgtggaggacgtgagacccccccacaaggtgaccgactacagcagcagcagcgaggagagcggcaccaccgacgaggaggacgacgacgtggagcaggagggcgccgacgagagcaccagcggccccgaggacaccagagccgccagcagcctgaacctgagcaacggcgagaccgagagcgtgaagaccatgatcgtgcacgacgacgtggagagcgagcccgccatgacccccagcaaggagggcaccctgatcgtgagacagacccagagcgccagcagcaccctgcagaagcacaagagcagcagcagcttcacccccttcatcgaccccagactgctgcagatcagccccagcagcggcaccaccgtgaccagcgtggtgggcttcagctgcgacggcatgagacccgaggccatcagacaggaccccaccagaaagggcagcgtggtgaacgtgaaccccaccaacaccagaccccagagcgacacccccgagatcagaaagtacaagaagagattcaacagcgagatcctgtgcgccgccctgtggggcgtgaacctgctggtgggcaccgagagcggcctgatgctgctggacagaagcggccagggcaaggtgtaccccctgatcaacagaagaagattccagcagatggacgtgctggagggcctgaacgtgctggtgaccatcagcggcaagaaggacaagctgagagtgtactacctgagctggctgagaaacaagatcctgcacaacgaccccgaggtggagaagaagcagggctggaccaccgtgggcgacctggagggctgcgtgcactacaaggtggtgaagtacgagagaatcaagttcctggtgatcgccctgaagagcagcgtggaggtgtacgcctgggcccccaagccctaccacaagttcatggccttcaagagcttcggcgagctggtgcacaagcccctgctggtggacctgaccgtggaggagggccagagactgaaggtgatctacggcagctgcgccggcttccacgccgtggacgtggacagcggcagcgtgtacgacatctacctgcccacccacatccagtgcagcatcaagccccacgccatcatcatcctgcccaacaccgacggcatggagctgctggtgtgctacgaggacgagggcgtgtacgtgaacacctacggcagaatcaccaaggacgtggtgctgcagtggggcgagatgcccaccagcgtggcctacatcagaagcaaccagaccatgggctggggcgagaaggccatcgagatcagaagcgtggagaccggccacctggacggcgtgttcatgcacaagagagcccagagactgaagttcctgtgcgagagaaacgacaaggtgttcttcgccagcgtgagaagcggcggcagcagccaggtgtacttcatgaccctgggcagaaccagcctgctgagctggtag

SEQ ID NO: 9736 - DNA, 1113 bp, Artificial Sequence
  Description of Artificial Sequence: Synthetic coding sequence
atgggcttcaacagacccagcaagatccaggagaacgccctgcccatgatgctggccgagcccccccagaacctgatcgcccagagccagagcggcaccggcaagaccgccgccttcgtgctggccatgctgagcagagtggagcccagcgacagatacccccagtgcctgtgcctgagccccacctacgagctggccctgcagaccggcaaggtgatcgagcagatgggcaagttctaccccgagctgaagctggcctacgccgtgagaggcaacaagctggagagaggccagaagatcagcgagcagatcgtgatcggcacccccggcaccgtgctggactggtgcagcaagctgaagttcatcgaccccaagaagatcaaggtgttcgtgctggacgaggccgacgtgatgatcgccacccagggccaccaggaccagagcatcagaatccagagaatgctgcccagaaactgccagatgctgctgttcagcgccaccttcgaggacagcgtgtggaagttcgcccagaaggtggtgcccgaccccaacgtgatcaagctgaagagagaggaggagaccctggacaccatcaagcagtactacgtgctgtgcagcagcagagacgagaagttccaggccctgtgcaacctgtacggcgccatcaccatcgcccaggccatgatcttctgccacaccagaaagaccgccagctggctggccgccgagctgagcaaggagggccaccaggtggccctgctgagcggcgagatgatggtggagcagagagccgccgtgatcgagagattcagagagggcaaggagaaggtgctggtgaccaccaacgtgtgcgccagaggcatcgacgtggagcaggtgagcgtggtgatcaacttcgacctgcccgtggacaaggacggcaaccccgacaacgagacctacctgcacagaatcggcagaaccggcagattcggcaagagaggcctggccgtgaacatggtggacagcaagcacagcatgaacatcctgaacagaatccaggagcacttcaacaagaagatcgagagactggacaccgacgacctggacgagatcgagaagatcgccaactag

SEQ ID NO: 9737 - DNA, 1437 bp, Artificial Sequence
  Description of Artificial Sequence: Synthetic coding sequence
atggccaccgacagctgggccctggccgtggacgagcaggaggccgccgtgaagagcatgaccaacctgcagatcaaggaggagaaggtgaaggccgacaccaacggcatcatcaagaccagcaccaccgccgagaagaccgacgaggaggagaaggaggacagagccgcccagagcctgctgaacaagctgatcagaagcaacctggtggacaacaccaaccaggtggaggtgctgcagagagaccccaacagccccctgtacagcgtgaagagcttcgaggagctgagactgaagccccagctgctgcagggcgtgtacgccatgggcttcaacagacccagcaagatccaggagaacgccctgcccatgatgctggccgagcccccccagaacctgatcgcccagagccagagcggcaccggcaagaccgccgccttcgtgctggccatgctgagcagagtggagcccagcgacagatacccccagtgcctgtgcctgagccccacctacgagctggccctgcagaccggcaaggtgatcgagcagatgggcaagttctaccccgagctgaagctggcctacgccgtgagaggcaacaagctggagagaggccagaagatcagcgagcagatcgtgatcggcacccccggcaccgtgctggactggtgcagcaagctgaagttcatcgaccccaagaagatcaaggtgttcgtgctggacgaggccgacgtgatgatcgccacccagggccaccaggaccagagcatcagaatccagagaatgctgcccagaaactgccagatgctgctgttcagcgccaccttcgaggacagcgtgtggaagttcgcccagaaggtggtgcccgaccccaacgtgatcaagctgaagagagaggaggagaccctggacaccatcaagcagtactacgtgctgtgcagcagcagagacgagaagttccaggccctgtgcaacctgtacggcgccatcaccatcgcccaggccatgatcttctgccacaccagaaagaccgccagctggctggccgccgagctgagcaaggagggccaccaggtggccctgctgagcggcgagatgatggtggagcagagagccgccgtgatcgagagattcagagagggcaaggagaaggtgctggtgaccaccaacgtgtgcgccagaggcatcgacgtggagcaggtgagcgtggtgatcaacttcgacctgcccgtggacaaggacggcaaccccgacaacgagacctacctgcacagaatcggcagaaccggcagattcggcaagagaggcctggccgtgaacatggtggacagcaagcacagcatgaacatcctgaacagaatccaggagcacttcaacaagaagatcgagagactggacaccgacgacctggacgagatcgagaagatcgccaactag

SEQ ID NO: 9738 - DNA, 2238 bp, Artificial Sequence
  Description of Artificial Sequence: Synthetic coding sequence
atggtgggccccggccccaccgccgccgccgccgtggaggagagacagagaaagctgcaggagtacctggccgccaagggcaagctgaagagccagaacaccaagccctacctgaagagcaagaacaactgccagaaccagccccccagcaagagcaccatcagacccaagaacgacgtgaccaaccacgtggtgctgcccgtgaagcccaagagaagcatcagcatcaagctgcagcccagaccccccaacaccgccggcagccagaagcccaagctggagccccccaagctgctgggcaagagactgaccagcgagtgcgtgagcagcaacccctacagcaagcccagcagcaagagcttccagcagtgcgaggccggcagcagcaccaccggcgagctgagcagaaagcccgtgggcagcctgaacatcgagcagctgaagaccaccaagcagcagctgaccgaccagggcaacggcaagtgcatcgacttcatgaacaacatccacgtggagaacgagagcctggacaacttcctgaaggagaccaacaaggagaacctgctggacatcctgaccgagcccgagagaaagcccgaccccaagctgtacaccagaagcaagcccaagaccgacagctacaaccagaccaagaacagcctggtgcccaagcaggccctgggcaagagcagcgtgaacagcgccgtgctgaaggacagagtgaacaagcagttcgtgggcgagacccagagcagaaccttccccgtgaagagccagcagctgagcagaggcgccgacctggccagacccggcgtgaagcccagcagaaccgtgcccagccacttcatcagaaccctgagcaaggtgcagagcagcaagaagcccgtggtgaagaacatcaaggacatcaaggtgaacagaagccagtacgagagacccaacgagaccaagatcagaagctaccccgtgaccgagcagagagtgaagcacaccaagcccagaacctaccccagcctgctgcagggcgagtacaacaacagacaccccaacatcaagcaggaccagaagagcagccaggtgtgcatcccccagaccagctgcgtgctgcagaagagcaaggccatcagccagagacccaacctgaccgtgggcagattcaacagcgccatccccagcacccccagcatcagacccaacggcaccagcggcaacaagcacaacaacaacggcttccagcagaaggcccagaccctggacagcaagctgaagaaggccgtgccccagaaccacttcctgaacaagaccgcccccaagacccaggccgacgtgaccaccgtgaacggcacccagaccaaccccaacatcaagaagaaggccaccgccgaggacagaagaaagcagctggaggagtggcagaagagcaagggcaagacctacaagagaccccccatggagctgaagaccaagagaaaggtgatcaaggagatgaacatcagcttctggaagagcatcgagaaggaggaggaggagaagaaggcccagctggagctgagcagcaagatcaacaacaccctgaccgagtgcctgaacctgatcgagggcggcgtgcccagcaacgagatcctgaacatcctgagcagcatccccgaggccgagaagttcgccaagttctggatctgcaaggccaagctgctggccagcaagggcaccttcgacgtgatcggcctgtacgaggaggccatcaagaacggcgccacccccatccaggagctgagaaaggtggtgctgaacatcctgcaggacagcaacagaaccaccgagggcatcaccagcgacagcctggtggccgagaccagcatcaccagcgtggaggagctggccaagaagatggagagcgtgaagagctgcctgagccccaaggagagagagcaggtgaccgccacccccagaatcgccaaggccgagcagcacaactaccccggcatcaagctgcagatcggccccatccccagaatcaacggcatgcccgaggtgcaggacatgaagttcatcacccccgtgagaagaagcagcagaatcgagagagccgtgagcagataccccgagatgctgcaggagcacgacctggtggtggccagcctggacgagctgctggaggtggaggagaccaagtgcttcatcttcagaagaaacgaggccctgcccgtgaccctgggcttccagacccccgagagctag

SEQ ID NO: 9739 - DNA, 378 bp, Artificial Sequence
  Description of Artificial Sequence: Synthetic coding sequence
atgagcagcaccctgggcaagctgagcaaccaggtggaggagaccctgcccctgctgaagaaggtgcccgccaactacttccacatctgcagcgccatcctgatgggcttcagcctgagcaagagcgccacccaggtgagcgccatccacatggacagcaaggtggacgaccacctgatcagaggcaccgagaagagcagactggagcccgccacccagctgttccagaacaccaagaagatcagactggaggacaccaaccaggagaacttcaccagaatcgagggcaccggcaccggcagcctgagcggcaaggccctgggcagcgtggtgtacgtgaaggagagcgacggcctggagatgaccgacgtggagtag

SEQ ID NO: 9740 - DNA, 4284 bp, Artificial Sequence
  Description of Artificial Sequence: Synthetic coding sequence
atgagcatgctgaagcccagcggcctgaaggcccccaccaagatcctgaagcccggcagcaccgccctgaagacccccaccgccgtggtggcccccgtggagaagaccatcagcagcgagaaggccagcagcacccccagcagcgagacccaggaggagttcgtggacgacttcagagtgggcgagagagtgtgggtgaacggcaacaagcccggcttcatccagttcctgggcgagacccagttcgcccccggccagtgggccggcatcgtgctggacgagcccatcggcaagaacgacggcagcgtggccggcgtgagatacttccagtgcgagcccctgaagggcatcttcaccagacccagcaagctgaccagaaaggtgcaggccgaggacgaggccaacggcctgcagaccacccccgccagcagagccaccagccccctgtgcaccagcaccgccagcatggtgagcagcagccccagcacccccagcaacatcccccagaagcccagccagcccgccgccaaggagcccagcgccaccccccccatcagcaacctgaccaagaccgccagcgagagcatcagcaacctgagcgaggccggcagcatcaagaagggcgagagagagctgaagatcggcgacagagtgctggtgggcggcaccaaggccggcgtggtgagattcctgggcgagaccgacttcgccaagggcgagtggtgcggcgtggagctggacgagcccctgggcaagaacgacggcgccgtggccggcaccagatacttccagtgccagcccaagtacggcctgttcgcccccgtgcacaaggtgaccaagatcggcttccccagcaccacccccgccaaggccaaggccaacgccgtgagaagagtgatggccaccaccagcgccagcctgaagagaagccccagcgccagcagcctgagcagcatgagcagcgtggccagcagcgtgagcagcagacccagcagaaccggcctgctgaccgagaccagcagcagatacgccagaaagatcagcggcaccaccgccctgcaggaggccctgaaggagaagcagcagcacatcgagcagctgctggccgagagagacctggagagagccgaggtggccaaggccaccagccacgtgggcgagatcgagcaggagctggccctggccagagacggccacgaccagcacgtgctggagctggaggccaagatggaccagctgagaaccatggtggaggccgccgacagagagaaggtggagctgctgaaccagctggaggaggagaagagaaaggtggaggacctgcagttcagagtggaggaggagagcatcaccaagggcgacctggagacccagaccaagctggagcacgccagaatcaaggagctggagcagagcctgctgttcgagaagaccaaggccgacaagctgcagagagagctggaggacaccagagtggccaccgtgagcgagaagagcagaatcatggagctggagaaggacctggccctgagagtgcaggaggtggccgagctgagaagaagactggagagcaacaagcccgccggcgacgtggacatgagcctgagcctgctgcaggagatcagcagcctgcaggagaagctggaggtgaccagaaccgaccaccagagagagatcaccagcctgaaggagcacttcggcgccagagaggagacccaccagaaggagatcaaggccctgtacaccgccaccgagaagctgagcaaggagaacgagagcctgaagagcaagctggagcacgccaacaaggagaacagcgacgtgatcgccctgtggaagagcaagctggagaccgccatcgccagccaccagcaggccatggaggagctgaaggtgagcttcagcaagggcctgggcaccgagaccgccgagttcgccgagctgaagacccagatcgagaagatgagactggactaccagcacgagatcgagaacctgcagaaccagcaggacagcgagagagccgcccacgccaaggagatggaggccctgagagccaagctgatgaaggtgatcaaggagaaggagaacagcctggaggccatcagaagcaagctggacaaggccgaggaccagcacctggtggagatggaggacaccctgaacaagctgcaggaggccgagatcaaggtgaaggagctggaggtgctgcaggccaagtgcaacgagcagaccaaggtgatcgacaacttcaccagccagctgaaggccaccgaggagaagctgctggacctggacgccctgagaaaggccagcagcgagggcaagagcgagatgaagaagctgagacagcagctggaggccgccgagaagcagatcaagcacctggagatcgagaagaacgccgagagcagcaaggccagcagcatcaccagagagctgcagggcagagagctgaagctgaccaacctgcaggagaacctgagcgaggtgagccaggtgaaggagaccctggagaaggagctgcagatcctgaaggagaagttcgccgaggccagcgaggaggccgtgagcgtgcagagaagcatgcaggagaccgtgaacaagctgcaccagaaggaggagcagttcaacatgctgagcagcgacctggagaagctgagagagaacctggccgacatggaggccaagttcagagagaaggacgagagagaggagcagctgatcaaggccaaggagaagctggagaacgacatcgccgagatcatgaagatgagcggcgacaacagcagccagctgaccaagatgaacgacgagctgagactgaaggagagagacgtggaggagctgcagctgaagctgaccaaggccaacgagaacgccagcttcctgcagaagagcatcgaggacatgaccgtgaaggccgagcagagccagcaggaggccgccaagaagcacgaggaggagaagaaggagctggagagaaagctgagcgacctggagaagaagatggagaccagccacaaccagtgccaggagctgaaggccagatacgagagagccaccagcgagaccaagaccaagcacgaggagatcctgcagaacctgcagaagaccctgctggacaccgaggacaagctgaagggcgccagagaggagaacagcggcctgctgcaggagctggaggagctgagaaagcaggccgacaaggccaaggccgcccagaccgccgaggacgccatgcagatcatggagcagatgaccaaggagaagaccgagaccctggccagcctggaggacaccaagcagaccaacgccaagctgcagaacgagctggacaccctgaaggagaacaacctgaagaacgtggaggagctgaacaagagcaaggagctgctgaccgtggagaaccagaagatggaggagttcagaaaggagatcgagaccctgaagcaggccgccgcccagaagagccagcagctgagcgccctgcaggaggagaacgtgaagctggccgaggagctgggcagaagcagagacgaggtgaccagccaccagaagctggaggaggagagaagcgtgctgaacaaccagctgctggagatgaagaagagagagagcaagttcatcaaggacgccgacgaggagaaggccagcctgcagaagagcatcagcatcaccagcgccctgctgaccgagaaggacgccgagctggagaagctgagaaacgaggtgaccgtgctgagaggcgagaacgccagcgccaagagcctgcacagcgtggtgcagaccctggagagcgacaaggtgaagctggagctgaaggtgaagaacctggagctgcagctgaaggagaacaagagacagctgagcagcagcagcggcaacaccgacacccaggccgacgaggacgagagagcccaggagagccagatcgacttcctgaacagcgtgatcgtggacctgcagagaaagaaccaggacctgaagatgaaggtggagatgatgagcgaggccgccctgaacggcaacggcgacgacctgaacaactacgacagcgacgaccaggagaagcagagcaagaagaagcccagactgttctgcgacatctgcgactgcttcgacctgcacgacaccgaggactgccccacccaggcccagatgagcgaggaccccccccacagcacccaccacggcagcagaggcgaggagagaccctactgcgagatctgcgagatgttcggccactgggccaccaactgcaacgacgacgagaccttctag

SEQ ID NO: 9741 - DNA, 975 bp, Artificial Sequence
  Description of Artificial Sequence: Synthetic coding sequence
atggccagcagcaacaccgtgctgatgagactggtggccagcgcctacagcatcgcccagaaggccggcatgatcgtgagaagagtgatcgccgagggcgacctgggcatcgtggagaagacctgcgccaccgacctgcagaccaaggccgacagactggcccagatgagcatctgcagcagcctggccagaaagttccccaagctgaccatcatcggcgaggaggacctgcccagcgaggaggtggaccaggagctgatcgaggacagccagtgggaggagatcctgaagcagccctgccccagccagtacagcgccatcaaggaggaggacctggtggtgtgggtggaccccctggacggcaccaaggagtacaccgagggcctgctggacaacgtgaccgtgctgatcggcatcgcctacgagggcaaggccatcgccggcgtgatcaaccagccctactacaactacgaggccggccccgacgccgtgctgggcagaaccatctggggcgtgctgggcctgggcgccttcggcttccagctgaaggaggtgcccgccggcaagcacatcatcaccaccaccagaagccacagcaacaagctggtgaccgactgcgtggccgccatgaaccccgacgccgtgctgagagtgggcggcgccggcaacaagatcatccagctgatcgagggcaaggccagcgcctacgtgttcgccagccccggctgcaagaagtgggacacctgcgcccccgaggtgatcctgcacgccgtgggcggcaagctgaccgacatccacggcaacgtgctgcagtaccacaagggcgtgagccacagaacctggcccaagcccgacttcttcagagcccagttcttcctggagagccacagctgcttcagcaacttcaagaacgtgagcacccccatcaagaacatctacgacgtgatcatctacgcctacgagaccgacctgtag

SEQ ID NO: 9742 - DNA, 270 bp, Artificial Sequence
  Description of Artificial Sequence: Synthetic coding sequence
atgggcaccaagagagaggccatcctgaaggtgctggagaacctgacccccgaggagctgaagaagttcaagatgaagctgggcaccgtgcccctgagagagggcttcgagagaatccccagaggcgccctgggccagctggacatcgtggacctgaccgacaagctggtggccagctactacgaggactacgccgccgagctggtggtggccgtgctgagagacatgagaatgctggaggaggccgccagactgcagagagccgcctag

SEQ ID NO: 9743 - DNA, 867 bp, Artificial Sequence
  Description of Artificial Sequence: Synthetic coding sequence
atgaccgtgggcaagagcagcaagatgctgcagcacatcgactacagaatgagatgcatcctgcaggacggcagaatcttcatcggcaccttcaaggccttcgacaagcacatgaacctgatcctgtgcgactgcgacgagttcagaaagatcaagcccaagaacagcaagcaggccgagagagaggagaagagagtgctgggcctggtgctgctgagaggcgagaacctggtgagcatgaccgtggagggccccccccccaaggacaccggcatcgccagagtgcccctggccggcgccgccggcggccccggcatcggcagagccgccggcagaggcatccccgccggcgtgcccatgccccaggcccccgccggcctggccggccccgtgagaggcgtgggcggccccagccagcaggtgatgaccccccagggcagaggcaccgtggccgccgccgccgccgccgccaccgccagcatcgccggcgcccccacccagtacccccccggcagaggcggcccccccccccccatgggcagaggcgcccccccccccggcatgatgggccccccccccggcatgagaccccccatgggcccccccatgggcatcccccccggcagaggcacccccatgggcatgcccccccccggcatgagaccccccccccccggctgcgaggccttcttcgacccctggccccagagcatggaggtggccccccagagaagaggcctggacagcagcggccccagataccacagacccgtgtgcttcctgtgctgctgcagctggagcctgatgggcctgagcggcttcctgaccggcccccccccccccggcatgagaccccccagaccctag

SEQ ID NO: 9744 - DNA, 3300 bp, Artificial Sequence
  Description of Artificial Sequence: Synthetic coding sequence
atgcacatcaagagcatcatcctggagggcttcaagagctacgcccagagaaccgaggtgaacggcttcgaccccctgttcaacgccatcaccggcctgaacggcagcggcaagagcaacatcctggacagcatctgcttcctgctgggcatcagcaacctgagccaggtgagagccagcaacctgcaggacctggtgtacaagaacggccaggccggcatcaccaaggccagcgtgagcatcaccttcgacaacagcgacaagaagcagagccccctgggcttcgaggtgcacgacgagatcaccgtgaccagacaggtggtgatcggcggcagaaacaagtacctgatcaacggcgtgaacgccaacaacaccagagtgcaggacctgttctgcagcgtgggcctgaacgtgaacaacccccacttcctgatcatgcagggcagaatcaccaaggtgctgaacatgaagccccccgagatcctgagcatgatcgaggaggccgccggcaccagaatgtacgagtacaagaagatcgccgcccagaagaccatcgagaagaaggaggccaagctgaaggagatcaagaccatcctggaggaggagatcacccccaccatccagaagctgaaggaggagagaagcagctacctggagtaccagaaggtgatgagagagatcgagcacctgagcagactgtacatcgcctaccagttcctgctggccgaggacaccaaggtgagaagcgccgaggagctgaaggagatgcaggacaaggtgatcaagctgcaggaggagctgagcgagaacgacaagaagatcaaggccctgaaccacgagatcgaggagctggagaagagaaaggacaaggagaccggcggcatcctgagaagcctggaggacgccctggccgaggcccagagagtgaacaccaagagccagagcgccttcgacctgaagaagaagaacctggcctgcgaggagagcaagagaaaggagctggagaagaacatggtggaggacagcaagaccctggccgccaaggagaaggaggtgaagaagatcaccgacggcctgcacgccctgcaggaggccagcaacaaggacgccgaggccctggccgccgcccagcagcacttcaacgccgtgagcgccggcctgagcagcaacgaggacggcgccgaggccaccctggccggccagatgatggcctgcaagaacgacatcagcaaggcccagaccgaggccaagcaggcccagatgaagctgaagcacgcccagcaggagctgaagaacaagcaggccgaggtgaagaagatggacagcggctacagaaaggaccaggaggccctggaggccgtgaagagactgaaggagaagctggaggccgagatgaagaagctgaactacgaggagaacaaggaggagagcctgctggagaagagaagacagctgagcagagacatcggcagactgaaggagacctacgaggccctgctggccagattccccaacctgagattcgcctacaaggaccccgagaagaactggaacagaaactgcgtgaagggcctggtggccagcctgatcagcgtgaaggacaccagcgccaccaccgccctggagctggtggccggcgagagactgtacaacgtggtggtggacaccgaggtgaccggcaagaagctgctggagagaggcgagctgaagagaagatacaccatcatccccctgaacaagatcagcgccagatgcatcgcccccgagaccctgagagtggcccagaacctggtgggccccgacaacgtgcacgtggccctgagcctggtggagtacaagcccgagctgcagaaggccatggagttcgtgttcggcaccaccttcgtgtgcgacaacatggacaacgccaagaaggtggccttcgacaagagaatcatgaccagaaccgtgaccctgggcggcgacgtgttcgacccccacggcaccctgagcggcggcgccagaagccaggccgccagcatcctgaccaagttccaggagctgaaggacgtgcaggacgagctgagaatcaaggagaacgagctgagagccctggaggaggagctggccggcctgaagaacaccgccgagaagtacagacagctgaagcagcagtgggagatgaagaccgaggaggccgacctgctgcagaccaagctgcagcagagcagctaccacaagcagcaggaggagctggacgccctgaagaagaccatcgaggagagcgaggagaccctgaagaacaccaaggagatccagagaaaggccgaggagaagtacgaggtgctggagaacaagatgaagaacgccgaggccgagagagagagagagctgaaggacgcccagaagaagctggactgcgccaagaccaaggccgacgccagcagcaagaagatgaaggagaagcagcaggaggtggaggccatcaccctggagctggaggagctgaagagagagcacaccagctacaagcagcagctggaggccgtgaacgaggccatcaagagctacgagagccagatcgaggtgatggccgccgaggtggccaagaacaaggagagcgtgaacaaggcccaggaggaggtgaccaagcagaaggaggtgatcaccgcccaggacaccgtgatcaaggccaagtacgccgaggtggccaagcacaaggagcagaacaacgacagccagctgaagatcaaggagctggaccacaacatcagcaagcacaagagagaggccgaggacggcgccgccaaggtgagcaagatgctgaaggactacgactggatcaacgccgagagacacctgttcggccagcccaacagcgcctacgacttcaagaccaacaaccccaaggaggccggccagagactgcagaagctgcaggagatgaaggagaagctgggcagaaacgtgaacatgagagccatgaacgtgctgaccgaggccgaggagagatacaacgacctgatgaagaagaagagaatcgtggagaacgacaagagcaagatcctgaccaccatcgaggacctggaccagaagaagaaccaggccctgaacatcgcctggcagaaggtgaacaaggacttcggcagcatcttcagcaccctgctgcccggcgccaacgccatgctggccccccccgagggccagaccgtgctggacggcctggagttcaaggtggccctgggcaacacctggaaggagaacctgaccgagctgagcggcggccagagacagaagcagcagaaccacaccaccggctag

SEQ ID NO: 9745 - DNA, 381 bp, Artificial Sequence
  Description of Artificial Sequence: Synthetic coding sequence
atgttccagaaggacgagtactgcatcctgatcctgggcctggacaacgccggcaagaccaccttcctggagcagagcaagaccagattcaacaagaactacaagggcatgagcctgagcaagatcaccaccaccgtgggcctgaacatcggcaccgtggacgtgggcaaggccagactgatgttctgggacctgggcggccaggaggagctgcagagcctgtgggacaaggacaagaccaagtgcggcgacctgggcaccctgcacagcagcaaggtgagcgccagcttcagactgagagacctggccgccgaccaccacagaacccagaagtggcagagacccgacgtgggcaccgccggctggctgcccctgccctag

SEQ ID NO: 9746 - DNA, 1119 bp, Artificial Sequence
  Description of Artificial Sequence: Synthetic coding sequence
atgaccttccagttcaacttcaccatcgaggaccacctggagaacgagctgacccccatcagagacggcgccctgaccctggacagcagcaaggagctgagcgtgagcgagagccagaagggcgaggagagagacagaaagtgcagcgccgagcagttcgacctgccccaggaccacctgtgggagcacaagagcatggagaacgccgcccccagccaggacaccgacagccccctgagcgccgccagcagcagcagaaacctggagccccacggcaagcagcccagcctgagagccgccaaggagcacgccatgcccaaggacctgaagaagatgctggagaacaaggtgatcgagaccctgcccggcttccagcacgtgaagctgagcgtggtgaagaccatcctgctgaaggagaacttccccggcgagaacatcgtgagcaagagcttcagcagccacagcgacctgatcaccggcgtgtacgagggcggcctgaagatctgggagtgcaccttcgacctgctggcctacttcaccaaggccaaggtgaagttcgccggcaagaaggtgctggacctgggctgcggcagcggcctgctgggcatcaccgccttcaagggcggcagcaaggagatccacttccaggactacaacagcatggtgatcgacgaggtgaccctgcccaacgtggtggccaacagcaccctggaggacgaggagaacgacgtgaacgagcccgacgtgaagagatgcagaaagcccaaggtgacccagctgtacaagtgcagattcttcagcggcgagtggagcgagttctgcaagctggtgctgagcagcgagaagctgttcgtgaagtacgacctgatcctgaccagcgagaccatctacaaccccgactactacagcaacctgcaccagaccttcctgagactgctgagcaagaacggcagagtgctgctggccagcaaggcccactacttcggcgtgggcggcggcgtgcacctgttccagaagttcgtggaggagagagacgtgttcaagaccagaatcctgaagatcatcgacgagggcctgaagagattcatcatcgagatcaccttcaagttccccggctag

SEQ ID NO: 9747 - DNA, 1635 bp, Artificial Sequence
  Description of Artificial Sequence: Synthetic coding sequence
atgaagtgccactacgaggccctgggcgtgagaagagacgccagcgaggaggagctgaagaaggcctacagaaagctggccctgaagtggcaccccgacaagaacctggacaacgccgccgaggccgccgagcagttcaagctgatccaggccgcctacgacgtgctgagcgacccccaggagagagcctggtacgacaaccacagagaggccctgctgaagggcggcttcgacggcgagtaccaggacgacagcctggacctgctgagatacttcaccgtgacctgctacagcggctacggcgacgacgagaagggcttctacaccgtgtacagaaacgtgttcgagatgatcgccaaggaggagctggagagcgtgctggaggaggaggtggacgacttccccaccttcggcgacagccagagcgactacgacaccgtggtgcaccccttctacgcctactggcagagcttctgcacccagaagaacttcgcctggaaggaggagtacgacaccagacaggccagcaacagatgggagaagagagccatggagaaggagaacaagaagatcagagacaaggccagaaaggagaagaacgagctggtgagacagctggtggccttcatcagaaagagagacaagagagtgcaggcccacagaaagctggtggaggagcagaacgccgagaaggccagaaaggccgaggagatgagaagacagcagaagctgaagcaggccaagctggtggagcagtacagagagcagagctggatgaccatggccaacctggagaaggagctgcaggagatggaggccagatacgagaaggagttcggcgacggcagcgacgagaacgagatggaggagcacgagctgaaggacgaggaggacggcaaggacagcgacgaggccgaggacgccgagctgtacgacgacctgtactgccccgcctgcgacaagagcttcaagaccgagaaggccatgaagaaccacgagaagagcaagaagcacagagagatggtggccctgctgaagcagcagctggaggaggaggaggagaacttcagcagaccccagatcgacgagaaccccctggacgacaacagcgaggaggagatggaggacgcccccaagcagaaggtgaagtacctgaccttcagattcatcttcgccctgagactgagcaagaagcagaagaagaagaagcagaagcccgcccagaactacgacgacaacttcaacgtgaacggccccggcgagggcgtgaaggtggaccccgaggacaccaacctgaaccaggacagcgccaaggagctggaggacagcccccaggagaacgtgagcgtgaccgagatcatcaagccctgcgacgaccccaagagcgaggccaagagcgtgcccaagcccaagggcaagaagaccaaggacatgaagaagcccgtgagagtgcccgccgagccccagaccatgagcgtgctgatcagctgcaccacctgccacagcgagttccccagcagaaacaagctgttcgaccacctgaaggccaccggccacgccagagcccccagcagcagcagcctgaacagcgccaccagcagccagagcaagaaggagaagagaaagaacagatag

SEQ ID NO: 9748 - DNA, 945 bp, Artificial Sequence
  Description of Artificial Sequence: Synthetic coding sequence
atgcccggcttcacctgctgcgtgcccggctgctacaacaacagccacagagacaaggccctgcacttctacaccttccccaaggacgccgagctgagaagactgtggctgaagaacgtgagcagagccggcgtgagcggctgcttcagcaccttccagcccaccaccggccacagactgtgcagcgtgcacttccagggcggcagaaagacctacaccgtgagagtgcccaccatcttccccctgagaggcgtgaacgagagaaaggtggccagaagacccgccggcgccgccgccgccagaagaagacagcagcagcagcagcagcagcagcagcagcagcagcagcagcagcagcagcagcagcagcagcagcagcagcagcagcagcagcagagcagccccagcgccagcaccgcccagaccgcccagctgcagcccaacctggtgagcgccagcgccgccgtgctgctgaccctgcaggccaccgtggacagcagccaggcccccggcagcgtgcagcccgcccccatcacccccaccggcgaggacgtgaagcccatcgacctgaccgtgcaggtggagttcgccgccgccgagggcgccgccgccgccgccgccgccagcgagctgcaggccgccaccgccggcctggaggccgccgagtgccccatgggcccccagctggtggtggtgggcgaggagggcttccccgacaccggcagcgaccacagctacagcctgagcagcggcaccaccgaggaggagctgctgagaaagctgaacgagcagagagacatcctggccctgatggaggtgaagatgaaggagatgaagggcagcatcagacacctgagactgaccgaggccaagctgagagaggagctgagagagaaggacagactgctggccatggccgtgatcagaaagaagcacggcatgtag

SEQ ID NO: 9749 - DNA, 645 bp, Artificial Sequence
  Description of Artificial Sequence: Synthetic coding sequence
atggccggcgagaacttcgccacccccttccacggccacgtgggcagaggcgccttcagcgacgtgtacgagcccgccgaggacaccttcctgctgctgaacgccctggaggccgccgccgccgagctggccggcgtggagatctgcctggaggtgggcagcggcagcggcgtggtgagcgccttcctggccagcatgatcggcccccaggccctgtacatgtgcaccgacatcaaccccgaggccgccgcctgcaccctggagaccgccagatgcaacaaggtgcacatccagcccgtgatcaccgacctggtgaagggcctgctgcccagactgaccgagaaggtggacctgctggtgttcaaccccccctacgtggtgacccccccccaggaggtgggcagccacggcatcgaggccgcctgggccggcggcaagaacggcagagaggtgatggacagattcttccccctggtgcccgacctgctgagccccaagggcctgttctacctggtgaccatcaaggagaacaaccccgaggagatcctgaagatcatgaagaccaagggcctgcagggcaccaccgccctgagcagacaggccggccaggagaccctgagcgtgctgaagttcaccaagagctag

SEQ ID NO: 9750 - DNA, 1536 bp, Artificial Sequence
  Description of Artificial Sequence: Synthetic coding sequence
atgagcggcggcttcgagctgcagcccagagacggcggccccagagtggccctggcccccggcgagaccgtgatcggcagaggccccctgctgggcatcaccgacaagagagtgagcagaagacacgccatcctggaggtggccggcggccagctgagaatcaagcccatccacaccaacccctgcttctaccagagcagcgagaagagccagctgctgcccctgaagcccaacctgtggtgctacctgaaccccggcgacagcttcagcctgctggtggacaagtacatcttcagaatcctgagcatccccagcgaggtggagatgcagtgcaccctgagaaacagccaggtgctggacgaggacaacatcctgaacgagacccccaagagccccgtgatcaacctgccccacgagaccaccggcgccagccagctggagggcagcaccgagatcgccaagacccagatgacccccaccaacagcgtgagcttcctgggcgagaacagagactgcaacaagcagcagcccatcctggccgagagaaagagaatcctgcccacctggatgctggccgagcacctgagcgaccagaacctgagcgtgcccgccatcagcggcggcaacgtgatccagggcagcggcaaggaggagatctgcaaggacaagagccagctgaacaccacccagcagggcagaagacagctgatcagcagcggcagcagcgagaacaccagcgccgagcaggacaccggcgaggagtgcaagaacaccgaccaggaggagagcaccatcagcagcaaggagatgccccagagcttcagcgccatcaccctgagcaacaccgagatgaacaacatcaagaccaacgcccagagaaacaagctgcccatcgaggagctgggcaaggtgagcaagcacaagatcgccaccaagagaaccccccacaaggaggacgaggccatgagctgcagcgagaactgcagcagcgcccagggcgacagcctgcaggacgagagccagggcagccacagcgagagcagcagcaaccccagcaaccccgagaccctgcacgccaaggccaccgacagcgtgctgcagggcagcgagggcaacaaggtgaagagaaccagctgcatgtacggcgccaactgctacagaaagaaccccgtgcacttccagcacttcagccaccccggcgacagcgactacggcggcgtgcagatcgtgggccaggacgagaccgacgacagacccgagtgcccctacggccccagctgctacagaaagaacccccagcacaagatcgagtacagacacaacaccctgcccgtgagaaacgtgctggacgaggacaacgacaacgtgggccagcccaacgagtacgacctgaacgacagcttcctggacgacgaggaggaggactacgagcccaccgacgaggacagcgactgggagcccggcaaggaggacgaggagaaggaggacgtggaggagctgctgaaggaggccaagagattcatgaagagaaagtag

SEQ ID NO: 9751 - DNA, 984 bp, Artificial Sequence
  Description of Artificial Sequence: Synthetic coding sequence
atggccgccgccgccgccgccgccgccgccaccaacggcaccggcggcagcagcggcatggaggtggacgccgccgtggtgcccagcgtgatggcctgcggcgtgaccggcagcgtgagcgtggccctgcaccccctggtgatcctgaacatcagcgaccactggatcagaatgagaagccaggagggcagacccgtgcaggtgatcggcgccctgatcggcaagcaggagggcagaaacatcgaggtgatgaacagcttcgagctgctgagccacaccgtggaggagaagatcatcatcgacaaggagtactactacaccaaggaggagcagttcaagcaggtgttcaaggagctggagttcctgggctggtacaccaccggcggcccccccgaccccagcgacatccacgtgcacaagcaggtgtgcgagatcatcgagagccccctgttcctgaagctgaaccccatgaccaagcacaccgacctgcccgtgagcgtgttcgagagcgtgatcgacatcatcaacggcgaggccaccatgctgttcgccgagctgacctacaccctggccaccgaggaggccgagagaatcggcgtggaccacgtggccagaatgaccgccaccggcagcggcgagaacagcaccgtggccgagcacctgatcgcccagcacagcgccatcaagatgctgcacagcagagtgaagctgatcctggagtacgtgaaggccagcgaggccggcgaggtgcccttcaaccacgagatcctgagagaggcctacgccctgtgccactgcctgcccgtgctgagcaccgacaagttcaagaccgacttctacgaccagtgcaacgacgtgggcctgatggcctacctgggcaccatcaccaagacctgcaacaccatgaaccagttcgtgaacaagttcaacgtgctgtacgacagacagggcatcggcagaagaatgagaggcctgttcttctag

SEQ ID NO: 9752 - DNA, 2574 bp, Artificial Sequence
  Description of Artificial Sequence: Synthetic coding sequence
atgaactaccagcagcagctggccaacagcgccgccatcagagccgagatccagagattcgagagcgtgcaccccaacatctacagcatctacgagctgctggagagagtggaggagcccgtgctgcagaaccagatcagagagcacgtgatcgccatcgaggacgccttcgtgaacagccaggagtggaccctgagcagaagcgtgcccgagctgaaggtgggcatcgtgggcaacctggccagcggcaagagcgccctggtgcacagatacctgaccggcacctacgtgcaggaggagagccccgagggcggcagattcaagaaggagatcgtggtggacggccagagctacctgctgctgatcagagacgagggcggcccccccgaggcccagttcgccatgtgggtggacgccgtgatcttcgtgttcagcctggaggacgagatcagcttccagaccgtgtaccactactacagcagaatggccaactacagaaacaccagcgagatccccctggtgctggtgggcacccaggacgccatcagcagcgccaaccccagagtgatcgacgacgccagagccagaaagctgagcaacgacctgaagagatgcacctactacgagacctgcgccacctacggcctgaacgtggagagagtgttccaggacgtggcccagaagatcgtggccaccagaaagaagcagcagctgagcatcggcccctgcaagagcctgcccaacagccccagccacagcagcgtgtgcagcgcccaggtgagcgccgtgcacatcagccagaccagcaacggcggcggcagcctgagcgactacagcagcagcgtgcccagcacccccagcaccagccagaaggagctgagaatcgacgtgccccccaccgccaacacccccacccccgtgagaaagcagagcaagagaagaagcaacctgttcaccagcagaaagggcagcgaccccgacaaggagaagaagggcctggagagcagagccgacagcatcggcagcggcagagccatccccatcaagcagggcatgctgctgaagagaagcggcaagagcctgaacaaggagtggaagaagaagtacgtgaccctgtgcgacaacggcgtgctgacctaccaccccagcctgcacgactacatgcagaacgtgcacggcaaggagatcgacctgctgagaaccaccgtgaaggtgcccggcaagagaccccccagagccaccagcgcctgcgcccccatcagcagccccaagaccaacggcctgagcaaggacatgagcagcctgcacatcagccccaacagcggcaacgtgaccagcgccagcggcagccagatggccagcggcatcagcctggtgagcttcaacagcagacccgacggcatgcaccagagaagctacagcgtgagcagcgccgaccagtggagcgaggccaccgtgatcgccaacagcgccatcagcagcgacaccggcctgggcgacagcgtgtgcagcagccccagcatcagcagcaccaccagccccaagctggaccccccccccagcccccacgccaacagaaagaagcacagaagaaagaagagcaccagcaacttcaaggccgacggcctgagcggcaccgccgaggagcaggaggagaacttcgagttcatcatcgtgagcctgaccggccagacctggcacttcgaggccaccacctacgaggagagagacgcctgggtgcaggccatcgagagccagatcctggccagcctgcagagctgcgagagcagcaagaacaagagcagactgaccagccagagcgaggccatggccctgcagagcatcagaaacatgagaggcaacagccactgcgtggactgcgagacccagaaccccaactgggccagcctgaacctgggcgccctgatgtgcatcgagtgcagcggcatccacagaaacctgggcacccacctgagcagagtgagaagcctggacctggacgactggcccgtggagctgatcaaggtgatgagcagcatcggcaacgagctggccaacagcgtgtgggaggagagcagccagggcagaaccaagcccagcgtggacagcaccagagaggagaaggagagatggatcagagccaagtacgagcagaagctgttcctggcccccctgccctgcaccgagctgagcctgggccagcacctgctgagagccaccgccgacgaggacctgagaaccgccatcctgctgctggcccacggcagcagagacgaggtgaacgagacctgcggcgagggcgacggcagaaccgccctgcacctggcctgcagaaagggcaacgtggtgctggcccagctgctgatctggtacggcgtggacgtgaccgccagagacgcccacggcaacaccgccctggcctacgccagacaggccagcagccaggagtgcatcgacgtgctgctgcagtacggctgccccgacgagagattcgtgctgatggccacccccaacctgagcagaagaaacaacaacagaaacaacagcagcggcagagtgcccaccatcatctag

SEQ ID NO: 9753 - DNA, 1653 bp, Artificial Sequence
  Description of Artificial Sequence: Synthetic coding sequence
atgagccagaccagcctgaagcagaagaagaacgagcccggcatgagaagcagcaaggagagcctggaggccgagaagagaaaggagagcgacaagaccggcgtgagactgagcaaccagggcagccaggagagcagcctgagaaagaccgacagcagaggctacctggtgagaagccagtggagcagaatcagcagaagccccagcaccaaggcccccagcatcgacgagcccagaagcagaaacaccagcgccaagctgcccagcagcagcaccagcagcagaacccccagcaccagccccagcctgcacgacagcagccccccccccctgagcggccagcccagcctgcagccccccgccagcccccagctgcccagaagcctggacagcagaccccccaccccccccgagcccgaccccggcagcagaagaagcaccaagatgcaggagaaccccgaggcctgggcccagggcatcgtgagagagatcagacagaccagagacagccagcccctggagtacagcagaaccagccccaccgagtggaagagcagcagccagagaagaggcatctaccccgccagcacccagctggacagaaacagcctgagcgagcagcagcagcagcagagagaggacgaggacgactacgaggccgcctactgggccagcatgagaagcttctacgagaagaaccccagctgcagcagaccctggccccccaagcccaagaacgccatcaccatcgccctgagcagctgcgccctgttcaacatggtggacggcagaaagatctacgagcaggagggcctggagaagtacatggagtaccagctgaccaacgagaacgtgatcctgacccccggccccgccttcagattcgtgaaggccctgcagtacgtgaacgccagactgagagacctgtaccccgacgagcaggacctgttcgacatcgtgctgatgaccaacaaccacgcccaggtgggcgtgagactgatcaacagcgtgaaccactacggcctgctgatcgacagattctgcctgaccggcggcaaggaccccatcggctacctgaaggcctacctgaccaacctgtacatcgccgccgacagcgagaaggtgcaggaggccatccaggagggcatcgccagcgccaccatgttcgacggcgccaaggacatggcctactgcgacacccagctgagagtggccttcgacggcgacgccgtgctgttcagcgacgagagcgagcacttcaccaaggagcacggcctggacaagttcttccagtacgacaccctgtgcgagagcaagcccctggcccagggccccctgaagggcttcctggaggacctgggcagactgcagaagaagttctacgccaagaacgagagactgctgtgccccatcagaacctacctggtgaccgccagaagcgccgccagcagcggcgccagagtgctgaagaccctgagaagatggggcctggagatcgacgaggccctgttcctggccggcgcccccaagagccccatcctggtgaagatcagaccccacatcttcttcgacgaccacatgttccacatcgagggcgcccagagactgggcagcatcgccgcctacggcttcaacaagaagttcagcagctag

SEQ ID NO: 9754 - DNA, 888 bp, Artificial Sequence; identical to SEQ ID NO: 9312
  Description of Artificial Sequence: Synthetic coding sequence

SEQ ID NO: 9755 - DNA, 549 bp, Artificial Sequence
  Description of Artificial Sequence: Synthetic coding sequence
atgagcggcagaagcgtgccccacgcccaccccgccaccgccgagtacgagttcgccaaccccagcagactgggcgagcagagattcggcgagggcctgctgcccgaggagatcctgacccccaccctgtaccacggctactacgtgagacccagagccgcccccgccggcgagggcagcagagccggcgccagcgagctgagactgagcgagggcaagttccaggccttcctggacgtgagccacttcacccccgacgaggtgaccgtgagaaccgtggacaacctgctggaggtgagcgccagacacccccagagactggacagacacggcttcgtgagcagagagttctgcagaacctacgtgctgcccgccgacgtggacccctggagagtgagagccgccctgagccacgacggcatcctgaacctggaggcccccagaggcggcagacacctggacaccgaggtgaacgaggtgtacatcagcctgctgcccgccccccccgaccccgaggaggaggaggaggccgccatcgtggagccctag

SEQ ID NO: 9756 - DNA, 636 bp, Artificial Sequence
  Description of Artificial Sequence: Synthetic coding sequence
atgagcaccgccgccgtgcccgagctgaagcagatcagcagagtggaggccatgagactgggccccggctggagccacagctgccacgccatgctgtacgccgccaaccccggccagctgttcggcagaatccccatgagattcagcgtgctgatgcagatgagattcgacggcctgctgggcttccccggcggcttcgtggacagaagattctggagcctggaggacggcctgaacagagtgctgggcctgggcctgggctgcctgagactgaccgaggccgactacctgagcagccacctgaccgagggcccccacagagtggtggcccacctgtacgccagacagctgaccctggagcagctgcacgccgtggagatcagcgccgtgcacagcagagaccacggcctggaggtgctgggcctggtgagagtgcccctgtacacccagaaggacagagtgggcggcttccccaacttcctgagcaacgccttcgtgagcaccgccaagtgccagctgctgttcgccctgaaggtgctgaacatgatgcccgaggagaagctggtggaggccctggccgccgccaccgagaagcagaagaaggccctggagaagctgctgcccgccagcagctag

SEQ ID NO: 9757 - DNA, 2622 bp, Artificial Sequence
  Description of Artificial Sequence: Synthetic coding sequence
atgcacccccccccccccgccgccgccatggacttcagccagaacagcctgttcggctacatggaggacctgcaggagctgaccatcatcgagagacccgtgagaagaagcctgaagacccccgaggagatcgagagactgaccgtggacgaggacctgagcgacatcgagagagccgtgtacctgctgagcgccggccaggacgtgcagggcaccagcgtgatcgccaacctgcccttcctgatgagacagaaccccaccgagaccctgagaagagtgctgcccaaggtgagagaggccctgcacgtggccggcgtggagatgcagctgaccgccgccatgagcttcctgaccatcctgcaggacgagagcgtgagcatccacgcctacacccacagcttcctgcaggtgatcctgctgcacctggagcacagagacaccggcgtgagcaacgcctggctggagaccctgctgagcgtgatcgaggtgctgcccaaggagaccctgagacacgagatcctgaaccccctggtgagcaaggcccagctgagccagaccgtgcagagcagactggtgagctgcaagatcctgggcaagctgaccaacaagttcgacgcccacaccatcaagagagagatcctgcccctggtgaagagcctgtgccaggacgtggagtacgaggtgagaagctgcatgtgcagacagctggagaacatcgcccagggcatcggcaccgagctgaccaagagcgtggtgctgcccgagctgatcgagctgagcagagacgagggcagcagcgtgagactggccgccttcgagaccctggtgaacctgctggacatcttcgacaccgacgacagaagccagaccatcctgcccctggtgaagagcttctgcgagaagagcttcaaggccgacgagagcatcctgatcagcctgagcttccacctgggcaagctgtgccacggcctgtacggcatcttcacccccgaccagcacctgagattcctggagttctacaagaagctgtgcaccctgggcctgcagcaggagaacggccacaacgagaaccagatccccccccagatcctggagcaggagaagaagtacatcagcgtgagaaagaactgcgcctacaacttccccgccatgatcgtgttcgtggaccccaagaacttccacatggagctgtacagcaccttcttctgcctgtgccacgaccccgaggtgcccgtgagatacaccatcgccatctgcttctacgaggtgagcaagctgctgaacagcggcgtgtacctgatccacaaggagctgatcaccctgctgcaggacgagagcctggaggtgctggacgccctgatcgaccacctgcccgagatcctggagctgatgagcaccggcggcgagagcagcgtgcaggagaacaagctgagcagcctgcccgacctgatccccgccctgaccgccgccgagcagagagccgccgccagcctgaagtggagaacccacgagaagctgctgcagaagtacgcctgcctgccccacgtgatcagcagcgaccagatctactacagattcctgcagagaatgttcaccatcatgatgaccaacaacgtgctgcccgtgcagaaggccgccagcagaaccctgtgcatcttcctgagatacaacagaaagcaggagcagagacacgaggtgatccagaagctgatcgagcagctgggccagggcaagagctactggaacagactgagattcctggacacctgcgagttcatcatcgagatcttcagcaagagcttcttctgcaagtacttcttcctgcccgccatcgagctgacccacgaccccgtggccaacgtgagaatgaagctgtgctacctgctgcccaaggtgaagagcaccctgaagatccccgccgacaagcacctgctgcagcagctggagatgtgcgtgagaaagctgctgtgccaggagaaggacaaggacgtgctggccatcgtgaagagaaccgtgctggagctggacagaatggagatgagcatggacgccttccagaagaagttctacgagaaggacctgctggaccaggagaaggagagagaggagctgctgctgctggagatggagcagctggagaaggagaagcagcagaacgacggcagacccatgagcgacaagatgttcgagaagaagagaagagacaccaagacccccacccagagcctgcccaagaacatccccatcagcgtgcccggccccagcagcgtgacccccagcaccagcaaggagatcaagaagagcaagctgatcagaagccagagcttcaacaaccaggccttccacgccaagtacggcaacctggagaagtgcgccagcaagagcagcaccaccggctacaccaccagcgtgagcggcctgggcaagaccagcgtgctgagcctggccgacgacagcttcagaaccagaaacgccagcagcgtgcccagcagcttcagccccaacacccccctgcccagcaccagcagaggcaccggcaacagcgtggaccccaagagcagcggcagcaaggacacccagcccagaaaggccaccctgaagagcagaaagagcaacccctag

SEQ ID NO: 9758 - DNA, 951 bp, Artificial Sequence
  Description of Artificial Sequence: Synthetic coding sequence
atgagacagcccctgagctggggcagatggagagccatgctggccagaacctacggccccggccccagcgccggctacagatgggccagcggcgcccagggctacgtgagaaacccccccgtgggcgcctgcgacctgcagggcgagctggacagattcggcggcatcagcgtgagactggccagactggacgccctggacagactggacgccgccgccttccagaagggcctgcaggccgccgtgcagcagtggagaagcgagggcagaaccgccgtgtggctgcacatccccatcctgcagagcagattcatcgcccccgccgccagcctgggcttctgcttccaccacgccgagagcgacagcagcaccctgaccctgtggctgagagagggccccagcagactgcccggctacgccagccaccaggtgggcgtggccggcgccgtgttcgacgagagcaccagaaagatcctggtggtgcaggacagaaacaagctgaagaacatgtggaagttccccggcggcctgagcgagcccgaggaggacatcggcgacaccgccgtgagagaggtgttcgaggagaccggcatcaagagcgagttcagaagcgtgctgagcatcagacagcagcacaccaaccccggcgccttcggcaagagcgacatgtacatcatctgcagactgaagccctacagcttcaccatcaacttctgccaggaggagtgcctgagatgcgagtggatggacctgaacgacctggccaagaccgagaacaccacccccatcaccagcagagtggccagactgctgctgtacggctacagagagggcttcgacaagatcgacctgaccgtggaggagctgcccgccgtgtacaccggcctgttctacaagctgtaccacaaggagctgcccgagaactacaagaccatgaagggcatcgactag

SEQ ID NO: 9759 - DNA, 537 bp, Artificial Sequence
  Description of Artificial Sequence: Synthetic coding sequence
atgggcgagacctggaagaacatctgcagcaccgtgagacacggctggtggctgagagaccacagaatggccggcctgcccatcccccccgagatcgtgaaggaggccgaggtgccccaggccgccctgggcgtgcccgcccagggcaccggcgacaacggccacacccccgtggaggaggaggtgggcggcatccccgtgcccgcccccggcctgctgcaggtgaccgagagaagacagcccctgagcagcgtgagcagcctggaggtgcacttcgacctgctggacctgaccgagctgaccgacatgagcgaccaggagctggccgaggtgttcgccgacagcgacgacgagaacctgaacaccgagagccccgccggcctgcaccccctgcccagagccggctacctgagaagccccagctggaccagaaccagagccgagcagagccacgagaagcagcccctgggcgaccccgagagacaggccaccgtgctggacaccttcctgaccgtggagagaccccaggaggactag

SEQ ID NO: 9760 - DNA, 741 bp, Artificial Sequence
  Description of Artificial Sequence: Synthetic coding sequence
atggccgagcaggagcagagaaagatccccctggtgcccgagaacctgctgaagaagagaaaggcctaccaggccctgaaggccacccaggccaagcaggccctgctggccaagaaggagcagaagaagggcaagggcctgagattcaagagactggagagcttcctgcacgacagctggagacagaagagagacaaggtgagactgagaagactggaggtgaagccccacgccctggagctgcccgacaagcacagcctggccttcgtggtgagaatcgagagaatcgacggcgtgagcctgctggtgcagagaaccatcgccagactgagactgaagaagatcttcagcggcgtgttcgtgaaggtgaccccccagaacctgaagatgctgagaatcgtggagccctacgtgacctggggcttccccaacctgaagagcgtgagagagctgatcctgaagagaggccaggccaaggtgaagaacaagaccatccccctgaccgacaacaccgtgatcgaggagcacctgggcaagttcggcgtgatctgcctggaggacctgatccacgagatcgccttccccggcaagcacttccaggagatcagctggttcctgtgccccttccacctgagcgtggccagacacgccaccaagaacagagtgggcttcctgaaggagatgggcacccccggctacagaggcgagagaatcaaccagctgatcagacagctgaactag

SEQ ID NO: 9761 - DNA, 2442 bp, Artificial Sequence
  Description of Artificial Sequence: Synthetic coding sequence
atggcctggccctgcatcaccagagcctgctgcatcgccagattctggaaccagctggacaaggccgacatcgccgtgcccctggtgttcaccaagtacagcgaggccaccgagcaccccggcgcccccccccagcccccccccccccagcagcaggcccagcccgccctggccccccccagcgccagagccgtggccatcgagacccagcccgcccagggcgagctggacgccgtggccagagccaccggccccgcccccggccccaccggcgagagagagcccgccgccggccccggcagaagcggccccggccccggcctgggcagcggcagcaccagcggccccgccgacagcgtgatgagacaggactacagagcctggaaggtgcagagacccgagcccagctgcagacccagaagcgagtaccagcccagcgacgcccccttcgagagagagacccagtaccagaaggacttcagagcctggcccctgcccagaagaggcgaccacccctggatccccaagcccgtgcagatcagcgccgccagccaggccagcgcccccatcctgggcgcccccaagagaagaccccagagccaggagagatggcccgtgcaggccgccgccgaggccagagagcaggaggccgcccccggcggcgccggcggcctggccgccggcaaggccagcggcgccgacgagagagacaccagaagaaaggccggccccgcctggatcgtgagaagagccgagggcctgggccacgagcagacccccctgcccgccgcccaggcccaggtgcaggccaccggccccgaggccggcagaggcagagccgccgccgacgccctgaacagacagatcagagaggaggtggccagcgccgtgagcagcagctacagaaacgagttcagagcctggaccgacatcaagcccgtgaagcccatcaaggccaagccccagtacaagccccccgacgacaagatggtgcacgagaccagctacagcgcccagttcaagggcgaggccagcaagcccaccaccgccgacaacaaggtgatcgacagaagaagaatcagaagcctgtacagcgagcccttcaaggagccccccaaggtggagaagcccagcgtgcagagcagcaagcccaagaagaccagcgccagccacaagcccaccagaaaggccaaggacaagcaggccgtgagcggccaggccgccaagaagaagagcgccgagggccccagcaccaccaagcccgacgacaaggagcagagcaaggagatgaacaacaagctggccgaggccaaggagagcctggcccagcccgtgagcgacagcagcaagacccagggccccgtggccaccgagcccgacaaggaccagggcagcgtggtgcccggcctgctgaagggccagggccccatggtgcaggagcccctgaagaagcagggcagcgtggtgcccggcccccccaaggacctgggccccatgatccccctgcccgtgaaggaccaggaccacaccgtgcccgagcccctgaagaacgagagccccgtgatcagcgcccccgtgaaggaccagggccccagcgtgcccgtgccccccaagaaccagagccccatggtgcccgccaaggtgaaggaccagggcagcgtggtgcccgagagcctgaaggaccagggccccagaatccccgagcccgtgaagaaccaggcccccatggtgcccgcccccgtgaaggacgagggccccatggtgagcgccagcgtgaaggaccagggccccatggtgagcgcccccgtgaaggaccagggccccatcgtgcccgcccccgtgaagggcgagggccccatcgtgcccgcccccgtgaaggacgagggccccatggtgagcgcccccatcaaggaccaggaccccatggtgcccgagcaccccaaggacgagagcgccatggccaccgcccccatcaagaaccagggcagcatggtgagcgagcccgtgaagaaccagggcctggtggtgagcggccccgtgaaggaccaggacgtggtggtgcccgagcacgccaaggtgcacgacagcgccgtggtggcccccgtgaagaaccagggccccgtggtgcccgagagcgtgaagaaccaggaccccatcctgcccgtgctggtgaaggaccagggccccaccgtgctgcagccccccaagaaccagggcagaatcgtgcccgagcccctgaagaaccaggtgcccatcgtgcccgtgcccctgaaggaccaggaccccctggtgcccgtgcccgccaaggaccagggccccgccgtgcccgagcccctgaagacccagggccccagagacccccagctgcccaccgtgagccccctgcccagagtgatgatccccaccgccccccacaccgagtacatcgagagcagcccctag

SEQ ID NO: 9762 - DNA, 261 bp, Artificial Sequence
  Description of Artificial Sequence: Synthetic coding sequence
atgccccagtaccagacctgggaggagttcagcagagccgccgagaagctgtacctggccgaccccatgaaggccagagtggtgctgaagtacagacacagcgacggcaacctgtgcgtgaaggtgaccgacgacctggtgtgcctggtgtacaagaccgaccaggcccaggacgtgaagaagatcgagaagttccacagccagctgatgagactgatggtggccaaggaggccagaaacgtgaccatggagaccgagtag

SEQ ID NO: 9763 - DNA, 1206 bp, Artificial Sequence
  Description of Artificial Sequence: Synthetic coding sequence
atggcccacgtgagcagcgagacccaggacgtgagccccaaggacgagctgaccgccagcgaggccagcaccagaagccccctgtgcgagcacaccttccccggcgacagcgacctgagaagcatgatcgaggagcacgccttccaggtgctgagccagggcagcctgctggagagccccagctacaccgtgtgcgtgagcgagcccgacaaggacgacgacttcctgagcctgaacttccccagaaagctgtggaagatcgtggagagcgaccagttcaagagcatcagctgggacgagaacggcacctgcatcgtgatcaacgaggagctgttcaagaaggagatcctggagaccaaggccccctacagaatcttccagaccgacgccatcaagagcttcgtgagacagctgaacctgtacggcttcagcaagatccagcagaacttccagagaagcgccttcctggccaccttcctgagcgaggagaaggagagcagcgtgctgagcaagctgaagttctactacaaccccaacttcaagagaggctacccccagctgctggtgagagtgaagagaagaatcggcgtgaagaacgccagccccatcagcaccctgttcaacgaggacttcaacaagaagcacttcagagccggcgccaacatggagaaccacaacagcgccctggccgccgaggccagcgaggagagcctgttcagcgccagcaagaacctgaacatgcccctgaccagagagagcagcgtgagacagatcatcgccaacagcagcgtgcccatcagaagcggcttccccccccccagccccagcaccagcgtgggccccagcgagcagatcgccaccgaccagcacgccatcctgaaccagctgaccaccatccacatgcacagccacagcacctacatgcaggccagaggccacatcgtgaacttcatcaccaccaccaccagccagtaccacatcatcagccccctgcagaacggctacttcggcctgaccgtggagcccagcgccgtgcccaccagataccccctggtgagcgtgaacgaggccccctacagaaacatgctgcccgccggcaacccctggctgcagatgcccaccatcgccgacagaagcgccgccccccacagcagactggccctgcagcccagccccctggacaagtaccaccccaactacaactag

SEQ ID NO: 9764 - DNA, 4302 bp, Artificial Sequence
  Description of Artificial Sequence: Synthetic coding sequence
atgtggagcctgaccgccagcgagggcgagagcaccaccgcccacttcttcctgggcgccggcgacgagggcctgggcaccagaggcatcggcatgagacccgaggagagcgacagcgagctgctggaggacgaggaggacgaggtgccccccgagccccagatcatcgtgggcatctgcgccatgaccaagaagagcaagagcaagcccatgacccagatcctggagagactgtgcagattcgactacctgaccgtggtgatcctgggcgaggacgtgatcctgaacgagcccgtggagaactggcccagctgccactgcctgatcagcttccacagcaagggcttccccctggacaaggccgtggcctacagcaagctgagaaaccccttcctgatcaacgacctggccatgcagtactacatccaggacagaagagaggtgtacagaatcctgcaggaggagggcatcgacctgcccagatacgccgtgctgaacagagaccccgccagacccgaggagtgcaacctgatcgagggcgaggaccaggtggaggtgaacggcgccgtgttccccaagcccttcgtggagaagcccgtgagcgccgaggaccacaacgtgtacatctactaccccagcagcgccggcggcggcagccagagactgttcagaaagatcggcagcagaagcagcgtgtacagccccgagagcagcgtgagaaagaccggcagctacatctacgaggagttcatgcccaccgacggcaccgacgtgaaggtgtacaccgtgggccccgactacgcccacgccgaggccagaaagagccccgccctggacggcaaggtggagagagacagcgagggcaaggagatcagataccccgtgatgctgaccgccatggagaagctggtggccagaaaggtgtgcgtggccttcaagcagaccgtgtgcggcttcgacctgctgagagccaacggccacagcttcgtgtgcgacgtgaacggcttcagcttcgtgaagaacagcatgaagtactacgacgactgcgccaagatcctgggcaacaccatcatgagagagctggccccccagttccagatcccctggagcatccccaccgaggccgaggacatccccatcgtgcccaccaccagcggcaccatgatggagctgagatgcgtgatcgccatcatcagacacggcgacagaacccccaagcagaagatgaagatggaggtgaagcaccccagattcttcgccctgttcgagaagcacggcggctacaagaccggcaagctgaagctgaagagacccgagcagctgcaggaggtgctggacatcaccagactgctgctggccgagctggagaaggagcccggcggcgagatcgaggagaagaccggcaagctggagcagctgaagagcgtgctggagatgtacggccacttcagcggcatcaacagaaaggtgcagctgacctactacccccacggcgtgaaggccagcaacgagggccaggacccccagagagagaccctggcccccagcctgctgctggtgctgaagtggggcggcgagctgacccccgccggcagagtgcaggccgaggagctgggcagagccttcagatgcatgtaccccggcggccagggcgactacgccggcttccccggctgcggcctgctgagactgcacagcaccttcagacacgacctgaagatctacgccagcgacgagggcagagtgcagatgaccgccgccgccttcgccaagggcctgctggccctggagggcgagctgacccccatcctggtgcagatggtgaagagcgccaacatgaacggcctgctggacagcgacggcgacagcctgagcagctgccagcacagagtgaaggccagactgcaccacatcctgcagcaggacgcccccttcggccccgaggactacgaccagctggcccccaccagaagcaccagcctgctgaacagcatgaccatcatccagaaccccgtgaaggtgtgcgaccaggtgttcgccctgatcgagaacctgacccaccagatcagagagagaatgcaggaccccagaagcgtggacctgcagctgtaccacagcgagaccctggagctgatgctgcagagatggagcaagctggagagagacttcagacagaagagcggcagatacgacatcagcaagatccccgacatctacgactgcgtgaagtacgacgtgcagcacaacggcagcctgggcctgcagggcaccgccgagctgctgagactgagcaaggccctggccgacgtggtgatcccccaggagtacggcatcagcagagaggagaagctggagatcgccgtgggcttctgcctgcccctgctgagaaagatcctgctggacctgcagagaacccacgaggacgagagcgtgaacaagctgcaccccctgtgctacctgagatacagcagaggcgtgctgagccccggcagacacgtgagaaccagactgtacttcaccagcgagagccacgtgcacagcctgctgagcgtgttcagatacggcggcctgctggacgagacccaggacgcccagtggcagagagccctggactacctgagcgccatcagcgagctgaactacatgacccagatcgtgatcatgctgtacgaggacaacacccaggaccccctgagcgaggagagattccacgtggagctgcacttcagccccggcgtgaagggcgtggaggaggagggcagcgcccccgccggctgcggcttcagacccgccagcagcgagaacgaggagatgaagaccaaccagggcagcatggagaacctgtgccccggcaaggccagcgacgagcccgacagagccctgcagaccagcccccagccccccgagggccccggcctgcccagaagaagccccctgatcagaaacagaaaggccggcagcatggaggtgctgagcgagaccagcagcagcagacccggcggctacagactgttcagcagcagcagaccccccaccgagatgaagcagagcggcctgggcagccagtgcaccggcctgttcagcaccaccgtgctgggcggcagcagcagcgcccccaacctgcaggactacgccagaagccacggcaagaagctgccccccgccagcctgaagcacagagacgagctgctgttcgtgcccgccgtgaagagattcagcgtgagcttcgccaagcaccccaccaacggcttcgagggctgcagcatggtgcccaccatctaccccctggagaccctgcacaacgccctgagcctgagacaggtgagcgagttcctgagcagagtgtgccagagacacaccgacgcccaggcccaggccagcgccgccctgttcgacagcatgcacagcagccaggccagcgacaaccccttcagcccccccagaaccctgcacagcccccccctgcagctgcagcagagaagcgagaagcccccctggtacagcagcggccccagcagcaccgtgagcagcgccggccccagcagccccaccaccgtggacggcaacagccagttcggcttcagcgaccagcccagcctgaacagccacgtggccgaggagcaccagggcctgggcctgctgcaggagacccccggcagcggcgcccaggagctgagcatcgagggcgagcaggagctgttcgagcccaaccagagcccccaggtgccccccatggagaccagccagccctacgaggaggtgagccagccctgccaggaggtgcccgacatcagccagccctgccaggacatcagcgaggccctgagccagccctgccagaaggtgcccgacatcagccagcagtgccaggagaaccacgacaacggcaaccacacctgccaggaggtgccccacatcagccagccctgccagaagagcagccagctgtgccagaaggtgagcgaggaggtgtgccagctgtgcctggagaacagcgaggaggtgagccagccctgccagggcgtgagcgtggaggtgggcaagctggtgcacaagttccacgtgggcgtgggcagcctggtgcaggagaccctggtggaggtgggcagccccgccgaggagatccccgaggaggtgatccagccctaccaggagttcagcgtggaggtgggcagactggcccaggagaccagcgccatcaacctgctgagccagggcatccccgagatcgacaagcccagccaggagttccccgaggagatcgacctgcaggcccaggaggtgcccgaggagatcaactag

SEQ ID NO: 9765 - DNA, 1137 bp, Artificial Sequence
  Description of Artificial Sequence: Synthetic coding sequence
atggacagcgtgagaagcggcgccttcggccacctgttcagacccgacaacttcatcttcggccagagcggcgccggcaacaactgggccaagggccactacaccgagggcgccgagctggtggacagcgtgctggacgtggtgagaaaggagtgcgagaactgcgactgcctgcagggcttccagctgacccacagcctgggcggcggcaccggcagcggcatgggcaccctgctgatcagcaaggtgagagaggagtaccccgacagaatcatgaacaccttcagcgtggtgcccagccccaaggtgagcgacaccgtggtggagccctacaacgccaccctgagcatccaccagctggtggagaacaccgacgagacctactgcatcgacaacgaggccctgtacgacatctgcttcagaaccctgaagctggccacccccacctacggcgacctgaaccacctggtgagcgccaccatgagcggcgtgaccaccagcctgagattccccggccagctgaacgccgacctgagaaagctggccgtgaacatggtgcccttccccagactgcacttcttcatgcccggcttcgcccccctgaccgccagaggcagccagcagtacagagccctgaccgtgcccgagctgacccagcagatgttcgacgccaagaacatgatggccgcctgcgaccccagacacggcagatacctgaccgtggccaccgtgttcagaggcagaatgagcatgaaggaggtggacgagcagatgctggccatccagagcaagaacagcagctacttcgtggagtggatccccaacaacgtgaaggtggccgtgtgcgacatcccccccagaggcctgaagatgagcagcaccttcatcggcaacagcaccgccatccaggagctgttcaagagaatcagcgagcagttcaccgccatgttcagaagaaaggccttcctgcactggtacaccggcgagggcatggacgagatggagttcaccgaggccgagagcaacatgaacgacctggtgagcgagtaccagcagtaccaggacgccaccgccgaggaggagggcgagatgtacgaggacgacgaggaggagagcgaggcccagggccccaagtag

SEQ ID NO: 9766 - DNA, 1161 bp, Artificial Sequence
  Description of Artificial Sequence: Synthetic coding sequence
atgtgcgagagagccgccagactgtgcagagccggcgcccacagactgctgagagagcccccccagcagggcagagccctgggcggcctgctgagatgggtgggcgccagaatgggcgagcccagagagagcctggcccccgccgcccccgccgaccccggccccgccagccccagaggcggcaccgccgtgatcctggacatcttcagaagagccgacaagaacgacgacggcaagctgagcctggaggagttccagctgttcttcgccgacggcgtgctgaacgagaaggagctggaggacctgttccacaccatcgacagcgacaacaccaaccacgtggacaccaaggagctgtgcgactacttcgtggaccacatgggcgactacgaggacgtgctggccagcctggagaccctgaaccacagcgtgctgaaggccatgggctacaccaagaaggtgtacgagggcggcagcaacgtggaccagttcgtgaccagattcctgctgaaggagaccgccaaccagatccagagcctgctgagcagcgtggagagcgccgtggaggccatcgaggagcagaccagccagctgagacagaaccacatcaagcccagccacagcgccgcccagacctggtgcggcagccccacccccgccagcgcccccaaccacaagctgatggccatggagcagggcaagaccctgcccagcgccaccgaggacgccaaggaggagggcctggaggcccagatcagcagactggccgagctgatcggcagactggagagcaaggccctgtggttcgacctgcagcagagactgagcgacgaggacggcaccaacatgcacctgcagctggtgagacaggagatggccgtgtgccccgagcagctgagcgagttcctggacagcctgagacagtacctgagaggcaccaccggcgtgagaaactgcttccacatcaccgccgtgagactgagcgacggcttcaccttcgtgatctacgagttctgggagaccgaggaggcctggaagagacacctgcagagccccctgtgcaaggccttcagacacgtgaaggtggacaccctgagccagcccgaggccctgagcagaatcctggtgcccgccgcctggtgcaccgtgggcagagactag

SEQ ID NO: 9767 - DNA, 1482 bp, Artificial Sequence
  Description of Artificial Sequence: Synthetic coding sequence
atggagagaagccccgacgtgagccccggccccagcagaagcttcaaggaggagctgctgtgcgccgtgtgctacgaccccttcagagacgccgtgaccctgagatgcggccacaacttctgcagaggctgcgtgagcagatgctgggaggtgcaggtgagccccacctgccccgtgtgcaaggacagagccagccccgccgacctgagaaccaaccacaccctgaacaacctggtggagaagctgctgagagaggaggccgagggcgccagatggaccagctacagattcagcagagtgtgcagactgcacagaggccagctgagcctgttctgcctggaggacaaggagctgctgtgctgcagctgccaggccgaccccagacaccagggccacagagtgcagcccgtgaaggacaccgcccacgacttcagagccaagtgcagaaacatggagcacgccctgagagagaaggccaaggccttctgggccatgagaagaagctacgaggccatcgccaagcacaaccaggtggaggccgcctggctggagggcagaatcagacaggagttcgacaagctgagagagttcctgagagtggaggagcaggccatcctggacgccatggccgaggagaccagacagaagcagctgctggccgacgagaagatgaagcagctgaccgaggagaccgaggtgctggcccacgagatcgagagactgcagatggagatgaaggaggacgacgtgagcttcctgatgaagcacaagagcagaaagagaagactgttctgcaccatggagcccgagcccgtgcagcccggcatgctgatcgacgtgtgcaagtacctgggcagcctgcagtacagagtgtggaagaagatgctggccagcgtggagagcgtgcccttcagcttcgaccccaacaccgccgccggctggctgagcgtgagcgacgacctgaccagcgtgaccaaccacggctacagagtgcaggtggagaaccccgagagattcagcagcgccccctgcctgctgggcagcagagtgttcagccagggcagccacgcctgggaggtggccctgggcggcctgcagagctggagagtgggcgtggtgagagtgagacaggacagcggcgccgagggccacagccacagctgctaccacgacaccagaagcggcttctggtacgtgtgcagaacccagggcgtggagggcgaccactgcgtgaccagcgaccccgccaccagccccctggtgctggccatccccagaagactgagagtggagctggagtgcgaggagggcgagctgagcttctacgacgccgagagacactgccacctgtacaccttccacgccagattcggcgaggtgagaccctacttctacctgggcggcgccagaggcgccggcccccccgagcccctgagaatctgccccctgcacatcagcgtgaaggaggagctggacggctag

SEQ ID NO: 9768 - DNA, 2262 bp, Artificial Sequence
  Description of Artificial Sequence: Synthetic coding sequence
atggcccccgacagcgaccccttccccgagggccccctgctgaagctgctgcccctggacgccagagacagaggcacccagagatgcagactgggccccgccgccctgcacgccctgggcgccagactgggcagcgccgtgaagatcagcctgcccgacggcggcagctgcctgtgcaccgcctggcccagaagagacggcgccgacggcttcgtgcagctggaccccctgtgcgccagccccggcgccgccgtgggcgccagcagaagcagaagaagcctgagcctgaacagactgctgctggtgccctgcccccccctgagaagagtggccgtgtggcccgtgctgagagagagagccggcgcccccggcgccagaaacaccgccgccgtgctggaggccgcccaggagctgctgagaaacagacccatcagcctgggccacgtggtggtggccccccccggcgcccccggcctggtggccgccctgcacatcgtgggcggcacccccagccccgaccccgccggcctggtgacccccagaaccagagtgagcctgggcggcgagccccccagcgaggcccagccccagcccgaggtgcccctgggcggcctgagcgaggccgccgacagcctgagagagctgctgagactgcccctgagataccccagagccctgaccgccctgggcctggccgtgcccagaggcgtgctgctggccggcccccccggcgtgggcaagacccagctggtgagagccgtggccagagaggccggcgccgagctgctggccgtgagcgcccccgccctgcagggcagcagacccggcgagaccgaggagaacgtgagaagagtgttccagagagccagagagctggccagcagaggccccagcctgctgttcctggacgagatggacgccctgtgcccccagagaggcagcagagcccccgagagcagagtggtggcccaggtgctgaccctgctggacggcgccagcggcgacagagaggtggtggtggtgggcgccaccaacagacccgacgccctggaccccgccctgagaagacccggcagattcgacagagaggtggtgatcggcacccccaccctgaagcagagaaaggagatcctgcaggtgatcaccagcaagatgcccatcagcagccacgtggacctgggcctgctggccgagatgaccgtgggctacgtgggcgccgacctgaccgccctgtgcagagaggccgccatgcacgccctgctgcacagcgagaagaaccaggacaaccccgtgatcgacgagatcgacttcctggaggccttcaagaacatccagcccagcagcttcagaagcgtgatcggcctgatggacatcaagcccgtggactgggaggagatcggcggcctggaggacgtgaagctgaagctgaagcagagcatcgagtggcccctgaagttcccctgggagttcgtgagaatgggcctgacccagcccaagggcgtgctgctgtacggcccccccggctgcgccaagaccaccctggtgagagccctggccaccagctgccactgcagcttcgtgagcgtgagcggcgccgacctgttcagccccttcgtgggcgacagcgagaaggtgctgagccagatcttcagacaggccagagccagcacccccgccatcctgttcctggacgagatcgacagcatcctgggcgccagaagcgccagcaagaccggctgcgacgtgcaggagagagtgctgagcgtgctgctgaacgagctggacggcgtgggcctgaagaccatcgagagaagaggcagcaagagcagccagcaggagttccaggaggtgttcaacagaagcgtgatgatcatcgccgccaccaacagacccgacgtgctggacaccgccctgctgagacccggcagactggacaagatcatctacatccccccccccgaccacaagggcagactgagcatcctgaaggtgtgcaccaagaccatgcccatcggccccgacgtgagcctggagaacctggccgccgagacctgcttcttcagcggcgccgacctgagaaacctgtgcaccgaggccgccctgctggccctgcaggagaacggcctggacgccaccaccgtgaagcaggagcacttcctgaagagcctgaagaccgtgaagcccagcctgagctgcaaggacctggccctgtacgagaacctgttcaagaaggagggcttcagcaacgtggagggcatctag

SEQ ID NO: 9769 - DNA, 1026 bp, Artificial Sequence
  Description of Artificial Sequence: Synthetic coding sequence
atgcccaagagaaaggtgaccttccagggcgtgggcgacgaggaggacgaggacgagatcatcgtgcccaagaagaagctggtggaccccgtggccggcagcggcggccccggcagcagattcaagggcaagcacagcctggacagcgacgaggaggaggacgacgacgacggcggcagcagcaagtacgacatcctggccagcgaggacgtggagggccaggaggccgccaccctgcccagcgagggcggcgtgagaatcacccccttcaacctgcaggaggagatggaggagggccacttcgacgccgacggcaactacttcctgaacagagacgcccagatcagagacagctggctggacaacatcgactgggtgaagatcagagagagaccccccggccagagacaggccagcgacagcgaggaggaggacagcctgggccagaccagcatgagcgcccaggccctgctggagggcctgctggagctgctgctgcccagagagaccgtggccggcgccctgagaagactgggcgccagaggcggcggcaagggcagaaagggccccggccagcccagcagcccccagagactggacagactgagcggcctggccgaccagatggtggccagaggcaacctgggcgtgtaccaggagaccagagagagactggccatgagactgaagggcctgggctgccagaccctgggcccccacaaccccacccccccccccagcctggacatgttcgccgaggagctggccgaggaggagctggagacccccacccccacccagagaggcgaggccgagagcagaggcgacggcctggtggacgtgatgtgggagtacaagtgggagaacaccggcgacgccgagctgtacggccccttcaccagcgcccagatgcagacctgggtgagcgagggctacttccccgacggcgtgtactgcagaaagctggacccccccggcggccagttctacaacagcaagagaatcgacttcgacctgtacacctag

SEQ ID NO: 9770 - DNA, 690 bp, Artificial Sequence
  Description of Artificial Sequence: Synthetic coding sequence
atggccgaggagatggagagcagcctggaggccagcttcagcagcagcggcgccgtgagcggcgccagcggcttcctgccccccgccagaagcagaatcttcaagatcatcgtgatcggcgacagcaacgtgggcaagacctgcctgacctacagattctgcgccggcagattccccgacagaaccgaggccaccatcggcgtggacttcagagagagagccgtggagatcgacggcgagagaatcaagatccagctgtgggacaccgccggccaggagagattcagaaagagcatggtgcagcactactacagaaacgtgcacgccgtggtgttcgtgtacgacatgaccaacatggccagcttccacagcctgcccagctggatcgaggagtgcaagcagcacctgctggccaacgacatccccagaatcctggtgggcaacaagtgcgacctgagaagcgccatccaggtgcccaccgacctggcccagaagttcgccgacacccacagcatgcccctgttcgagaccagcgccaagaaccccaacgacaacgaccacgtggaggccatcttcatgaccctggcccacaagctgaagagccacaagcccctgatgctgagccagccccccgacaacggcatcatcctgaagcccgagcccaagcccgccatgacctgctggtgctag

SEQ ID NO: 9771 - DNA, 2352 bp, Artificial Sequence
  Description of Artificial Sequence: Synthetic coding sequence
atgctgctgggcttcagaagaggcagaagaagccacttcaagcacatcatccacggcctgctgcccgccgccagcgtggcccccaaggccgccgtgcccagaacccccccccccagaagccccaaccccagccccgagagacccagaagcgccctggccgccgccatcctggccaccaccctgaccggcagaaccgtggccatcccccagcccagacagagaagcagaagcgagagcgacgtgagcagcgtggagcaggacagcttcatcgagccctacgccaccaccagccagctgagacccagacccaactggcagagcgagatgggcagaagaagcagcctgcccagcttcgagaccctggactacggcgacgaggaggacatcgagacccagctgagcagcagcggcaaggagctgggcgacgtgagcgccagagaggacagaggcggccacagcgacgacctgtacgccgtgccccacagaaaccaggtgcccctgctgcacgaggtgaacagcgaggacgacgagaacatcagccaccaggacggcttccccggcagcccccccgccccccagagaacccagcagaaggacggcaagcaccccgtgctgaacctgaaggacgagaagccccccctgtgcgagaagcccccccccagccccgacatcaccggcagagccagacagagatacaccgagatcaccagagagaagttcgaggccctgaaggaggagaacatggacctgaacaacatgaaccagagcctgaccctggagctgaacaccatgaagcaggccatgaaggagctgcagctgaagctgaagggcatggagaaggagaagagaaagctgaaggaggccgagaaggccagcagccaggaggtggccgcccccgagctgctgtacctgagaaagcaggcccaggagctggtggacgagaacgacggcctgaagatgaccgtgcacagactgaacgtggagctgagcagataccagaccaagttcagacacctgagcaaggaggagagcctgaacatcgagggcctgcccagcaagggccccatccccccctggctgctggacatcaagtacctgagccccctgctgctggcctacgaggacatgatgaaggagaaggacgagctgaacgccaccctgaaggaggagatgagaatgttcagaatgagagtgcaggaggtggtgaaggagaacgaggagctgcaccaggagctgaacaagagcagcgccgtgaccagcgaggagtggagacagctgcagacccaggccaagctggtgctggaggagaacaagctgctgctggagcagctggagatccagcagagaaaggccaaggacagccaccaggagagactgcaggaggtgagcaagctgaccaagcagctgatgctgctggaggccaagacccacggccaggagaaggagctggccgagaacagagagcagctggagatcctgagagccaagtgccaggagctgaagacccacagcgacggcaagatcgccgtggaggtgcacaagagcatcgtgaacgagctgaagagccagctgcagaaggaggaggagaaggagagagccgagatggaggagctgatggagaagctgaccgtgctgcaggcccagaagaagagcctgctgctggagaagaacagcctgaccgagcagaacaaggccctggaggccgagctggagagagcccagaagatcaacagaaagagccagaagaagatcgaggtgctgaagaagcaggtggagaaggccatgggcaacgagatgagcgcccaccagtacctggccaacctggtgggcctggccgagaacatcacccaggagagagacagcctgatgtgcctggccaagtgcctggagagcgagaaggacggcgtgctgaacaaggtgatcaagagcaacatcagactgggcaagctggaggagaaggtgaagggctacaagaagcaggccgccctgaagctgggcgacatcagccacagactgctggagcagcaggaggacttcgccggcaagaccgcccagtacagacaggagatgagacacctgcaccaggtgctgaaggacaagcaggaggtgctggaccaggccctgcagcagaacagagagatggagggcgagctggaggtgatctgggagagcaccttcagagagaacagaagaatcagagagctgctgcaggacaccctgaccagaaccggcgtgcaggacaaccccagagccctggtggcccccagcctgaacggcgtgagccaggccgacctgctggacggctgcgacgtgtgcagctacgacctgaagagccacgcccccacctgctag

SEQ ID NO: 9772 - DNA, 639 bp, Artificial Sequence
  Description of Artificial Sequence: Synthetic coding sequence
atggccgccagaagaggcgccctgatcgtgctggagggcgtggacagagccggcaagagcacccagagcagaaagctggtggaggccctgtgcgccgccggccacagagccgagctgctgagattccccgagagaagcaccgagatcggcaagctgctgagcagctacctgcagaagaagagcgacgtggaggaccacagcgtgcacctgctgttcagcgccaacagatgggagcaggtgcccctgatcaaggagaagctgagccagggcgtgaccctggtggtggacagatacgccttcagcggcgtggccttcaccggcgccaaggagaacttcagcctggactggtgcaagcagcccgacgtgggcctgcccaagcccgacctggtgctgttcctgcagctgcagctggccgacgccgccaagagaggcgccttcggccacgagagatacgagaacggcgccttccaggagagagccctgagatgcttccaccagctgatgaaggacaccaccctgaactggaagatggtggacgccagcaagagcatcgaggccgtgcacgaggacatcagagtgctgagcgaggacgccatcagaaccgccaccgagaagcccctgggcgagctgtggaagtag

SEQ ID NO: 9773 - DNA, 504 bp, Artificial Sequence
  Description of Artificial Sequence: Synthetic coding sequence
atggaggagacctacaccgacagcctggaccccgagaagctgctgcagtgcccctacgacaagaaccaccagatcagagcctgcagattcccctaccacctgatcaagtgcagaaagaaccaccccgacgtggccagcaagctggccacctgccccttcaacgccagacaccaggtgcccagagccgagatcagccaccacatcagcagctgcgacgacagaagctgcatcgagcaggacgtggtgaaccagaccagaagcctgagacaggagaccctggccgagagcacctggcagtgccccccctgcgacgaggactgggacaaggacctgtgggagcagaccagcacccccttcgtgtggggcaccacccactacagcgacaacaacagccccgccagcaacatcgtgaccgagcacaagaacaacctggccagcggcatgagagtgcccaagagcctgccctacgtgctgccctggaagaacaacggcaacgcccagtag

SEQ ID NO: 9774 - DNA, 381 bp, Artificial Sequence
  Description of Artificial Sequence: Synthetic coding sequence
atggccgccggccccgagccccccgagtgggagcccagatggagaaaggccctgagaggcaaggagaacaagggcagcgtggagatcatgagaaaggacctgaacgacgccagagacctgcacggccaggccgagagcgccgccgccgtgtggaagggccacgtgatggacagaagaaagaaggccctgaccgactacaagaagctgagagccttcttcgtggaggaggaggagcacttcctgcaggaggccgagaaggaggagggcctgcccgaggacgagctggccgaccccaccgagagattcagaagcctgctgcaggccgtgagcgagctggagaagaagcacagaaacctgggcctgagcatgctgctgcagtag

SEQ ID NO: 9775 - DNA, 1668 bp, Artificial Sequence
  Description of Artificial Sequence: Synthetic coding sequence
atgcagagctgcgagagcagcggcgacagcgccgacgaccccctgagcagaggcctgagaagaagaggccagcccagagtggtggtgatcggcgccggcctggccggcctggccgccgccaaggccctgctggagcagggcttcaccgacgtgaccgtgctggaggccagcagccacatcggcggcagagtgcagagcgtgaagctgggccacgccaccttcgagctgggcgccacctggatccacggcagccacggcaaccccatctaccacctggccgaggccaacggcctgctggaggagaccaccgacggcgagagaagcgtgggcagaatcagcctgtacagcaagaacggcgtggcctgctacctgaccaaccacggcagaagaatccccaaggacgtggtggaggagttcagcgacctgtacaacgaggtgtacaacctgacccaggagttcttcagacacgacaagcccgtgaacgccgagagccagaacagcgtgggcgtgttcaccagagaggaggtgagaaacagaatcagaaacgaccccgacgaccccgaggccaccaagagactgaagctggccatgatccagcagtacctgaaggtggagagctgcgagagcagcagccacagcatggacgaggtgagcctgagcgccttcggcgagtggaccgagatccccggcgcccaccacatcatccccagcggcttcatgagagtggtggagctgctggccgagggcatccccgcccacgtgatccagctgggcaagcccgtgagatgcatccactgggaccaggccagcgccagacccagaggccccgagatcgagcccagaggcgagggcgaccacaaccacgacaccggcgagggcggccagggcggcgaggagcccagaggcggcagatgggacgaggacgagcagtggagcgtggtggtggagtgcgaggactgcgagctgatccccgccgaccacgtgatcgtgaccgtgagcctgggcgtgctgaagagacagtacaccagcttcttcagacccggcctgcccaccgagaaggtggccgccatccacagactgggcatcggcaccaccgacaagatcttcctggagttcgaggagcccttctggggccccgagtgcaacagcctgcagttcgtgtgggaggacgaggccgagagccacaccctgacctacccccccgagctgtggtacagaaagatctgcggcttcgacgtgctgtacccccccgagagatacggccacgtgctgagcggctggatctgcggcgaggaggccctggtgatggagaagtgcgacgacgaggccgtggccgagatctgcaccgagatgctgagacagttcaccggcaaccccaacatccccaagcccagaagaatcctgagaagcgcctggggcagcaacccctacttcagaggcagctacagctacacccaggtgggcagcagcggcgccgacgtggagaagctggccaagcccctgccctacaccgagagcagcaagaccgcccccatgcaggtgctgttcagcggcgaggccacccacagaaagtactacagcaccacccacggcgccctgctgagcggccagagagaggccgccagactgatcgagatgtacagagacctgttccagcagggcacctag

SEQ ID NO: 9776 - DNA, 3153 bp, Artificial Sequence
  Description of Artificial Sequence: Synthetic coding sequence
atggccctgtacgacgaggacctgctgaagaaccccttctacctggccctgcagaagtgcagacccgacctgtgcagcaaggtggcccagatccacggcatcgtgctggtgccctgcaagggcagcctgagcagcagcatccagagcacctgccagttcgagagctacatcctgatccccgtggaggagcacttccagaccctgaacggcaaggacgtgttcatccagggcaacagaatcaagctgggcgccggcttcgcctgcctgctgagcgtgcccatcctgttcgaggagaccttctacaacgagaaggaggagagcttcagcatcctgtgcatcgcccaccccctggagaagagagagagcagcgaggagcccctggcccccagcgaccccttcagcctgaagaccatcgaggacgtgagagagttcctgggcagacacagcgagagattcgacagaaacatcgccagcttccacagaaccttcagagagtgcgagagaaagagcctgagacaccacatcgacagcgccaacgccctgtacaccaagtgcctgcagcagctgctgagagacagccacctgaagatgctggccaagcaggaggcccagatgaacctgatgaagcaggccgtggagatctacgtgcaccacgagatctacaacctgatcttcaagtacgtgggcaccatggaggccagcgaggacgccgccttcaacaagatcaccagaagcctgcaggacctgcagcagaaggacatcggcgtgaagcccgagttcagcttcaacatccccagagccaagagagagctggcccagctgaacaagtgcaccagcccccagcagaagctggtgtgcctgagaaaggtggtgcagctgatcacccagagccccagccagagagtgaacctggagaccatgtgcgccgacgacctgctgagcgtgctgctgtacctgctggtgaagaccgagatccccaactggatggccaacctgagctacatcaagaacttcagattcagcagcctggccaaggacgagctgggctactgcctgaccagcttcgaggccgccatcgagtacatcagacagggcagcctgagcgccaagccccccgagagcgagggcttcggcgacagactgttcctgaagcagagaatgagcctgctgagccagatgaccagcagccccaccgactgcctgttcaagcacatcgccagcggcaaccagaaggaggtggagagactgctgagccaggaggaccacgacaaggacaccgtgcagaagatgtgccaccccctgtgcttctgcgacgactgcgagaagctggtgagcggcagactgaacgaccccagcgtggtgacccccttcagcagagacgacagaggccacacccccctgcacgtggccgccgtgtgcggccaggccagcctgatcgacctgctggtgagcaagggcgccatggtgaacgccaccgactaccacggcgccacccccctgcacctggcctgccagaagggctaccagagcgtgaccctgctgctgctgcactacaaggccagcgccgaggtgcaggacaacaacggcaacacccccctgcacctggcctgcacctacggccacgaggactgcgtgaaggccctggtgtactacgacgtggagagctgcagactggacatcggcaacgagaagggcgacacccccctgcacatcgccgccagatggggctaccagggcgtgatcgagaccctgctgcagaacggcgccagcaccgagatccagaacagactgaaggagacccccctgaagtgcgccctgaacagcaagatcctgagcgtgatggaggcctaccacctgagcttcgagagaagacagaagagcagcgaggcccccgtgcagagcccccagagaagcgtggacagcatcagccaggagagcagcaccagcagcttcagcagcatgagcgccagcagcagacaggaggagaccaagaaggactacagagaggtggagaagctgctgagagccgtggccgacggcgacctggagatggtgagatacctgctggagtggaccgaggaggacctggaggacgccgaggacaccgtgagcgccgccgaccccgagttctgccaccccctgtgccagtgccccaagtgcgcccccgcccagaagagactggccaaggtgcccgccagcggcctgggcgtgaacgtgaccagccaggacggcagcagccccctgcacgtggccgccctgcacggcagagccgacctgatccccctgctgctgaagcacggcgccaacgccggcgccagaaacgccgaccaggccgtgcccctgcacctggcctgccagcagggccacttccaggtggtgaagtgcctgctggacagcaacgccaagcccaacaagaaggacctgagcggcaacacccccctgatctacgcctgcagcggcggccaccacgagctggtggccctgctgctgcagcacggcgccagcatcaacgccagcaacaacaagggcaacaccgccctgcacgaggccgtgatcgagaagcacgtgttcgtggtggagctgctgctgctgcacggcgccagcgtgcaggtgctgaacaagagacagagaaccgccgtggactgcgccgagcagaacagcaagatcatggagctgctgcaggtggtgcccagctgcgtggccagcctggacgacgtggccgagaccgacagaaaggagtacgtgaccgtgaagatcagaaagaagtggaacagcaagctgtacgacctgcccgacgagcccttcaccagacagttctacttcgtgcacagcgccggccagttcaagggcaagaccagcagagagatcatggccagagacagaagcgtgcccaacctgaccgagggcagcctgcacgagcccggcagacagagcgtgaccctgagacagaacaacctgcccgcccagagcggcagccacgccgccgagaagggcaacagcgactggcccgagagacccggcctgacccagaccggccccggccacagaagaatgctgagaagacacaccgtggaggacgccgtggtgagccagggccccgaggccgccggccccctgagcaccccccaggaggtgagcgccagcagaagctag

SEQ ID NO: 9777 - DNA, 1662 bp, Artificial Sequence
  Description of Artificial Sequence: Synthetic coding sequence
atggacgtggacaaggagctgggcatggagagcgtgaaggccggcgccagcggcaagcccgagatgagactgggcacccaggaggagaccagcgagggcgacgccaacgagagcagcctgctggtgctgagcagcaacgtgcccctgctggccctggagttcctggagatcgcccaggccaaggagaaggccttcctgcccatggtgagccacaccttccacatgagaaccgaggagagcgacgccagccaggagggcgacgacctgcccaagagcagcgccaacaccagccaccccaagcaggacgacagccccaagagcagcgaggagaccatccagcccaaggagggcgacatccccaaggcccccgaggagaccatccagagcaagaaggaggacctgcccaagagcagcgagaaggccatccagcccaaggagagcaacatccccaagagcagcgccaagcccatccagcccaagctgggcaacatccccaaggccagcgtgaagcccagccagcccaaggagggcgacatccccaaggcccccgaggagaccatccagagcaagaaggaggacctgcccaagagcagcgaggaggccatccagcccaaggagggcgacatccccaagagcagcgccaagcccatccagcccaagctgggcaacatcgccaagaccagcgtgaagcccagccagcccaaggagagcgacatccccaagagccccgaggagaccatccagcccaaggagggcgacatccccaagagcagcgccaagcccatccagcccaagctgggcaacatccccaaggccagcgtgaagcccagccagcccaaggagggcgacatcagcaagagccccgaggaggccatccagcccaaggagggcgacctgcccaagagcctggaggaggccatccagcccaaggagggcgacatccccaagagccccgaggaggccatccagcccaaggagggcgacatccccaagagcctggaggaggccatccagcccaaggagggcgacatccccaagagccccgaggagaccatccagcccaagaagggcgacatccccaagagccccgaggaggccatccagcccaaggagggcgacatccccaagagccccaagcaggccatccagcccaaggagggcgacatccccaagagcctggaggaggccatcccccccaaggagatcgacatccccaagagccccgaggagaccatccagcccaaggaggacgacagccccaagagcctggaggaggccacccccagcaaggagggcgacatcctgaagcccgaggaggagaccatggagttccccgagggcgacaaggtgaaggtgatcctgagcaaggaggacttcgaggccagcctgaaggaggccggcgagagactggtggccgtggacttcagcgccacctggtgcggcccctgcagaaccatcagacccttcttccacgccctgagcgtgaagcacgaggacgtggtgttcctggaggtggacgccgacaactgcgaggaggtggtgagagagtgcgccatcatgtgcgtgcccaccttccagttctacaagaaggaggagaaggtggacgagctgtgcggcgccctgaaggagaagctggaggccgtgatcgccgagctgaagtag

SEQ ID NO: 9778 - DNA, 2268 bp, Artificial Sequence
  Description of Artificial Sequence: Synthetic coding sequence
atggtgagccacggcagcagccccagcctgctggaggccctgagcagcgacttcctggcctgcaagatctgcctggagcagctgagagcccccaagaccctgccctgcctgcacacctactgccaggactgcctggcccagctggccgacggcggcagagtgagatgccccgagtgcagagagaccgtgcccgtgccccccgagggcgtggccagcttcaagaccaacttcttcgtgaacggcctgctggacctggtgaaggccagagcctgcggcgacctgagagccggcaagcccgcctgcgccctgtgccccctggtgggcggcaccagcaccggcggccccgccaccgccagatgcctggactgcgccgacgacctgtgccaggcctgcgccgacggccacagatgcaccagacagacccacacccacagagtggtggacctggtgggctacagagccggctggtacgacgaggaggccagagagagacaggccgcccagtgcccccagcaccccggcgaggccctgagattcctgtgccagccctgcagccagctgctgtgcagagagtgcagactggacccccacctggaccacccctgcctgcccctggccgaggccgtgagagccagaagacccggcctggagggcctgctggccggcgtggacaacaacctggtggagctggaggccgccagaagagtggagaaggaggccctggccagactgagagagcaggccgccagagtgggcacccaggtggaggaggccgccgagggcgtgctgagagccctgctggcccagaagcaggaggtgctgggccagctgagagcccacgtggaggccgccgaggaggccgccagagagagactggccgagctggagggcagagagcaggtggccagagccgccgccgccttcgccagaagagtgctgagcctgggcagagaggccgagatcctgagcctggagggcgccatcgcccagagactgagacagctgcagggctgcccctgggcccccggccccgccccctgcctgctgccccagctggagctgcaccccggcctgctggacaagaactgccacctgctgagactgagcttcgaggagcagcagccccagaaggacggcggcaaggacggcgccggcacccagggcggcgaggagagccagagcagaagagaggacgagcccaagaccgagagacagggcggcgtgcagccccaggccggcgacggcgcccagacccccaaggaggagaaggcccagaccaccagagaggagggcgcccagaccctggaggaggacagagcccagaccccccacgaggacggcggcccccagccccacagaggcggcagacccaacaagaagaagaagttcaagggcagactgaagagcatcagcagagagcccagccccgccctgggccccaacctggacggcagcggcctgctgcccagacccatcttctactgcagcttccccaccagaatgcccggcgacaagagaagccccagaatcaccggcctgtgccccttcggccccagagagatcctggtggccgacgagcagaacagagccctgaagagattcagcctgaacggcgactacaagggcaccgtgcccgtgcccgagggctgcagcccctgcagcgtggccgccctgcagagcgccgtggccttcagcgccagcgccagactgtacctgatcaaccccaacggcgaggtgcagtggagaagagccctgagcctgagccaggccagccacgccgtggccgccctgcccagcggcgacagagtggccgtgagcgtggccggccacgtggaggtgtacaacatggagggcagcctggccaccagattcatccccggcggcaaggccagcagaggcctgagagccctggtgttcctgaccaccagcccccagggccacttcgtgggcagcgactggcagcagaacagcgtggtgatctgcgacggcctgggccaggtggtgggcgagtacaagggccccggcctgcacggctgccagcccggcagcgtgagcgtggacaagaagggctacatcttcctgaccctgagagaggtgaacaaggtggtgatcctggaccccaagggcagcctgctgggcgacttcctgaccgcctaccacggcctggagaagcccagagtgaccaccatggtggacggcagatacctggtggtgagcctgagcaacggcaccatccacatcttcagagtgagaagccccgacagctag

SEQ ID NO: 9779 - DNA, 1467 bp, Artificial Sequence
  Description of Artificial Sequence: Synthetic coding sequence
atggccgccggcagcgaggccaccacccccgtgatcgtggccgccggcgccggcggcgaggagggcgagcacgtgaagcccttcaagcccgagaaggccaaggagatcatcatgagcctgcagcagcccgccatcttctgcaacatggtgttcgactggcccgccagacactggaacgccaagtacctgagccaggtgctgcacggcaagcagatcagattcagaatgggcatgaagagcatgagcaccgtgccccagttcgagaccacctgcaactacgtggaggccaccctggaggagttcctgacctggaactgcgaccagagcagcatcagcggccccttcagagactacgaccacagcaagttctgggcctacgccgactacaagtacttcgtgagcctgttcgaggacaagaccgacctgttccaggacgtgaagtggagcgacttcggcttccccggcagaaacggccaggagagcaccctgtggatcggcagcctgggcgcccacaccccctgccacctggacagctacggctgcaacctggtgttccaggtgcagggcagaaagagatggcacctgttcccccccgaggacacccccttcctgtaccccaccagaatcccctacgaggagagcagcgtgttcagcaagatcaacgtggtgaaccccgacctgaagagattcccccagttcagaaaggcccagagacacgccgtgaccctgagccccggccaggtgctgttcgtgcccagacactggtggcactacgtggagagcatcgaccccgtgaccgtgagcatcaacagctggatcgagctggaggaggaccacctggccagagtggaggaggccatcaccagaatgctggtgtgcgccctgaagaccgccgagaacccccagaacaccagagcctggctgaaccccaccgaggtggaggagaccagccacgccgtgaactgctgctacctgaacgccgccgtgagcgccttcttcgacagatgcagaaccagcgaggtggtggagatccaggccctgagaaccgacggcgagcacatgaagaaggaggagctgaacgtgtgcaaccacatggaggtgggccagaccggcagccagaacctgaccaccggcaccgacaagcccgaggccgccagccccttcggccccgacctggtgcccgtggcccagagaagcgaggagccccccagcgagagaggcggcatcttcggcagcgacggcaaggacttcgtggacaaggacggcgagcacttcggcaagctgcactgcgccaagagacagcagatcatgagcaacagcgagaacgccatcgaggagcagatcgccagcaacaccaccaccaccccccagaccttcatcagcaccgacgacctgctggactgcctggtgaacccccaggtgaccagaatcgtggcccagctgctgatccagggcagaagcctgtag

SEQ ID NO: 9780 - DNA, 579 bp, Artificial Sequence
  Description of Artificial Sequence: Synthetic coding sequence
atggcccccaagcccggcgccgagtggagcaccgccctgagccacctggtgctgggcgtggtgagcctgcacgccgccgtgagcaccgccgaggccagcagaggcgccgccgccggcttcctgctgcaggtgctggccgccaccaccaccctggcccccggcctgagcacccacgaggactgcctggccggcgcctgggtggccaccgtgatcggcctgcccctgctggccttcgacttccactgggtgaacggcgacagaagcagcgccaacctgctgctgggcggcggcatggtgctggccgtggccggcggccacctgggccccgagggcagaagcgtggccggccaggccatgctgctggtggtggccgtgaccatcctgatcgtggccgtgttcaccgccaacacctacggcatgtggggcggcgccatgctgggcgtggccggcctgctgagcagactggaggaggacagactgctgctgctgcccaaggaggacgtgtgcagatgggccctggccgtgggcagctgggcctactgcagagccctgcacacccagagactgcagtgggagtag

SEQ ID NO: 9781 - DNA, 462 bp, Artificial Sequence
  Description of Artificial Sequence: Synthetic coding sequence
atgaccagcgagagcaccagcccccccgtggtgccccccctgcacagccccaagagccccgtgtggcccaccttccccttccacagagagggcagcagagtgtgggagagaggcggcgtgccccccagagacctgcccagccccctgcccaccaagagaaccagaacctacagcgccaccgccagagccagcgccggccccgtgttcaagggcgtgtgcaagcagttcagcagaagccagggccacggcttcatcacccccgagaacggcagcgaggacatcttcgtgcacgtgagcgacatcgagggcgagtacgtgcccgtggagggcgacgaggtgacctacaagatgtgccccatcccccccaagaaccagaagttccaggccgtggaggtggtgctgacccagctggccccccacaccccccacgagacctggagcggccaggtggtgggcagctag

SEQ ID NO: 9782 - DNA, 537 bp, Artificial Sequence
  Description of Artificial Sequence: Synthetic coding sequence
atgagcagcttcagcagagccccccagcagtgggccaccttcgccagaatctggtacctgctggacggcaagatgcagccccccggcaagctggccgccatggccagcatcagactgcagggcctgcacaagcccgtgtaccacgccctgagcgactgcggcgaccacgtggtgatcatgaacaccagacacatcgccttcagcggcaacaagtgggagcagaaggtgtacagcagccacaccggctaccccggcggcttcagacaggtgaccgccgcccagctgcacctgagagaccccgtggccatcgtgaagctggccatctacggcatgctgcccaagaacctgcacagaagaaccatgatggagagactgcacctgttccccgacgagtacatccccgaggacatcctgaagaacctggtggaggagctgccccagcccagaaagatccccaagagactggacgagtacacccaggaggagatcgacgccttccccagactgtggaccccccccgaggactacagactgtag

SEQ ID NO: 9783 - DNA, 8763 bp, Artificial Sequence
  Description of Artificial Sequence: Synthetic coding sequence
atgagaggcagaagaggcagaccccccaagcagcccgccgcccccgccgccgagagatgcgcccccgccccccccccccccccccccccccccaccagcggccccatcggcggcctgagaagcagacacagaggcagcagcagaggcagatgggccgccgcccaggccgaggtggcccccaagaccagactgagcagccccagaggcggcagcagcagcagaagaaagccccccccccccccccccgccccccccagcaccagcgcccccggcagaggcggcagaggcggcggcggcggcagaaccggcggcggcggcggcggcggccacctggccagaaccaccgccgccagaagagccgtgaacaaggtggtgtacgacgaccacgagagcgaggaggaggaggaggaggaggacatggtgagcgaggaggaggaggaggaggacggcgacgccgaggagacccaggacagcgaggacgacgaggaggacgagatggaggaggacgacgacgacagcgactaccccgaggagatggaggacgacgacgacgacgccagctactgcaccgagagcagcttcagaagccacagcacctacagcagcacccccggcagaagaaagcccagagtgcacagacccagaagccccatcctggaggagaaggacatcccccccctggagttccccaagagcagcgaggacctgatggtgcccaacgagcacatcatgaacgtgatcgccatctacgaggtgctgagaaacttcggcaccgtgctgagactgagccccttcagattcgaggacttctgcgccgccctggtgagccaggagcagtgcaccctgatggccgagatgcacgtggtgctgctgaaggccgtgctgagagaggaggacaccagcaacaccaccttcggccccgccgacctgaaggacagcgtgaacagcaccctgtacttcatcgacggcatgacctggcccgaggtgctgagagtgtactgcgagagcgacaaggagtaccaccacgtgctgccctaccaggaggccgaggactacccctacggccccgtggagaacaagatcaaggtgctgcagttcctggtggaccagttcctgaccaccaacatcgccagagaggagctgatgagcgagggcgtgatccagtacgacgaccactgcagagtgtgccacaagctgggcgacctgctgtgctgcgagacctgcagcgccgtgtaccacctggagtgcgtgaagccccccctggaggaggtgcccgaggacgagtggcagtgcgaggtgtgcgtggcccacaaggtgcccggcgtgaccgactgcgtggccgagatccagaagaacaagccctacatcagacacgagcccatcggctacgacagaagcagaagaaagtactggttcctgaacagaagactgatcatcgaggaggacaccgagaacgagaacgagaagaagatctggtactacagcaccaaggtgcagctggccgagctgatcgactgcctggacaaggactactgggaggccgagctgtgcaagatcctggaggagatgagagaggagatccacagacacatggacatcaccgaggacctgaccaacaaggccagaggcagcaacaagagcttcctggccgccgccaacgaggagatcctggagagcatcagagccaagaagggcgacatcgacaacgtgaagagccccgaggagaccgagaaggacaagaacgagaccgagaacgacagcaaggacgccgagaagaacagagaggagttcgaggaccagagcctggagaaggacagcgacgacaagacccccgacgacgaccccgagcagggcaagagcgaggtgggcgacttcaagagcgagaagagcaacggcgagctgagcgagagccccggcgccggcaagggcgccagcggcagcaccagaatcatcaccagactgagaaaccccgacagcaagctgagccagctgaagagccagcaggtggccgccgccgcccacgaggccaacaagctgttcaaggagggcaaggaggtgctggtggtgaacagccagggcgagatcagcagactgagcaccaagaaggaggtgatcatgaagggcaacatcaacaactacttcaagctgggccaggagggcaagtacagagtgtaccacaaccagtacagcaccaacagcttcgccctgaacaagcaccagcacagagaggaccacgacaagagaagacacctggcccacaagttctgcctgacccccgccggcgagttcaagtggaacggcagcgtgcacggcagcaaggtgctgaccatcagcaccctgagactgaccatcacccagctggagaacaacatccccagcagcttcctgcaccccaactgggccagccacagagccaactggatcaaggccgtgcagatgtgcagcaagcccagagagttcgccctggccctggccatcctggagtgcgccgtgaagcccgtggtgatgctgcccatctggagagagagcctgggccacaccagactgcacagaatgaccagcatcgagagagaggagaaggagaaggtgaagaagaaggagaagaagcaggaggaggaggagaccatgcagcaggccacctgggtgaagtacaccttccccgtgaagcaccaggtgtggaagcagaagggcgaggagtacagagtgaccggctacggcggctggagctggatcagcaagacccacgtgtacagattcgtgcccaagctgcccggcaacaccaacgtgaactacagaaagagcctggagggcaccaagaacaacatggacgagaacatggacgagagcgacaagagaaagtgcagcagaagccccaagaagatcaagatcgagcccgacagcgagaaggacgaggtgaagggcagcgacgccgccaagggcgccgaccagaacgagatggacatcagcaagatcaccgagaagaaggaccaggacgtgaaggagctgctggacagcgacagcgacaagccctgcaaggaggagcccatggaggtggacgacgacatgaagaccgagagccacgtgaactgccaggagagcagccaggtggacgtggtgaacgtgagcgagggcttccacctgagaaccagctacaagaagaagaccaagagcagcaagctggacggcctgctggagagaagaatcaagcagttcaccctggaggagaagcagagactggagaagatcaagctggagggcggcatcaagggcatcggcaagaccagcaccaacagcagcaagaacctgagcgagagccccgtgatcaccaaggccaaggagggctgccagagcgacagcatgagacaggagcagagccccaacgccaacaacgaccagcccgaggacctgatccagggctgcagcgagagcgacagcagcgtgctgagaatgagcgaccccagccacaccaccaacaagctgtaccccaaggacagagtgctggacgacgtgagcatcagaagccccgagaccaagtgccccaagcagaacagcatcgagaacgacatcgaggagaaggtgagcgacctggccagcagaggccaggagcccagcaagagcaagaccaagggcaacgacttcttcatcgacgacagcaagctggccagcgccgacgacatcggcaccctgatctgcaagaacaagaagcccctgatccaggaggagagcgacaccatcgtgagcagcagcaagagcgccctgcacagcagcgtgcccaagagcaccaacgacagagacgccacccccctgagcagagccatggacttcgagggcaagctgggctgcgacagcgagagcaacagcaccctggagaacagcagcgacaccgtgagcatccaggacagcagcgaggaggacatgatcgtgcagaacagcaacgagagcatcagcgagcagttcagaaccagagagcaggacgtggaggtgctggagcccctgaagtgcgagctggtgagcggcgagagcaccggcaactgcgaggacagactgcccgtgaagggcaccgaggccaacggcaagaagcccagccagcagaagaagctggaggagagacccgtgaacaagtgcagcgaccagatcaagctgaagaacaccaccgacaagaagaacaacgagaacagagagagcgagaagaagggccagagaaccagcaccttccagatcaacggcaaggacaacaagcccaagatctacctgaagggcgagtgcctgaaggagatcagcgagagcagagtggtgagcggcaacgtggagcccaaggtgaacaacatcaacaagatcatccccgagaacgacatcaagagcctgaccgtgaaggagagcgccatcagacccttcatcaacggcgacgtgatcatggaggacttcaacgagagaaacagcagcgagaccaagagccacctgctgagcagcagcgacgccgagggcaactacagagacagcctggagaccctgcccagcaccaaggagagcgacagcacccagaccaccacccccagcgccagctgccccgagagcaacagcgtgaaccaggtggaggacatggagatcgagaccagcgaggtgaagaaggtgaccagcagccccatcaccagcgaggaggagagcaacctgagcaacgacttcatcgacgagaacggcctgcccatcaacaagaacgagaacgtgaacggcgagagcaagagaaagaccgtgatcaccgaggtgaccaccatgaccagcaccgtggccaccgagagcaagaccgtgatcaaggtggagaagggcgacaagcagaccgtggtgagcagcaccgagaactgcgccaagagcaccgtgaccaccaccaccaccaccgtgaccaagctgagcacccccagcaccggcggcagcgtggacatcatcagcgtgaaggagcagagcaagaccgtggtgaccaccaccgtgaccgacagcctgaccaccaccggcggcaccctggtgaccagcatgaccgtgagcaaggagtacagcaccagagacaaggtgaagctgatgaagttcagcagacccaagaagaccagaagcggcaccgccctgcccagctacagaaagttcgtgaccaagagcagcaagaagagcatcttcgtgctgcccaacgacgacctgaagaagctggccagaaagggcggcatcagagaggtgccctacttcaactacaacgccaagcccgccctggacatctggccctaccccagccccagacccaccttcggcatcacctggagatacagactgcagaccgtgaagagcctggccggcgtgagcctgatgctgagactgctgtgggccagcctgagatgggacgacatggccgccaaggccccccccggcggcggcaccaccagaaccgagaccagcgagaccgagatcaccaccaccgagatcatcaagagaagagacgtgggcccctacggcatcagaagcgagtactgcatcagaaagatcatctgccccatcggcgtgcccgagacccccaaggagacccccaccccccagagaaagggcctgagaagcagcgccctgagacccaagagacccgagacccccaagcagaccggccccgtgatcatcgagacctgggtggccgaggaggagctggagctgtgggagatcagagccttcgccgagagagtggagaaggagaaggcccaggccgtggagcagcaggccaagaagagactggagcagcagaagcccaccgtgatcgccaccagcaccaccagccccaccagcagcaccaccagcaccatcagccccgcccagaaggtgatggtggcccccatcagcggcagcgtgaccaccggcaccaagatggtgctgaccaccaaggtgggcagccccgccaccgtgaccttccagcagaacaagaacttccaccagaccttcgccacctgggtgaagcagggccagagcaacagcggcgtggtgcaggtgcagcagaaggtgctgggcatcatccccagcagcaccggcaccagccagcagaccttcaccagcttccagcccagaaccgccaccgtgaccatcagacccaacaccagcggcagcggcggcaccaccagcaacagccaggtgatcaccggcccccagatcagacccggcatgaccgtgatcagaacccccctgcagcagagcaccctgggcaaggccatcatcagaacccccgtgatggtgcagcccggcgccccccagcaggtgatgacccagatcatcagaggccagcccgtgagcaccgccgtgagcgcccccaacaccgtgagcagcacccccggccagaagagcctgaccagcgccaccagcaccagcaacatccagagcagcgccagccagccccccagaccccagcagggccaggtgaagctgaccatggcccagctgacccagctgacccagggccacggcggcaaccagggcctgaccgtggtgatccagggccagggccagaccaccggccagctgcagctgatcccccagggcgtgaccgtgctgcccggccccggccagcagctgatgcaggccgccatgcccaacggcaccgtgcagagattcctgttcacccccctggccaccaccgccaccaccgccagcaccaccaccaccaccgtgagcaccaccgccgccggcaccggcgagcagagacagagcaagctgagcccccagatgcaggtgcaccaggacaagaccctgccccccgcccagagcagcagcgtgggccccgccgaggcccagccccagaccgcccagcccagcgcccagccccagccccagacccagccccagagccccgcccagcccgaggtgcagacccagcccgaggtgcagacccagaccaccgtgagcagccacgtgcccagcgaggcccagcccacccacgcccagagcagcaagccccaggtggccgcccagagccagccccagagcaacgtgcagggccagagccccgtgagagtgcagagccccagccagaccagaatcagacccagcacccccagccagctgagccccggccagcagagccaggtgcagaccaccaccagccagcccatccccatccagccccacaccagcctgcagatccccagccagggccagccccagagccagccccaggtgcagagcagcacccagaccctgagcagcggccagaccctgaaccaggtgaccgtgagcagccccagcagaccccagctgcagatccagcagccccagccccaggtgatcgccgtgccccagctgcagcagcaggtgcaggtgctgagccagatccagagccaggtggtggcccagatccaggcccagcagagcggcgtgccccagcagatcaagctgcagctgcccatccagatccagcagagcagcgccgtgcagacccaccagatccagaacgtggtgaccgtgcaggccgccagcgtgcaggagcagctgcagagagtgcagcagctgagagaccagcagcagaagaagaagcagcagcagatcgagatcaagagagagcacaccctgcaggccagcaaccagagcgagatcatccagaagcaggtggtgatgaagcacaacgccgtgatcgagcacctgaagcagaagaagagcatgacccccgccgagagagaggagaaccagagaatgatcgtgtgcaaccaggtgatgaagtacatcctggacaagatcgacaaggaggagaagcaggccgccaagaagagaaagagagaggagagcgtggagcagaagagaagcaagcagaacgccaccaagctgagcgccctgctgttcaagcacaaggagcagctgagagccgagatcctgaagaagagagccctgctggacaaggacctgcagatcgaggtgcaggaggagctgaagagagacctgaagatcaagaaggagaaggacctgatgcagctggcccaggccaccgccgtggccgccccctgcccccccgtgacccccgccccccccgccccccccgcccccccccccagccccccccccccccccgccgtgcagcacaccggcctgctgagcacccccaccctgcccgccgccagccagaagagaaagagagaggaggagaaggacagcagcagcaagagcaagaagaagaagatgatcagcaccaccagcaaggagaccaagaaggacaccaagctgtactgcatctgcaagaccccctacgacgagagcaagttctacatcggctgcgacagatgccagaactggtaccacggcagatgcgtgggcatcctgcagagcgaggccgagctgatcgacgagtacgtgtgcccccagtgccagagcaccgaggacgccatgaccgtgctgacccccctgaccgagaaggactacgagggcctgaagagagtgctgagaagcctgcaggcccacaagatggcctggcccttcctggagcccgtggaccccaacgacgcccccgactactacggcgtgatcaaggagcccatggacctggccaccatggaggagagagtgcagagaagatactacgagaagctgaccgagttcgtggccgacatgaccaagatcttcgacaactgcagatactacaaccccagcgacagccccttctaccagtgcgccgaggtgctggagagcttcttcgtgcagaagctgaagggcttcaaggccagcagaagccacaacaacaagctgcagagcaccgccagctag

SEQ ID NO: 9784 - DNA, 390 bp, Artificial Sequence
  Description of Artificial Sequence: Synthetic coding sequence
atggccgaccccagagtgagacagatcaagatcaagaccggcgtggtgaagagactggtgaaggagaaggtgatgtacgagaaggaggccaagcagcaggaggagaagatcgagaagatgagagccgaggacggcgagaactacgacatcaagaagcaggccgagatcctgcaggagagcagaatgatgatccccgactgccagagaagactggaggccgcctacctggacctgcagagaatcctggtgagcaaggacttctgcgtgatgttcaagttcttcttcagcatccagtacatggagagccagaagttcaagtacctgaccctgagaaccagctggcagtacttcctgttcacctgccccctgtacagatacatcctgaagtag

SEQ ID NO: 9785 - DNA, 582 bp, Artificial Sequence
  Description of Artificial Sequence: Synthetic coding sequence
atgagcgacgacgacagcagagccagcaccagcagcagcagcagcagcagcagcaaccagcagaccgagaaggagaccaacacccccaagaagaaggagagcaaggtgagcatgagcaagaacagcaagctgctgagcaccagcgccaagagaatccagaaggagctggccgacatcaccctggaccccccccccaactgcagcgccggccccaagggcgacaacatctacgagtggagaagcaccatcctgggcccccccggcagcgtgtacgagggcggcgtgttcttcctggacatcaccttcacccccgagtaccccttcaagccccccaaggtgaccttcagaaccagaatctaccactgcaacatcaacagccagggcgtgatctgcctggacatcctgaaggacaactggagccccgccctgaccatcagcaaggtgctgctgagcatctgcagcctgctgaccgactgcaaccccgccgaccccctggtgggcagcatcgccacccagtacatgaccaacagagccgagcacgacagaatggccagacagtggaccaagagatacgccacctag

SEQ ID NO: 9786 - DNA, 1395 bp, Artificial Sequence
  Description of Artificial Sequence: Synthetic coding sequence
atgagcctgcagttcagcaacggcagcagacacgtgtgcctgagaagcggcgccggcagcgtgagacccctgaacggcggcgccggcttcgccggcagcagcgcctgcggcggcagcgtggccggcagcgagttcagctgcgccctgggcggcggcctgggcagcgtgcccggcggcagccacgccggcggcgccctgggcaacgccgcctgcatcggcttcgccggcagcgagggcggcctgctgagcggcaacgagaaggtgaccatgcagaacctgaacgacagactggccagctacctggacaacgtgagagccctggaggaggccaacgccgagctggagagaaagatcaagggctggtacgagaagtacggccccggcagctgcagaggcctggaccacgactacagcagataccacctgaccatcgaggacctgaagaacaagatcatcagcagcaccaccaccaacgccaacgtgatcctgcagatcgacaacgccagactggccgccgacgacttcagactgaagtacgagaacgagctgaccctgcaccagaacgtggaggccgacatcaacggcctgagaagagtgctggacgagctgaccctgtgcagaaccgaccaggagctgcagtacgagagcctgagcgaggagatgacctacctgaagaagaaccacgaggaggagatgaaggccctgcagtgcgccgccggcggcaacgtgaacgtggagatgaacgccgcccccggcgtggacctggccgtgctgctgaacaacatgagagccgagtacgaggccctggccgagcagaacagaaaggacgccgaggcctggttcaacgagaagagcgccagcctgcagcagcagatcagccacgacagcggcgccgccaccttcgccagaagccagctgaccgagatgagaagaaccctgcagaccctggagatccagctgcagagcctgatggccaccaagcacagcctggagtgcagcctgaccgagaccgagagcaactactgcacccagctggcccagatccaggcccagatcggcgccctggaggagcagctgcaccaggtgagaaccgagaccgagggccagaagctggagtacgagcacctgctggacgtgaaggtgcacctggagaaggagatcgagacctactgcagactgatcgacggcgacggcaacagctgcagcaagagcaagggcttcggcagcggcagccccggcaacagcagcaaggacctgagcaagaccaccctggtgaagaccgtggtggaggagctggaccagagaggcaaggtgctgagcagcagaatccacagcatcgaggagaagaccagcaagatgaccaacggcaagaccgagcagagagtgcccttctag

SEQ ID NO: 9787 - DNA, 2013 bp, Artificial Sequence
  Description of Artificial Sequence: Synthetic coding sequence
atggaggagttcagaagaagctacagcagactgtgcagagagagcggcgccgagccccaggaggccgtgctgcagcagctgcaccagctgcccagaggcagactggacctggccacccagagcctgaccgtggagacctgcagagccctgggcaagctgctgcccagagagaccctgtgcaccgagctggtgctgagcgactgcatgctgagcgaggagggcgccaccctgctgctgagaggcctgtgcgccaacaccgtgctgagattcctggacctgaagggcaacaacctgagagccgccggcgccgaggccctgggcaagctgctgcagcagaacaagagcatccagagcctgaccctggagtggaacagcctgggcacctgggacgacgccttcgccaccttctgcggcggcctggccgccaacggcgccctgcagagactggacctgagaaacaaccagatcagccacaagggcgccgaggagctggccctggccctgaagggcaacaccaccctgcagcagctggacctgagatggaacaacgtgggcctgctgggcggcagagccctgatgaactgcctgcccagcaacagaaccctgtggagactggacctggccggcaacaacatccccggcgacgtgctgagagccgtggagcaggccatgggccacagccaggacagactgaccaccttccaggagaaccaggccagaacccacgtgctgagcaaggaggtgcagcacctgagagaggagaagagcaagcagttcctggacctgatggagaccatcgacaagcagagagaggagatggccaagagcagcagagccagcgccgccagagtgggccagctgcaggaggccctgaacgagagacacagcatcatcaacgccctgaaggccaagctgcagatgaccgaggccgccctggccctgagcgagcagaaggcccaggacctgggcgagctgctggccaccgccgagcaggagcagctgagcctgagccagagacaggccaaggagctgaagctggagcagcaggaggccgccgagagagagagcaagctgctgagagacctgagcgccgccaacgagaagaacctgctgctgcagaaccaggtggacgagctggagagaaagttcagatgccagcaggagcagctgttccagaccagacaggagatgaccagcatgagcgccgagctgaagatgagagccatccaggccgaggagagactggacatggagaagagaagatgcagacagagcctggaggacagcgagagcctgagaatcaaggaggtggagcacatgaccagacacctggaggagagcgagaaggccatgcaggagagagtgcagagactggaggccgccagactgagcctggaggaggagctgagcagagtgaaggccgccgccctgagcgagagaggccaggccgaggaggagctgatcaaggccaagagccaggccagactggaggagcagcagagactggcccacctggaggacaagctgagactgctggcccaggccagagacgaggcccagggcgcctgcctgcagcagaagcaggtggtggccgaggcccagaccagagtgagccagctgggcctgcaggtggagggcctgagaagaagactggaggagctgcagcaggagctgagcctgaaggaccaggagagagtggccgaggtgagcagagtgagagtggagctgcaggagcagaacggcagactgcaggccgagctggccgcccaggaggccctgagagagaaggccgccgccctggagagacagctgaaggtgatggccagcgaccacagagaggccctgctggacagagagagcgagaacgccagcctgagagagaagctgagactgagagaggccgagatcgccagaatcagagacgaggaggcccagagagccagcttcctgcagaacgccgtgctggcctacgtgcaggccagccccgtgagaaccctgagcccccccaagtag

SEQ ID NO: 9788 - DNA, 1782 bp, Artificial Sequence
  Description of Artificial Sequence: Synthetic coding sequence
atggagcccgccaccgcccccagacccgacatggcccccgagctgacccccgaggaggagcaggccaccaagcagttcctggaggagatcaacaagtggaccgtgcagtacaacgtgagccccctgagctggaacgtggccgtgaagttcctgatggccagaaagttcgacgtgctgagagccatcgagctgttccacagctacagagagaccagaagaaaggagggcatcgtgaagctgaagccccacgaggagcccctgagaagcgagatcctgagcggcaagttcaccatcctgaacgtgagagaccccaccggcgccagcatcgccctgttcaccgccagactgcaccacccccacaagagcgtgcagcacgtggtgctgcaggccctgttctacctgctggacagagccgtggacagcttcgagacccagagaaacggcctggtgttcatctacgacatgtgcggcagcaactacgccaacttcgagctggacctgggcaagaaggtgctgaacctgctgaagggcgccttccccgccagactgaagaaggtgctgatcgtgggcgcccccatctggttcagagtgccctacagcatcatcagcctgctgctgaaggacaaggtgagagagagaatccagatcctgaagaccagcgaggtgacccagcacctgcccagagagtgcctgcccgagaacctgggcggctacgtgaagatcgacctggccacctggaacttccagttcctgccccaggtgaacggccaccccgaccccttcgacgagatcatcctgttcagcctgccccccgccctggactgggacagcgtgcacgtgcccggcccccacgccatgaccatccaggagctggtggactacgtgaacgccagacagaagcagggcatctacgaggagtacgaggacatcagaagagagaaccccgtgggcaccttccactgcagcatgagccccggcaacctggagaagaacagatacggcgacgtgccctgcctggaccagaccagagtgaagctgaccaagagaagcggccacacccagaccgactacatcaacgccagcttcatggacggctacaagcagaagaacgcctacatcggcacccagggccccctggagaacacctacagagacttctggctgatggtgtgggagcagaaggtgctggtgatcgtgatgaccaccagattcgaggagggcggcagaagaaagtgcggccagtactggcccctggagaaggacagcagaatcagattcggcttcctgaccgtgaccaacctgggcgtggagaacatgaaccactacaagaagaccaccctggagatccacaacaccgaggagagacagaagagacaggtgacccacttccagttcctgagctggcccgactacggcgtgcccagcagcgccgccagcctgatcgacttcctgagagtggtgagaaaccagcagagcctggccgtgagcaacatgggcgccagaagcaagggccagtgccccgagccccccatcgtggtgcactgcagcgccggcatcggcagaaccggcaccttctgcagcctggacatctgcctggcccagctggaggagctgggcaccctgaacgtgttccagaccgtgagcagaatgagaacccagagagccttcagcatccagacccccgagcagtactacttctgctacaaggccatcctggagttcgccgagaaggagggcatggtgagcagcggccagaacctgctggccgtggagagccagtag

SEQ ID NO: 9789 - DNA, 1884 bp, Artificial Sequence
  Description of Artificial Sequence: Synthetic coding sequence
atggagggcctggccggctacgtgtacaaggccgccagcgagggcaaggtgctgaccctggccgccctgctgctgaacagaagcgagagcgacatcagatacctgctgggctacgtgagccagcagggcggccagagaagcacccccctgatcatcgccgccagaaacggccacgccaaggtggtgagactgctgctggagcactacagagtgcagacccagcagaccggcaccgtgagattcgacggctacgtgatcgacggcgccaccgccctgtggtgcgccgccggcgccggccacttcgaggtggtgaagctgctggtgagccacggcgccaacgtgaaccacaccaccgtgaccaacagcacccccctgagagccgcctgcttcgacggcagactggacatcgtgaagtacctggtggagaacaacgccaacatcagcatcgccaacaagtacgacaacacctgcctgatgatcgccgcctacaagggccacaccgacgtggtgagatacctgctggagcagagagccgaccccaacgccaaggcccactgcggcgccaccgccctgcacttcgccgccgaggccggccacatcgacatcgtgaaggagctgatcaagtggagagccgccatcgtggtgaacggccacggcatgacccccctgaaggtggccgccgagagctgcaaggccgacgtggtggagctgctgctgagccacgccgactgcgacagaagaagcagaatcgaggccctggagctgctgggcgccagcttcgccaacgacagagagaactacgacatcatcaagacctaccactacctgtacctggccatgctggagagattccaggacggcgacaacatcctggagaaggaggtgctgccccccatccacgcctacggcaacagaaccgagtgcagaaacccccaggagctggagagcatcagacaggacagagacgccctgcacatggagggcctgatcgtgagagagagaatcctgggcgccgacaacatcgacgtgagccaccccatcatctacagaggcgccgtgtacgccgacaacatggagttcgagcagtgcatcaagctgtggctgcacgccctgcacctgagacagaagggcaacagaaacacccacaaggacctgctgagattcgcccaggtgttcagccagatgatccacctgaacgagaccgtgaaggcccccgacatcgagtgcgtgctgagatgcagcgtgctggagatcgagcagagcatgaacagagtgaagaacatcagcgacgccgacgtgcacaacgccatggacaactacgagtgcaacctgtacaccttcctgtacctggtgtgcatcagcaccaagacccagtgcagcgaggaggaccagtgcaagatcaacaagcagatctacaacctgatccacctggaccccagaaccagagagggcttcaccctgctgcacctggccgtgaacagcaacacccccgtggacgacttccacaccaacgacgtgtgcagcttccccaacgccctggtgaccaagctgctgctggactgcggcgccgaggtgaacgccgtggacaacgagggcaacagcgccctgcacatcatcgtgcagtacaacagacccatcagcgacttcctgaccctgcacagcatcatcatcagcctggtggaggccggcgcccacaccgacatgaccaacaagcagaacaagacccccctggacaagagcaccaccggcgtgagcgagatcctgctgaagacccagatgaagatgagcctgaagtgcctggccgccagagccgtgagagccaacgacatcaactaccaggaccagatccccagaaccctggaggagttcgtgggcttccactag

SEQ ID NO: 9790 - DNA, 378 bp, Artificial Sequence
  Description of Artificial Sequence: Synthetic coding sequence
atgcccagcgagaagaccttcaagcagagaagaaccttcgagcagagagtggaggacgtgagactgatcagagagcagcaccccaccaagatccccgtgatcatcgagagatacaagggcgagaagcagctgcccgtgctggacaagaccaagttcctggtgcccgaccacgtgaacatgagcgagctgatcaagatcatcagaagaagactgcagctgaacgccaaccaggccttcttcctgctggtgaacggccacagcatggtgagcgtgagcacccccatcagcgaggtgtacgagagcgagaaggacgaggacggcttcctgtacatggtgtgcgccagccaggagaccttcggcatgaagctgagcgtgtag

SEQ ID NO: 9791 - DNA, 3786 bp, Artificial Sequence
  Description of Artificial Sequence: Synthetic coding sequence
atgggcaccggcgacttcatctgcatcagcatgaccggcggcgccccctggggcttcagactgcagggcggcaaggagcagaagcagcccctgcaggtggccaagatcagaaaccagagcaaggccagcggcagcggcctgtgcgagggcgacgaggtggtgagcatcaacggcaacccctgcgccgacctgacctaccccgaggtgatcaagctgatggagagcatcaccgacagcctgcagatgctgatcaagagacccagcagcggcatcagcgaggccctgatcagcgagaacgagaacaagaacctggagcacctgacccacggcggctacgtggagagcaccaccctgcagatcagacccgccaccaagacccagtgcaccgagttcttcctggcccccgtgaagaccgaggtgcccctggccgagaaccagagaagcggccccgactgcgccggcagcctgaaggaggagaccggccccagctaccagagagccccccagatgcccgacagccagagaggcagagtggccgaggagctgatcctgagagagaaggtggaggccgtgcagcccggccccgtggtggagctgcagctgagcctgagccaggagagacacaagggcgccagcggccccctggtggccctgcccggcgccgagaagagcaagagccccgaccccgaccccaacctgagccacgacagaatcgtgcacatcaacagcatccccaccaacgagaaggccgaccccttcctgagaagcagcaagatcatccagatcagcagcggcagagagctgagagtgatccaggagagcgaggccggcgacgccggcctgcccagagtggaggtgatcctggactgcagcgacagacagaagaccgagggctgcagactgcaggccggcaaggagtgcgtggacagccccgtggagggcggccagagcgaggccccccccagcctggtgagcttcgccgtgagcagcgagggcaccgagcagggcgaggaccccagaagcgagaaggaccacagcagaccccacaagcacagagccagacacgccagactgagaagaagcgagagcctgagcgagaagcaggtgaaggaggccaagagcaagtgcaagagcatcgccctgctgctgaccgacgcccccaaccccaacagcaagggcgtgctgatgttcaagaagagaagaagaagagccagaaagtacaccctggtgagctacggcaccggcgagctggagagagaggccgacgaggaggaggagggcgacaaggaggacacctgcgaggtggccttcctgggcgccagcgagagcgaggtggacgaggagctgctgagcgacgtggacgacaacacccaggtggtgaacttcgactgggacagcggcctggtggacatcgagaagaagctgaacagaggcgacaagatggagatgctgcccgacaccaccggcaagggcgccctgatgttcgccaagagaagagagagaatggaccagatcaccgcccagaaggaggaggacaaggtgggcggcacccccagcagagagcaggacgccgcccagaccgacggcctgagaaccaccaccagctaccagagaaaggaggaggagagcgtgagaacccagagcagcgtgagcaagagctacatcgaggtgagccacggcctgggccacgtgccccagcagaacggcttcagcggcaccagcgagaccgccaacatccagagaatggtgcccatgaacagaaccgccaagcccttccccggcagcgtgaaccagcccgccacccccttcagccccaccagaaacatgaccagccccatcgccgacttccccgccccccccccctacagcgccgtgacccccccccccgacgccttcagcagaggcgtgagcagccccatcgccggccccgcccagccccccccctggccccagcccgccccctggagccagcccgccttctacgacagcagcgagagaatcgccagcagagacgagagaatcagcgtgcccgccaagagaaccggcatcctgcaggaggccaagagaagaagcaccaccaagcccatgttcaccttcaaggagcccaaggtgagccccaaccccgagctgctgagcctgctgcagaacagcgagggcaagagaggcaccggcgccggcggcgacagcggccccgaggaggactacctgagcctgggcgccgaggcctgcaacttcatgcagagcagcagcgccaagcagaagacccccccccccgtggcccccaagcccgccgtgaagagcagcagcagccagcccgtgacccccgtgagccccgtgtggagccccggcgtggcccccacccagccccccgccttccccaccagcaaccccagcaagggcaccgtggtgagcagcatcaagatcgcccagcccagctacccccccgccagacccgccagcaccctgaacgtggccggccccttcaagggcccccaggccgccgtggccagccagaactacacccccaagcccaccgtgagcacccccaccgtgaacgccgtgcagcccggcgccgtgggccccagcaacgagctgcccggcatgagcggcagaggcgcccagctgttcgccaagagacagagcagaatggagaagtacgtggtggacagcgacaccgtgcaggcccacgccgccagagcccagagccccacccccagcctgcccgccagctggaagtacagcagcaacgtgagagcccccccccccgtggcctacaaccccatccacagccccagctaccccctggccgccctgaagagccagcccagcgccgcccagcccagcaagatgggcaagaagaagggcaagaagcccctgaacgccctggacgtgatgaagcaccagccctaccagctgaacgccagcctgttcaccttccagccccccgacgccaaggacggcctgccccagaagagcagcgtgaaggtgaacagcgccctggccatgaagcaggccctgccccccagacccgtgaacgccgccagccccaccaacgtgcaggccagcagcgtgtacagcgtgcccgcctacaccagcccccccagcttcttcgccgaggccagcagccccgtgagcgccagccccgtgcccgtgggcatccccaccagccccaagcaggagagcgccagcagcagctacttcgtggcccccagacccaagttcagcgccaagaagagcggcgtgaccatccaggagagcggcagaagcctgagcctgcccggcagaagcgtgcccccccccatcagcaccagcccctgggtgtaccagcccacctacagctacagcagcaagcccaccgacggcctggagaaggccaacaagagacccaccccctgggaggccgccgccaagagccccctgggcctggtggacgacgccttccagcccagaaacatccaggagagcatcgtggccaacgtggtgagcgccgccagaagaaaggtgctgcccggcccccccgaggactggaacgagagactgagctacatcccccagacccagaaggcctacatgggcagctgcggcagacaggagtacaacgtgaccgccaacaacaacatgagcaccaccagccagtacggcagccagctgccctacgcctactacagacaggccagcagaaacgacagcgccatcatgagcatggagaccagaagcgactactgcctgcccgtggccgactacaactacaacccccaccccagaggctggagaagacagacctag

SEQ ID NO: 9792 - DNA, 1146 bp, Artificial Sequence
  Description of Artificial Sequence: Synthetic coding sequence
atgagctggaccgtgcccgtggtgagagccagccagagagtgagcagcgtgggcgccaacttcctgtgcctgggcatggccctgtgccccagacaggccaccagaatccccctgaacggcacctggctgttcacccccgtgagcaagatggccaccgtgaagagcgagctgatcgagagattcaccagcgagaagcccgtgcaccacagcaaggtgagcatcatcggcaccggcagcgtgggcatggcctgcgccatcagcatcctgctgaagggcctgagcgacgagctggccctggtggacctggacgaggacaagctgaagggcgagaccatggacctgcagcacggcagccccttcaccaagatgcccaacatcgtgtgcagcaaggactacttcgtgaccgccaacagcaacctggtgatcatcaccgccggcgccagacaggagaagggcgagaccagactgaacctggtgcagagaaacgtggccatcttcaagctgatgatcagcagcatcgtgcagtacagcccccactgcaagctgatcatcgtgagcaaccccgtggacatcctgacctacgtggcctggaagctgagcgccttccccaagaacagaatcatcggcagcggctgcaacctggacaccgccagattcagattcctgatcggccagaagctgggcatccacagcgagagctgccacggctggatcctgggcgagcacggcgacagcagcgtgcccgtgtggagcggcgtgaacatcgccggcgtgcccctgaaggacctgaacagcgacatcggcaccgacaaggaccccgagcagtggaagaacgtgcacaaggaggtgaccgccaccgcctacgagatcatcaagatgaagggctacaccagctgggccatcggcctgagcgtggccgacctgaccgagagcatcctgaagaacctgagaagaatccaccccgtgagcaccatcatcaagggcctgtacggcatcgacgaggaggtgttcctgagcatcccctgcatcctgggcgagaacggcatcaccaacctgatcaagatcaagctgacccccgaggaggaggcccacctgaagaagagcgccaagaccctgtgggagatccagaacaagctgaagctgtag

SEQ ID NO: 9793 - DNA, 861 bp, Artificial Sequence
  Description of Artificial Sequence: Synthetic coding sequence
atgatggccacccccaaccagaccgcctgcaacgccgagagccccgtggccctggaggaggccaagaccagcggcgcccccggcagcccccagaccccccccgagagacacgacagcggcggcagcctgcccctgacccccagaatggagagccacagcgaggacgaggacctggccggcgccgtgggcggcctgggctggaacagcagaagccccagaacccagagccccggcggctgcagcgccgaggccgtgctggccagaaagaagcacagaagaagacccagcaagagaaagagacactggagaccctacctggagctgagctgggccgagaagcagcagagagacgagagacagagccagagagccagcagagtgagagaggagatgttcgccaagggccagcccgtggccccctacaacaccacccagttcctgatgaacgacagagaccccgaggagcccaacctggacgtgccccacggcatcagccaccccggcagcagcggcgagagcgaggccggcgacagcgacggcagaggcagagcccacggcgagttccagagaaaggacttcagcgagacctacgagagattccacaccgagagcctgcagggcagaagcaagcaggagctggtgagagactacctggagctggagaagagactgagccaggccgaggaggagaccagaagactgcagcagctgcaggcctgcaccggccagcagagctgcagacaggtggaggagctggccgccgaggtgcagagactgagaaccgagaaccagagactgagacaggagaaccagatgtggaacagagagggctgcagatgcgacgaggagcccggcacctag

SEQ ID NO: 9794 - DNA, 1206 bp, Artificial Sequence; identical to SEQ ID NO: 9763
  Description of Artificial Sequence: Synthetic coding sequence

SEQ ID NO: 9795 - DNA, 1728 bp, Artificial Sequence
  Description of Artificial Sequence: Synthetic coding sequence
atggccatggcccccagccccagcctggtgcaggtgtacaccagccccgccgccgtggccgtgtgggagtggcaggacggcctgggcacctggcacccctacagcgccaccgtgtgcagcttcatcgagcagcagttcgtgcagcagaagggccagagattcggcctgggcagcctggcccacagcatccccctgggccaggccgaccccagcctggccccctacatcatcgacctgcccagctggacccagttcagacaggacaccggcaccatgagagccgtgagaagacacctgttcccccagcacagcgcccccggcagaggcgtggtgtgggagtggctgagcgacgacggcagctggaccgcctacgaggccagcgtgtgcgactacctggagcagcaggtggccagaggcaaccagctggtggacctggcccccctgggctacaactacaccgtgaactacaccacccacacccagaccaacaagaccagcagcttctgcagaagcgtgagaagacaggccggccccccctaccccgtgaccaccatcatcgccccccccggccacaccggcgtggcctgcagctgccaccagtgcctgagcggcagcagaaccggccccgtgagcggcagatacagacacagcatgaccaacctgcccgcctaccccgtgccccagcaccccccccacagaaccgccagcgtgttcggcacccaccaggccttcgccccctacaacaagcccagcctgagcggcgccagaagcgcccccagactgaacaccaccaacgcctggggcgccgccccccccagcctgggcagccagcccctgtacagaagcagcctgagccacctgggcccccagcacctgccccccggcagcagcaccagcggcgccgtgagcgccagcctgcccagcggccccagcagcagccccggcagcgtgcccgccaccgtgcccatgcagatgcccaagcccagcagagtgcagcaggccctggccggcgccacccccaagcccgagcccgagcccgagcaggtgatcaagaactacaccgaggagctgaaggtgccccccgacgaggactgcatcatctgcatggagaagctgagcaccgccagcggctacagcgacgtgaccgacagcaaggccatcggcagcctggccgtgggccacctgaccaagtgcagccacgccttccacctgctgtgcctgctggccatgtactgcaacggcaacaaggacggcagcctgcagtgccccagctgcaagaccatctacggcgagaagaccggcacccagccccagggcaagatggaggtgctgagattccagatgagcctgcccggccacgaggactgcggcaccatcctgatcgtgtacagcatcccccacggcatccagggccccgagcaccccaaccccggcaagcccttcaccgccagaggcttccccagacagtgctacctgcccgacaacgcccagggcagaaaggtgctggagctgctgaaggtggcctggaagagaagactgatcttcaccgtgggcaccagcagcaccaccggcgagaccgacaccgtggtgtggaacgagatccaccacaagaccgagatggacagaaacatcaccggccacggctaccccgaccccaactacctgcagaacgtgctggccgagctggccgcccagggcgtgaccgaggactgcctggagcagcagtag

SEQ ID NO: 9796 - DNA, 1095 bp, Artificial Sequence
  Description of Artificial Sequence: Synthetic coding sequence
atggagcacaacggcagcgccagcaacgccgacaagatccaccagaacagactgagcagcgtgaccgaggacgaggaccaggacgccgccctgaccatcgtgaccgtgctggacaaggtggccagcatcgtggacagcgtgcaggccagccagaagagaatcgaggagagacacagagagatggagaacgccatcaagagcgtgcagatcgacctgctgaagctgagccagagccacagcaacaccggccacatcatcaacaagctgttcgagaagaccagaaaggtgagcgcccacatcaaggacgtgaaggccagagtggagaagcagcagatccacgtgaagaaggtggaggtgaagcaggaggagatcatgaagaagaacaagttcagagtggtgatcttccaggagaagttcagatgccccaccagcctgagcgtggtgaaggacagaaacctgaccgagaaccaggaggaggacgacgacgacatcttcgacccccccgtggacctgagcagcgacgaggagtactacgtggaggagagcagaagcgccagactgagaaagagcggcaaggagcacatcgacaacatcaagaaggccttcagcaaggagaacatgcagaagaccagacagaacctggacaagaaggtgaacagaatcagaaccagaatcgtgacccccgagagaagagagagactgagacagagcggcgagagactgagacagagcggcgagagactgagacagagcggcgagagattcaagaagagcatcagcaacgccgcccccagcaaggaggccttcaagatgagaagcctgagaaagggcaaggacagaaccgtggccgagggcgaggagtgcgccagagagatgggcgtggacatcatcgccagaagcgagagcctgggccccatcagcgagctgtacagcgacgagctgagcgagcccgagcacgaggccgccagacccgtgtaccccccccacgagggcagagagatccccacccccgagcccctgaaggtgaccttcaagagccaggtgaaggtggaggacgacgagagcctgctgctggacctgaagcacagcagctag

SEQ ID NO: 9797 - DNA, 1266 bp, Artificial Sequence
  Description of Artificial Sequence: Synthetic coding sequence
atgcccaccctgagcgtgttcatggacgtgcccctggcccacaagctggagggcagcctgctgaagacctacaagcaggacgactaccccaacaagatcttcctggcctacagagtgtgcatgaccaacgagggccacccctgggtgagcctggtggtgcagaagaccagactgcagatcagccaggaccccagcctgaactacgagtacctgcccaccatgggcctgaagagcttcatccaggccagcctggccctgctgttcggcaagcacagccaggccatcgtggagaacagagtgggcggcgtgcacaccgtgggcgacagcggcgccttccagctgggcgtgcagttcctgagagcctggcacaaggacgccagaatcgtgtacatcatcagcagccagaaggagctgcacggcctggtgttccaggacatgggcttcaccgtgtacgagtacagcgtgtgggaccccaagaagctgtgcatggaccccgacatcctgctgaacgtggtggagcagatcccccacggctgcgtgctggtgatgggcaacatcatcgactgcaagctgacccccagcggctgggccaagctgatgagcatgatcaagagcaagcagatcttccccttcttcgacatcccctgccagggcctgtacaccagcgacctggaggaggacaccagaatcctgcagtacttcgtgagccagggcttcgagttcttctgcagccagagcctgagcaagaacttcggcatctacgacgagggcgtgggcatgctggtggtggtggccgtgaacaaccagcagctgctgtgcgtgctgagccagctggagggcctggcccaggccctgtggctgaacccccccaacaccggcgccagagtgatcaccagcatcctgtgcaaccccgccctgctgggcgagtggaagcagagcctgaaggaggtggtggagaacatcatgctgaccaaggagaaggtgaaggagaagctgcagctgctgggcacccccggcagctggggccacatcaccgagcagagcggcacccacggctacctgggcctgaacagccagcaggtggagtacctggtgagaaagaagcacatctacatccccaagaacggccagatcaacttcagctgcatcaacgccaacaacatcaactacatcaccgagggcatcaacgaggccgtgctgctgaccgagagcagcgagatgtgcctgcccaaggagaagaagaccctgatcggcatcaagctgtag

SEQ ID NO: 9798 - DNA, 576 bp, Artificial Sequence
  Description of Artificial Sequence: Synthetic coding sequence
atgggcaagagctgcaaggtggtggtgtgcggccaggccagcgtgggcaagaccagcatcctggagcagctgctgtacggcaaccacgtggtgggcagcgagatgatcgagacccaggaggacatctacgtgggcagcatcgagaccgacagaggcgtgagagagcaggtgagattctacgacaccagaggcctgagagacggcgccgagctgcccagacactgcttcagctgcaccgacggctacgtgctggtgtacagcaccgacagcagagagagcttccagagagtggagctgctgaagaaggagatcgacaagagcaaggacaagaaggaggtgaccatcgtggtgctgggcaacaagtgcgacctgcaggagcagagaagagtggaccccgacgtggcccagcactgggccaagagcgagaaggtgaagctgtgggaggtgagcgtggccgacagaagaagcctgctggagcccttcgtgtacctggccagcaagatgacccagccccagagcaagagcgccttccccctgagcagaaagaacaagggcagcggcagcctggacggctag

SEQ ID NO: 9799 - DNA, 3207 bp, Artificial Sequence
  Description of Artificial Sequence: Synthetic coding sequence
atggtgagcagcgacagacccgtgagcctggaggacgaggtgagccacagcatgaaggagatgatcggcggctgctgcgtgtgcagcgacgagagaggctgggccgagaaccccctggtgtactgcgacggccacggctgcagcgtggccgtgcaccaggcctgctacggcatcgtgcaggtgcccaccggcccctggttctgcagaaagtgcgagagccaggagagagccgccagagtgagatgcgagctgtgcccccacaaggacggcgccctgaagagaaccgacaacggcggctgggcccacgtggtgtgcgccctgtacatccccgaggtgcagttcgccaacgtgagcaccatggagcccatcgtgctgcagagcgtgccccacgacagatacaacaagacctgctacatctgcgacgagcagggcagagagagcaaggccgccaccggcgcctgcatgacctgcaacaagcacggctgcagacaggccttccacgtgacctgcgcccagttcgccggcctgctgtgcgaggaggagggcaacggcgccgacaacgtgcagtactgcggctactgcaagtaccacttcagcaagctgaagaagagcaagagaggcagcaacagaagctacgaccagagcctgagcgacagcagcagccacagccaggacaagcaccacgagaaggagaagaagaagtacaaggagaaggacaagcacaagcagaagcacaagaagcagcccgagcccagccccgccctggtgcccagcctgaccgtgaccaccgagaagacctacaccagcaccagcaacaacagcatcagcggcagcctgaagagactggaggacaccaccgccagattcaccaacgccaacttccaggaggtgagcgcccacaccagcagcggcaaggacgtgagcgagaccagaggcagcgagggcaagggcaagaagagcagcgcccacagcagcggccagagaggcagaaagcccggcggcggcagaaaccccggcaccaccgtgagcgccgccagccccttcccccagggcagcttcagcggcacccccggcagcgtgaagagcagcagcggcagcagcgtgcagagcccccaggacttcctgagcttcaccgacagcgacctgagaaacgacagctacagccacagccagcagagcagcgccaccaaggacgtgcacaagggcgagagcggcagccaggagggcggcgtgaacagcttcagcaccctgatcggcctgcccagcaccagcgccgtgaccagccagcccaagagcttcgagaacagccccggcgacctgggcaacagcagcctgcccaccgccggctacaagagagcccagaccagcggcatcgaggaggagaccgtgaaggagaagaagagaaagggcaacaagcagagcaagcacggccccggcagacccaagggcaacaagaaccaggagaacgtgagccacctgagcgtgagcagcgccagccccaccagcagcgtggccagcgccgccggcagcatcaccagcagcagcctgcagaagagccccaccctgctgagaaacggcagcctgcagagcctgagcgtgggcagcagccccgtgggcagcgagatcagcatgcagtacagacacgacggcgcctgccccaccaccaccttcagcgagctgctgaacgccatccacaacggcatctacaacagcaacgacgtggccgtgagcttccccaacgtggtgagcggcagcggcagcagcacccccgtgagcagcagccacctgccccagcagagcagcggccacctgcagcaggtgggcgccctgagccccagcgccgtgagcagcgccgcccccgccgtggccaccacccaggccaacaccctgagcggcagcagcctgagccaggcccccagccacatgtacggcaacagaagcaacagcagcatggccgccctgatcgcccagagcgagaacaaccagaccgaccaggacctgggcgacaacagcagaaacctggtgggcagaggcagcagccccagaggcagcctgagccccagaagccccgtgagcagcctgcagatcagatacgaccagcccggcaacagcagcctggagaacctgccccccgtggccgccagcatcgagcagctgctggagagacagtggagcgagggccagcagttcctgctggagcagggcacccccagcgacatcctgggcatgctgaagagcctgcaccagctgcaggtggagaacagaagactggaggagcagatcaagaacctgaccgccaagaaggagagactgcagctgctgaacgcccagctgagcgtgcccttccccaccatcaccgccaaccccagccccagccaccagatccacaccttcagcgcccagaccgcccccaccaccgacagcctgaacagcagcaagagcccccacatcggcaacagcttcctgcccgacaacagcctgcccgtgctgaaccaggacctgaccagcagcggccagagcaccagcagcagcagcgccctgagcacccccccccccgccggccagagccccgcccagcagggcagcggcgtgagcggcgtgcagcaggtgaacggcgtgaccgtgggcgccctggccagcggcatgcagcccgtgaccagcaccatccccgccgtgagcgccgtgggcggcatcatcggcgccctgcccggcaaccagctggccatcaacggcatcgtgggcgccctgaacggcgtgatgcagacccccgtgaccatgagccagaaccccacccccctgacccacaccaccgtgccccccaacgccacccaccccatgcccgccaccctgaccaacagcgccagcggcctgggcctgctgagcgaccagcagagacagatcctgatccaccagcagcagttccagcagctgctgaacagccagcagctgacccccgagcagcaccaggccttcctgtaccagctgatgcagcaccaccaccagcagcaccaccagcccgagctgcagcagctgcagatccccggccccacccagatccccatcaacaacctgctggccggcacccaggccccccccctgcacaccgccaccaccaaccccttcctgaccatccacggcgacaacgccagccagaaggtggccagactgagcgacaagaccggccccgtggcccaggagaagagctag

SEQ ID NO: 9800 - DNA, 1353 bp, Artificial Sequence
  Description of Artificial Sequence: Synthetic coding sequence
atgagctgcctgatggtggagagatgcggcgagatcctgttcgagaaccccgaccagaacgccaagtgcgtgtgcatgctgggcgacatcagactgagaggccagaccggcgtgagagccgagagaagaggcagctaccccttcatcgacttcagactgctgaacagcaccacctacagcggcgagatcggcaccaagaagaaggtgaagagactgctgagcttccagagatacttccacgccagcagactgctgagaggcatcatcccccaggcccccctgcacctgctggacgaggactacctgggccaggccagacacatgctgagcaaggtgggcatgtgggacttcgacatcttcctgttcgacagactgaccaacggcaacagcctggtgaccctgctgtgccacctgttcaacacccacggcctgatccaccacttcaagctggacatggtgaccctgcacagattcctggtgatggtgcaggaggactaccacagccagaacccctaccacaacgccgtgcacgccgccgacgtgacccaggccatgcactgctacctgaaggagcccaagctggccagcttcctgacccccctggacatcatgctgggcctgctggccgccgccgcccacgacgtggaccaccccggcgtgaaccagcccttcctgatcaagaccaaccaccacctggccaacctgtaccagaacatgagcgtgctggagaaccaccactggagaagcaccatcggcatgctgagagagagcagactgctggcccacctgcccaaggagatgacccaggacatcgagcagcagctgggcagcctgatcctggccaccgacatcaacagacagaacgagttcctgaccagactgaaggcccacctgcacaacaaggacctgagactggaggacgcccaggacagacacttcatgctgcagatcgccctgaagtgcgccgacatctgcaacccctgcagaatctgggagatgagcaagcagtggagcgagagagtgtgcgaggagttctacagacagggcgagctggagcagaagttcgagctggagatcagccccctgtgcaaccagcagaaggacagcatccccagcatccagatcggcttcatgagctacatcgtggagcccctgttcagagagtgggcccacttcaccggcaacagcaccctgagcgagaacatgctgggccacctggcccacaacaaggcccagtggaagagcctgctgcccagacagcacagaagcagaggcagcagcggcagcggccccgaccacgaccacgccggccagggcaccgagagcgaggagcaggagggcgacagcccctag

SEQ ID NO: 9801 - DNA, 2268 bp, Artificial Sequence
  Description of Artificial Sequence: Synthetic coding sequence
atggccggctgcatccccgaggagaagacctacagaagattcctggagctgttcctgggcgagttcagaggcccctgcggcggcggcgagcccgagcccgagcccgagcccgagcccgagcccgagcccgagagcgagcccgagcccgagcccgagctggtggaggccgaggccgccgaggccagcgtggaggagcccggcgaggaggccgccaccgtggccgccaccgaggagggcgaccaggagcaggaccccgagcccgaggaggaggccgccgtggagggcgaggaggaggaggagggcgccgccaccgccgccgccgcccccggccacagcgccgtgccccccccccccccccagctgccccccctgccccccctgcccagacccctgagcgagagaatcaccagagaggaggtggagggcgagagcctggacctgtgcctgcagcagctgtacaagtacaactgccccagcttcctggccgccgccctggccagagccaccagcgacgaggtgctgcagagcgacctgagcgcccactacatccccaaggagaccgacggcaccgagggcaccgtggagatcgagaccgtgaagctggccagaagcgtgttcagcaagctgcacgagatctgctgcagctgggtgaaggacttccccctgagaagaagaccccagctgtactacgagaccagcatccacgccatcaagaacatgagaagaaagatggaggacaagcacgtgtgcatccccgacttcaacatgctgttcaacctggaggaccaggaggagcaggcctacttcgccgtgttcgacggccacggcggcgtggacgccgccatctacgccagcatccacctgcacgtgaacctggtgagacaggagatgttcccccacgaccccgccgaggccctgtgcagagccttcagagtgaccgacgagagattcgtgcagaaggccgccagagagagcctgagatgcggcaccaccggcgtggtgaccttcatcagaggcaacatgctgcacgtggcctgggtgggcgacagccaggtgatgctggtgagaaagggccaggccgtggagctgatgaagccccacaagcccgacagagaggacgagaagcagagaatcgaggccctgggcggctgcgtggtgtggttcggcgcctggagagtgaacggcagcctgagcgtgagcagagccatcggcgacgccgagcacaagccctacatctgcggcgacgccgacagcgccagcaccgtgctggacggcaccgaggactacctgatcctggcctgcgacggcttctacgacaccgtgaaccccgacgaggccgtgaaggtggtgagcgaccacctgaaggagaacaacggcgacagcagcatggtggcccacaagctggtggccagcgccagagacgccggcagcagcgacaacatcaccgtgatcgtggtgttcctgagagacatgaacaaggccgtgaacgtgagcgaggagagcgactggaccgagaacagcttccagggcggccaggaggacggcggcgacgacaaggagaaccacggcgagtgcaagagaccctggccccagcaccagtgcagcgcccccgccgacctgggctacgacggcagagtggacagcttcaccgacagaaccagcctgagccccggcagccagatcaacgtgctggaggaccccggctacctggacctgacccagatcgaggccagcaagccccacagcgcccagttcctgctgcccgtggagatgttcggccccggcgcccccaagaaggccaacctgatcaacgagctgatgatggagaagaagagcgtgcagagcagcctgcccgagtggagcggcgccggcgagttccccaccgccttcaacctgggcagcaccggcgagcagatctacagaatgcagagcctgagccccgtgtgcagcggcctggagaacgagcagttcaagagccccggcaacagagtgagcagactgagccacctgagacaccactacagcaagaagtggcacagattcagattcaaccccaagttctacagcttcctgagcgcccaggagcccagccacaagatcggcaccagcctgagcagcctgaccggcagcggcaagagaaacagaatcagaagcagcctgccctggagacagaacagctggaagggctacagcgagaacatgagaaagctgagaaagacccacgacatcccctgccccgacctgccctggagctacaagatcgagtag

SEQ ID NO: 9802 - DNA, 771 bp, Artificial Sequence
  Description of Artificial Sequence: Synthetic coding sequence
atggccagcagatacgacagagccatcaccgtgttcagccccgacggccacctgttccaggtggagtacgcccaggaggccgtgaagaagggcagcaccgccgtgggcatcagaggcaccaacatcgtggtgctgggcgtggagaagaagagcgtggccaagctgcaggacgagagaaccgtgagaaagatctgcgccctggacgaccacgtgtgcatggccttcgccgtgctgaccatcttcatcggcctgaccgccgacgccagagtggtgatcaacagagccagagtggagtgccagagccacaagctgaccgtggaggaccccgtgaccgtggagtacatcaccagattcatcgccaccctgaagcagaagtacacccagagcaacggcagaagacccttcggcatcagcgccctgatcgtgggcttcgacgacgacggcatcagcagactgtaccagaccgaccccagcggcacctaccacgcctggaaggccaacgccatcggcagaagcgccaagaccgtgagagagttcctggagaagaactacaccgaggacgccatcgccagcgacagcgaggccatcaagctggccatcaaggccctgctggaggtggtgcagagcggcggcaagaacatcgagctggccatcatcagaagaaaccagcccctgaagatgttcagcgccaaggaggtggagctgtacgtgaccgagatcgagaaggagaaggaggaggccgagaagaagaagagcaagaagagcgtgtag

SEQ ID NO: 9803 - DNA, 3108 bp, Artificial Sequence
  Description of Artificial Sequence: Synthetic coding sequence
atggcccccagactgcagctggagaaggccgcctggagatgggccgagaccgtgagacccgaggaggtgagccaggagcacatcgagaccgcctacagaatctggctggagccctgcatcagaggcgtgtgcagaagaaactgcaagggcaaccccaactgcctggtgggcatcggcgagcacatctggctgggcgagatcgacgagaacagcttccacaacatcgacgaccccaactgcgagagaagaaagaagaacagcttcgtgggcctgaccaacctgggcgccacctgctacgtgaacaccttcctgcaggtgtggttcctgaacctggagctgagacaggccctgtacctgtgccccagcacctgcagcgactacatgctgggcgacggcatccaggaggagaaggactacgagccccagaccatctgcgagcacctgcagtacctgttcgccctgctgcagaacagcaacagaagatacatcgaccccagcggcttcgtgaaggccctgggcctggacaccggccagcagcaggacgcccaggagttcagcaagctgttcatgagcctgctggaggacaccctgagcaagcagaagaaccccgacgtgagaaacatcgtgcagcagcagttctgcggcgagtacgcctacgtgaccgtgtgcaaccagtgcggcagagagagcaagctgctgagcaagttctacgagctggagctgaacatccagggccacaagcagctgaccgactgcatcagcgagttcctgaaggaggagaagctggagggcgacaacagatacttctgcgagaactgccagagcaagcagaacgccaccagaaagatcagactgctgagcctgccctgcaccctgaacctgcagctgatgagattcgtgttcgacagacagaccggccacaagaagaagctgaacacctacatcggcttcagcgagatcctggacatggagccctacgtggagcacaagggcggcagctacgtgtacgagctgagcgccgtgctgatccacagaggcgtgagcgcctacagcggccactacatcgcccacgtgaaggacccccagagcggcgagtggtacaagttcaacgacgaggacatcgagaagatggagggcaagaagctgcagctgggcatcgaggaggacctggccgagcccagcaagagccagaccagaaagcccaagtgcggcaagggcacccactgcagcagaaacgcctacatgctggtgtacagactgcagacccaggagaagcccaacaccaccgtgcaggtgcccgccttcctgcaggagctggtggacagagacaacagcaagttcgaggagtggtgcatcgagatggccgagatgagaaagcagagcgtggacaagggcaaggccaagcacgaggaggtgaaggagctgtaccagagactgcccgccggcgccgagccctacgagttcgtgagcctggagtggctgcagaagtggctggacgagagcacccccaccaagcccatcgacaaccacgcctgcctgtgcagccacgacaagctgcaccccgacaagatcagcatcatgaagagaatcagcgagtacgccgccgacatcttctacagcagatacggcggcggccccagactgaccgtgaaggccctgtgcaaggagtgcgtggtggagagatgcagaatcctgagactgaagaaccagctgaacgaggactacaagaccgtgaacaacctgctgaaggccgccgtgaagggcagcgacggcttctgggtgggcaagagcagcctgagaagctggagacagctggccctggagcagctggacgagcaggacggcgacgccgagcagagcaacggcaagatgaacggcagcaccctgaacaaggacgagagcaaggaggagagaaaggaggaggaggagctgaacttcaacgaggacatcctgtgcccccacggcgagctgtgcatcagcgagaacgagagaagactggtgagcaaggaggcctggagcaagctgcagcagtacttccccaaggcccccgagttccccagctacaaggagtgctgcagccagtgcaagatcctggagagagagggcgaggagaacgaggccctgcacaagatgatcgccaacgagcagaagaccagcctgcccaacctgttccaggacaagaacagaccctgcctgagcaactggcccgaggacaccgacgtgctgtacatcgtgagccagttcttcgtggaggagtggagaaagttcgtgagaaagcccaccagatgcagccccgtgagcagcgtgggcaacagcgccctgctgtgcccccacggcggcctgatgttcaccttcgccagcatgaccaaggaggacagcaagctgatcgccctgatctggcccagcgagtggcagatgatccagaagctgttcgtggtggaccacgtgatcaagatcaccagaatcgaggtgggcgacgtgaaccccagcgagacccagtacatcagcgagcccaagctgtgccccgagtgcagagagggcctgctgtgccagcagcagagagacctgagagagtacacccaggccaccatctacgtgcacaaggtggtggacaacaagaaggtgatgaaggacagcgcccccgagctgaacgtgagcagcagcgagaccgaggaggacaaggaggaggccaagcccgacggcgagaaggaccccgacttcaaccagagcaacggcggcaccaagagacagaagatcagccaccagaactacatcgcctaccagaagcaggtgatcagaagaagcatgagacacagaaaggtgagaggcgagaaggccctgctggtgagcgccaaccagaccctgaaggagctgaagatccagatcatgcacgccttcagcgtggcccccttcgaccagaacctgagcatcgacggcaagatcctgagcgacgactgcgccaccctgggcaccctgggcgtgatccccgagagcgtgatcctgctgaaggccgacgagcccatcgccgactacgccgccatggacgacgtgatgcaggtgtgcatgcccgaggagggcttcaagggcaccggcctgctgggccactag

SEQ ID NO: 9804 - DNA, 2382 bp, Artificial Sequence
  Description of Artificial Sequence: Synthetic coding sequence
atgctgatccagagcgagaagaagacccagctgagcaagaccgagagcgtgaaggagagcgagagcctgatggagttcgcccagcccgagatccagccccaggagttcctgaacagaagatacatgaccgaggtggactacagcaacaagcagggcgaggagcagccctgggaggccgactacgccagaaagcccaacctgcccaagagatgggacatgctgaccgagcccgacggccaggagaagaagcaggagagcttcaagagctgggaggccagcggcaagcaccaggaggtgagcaagcccgccgtgagcctggagcagagaaagcaggacaccagcaagctgagaagcaccctgcccgaggagcagaagaagcaggagatcagcaagagcaagcccagccccagccagtggaagcaggacacccccaagagcaaggccggctacgtgcaggaggagcagaagaagcaggagacccccaagctgtggcccgtgcagctgcagaaggagcaggaccccaagaagcagacccccaagagctggacccccagcatgcagagcgagcagaacaccaccaagagctggaccacccccatgtgcgaggagcaggacagcaagcagcccgagacccccaagagctgggagaacaacgtggagagccagaagcacagcctgaccagccagagccagatcagccccaagagctggggcgtggccaccgccagcctgatccccaacgaccagctgctgcccagaaagctgaacaccgagcccaaggacgtgcccaagcccgtgcaccagcccgtgggcagcagcagcaccctgcccaaggaccccgtgctgagaaaggagaagctgcaggacctgatgacccagatccagggcacctgcaacttcatgcaggagagcgtgctggacttcgacaagcccagcagcgccatccccaccagccagccccccagcgccacccccggcagccccgtggccagcaaggagcagaacctgagcagccagagcgacttcctgcaggagcccctgcaggccaccagcagccccgtgacctgcagcagcaacgcctgcctggtgaccaccgaccaggccagcagcggcagcgagaccgagttcatgaccagcgagacccccgaggccgccatcccccccggcaagcagcccagcagcctggccagccccaacccccccatggccaagggcagcgagcagggcttccagagcccccccgccagcagcagcagcgtgaccatcaacaccgcccccttccaggccatgcagaccgtgttcaacgtgaacgcccccctgccccccagaaaggagcaggagatcaaggagagcccctacagccccggctacaaccagagcttcaccaccgccagcacccagacccccccccagtgccagctgcccagcatccacgtggagcagaccgtgcacagccaggagaccgccaactaccaccccgacggcaccatccaggtgagcaacggcagcctggccttctaccccgcccagaccaacgtgttccccagacccacccagcccttcgtgaacagcagaggcagcgtgagaggctgcaccagaggcggcagactgatcaccaacagctacagaagccccggcggctacaagggcttcgacacctacagaggcctgcccagcatcagcaacggcaactacagccagctgcagttccaggccagagagtacagcggcgccccctacagccagagagacaacttccagcagtgctacaagagaggcggcaccagcggcggccccagagccaacagcagagccggctggagcgacagcagccaggtgagcagccccgagagagacaacgagaccttcaacagcggcgacagcggccagggcgacagcagaagcatgacccccgtggacgtgcccgtgaccaaccccgccgccaccatcctgcccgtgcacgtgtaccccctgccccagcagatgagagtggccttcagcgccgccagaaccagcaacctggcccccggcaccctggaccagcccatcgtgttcgacctgctgctgaacaacctgggcgagaccttcgacctgcagctgggcagattcaactgccccgtgaacggcacctacgtgttcatcttccacatgctgaagctggccgtgaacgtgcccctgtacgtgaacctgatgaagaacgaggaggtgctggtgagcgcctacgccaacgacggcgcccccgaccacgagaccgccagcaaccacgccatcctgcagctgttccagggcgaccagatctggctgagactgcacagaggcgccatctacggcagcagctggaagtacagcaccttcagcggctacctgctgtaccaggactag

SEQ ID NO: 9805 - DNA, 1083 bp, Artificial Sequence
  Description of Artificial Sequence: Synthetic coding sequence
atggaggagctgagccaggccctggccagcagcttcagcgtgagccaggacctgaacagcaccgccgccccccaccccagactgagccagtacaagagcaagtacagcagcctggagcagagcgagagaagaagaagactgctggagctgcagaagagcaagagactggactacgtgaaccacgccagaagactggccgaggacgactggaccggcatggagagcgaggaggagaacaagaaggacgacgaggagatggacatcgacaccgtgaagaagctgcccaagcactacgccaaccagctgatgctgagcgagtggctgatcgacgtgcccagcgacctgggccaggagtggatcgtggtggtgtgccccgtgggcaagagagccctgatcgtggccagcagaggcagcaccagcgcctacaccaagagcggctactgcgtgaacagattcagcagcctgctgcccggcggcaacagaagaaacagcaccgccaaggactacaccatcctggactgcatctacaacgaggtgaaccagacctactacgtgctggacgtgatgtgctggagaggccaccccttctacgactgccagaccgacttcagattctactggatgcacagcaagctgcccgaggaggagggcctgggcgagaagaccaagctgaaccccttcaagttcgtgggcctgaagaacttcccctgcacccccgagagcctgtgcgacgtgctgagcatggacttccccttcgaggtggacggcctgctgttctaccacaagcagacccactacagccccggcagcacccccctggtgggctggctgagaccctacatggtgagcgacgtgctgggcgtggccgtgcccgccggccccctgaccaccaagcccgactacgccggccaccagctgcagcagatcatggagcacaagaagagccagaaggagggcatgaaggagaagctgacccacaaggccagcgagaacggccactacgagctggagcacctgagcacccccaagctgaagggcagcagccacagccccgaccaccccggctgcctgatggagaactag

SEQ ID NO: 9806 - DNA, 525 bp, Artificial Sequence
  Description of Artificial Sequence: Synthetic coding sequence
ctgatccacaagcccctgaagagagccatcaccaccctgatggccggcatcctgagactggtggtgcagtggccccccggcagactgcagaccgtgaccaagggcgtggagagcctgatctgcaccgactggatcagacacaagttcaccagaagcagaatccccgagaaggtgttccaggccagccccgaggaccacgagaagtacggcggcgacccccagaacccccacaagctgcacatcgtgaccagaatcaagagcaccagaagaagaccctactgggagaaggacatcatcaagatgctgggcctggagaaggcccacaccccccaggtgcacaagaacatccccagcgtgaacgccaagctgaaggtggtgaagcacctgatcagaatcaagcccctgaagctgccccagggcctgcccgccgaggagaacatgagcaacacctgcctgaagagcaccggcgagctggtggtgcagtggcacctgaagcccgtggagcagaaggcccacgagagctag

SEQ ID NO: 9807 - DNA, 1434 bp, Artificial Sequence
  Description of Artificial Sequence: Synthetic coding sequence
atggccacctacacctgcatcacctgcagagtggccttcagagacgccgacatgcagagagcccactacaagaccgactggcacagatacaacctgagaagaaaggtggccagcatggcccccgtgaccgccgagggcttccaggagagagtgagagcccagagagccgtggccgaggaggagagcaagggcagcgccacctactgcaccgtgtgcagcaagaagttcgccagcttcaacgcctacgagaaccacctgaagagcagaagacacgtggagctggagaagaaggccgtgcaggccgtgaacagaaaggtggagatgatgaacgagaagaacctggagaagggcctgggcgtggacagcgtggacaaggacgccatgaacgccgccatccagcaggccatcaaggcccagcccagcatgagccccaagaaggccccccccgcccccgccaaggaggccagaaacgtggtggccgtgggcaccggcggcagaggcacccacgacagagaccccagcgagaagccccccagactgcagtggttcgagcagcaggccaagaagctggccaagcagcaggaggaggacagcgaggaggaggaggaggacctggacggcgacgactgggaggacatcgacagcgacgaggagctggagtgcgaggacaccgaggccatggacgacgtggtggagcaggacgccgaggaggaggaggccgaggagggcccccccctgggcgccatccccatcaccgactgcctgttctgcagccaccacagcagcagcctgatgaagaacgtggcccacatgaccaaggaccacagcttcttcatccccgacatcgagtacctgagcgacatcaagggcctgatcaagtacctgggcgagaaggtgggcgtgggcaagatctgcctgtggtgcaacgagaagggcaagagcttctacagcaccgaggccgtgcaggcccacatgaacgacaagagccactgcaagctgttcaccgacggcgacgccgccctggagttcgccgacttctacgacttcagaagcagctaccccgaccacaaggagggcgaggaccccaacaaggccgaggagctgcccagcgagaagaacctggagtacgacgacgagaccatggagctgatcctgcccagcggcgccagagtgggccacagaagcctgatgagatactacaagcagagattcggcctgagcagagccgtggccgtggccaagaacagaaaggccgtgggcagagtgctgcagcagtacagagccctgggctggaccggcagcaccggcgccgccctgatgagagagagagacatgcagtacgtgcagagaatgaagagcaagtggatgctgaagaccggcatgaagaacaacgccaccaagcagatgcacttcagagtgcaggtgagattctag

SEQ ID NO: 9808 - DNA, 2862 bp, Artificial Sequence
  Description of Artificial Sequence: Synthetic coding sequence
atgatcaccagcgccgccggcatcatcagcctgctggacgaggacgagccccagctgaaggagttcgccctgcacaagctgaacgccgtggtgaacgacttctgggccgagatcagcgagagcgtggacaagatcgaggtgctgtacgaggacgagggcttcagaagcagacagttcgccgccctggtggccagcaaggtgttctaccacctgggcgccttcgaggagagcctgaactacgccctgggcgccggcgacctgttcaacgtgaacgacaacagcgagtacgtggagaccatcatcgccaagtgcatcgaccactacaccaagcagtgcgtggagaacgccgacctgcccgagggcgagaagaagcccatcgaccagagactggagggcatcgtgaacaagatgttccagagatgcctggacgaccacaagtacaagcaggccatcggcatcgccctggagaccagaagactggacgtgttcgagaagaccatcctggagagcaacgacgtgcccggcatgctggcctacagcctgaagctgtgcatgagcctgatgcagaacaagcagttcagaaacaaggtgctgagagtgctggtgaagatctacatgaacctggagaagcccgacttcatcaacgtgtgccagtgcctgatcttcctggacgacccccaggccgtgagcgacatcctggagaagctggtgaaggaggacaacctgctgatggcctaccagatctgcttcgacctgtacgagagcgccagccagcagttcctgagcagcgtgatccagaacctgagaaccgtgggcacccccatcgccagcgtgcccggcagcaccaacaccggcaccgtgcccggcagcgagaaggacagcgacagcatggagaccgaggagaagaccagcagcgccttcgtgggcaagacccccgaggccagccccgagcccaaggaccagaccctgaagatgatcaagatcctgagcggcgagatggccatcgagctgcacctgcagttcctgatcagaaacaacaacaccgacctgatgatcctgaagaacaccaaggacgccgtgagaaacagcgtgtgccacaccgccaccgtgatcgccaacagcttcatgcactgcggcaccaccagcgaccagttcctgagagacaacctggagtggctggccagagccaccaactgggccaagttcaccgccaccgccagcctgggcgtgatccacaagggccacgagaaggaggccctgcagctgatggccacctacctgcccaaggacaccagccccggcagcgcctaccaggagggcggcggcctgtacgccctgggcctgatccacgccaaccacggcggcgacatcatcgactacctgctgaaccagctgaagaacgccagcaacgacatcgtgagacacggcggcagcctgggcctgggcctggccgccatgggcaccgccagacaggacgtgtacgacctgctgaagaccaacctgtaccaggacgacgccgtgaccggcgaggccgccggcctggccctgggcctggtgatgctgggcagcaagaacgcccaggccatcgaggacatggtgggctacgcccaggagacccagcacgagaagatcctgagaggcctggccgtgggcatcgccctggtgatgtacggcagaatggaggaggccgacgccctgatcgagagcctgtgcagagacaaggaccccatcctgagaagaagcggcatgtacaccgtggccatggcctactgcggcagcggcaacaacaaggccatcagaagactgctgcacgtggccgtgagcgacgtgaacgacgacgtgagaagagccgccgtggagagcctgggcttcatcctgttcagaacccccgagcagtgccccagcgtggtgagcctgctgagcgagagctacaacccccacgtgagatacggcgccgccatggccctgggcatctgctgcgccggcaccggcaacaaggaggccatcaacctgctggagcccatgaccaacgaccccgtgaactacgtgagacagggcgccctgatcgccagcgccctgatcatgatccagcagaccgagatcacctgccccaaggtgaaccagttcagacagctgtacagcaaggtgatcaacgacaagcacgacgacgtgatggccaagttcggcgccatcctggcccagggcatcctggacgccggcggccacaacgtgaccatcagcctgcagagcagaaccggccacacccacatgcccagcgtggtgggcgtgctggtgttcacccagttctggttctggttccccctgagccacttcctgagcctggcctacacccccacctgcgtgatcggcctgaacaaggacctgaagatgcccaaggtgcagtacaagagcaactgcaagcccagcaccttcgcctaccccgcccccctggaggtgcccaaggagaaggagaaggagaaggtgagcaccgccgtgctgagcatcaccgccaaggccaagaagaaggagaaggagaaggagaagaaggaggaggagaagatggaggtggacgaggccgagaagaaggaggagaaggagaagaagaaggagcccgagcccaacttccagctgctggacaaccccgccagagtgatgcccgcccagctgaaggtgctgaccatgcccgagacctgcagataccagcccttcaagcccctgagcatcggcggcatcatcatcctgaaggacaccagcgaggacatcgaggagctggtggagcccgtggccgcccacggccccaagatcgaggaggaggagcaggagcccgagccccccgagcccttcgagtacatcgacgactag

SEQ ID NO: 9809 - DNA, 984 bp, Artificial Sequence
  Description of Artificial Sequence: Synthetic coding sequence
atgtgcagcaccagcggctgcgacctggaggagatccccctggacgacgacgacctgaacaccatcgagttcaagatcctggcctactacaccagacaccacgtgttcaagagcacccccgccctgttcagccccaagctgctgagaaccagaagcctgagccagagaggcctgggcaactgcagcgccaacgagagctggaccgaggtgagctggccctgcagaaacagccagagcagcgagaaggccatcaacctgggcaagaagaagagcagctggaaggccttcttcggcgtggtggagaaggaggacagccagagcacccccgccaaggtgagcgcccagggccagagaaccctggagtaccaggacagccacagccagcagtggagcagatgcctgagcaacgtggagcagtgcctggagcacgaggccgtggaccccaaggtgatcagcatcgccaacagagtggccgagatcgtgtacagctggccccccccccaggccacccaggccggcggcttcaagagcaaggagatcttcgtgaccgagggcctgagcttccagctgcagggccacgtgcccgtggccagcagcagcaagaaggacgaggaggagcagatcctggccaagatcgtggagctgctgaagtacagcggcgaccagctggagagaaagctgaagaaggacaaggccctgatgggccacttccaggacggcctgagctacagcgtgttcaagaccatcaccgaccaggtgctgatgggcgtggaccccagaggcgagagcgaggtgaaggcccagggcttcaaggccgccctggtgatcgacgtgaccgccaagctgaccgccatcgacaaccaccccatgaacagagtgctgggcttcggcaccaagtacctgaaggagaacttcagcccctggatccagcagcacggcggctgggagaagatcctgggcatcagccacgaggaggtggactag

SEQ ID NO: 9810 - DNA, 1086 bp, Artificial Sequence
  Description of Artificial Sequence: Synthetic coding sequence
atgggcggcgccgtgagcgccggcgaggacaacgacgagctgatcgacaacctgaaggaggcccagtacatcagaaccgagctggtggagcaggccttcagagccatcgacagagccgactactacctggaggagttcaaggagaacgcctacaaggacctggcctggaagcacggcaacatccacctgagcgccccctgcatctacagcgaggtgatggaggccctggacctgcagcccggcctgagcttcctgaacctgggcagcggcaccggctacctgagcagcatggtgggcctgatcctgggccccttcggcgtgaaccacggcgtggagctgcacagcgacgtgatcgagtacgccaagcagaagctggacttcttcatcagaaccagcgacagcttcgacaagttcgacttctgcgagcccagcttcgtgaccggcaactgcctggagatcagccccgactgcagccagtacgacagagtgtactgcggcgccggcgtgcagaaggagcacgaggagtacatgaagaacctgctgaaggtgggcggcatcctggtgatgcccctggaggagaagctgaccaagatcaccagaaccggccccagcgcctgggagaccaagaagatcctggccgtgagcttcgcccccctgatccagccctgccacagcgagagcggcaagagcagactggtgcagctgccccccgtggccgtgagaagcctgcaggacctggccagaatcgccatcagaggcaccatcaagaagatcatccaccaggagaccgtgagcaagaacggcaacggcctgaagaacacccccagattcaagagaagaagagtgagaagaagaagaatggagaccatcgtgttcctggacaaggaggtgttcgccagcagaatcagcaaccccagcgacgacaacagctgcgaggacctggaggaggagagaagagaggaggaggagaagaccccccccgagaccaagcccgacccccccgtgaacttcctgagacagaaggtgctgagcctgcccctgcccgaccccctgaagtactacctgctgtactacagagagaagtag

SEQ ID NO: 9811 - DNA, 780 bp, Artificial Sequence
  Description of Artificial Sequence: Synthetic coding sequence
atgaaggacgtggacaacctgaagagcatcaaggaggagtgggtgtgcgagaccggcagcgacaaccagcccctgggcaacaaccagcagagcaactgcgagtacttcgtggacagcctgttcgaggaggcccagaaggtgagcagcaagtgcgtgagccccgccgagcagaagaagcaggtggacgtgaacatcaagctgtggaagaacggcttcaccgtgaacgacgacttcagaagctacagcgacggcgccagccagcagttcctgaacagcatcaagaagggcgagctgcccagcgagctgcagggcatcttcgacaaggaggaggtggacgtgaaggtggaggacaagaagaacgagatctgcctgagcaccaagcccgtgttccagcccttcagcggccagggccacagactgggcagcgccacccccaagatcgtgagcaaggccaagaacatcgaggtggagaacaagaacaacctgagcgccgtgcccctgaacaacctggagcccatcaccaacatccagatctggctggccaacggcaagagaatcgtgcagaagttcaacatcacccacagagtgagccacatcaaggacttcatcgagaagtaccagggcagccagagaagcccccccttcagcctggccaccgccctgcccgtgctgagactgctggacgagaccctgaccctggaggaggccgacctgcagaacgccgtgatcatccagagactgcagaagaccgccagcttcagagagctgagcgagcactag

SEQ ID NO: 9812 - DNA, 990 bp, Artificial Sequence
  Description of Artificial Sequence: Synthetic coding sequence
atggtgagaaccaagacctggaccctgaagaagcacttcgtgggctaccccaccaacagcgacttcgagctgaagaccgccgagctgccccccctgaagaacggcgaggtgctgctggaggccctgttcctgaccgtggacccctacatgagagtggccgccaagagactgaaggagggcgacaccatgatgggccagcaggtggccaaggtggtggagagcaagaacgtggccctgcccaagggcaccatcgtgctggccagccccggctggaccacccacagcatcagcgacggcaaggacctggagaagctgctgaccgagtggcccgacaccatccccctgagcctggccctgggcaccgtgggcatgcccggcctgaccgcctacttcggcctgctggagatctgcggcgtgaagggcggcgagaccgtgatggtgaacgccgccgccggcgccgtgggcagcgtggtgggccagatcgccaagctgaagggctgcaaggtggtgggcgccgtgggcagcgacgagaaggtggcctacctgcagaagctgggcttcgacgtggtgttcaactacaagaccgtggagagcctggaggagaccctgaagaaggccagccccgacggctacgactgctacttcgacaacgtgggcggcgagttcagcaacaccgtgatcggccagatgaagaagttcggcagaatcgccatctgcggcgccatcagcacctacaacagaaccggccccctgccccccggccccccccccgagatcgtgatctaccaggagctgagaatggaggccttcgtggtgtacagatggcagggcgacgccagacagaaggccctgaaggacctgctgaagtgggtgctggagggcaagatccagtacaaggagtacatcatcgagggcttcgagaacatgcccgccgccttcatgggcatgctgaagggcgacaacctgggcaagaccatcgtgaaggcctag

SEQ ID NO: 9813 - DNA, 3006 bp, Artificial Sequence
  Description of Artificial Sequence: Synthetic coding sequence
atgcagagcaccgacctgggcaacaaggagagcggcaagatctggcacagaaagcccagccccgccaccagagacggcatcatcgtgaacatcatccacaacaccagcgactaccaccccaaggtgctgagattcctgaacgtggccttcgacggcaccggcgactgcctgatcgccggcgaccaccagggcaacatctacgtgttcgacctgcacggcaacagattcaacctggtgcagagaaccgcccaggcctgcaccgccctggccttcaacctgagaagaaagagcgagttcctggtggccctggccgactacagcatcaagtgcttcgacaccgtgaccaaggagctggtgagctggatgagaggccacgagagcagcgtgttcagcatcagcgtgcacgccagcggcaagtacgccatcaccaccagcagcgacaccgcccagctgtgggacctggacaccttccagagaaagagaaagctgaacatcagacagagcgtgggcatccagaaggtgttcttcctgcccctgagcaacaccatcctgagctgcttcaaggacaacagcatcttcgcctgggagtgcgacaccctgttctgcaagtaccagctgcccgccccccccgagagcagcagcatcctgtacaaggtgttcgccgtgaccagagacggcagaatcctggccgccggcggcaagagcaaccacctgcacctgtggtgcctggaggccagacagctgttcagaatcatccagatgcccaccaaggtgagagccatcagacacctggagttcctgcccgacagcttcgacgccggcagcaaccaggtgctgggcgtgctgagccaggacggcatcatgagattcatcaacatgcagacctgcaagctgctgttcgagatcggcagcctggacgagggcatcagcagcagcgccatcagcccccacggcagatacatcgccagcatcatggagaacggcagcctgaacatctacagcgtgcaggccctgacccaggagatcaacaagccccccccccccctggtgaaggtgatcgaggacctgcccaagaacaagctgagcagcagcgacctgaagatgaaggtgaccagcggcagagtgcagcagcccgccaagagcagagagagcaagatgcagaccagaatcctgaagcaggacctgaccggcgacttcgagagcaagaagaacgagctgcccgacggcctgaacaagaagagactgcagatcctgctgaagggctacggcgagtaccccaccaagtacagaatgttcatctggagaagcctgctgcagctgcccgagaaccacaccgccttcagcaccctgatcgacaagggcacccacgtggccttcctgaacctgcagaagaagtaccccatcaagagcagaaagctgctgagagtgctgcagagaaccctgagcgccctggcccactggagcgtgatcttcagcgacaccccctacctgcccctgctggccttccccttcgtgaagctgttccagaacaaccagctgatctgcttcgaggtgatcgccaccctgatcatcaactggtgccagcactggttcgagtacttccccaacccccccatcaacatcctgagcatgatcgagaacgtgctggccttccacgacaaggagctgctgcagcacttcatcgaccacgacatcaccagccagctgtacgcctggcccctgctggagaccgtgttcagcgaggtgctgaccagagaggagtggctgaagctgttcgacaacatcttcagcaaccaccccagcttcctgctgatgaccgtggtggcctacaacatctgcagcagaacccccctgctgagctgcaacctgaaggacgacttcgagttcttcttccaccacagaaacaacctggacatcaacgtggtgatcagacaggtgtaccacctgatggagaccacccccaccgacatccaccccgacagcatgctgaacgtgttcgtggccctgaccaagggccagtaccccgtgttcaaccagtaccccaagttcatcgtggactaccagacccaggagagagagagaatcagaaacgacgagctggactacctgagagagagacagaccgtggaggacatgcaggccaaggtggaccagcagagagtggaggacgaggcctggtaccagaagcaggagctgctgagaaaggccgaggagaccagaagagagatgctgctgcaggaggaggagaagatgatccagcagagacagagactggccgccgtgaagagagagctgaaggtgaaggagatgcacctgcaggacgccgccagaagaagattcctgaagctgcagcaggaccagcaggagatggagctgagaagactggacgacgagatcggcagaaaggtgtacatgagagacagagagatcgccgccaccgccagagacctggagatgagacagctggagctggagagccagaagagactgtacgagaagaacctgaccgagaaccaggaggccctggccaaggagatgagagccgacgccgacgcctacagaagaaaggtggacctggaggagcacatgttccacaagctgatcgaggccggcgagacccagagccagaagacccagaagtggaaggaggccgagggcaaggagttcagactgagaagcgccaagaaggccagcgccctgagcgacgccagcagaaagtggttcctgaagcaggagatcaacgccgccgtggagcacgccgagaacccctgccacaaggaggagcccagattccagaacgagcaggacagcagctgcctgcccagaaccagccagctgaacgacagcagcgagatggaccccagcacccagatcagcctgaacagaagagccgtggagtgggacaccaccggccagaacctgatcaagaaggtgagaaacctgagacagagactgaccgccagagccagacacagatgccagaccccccacctgctggccgcctag

SEQ ID NO: 9814 - DNA, 651 bp, Artificial Sequence
  Description of Artificial Sequence: Synthetic coding sequence
atgagcttcctgttcggcagcagaagcagcaagaccttcaagcccaagaagaacatccccgagggcagccaccagtacgagctgctgaagcacgccgaggccaccctgggcagcggcaacctgagaatggccgtgatgctgcccgagggcgaggacctgaacgagtgggtggccgtgaacaccgtggacttcttcaaccagatcaacatgctgtacggcaccatcaccgacttctgcaccgaggagagctgccccgtgatgagcgccggccccaagtacgagtaccactgggccgacggcaccaacatcaagaagcccatcaagtgcagcgcccccaagtacatcgactacctgatgacctgggtgcaggaccagctggacgacgagaccctgttccccagcaagatcggcgtgcccttccccaagaacttcatgagcgtggccaagaccatcctgaagagactgttcagagtgtacgcccacatctaccaccagcacttcgaccccgtgatccagctgcaggaggaggcccacctgaacaccagcttcaagcacttcatcttcttcgtgcaggagttcaacctgatcgacagaagagagctggcccccctgcaggagctgatcgagaagctgaccagcaaggacagatag

SEQ ID NO: 9815 - DNA, 477 bp, Artificial Sequence
  Description of Artificial Sequence: Synthetic coding sequence
atggccgcccagggcgtgggccccggccccggcagcgccgccccccccggcctggaggccgccagacagaagctggccctgagaagaaagaaggtgctgagcaccgaggagatggagctgtacgagctggcccaggccgccggcggcggcatcgaccccgacgtgttcaagatcctggtggacctgctgaagctgaacgtggcccccctggccgtgttccagatgctgaagagcatgtgcgccggccagagactggccagcgagccccaggaccccgccgccgtgagcctgcccaccagcagcgtgcccgagaccagaggcagagacaagggcagcgccgccctgggcggcgtgctggccctggccgagagaagcaaccacgagggcagcagccagagaatgcccagacagcccagcgccaccagactgcccaagggcggcggccccggcaagagccccacccagggcagcacctag

SEQ ID NO: 9816 - DNA, 1425 bp, Artificial Sequence
  Description of Artificial Sequence: Synthetic coding sequence
atgaacagcgtgagccccgccgccgcccagtacagaagcagcagccccgaggacgccagaagaagacccgaggccagaagacccagaggccccagaggccccgaccccaacggcctgggccccagcggcgccagcggccccgccctgggcagccccggcgccggccccagcgagcccgacgaggtggacaagttcaaggccaagttcctgaccgcctggaacaacgtgaagtacggctgggtggtgaagagcagaaccagcttcagcaagatcagcagcatccacctgtgcggcagaagatacagattcgagggcgagggcgacatccagagattccagagagacttcgtgagcagactgtggctgacctacagaagagacttcccccccctgcccggcggctgcctgaccagcgactgcggctggggctgcatgctgagaagcggccagatgatgctggcccagggcctgctgctgcacttcctgcccagagactggacctgggccgagggcatgggcctgggcccccccgagctgagcggcagcgccagccccagcagataccacggccccgccagatggatgccccccagatgggcccagggcgcccccgagctggagcaggagagaagacacagacagatcgtgagctggttcgccgaccaccccagagcccccttcggcctgcacagactggtggagctgggccagagcagcggcaagaaggccggcgactggtacggccccagcctggtggcccacatcctgagaaaggccgtggagagctgcagcgacgtgaccagactggtggtgtacgtgagccaggactgcaccgtgtacaaggccgacgtggccagactggtggccagacccgaccccaccgccgagtggaagagcgtggtgatcctggtgcccgtgagactgggcggcgagaccctgaaccccgtgtacgtgccctgcgtgaaggagctgctgagatgcgagctgtgcctgggcatcatgggcggcaagcccagacacagcctgtacttcatcggctaccaggacgacttcctgctgtacctggacccccactactgccagcccaccgtggacgtgagccaggccgacttccccctggagagcttccactgcaccagccccagaaagatggccttcgccaagatggaccccagctgcaccgtgggcttctacgccggcgacagaaaggagttcgagaccctgtgcagcgagctgaccagagtgctgagcagcagcagcgccaccgagagataccccatgttcaccctggccgagggccacgcccaggaccacagcctggacgacctgtgcagccagctggcccagcccaccctgagactgcccagaaccggcagactgctgagagccaagagacccagcagcgaggacttcgtgttcctgtag

SEQ ID NO: 9817 - DNA, 945 bp, Artificial Sequence
  Description of Artificial Sequence: Synthetic coding sequence
atggccttcgtgaccagacagttcatgagaagcgtgagcagcagcagcaccgccagcgccagcgccaagaagatcatcgtgaagcacgtgaccgtgatcggcggcggcctgatgggcgccggcatcgcccaggtggccgccgccaccggccacaccgtggtgctggtggaccagaccgaggacatcctggccaagagcaagaagggcatcgaggagagcctgagaaaggtggccaagaagaagttcgccgagaacctgaaggccggcgacgagttcgtggagaagaccctgagcaccatcgccaccagcaccgacgccgccagcgtggtgcacagcaccgacctggtggtggaggccatcgtggagaacctgaaggtgaagaacgagctgttcaagagactggacaagttcgccgccgagcacaccatcttcgccagcaacaccagcagcctgcagatcaccagcatcgccaacgccaccaccagacaggacagattcgccggcctgcacttcttcaaccccgtgcccgtgatgaagctggtggaggtgatcaagacccccatgaccagccagaagaccttcgagagcctggtggacttcagcaaggccctgggcaagcaccccgtgagctgcaaggacacccccggcttcatcgtgaacagactgctggtgccctacctgatggaggccatcagactgtacgagagaggcgacgccagcaaggaggacatcgacaccgccatgaagctgggcgccggctaccccatgggccccttcgagctgctggactacgtgggcctggacaccaccaagttcatcgtggacggctggcacgagatggacgccgagaaccccctgcaccagcccagccccagcctgaacaagctggtggccgagaacaagttcggcaagaagaccggcgagggcttctacaagtacaagtag

SEQ ID NO: 9818 - DNA, 810 bp, Artificial Sequence
  Description of Artificial Sequence: Synthetic coding sequence
atgggcaactgctgctggacccagtgcttcggcctgctgagaaaggaggccggcagactgcagagagtgggcggcggcggcggcagcaagtacttcagaacctgcagcagaggcgagcacctgaccatcgagttcgagaacctggtggagagcgacgagggcgagagccccggcagcagccacagacccctgaccgaggaggagatcgtggacctgagagagagacactacgacagcatcgccgagaagcagaaggacctggacaagaagatccagaaggagcaggagagacagagaatcgtgcagcagtaccaccccagcaacaacggcgagtaccagagcagcggccccgaggacgacttcgagagctgcctgagaaacatgaagagccagtacgaggtgttcagaagcagcagactgagcagcgacgccaccgtgctgacccccaacaccgagagcagctgcgacctgatgaccaagaccaagagcaccagcggcaacgacgacagcaccagcctggacctggagtgggaggacgaggagggcatgaacagaatgctgcccatgagagagagaagcaagaccgaggaggacatcctgagagccgccctgaagtacagcaacaagaagaccggcagcaaccccaccagcgccagcgacgacagcaacggcctggagtgggagaacgacttcgtgagcgccgagatggacgacaacggcaacagcgagtacagcggcttcgtgaaccccgtgctggagctgagcgacagcggcatcagacacagcgacaccgaccagcagaccagatag

SEQ ID NO: 9819 - DNA, 1371 bp, Artificial Sequence
  Description of Artificial Sequence: Synthetic coding sequence
atgaagtgcgagcactgcaccagaaaggagtgcagcaagaagaccaagaccgacgaccaggagaacgtgagcgccgacgcccccagccccgcccaggagaacggcgagaagggcgagttccacaagctggccgacgccaagatcttcctgagcgactgcctggcctgcgacagctgcatgaccgccgaggagggcgtgcagctgagccagcagaacgccaaggacttcttcagagtgctgaacctgaacaagaagtgcgacaccagcaagcacaaggtgctggtggtgagcgtgtgcccccagagcctgccctacttcgccgccaagttcaacctgagcgtgaccgacgccagcagaagactgtgcggcttcctgaagagcctgggcgtgcactacgtgttcgacaccaccatcgccgccgacttcagcatcctggagagccagaaggagttcgtgagaagatacagacagcacagcgaggaggagagaaccctgcccatgctgaccagcgcctgccccggctgggtgagatacgccgagagagtgctgggcagacccatcaccgcccacctgtgcaccgccaagagcccccagcaggtgatgggcagcctggtgaaggactacttcgccagacagcagaacctgagccccgagaagatcttccacgtgatcgtggccccctgctacgacaagaagctggaggccctgcaggagagcctgccccccgccctgcacggcagcagaggcgccgactgcgtgctgaccagcggcgagatcgcccagatcatggagcagggcgacctgagcgtgagagacgccgccgtggacaccctgttcggcgacctgaaggaggacaaggtgaccagacacgacggcgccagcagcgacggccacctggcccacatcttcagacacgccgccaaggagctgttcaacgaggacgtggaggaggtgacctacagagccctgagaaacaaggacttccaggaggtgaccctggagaagaacggcgaggtggtgctgagattcgccgccgcctacggcttcagaaacatccagaacatgatcctgaagctgaagaagggcaagttccccttccacttcgtggaggtgctggcctgcgccggcggctgcctgaacggcagaggccaggcccagacccccgacggccacgccgacaaggccctgctgagacagatggagggcatctacgccgacatccccgtgagaagacccgagagcagcgcccacgtgcaggagctgtaccaggagtggctggagggcatcaacagccccaaggccagagaggtgctgcacaccacctaccagagccaggagagaggcacccacagcctggacatcaagtggtag

SEQ ID NO: 9820 - DNA, 612 bp, Artificial Sequence
  Description of Artificial Sequence: Synthetic coding sequence
atggcccacgtgagcagcgagacccaggacgtgagccccaaggacgagctgaccgccagcgaggccagcaccagaagccccctgtgcgagcacaccttccccggcgacagcgacctgagaagcatgatcgaggagcacgccttccaggtgctgagccagggcagcctgctggagagccccagctacaccgtgtgcgtgagcgagcccgacaaggacgacgacttcctgagcctgaacttccccagaaagctgtggaagatcgtggagagcgaccagttcaagagcatcagctgggacgagaacggcacctgcatcgtgatcaacgaggagctgttcaagaaggagatcctggagaccaaggccccctacagaatcttccagaccgacgccatcaagagcttcgtgagacagctgaacctgtacggcttcagcaagatccagcagaacttccagagaagcgccttcctggccaccttcctgagcgaggagaaggagagcagcgtgctgagcaagatcagattcaccaagatgaagctgagcagaagcagcacctacgagaacagatacctgtgctgcaacctgcacctgaaggacgagagcaactacagctag

SEQ ID NO: 9821 - DNA, 2052 bp, Artificial Sequence
  Description of Artificial Sequence: Synthetic coding sequence
atgaacaccagcatcccctaccagcagaacccctacaaccccagaggcagcagcaacgtgatccagtgctacagatgcggcgacacctgcaagggcgaggtggtgagagtgcacaacaaccacttccacatcagatgcttcacctgccaggtgtgcggctgcggcctggcccagagcggcttcttcttcaagaaccaggagtacatctgcacccaggactaccagcagctgtacggcaccagatgcgacagctgcagagacttcatcaccggcgaggtgatcagcgccctgggcagaacctaccaccccaagtgcttcgtgtgcagcctgtgcagaaagcccttccccatcggcgacaaggtgaccttcagcggcaaggagtgcgtgtgccagacctgcagccagagcatggccagcagcaagcccatcaagatcagaggccccagccactgcgccggctgcaaggaggagatcaagcacggccagagcctgctggccctggacaagcagtggcacgtgagctgcttcaagtgccagacctgcagcgtgatcctgaccggcgagtacatcagcaaggacggcgtgccctactgcgagagcgactaccacgcccagttcggcatcaagtgcgagacctgcgacagatacatcagcggcagagtgctggaggccggcggcaagcactaccaccccacctgcgccagatgcgtgagatgccaccagatgttcaccgagggcgaggagatgtacctgaccggcagcgaggtgtggcaccccatctgcaagcaggccgccagagccgagaagaagctgaagcacagaagaaccagcgagaccagcatcagcccccccggcagcagcatcggcagccccaacagagtgatctgcgccaaggtggacaacgagatcctgaactacaaggacctggccgccctgcccaaggtgaagagcatctacgaggtgcagagacccgacctgatcagctacgagccccacagcagatacatgagcgacgagatgctggagagatgcggctacggcgagagcctgggcaccctgagcccctacagccaggacatctacgagaacctggacctgagacagagaagagccagcagccccggctacatcgacagccccacctacagcagacagggcatgagccccaccttcagcagaagcccccaccactactacagaagcggccccgagagcggcagaagcagcccctaccacagccagctggacgtgagaagcagcacccccaccagctaccaggcccccaagcacttccacatccccgccggcgacagcaacatctacagaaagccccccatctacaagagacacggcgacctgagcaccgccaccaagagcaagaccagcgaggacatcagccagaccagcaagtacagccccatctacagccccgacccctactacgccagcgagagcgagtactggacctaccacggcagccccaaggtgcccagagccagaagattcagcagcggcggcgaggaggacgacttcgacagaagcatgcacaagctgcagagcggcatcggcagactgatcctgaaggaggagatgaaggccagaagcagcagctacgccgacccctggaccccccccagaagcagcaccagcagcagagaggccctgcacaccgccggctacgagatgagcctgaacggcagccccagaagccactacctggccgacagcgaccccctgatcagcaagagcgccagcctgcccgcctacagaagaaacggcctgcacagaacccccagcgccgacctgttccactacgacagcatgaacgccgtgaactggggcatgagagagtacaagatctacccctacgagctgctgctggtgaccaccagaggcagaaacagactgcccaaggacgtggacagaaccagactggagagacacctgagccaggaggagttctaccaggtgttcggcatgaccatcagcgagttcgacagactggccctgtggaagagaaacgagctgaagaagcaggccagactgttctag

SEQ ID NO: 9822 - DNA, 2541 bp, Artificial Sequence
  Description of Artificial Sequence: Synthetic coding sequence
atgctgttcaccgtgagctgcagcaagatgagcagcatcgtggacagagacgacagcagcatcttcgacggcctggtggaggaggacgacaaggacaaggccaagagagtgagcagaaacaagagcgagaagaagagaagagaccagttcaacgtgctgatcaaggagctgggcagcatgctgcccggcaacgccagaaagatggacaagagcaccgtgctgcagaagagcatcgacttcctgagaaagcacaaggagatcaccgcccagagcgacgccagcgagatcagacaggactggaagcccaccttcctgagcaacgaggagttcacccagctgatgctggaggccctggacggcttcttcctggccatcatgaccgacggcagcatcatctacgtgagcgagagcgtgaccagcctgctggagcacctgcccagcgacctggtggaccagagcatcttcaacttcatccccgagggcgagcacagcgaggtgtacaagatcctgagcacccacctgctggagagcgacagcctgacccccgagtacctgaagagcaagaaccagctggagttctgctgccacatgctgagaggcaccatcgaccccaaggagcccagcacctacgagtacgtgaagttcatcggcaacttcaagagcctgaacagcgtgagcagcagcgcccacaacggcttcgagggcaccatccagagaacccacagacccagctacgaggacagagtgtgcttcgtggccaccgtgagactggccaccccccagttcatcaaggagatgtgcaccgtggaggagcccaacgaggagttcaccagcagacacagcctggagtggaagttcctgttcctggaccacagagccccccccatcatcggctacctgcccttcgaggtgctgggcaccagcggctacgactactaccacgtggacgacctggagaacctggccaagtgccacgagcacctgatgcagtacggcaagggcaagagctgctactacagattcctgaccaagggccagcagtggatctggctgcagacccactactacatcacctaccaccagtggaacagcagacccgagttcatcgtgtgcacccacaccgtggtgagctacgccgaggtgagagccgagagaagaagagagctgggcatcgaggagagcctgcccgagaccgccgccgacaagagccaggacagcggcagcgacaacagaatcaacaccgtgagcctgaaggaggccctggagagattcgaccacagccccacccccagcgccagcagcagaagcagcagaaagagcagccacaccgccgtgagcgaccccagcagcacccccaccaagatccccaccgacaccagcaccccccccagacagcacctgcccgcccacgagaagatggtgcagagaagaagcagcttcagcagccagagcatcaacagccagagcgtgggcagcagcctgacccagcccgtgatgagccaggccaccaacctgcccatcccccagggcatgagccagttccagttcagcgcccagctgggcgccatgcagcacctgaaggaccagctggagcagagaaccagaatgatcgaggccaacatccacagacagcaggaggagctgagaaagatccaggagcagctgcagatggtgcacggccagggcctgcagatgttcctgcagcagagcaaccccggcctgaacttcggcagcgtgcagctgagcagcggcaacagcagcaacatccagcagctggcccccatcaacatgcagggccaggtggtgcccaccaaccagatccagagcggcatgaacaccggccacatcggcaccacccagcacatgatccagcagcagaccctgcagagcaccagcacccagagccagcagaacgtgctgagcggccacagccagcagaccagcctgcccagccagacccagagcaccctgaccgcccccctgtacaacaccatggtgatcagccagcccgccgccggcagcatggtgcagatccccagcagcatgccccagaacagcacccagagcgccgccgtgaccaccttcacccaggacagacagatcagattcagccagggccagcagctggtgaccaagctggtgaccgcccccgtggcctgcggcgccgtgatggtgcccagcaccatgctgatgggccaggtggtgaccgcctaccccaccttcgccacccagcagcagcagagccagaccctgagcgtgacccagcagcagcagcagcagagcagccaggagcagcagctgaccagcgtgcagcagcccagccaggcccagctgacccagcccccccagcagttcctgcagaccagcagactgctgcacggcaaccccagcacccagctgatcctgagcgccgccttccccctgcagcagagcaccttcccccagagccaccaccagcagcaccagagccagcagcagcagcagctgagcagacacagaaccgacagcctgcccgaccccagcaaggtgcagccccagtag

SEQ ID NO: 9823 - DNA, 1656 bp, Artificial Sequence
  Description of Artificial Sequence: Synthetic coding sequence
atgggcagaaaggccatcgtgctggccatcgccaacaccagcctggccttccccctgtgccagcacctggtgaccttctgcctgggcgaggacgacggcgtgcacaccgtggaggacgccagcagaaagctggccgtgatggacagccagggcagagtgtgggcccaggagatgctgctgagagtgagccccgaccacgtgaccctgctggaccccgccagcaaggaggagctggagagctaccccctgggcgccatcgtgagatgcgacgccgtgatgccccccggcagaagcagaagcctgctgctgctggtgtgccaggagcccgagagagcccagcccgacgtgcacttcttccagggcctgagactgggcgccgagctgatcagagaggacatccagggcgccctgcacaactacagaagcggcagaggcgagagaagagccgccgccctgagagccacccaggaggagctgcagagagacagaagccccgccgccgagaccccccccctgcagagaagacccagcgtgagagccgtgatcagcaccgtggagagaggcgccggcagaggcagaccccaggccaagcccatccccgaggccgaggaggcccagagacccgagcccgtgggcaccagcagcaacgccgacagcgccagccccgacctgggccccagaggccccgacctggccgtgctgcaggccgagagagaggtggacatcctgaaccacgtgttcgacgacgtggagagcttcgtgagcagactgcagaagagcgccgaggccgccagagtgctggagcacagagagagaggcagaagaagcagaagaagagccgccggcgagggcctgctgaccctgagagccaagccccccagcgaggccgagtacaccgacgtgctgcagaagatcaagtacgccttcagcctgctggccagactgagaggcaacatcgccgaccccagcagccccgagctgctgcacttcctgttcggccccctgcagatgatcgtgaacaccagcggcggccccgagttcgccagcagcgtgagaagaccccacctgaccagcgacgccgtggccctgctgagagacaacgtgacccccagagagaacgagctgtggaccagcctgggcgacagctggaccagacccggcctggagctgagccccgaggagggccccccctacagacccgagttcttcagcggctgggagccccccgtgaccgacccccagagcagagcctgggaggaccccgtggagaagcagctgcagcacgagagaagaagaagacaggtgacccaggccacccagcagggcagaggctgggaggtgagaggcagaggcagaagcgcctggcccagactgaccagactgagctacttcctgcagcagagcgccccccaggtggccgtgaacggccacagagacctggagcccgagagcgagccccagctggagagcgagaccgccggcaagtgggtgctgtgcaactacgacttccaggccagaaacagcagcgagctgagcgtgaagcagagagacgtgctggaggccctgcaggacaaggagaaggtgagcgagctggaggccgtgatggagaagcagaagaagaaggtggagggcgaggtggagatggaggtgatctag

SEQ ID NO: 9824 - DNA, 1689 bp, Artificial Sequence
  Description of Artificial Sequence: Synthetic coding sequence
atggccgccagcgccaagagaaagcaggaggagaagcacctgaagatgctgagagacatgaccggcctgccccacaacagaaagtgcttcgactgcgaccagagaggccccacctacgtgaacatgaccgtgggcagcttcgtgtgcaccagctgcagcggcagcctgagaggcctgaaccccccccacagagtgaagagcatcagcatgaccaccttcacccagcaggagatcgagttcctgcagaagcacggcaacgaggtgtgcaagcagatctggctgggcctgttcgacgacagaagcagcgccatccccgacttcagagacccccagaaggtgaaggagttcctgcaggagaagtacgagaagaagagatggtacgtgccccccgagcaggccaaggtggtggccagcgtgcacgccagcatcagcggcagcagcgccagcagcaccagcagcacccccgaggtgaagcccctgaagagcctgctgggcgacagcgcccccaccctgcacctgaacaagggcacccccagccagagccccgtggtgggcagaagccagggccagcagcaggagaagaagcagttcgacctgctgagcgacctgggcagcgacatcttcgccgcccccgccccccagagcaccgccaccgccaacttcgccaacttcgcccacttcaacagccacgccgcccagaacagcgccaacgccgacttcgccaacttcgacgccttcggccagagcagcggcagcagcaacttcggcggcttccccaccgccagccacagccccttccagccccagaccaccggcggcagcgccgccagcgtgaacgccaacttcgcccacttcgacaacttccccaagagcagcagcgccgacttcggcaccttcaacaccagccagagccaccagaccgccagcgccgtgagcaaggtgagcaccaacaaggccggcctgcagaccgccgacaagtacgccgccctggccaacctggacaacatcttcagcgccggccagggcggcgaccagggcagcggcttcggcaccaccggcaaggcccccgtgggcagcgtggtgagcgtgcccagccagagcagcgccagcagcgacaagtacgccgccctggccgagctggacagcgtgttcagcagcgccgccaccagcagcaacgcctacaccagcaccagcaacgccagcagcaacgtgttcggcaccgtgcccgtggtggccagcgcccagacccagcccgccagcagcagcgtgcccgcccccttcggcgccacccccagcaccaaccccttcgtggccgccgccggccccagcgtggccagcagcaccaaccccttccagaccaacgccagaggcgccaccgccgccaccttcggcaccgccagcatgagcatgcccaccggcttcggcacccccgccccctacagcctgcccaccagcttcagcggcagcttccagcagcccgccttccccgcccaggccgccttcccccagcagaccgccttcagccagcagcccaacggcgccggcttcgccgccttcggccagaccaagcccgtggtgacccccttcggccaggtggccgccgccggcgtgagcagcaaccccttcatgaccggcgcccccaccggccagttccccaccggcagcagcagcaccaaccccttcctgtag

SEQ ID NO: 9825 - DNA, 2052 bp, Artificial Sequence
  Description of Artificial Sequence: Synthetic coding sequence
atggccgccgccgtggccgcccccctggccgccggcggcgaggaggccgccgccaccaccagcgtgcccggcagccccggcctgcccggcagaagaagcgccgagagagccctggaggaggccgtggccaccggcaccctgaacctgagcaacagaagactgaagcacttccccagaggcgccgccagaagctacgacctgagcgacatcacccaggccgacctgagcagaaacagattccccgaggtgcccgaggccgcctgccagctggtgagcctggagggcctgagcctgtaccacaactgcctgagatgcctgaaccccgccctgggcaacctgaccgccctgacctacctgaacctgagcagaaaccagctgagcctgctgcccccctacatctgccagctgcccctgagagtgctgatcgtgagcaacaacaagctgggcgccctgccccccgacatcggcaccctgggcagcctgagacagctggacgtgagcagcaacgagctgcagagcctgcccagcgagctgtgcggcctgagcagcctgagagacctgaacgtgagaagaaaccagctgagcaccctgcccgaggagctgggcgacctgcccctggtgagactggacttcagctgcaacagagtgagcagaatccccgtgagcttctgcagactgagacacctgcaggtgatcctgctggacagcaaccccctgcagagcccccccgcccaggtgtgcctgaagggcaagctgcacatcttcaagtacctgagcaccgaggccggccagagaggcagcgccctgggcgacctggcccccagcagaccccccagcttcagcccctgccccgccgaggacctgttccccggccacagatacgacggcggcctggacagcggcttccacagcgtggacagcggcagcaagagatggagcggcaacgagagcaccgacgagttcagcgagctgagcttcagaatcagcgagctggccagagagcccagaggccccagagagagaaaggaggacggcagcgccgacggcgaccccgtgcagatcgacttcatcgacagccacgtgcccggcgaggacgaggagagaggcaccgtggaggagcagagaccccccgagctgagccccggcgccggcgacagagagagagcccccagcagcagaagagaggagcccgccggcgaggagagaagaagacccgacaccctgcagctgtggcaggagagagagagaagacagcagcagcagagcggcgcctggggcgcccccagaaaggacagcctgctgaagcccggcctgagagccgtggtgggcggcgccgccgccgtgagcacccaggccatgcacaacggcagccccaagagcagcgccagccaggccggcgccgccgccggccagggcgcccccgcccccgcccccgccagccaggagcccctgcccatcgccggccccgccaccgcccccgcccccagacccctgggcagcatccagagacccaacagcttcctgttcagaagcagcagccagagcggcagcggccccagcagccccgacagcgtgctgagacccagaagatacccccaggtgcccgacgagaaggacctgatgacccagctgagacaggtgctggagagcagactgcagagacccctgcccgaggacctggccgaggccctggccagcggcgtgatcctgtgccagctggccaaccagctgagacccagaagcgtgcccttcatccacgtgcccagccccgccgtgcccaagctgagcgccctgaaggccagaaagaacgtggagagcttcctggaggcctgcagaaagatgggcgtgcccgaggccgacctgtgcagccccagcgacctgctgcagggcaccgccagaggcctgagaaccgccctggaggccgtgaagagagtgggcggcaaggccctgccccccctgtggccccccagcggcctgggcggcttcgtggtgttctacgtggtgctgatgctgctgctgtacgtgacctacaccagactgctgggcagctag

SEQ ID NO: 9826 - DNA, 303 bp, Artificial Sequence
  Description of Artificial Sequence: Synthetic coding sequence
atgagcaccagcaccagctgccccatccccggcggcagagaccagctgcccgactgctacagcaccacccccggcggcaccctgtacgccaccacccccggcggcaccagaatcatctacgacagaaagttcctgctggagtgcaagaacagccccatcgccagaacccccccctgctgcctgccccagatccccggcgtgaccaccccccccaccgcccccctgagcaagctggaggagctgaaggagcaggagaccgaggaggagatccccgacgacgcccagttcgagatggacatctag

SEQ ID NO: 9827 - DNA, 2382 bp, Artificial Sequence
  Description of Artificial Sequence: Synthetic coding sequence
atgcccatggagagcgccagcagcgacaacaagaagcagatccccaacgaggccagcgccagaagcgagagagacaccagcgacctggagcagaactggagcctgcaggaccactacagaatgtacagccccatcatctaccaggccctgtgcgagcacgtgcagacccagatgagcctgatgaacgacctgaccagcaagaacatccccaacggcatccccgccgtgccctgccacgcccccagccacagcgagagccaggccaccccccacagcagctacggcctgtgcaccagcacccccgtgtggagcctgcagagacccccctgcccccccaaggtgcacagcgaggtgcagaccgacggcaacagccagttcgccagccagggcaagaccgtgagcgccacctgcaccgacgtgctgagaaacagcttcaacaccagccccggcgtgccctgcagcctgcccaagaccgacatcagcgccatccccaccctgcagcagctgggcctggtgaacggcatcctgccccagcagggcatccacaaggagaccgacctgctgaagtgcatccagacctacctgagcctgttcagaagccacggcaaggagacccacctggacagccagacccacagaagccccacccagagccagcccgccttcctggccaccaacgaggagaagtgcgccagagagcagatcagagaggccaccagcgagagaaaggacctgaacatccacgtgagagacaccaagaccgtgaaggacgtgcagaaggccaagaacgtgaacaagaccgccgagaaggtgagaatcatcaagtacctgctgggcgagctgaaggccctggtggccgagcaggaggacagcgagatccagagactgatcaccgagatggaggcctgcatcagcgtgctgcccaccgtgagcggcaacaccgacatccaggtggagatcgccctggccatgcagcccctgagaagcgagaacgcccagctgagaagacagctgagaatcctgaaccagcagctgagagagcagcagaagacccagaagcccagcggcgccgtggactgcaacctggagctgttcagcctgcagagcctgaacatgagcctgcagaaccagctggaggagagcctgaagagccaggagctgctgcagagcaagaacgaggagctgctgaaggtgatcgagaaccagaaggacgagaacaagaagttcagcagcatcttcaaggacaaggaccagaccatcctggagaacaagcagcagtacgacatcgagatcaccagaatcaagatcgagctggaggaggccctggtgaacgtgaagagcagccagttcaagctggagaccgccgagaaggagaaccagatcctgggcatcaccctgagacagagagacgccgaggtgaccagactgagagagctgaccagaaccctgcagaccagcatggccaagctgctgagcgacctgagcgtggacagcgccagatgcaagcccggcaacaacctgaccaagagcctgctgaacatccacgacaagcagctgcagcacgaccccgcccccgcccacaccagcatcatgagctacctgaacaagctggagaccaactacagcttcacccacagcgagcccctgagcaccatcaagaacgaggagaccatcgagcccgacaagacctacgagaacgtgctgagcagcagaggcccccagaacagcaacaccagaggcatggaggaggccagcgcccccggcatcatcagcgccctgagcaagcaggacagcgacgagggcagcgagaccatggccctgatcgaggacgagcacaacctggacaacaccatctacatccccttcgccagaagcacccccgagaagaagagccccctgagcaagagactgagcccccagccccagatcagagccgccaccacccagctggtgagcaacagcggcctggccgtgagcggcaaggagaacaagctgtgcacccccgtgatctgcagcagcagcaccaaggaggccgaggacgcccccgagaagctgagcagagccagcgacatgaaggacacccagctgctgaagaagatcaaggaggccatcggcaagatccccgccgccaccaaggagcccgaggagcagaccgcctgccacggccccagcggctgcctgagcaacagcctgcaggtgaagggcaacaccgtgtgcgacggcagcgtgttcaccagcgacctgatgagcgactggagcatcagcagcttcagcaccttcaccagcagagacgagcaggacttcagaaacggcctggccgccctggacgccaacatcgccagactgcagaagagcctgagaaccggcctgctggagaagtag

SEQ ID NO: 9828 - DNA, 1119 bp, Artificial Sequence; identical to SEQ ID NO: 9746
  Description of Artificial Sequence: Synthetic coding sequence

SEQ ID NO: 9829 - DNA, 336 bp, Artificial Sequence
  Description of Artificial Sequence: Synthetic coding sequence
atgaccaccctgagagccttcacctgcgacgacctgttcagattcaacaacatcaacctggaccccctgaccgagacctacggcatccccttctacctgcagtacctggcccactggcccgagtacttcatcgtggccgaggcccccggcggcgagctgatgggctacatcatgggcaaggccgagggcagcgtggccagagaggagtggcacggccacgtgaccgccctgagcgtggcccccgagttcagaagactgggcctggccgccaagctgatggagctgctggaggagatcagcgagagatacgaggagagcaccttccagggctactag

SEQ ID NO: 9830 - DNA, 1449 bp, Artificial Sequence
  Description of Artificial Sequence: Synthetic coding sequence
atgaacggcaccctggaccaccccgaccagcccgacctggacgccatcaagatgttcgtgggccaggtgcccagaacctggagcgagaaggacctgagagagctgttcgagcagtacggcgccgtgtacgagatcaacgtgctgagagacagaagccagaaccccccccagagcaagggctgctgcttcgtgaccttctacaccagaaaggccgccctggaggcccagaacgccctgcacaacatgaaggtgctgcccggcatgcaccaccccatccagatgaagcccgccgacagcgagaagaacaacgccgtggaggacagaaagctgttcatcggcatgatcagcaagaagtgcaccgagaacgacatcagagtgatgttcagcagcttcggccagatcgaggagtgcagaatcctgagaggccccgacggcctgagcagaggctgcgccttcgtgaccttcaccaccagagccatggcccagaccgccatcaaggccatgcaccaggcccagaccatggagggctgcagcagccccatggtggtgaagttcgccgacacccagaaggacaaggagcagaagagaatggcccagcagctgcagcagcagatgcagcagatcagcgccgccagcgtgtggggcaacctggccggcctgaacaccctgggcccccagtacctggccctgctgcagcagaccgccagcagcggcaacctgaacaccctgagcagcctgcaccccatgggcggcctgaacgccatgcagctgcagaacctggccgccctggccgccgccgccagcgccgcccagaacacccccagcggcaccaacgccctgaccaccagcagcagccccctgagcgtgctgaccagcagcggcagcagccccagcagcagcagcagcaacagcgtgaaccccatcgccagcctgggcgccctgcagaccctggccggcgccaccgccggcctgaacgtgggcagcctggccggcatggccgccctgaacggcggcctgggcagcagcggcctgagcaacggcaccggcagcaccatggaggccctgacccaggcctacagcggcatccagcagtacgccgccgccgccctgcccaccctgtacaaccagaacctgctgacccagcagagcatcggcgccgccggcagccagaaggagggccccgagggcgccaacctgttcatctaccacctgccccaggagttcggcgaccaggacctgctgcagatgttcatgcccttcggcaacgtggtgagcgccaaggtgttcatcgacaagcagaccaacctgagcaagtgcttcggcttcgtgagctacgacaaccccgtgagcgcccaggccgccatccagagcatgaacggcttccagatcggcatgaagagactgaaggtgcagctgaagagaagcaagaacgacagcaagccctactag

SEQ ID NO: 9831 - DNA, 1347 bp, Artificial Sequence
  Description of Artificial Sequence: Synthetic coding sequence
atgagccccctggagtgcagcgagtgcttcggcgaccagctgctgcacagaacctacacctggcagctgaccctgcacagcagacccaactacaccagaaagagagacaccagaagcgagagcctggagatccccatcagcgtggtgctgccccagagaggcaccgccgagcccttccccagactgcacaacctgtacagcacccccagatgcgcccagcaggccgccctgcccagactgagcagaagaatggccagccagcacagctaccccctgaacagattcagcagcgtgcccctggaccccatggagagacccatgagccaggccgacctggagctggactacaacccccccagagtgcagctgagcgacgagatgttcgtgttccaggacggcagatgggtgaacgagaactgcagactgcagagcccctacttcagccccagcgccagcttccaccacaagctgcaccacaagagactggccaaggagtgcatgctgcaggaggagaacaagagcctgagagaggagaacaaggccctgagagaggagaacagaatgctgagcaaggagaacaagatcctgcaggtgttctgggaggagcacaaggccagcctgggcagagaggagagcagagcccccagccccctgctgcacaaggacagcgccagcctggaggtggtgaagaaggaccacgtggccctgcaggtgcccagaggcaaggaggacagcaccctgcagctgctgagagaggagaacagagccctgcagcagctgctggagcagaagcaggcctactgggcccaggccgaggacaccgccgcccccgccgaggagagcaagcccgcccccagcccccacgaggagccctgcagccccggcctgctgcaggaccagggcagcggcctgagcagcagattcgaggagcccaagggcccccccgccagacaggaggacagcaaggagctgagagccctgagaaagatggtgagcaacatgagcggccccagcggcgaggaggaggccaaggtgggccccggcctgcccgacggctgccagcccctgcagctgctgagagagatgagacaggccctgcaggccctgctgaaggagaacagactgctgcaggaggagaacagaaccctgcaggtgctgagagccgagcacagaggcttccaggaggagaacaaggccctgtgggagaacaacaagctgaagctgcagcagaagctggtgatcgacaccgtgaccgaggtgaccgccagaatggagatgctgatcgaggagctgtacgccttcatgcccgccagaagccaggaccccaagaagcccagcagagtgtag

SEQ ID NO: 9832 - DNA, 1002 bp, Artificial Sequence
  Description of Artificial Sequence: Synthetic coding sequence
atggccgccgccgccgccggcaccgccaccagccagagattcttccagagcttcagcgacgccctgatcgacgaggacccccaggccgccctggaggagctgaccaaggccctggagcagaagcccgacgacgcccagtactactgccagagagcctactgccacatcctgctgggcaactactgcgtggccgtggccgacgccaagaagagcctggagctgaaccccaacaacagcaccgccatgctgagaaagggcatctgcgagtaccacgagaagaactacgccgccgccctggagaccttcaccgagggccagaagctggacagcgccgacgccaacttcagcgtgtggatcaagagatgccaggaggcccagaacggcagcgagagcgaggtgtggacccaccagagcaagatcaagtacgactggtaccagaccgagagccaggtggtgatcaccctgatgatcaagaacgtgcagaagaacgacgtgaacgtggagttcagcgagaaggagctgagcgccctggtgaagctgcccagcggcgaggactacaacctgaagctggagctgctgcaccccatcatccccgagcagagcaccttcaaggtgctgagcaccaagatcgagatcaagctgaagaagcccgaggccgtgagatgggagaagctggagggccagggcgacgtgcccacccccaagcagttcgtggccgacgtgaagaacctgtaccccagcagcagcccctacaccagaaactgggacaagctggtgggcgagatcaaggaggaggagaagaacgagaagctggagggcgacgccgccctgaacagactgttccagcagatctacagcgacggcagcgacgaggtgaagagagccatgaacaagagcttcatggagagcggcggcaccgtgctgagcaccaactggagcgacgtgggcaagagaaaggtggagatcaacccccccgacgacatggagtggaagaagtactag

SEQ ID NO: 9833 - DNA, 1029 bp, Artificial Sequence
  Description of Artificial Sequence: Synthetic coding sequence
atgagcctgcacggcaagagaaaggagatctacaagtacgaggccccctggaccgtgtacgccatgaactggagcgtgagacccgacaagagattcagactggccctgggcagcttcgtggaggagtacaacaacaaggtgcagctggtgggcctggacgaggagagcagcgagttcatctgcagaaacaccttcgaccacccctaccccaccaccaagctgatgtggatccccgacaccaagggcgtgtaccccgacctgctggccaccagcggcgactacctgagagtgtggagagtgggcgagaccgagaccagactggagtgcctgctgaacaacaacaagaacagcgacttctgcgcccccctgaccagcttcgactggaacgaggtggacccctacctgctgggcaccagcagcatcgacaccacctgcaccatctggggcctggagaccggccaggtgctgggcagagtgaacctggtgagcggccacgtgaagacccagctgatcgcccacgacaaggaggtgtacgacatcgccttcagcagagccggcggcggcagagacatgttcgccagcgtgggcgccgacggcagcgtgagaatgttcgacctgagacacctggagcacagcaccatcatctacgaggacccccagcaccaccccctgctgagactgtgctggaacaagcaggaccccaactacctggccaccatggccatggacggcatggaggtggtgatcctggacgtgagagtgccctgcacccccgtggccagactgaacaaccacagagcctgcgtgaacggcatcgcctgggccccccacagcagctgccacatctgcaccgccgccgacgaccaccaggccctgatctgggacatccagcagatgcccagagccatcgaggaccccatcctggcctacaccgccgagggcgagatcaacaacgtgcagtgggccagcacccagcccgactggatcgccatctgctacaacaactgcctggagatcctgagagtgtag

SEQ ID NO: 9834 - DNA, 507 bp, Artificial Sequence
  Description of Artificial Sequence: Synthetic coding sequence
atggccgagggcagcagaatcccccaggccagagccctgctgcagcagtgcctgcacgccagactgcagatcagacccgccgacggcgacgtggccgcccagtgggtggaggtgcagagaggcctggtgatctacgtgtgcttcttcaagggcgccgacaaggagctgctgcccaagatggtgaacaccctgctgaacgtgaagctgagcgagaccgagaacggcaagcacgtgagcatcctggacctgcccggcaacatcctgatcatcccccaggccaccctgggcggcagactgaagggcagaaacatgcagtaccacagcaacagcggcaaggaggagggcttcgagctgtacagccagttcgtgaccctgtgcgagaaggaggtggccgccaacagcaagtgcgccgaggccagagtggtggtggagcacggcacctacggcaacagacaggtgctgaagctggacaccaacggccccttcacccacctgatcgagttctag

SEQ ID NO: 9835 - DNA, 3069 bp, Artificial Sequence
  Description of Artificial Sequence: Synthetic coding sequence
atggagggcgccctgaccgccagagacaaggtgggcgtgcaggacttcgtgctgctggacgcctacaccagcgagagcgccttcgtggacaacctgagaaagagattcagcgagaacctgatctacacctacatcggcaccctgctggtgagcgtgaacccctaccaggagctgggcatctacaccgtgagccagatggagctgtaccagggcgtgaacttcttcgagctgcccccccacgtgtacgccatcgccgacaacgcctacagaatgatgtgcgccgagctgaacaaccacttcatcctgatcagcggcgagagcggcgccggcaagaccgaggccagcaagaagatcctggagtacttcgccgtgacctgccccatgacccagagcctgcagatcgccagagacagactgctgttcagcaaccccgtgctggaggccttcggcaacgccagaaccctgagaaacgacaacagcagcagattcggcaagtacatggacatccagttcgacttccagggcatccccgtgggcggccacatcatcagctacctgatcgagaagagcagagtggtgtaccagaacgagggcgagagaaacttccacatcttctaccagctgctggccggcggcgaggaggagagactgagctacctgggcctggagagagacccccagctgtacaagtacctgagccagggccactgcgccaaggagagcagcatcagcgacaagaacgactggaagaccgtgagcaacgccttcagcgtgatcgacttcaccgaggccgacctggagaacctgttcggcatcatcgccagcgtgctgcacctgggcaacatcggcttcgaggaggacgaccagggctgcgccaccatccccgacacccacgagatcaagtggatcgccaagctgctgggcgtgcaccccagcgtgctgctggaggccctgacccacagaaagatcgaggccaagaccgaggaggtgatctgccccctgaccctggagctgagcgtgtacgccagagacgccatggccaaggccgtgtacggcagaaccttcacctggctggtgaacaagatcaacagcagcctggtgaacaaggacttcaccagaaagaccgtgatcggcctgctggacatctacggcttcgaggtgttcgacaagaacggcttcgagcagttctgcatcaactactgcaacgagaagctgcagcagctgctgatcgagagaaccctgaaggccgagcaggccgagtacgagatggagggcatcgagtgggagcccatcaagtacttcaacaacaagatcatctgcgacctggtggaggagagacacaagggcatcatcagcatcctggacgaggagtgcatcagacccggccccgccaccgacctgagcttcctggagaagctggaggagaaggtgggcaagcacgcccacttcgagaccagaaagctggccggccccaagggcagaaagagaatcggctggatggagttcagactgctgcactacgccggcgaggtgacctactgcaccaagggcttcctggagaagaacaacgacctgctgtacagacacctgaaggaggtgctgtgcaagagcaagaacatcatcctgagagagtgcttcctgctggccgagctggagaacagaagaagaccccccaccgtgggcacccagttcaagaacagcctgagcagcctgctggagaccctgatcagcaaggagcccagctacatcagatgcatcaagcccaacgacagaaaggagcccagcaagttcgacgacttcctgatcagacaccagatcaagtacctgggcctgatggagcacctgagagtgagaagagccggcttcgcctacagaagaaagtacgagcacttcctgcagagatacaagagcctgtgccccgacacctggccccactggcacggcccccccgccgagggcgtggagagactgatcaagtacatcggctacaagcccgaggagtacaagctgggcaagaccaagatcttcatcagattccccagaaccctgttcgccaccgaggacgccttcgagttcagcaagcaccagctggtggccagaatccaggccacctacaagagatgcctgggcagaagagagtacgtgaagaagagacaggccgccatcaagctggaggcccactggagaggcgccctggccagaaaggccatccagagaagaaagtgggccgtgagaatcatcagaaagttcatcaagggcttcatcagcagaaacaagcccctgtgccccgacaacgaggagttcatcgtgttcgtgagaaagaactacatcctgaacctgagataccacctgcccaagaccgtgctggacaagagctggctgagaccccccggcatcctggagaacgccagcgacctgctgagaaagatgtgcgtgagaaacctggtgcagaagtactgcagaggcatcaccgccgagagaaaggccatgatgcagcagaaggtggtgaccagcgagatcttcagaggcagaaaggacggctacaccgagagcctgaaccagcccttcgtgaacagcagaatcgacgagggcgacatcaaccccaaggtgctgcagctgatcagccacgagaagatccagtacggcgtgcccgtgatcaagtacgacagaaagggcttcaaggccagacagagacagctgatcctgacccagaaggccgcctacgtggtggagctggccaagatcaagcagaagatcgagtacagcgccctgaagggcgtgagcaccagcaacctgagcgacggcatcctggtgatccacgtgagccccgaggacagcaagcagaagggcgacgccgtgctgcagtgcggccacgtgttcgaggccgtgaccaagctggtgatgctggtgaagaaggagaacatcgtgaacgtggtgcagggcagcctgcagttcttcatcagccccggcaaggagggcaccatcgtgttcgacaccggcctggaggagcaggtgtacaagaacaagaacggccagctgaccgtggtgagcgtgagaagaaagagctag

SEQ ID NO: 9836 - DNA, 1044 bp, Artificial Sequence
  Description of Artificial Sequence: Synthetic coding sequence
atgaacaccctgatggacgtgctgagacacagacccggctgggtggaggtgaaggacgagggcgagtgggacttctactggtgcgacgtgagctggctgagagagaacttcgaccacacctacatggacgagcacgtgagaatcagccacttcagaaaccactacgagctgaccagaaagaactacatggtgaagaacctgaagagattcagaaagcagctggagagagaggccggcaagctggaggccgccaagtgcgacttcttccccaagaccttcgagatgccctgcgagtaccacctgttcgtggaggagttcagaaagaaccccggcatcacctggatcatgaagcccgtggccagaagccagggcaagggcatcttcctgttcagaagactgaaggacatcgtggactggagaaaggacaccagaagcagcgacgaccagaaggacgacatccccgtggagaactacgtggcccagagatacatcgagaacccctacctgatcggcggcagaaagttcgacctgagagtgtacgtgctggtgatgagctacatccccctgagagcctggctgtacagagacggcttcgccagattcagcaacaccagattcaccctgaacagcatcgacgaccagtacgtgcacctgaccaacgtggccgtgcagaagaccagccccgactaccaccccaagaagggctgcaagtggaccctgcagagattcagacagtacctggccagcaagcacggccccgaggccgtggagaccctgttcagagacatcgacaacatcttcgtgaagagcctgcagagcgtgcagaaggtgatcatcagcgacaagcactgcttcgagctgtacggctacgacatcctgatcgaccaggacctgaagccctggctgctggaggtgaacgccagccccagcctgaccgccagcagccaggaggactacgagctgaagacctgcctgctggaggacaccctgcacgtggtggacatggaggccagaagcctgagagccgacagcccctgctggtag

SEQ ID NO: 9837 - DNA, 444 bp, Artificial Sequence
  Description of Artificial Sequence: Synthetic coding sequence
atgagcagcgagccccccccccccccccagccccccacccaccaggccagcgtgggcctgctggacacccccagaagcagagagagaagccccagccccctgagaggcaacgtggtgcccagccccctgcccaccagaagaaccagaaccttcagcgccaccgtgagagccagccagggccccgtgtacaagggcgtgtgcaagtgcttctgcagaagcaagggccacggcttcatcacccccgccgacggcggccccgacatcttcctgcacatcagcgacgtggagggcgagtacgtgcccgtggagggcgacgaggtgacctacaagatgtgcagcatcccccccaagaacgagaagctgcaggccgtggaggtggtgatcacccacctggcccccggcaccaagcacgagacctggagcggccacgtgatcagcagctag

SEQ ID NO: 9838 - DNA, 558 bp, Artificial Sequence
  Description of Artificial Sequence: Synthetic coding sequence
atggccgacggcggcggcggcggcggcaccggcgccgtgggcggcggcggcaccagccaggccagcgccggcgccgccaccggcgccaccggcgccagcggcggcggcggccccatcaaccccgccagcctgccccccggcgacccccagctgatcgccctgatcgtggagcagctgaagagcagaggcctgttcgacagcttcagaagagactgcctggccgacgtggacaccaagcccgcctaccagaacctgagacagaaggtggacaacttcgtgagcacccacctggacaagcaggagtggaaccccaccatgaacaagaaccagctgagaaacggcctgagacagagcgtggtgcagagcggcatgctggaggccggcgtggacagaatcatcagccaggtggtggaccccaagctgaaccacatcttcagaccccagatcgagagagccatccacgagttcctggccgcccagaagaaggccgccgtgcccgcccccccccccgagcccgagggccaggacccccccgcccccagccaggacaccagctag

SEQ ID NO: 9839 - DNA, 6351 bp, Artificial Sequence
  Description of Artificial Sequence: Synthetic coding sequence
atggacgaggtggagcaggaccagcacgaggccagactgaaggagctgttcgacagcttcgacaccaccggcaccggcagcctgggccaggaggagctgaccgacctgtgccacatgctgagcctggaggaggtggcccccgtgctgcagcagaccctgctgcaggacaacctgctgggcagagtgcacttcgaccagttcaaggaggccctgatcctgatcctgagcagaaccctgagcaacgaggagcacttccaggagcccgactgcagcctggaggcccagcccaagtacgtgagaggcggcaagagatacggcagaagaagcctgcccgagttccaggagagcgtggaggagttccccgaggtgaccgtgatcgagcccctggacgaggaggccagacccagccacatccccgccggcgactgcagcgagcactggaagacccagagaagcgaggagtacgaggccgagggccagctgagattctggaaccccgacgacctgaacgccagccagagcggcagcagccccccccaggactggatcgaggagaagctgcaggaggtgtgcgaggacctgggcatcaccagagacggccacctgaacagaaagaagctggtgagcatctgcgagcagtacggcctgcagaacgtggacggcgagatgctggaggaggtgttccacaacctggaccccgacggcaccatgagcgtggaggacttcttctacggcctgttcaagaacggcaagagcctgacccccagcgccagcaccccctacagacagctgaagagacacctgagcatgcagagcttcgacgagagcggcagaagaaccaccaccagcagcgccatgaccagcaccatcggcttcagagtgttcagctgcctggacgacggcatgggccacgccagcgtggagagaatcctggacacctggcaggaggagggcatcgagaacagccaggagatcctgaaggccctggacttcagcctggacggcaacatcaacctgaccgagctgaccctggccctggagaacgagctgctggtgaccaagaacagcatccaccaggccgccctggccagcttcaaggccgagatcagacacctgctggagagagtggaccaggtggtgagagagaaggagaagctgagaagcgacctggacaaggccgagaagctgaagagcctgatggccagcgaggtggacgaccaccacgccgccatcgagagaagaaacgagtacaacctgagaaagctggacgaggagtacaaggagagaatcgccgccctgaagaacgagctgagaaaggagagagagcagatcctgcagcaggccggcaagcagagactggagctggagcaggagatcgagaaggccaagaccgaggagaactacatcagagacagactggccctgagcctgaaggagaacagcagactggagaacgagctgctggagaacgccgagaacgtgctggccgagaagttcggcgacctggaccccagcagcgccgagttcttcctgcaggaggagagactgacccagatgagaaacgagtacgagagacagtgcagagtgctgcaggaccaggtggacgagctgcagagcgagctggaggagtacagagcccagggcagagtgctgagactgcccctgaagaacagccccagcgaggaggtggaggccaacagcggcggcatcgagcccgagcacggcctgggcagcgaggagtgcaaccccctgaacatgagcatcgaggccgagctggtgatcgagcagatgaaggagcagcaccacagagacatctgctgcctgagactggagctggaggacaaggtgagacactacgagaagcagctggacgagaccgtggtgagctgcaagaaggcccaggagaacatgaagcagagacacgagaacgagacccacaccctggagaagcagatcagcgacctgaagaacgagatcgccgagctgcagggccaggccgccgtgctgaaggaggcccaccacgaggccacctgcagacacgaggaggagaagaagcagctgcaggtgaagctggaggaggagaagacccacctgcaggagaagctgagactgcagcacgagatggagctgaaggccagactgacccaggcccaggccagcttcgagagagagagagagggcctgcagagcagcgcctggaccgaggagaaggtgagaggcctgacccaggagctggagcagttccaccaggagcagctgaccagcctggtggagaagcacaccctggagaaggaggagctgagaaaggagctgctggagaagcaccagagagagctgcaggagggcagagagaagatggagaccgagtgcaacagaagaaccagccagatcgaggcccagttccagagcgactgccagaaggtgaccgagagatgcgagagcgccctgcagagcctggagggcagatacagacaggagctgaaggacctgcaggagcagcagagagaggagaagagccagtgggagttcgagaaggacgagctgacccaggagtgcgccgaggcccaggagctgctgaaggagaccctgaagagagagaagaccaccagcctggtgctgacccaggagagagagatgctggagaagacctacaaggagcacctgaacagcatggtggtggagagacagcagctgctgcaggacctggaggacctgagaaacgtgagcgagacccagcagagcctgctgagcgaccagatcctggagctgaagagcagccacaagagagagctgagagagagagaggaggtgctgtgccaggccggcgccagcgagcagctggccagccagagactggagagactggagatggagcacgaccaggagagacaggagatgatgagcaagctgctggccatggagaacatccacaaggccacctgcgagaccgccgacagagagagagccgagatgagcaccgagatcagcagactgcagagcaagatcaaggagatgcagcaggccaccagccccctgagcatgctgcagagcggctgccaggtgatcggcgaggaggaggtggagggcgacggcgccctgagcctgctgcagcagggcgagcagctgctggaggagaacggcgacgtgctgctgagcctgcagagagcccacgagcaggccgtgaaggagaacgtgaagatggccaccgagatcagcagactgcagcagagactgcagaagctggagcccggcctggtgatgagcagctgcctggacgagcccgccaccgagttcttcggcaacaccgccgagcagaccgagcagttcctgcagcagaacagaaccaagcaggtggagggcgtgaccagaagacacgtgctgagcgacctggaggacgacgaggtgagagacctgggcagcaccggcaccagcagcgtgcagagacaggaggtgaagatcgaggagagcgaggccagcgtggagggcttcagcgagctggagaacagcgaggagaccagaaccgagagctgggagctgaagaaccagatcagccagctgcaggagcagctgatgatgctgtgcgccgactgcgacagagccagcgagaagaagcaggacctgctgttcgacgtgagcgtgctgaagaagaagctgaagatgctggagagaatccccgaggccagccccaagtacaagctgctgtacgaggacgtgagcagagagaacgactgcctgcaggaggagctgagaatgatggagaccagatacgacgaggccctggagaacaacaaggagctgaccgccgaggtgttcagactgcaggacgagctgaagaagatggaggaggtgaccgagaccttcctgagcctggagaagagctacgacgaggtgaagatcgagaacgagggcctgaacgtgctggtgctgagactgcagggcaagatcgagaagctgcaggagagcgtggtgcagagatgcgactgctgcctgtgggaggccagcctggagaacctggagatcgagcccgacggcaacatcctgcagctgaaccagaccctggaggagtgcgtgcccagagtgagaagcgtgcaccacgtgatcgaggagtgcaagcaggagaaccagtacctggagggcaacacccagctgctggagaaggtgaaggcccacgagatcgcctggctgcacggcaccatccagacccaccaggagagacccagagtgcagaaccaggtgatcctggaggagaacaccaccctgctgggcttccaggacaagcacttccagcaccaggccaccatcgccgagctggagctggagaagaccaagctgcaggagctgaccagaaagctgaaggagagagtgaccatcctggtgaagcagaaggacgtgctgagccacggcgagaaggaggaggagctgaaggccatgatgcacgacctgcagatcacctgcagcgagatgcagcagaaggtggagctgctgagatacgagagcgagaagctgcagcaggagaacagcatcctgagaaacgagatcaccaccctgaacgaggaggacagcatcagcaacctgaagctgggcaccctgaacggcagccaggaggagatgtggcagaagaccgagaccgtgaagcaggagaacgccgccgtgcagaagatggtggagaacctgaagaagcagatcagcgagctgaagatcaagaaccagcagctggacctggagaacaccgagctgagccagaagaacagccagaaccaggagaagctgcaggagctgaaccagagactgaccgagatgctgtgccagaaggagaaggagcccggcaacagcgccctggaggagagagagcaggagaagttcaacctgaaggaggagctggagagatgcaaggtgcagagcagcaccctggtgagcagcctggaggccgagctgagcgaggtgaagatccagacccacatcgtgcagcaggagaaccacctgctgaaggacgagctggagaagatgaagcagctgcacagatgccccgacctgagcgacttccagcagaagatcagcagcgtgctgagctacaacgagaagctgctgaaggagaaggaggccctgagcgaggagctgaacagctgcgtggacaagctggccaagagcagcctgctggagcacagaatcgccaccatgaagcaggagcagaagagctgggagcaccagagcgccagcctgaagagccagctggtggccagccaggagaaggtgcagaacctggaggacaccgtgcagaacgtgaacctgcagatgagcagaatgaagagcgacctgagagtgacccagcaggagaaggaggccctgaagcaggaggtgatgagcctgcacaagcagctgcagaacgccggcggcaagagctgggcccccgagatcgccacccaccccagcggcctgcacaaccagcagaagagactgagctgggacaagctggaccacctgatgaacgaggagcagcagctgctgtggcaggagaacgagagactgcagaccatggtgcagaacaccaaggccgagctgacccacagcagagagaaggtgagacagctggagagcaacctgctgcccaagcaccagaagcacctgaaccccagcggcaccatgaaccccaccgagcaggagaagctgagcctgaagagagagtgcgaccagttccagaaggagcagagccccgccaacagaaaggtgagccagatgaacagcctggagcaggagctggagaccatccacctggagaacgagggcctgaagaagaagcaggtgaagctggacgagcagctgatggagatgcagcacctgagaagcaccgccacccccagccccagcccccacgcctgggacctgcagctgctgcagcagcaggcctgccccatggtgcccagagagcagttcctgcagctgcagagacagctgctgcaggccgagagaatcaaccagcacctgcaggaggagctggagaacagaaccagcgagaccaacaccccccagggcaaccaggagcagctggtgaccgtgatggaggagagaatgatcgaggtggagcagaagctgaagctggtgaagagactgctgcaggagaaggtgaaccagctgaaggagcagctgtgcaagaacaccaaggccgacgccatggtgaaggacctgtacgtggagaacgcccagctgctgaaggccctggaggtgaccgagcagagacagaagaccgccgagaagaagaactacctgctggaggagaagatcgccagcctgagcaacatcgtgagaaacctgacccccgcccccctgaccagcaccccccccctgagaagctag

SEQ ID NO: 9840 - DNA, 2664 bp, Artificial Sequence
  Description of Artificial Sequence: Synthetic coding sequence
atgcccatcctgctgttcctgatcgacaccagcgccagcatgaaccagagaagccacctgggcaccacctacctggacaccgccaagggcgccgtggagaccttcatgaagctgagagccagagaccccgccagcagaggcgacagatacatgctggtgaccttcgaggagcccccctacgccatcaaggccggctggaaggagaaccacgccaccttcatgaacgagctgaagaacctgcaggccgagggcctgaccaccctgggccagagcctgagaaccgccttcgacctgctgaacctgaacagactggtgaccggcatcgacaactacggccagggcagaaaccccttcttcctggagcccgccatcatcatcaccatcaccgacggcagcaagctgaccaccaccagcggcgtgcaggacgagctgcacctgcccctgaacagccccctgcccggcagcgagctgaccaaggagcccttcagatgggaccagagactgttcgccctggtgctgagactgcccggcaccatgagcgtggagagcgagcagctgaccggcgtgcccctggacgacagcgccatcacccccatgtgcgaggtgaccggcggcagaagctacagcgtgtgcagccccagaatgctgaaccagtgcctggagagcctggtgcagaaggtgcagagcggcgtggtgatcaacttcgagaaggccggccccgaccccagccccgtggaggacggccagcccgacatcagcagacccttcggcagccagccctggcacagctgccacaagctgatctacgtgagacccaaccccaagaccggcgtgcccatcggccactggcccgtgcccgagagcttctggcccgaccagaacagccccaccctgccccccagaaccagccaccccgtggtgaagttcagctgcaccgactgcgagcccatggtgatcgacaagctgcccttcgacaagtacgagctggagcccagccccctgacccagttcatcctggagagaaagagcccccagacctgctggcaggtgtacgtgagcaacagcgccaagtacagcgagctgggccaccccttcggctacctgaaggccagcaccgccctgaactgcgtgaacctgttcgtgatgccctacaactaccccgtgctgctgcccctgctggacgacctgttcaaggtgcacaaggccaagcccaccctgaagtggagacagagcttcgagagctacctgaagaccatgcccccctactacctgggccccctgaagaaggccgtgagaatgatgggcgcccccaacctgatcgccgacagcatggagtacggcctgagctacagcgtgatcagctacctgaagaagctgagccagcaggccaagatcgagagcgacagagtgatcggcagcgtgggcaagaaggtggtgcaggagaccggcatcaaggtgagaagcagaagccacggcctgagcatggcctacagaaaggacttccagcagctgctgcagggcatcagcgaggacgtgccccacagactgctggacctgaacatgaaggagtacaccggcttccaggtggccctgctgaacaaggacctgaagccccagaccttcagaaacgcctacgacatccccagaagaaacctgctggaccacctgaccagaatgagaagcaacctgctgaagagcaccagaagattcctgaagggccaggacgaggaccaggtgcacagcgtgcccatcgcccagatgggcaactaccaggagtacctgaagcaggtgcccagccccctgagagagctggaccccgaccagcccagaagactgcacaccttcggcaaccccttcaagctggacaagaagggcatgatgatcgacgaggccgacgagttcgtggccggcccccagaacaagcacaagagacccggcgagcccaacatgcagggcatccccaagagaagaagatgcatgagccccctgctgagaggcagacagcagaaccccgtggtgaacaaccacatcggcggcaagggcccccccgcccccaccacccaggcccagcccgacctgatcaagcccctgcccctgcacaagatcagcgagaccaccaacgacagcatcatccacgacgtggtggagaaccacgtggccgaccagctgagcagcgacatcacccccaacgccatggacaccgagttcagcgccagcagccccgccagcctgctggagagacccaccaaccacatggaggccctgggccacgaccacctgggcaccaacgacctgaccgtgggcggcttcctggagaaccacgaggagcccagagacaaggagcagtgcgccgaggagaacatccccgccagcagcctgaacaagggcaagaagctgatgcactgcagaagccacgaggaggtgaacaccgagctgaaggcccagatcatgaaggagatcagaaagcccggcagaaagtacgagagaatcttcaccctgctgaagcacgtgcagggcagcctgcagaccagactgatcttcctgcagaacgtgatcaaggaggccagcagattcaagaagagaatgctgatcgagcagctggagaacttcctggacgagatccacagaagagccaaccagatcaaccacatcaacagcaactag

SEQ ID NO: 9841 - DNA, 1944 bp, Artificial Sequence
  Description of Artificial Sequence: Synthetic coding sequence
atgagcgacgaggtgttcagcaccaccctggcctacaccaagagccccaaggtgaccaagagaaccaccttccaggacgagctgatcagagccatcaccgccagaagcgccagacagagaagcagcgagtacagcgacgacttcgacagcgacgagatcgtgagcctgggcgacttcagcgacaccagcgccgacgagaacagcgtgaacaagaagatgaacgacttccacatcagcgacgacgaggagaagaaccccagcaagctgctgttcctgaagaccaacaagagcaacggcaacatcaccaaggacgagcccgtgtgcgccatcaagaacgaggaggagatggcccccgacggctgcgaggacatcgtggtgaagagcttcagcgagagccagaacaaggacgaggagttcgagaaggacaagatcaagatgaagcccaagcccagaatcctgagcatcaagagcaccagcagcgccgagaacaacagcctggacaccgacgaccacttcaagcccagccccagacccagaagcatgctgaagaagaagagccacatggaggagaaggacggcctggaggacaaggagaccgccctgagcgaggagctggagctgcacagcgcccccagcagcctgcccacccccaacggcatccagctggaggccgagaagaaggccttcagcgagaacctggaccccgaggacagctgcctgaccagcctggccagcagcagcctgaagcagatcctgggcgacagcttcagccccggcagcgagggcaacgccagcggcaaggaccccaacgaggagatcaccgagaaccacaacagcctgaagagcgacgagaacaaggagaacagcttcagcgccgaccacgtgaccaccgccgtggagaagagcaaggagagccaggtgaccgccgacgacctggaggaggagaaggccaaggccgagctgatcatggacgacgacagaaccgtggaccccctgctgagcaagagccagagcatcctgatcagcaccagcgccaccgccagcagcaagaagaccatcgaggacagaaacatcaagaacaagaagagcaccaacaacagagccagcagcgccagcgccagactgatgaccagcgagttcctgaagaagagcagcagcaagagaagaacccccagcaccaccaccagcagccactacctgggcaccctgaaggtgctggaccagaagcccagccagaagcagagcatcgagcccgacagagccgacaacatcagagccgccgtgtaccaggagtggctggagaagaagaacgtgtacctgcacgagatgcacagaatcaagagaatcgagagcgagaacctgagaatccagaacgagcagaagaaggccgccaagagagaggaggccctggccagcttcgaggcctggaaggccatgaaggagaaggaggccaagaagatcgccgccaagaagagactggaggagaagaacaagaagaagaccgaggaggagaacgccgccagaaagggcgaggccctgcaggccttcgagaagtggaaggagaagaagatggagtacctgaaggagaagaacagaaaggagagagagtacgagagagccaagaagcagaaggaggaggagaccgtggccgagaagaagaaggacaacctgaccgccgtggagaagtggaacgagaagaaggaggccttcttcaagcagaaggagaaggagaagatcaacgagaagagaaaggaggagctgaagagagccgagaagaaggacaaggacaagcaggccatcaacgagtacgagaagtggctggagaacaaggagaagcaggagagaatcgagagaaagcagaagaagagacacagcttcctggagagcgaggccctgcccccctggagcccccccagcagaaccgtgttcgccaaggtgttctag

SEQ ID NO: 9842 - DNA, 1074 bp, Artificial Sequence
  Description of Artificial Sequence: Synthetic coding sequence
atgcagaccttcctgaagggcaagagagtgggctactggctgagcgagaagaagatcaagaagctgaacttccaggccttcgccgagctgtgcagaaagagaggcatggaggtggtgcagctgaacctgagcagacccatcgaggagcagggccccctggacgtgatcatccacaagctgaccgacgtgatcctggaggccgaccagaacgacagccagagcctggagctggtgcacagattccaggagtacatcgacgcccaccccgagaccatcgtgctggaccccctgcccgccatcagaaccctgctggacagaagcaagagctacgagctgatcagaaagatcgaggcctacatggaggacgacagaatctgcagcccccccttcatggagctgaccagcctgtgcggcgacgacaccatgagactgctggagaagaacggcctgaccttccccttcatctgcaagaccagagtggcccacggcaccaacagccacgagatggccatcgtgttcaaccaggagggcctgaacgccatccagcccccctgcgtggtgcagaacttcatcaaccacaacgccgtgctgtacaaggtgttcgtggtgggcgagagctacaccgtggtgcagagacccagcctgaagaacttcagcgccggcaccagcgacagagagagcatcttcttcaacagccacaacgtgagcaagcccgagagcagcagcgtgctgaccgagctggacaagatcgagggcgtgttcgagagacccagcgacgaggtgatcagagagctgagcagagccctgagacaggccctgggcgtgagcctgttcggcatcgacatcatcatcaacaaccagaccggccagcacgccgtgatcgacatcaacgccttccccggctacgagggcgtgagcgagttcttcaccgacctgctgaaccacatcgccaccgtgctgcagggccagagcaccgccatggccgcccccagcggcgagttcagagccggcgacctgtgctgcgacctgggcaagagcttccaggtgttcggccccccccccccctgcctgtag

SEQ ID NO: 9843 - DNA, 852 bp, Artificial Sequence
  Description of Artificial Sequence: Synthetic coding sequence
atgctgagatgcggccagatgatcttcgcccaggccctggtgtgcagacacctgggcagagactggagatggacccagagaaagagacagcccgacagctacttcagcgtgctgaacgccttcatcgacagaaaggacagctactacagcatccaccagatcgcccagatgggcgtgggcgagggcaagagcatcggccagtggtacggccccaacaccgtggcccaggtgctgaagaagctggccgtgttcgacacctggagcagcctggccgtgcacatcgccatggacaacaccgtggtgatggaggagatcagaagactgtgcagaaccagcgtgccctgcgccggcgccaccgccttccccgccgacagcgacagacactgcaacggcttccccgccggcgccgaggtgaccaacagacccagcccctggagacccctggtgctgctgatccccctgagactgggcctgaccgacatcaacgaggcctacgtggagaccctgaagcactgcttcatgatgccccagagcctgggcgtgatcggcggcaagcccaacagcgcccactacttcatcggctacgtgggcgaggagctgatctacctggacccccacaccacccagcccgccgtggagcccaccgacggctgcttcatccccgacgagagcttccactgccagcaccccccctgcagaatgagcatcgccgagctggaccccagcatcgccgtggtgctgggcgtgggcaagcagggcagactggtgagaagcatcccctgggcccccagacccagcagctggtgcgccgccgtgctgggcgccgccgtggtgatgtgcggcaccccctag

SEQ ID NO: 9844 - DNA, 2160 bp, Artificial Sequence
  Description of Artificial Sequence: Synthetic coding sequence
atgggcttcagcaacatggaggacgacggccccgaggaggaggagagagtggccgagccccaggccaacttcaacaccccccaggccctgagattcgaggagctgctggccaacctgctgaacgagcagcaccagatcgccaaggagctgttcgagcagctgaagatgaagaagcccagcgccaagcagcagaaggaggtggagaaggtgaagccccagtgcaaggaggtgcaccagaccctgatcctggaccccgcccagagaaagagactgcagcagcagatgcagcagcacgtgcagctgctgacccagatccacctgctggccacctgcaaccccaacctgaaccccgaggccagcagcaccagaatctgcctgaaggagctgggcaccttcgcccagagcagcatcgccctgcaccaccagtacaaccccaagttccagaccctgttccagccctgcaacctgatgggcgccatgcagctgatcgaggacttcagcacccacgtgagcatcgactgcagcccccacaagaccgtgaagaagaccgccaacgagttcccctgcctgcccaagcaggtggcctggatcctggccaccagcaaggtgttcatgtaccccgagctgctgcccgtgtgcagcctgaaggccaagaacccccaggacaagatcctgttcaccaaggccgaggacaacaagtacctgctgacctgcaagaccgccagacagctgaccgtgagaatcaagaacctgaacatgaacagagcccccgacaacatcatcaagttctacaagaagaccaagcagctgcccgtgctgggcaagtgctgcgaggagatccagccccaccagtggaagccccccatcgagagagaggagcacagactgcccttctggctgaaggccagcctgcccagcatccaggaggagctgagacacatggccgacggcgccagagaggtgggcaacatgaccggcaccaccgagatcaacagcgaccagggcctggagaaggacaacagcgagctgggcagcgagaccagataccccctgctgctgcccaagggcgtggtgctgaagctgaagcccgtggccgacagattccccaagaaggcctggagacagaagagaagcagcgtgctgaagcccctgctgatccagcccagccccagcctgcagcccagcttcaaccccggcaagacccccgcccagagcacccacagcgaggccccccccagcaagatggtgctgagaatcccccaccccatccagcccgccaccgtgctgcagaccgtgcccggcgtgccccccctgggcgtgagcggcggcgagagcttcgagagccccgccgccctgcccgccatgccccccgaggccagaaccagcttccccctgagcgagagccagaccctgctgagcagcgcccccgtgcccaaggtgatgatgcccagccccgccagcagcatgttcagaaagccctacgtgagaagaagacccagcaagagaagaggcgccagagccttcagatgcatcaagcccgcccccgtgatccaccccgccagcgtgatcttcaccgtgcccgccaccaccgtgaagatcgtgagcctgggcggcggctgcaacatgatccagcccgtgaacgccgccgtggcccagagcccccagaccatccccatcgccaccctgctggtgaaccccaccagcttcccctgccccctgaaccagcccctggtggccagcagcgtgagccccctgatcgtgagcggcaacagcgtgaacctgcccatccccagcacccccgaggacaaggcccacatgaacgtggacatcgcctgcgccgtggccgacggcgagaacgccttccagggcctggagcccaagctggagccccaggagctgagccccctgagcgccaccgtgttccccaaggtggagcacagccccggccccccccccgtggacaagcagtgccaggagggcctgagcgagaacagcgcctacagatggaccgtggtgaagaccgaggagggcagacaggccctggagcccctgccccagggcatccaggagagcctgaacaacagcagccccggcgacctggaggaggtggtgaagatggagcccgaggacgccaccgaggagatcagcggcttcctgtag

SEQ ID NO: 9845 - DNA, 1134 bp, Artificial Sequence
  Description of Artificial Sequence: Synthetic coding sequence
atggaggccgccgccgtgaccgtgaccagaagcgccaccagaagaagaagaagacagctgcagggcctggccgcccccgaggccggcacccaggaggagcaggaggaccaggagcccagacccagaagaagaagacccggcagaagcatcaaggacgaggaggaggagaccgtgttcagagaggtggtgagcttcagccccgaccccctgcccgtgagatactacgacaaggacaccaccaagcccatcagcttctacctgagcagcctggaggagctgctggcctggaagcccagactggaggacggcttcaacgtggccctggagcccctggcctgcagacagccccccctgagcagccagagacccagaaccctgctgtgccacgacatgatgggcggctacctggacgacagattcatccagggcagcgtggtgcagaccccctacgccttctaccactggcagtgcatcgacgtgttcgtgtacttcagccaccacaccgtgaccatcccccccgtgggctggaccaacaccgcccacagacacggcgtgtgcgtgctgggcaccttcatcaccgagtggaacgagggcggcagactgtgcgaggccttcctggccggcgacgagagaagctaccaggccgtggccgacagactggtgcagatcacccagttcttcagattcgacggctggctgatcaacatcgagaacagcctgagcctggccgccgtgggcaacatgccccccttcctgagatacctgaccacccagctgcacagacaggtgcccggcggcctggtgctgtggtacgacagcgtggtgcagagcggccagctgaagtggcaggacgagctgaaccagcacaacagagtgttcttcgacagctgcgacggcttcttcaccaactacaactggagagaggagcacctggagagaatgctgggccaggccggcgagagaagagccgacgtgtacgtgggcgtggacgtgttcgccagaggcaacgtggtgggcggcagattcgacaccgacaagagcctggagctgatcagaaagcacggcttcagcgtggccctgttcgcccccggctgcagcgtgttccccggcgtgggcaacctgctgtgctgctag

SEQ ID NO: 9846 - DNA, 927 bp, Artificial Sequence
  Description of Artificial Sequence: Synthetic coding sequence
atgagaggcaagagaagaccccagaccagagccgccagaagactggccgcccaggagagcagcgaggccgaggacatgagcgtgcccagaggccccatcgcccagtgggccgacggcgccatcagccccaacggccacagaccccagctgagagccgccagcggcgaggacagcaccgaggaggccctggccgccgccgccgccccctgggagggcggccccgtgcccggcgtggacaccagccccttcgccaagagcctgggccacagcagaggcgaggccgacctgttcgacagcggcgacatcttcagcaccggcaccggcagccagagcgtggagagaaccaagcccaaggccaagatcgccgagaaccccgccaacccccccgtgggcggcaaggccaagagccccatgttccccgccctgggcgaggccagcagcgacgacgacctgttccagagcgccaagcccaagcccgccaagaagaccaaccccttccccctgctggaggacgaggacgacctgttcaccgaccagaaggtgaagaagaacgagaccaagagcagcagccagcaggacgtgatcctgaccacccaggacatcttcgaggacgacatcttcgccaccgaggccatcaagcccagccagaagaccagagagaaggagaagaccctggagagcaacctgttcgacgacaacatcgacatcttcgccgacctgaccgtgaagcccaaggagaagagcaagaagaaggtggaggccaagagcatcttcgacgacgacatggacgacatcttcagcaccggcatccaggccaagaccaccaagcccaagagcagaagcgcccaggccgcccccgagcccagattcgagcacaaggtgagcaacatcttcgacgaccccctgaacgccttcggcggccagtag

SEQ ID NO: 9847 - DNA, 933 bp, Artificial Sequence
  Description of Artificial Sequence: Synthetic coding sequence
atgctgaagaacaagggccacagcagcaagaaggacaacctggccgtgaacgccgtggccctgcaggaccacatcctgcacgacctgcagctgagaaacctgagcgtggccgaccacagcaagacccaggtgcagaagaaggagaacaagagcctgaagagagacaccaaggccatcatcgacaccggcctgaagaagaccacccagtgccccaagctggaggacagcgagaaggagtacgtgctggaccccaagcccccccccctgaccctggcccagaagctgggcctgatcggccccccccccccccccctgagcagcgacgagtgggagaaggtgaagcagagaagcctgctgcagggcgacagcgtgcagccctgccccatctgcaaggaggagttcgagctgagaccccaggtgctgctgagctgcagccacgtgttccacaaggcctgcctgcaggccttcgagaagttcaccaacaagaagacctgccccctgtgcagaaagaaccagtaccagaccagagtgatccacgacggcgccagactgttcagaatcaagtgcgtgaccagaatccaggcctactggagaggctgcgtggtgagaaagtggtacagaaacctgagaaagaccgtgccccccaccgacgccaagctgagaaagaagttcttcgagaagaagttcaccgagatcagccacagaatcctgtgcagctacaacaccaacatcgaggagctgttcgccgagatcgaccagtgcctggccatcaacagaagcgtgctgcagcagctggaggagaagtgcggccacgagatcaccgaggaggagtgggagaagatccaggtgcagaacgagaccagcgcctgcttcgaggacccctgcctgggcgcccacggcagccacttcagcctgagcaacttcctgctgtag

SEQ ID NO: 9848 - DNA, 1119 bp, Artificial Sequence
  Description of Artificial Sequence: Synthetic coding sequence
atgagagtgggccccgtgagaagcgccatgagcggcgccagccagcccagaggccccgccctgctgttccccgccaccagaggcgtgcccgccaagagactgctggacgccgacgacgccgccgccgtggccgccaagtgccccagactgagcgagtgcagcagcccccccgactacctgagcccccccggcagcccctgcagcccccagcccccccccgccgcccccggcgccggcggcggcagcggcagcgcccccggccccagcagaatcgccgactacctgctgctgcccctggccgagagagagcacgtgagcagagccctgtgcatccacaccggcagagagctgagatgcaaggtgttccccatcaagcactaccaggacaagatcagaccctacatccagctgcccagccacagcaacatcaccggcatcgtggaggtgatcctgggcgagaccaaggcctacgtgttcttcgagaaggacttcggcgacatgcacagctacgtgagaagcagaaagagactgagagaggaggaggccgccagactgttcaagcagatcgtgagcgccgtggcccactgccaccagagcgccatcgtgctgggcgacctgaagctgagaaagttcgtgttcagcaccgaggagagaacccagctgagactggagagcctggaggacacccacatcatgaagggcgaggacgacgccctgagcgacaagcacggctgccccgcctacgtgagccccgagatcctgaacaccaccggcacctacagcggcaaggccgccgacgtgtggagcctgggcgtgatgctgtacaccctgctggtgggcagataccccttccacgacagcgaccccagcgccctgttcagcaagatcagaagaggccagttctgcatccccgagcacatcagccccaaggccagatgcctgatcagaagcctgctgagaagagagcccagcgagagactgaccgcccccgagatcctgctgcacccctggttcgagagcgtgctggagcccggctacatcgacagcgagatcggcaccagcgaccagatcgtgcccgagtaccaggaggacagcgacatcagcagcttcttctgctag

SEQ ID NO: 9849 - DNA, 1554 bp, Artificial Sequence
  Description of Artificial Sequence: Synthetic coding sequence
atggagaccgacctgaacagccaggacagaaaggacctggacaagttcatcaagttcttcgccctgaagaccgtgcaggtgatcgtgcaggccagactgggcgagaagatctgcaccagaagcagcagcagccccaccggcagcgactggttcaacctggccatcaaggacatccccgaggtgacccacgaggccaagaaggccctggccggccagctgcccgccgtgggcagaagcatgtgcgtggagatcagcctgaagaccagcgagggcgacagcatggagctggagatctggtgcctggagatgaacgagaagtgcgacaaggagatcaaggtgagctacaccgtgtacaacagactgagcctgctgctgaagagcctgctggccatcaccagagtgacccccgcctacagactgagcagaaagcagggccacgagtacgtgatcctgtacagaatctacttcggcgaggtgcagctgagcggcctgggcgagggcttccagaccgtgagagtgggcaccgtgggcacccccgtgggcaccatcaccctgagctgcgcctacagaatcaacctggccttcatgagcaccagacagttcgagagaaccccccccatcatgggcatcatcatcgaccacttcgtggacagaccctaccccagcagcagccccatgcacccctgcaactacagaaccgccggcgaggacaccggcgtgatctaccccagcgtggaggacagccaggaggtgtgcaccaccagcttcagcaccagcccccccagccagctgagcagcagcagactgagctaccagcccgccgccctgggcgtgggcagcgccgacctggcctaccccgtggtgttcgccgccggcctgaacgccacccacccccaccagctgatggtgcccggcaaggagggcggcgtgcccctggcccccaaccagcccgtgcacggcacccaggccgaccaggagagactggccacctgcacccccagcgacagaacccactgcgccgccacccccagcagcagcgaggacaccgagaccgtgagcaacagcagcgagggcagagccagcccccacgacgtgctggagaccatcttcgtgagaaaggtgggcgccttcgtgaacaagcccatcaaccaggtgaccctgaccagcctggacatccccttcgccatgttcgcccccaagaacctggagctggaggacaccgaccccatggtgaacccccccgacagccccgagaccgagagccccctgcagggcagcctgcacagcgacggcagcagcggcggcagcagcggcaacacccacgacgacttcgtgatgatcgacttcaagcccgccttcagcaaggacgacatcctgcccatggacctgggcaccttctacagagagttccagaaccccccccagctgagcagcctgagcatcgacatcggcgcccagagcatggccgaggacctggacagcctgcccgagaagctggccgtgcacgagaagaacgtgagagagttcgacgccttcgtggagaccctgcagtag

SEQ ID NO: 9850 - DNA, 1488 bp, Artificial Sequence
  Description of Artificial Sequence: Synthetic coding sequence
atgtggagaggctgcgccagaagcagaaagagaaagaaggtggacaacgactacaacgccctgagagagagactgagcaccctgcccgacaagctgagctacaacatcatggtgcccttcggccccttcgccttcatgcccggcaagctggtgcacaccaacgaggtgaccgtgctgctgggcgacaactggttcgccaagtgcagcgccaagcaggccgtgggcctggtggagcacagaaaggagcacgtgagaaagaccatcgacgacctgaagaaggtgatgaagaacttcgagagcagagtggagttcaccgaggacctgcagaagatgagcgacgccgccggcgacatcgtggacatcagagaggagatcaagtgcgacttcgagttcaaggccaagcacagaatcgcccacaagccccacagcaagcccaagaccagcgacatcttcgaggccgacatcgccaacgacgtgaagagcaaggacctgctggccgacaaggagctgtgggccagactggaggagctggagagacaggaggagctgctgggcgagctggacagcaagcccgacaccgtgatcgccaacggcgaggacaccaccagcagcgaggaggagaaggaggacagaaacaccaacgtgaacgccatgcaccaggtgaccgacagccacaccccctgccacaaggacgtggccagcagcgagcccttcagcggccaggtgaacagccagctgaactgcagcgtgaacggcagcagcagctaccacagcgacgacgacgacgacgacgacgacgacgacgacgacgacaacatcgacgacgacgacggcgacaacgaccacgaggccctgggcgtgggcgacaacagcatccccaccatctacttcagccacaccgtggagcccaagagagtgagaatcaacaccggcaagaacaccaccctgaagttcagcgagaagaaggaggaggccaagagaaagagaaagaacagcaccggcagcggccacagcgcccaggagctgcccaccatcagaacccccgccgacatctacagagccttcgtggacgtggtgaacggcgagtacgtgcccagaaagagcatcctgaagagcagaagcagagagaacagcgtgtgcagcgacaccagcgagagcagcgccgccgagttcgacgacagaagaggcgtgctgagaagcatcagctgcgaggaggccacctgcagcgacaccagcgagagcatcctggaggaggagccccaggagaaccagaagaagctgctgcccctgagcgtgacccccgaggccttcagcggcaccgtgatcgagaaggagttcgtgagccccagcctgacccccccccccgccatcgcccaccccgccctgcccaccatccccgagagaaaggaggtgctgctggaggccagcgaggagaccggcaagagagtgagcaagttcaaggccgccagactgcagcagaaggactag

SEQ ID NO: 9851 - DNA, 1458 bp, Artificial Sequence
  Description of Artificial Sequence: Synthetic coding sequence
atgtgccaggtgggcgaggactacggcgagcccgcccccgaggagcccccccccgcccccagacccagcagagagcagaagtgcgtgaagtgcaaggaggcccagcccgtggtggtgatcagagccggcgacgccttctgcagagactgcttcaaggccttctacgtgcacaagttcagagccatgctgggcaagaacagactgatcttccccggcgagaaggtgctgctggcctggagcggcggccccagcagcagcagcatggtgtggcaggtgctggagggcctgagccaggacagcgccaagagactgagattcgtggccggcgtgatcttcgtggacgagggcgccgcctgcggccagagcctggaggagagaagcaagaccctggccgaggtgaagcccatcctgcaggccaccggcttcccctggcacgtggtggccctggaggaggtgttcagcctgccccccagcgtgctgtggtgcagcgcccaggagctggtgggcagcgagggcgcctacaaggccgccgtggacagcttcctgcagcagcagcacgtgctgggcgccggcggcggccccggccccacccagggcgaggagcagcccccccagccccccctggacccccagaacctggccagaccccccgcccccgcccagaccgaggccctgagccagctgttctgcagcgtgagaaccctgaccgccaaggaggagctgctgcagaccctgagaacccacctgatcctgcacatggccagagcccacggctacagcaaggtgatgaccggcgacagctgcaccagactggccatcaagctgatgaccaacctggccctgggcagaggcgccttcctggcctgggacaccggcttcagcgacgagagacacggcgacgtggtggtggtgagacccatgagagaccacaccctgaaggaggtggccttctacaacagactgttcagcgtgcccagcgtgttcacccccgccgtggacaccaaggcccccgagaaggccagcatccacagactgatggaggccttcatcctgagactgcagacccagttccccagcaccgtgagcaccgtgtacagaaccagcgagaagctggtgaagggccccagagacggccccgccgccggcgacagcggccccagatgcctgctgtgcatgtgcgccctggacgtggacgccgccgacagcgccaccgccttcggcgcccagaccagcagcagactgagccagatgcagagccccatccccctgaccgagaccagaaccccccccggcccctgctgcagccccggcgtgggctgggcccagagatgcggccagggcgcctgcagaagagaggacccccaggcctgcatcgaggagcagctgtgctacagctgcagagtgaacatgaaggacctgggcctgggcctggccggcgaccccggcctgagcgactag

SEQ ID NO: 9852 - DNA, 1353 bp, Artificial Sequence
  Description of Artificial Sequence: Synthetic coding sequence
atgagcctgagactgagcagcgccagcagaagaagctgccccagacccaccaccggcagcctgagactgtacggcggcggcaccagcttcggcaccggcaacagctgcggcatcagcggcatcggcagcggcttcagcagcgccttcggcggcagcagcagcggcggcaacaccggcggcggcaacccctgcgccggcttcaccgtgaacgagagaggcctgctgagcggcaacgagaaggtgaccatgcagaacctgaacgacagactggccagctacctggacagcgtgcacgccctggaggaggccaacgccgacctggagcagaagatcaagggctggtacgagaagttcggccccggcagctgcagaggcctggaccacgactacagcagatacttccccatcatcgacgacctgaagaaccagatcatcgccagcaccaccagcaacgccaacgccgtgctgcagatcgacaacgccagactgaccgccgacgacttcagactgaagtacgagaacgagctggccctgcaccagagcgtggaggccgacgtgaacggcctgagaagagtgctggacgagatcaccctgtgcagaaccgacctggagatccagtacgagaccctgagcgaggagatgacctacctgaagaagaaccacaaggaggagatgcaggtgctgcagtgcgccgccggcggcaacgtgaacgtggagatgaacgccgcccccggcgtggacctgaccgtgctgctgaacaacatgagagccgagtacgaggccctggccgagcagaacagaagagacgccgaggcctggttcaacgagaagagcgccagcctgcagcagcagatcagcgaggacgtgggcgccaccaccagcgccagaaacgagctgaccgagatgaagagaaccctgcagaccctggagatcgagctgcagagcctgctggccaccaagcacagcctggagtgcagcctgaccgagaccgagagcaactactgcgcccagctggcccagatccaggcccagatcggcgccctggaggagcagctgcaccaggtgagaaccgagaccgagggccagaagctggagtacgagcagctgctggacatcaagctgcacctggagaaggagatcgagacctactgcctgctgatcggcggcgacgacggcgcctgcaagagcggcggctacaagagcaaggactacggcagcggcaacgtgggcagccaggtgaaggaccccgccaaggccatcgtggtgaagaaggtgctggaggaggtggaccagagaagcaagatcctgaccaccagactgcacagcctggaggagaagagccagagcaactag

SEQ ID NO: 9853 - DNA, 2679 bp, Artificial Sequence
  Description of Artificial Sequence: Synthetic coding sequence
atggaccagcccgaggccccctgcagcagcaccggccccagactggccgtggccagagagctgctgctggccgccctggaggagctgagccaggagcagctgaagagattcagacacaagctgagagacgtgggccccgacggcagaagcatcccctggggcagactggagagagccgacgccgtggacctggccgagcagctggcccagttctacggccccgagcccgccctggaggtggccagaaagaccctgaagagagccgacgccagagacgtggccgcccagctgcaggagagaagactgcagagactgggcctgggcagcggcaccctgctgagcgtgagcgagtacaagaagaagtacagagagcacgtgctgcagctgcacgccagagtgaaggagagaaacgccagaagcgtgaagatcaccaagagattcaccaagctgctgatcgcccccgagagcgccgcccccgaggaggccatgggccccgccgaggagcccgagcccggcagagccagaagaagcgacacccacaccttcaacagactgttcagaagagacgaggagggcagaagacccctgaccgtggtgctgcagggccccgccggcatcggcaagaccatggccgccaagaagatcctgtacgactgggccgccggcaagctgtaccagggccaggtggacttcgccttcttcatgccctgcggcgagctgctggagagacccggcaccagaagcctggccgacctgatcctggaccagtgccccgacagaggcgcccccgtgccccagatgctggcccagccccagagactgctgttcatcctggacggcgccgacgagctgcccgccctgggcggccccgaggccgccccctgcaccgaccccttcgaggccgccagcggcgccagagtgctgggcggcctgctgagcaaggccctgctgcccaccgccctgctgctggtgaccaccagagccgccgcccccggcagactgcagggcagactgtgcagcccccagtgcgccgaggtgagaggcttcagcgacaaggacaagaagaagtacttctacaagtacttcagagacgagagaagagccgagagagcctacagattcgtgaaggagaacgagaccctgttcgccctgtgcttcgtgcccttcgtgtgctggatcgtgtgcaccgtgctgagacagcagctggagctgggcagagacctgagcagaaccagcaagaccaccaccagcgtgtacctgctgttcatcaccagcgtgctgagcagcgcccccgtggccgacggccccagactgcagggcgacctgagaaacctgtgcagactggccagagagggcgtgctgggcagaagagcccagttcgccgagaaggagctggagcagctggagctgagaggcagcaaggtgcagaccctgttcctgagcaagaaggagctgcccggcgtgctggagaccgaggtgacctaccagttcatcgaccagagcttccaggagttcctggccgccctgagctacctgctggaggacggcggcgtgcccagaaccgccgccggcggcgtgggcaccctgctgagaggcgacgcccagccccacagccacctggtgctgaccaccagattcctgttcggcctgctgagcgccgagagaatgagagacatcgagagacacttcggctgcatggtgagcgagagagtgaagcaggaggccctgagatgggtgcagggccagggccagggctgccccggcgtggcccccgaggtgaccgagggcgccaagggcctggaggacaccgaggagcccgaggaggaggaggagggcgaggagcccaactaccccctggagctgctgtactgcctgtacgagacccaggaggacgccttcgtgagacaggccctgtgcagattccccgagctggccctgcagagagtgagattctgcagaatggacgtggccgtgctgagctactgcgtgagatgctgccccgccggccaggccctgagactgatcagctgcagactggtggccgcccaggagaagaagaagaagagcctgggcaagagactgcaggccagcctgggcggcggcagcagcagccagggcaccaccaagcagctgcccgccagcctgctgcaccccctgttccaggccatgaccgaccccctgtgccacctgagcagcctgaccctgagccactgcaagctgcccgacgccgtgtgcagagacctgagcgaggccctgagagccgcccccgccctgaccgagctgggcctgctgcacaacagactgagcgaggccggcctgagaatgctgagcgagggcctggcctggccccagtgcagagtgcagaccgtgagagtgcagctgcccgacccccagagaggcctgcagtacctggtgggcatgctgagacagagccccgccctgaccaccctggacctgagcggctgccagctgcccgcccccatggtgacctacctgtgcgccgtgctgcagcaccagggctgcggcctgcagaccctgagcctggccagcgtggagctgagcgagcagagcctgcaggagctgcaggccgtgaagagagccaagcccgacctggtgatcacccaccccgccctggacggccacccccagccccccaaggagctgatcagcaccttctag

SEQ ID NO: 9854 - DNA, 1047 bp, Artificial Sequence
  Description of Artificial Sequence: Synthetic coding sequence
atgggcaaggactactacaagatcctgggcatccccagcggcgccaacgaggacgagatcaagaaggcctacagaaagatggccctgaagtaccaccccgacaagaacaaggagcccaacgccgaggagaagttcaaggagatcgccgaggcctacgacgtgctgagcgaccccaagaagagaggcctgtacgaccagtacggcgaggagggcctgaagaccggcggcggcaccagcggcggcagcagcggcagcttccactacaccttccacggcgacccccacgccaccttcgccagcttcttcggcggcagcaaccccttcgacatcttcttcgccagcagcagaagcaccagacccttcagcggcttcgaccccgacgacatggacgtggacgaggacgaggaccccttcggcgccttcggcagattcggcttcaacggcctgagcagaggccccagaagagcccccgagcccctgtaccccagaagaaaggtgcaggacccccccgtggtgcacgagctgagagtgagcctggaggagatctaccacggcagcaccaagagaatgaagatcaccagaagaagactgaaccccgacggcagaaccgtgagaaccgaggacaagatcctgcacatcgtgatcaagagaggctggaaggagggcaccaagatcaccttccccaaggagggcgacgccacccccgacaacatccccgccgacatcgtgttcgtgctgaaggacaagccccacgcccacttcagaagagacggcaccaacgtgctgtacagcgccctgatcagcctgaaggaggccctgtgcggctgcaccgtgaacatccccaccatcgacggcagagtgatccccctgccctgcaacgacgtgatcaagcccggcaccgtgaagagactgagaggcgagggcctgcccttccccaaggtgcccacccagagaggcgacctgatcgtggagttcaaggtgagattccccgacagactgaccccccagaccagacagatcctgaagcagcacctgccctgcagctag

SEQ ID NO: 9855 - DNA, 1899 bp, Artificial Sequence
  Description of Artificial Sequence: Synthetic coding sequence
atggacaccatgatgctgaacgtgagaaacctgttcgagcagctggtgagaagagtggagatcctgagcgagggcaacgaggtgcagttcatccagctggccaaggacttcgaggacttcagaaagaagtggcagagaaccgaccacgagctgggcaagtacaaggacctgctgatgaaggccgagaccgagagaagcgccctggacgtgaagctgaagcacgccagaaaccaggtggacgtggagatcaagagaagacagagagccgaggccgactgcgagaagctggagagacagatccagctgatcagagagatgctgatgtgcgacaccagcggcagcatccagctgagcgaggagcagaagagcgccctggccttcctgaacagaggccagcccagcagcagcaacgccggcaacaagagactgagcaccatcgacgagagcggcagcatcctgagcgacatcagcttcgacaagaccgacgagagcctggactgggacagcagcctggtgaagaccttcaagctgaagaagagagagaagagaagaagcaccagcagacagttcgtggacggcccccccggccccgtgaagaagaccagaagcatcggcagcgccgtggaccagggcaacgagagcatcgtggccaagaccaccgtgaccgtgcccaacgacggcggccccatcgaggccgtgagcaccatcgagaccgtgccctactggaccagaagcagaagaaagaccggcaccctgcagccctggaacagcgacagcaccctgaacagcagacagctggagcccagaaccgagaccgacagcgtgggcaccccccagagcaacggcggcatgagactgcacgacttcgtgagcaagaccgtgatcaagcccgagagctgcgtgccctgcggcaagagaatcaagttcggcaagctgagcctgaagtgcagagactgcagagtggtgagccaccccgagtgcagagacagatgccccctgccctgcatccccaccctgatcggcacccccgtgaagatcggcgagggcatgctggccgacttcgtgagccagaccagccccatgatccccagcatcgtggtgcactgcgtgaacgagatcgagcagagaggcctgaccgagaccggcctgtacagaatcagcggctgcgacagaaccgtgaaggagctgaaggagaagttcctgagagtgaagaccgtgcccctgctgagcaaggtggacgacatccacgccatctgcagcctgctgaaggacttcctgagaaacctgaaggagcccctgctgaccttcagactgaacagagccttcatggaggccgccgagatcaccgacgaggacaacagcatcgccgccatgtaccaggccgtgggcgagctgccccaggccaacagagacaccctggccttcctgatgatccacctgcagagagtggcccagagcccccacaccaagatggacgtggccaacctggccaaggtgttcggccccaccatcgtggcccacgccgtgcccaaccccgaccccgtgaccatgctgcaggacatcaagagacagcccaaggtggtggagagactgctgagcctgcccctggagtactggagccagttcatgatggtggagcaggagaacatcgaccccctgcacgtgatcgagaacagcaacgccttcagcaccccccagacccccgacatcaaggtgagcctgctgggccccgtgaccacccccgagcaccagctgctgaagacccccagcagcagcagcctgagccagagagtgagaagcaccctgaccaagaacacccccagattcggcagcaagagcaagagcgccaccaacctgggcagacagggcaacttcttcgccagccccatgctgaagtag

SEQ ID NO: 9856 - DNA, 12075 bp, Artificial Sequence
  Description of Artificial Sequence: Synthetic coding sequence
atgagcagcgagcaggacaagagcgccagcaaggagaagagcaagaagcccgtgagattcctgccccagctgagcatggagaagctggccagcaaggagaagttcaaggcccccgccagagccctgccccagctgagcatggtgagcaccaagccccactggcagcaggccgcccccagcttccacctgagcgtgaagcaggacgacgagagccccgagcccttcagcgtgaagaacgagcagagccacgccgagtacatggagagattcggcaagaagggcaagctgccccaccaggtggacgacagctacgtgggccccagcaccagcaagagcaagggcaagagcccccacaaggagagagagaacttcagaagcaccctggtgaacgtgatcatgcagcaggacgccgacctggacagcgccgtgcccgacggcagcaccatccccaagcccaccgccagcgccatcgagaaggacatcctgagatactactactacatccaccacggcatcgacaccgaccacgtggcccccatggaggacagctggctggagcacgtgctggacctggtgccccagcacctgaaggtgttcaccgacagcatcgtgaccctgagcgacgagatgagagaggactacctgctgagcgtgagaaagagcatcgtggacttcgtgctgaaggaccccagagagaagggcgacgacaagaagaccgacgagctgcccgcccacagagccgagatggagatcctgcccaagccctggagaaagagcttcctggccgccagcagctacatcagagaccacctgaacgccatgaaccccaccatgctggccgtgctggacctgtggcacaccaacttcaagaagctgagactggtggacatcaaggagttccacaactgccaggacgccctggagctgagcagcttccagaacatcatcatgagacacatggacagcgccaaggagaccctgctgaagatgtggttccccgaggtgcagaacatctactaccagggcaacaagaagaagcagctgcccaccggcgacagcagcgccaagctggagagcttcttcaactgcgccgccgccctgatgaccctgcagctgcaggacctgaccctggtgagcatgcaggacttcaccgacctgatcgcccagccccccgacagcgtgagagccttcgagcaccccggcttcatcatgagactgatcctggacaacgacaccatcaagttcgagcccgagctgagcgactacatcgacatcttcctgaacgtgtacgacgtgatgatcaaggccgtgagcttcgtgcccagagtggagaccaagctgtacagcaagtgggagagcaagagcaagcccaccaccctgaagcccatcatcctgaacgagatcgtggacgcccacaaggagaagatcaaggaggtgatcatgaaggagagcgtggcccccaccgagcacctgagactgtacgacaagtacgacttcctgatcaccagaaaggccgagagagacgtggacaacttcctggccgagaaccacagctacgagaagatcatcgacgagatctgcaagtaccagaagctgatcgaggagatccagtacaccagcatcaagaccatcagactgggcatgttcgagatgcactgcgaggagctgatcagagccctggtgaagagagccgacatcatctgcggcaagctgctggccaagatgttcagagaccaccaggaggtgaacaccagactgtgcgacgagttcgagagaatcgccgagaaggccctgagcaccccccccaacaccgccgagctgatggagatgaaggcctacatccagaaggtggaggtgaccgacatgatcgagctggagcagagactggtggacagcaagaactgcctggccttcctgatcgagtacgtgaacttcagccccgccgacatgagactgaacaacagcgtgttccagtggtacggcagaatgggcgagatcttcgaggagcacagaaagatcatcaaggagaagatcgagcagtaccaggagggcctgaagctgagatgcgagagattcgtggaggagctggagagctacgccaagcagagcgaggagttctacagcttcggcgacctgcaggacgtgcagagatacctgaagaaggcccagatcctgaacggcaagctggacctggccgccgacaagatcgagcagttcaacgccgaggaggaggccttcggctggctgcccagcgtgtacccccagagaaagaagatccaggacggcctgaacccctacctgagactgtacgagaccgccgtggagttcagcagcaactacagagcctggaccgagggcccctaccacaaggtgaaccccgaccaggtggaggccgacatcggcaactactggagaggcctgtacaagctggagaagaccttccacgacagcccctacgccctggccatgaccaagaaggtgagaagcaaggtggaggacttcaagcagcacatccccctgatccaggtgatctgcaaccccggcctgagacccagacactgggaggccatgagcgccatcgtgggctaccccctgcagcccagcgacgacagcaccgtgagcagcttcctggacatgaacctggagccctacatcgacagattcgagggcatcagcgaggccgccagcaaggagtacagcctggagaaggccatggagaagatgatcaccgagtgggacgccgtggagttcgtgatccacagctacagagagaccggcaccttcatcctggccagcgtggacgagatccagatgctgctggacgaccacatcatcaagacccagaccatgagaggcagccccttcatcaagccctacgagaagcagatgagagagtgggagggcaagctgctgctgctgcaggagatcctggacgagtggctgaaggtgcaggccacctggctgtacctggagcccatcttcagcagccccgacatcatgagccagatgcccgaggagggcagaagattcaccgccgtggacaagacctggagagacatcatgagaagcgtgatgcaggacaagcacgtgctgaccgtggtgaccatcgacagaatgctggagagactgaagaagagcaacgagctgctggagctgatcctgaagggcctgaacgagtacctggagaagaagagactgttcttccccagattcttcttcctgagcaacgacgagctgctggagatcctgagcgagaccaaggaccccaccagagtgcagccccacctgaagaagtgcttcgagggcatcgccaaggtggagttcaccgagaccctggacatcacccacatgaagagcagcgagggcgaggtggtggagctgatcgagatcatcagcaccgccaaggccagaggccaggtggagaagtggctggtggagctggagagagtgatgatcaacagcatccacaaggtgaccggcgacgccaccttcgcctacaccaagtacgagagaatcaactgggtgagagactggcccggccagaccgtgctgtgcgtgagccagatcttctggaccaaggaggtgcagaccgccatccccatgggcatcaaggccctggagcagtacctgaagacctgcaacagacagatcgacgacatcgtgaccctggtgagaggcaagctgagcatgcagaacagagtgaccctgggcgccctggtggtgctggacgtgcacgccagagacgtgctgagcagcctggtgaagaagaacatcagcgacgacagcgacttcgagtggctgagccagctgagatactactggcaggagaaccacctggagaccaagatgatcaacgccggcctgagatacggctacgagtacctgggcaacagccccagactggtgatcacccccctgaccgacagatgctacagaaccctgttcggcgccctgcacctgcacctgggcggcgcccccgagggccccgccggcaccggcaagaccgagaccaccaaggacctggccaaggccgtggccaagcagtgcgtggtgttcaactgcagcgacggcctggactacctggccctgggcaagttcttcaagggcctgctgagctgcggcgcctgggcctgcttcgacgagttcaacagaatcgacctggaggtgctgagcgtggtggcccagcagatcctgaccatccagagaggcatcaacgccggcgccgacatcctgatgttcgagggcaccgagctgaagctggaccccacctgcgccgtgttcatcaccatgaaccccggctacgccggcagaagcgagctgcccgacaacctgaaggccctgttcagaaccgtggccatgatggtgcccgactacgccatgatcgccgagatcgtgctgtacagctgcggcttcgtgaccgccagacccctgagcgtgaagatcgtggccacctacagactgtgcagcgagcagctgagcagccagcaccactacgactacggcatgagagccgtgaagagcgtgctgaccgccgccggcaacctgaagctgaagtaccccaacgagaacgaggagatcctgctgctgagaagcatcatcgacgtgaacctgcccaagttcctgagccacgacctgcccctgttcgagggcatcaccagcgacctgttccccggcgtgaagctgcccaagcccgactacaacgacctgctggccgccatcaaggacaactgcgccagcatgaacctgcagatgaccgccttcttcagcgagaagatcctgcaggtgtacgagatgatgatcgtgagacacggcttcatgatcgtgggcgagcccttcggcggcaagaccagcgcctacagagtgctggccggcgccctgaacgacatctgcgagaagggcctgatggaggagaacaaggtgcagatcaccgtgctgaaccccaagagcgtgaccatgggccagctgtacggccagttcgacagcgtgagccacgagtggagcgacggcgtgctggccgtgagcttcagagccttcgccagcagcgtgacccccgacagaaagtggctgatcttcgacggccccgtggacgccgtgtggatcgagaacatgaacaccgtgctggacgacaacaagaagctgtgcctgatgagcggcgagatcatccagatgagcccccagatgaacctgatcttcgagcccatggacctggaggtggccagccccgccaccgtgagcagatgcggcatgatctacatggagccccacatgctgggctggagacccctgatgctgagctgggtgaacctgctgcccgccagcgtgagcgtgatccagaaggagttcatcatgggcctgttcgacagaatggtgcccgtgagcgtggagttcatcagaaagcacaccaaggagctgagccccaccagcgacaccaacctggtgagaagcctgatgaacctgatcgactgcttcatggacgacttcgccgacgaggtgaagctgaaggagagaaacgacagagagacctacagcctgctggagggcatcttcctgttcagcctgatctggagcgtgggcgccagctgcaccgacgacgacagactgaagttcaacaagatcctgagagagctgatggagagccccatcagcgacagaaccagaaacaccttcaagctgcagagcggcaccgagcagaccagcagcaaggccctgaccgtgcccttccccgagaagggcaccatctacgactaccagttcgtgaccgagggcatcggcaagtgggagccctggatcaagaagctgaaggaggccccccccatccccaaggacgtgatgttcaacgagatcatcgtgcccaccctggacaccatcagatacagcgccctgatggagctgctgaccacccaccagaagcccagcatcttcgtgggccccaccggcaccggcaagagcgtgtacatcaccaacttcctgctgaaccagctgaacaaggagatctacaagcccctgctgatcaacttcagcgcccagaccaccgccgcccagacccagaacatcgtgatgagcaagctggacaagagaagaaagggcgtgttcggcccccccctgggcaagagaatggtggtgttcgtggacgacgtgaacatgcccgccagagaggtgtacggcgcccagccccccatcgagctgctgagacagtggctggaccactggaactggtacgacctgaaggactgcagcatgatcaagctggtggacatccagatcatgtgcgccatgggcccccccggcggcggcagaaaccccgtgacccccagatacatgagacacttcaacatcatcaccatcaacgagttcagcgacaagagcatgtacaccatcttcagcagaatcctgacctggcacctggagatctgctacaagttccccgacgagttcctggacctgaccacccagatcgtgaacggcaccatgaccctgtacaaggaggccatgaagaacctgctgcccacccccgccaagagccactacctgttcaacctgagagacttcagcagagtgatccagggcgtgtgcctgagcagacccgagaccaccgagaccaccgaggtgatcaagagactgtgggtgcacgaggtgctgagagtgtactacgacagactgctggacaacaccgacagaagctggctgatcaactacatccaggagatcctgagaaactacatgtacgaggacttccacgagctgttccagagactggacttcgacaacgacggcatggtggaggccgacgacctgagaagcctgatgttctgcgacttccacgaccccaagagagaggacaccaactacagagagatcgccgacgtggacaacctgagaatgatcgtggagatccacctggaggagtacaacaacatcagcaagaagcccatgaacctggtgctgttcagattcgccatcgagcacatcagcagaatcagcagaatcctgaagcagcccagaagccacgccctgctggtgggcgtgggcggcagcggcagacagagcgtgaccagactggccgcccacatggccgactacagcgtgttccaggtggagatcagcaagggctacgacaccaccgagtggcacgaggacctgaaggtgatcctgagaaagtgcgccgagggcgagatgcagggcgtgttcctgttcaccgacacccagatcaaggaggagagcttcctggaggacgtgagcaacctgctgaacgccggcgagatccccaacctgttcgccctggacgagaagcaggagatctgcgacaagatgagacagctggacagacagagagacaagaccaagcagaccgacggcagccccatcgccctgttcaacatgttcatcgaccactgcagaagccagctgcacgtggtgctggccatgagccccatcggcgacgccttcagaaacagactgagaaagttccccgccctggtgaactgctgcaccatcgactggttccagagctggcccgaggacgccctgcaggccgtggccagcagattcctggaggagatcgagatgagcgaggagatcagagacggctgcatcgacatgtgcaagagcttccacaccagcaccatcgacctgagcaagagcttcttcgtggagctgcagagatacaactacgtgacccccaccagctacctggagctgatcagcaccttcaagctgctgctggagaagaagagaagcgaggtgatgaagatgaagaagagatacgaggtgggcctggagaagctggacagcgccagcagccaggtggccaccatgcagatggagctggaggccctgcacccccagctgaaggtggccagcaaggaggtggacgagatgatgatcatgatcgagaaggagagcgtggaggtggccaagaccgagaagatcgtgaaggccgacgagaccatcgccaacgagcaggccatggccagcaaggccatcaaggacgagtgcgacgccgacctggccggcgccctgcccatcctggagagcgccctggccgccctggacaccctgaccgcccaggacatcaccgtggtgaagagcatgaagagcccccccgccggcgtgaagctggtgatggaggccatctgcatcctgaagggcatcaaggccgacaagatccccgaccccaccggcagcggcaagaagatcgaggacttctggggccccgccaagagactgctgggcgacatgagattcctgcagagcctgcacgagtacgacaaggacaacatcccccccgcctacatgaacatcatcagaaagaactacatccccaaccccgacttcgtgcccgagaagatcagaaacgccagcaccgccgccgagggcctgtgcaagtgggtgatcgccatggacagctacgacaaggtggccaagatcgtggcccccaagaagatcaagctggccgccgccgagggcgagctgaagatcgccatggacggcctgagaaagaagcaggccgccctgaaggaggtgcaggacaagctggccagactgcaggacaccctggagctgaacaagcagaagaaggccgacctggagaaccaggtggacctgtgcagcaagaagctggagagagccgagcagctgatcggcggcctgggcggcgagaagaccagatggagccacaccgccctggagctgggccagctgtacatcaacctgaccggcgacatcctgatcagcagcggcgtggtggcctacctgggcgccttcaccagcacctacagacagaaccagaccaaggagtggaccaccctgtgcaagggcagagacatcccctgcagcgacgactgcagcctgatgggcaccctgggcgaggccgtgaccatcagaacctggaacatcgccggcctgcccagcgacagcttcagcatcgacaacggcatcatcatcatgaacgccagaagatggcccctgatgatcgacccccagagccaggccaacaagtggatcaagaacatggagaaggccaacagcctgtacgtgatcaagctgagcgagcccgactacgtgagaaccctggagaactgcatccagttcggcacccccgtgctgctggagaacgtgggcgaggagctggaccccatcctggagcccctgctgctgaagcagaccttcaagcagggcggcagcacctgcatcagactgggcgacagcaccatcgagtacgcccccgacttcagattctacatcaccaccaagctgagaaacccccactacctgcccgagaccagcgtgaaggtgaccctgctgaacttcatgatcacccccgagggcatgcaggaccagctgctgggcatcgtggtggcccaggagagacccgacctggaggaggagaagcaggccctgatcctgcagggcgccgagaacaagagacagctgaaggagatcgaggacaagatcctggaggtgctgagcagcagcgagggcaacatcctggaggacgagaccgccatcaagatcctgagcagcagcaaggccctggccaacgagatcagccagaagcaggaggtggccgaggagaccgagaagaagatcgacaccaccagaatgggctacagacccatcgccatccacagcagcatcctgttcttcagcctggccgacctggccaacatcgagcccatgtaccagtacagcctgacctggttcatcaacctgttcatcctgagcatcgagaacagcgagaagagcgagatcctggccaagagactgcagatcctgaaggaccacttcacctacagcctgtacgtgaacgtgtgcagaagcctgttcgagaaggacaagctgctgttcagcttctgcctgaccatcaacctgctgctgcacgagagagccatcaacaaggccgagtggagattcctgctgaccggcggcatcggcctggacaacccctacgccaacctgtgcacctggctgccccagaagagctgggacgagatctgcagactggacgacctgcccgccttcaagaccatcagaagagagttcatgagactgaaggacggctggaagaaggtgtacgacagcctggagccccaccacgaggtgttccccgaggagtgggaggacaaggccaacgagttccagagaatgctgatcatcagatgcctgagacccgacaaggtgatccccatgctgcaggagttcatcatcaacagactgggcagagccttcatcgagcccccccccttcgacctggccaaggccttcggcgacagcaactgctgcgcccccctgatcttcgtgctgagccccggcgccgaccccatggccgccctgctgaagttcgccgacgaccagggctacggcggcagcaagctgagcagcctgagcctgggccagggccagggccccatcgccatgaagatgctggagaaggccgtgaaggagggcacctgggtggtgctgcagaactgccacctggccaccagctggatgcccaccctggagaaggtgtgcgaggagctgagccccgagagcacccaccccgacttcagaatgtggctgaccagctaccccagccccaacttccccgtgagcgtgctgcagaacggcgtgaagatgaccaacgaggcccccaagggcctgagagccaacatcatcagaagctacctgatggaccccatcagcgaccccgagttcttcggcagctgcaagaagcccgaggagttcaagaagctgctgtacggcctgtgcttcttccacgccctggtgcaggagagaagaaagttcggccccctgggctggaacatcccctacgagttcaacgagaccgacctgagaatcagcgtgcagcagctgcacatgttcctgaaccagtacgaggagctgccctacgaggccctgagatacatgaccggcgagtgcaactacggcggcagagtgaccgacgactgggacagaagaaccctgagaagcatcctgaacaagttcttcaaccccgagctggtggagaacagcgactacaagttcgacagcagcggcatctacttcgtgccccccagcggcgaccacaagagctacatcgagtacaccaagaccctgcccctgacccccgcccccgagatcttcggcatgaacgccaacgccgacatcaccaaggaccagagcgagacccagctgctgttcgacaacatcctgctgacccagagcagaagcgccggcgccggcgccaagagcagcgacgaggtggtgaacgaggtggccagcgacatcctgggcaagctgcccaacaacttcgacatcgaggccgccatgagaagataccccaccacctacacccagagcatgaacaccgtgctggtgcaggagatgggcagattcaacaagctgctgaagaccatcagagacagctgcgtgaacatccagaaggccatcaagggcctggccgtgatgagcaccgacctggaggaggtggtgagcagcatcctgaacgtgaagatccccgagatgtggatgggcaagagctaccccagcctgaagcccctgggcagctacgtgaacgacttcctggccagactgaagttcctgcagcagtggtacgaggtgggccccccccccgtgttctggctgagcggcttcttcttcacccaggccttcctgaccggcgcccagcagaactacgccagaaagtacaccatccccatcgacctgctgggcttcgactacgaggtgatggaggacaaggagtacaagcacccccccgaggacggcgtgttcatccacggcctgttcctggacggcgccagctggaacagaaagatcaagaagctggccgagagccaccccaagatcctgtacgacaccgtgcccgtgatgtggctgaagccctgcaagagagccgacatccccaagagacccagctacgtggcccccctgtacaagaccagcgagagaagaggcgtgctgagcaccaccggccacagcaccaacttcgtgatcgccatgaccctgcccagcgaccagcccaaggagcactggatcggcagaggcgtggccctgctgtgccagctgaacagctag

SEQ ID NO: 9857 - DNA, 1506 bp, Artificial Sequence
  Description of Artificial Sequence: Synthetic coding sequence
atgagcagcagacaggacaagagcgccagcaaggagaagagcaagaagcccgtgagattcctgccccagctgagcatggagaagctggccagcaaggagaagttcaaggcccccgccagagccctgccccagctgagcatggtgagcaccaagccccactggcagcaggccgcccccagcttccacctgagcgtgaagcaggacgacgagagccccgagcccttcagcgtgaagaacgagcagagccacgccgagtacatggagagattcggcaagaagggcaagctgccccaccaggtggacgacagctacgtgggccccagcaccagcaagagcaagggcaagagcccccacaaggagagagagaacttcagaagcaccctggtgaacgtgatcatgcagcaggacgccgacctggacagcgccgtgcccgacggcagcaccatccccaagcccaccgccagcgccatcgagaaggacatcctgagatactactactacatccaccacggcatcgacaccgaccacgtggcccccatggaggacagctggctggagcacgtgctggacctggtgccccagcacctgaaggtgttcaccgacagcatcgtgaccctgagcgacgagatgagagaggactacctgctgagcgtgagaaagagcatcgtggacttcgtgctgaaggaccccagagagaagggcgacgacaagaagaccgacgagctgcccgcccacagagccgagatggagatcctgcccaagccctggagaaagagcttcctggccgccagcagctacatcagagaccacctgaacgccatgaaccccaccatgctggccgtgctggacctgtggcacaccaacttcaagaagctgagactggtggacatcaaggagttccacaactgccaggacgccctggagctgagcagcttccagaacatcatcatgagacacatggacagcgccaaggagaccctgctgaagatgtggttccccgaggtgcagaacatctactaccagggcaacaagaagaagcagctgcccaccggcgacagcagcgccaagctggagagcttcttcaactgcgccgccgccctgatgaccctgcagctgcaggacctgaccctggtgagcatgcaggacttcaccgacctgatcgcccagccccccgacagcgtgagagccttcgagcaccccggcttcatcatgagactgatcctggacaacgacaccatcaagttcgagcccgagctgagcgactacatcgacatcttcctgaacgtgtacgacgtgatgatcaaggccgtgagcttcgtgcccagagtggagaccaagctgtacagcaagtggagaaacaaggccaagcccggccacttctacttcagccacatccagagaagcgtgaccttccagcacagcgaggtgagcagcccccagaacagccacttcaagatcgtgagccccttcagcgtgctgggcttcacctggagatgccagctgtag

SEQ ID NO: 9858 - DNA, 840 bp, Artificial Sequence
  Description of Artificial Sequence: Synthetic coding sequence
atggccgcccccgtgagaagaaccctgctgggcgtggccggcggctggagaagattcgagagactgtgggccggcagcctgagcagcagaagcctggccctggccgccgcccccagcagcaacggcagcccctggagactgctgggcgccctgtgcctgcagagaccccccgtggtgagcaagcccctgacccccctgcaggaggagatggccagcctgctgcagcagatcgagatcgagagaagcctgtacagcgaccacgagctgagagccctggacgagaaccagagactggccaagaagaaggccgacctgcacgacgaggaggacgagcaggacatcctgctggcccaggacctggaggacatgtgggagcagaagttcctgcagttcaagctgggcgccagaatcaccgaggccgacgagaagaacgacagaaccagcctgaacagaaagctggacagaaacctggtgctgctggtgagagagaagttcggcgaccaggacgtgtggatcctgccccaggccgagtggcagcccggcgagaccctgagaggcaccgccgagagaaccctggccaccctgagcgagaacaacatggaggccaagttcctgggcaacgccccctgcggccactacaccttcaagttcccccaggccatgagaaccgagagcaacctgggcgccaaggtgttcttcttcaaggccctgctgctgaccggcgacttcagccaggccggcaacaagggccaccacgtgtgggtgaccaaggacgagctgggcgactacctgaagcccaagtacctggcccaggtgagaagattcgtgagcgacctgtag

SEQ ID NO: 9859 - DNA, 609 bp, Artificial Sequence
  Description of Artificial Sequence: Synthetic coding sequence
atggaggccgaggccggcggcctggaggagctgaccgacgaggagatggccgccctgggcaaggaggagctggtgagaagactgagaagagaggaggccgccagactggccgccctggtgcagagaggcagactgatgcaggaggtgaacagacagctgcagggccacctgggcgagatcagagagctgaagcagctgaacagaagactgcaggccgagaacagagagctgagagacctgtgctgcttcctggacagcgagagacagagaggcagaagagccgccagacagtggcagctgttcggcacccaggccagcagagccgtgagagaggacctgggcggctgctggcagaagctggccgagctggagggcagacaggaggagctgctgagagagaacctggccctgaaggagctgtgcctggccctgggcgaggagtggggccccagaggcggccccagcggcgccggcggcagcggcgccggccccgcccccgagctggccctgcccccctgcggccccagagacctgggcgacggcagcagcagcaccggcagcgtgggcagccccgaccagctgcccctggcctgcagccccgacgactag

SEQ ID NO: 9860 - DNA, 1353 bp, Artificial Sequence
  Description of Artificial Sequence: Synthetic coding sequence
atgagagagtgcatcagcatccacgtgggccaggccggcgtgcagatcggcaacgcctgctgggagctgtactgcctggagcacggcatccagcccgacggccagatgcccagcgacaagaccatcggcggcggcgacgacagcttcaacaccttcttcagcgagaccggcgccggcaagcacgtgcccagagccgtgttcgtggacctggagcccaccgtggtggacgaggtgagaaccggcacctacagacagctgttccaccccgagcagctgatcaccggcaaggaggacgccgccagcaactacgccagaggccactacaccatcggcaaggagatcgtggacctggtgctggacagaatcagaaagctggccgacctgtgcaccggcctgcagggcttcctgatcttccacagcttcggcggcggcaccggcagcggcttcgccagcctgctgatggagagactgagcgtggactacagcaagaagagcaagctggagttcgccatctaccccgccccccaggtgagcaccgccgtggtggagccctacaacagcatcctgaccacccacaccaccctggagcacagcgactgcgccttcatggtggacaacgaggccatctacgacatctgcagaagaaacctggacatcgagagacccacctacaccaacctgaacagactgatcggccagatcgtgagcagcatcaccgccagcctgagattcgacggcgccctgaacgtggacctgaccgagttccagaccaacctggtgccctaccccagaatccacttccccctggccacctacgcccccgtgatcagcgccgagaaggcctaccacgagcagctgagcgtggccgagatcaccaacgcctgcttcgagcccgccaaccagatggtgaagtgcgaccccagacacggcaagtacatggcctgctgcatgctgtacagaggcgacgtggtgcccaaggacgtgaacgccgccatcgccaccatcaagaccaagagaaccatccagttcgtggactggtgccccaccggcttcaaggtgggcatcaactaccagccccccaccgtggtgcccggcggcgacctggccaaggtgcagagagccgtgtgcatgctgagcaacaccaccgccatcgccgaggcctgggccagactggtgcacaagttcgacctgatgtacgccaagtgggccttcgtgcactggtacgtgggcgagggcatggaggagggcgagttcagcgaggccagagaggacctggccgccctggagaaggactgcgaggaggtgggcgtggacagcgtggaggccgaggccgaggagggcgaggcctactag

SEQ ID NO: 9861 - DNA, 3078 bp, Artificial Sequence
  Description of Artificial Sequence: Synthetic coding sequence
atggtggccatggccgaggccgaggccggcgtggccgtggaggtgagaggcctgccccccgccgtgcccgacgagctgctgaccctgtacttcgagaacagaagaagaagcggcggcggccccgtgctgagctggcagagactgggctgcggcggcgtgctgaccttcagagagcccgccgacgccgagagagtgctggcccaggccgaccacgagctgcacggcgcccagctgagcctgagacccgccccccccagagcccccgccagactgctgctgcagggcctgccccccggcaccaccccccagagactggagcagcacgtgcaggccctgctgagagccagcggcctgcccgtgcagccctgctgcgccctggccagccccagacccgacagagccctggtgcagctgcccaagcccctgagcgaggccgacgtgagagtgctggaggagcaggcccagaacctgggcctggagggcaccctggtgagcctggccagagtgccccaggccagagccgtgagagtggtgggcgacggcgccagcgtggacctgctgctgctggagctgtacctggagaacgagagaagaagcggcggcggccccctggaggacctgcagagactgcccggccccctgggcaccgtggccagcttccagcagtggcaggtggccgagagagtgctgcagcaggagcacagactgcagggcagcgagctgagcctggtgccccactacgacatcctggagcccgaggagctggccgagaacaccagcggcggcgaccaccccagcacccagggccccagagccaccaagcacgccctgctgagaaccggcggcctggtgaccgccctgcagggcgccggcaccgtgaccatgggcagcggcgaggagcccggccagagcggcgccagcctgagaaccggccccatggtgcagggcagaggcatcatgaccaccggcagcggccaggagcccggccagagcggcaccagcctgagaaccggccccatgggcagcctgggccaggccgagcaggtgagcagcatgcccatgggcagcctggagcacgagggcctggtgagcctgagacccgtgggcctgcaggagcaggagggccccatgagcctgggccccgtgggcagcgccggccccgtggagaccagcaagggcctgctgggccaggagggcctggtggagatcgccatggacagccccgagcaggagggcctggtgggccccatggagatcaccatgggcagcctggagaaggccggccccgtgagccccggctgcgtgaagctggccggccaggagggcctggtggagatggtgctgctgatggagcccggcgccatgagattcctgcagctgtaccacgaggacctgctggccggcctgggcgacgtggccctgctgcccctggagggccccgacatgaccggcttcagactgtgcggcgcccaggccagctgccaggccgccgaggagttcctgagaagcctgctgggcagcatcagctgccacgtgctgtgcctggagcaccccggcagcgccagattcctgctgggccccgagggccagcacctgctgcagggcctggaggcccagttccagtgcgtgttcggcaccgagagactggccaccgccaccctggacaccggcctggaggaggtggaccccaccgaggccctgcccgtgctgcccggcaacgcccacaccctgtggacccccgacagcaccggcggcgaccaggaggacgtgagcctggaggaggtgagagagctgctggccaccctggagggcctggacctggacggcgaggactggctgcccagagagctggaggaggagggcccccaggagcagcccgaggaggaggtgacccccggccacgaggaggaggagcccgtggcccccagcaccgtggcccccagatggctggaggaggaggccgccctgcagctggccctgcacagaagcctggagccccagggccaggtggccgagcaggaggaggccgccgccctgagacaggccctgaccctgagcctgctggagcagccccccctggaggccgaggagccccccgacggcggcaccgacggcaaggcccagctggtggtgcacagcgccttcgagcaggacgtggaggagctggacagagccctgagagccgccctggaggtgcacgtgcaggaggagaccgtgggcccctggagaagaaccctgcccgccgagctgagagccagactggagagatgccacggcgtgagcgtggccctgagaggcgactgcaccatcctgagaggcttcggcgcccaccccgccagagccgccagacacctggtggccctgctggccggcccctgggaccagagcctggccttccccctggccgccagcggccccaccctggccggccagaccctgaagggcccctggaacaacctggagagactggccgagaacaccggcgagttccaggaggtggtgagagccttctacgacaccctggacgccgccagaagcagcatcagagtggtgagagtggagagagtgagccaccccctgctgcagcagcagtacgagctgtacagagagagactgctgcagagatgcgagagaagacccgtggagcaggtgctgtaccacggcaccaccgcccccgccgtgcccgacatctgcgcccacggcttcaacagaagcttctgcggcagaaacgccaccgtgtacggcaagggcgtgtacttcgccagaagagccagcctgagcgtgcaggacagatacagcccccccaacgccgacggccacaaggccgtgttcgtggccagagtgctgaccggcgactacggccagggcagaagaggcctgagagccccccccctgagaggccccggccacgtgctgctgagatacgacagcgccgtggactgcatctgccagcccagcatcttcgtgatcttccacgacacccaggccctgcccacccacctgatcacctgcgagcacgtgcccagagccagccccgacgaccccagcggcctgcccggcagaagccccgacacctag

SEQ ID NO: 9862 - DNA, 390 bp, Artificial Sequence
  Description of Artificial Sequence: Synthetic coding sequence
atgagccacctgcagagcctgctgctggacaccctgctgggcaccaagcacgtggacagcgccgccctgatcaagatccaggagagaagcctgtgcgtggccagccccggcttcaacgtgacccccagcgacgtgagaaccctggtgaacggcttcgccaagaaccccctgcaggccagaagagagggcctgtacttcaagggcaaggactacagatgcgtgagagccgacgagtacagcctgtacgccaagaacgagaacaccggcgtggtggtggtgaagacccacctgtacctgctggtggccacctacaccgagggcatgtaccccagcatctgcgtggaggccaccgagagcctgggcgactacctgagaaagaagggcagctag

SEQ ID NO: 9863 - DNA, 945 bp, Artificial Sequence
  Description of Artificial Sequence: Synthetic coding sequence
atgctgggcaagggcggcaagagaaagttcgacgagcacgaggacggcctggagggcaagatcgtgagcccctgcgacggccccagcaaggtgagctacaccctgcagagacagaccatcttcaacatcagcctgatgaagctgtacaaccacagacccctgaccgagcccagcctgcagaagaccgtgctgatcaacaacatgctgagaagaatccaggaggagctgaagcaggagggcagcctgagacccatgttcacccccagcagccagcccaccaccgagcccagcgacagctacagagaggccccccccgccttcagccacctggccagccccagcagccacccctgcgacctgggcagcaccacccccctggaggcctgcctgacccccgccagcctgctggaggacgacgacgacaccttctgcaccagccaggccatgcagcccaccgcccccaccaagctgagcccccccgccctgctgcccgagaaggacagcttcagcagcgccctggacgagatcgaggagctgtgccccaccagcaccagcaccgaggccgccaccgccgccaccgacagcgtgaagggcaccagcagcgaggccggcacccagaagctggacggcccccaggagagcagagccgacgacagcaagctgatggacagcctgcccggcaacttcgagatcaccaccagcaccggcttcctgaccgacctgaccctggacgacatcctgttcgccgacatcgacaccagcatgtacgacttcgacccctgcaccagcagcagcggcaccgccagcaagatggcccccgtgagcgccgacgacctgctgaagaccctggccccctacagcagccagcccgtgacccccagccagcccttcaagatggacctgaccgagctggaccacatcatggaggtgctggtgggcagctag

SEQ ID NO: 9864 - DNA, 246 bp, Artificial Sequence
  Description of Artificial Sequence: Synthetic coding sequence
atgaagggcagcagaatcgagctgggcgacgtgaccccccacaacatcaagcagctgaagagactgaaccaggtgatcttccccgtgagctacaacgacaagttctacaagaagttcggcttcgagatcatcgagaccaagaagaactactacaagagaatcgagcccgccgacgcccacgtgctgcagaagaacctgaaggtgcccagcggccagaacgccgacgtgcagaagaccgacaactag

SEQ ID NO: 9865 - DNA, 1437 bp, Artificial Sequence
  Description of Artificial Sequence: Synthetic coding sequence
atggccagcgccaccgaggaccccgtgctggagagatacttcaagggccacaaggccgccatcaccagcctggacctgagccccaacggcaagcagctggccaccgccagctgggacaccttcctgatgctgtggaacttcaagccccacgccagagcctacagatacgtgggccacaaggacgtggtgaccagcgtgcagttcagcccccacggcaacctgctggccagcgccagcagagacagaaccgtgagactgtggatccccgacaagagaggcaagttcagcgagttcaaggcccacaccgcccccgtgagaagcgtggacttcagcgccgacggccagttcctggccaccgccagcgaggacaagagcatcaaggtgtggagcatgtacagacagagattcctgtacagcctgtacagacacacccactgggtgagatgcgccaagttcagccccgacggcagactgatcgtgagctgcagcgaggacaagaccatcaagatctgggacaccaccaacaagcagtgcgtgaacaacttcagcgacagcgtgggcttcgccaacttcgtggacttcaaccccagcggcacctgcatcgccagcgccggcagcgaccagaccgtgaaggtgtgggacgtgagagtgaacaagctgctgcagcactaccaggtgcacagcggcggcgtgaactgcatcagcttccaccccagcggcaactacctgatcaccgccagcagcgacggcaccctgaagatcctggacctgctggagggcagactgatctacaccctgcagggccacaccggccccgtgttcaccgtgagcttcagcaagggcggcgagctgttcgccagcggcggcgccgacacccaggtgctgctgtggagaaccaacttcgacgagctgcactgcaagggcctgaccaagagaaacctgaagagactgcacttcgacagccccccccacctgctggacatctaccccagaaccccccacccccacgaggagaaggtggagaccgtggagatcaaccccaagctggaggtgatcgacctgcagatcagcaccccccccgtgatggacatcctgagcttcgacagcaccaccaccaccgagaccagcggcagaaccctgcccgacaagggcgaggaggcctgcggctacttcctgaaccccagcctgatgagccccgagtgcctgcccaccaccaccaagaagaagaccgaggacatgagcgacctgccctgcgagagccagagaagcatccccctggccgtgaccgacgccctggagcacatcatggagcagctgaacgtgctgacccagaccgtgagcatcctggagcagagactgaccctgaccgaggacaagctgaaggactgcctggagaaccagcagaagctgttcagcgccgtgcagcagaagagctag

SEQ ID NO: 9866 - DNA, 1263 bp, Artificial Sequence
  Description of Artificial Sequence: Synthetic coding sequence
atgctgaaggccgtgatcctgatcggcggcccccagaagggcaccagattcagacccctgagcttcgaggtgcccaagcccctgttccccgtggccggcgtgcccatgatccagcaccacatcgaggcctgcgcccaggtgcccggcatgcaggagatcctgctgatcggcttctaccagcccgacgagcccctgacccagttcctggaggccgcccagcaggagttcaacctgcccgtgagatacctgcaggagttcgcccccctgggcaccggcggcggcctgtaccacttcagagaccagatcctggccggcagccccgaggccttcttcgtgctgaacgccgacgtgtgcagcgacttccccctgagcgccatgctggaggcccacagaagacagagacaccccttcctgctgctgggcaccaccgccaacagaacccagagcctgaactacggctgcatcgtggagaacccccagacccacgaggtgctgcactacgtggagaagcccagcaccttcatcagcgacatcatcaactgcggcatctacctgttcagccccgaggccctgaagcccctgagagacgtgttccagagaaaccagcaggacggccagctggaggacagccccggcctgtggcccggcgccggcaccatcagactggagcaggacgtgttcagcgccctggccggccagggccagatctacgtgcacctgaccgacggcatctggagccagatcaagagcgccggcagcgccctgtacgccagcagactgtacctgagcagataccaggacacccaccccgagagactggccaagcacacccccggcggcccctggatcagaggcaacgtgtacatccaccccaccgccaaggtggcccccagcgccgtgctgggccccaacgtgagcatcggcaagggcgtgaccgtgggcgagggcgtgagactgagagagagcatcgtgctgcacggcgccaccctgcaggagcacacctgcgtgctgcacagcatcgtgggctggggcagcaccgtgggcagatgggccagagtggagggcacccccagcgaccccaaccccaacgaccccagagccagaatggacagcgagagcctgttcaaggacggcaagctgctgcccgccatcaccatcctgggctgcagagtgagaatccccgccgaggtgctgatcctgaacagcatcgtgctgccccacaaggagctgagcagaagcttcaccaaccagatcatcctgtag

SEQ ID NO: 9867 - DNA, 1215 bp, Artificial Sequence
  Description of Artificial Sequence: Synthetic coding sequence
atggaccaggactacgagagaagactgctgagacagatcgtgatccagaacgagaacaccatgcccagagtgaccgagatgagaagaaccctgacccccgccagcagccccgtgagcagccccagcaagcacggcgacagattcatccccagcagagccggcgccaactggagcgtgaacttccacagaatcaacgagaacgagaagagccccagccagaacagaaaggccaaggacgccaccagcgacaacggcaaggacggcctggcctacagcgccctgctgaagaacgagctgctgggcgccggcatcgagaaggtgcaggacccccagaccgaggacagaagactgcagcccagcacccccgagaagaagggcctgttcaccgtgaccagactgtgcgacctgagcgtggagggcgacagcgtgaccagcgtgggctggagcgagagaggcaacctggtggccgtgggcacccacaagggcttcgtgcagatctgggacgccgccgccggcaagaagctgagcatgctggagggccacaccgccagagtgggcgccctggcctggaacgccgagcagctgagcagcggcagcagagacagaatgatcctgcagagagacatcagaaccccccccctgcagagcgagagaagactgcagggccacagacaggaggtgtgcggcctgaagtggagcaccgaccaccagctgctggccagcggcggcaacgacaacaagctgctggtgtggaaccacagcagcctgagccccgtgcagcagtacaccgagcacctggccgccgtgaaggccatcgcctggagcccccaccagcacggcctgctggccagcggcggcggcaccgccgacagatgcatcagattctggaacaccctgaccggccagcccctgcagtgcatcgacaccggcagccaggtgtgcaacctggcctggagcaagcacgccaacgagctggtgagcacccacggctacagccagaaccagatcctggtgtggaagtaccccagcctgacccaggtggccaagctgaccggccacagctacagagtgctgtacctggccatgagccccgacggcgaggccatcgtgaccggcgccggcgacgagaccctgagattctggaacgtgttcagcaagaccagaagcaccaaggagagcgtgagcgtgctgaacctgttcaccagaatcagatag

SEQ ID NO: 9868 - DNA, 5892 bp, Artificial Sequence
  Description of Artificial Sequence: Synthetic coding sequence
atgaagcagagaaagggccagggcagcggcggcagcagaggcagaaagaagagaggcctgagcgacatcagccccagcaccagcctgccccccctggtggagggccagctgagatgcttcctgaagctgaccgtgaacagagtgatctggaagatcgccaagccccccacctgcgtgctggtgagagtgagatggtggggcgagaccagcgacggcaccctgttctgccccagagacgccctgcagaccgagcccaaggccgtgagaaccaccaccagatacgccatcagatgcggccccaagcagttcaccagctacctgaccgacatggccgtgctggtgctggaggtgatcaccaagctggacggcctgcccatcggcagagtgcagatcaacggcctggcccagctgagccccacccaccagatcaacggcttcttcaccatcgtgagcagcaccagcaagaagctgggcgagctgcaggtgagcctggccctggagcccctgagcgagacctacgacagctaccaccccctgcccaccaccgacatgaccgagaacgtgctgctgagcaagcagggcttcagagagaacaccgagcccagcagcacccagttccaggtgcccagcagacccagagacatccacaccatcaagatcgacggcaaggagctggccgccaacagcagcagaagcaccacccccagaggcaaggaccacgtgtgcttcgccgagaaccccgacaccatcaaggacagcagcttcggcctgcagcacagcctgaacagcggccagagcctggagagcgtgaccctgaagggcagagcccccagaaagcagatgagcctgctgaacagcagcgagttccagccccagatcagaaccgtggccaagagccacagcgacagctgcatcctgagcagcaacaacctgcccaccaaggacctgctgagcgccctgctggagcagggcaacaagctgagaaacgccatggtgatcagcgccatgaagagcagccccgagaccagcatgctgctggaccaggtgcacccccccatcaacgaggacagcctgagagccagcacccagatcagagccttcagcagaaacagattcaaggaccacatcgaggaccacctgctgcccagcaccgagaacaccttctggagacacgacaccaaggccgacaccagagccatccagctgctgctgggcagcgccgagctgagccagggcaacttctgggacggcctgggcagcccccccgacagccccagccccggcagcgacgtgtactgcatcagcgagctgaacgacccccagtacgaccagagcctgctggagaacctgttctacaccgcccccaagagcgacaccagcatcagcgacttcctgagcgaggaggacgacatcgtgcccagcaagaagatcagccagagcaccgccctggccagaagcagcaaggtgctggagagcagcgaccacaagctgaagaagagaagcgccggcaagagaaacagaaacctggtggagcagcagatgctgagcgagacccccgaggacgcccagaccatgaccctgagcgtggacagactggccctgctgggcagaacccacagcgtgagaatcatcatcgagaccatgggcgtgccccccgacagcccccagatgacccccggcaagaagagctacgccggccccccccccaaggtgaccaccgccaagaagagaaccttcttcgtggagtaccacttccccgtgggcttcagcgagagcggcctgggcaagaccgccctgatcaccgaggtggtgagactggccagcagcaagatcaccgacggcaaggtgaagttccagcagagattcgtgttccccgtgcagttcggcggccccatgatcgagcactggtggaacagcaacctgaccttccagatctacgtgaagaagaccccccagaagaagcccgaggtgatcggcagcgtgagcctgagcctgagagccgtgatccagagcgagctgctgagcttcagcgaccagctgcccgtgcagcaggagaacggccagagccccttcggccccctgaaggtgaccatggagctgatcaccgacaacaaggacttcaccggcatcaacaccaagctgagcggcaacacccactacacccccctgtgcgcccccaccagccccaacaaggccctgcccgagctgaaccaggacatgacctgcaccaagaacccccagaacctgaaccagatccacgaggagaccgccaagaaggcccagaacctggtgctgcccaacagaaagagccccagccccgtggccccccaccccagcaccttcgtggccacccccgccagccacaacctggtgaaccagaccaacggcaccaccaaggagagcgccctgctgctgcacgtgctgctgatggtgcccgacggcaaggacttcatcagcggcgagagcgagaagcagagcccctgcaacgtgtacctgaactgcaagctgttcagcaccgaggaggtgaccagaagcgtgatcgcctggggcaccacccagcccgtgttcaacttcagccaggtgatccccgtgagcctgagcagcaagtacctggagagactgaagaacaacgtgatggtgatcgagacctggaacaaggtgagaagccccggccaggacaagctgctgggcctggtgaagctgcccctgcaccagttctacatgagcttcaaggacgccaagatcagcagactgctgctggacgcccagtaccccgtggtggccgtggacagctacatgcccgtgatcgacgtgttcagcggccaccagaacggcagcctgagagtgttcctggccatgggcagcagcaaccagatcatggccctgcagagactgaagaacgaggagggcaccctgccccccttcagccccagacccgcccacttcctggaccagcccaccgccgccagcgtggccatggccgaggacagaggcaacggcctgatggagcactgcttcgagatccacatcgagatggtgaagggcctggcccccctgcaggccaccgtgtggggcgaggccgactgctacgtgcagtactacttccccgtgcagcacagccagagcagcgtgctgaagggccccgagttcctggagaacggcatcaccctgaagcccttcagaaccgccaccaccctgtgcgtgcccgaccccatcttcaacagcgagcaccaccacagcctgctgctgcccgccgaggtgcccgtgcagagactgctgctgagcgccttcagcgcccagggcctggtgcccggcggcggcgtgcagttcgagatctggtgcagatactactaccccaacgtgagagaccagaaggtggccaagggcaccctgcccctgagcagaatctgcgccatggtgaccacccagcacagagaggacgtgggcatccagaccttcaacctgcccctgacccccagaatcgagaacagaaaggagctgagaaaccagagcagcggcctgctggacgtgggcctgagatacagaagaagccccagaaccgccgagggcgtgctggccgccagaaccgtgagcatcagcgtgcagatcatcagagcctgcggcctgcaggccgccgccaaggccctggccgagagagagcccgccctgcagttcagcgccaccgtgggcgtgaacgccagcgtgaccacccacctgagcttcctgccccagggcgagcagagaagaacccaccccgtggcctgcagcttctgccccgagttcagccaccacgtggagttcacctgcaacctggtgacccagcactgcagcggcgaggcctgcttcctggccgagctgctggagttcgccgaggtgatcttcgccgtgtaccacgagaacaccaagagcgccagcgacatcatcagcatcgagagctgcaaggagtacctgctgggcgtggtgaaggtgcccaccaaggagctgctgatcaagagaagcggcatcaccggctggtaccccatcatcctgcccgaggacggcggcctgccccacggcctggagctgatgcagaagatcgtgggcggcctggagctgagcatcagcttcacccacagaggcgacagagagagagtgctggaggccgccgagcacctgggctggagcttcgagaacagcctgaaggacttcgtgagaatggacgagggcgagcccgccaccgtgaccatcagcacccccagactgtggctgcccatccactgcgtgctgctggccggccacaaccacatccacaagaacacctactgctacctgagatacaagttctacgaccacgaggccttctggacccccctgaagaagcccaaggagagcgtgaacaagaagcagatcatggtgaccttcaaggccagcaagagagccgaggtgaccagaggccccagcctgctgtggtacttcagagaggagagactggagatccaggtgtggagagcctacggcaacgacagcgtggagagaccccaccagaccgacagctggatcggcagcgcctacgtggacctggccagactgggcgagagaagcgccagaaccctgaccgtgagcggcgtgtaccccctgttcggcagaaacgccagcaacctgagcggcgccgccctgagagtgcacgtggtgctgagcagcctgagcagccacctggagcccacccacgagctggacagcatggactgcagcagccacagcgagagcgagcagctgcccagaagaaacgacgaggtgcagctgagcccccccgaggtgatcagctgccaccagaagagccccgccagcacccaggtgccctgcagcagcaccaccgccgaggtgagactgacccaggagggccccgccgacctggacggcaccttcgccgtgagcatcctggtggagagagccatgcacctgagcctgaagggcagccccctgaccgagagaaaggtgagcatccccagctgctgcgtgagcttcgccaccgccgacgagagcagccccgtgtacacccaggtggtggagaacaccgacagccccatctggaacttccagcagcagagcagactgagcaaggagctgctgctggacccccagcagaccctggtgttcaaggtgtggcacaagggcgacgaggagagagtgatcggcttcgccagcgtggacctgagccccctgctgagcggcttccagttcgtgtgcggctggtacaacatcaccgacttcagcggcgagtgccagggccagatcaaggtggccgtgagccccctggagagcctgatccacttcaaggaggagagacaggccagaagaggcgtggagaccagcaagagcctgatccccatctacagccccttcagcttccccgccagcgacacctacgccgccttcagcagccacatggccagacagaccctggaccagctggcccacgccagcagcaaggagctggacttcagcagccccggcagaagcgacaccaccagaagccaggccagcagacacgaggagcacgtgcagaacatcagaagattccacgagagcctgcacctgcagggcgaggcccccctgccctgcgacgacaagctgaccaccagccccctgagcagccagaccagcatcctgaccagcctgagaaagaacctgagcgagctggaccagatccagagatacttcagacagaagctgaccaagcccttcctgcccctgagcccccagacccagaccgccatcagccagcaccaggagagctgcagagaccacctgggccccggcgccagcagcctggaccccggcagccagtgcatcctggagaagagcagcaacctggtgctgcaggtgagcagcctgatcaccggcagctactag

SEQ ID NO: 9869 - DNA, 5586 bp, Artificial Sequence
  Description of Artificial Sequence: Synthetic coding sequence
atgaagcagagaaagggccagggcagcggcggcagcagaggcagaaagaagagaggcctgagcgacatcagccccagcaccagcctgccccccctggtggagggccagctgagatgcttcctgaagctgaccgtgaacagagtgatctggaagatcgccaagccccccacctgcgtgctggtgagagtgagatggtggggcgagaccagcgacggcaccctgttctgccccagagacgccctgcagaccgagcccaaggccgtgagaaccaccaccagatacgccatcagatgcggccccaagcagttcaccagctacctgaccgacatggccgtgctggtgctggaggtgatcaccaagctggacggcctgcccatcggcagagtgcagatcaacggcctggcccagctgagccccacccaccagatcaacggcttcttcaccatcgtgagcagcaccagcaagaagctgggcgagctgcaggtgagcctggccctggagcccctgagcgagacctacgacagctaccaccccctgcccaccaccgacatgaccgagaacgtgctgctgagcaagcagggcttcagagagaacaccgagcccagcagcacccagttccaggtgcccagcagacccagagacatccacaccatcaagatcgacggcaaggagctggccgccaacagcagcagaagcaccacccccagaggcaaggaccacgtgtgcttcgccgagaaccccgacaccatcaaggacagcagcttcggcctgcagcacagcctgaacagcggccagagcctggagagcgtgaccctgaagggcagagcccccagaaagcagatgagcctgctgaacagcagcgagttccagccccagatcagaaccgtggccaagagccacagcgacagctgcatcctgagcagcaacaacctgcccaccaaggacctgctgagcgccctgctggagcagggcaacaagctgagaaacgccatggtgatcagcgccatgaagagcagccccgagaccagcatgctgctggaccaggtgcacccccccatcaacgaggacagcctgagagccagcacccagatcagagccttcagcagaaacagattcaaggaccacatcgaggaccacctgctgcccagcaccgagaacaccttctggagacacgacaccaaggccgacaccagagccatccagctgctgctgggcagcgccgagctgagccagggcaacttctgggacggcctgggcagcccccccgacagccccagccccggcagcgacgtgtactgcatcagcgagctgaacgacccccagtacgaccagagcctgctggagaacctgttctacaccgcccccaagagcgacaccagcatcagcgacttcctgagcgaggaggacgacatcgtgcccagcaagaagatcagccagagcaccgccctggccagaagcagcaaggtgctggagagcagcgaccacaagctgaagaagagaagcgccggcaagagaaacagaaacctggtggagcagcagatgctgagcgagacccccgaggacgcccagaccatgaccctgagcgtggacagactggccctgctgggcagaacccacagcgtgagaatcatcatcgagaccatgggcgtgccccccgacagcccccagatgacccccggcaagaagagctacgccggccccccccccaaggtgaccaccgccaagaagagaaccttcttcgtggagtaccacttccccgtgggcttcagcgagagcggcctgggcaagaccgccctgatcaccgaggtggtgagactggccagcagcaagatcaccgacggcaaggtgaagttccagcagagattcgtgttccccgtgcagttcggcggccccatgatcgagcactggtggaacagcaacctgaccttccagatctacgtgaagaagaccccccagaagaagcccgaggtgatcggcagcgtgagcctgagcctgagagccgtgatccagagcgagctgctgagcttcagcgaccagctgcccgtgcagcaggagaacggccagagccccttcggccccctgaaggtgaccatggagctgatcaccgacaacaaggacttcaccggcatcaacaccaagctgagcggcaacacccactacacccccctgtgcgcccccaccagccccaacaaggccctgcccgagctgaaccaggacatgacctgcaccaagaacccccagaacctgaaccagatccacgaggagaccgccaagaaggcccagaacctggtgctgcccaacagaaagagccccagccccgtggccccccaccccagcaccttcgtggccacccccgccagccacaacctggtgaaccagaccaacggcaccaccaaggagagcgccctgctgctgcacgtgctgctgatggtgcccgacggcaaggacttcatcagcggcgagagcgagaagcagagcccctgcaacgtgtacctgaactgcaagctgttcagcaccgaggaggtgaccagaagcgtgatcgcctggggcaccacccagcccgtgttcaacttcagccaggtgatccccgtgagcctgagcagcaagtacctggagagactgaagaacaacgtgatggtgatcgagacctggaacaaggtgagaagccccggccaggacaagctgctgggcctggtgaagctgcccctgcaccagttctacatgagcttcaaggacgccaagatcagcagactgctgctggacgcccagtaccccgtggtggccgtggacagctacatgcccgtgatcgacgtgttcagcggccaccagaacggcagcctgagagtgttcctggccatgggcagcagcaaccagatcatggccctgcagagactgaagaacgaggagggcaccctgccccccttcagccccagacccgcccacttcctggaccagcccaccgccgccagcgtggccatggccgaggacagaggcaacggcctgatggagcactgcttcgagatccacatcgagatggtgaagggcctggcccccctgcaggccaccgtgtggggcgaggccgactgctacgtgcagtactacttccccgtgcagcacagccagagcagcgtgctgaagggccccgagttcctggagaacggcatcaccctgaagcccttcagaaccgccaccaccctgtgcgtgcccgaccccatcttcaacagcgagcaccaccacagcctgctgctgcccgccgaggtgcccgtgcagagactgctgctgagcgccttcagcgcccagggcctggtgcccggcggcggcgtgcagttcgagatctggtgcagatactactaccccaacgtgagagaccagaaggtggccaagggcaccctgcccctgagcagaatctgcgccatggtgaccacccagcacagagaggacgtgggcatccagaccttcaacctgcccctgacccccagaatcgagaacagaaaggagctgagaaaccagagcagcggcctgctggacgtgggcctgagatacagaagaagccccagaaccgccgagggcgtgctggccgccagaaccgtgagcatcagcgtgcagatcatcagagcctgcggcctgcaggccgccgccaaggccctggccgagagagagcccgccctgcagttcagcgccaccgtgggcgtgaacgccagcgtgaccacccacctgagcttcctgccccagggcgagcagagaagaacccaccccgtggcctgcagcttctgccccgagttcagccaccacgtggagttcacctgcaacctggtgacccagcactgcagcggcgaggcctgcttcctggccgagctgctggagttcgccgaggtgatcttcgccgtgtaccacgagaacaccaagagcgccagcgacatcatcagcatcgagagctgcaaggagtacctgctgggcgtggtgaaggtgcccaccaaggagctgctgatcaagagaagcggcatcaccggctggtaccccatcatcctgcccgaggacggcggcctgccccacggcctggagctgatgcagaagatcgtgggcggcctggagcacctgggctggagcttcgagaacagcctgaaggacttcgtgagaatggacgagggcgagcccgccaccgtgaccatcagcacccccagactgtggctgcccatccactgcgtgctgctggccggccacaaccacatccacaagaacacctactgctacctgagatacaagttctacgaccacgaggccttctggacccccctgaagaagcccaaggagagcgtgaacaagaagcagatcatggtgaccttcaaggccagcaagagagccgaggtgaccagaggccccagcctgctgtggtacttcagagaggagagactggagatccaggtgtggagagcctacggcaacgacagcgtggagagaccccaccagaccgacagctggatcggcagcgcctacgtggacctggccagactgggcgagagaagcgccagaaccctgaccgtgagcggcgtgtaccccctgttcggcagaaacgccagcaacctgagcggcgccgccctgagagtgcacgtggtgctgagcagcctgagcagccacctggagcccacccacgagctggacagcatggactgcagcagccacagcgagagcgagcagctgcccagaagaaacgacgaggtgcagctgagcccccccgaggtgatcagctgccaccagaagagccccgccagcacccaggtgccctgcagcagcaccaccgccgaggtgagactgacccaggagggccccgccgacctggacggcaccttcgccgtgagcatcctggtggagagagccatgcacctgagcctgaagggcagccccctgaccgagagaaaggtgagcatccccagctgctgcgtgagcttcgccaccgccgacgagagcagccccgtgtacacccaggtggtggagaacaccgacagccccatctggaacttccagcagcagagcagactgagcaaggagctgctgctggacccccagcagaccctggtgttcaaggtgtggcacaagggcgacgaggagagagtgatcggcttcgccagcgtggacctgagccccctgctgagcggcttccagttcgtgtgcggctggtacaacatcaccgacttcagcggcgagtgccagggccagatcaaggtggccgtgagccccctggagagcctgatccacttcaaggaggagagacaggccagaagaggcgtggagaccagcaagagcctgatccccatctacagccccttcagcttccccgccagcgacacctacgccgccttcagcagccacatggccagacagaccctggaccagctggcccacgccagcagcaaggagctggacttcagcagccccggcagaagcgacaccaccagaagccaggccagcagacacgaggagcacgtgcagaacatcagaagattccacgagagcctgcacctgcagggcgaggcccccctgccctgcgacgacaagctgaccaccagccccctgagcagccagacctag

SEQ ID NO: 9870 - DNA, 1131 bp, Artificial Sequence
  Description of Artificial Sequence: Synthetic coding sequence
atgctgaccttcctgcagcagctgagagtggactggcccgccgccagcgagagagccagcagccacaccctgagaagccacgccctggaggagctgaccagcgccaacgacggcagaaccctgagccccggcatcctgggcagactgtgcctgaaggagctggtggaggagcagggcagaaccgccggctacgaccccaacctggacaactgcctggtgaccgaggacctgctgagcgtgctggccgagctgcaggaggccctgtggcactggcccgaggacagccaccccggcctggccggcgccagcgacaccggcaccggcggctgcctggtggtgcacgtggtgagctgcgaggaggagttccagcagcagaagctggacctgctgtggcagaagctggtggacaaggcccccctgagacagaagcacctgatctgcggccccgtgaaggtggccggcgcccccggcaccctgatgaccgcccccgagtactacgagttcagacacacccaggtgtgcaaggccagcgccctgaagcacggcggcgacctggcccaggaccccgcctggaccgagatcttcggcgtgctgagcgtggccaccatcaagttcgagatgctgagcaccgccccccagagccagctgttcctggccctggccgacagcagcatcagcaccaagggcaccaagagcggcaccttcgtgatgtacaactgcgccagactggccaccctgttcgagagctacaagtgcagcatggagcagggcctgtaccccaccttcccccccgtgagcagcctggacttcagcctgctgcacgacgagggcgagtggctgctgctgttcaacagcatcctgcccttccccgacctgctgagcagaaccgccgtgctggactgcaccgcccccggcctgcacatcgccgtgagaaccgagatgatctgcaagttcctggtgcagctgagcatggacttcagcagctactacaacagagtgcacatcctgggcgagcccagaccccacctgttcggccagatgttcgtgagactgcagctgctgagagccgtgagagaggtgctgcacaccggcctggccatgctgggcctgccccccctgagccacatctag

SEQ ID NO: 9871 - DNA, 1572 bp, Artificial Sequence
  Description of Artificial Sequence: Synthetic coding sequence
atgaaccagccctgcaacagcatggagcccagagtgatggacgacgacatgctgaagctggccgtgggcgaccagggcccccaggaggaggccggccagctggccaagcaggagggcatcctgttcaaggacgtgctgagcctgcagctggacttcagaaacatcctgagaatcgacaacctgtggcagttcgagaacctgagaaagctgcagctggacaacaacatcatcgagaagatcgagggcctggagaacctggcccacctggtgtggctggacctgagcttcaacaacatcgagaccatcgagggcctggacaccctggtgaacctggaggacctgagcctgttcaacaacagaatcagcaagatcgacagcctggacgccctggtgaagctgcaggtgctgagcctgggcaacaacagaatcgacaacatgatgaacatcatctacctgagaagattcaagtgcctgagaaccctgagcctgagcagaaaccccatcagcgaggccgaggactacaagatgttcatctgcgcctacctgcccgacctgatgtacctggactacagaagaatcgacgaccacaccaagaagctggccgaggccaagcaccagtacagcatcgacgagctgaagcaccaggagaacctgatgcaggcccagctggaggacgagcaggcccagagagaggagctggagaagcacaagaccgccttcgtggagcacctgaacggcagcttcctgttcgacagcatgtacgccgaggacagcgagggcaacaacctgagctacctgcccggcgtgggcgagctgctggagacctacaaggacaagttcgtgatcatctgcgtgaacatcttcgagtacggcctgaagcagcaggagaagagaaagaccgagctggacaccttcagcgagtgcgtgagagaggccatccaggagaaccaggagcagggcaagagaaagatcgccaagttcgaggagaagcacctgagcagcctgagcgccatcagagaggagctggagctgcccaacatcgagaagatgatcctggagtgcagcgccgacatcagcgagctgttcgacgccctgatgaccctggagatgcagctggtggagcagctggaggagaccatcaacatgttcgagagaaacatcgtggacatggtgggcctgttcatcgagaacgtgcagagcctgatggcccagtgcagagacctggagaaccaccaccacgagaagctgctggagatcagcatcagcaccctggagaagatcgtggagggcgacctggacgaggacctgcccaacgacctgagagccctgttcgtggacaaggacaccatcgtgaacgccgtgggcgccagccacgacatccacctgctgaagatcgacaacagagaggacgagctggtgaccagaatcaacagctggtgcaccagactgatcgacagaatccacaaggacgagatcatgagaaacagaaagagagtgaaggagatcaaccagtacatcgaccacatgcagagcgagctggacaacctggagtgcggcgacatcctggactag

SEQ ID NO: 9872 - DNA, 1680 bp, Artificial Sequence
  Description of Artificial Sequence: Synthetic coding sequence
atgaaggtgatcacctgcgagatcgcctggcacaacaaggagcccgtgtacagcctggacttccagcacggcaccgccggcagaatccacagactggccagcgccggcgtggacaccaacgtgagaatctggaaggtggagaagggccccgacggcaaggccatcgtggagttcctgagcaacctggccagacacaccaaggccgtgaacgtggtgagattcagccccaccggcgagatcctggccagcggcggcgacgacgccgtgatcctgctgtggaaggtgaacgacaacaaggagcccgagcagatcgccttccaggacgaggacgaggcccagctgaacaaggagaactggaccgtggtgaagaccctgagaggccacctggaggacgtgtacgacatctgctgggccaccgacggcaacctgatggccagcgccagcgtggacaacaccgccatcatctgggacgtgagcaagggccagaagatcagcatcttcaacgagcacaagagctacgtgcagggcgtgacctgggaccccctgggccagtacgtggccaccctgagctgcgacagagtgctgagagtgtacagcatccagaagaagagagtggccttcaacgtgagcaagatgctgagcggcatcggcgccgagggcgaggccagaagctacagaatgttccacgacgacagcatgaagagcttcttcagaagactgagcttcacccccgacggcagcctgctgctgacccccgccggctgcgtggagagcggcgagaacgtgatgaacaccacctacgtgttcagcagaaagaacctgaagagacccatcgcccacctgccctgccccggcaaggccaccctggccgtgagatgctgccccgtgtacttcgagctgagacccgtggtggagaccggcgtggagctgatgagcctgccctacagactggtgttcgccgtggccagcgaggacagcgtgctgctgtacgacacccagcagagcttccccttcggctacgtgagcaacatccactaccacaccctgagcgacatcagctggagcagcgacggcgccttcctggccatcagcagcaccgacggctactgcagcttcgtgaccttcgagaaggacgagctgggcatccccctgaaggagaagcccgtgctgaacatgagaacccccgacaccgccaagaagaccaagagccagacccacagaggcagcagccccggccccagacccgtggagggcacccccgccagcagaacccaggaccccagcagccccggcaccacccccccccaggccagacaggcccccgcccccaccgtgatcagagacccccccagcatcacccccgccgtgaagagccccctgcccggccccagcgaggagaagaccctgcagcccagcagccagaacaccaaggcccaccccagcagaagagtgaccctgaacaccctgcaggcctggagcaagaccacccccagaagaatcaacctgacccccctgaagaccgacaccccccccagcagcgtgcccaccagcgtgatcagcacccccagcaccgaggagatccagagcgagacccccggcgacgcccagggcagcccccccgagctgaagagacccagactggacgagaacaagggcggcaccgagagcctggacccctag

SEQ ID NO: 9873 - DNA, 1527 bp, Artificial Sequence
  Description of Artificial Sequence: Synthetic coding sequence
atggccgacggccaggtggccgagctgctgctgagaagactggaggccagcgacggcggcctggacagcgccgagctggccgccgagctgggcatggagcaccaggccgtggtgggcgccgtgaagagcctgcaggccctgggcgaggtgatcgaggccgagctgagaagcaccaagcactgggagctgaccgccgagggcgaggagatcgccagagagggcagccacgaggccagagtgttcagaagcatcccccccgagggcctggcccagagcgagctgatgagactgcccagcggcaaggtgggcttcagcaaggccatgagcaacaagtggatcagagtggacaagagcgccgccgacggccccagagtgttcagagtggtggacagcatggaggacgaggtgcagagaagactgcagctggtgagaggcggccaggccgagaagctgggcgagaaggagagaagcgagctgagaaagagaaagctgctggccgaggtgaccctgaagacctactgggtgagcaagggcagcgccttcagcaccagcatcagcaagcaggagaccgagctgagccccgagatgatcagcagcggcagctggagagacagacccttcaagccctacaacttcctggcccacggcgtgctgcccgacagcggccacctgcaccccctgctgaaggtgagaagccagttcagacagatcttcctggagatgggcttcaccgagatgcccaccgacaacttcatcgagagcagcttctggaacttcgacgccctgttccagccccagcagcaccccgccagagaccagcacgacaccttcttcctgagagaccccgccgaggccctgcagctgcccatggactacgtgcagagagtgaagagaacccacagccagggcggctacggcagccagggctacaagtacaactggaagctggacgaggccagaaagaacctgctgagaacccacaccaccagcgccagcgccagagccctgtacagactggcccagaagaagcccttcacccccgtgaagtacttcagcatcgacagagtgttcagaaacgagaccctggacgccacccacctggccgagttccaccagatcgagggcgtggtggccgaccacggcctgaccctgggccacctgatgggcgtgctgagagagttcttcaccaagctgggcatcacccagctgagattcaagcccgcctacaacccctacaccgagcccagcatggaggtgttcagctaccaccagggcctgaagaagtgggtggaggtgggcaacagcggcgtgttcagacccgagatgctgctgcccatgggcctgcccgagaacgtgagcgtgatcgcctggggcctgagcctggagagacccaccatgatcaagtacggcatcaacaacatcagagagctggtgggccacaaggtgaacctgcagatggtgtacgacagccccctgtgcagactggacgccgagcccagacccccccccacccaggaggccgcctag

SEQ ID NO: 9874 - DNA, 1203 bp, Artificial Sequence
  Description of Artificial Sequence: Synthetic coding sequence
atgagcagccccctggccagcctgagcaagaccagaaaggtgcccctgcccagcgagcccatgaaccccggcagaagaggcatcagaatctacggcgacgaggacgaggtggacatgctgagcgacggctgcggcagcgaggagaagatcagcgtgcccagctgctacggcggcatcggcgcccccgtgagcagacagggcgacagcctggccccccccgaggtggacttcgacagactgctggccagcctgcaggacctgagcgagctggtggtggagggcgacacccaggtgacccccgtgcccggcggcgccagactgagaaccctggagcccatccccctgaagctgtacagaaacggcatcatgatgttcgacggccccttccagcccttctacgaccccagcacccagagatgcctgagagacatcctggacggcttcttccccagcgagctgcagagactgtaccccaacggcgtgcccttcaaggtgagcgacctgagaaaccaggtgtacctggaggacggcctggaccccttccccggcgagggcagagtggtgggcagacagctgatgcacaaggccctggacagagtggaggagcaccccggcagcagaatgaccgccgagaagttcctgaacagactgcccaagttcgtgatcagacagggcgaggtgatcgacatcagaggccccatcagagacaccctgcagaactgctgccccctgcccgccagaatccaggagatcgtggtggagacccccaccctggccgccgagagagagagaagccaggagagccccaacacccccgccccccccctgagcatgctgagaatcaagagcgagaacggcgagcaggccttcctgctgatgatgcagcccgacaacaccatcggcgacgtgagagccctgctggcccaggccagagtgatggacgccagcgccttcgagatcttcagcaccttcccccccaccctgtaccaggacgacaccctgaccctgcaggccgccggcctggtgcccaaggccgccctgctgctgagagccagaagagcccccaagagcagcctgaagttcagccccggcccctgccccggccccggccccggccccagccccggccccggccccggccccagccccggccccggccccggccccagcccctgccccggccccagccccagcccccagtag

SEQ ID NO: 9875 - DNA, 1350 bp, Artificial Sequence
  Description of Artificial Sequence: Synthetic coding sequence
atggccagcgccctgagaccccccagagtgcccaagcccaagggcgtgctgcccagccactactacgagagcttcctggagaagaagggcccctgcgacagagactacaagaagttctgggccggcctgcagggcctgaccatctacttctacaacagcaacagagacttccagcacgtggagaagctgaacctgggcgccttcgagaagctgaccgacgagatcccctggggcagcagcagagaccccggcacccacttcagcctgatcctgagagaccaggagatcaagttcaaggtggagaccctggagtgcagagagatgtggaagggcttcatcctgaccgtggtggagctgagagtgcccaccgacctgaccctgctgcccggccacctgtacatgatgagcgaggtgctggccaaggaggaggccagaagagccctggagacccccagctgcttcctgaaggtgagcagactggaggcccagctgctgctggagagataccccgagtgcggcaacctgctgctgagacccagcggcgacggcgccgacggcgtgagcgtgaccaccagacagatgcacaacggcacccacgtggtgagacactacaaggtgaagagagagggccccaagtacgtgatcgacgtggagcagcccttcagctgcaccagcctggacgccgtggtgaactacttcgtgagccacaccaagaaggccctggtgcccttcctgctggacgaggactacgagaaggtgctgggctacgtggaggccgacaaggagaacggcgagaacgtgtgggtggcccccagcgcccccggccccggccccgccccctgcaccggcggccccaagcccctgagccccgccagcagccaggacaagctgccccccctgccccccctgcccaaccaggaggagaactacgtgacccccatcggcgacggccccgccgtggactacgagaaccaggacgtggccagcagcagctggcccgtgatcctgaagcccaagaagctgcccaagccccccgccaagctgcccaagccccccgtgggccccaagcccgtggagaagggcttccaccacgtggcccaggccggcctggagctgctgaccagcagcgacccccccaccagcgccagccagagcgccggcatcaccggcgtgagccaccacacctggccccacctgagcagcctgcccgagcccaaggtgttcaacggcggcctgggcagaaagctgcccgtgagcagcgcccagcccctgttccccaccgccggcctggccgacatgaccgccgagctgcagaagaagctggagaagagaagagccctggagcactag

SEQ ID NO: 9876 - DNA, 1239 bp, Artificial Sequence
  Description of Artificial Sequence: Synthetic coding sequence
atggaccccatcagaagcttctgcggcaagctgagaagcctggccagcaccctggactgcgagaccgccagactgcagagagccctggacggcgaggagagcgacttcgaggactaccccatgagaatcctgtacgacctgcacagcgaggtgcagaccctgaaggacgacgtgaacatcctgctggacaaggccagactggagaaccaggagggcatcgacttcatcaaggccaccaaggtgctgatggagaagaacagcatggacatcatgaagatcagagagtacttccagaagtacggctacagccccagagtgaagaagaacagcgtgcacgagcaggaggccatcaacagcgaccccgagctgagcaactgcgagaacttccagaagaccgacgtgaaggacgacctgagcgacccccccgtggccagcagctgcatcagcgagaagagccccagaagcccccagctgagcgacttcggcctggagagatacatcgtgagccaggtgctgcccaaccccccccaggccgtgaacaactacaaggaggagcccgtgatcgtgaccccccccaccaagcagagcctggtgaaggtgctgaagacccccaagtgcgccctgaagatggacgacttcgagtgcgtgacccccaagctggagcacttcggcatcagcgagtacaccatgtgcctgaacgaggactacaccatgggcctgaagaacgccagaaacaacaagagcgaggaggccatcgacaccgagagcagactgaacgacaacgtgttcgccacccccagccccatcatccagcagctggagaagagcgacgccgagtacaccaacagccccctggtgcccaccttctgcacccccggcctgaagatccccagcaccaagaacagcatcgccctggtgagcaccaactaccccctgagcaagaccaacagcagcagcaacgacctggaggtggaggacagaaccagcctggtgctgaacagcgacacctgcttcgagaacctgaccgaccccagcagccccaccatcagcagctacgagaacctgctgagaacccccaccccccccgaggtgaccaagatccccgaggacatcctgcagctgctgagcaagtacaacagcaacctggccacccccatcgccatcaaggccgtgccccccagcaagagattcctgaagcacggccagaacatcagagacgtgagcaacaaggagaactag

SEQ ID NO: 9877 - DNA, 2583 bp, Artificial Sequence
  Description of Artificial Sequence: Synthetic coding sequence
atgaccgagggcaccaagaagaccagcaagaagttcaagttcttcaagttcaagggcttcggcagcctgagcaacctgcccagaagcttcaccctgagaagaagcagcgccagcatcagcagacagagccacctggagcccgacaccttcgaggccacccaggacgacatggtgaccgtgcccaagagcccccccgcctacgccagaagcagcgacatgtacagccacatgggcaccatgcccagacccagcatcaagaaggcccagaacagccaggccgccagacaggcccaggaggccggccccaagcccaacctggtgcccggcggcgtgcccgacccccccggcctggaggccgccaaggaggtgatggtgaaggccaccggccccctggaggacacccccgccatggagcccaaccccagcgccgtggaggtggaccccatcagaaagcccgaggtgcccaccggcgacgtggaggaggagagaccccccagagacgtgcacagcgagagagccgccggcgagcccgaggccggcagcgactacgtgaagttcagcaaggagaagtacatcctggacagcagccccgagaagctgcacaaggagctggaggaggagctgaagctgagcagcaccgacctgagaagccacgcctggtaccacggcagaatccccagagaggtgagcgagaccctggtgcagagaaacggcgacttcctgatcagagacagcctgaccagcctgggcgactacgtgctgacctgcagatggagaaaccaggccctgcacttcaagatcaacaaggtggtggtgaaggccggcgagagctacacccacatccagtacctgttcgagcaggagagcttcgaccacgtgcccgccctggtgagataccacgtgggcagcagaaaggccgtgagcgagcagagcggcgccatcatctactgccccgtgaacagaaccttccccctgagatacctggaggccagctacggcctgggccagggcagcagcaagcccgccagccccgtgagccccagcggccccaagggcagccacatgaagagaagaagcgtgaccatgaccgacggcctgaccgccgacaaggtgaccagaagcgacggctgccccaccagcaccagcctgcccagacccagagacagcatcagaagctgcgccctgagcatggaccagatccccgacctgcacagccccatgagccccatcagcgagagccccagcagccccgcctacagcaccgtgaccagagtgcacgccgcccccgccgcccccagcgccaccgccctgcccgccagccccgtggccagaagaagcagcgagccccagctgtgccccggcagcgcccccaagacccacggcgagagcgacaagggcccccacaccagccccagccacaccctgggcaaggccagccccagccccagcctgagcagctacagcgaccccgacagcggccactactgccagctgcagccccccgtgagaggcagcagagagtgggccgccaccgagaccagcagccagcaggccagaagctacggcgagagactgaaggagctgagcgagaacggcgcccccgagggcgactggggcaagaccttcaccgtgcccatcgtggaggtgaccagcagcttcaaccccgccaccttccagagcctgctgatccccagagacaacagacccctggaggtgggcctgctgagaaaggtgaaggagctgctggccgaggtggacgccagaaccctggccagacacgtgaccaaggtggactgcctggtggccagaatcctgggcgtgaccaaggagatgcagaccctgatgggcgtgagatggggcatggagctgctgaccctgccccacggcagacagctgagactggacctgctggagagattccacaccatgagcatcatgctggccgtggacatcctgggctgcaccggcagcgccgaggagagagccgccctgctgcacaagaccatccagctggccgccgagctgagaggcaccatgggcaacatgttcagcttcgccgccgtgatgggcgccctggacatggcccagatcagcagactggagcagacctgggtgaccctgagacagagacacaccgagggcgccatcctgtacgagaagaagctgaagcccttcctgaagagcctgaacgagggcaaggagggcccccccctgagcaacaccaccttcccccacgtgctgcccctgatcaccctgctggagtgcgacagcgccccccccgagggccccgagccctggggcagcaccgagcacggcgtggaggtggtgctggcccacctggaggccgccagaaccgtggcccaccacggcggcctgtaccacaccaacgccgaggtgaagctgcagggcttccaggccagacccgagctgctggaggtgttcagcaccgagttccagatgagactgctgtggggcagccagggcgccagcagcagccaggccagaagatacgagaagttcgacaaggtgctgaccgccctgagccacaagctggagcccgccgtgagaagcagcgagctgtag

SEQ ID NO: 9878 - DNA, 573 bp, Artificial Sequence
  Description of Artificial Sequence: Synthetic coding sequence
atgaccgtgccctggagacccggcaagagaagaatcacctacaaggaggaggaggacctgaccctgcagcccagacccgccagcagcgcccccgagagcctggtgggcctgcaggagggcaagagcaccgagcagggcaaccacgaccagctgaaggagctgtacagcgccggcaacctgaccgtgctggccaccgaccccctgctgcaccaggaccccgtgcagctggacttccacttcagactgaccagccagaccagcgcccactggcacggcctgctgtgcgacagaagactgttcctggacatcccctaccaggccctggaccagggcaacagagagagcctgaccgccaccctggagtacgtggaggagaagaccaacgtggacagcgtgttcgtgaacttccagaacgacagaaacgacagaggcgccctgctgagagccttcagctacatgggcttcgaggtggtgagacccgaccaccccgccctgccccccctggacaacgtgatcttcatggtgtaccccctggagagagacgtgggccacctgcccagcgagcccccctag

SEQ ID NO: 9879 - DNA, 1527 bp, Artificial Sequence
  Description of Artificial Sequence: Synthetic coding sequence
atggccaccgactggctgggcagcatcgtgagcatcaactgcggcgacagcctgggcgtgtaccagggcagagtgagcgccgtggaccaggtgagccagaccatcagcctgaccagacccttccacaacggcgtgaagtgcctggtgcccgaggtgaccttcagagccggcgacatcaccgagctgaagatcctggagatccccggccccggcgacaaccagcacttcggcgacctgcaccagaccgagctgggccccagcggcgccggctgccaggtgggcatcaaccagaacggcaccggcaagttcgtgaagaagcccgccagcagcagcagcgccccccagaacatccccaagagaaccgacgtgaagagccaggacgtggccgtgagcccccagcagcagcagtgcagcaagagctacgtggacagacacatggagagcctgagccagagcaagagcttcagaagaagacacaacagctggagcagcagcagcagacaccccaaccaggccacccccaagaagagcggcctgaagaacggccagatgaagaacaaggacgacgagtgcttcggcgacgacatcgaggagatccccgacaccgacttcgacttcgagggcaacctggccctgttcgacaaggccgccgtgttcgaggagatcgacacctacgagagaagaagcggcaccagaagcagaggcatccccaacgagagacccaccagatacagacacgacgagaacatcctggagagcgagcccatcgtgtacagaagaatcatcgtgccccacaacgtgagcaaggagttctgcaccgacagcggcctggtggtgcccagcatcagctacgagctgcacaagaagctgctgagcgtggccgagaagcacggcctgaccctggagagaagactggagatgaccggcgtgtgcgccagccagatggccctgaccctgctgggcggccccaacagactgaaccccaagaacgtgcaccagagacccaccgtggccctgctgtgcggcccccacgtgaagggcgcccagggcatcagctgcggcagacacctggccaaccacgacgtgcaggtgatcctgttcctgcccaacttcgtgaagatgctggagagcatcaccaacgagctgagcctgttcagcaagacccagggccagcaggtgagcagcctgaaggacctgcccaccagccccgtggacctggtgatcaactgcctggactgccccgagaacgtgttcctgagagaccagccctggtacaaggccgccgtggcctgggccaaccagaacagagcccccgtgctgagcatcgacccccccgtgcacgaggtggagcagggcatcgacgccaagtggagcctggccctgggcctgcccctgcccctgggcgagcacgccggcagaatctacctgtgcgacatcggcatcccccagcaggtgttccaggaggtgggcatcaactaccacagccccttcggctgcaagttcgtgatccccctgcacagcgcctag

SEQ ID NO: 9880 - DNA, 1158 bp, Artificial Sequence
  Description of Artificial Sequence: Synthetic coding sequence
atgggcagatggtgccagaccgtggccagaggccagagacccagaaccagcgcccccagcagagccggcgccctgctgctgctgctgctgctgctgagaagcgccggctgctggggcgccggcgaggcccccggcgccctgagcaccgccgaccccgccgaccagagcgtgcagtgcgtgcccaaggccacctgccccagcagcagacccagactgctgtggcagacccccaccacccagaccctgcccagcaccaccatggagacccagttccccgtgagcgagggcaaggtggacccctacagaagctgcggcttcagctacgagcaggaccccaccctgagagaccccgaggccgtggccagaagatggccctggatggtgagcgtgagagccaacggcacccacatctgcgccggcaccatcatcgccagccagtgggtgctgaccgtggcccactgcctgatctggagagacgtgatctacagcgtgagagtgggcagcccctggatcgaccagatgacccagaccgccagcgacgtgcccgtgctgcaggtgatcatgcacagcagatacagagcccagagattctggagctgggtgggccaggccaacgacatcggcctgctgaagctgaagcaggagctgaagtacagcaactacgtgagacccatctgcctgcccggcaccgactacgtgctgaaggaccacagcagatgcaccgtgaccggctggggcctgagcaaggccgacggcatgtggccccagttcagaaccatccaggagaaggaggtgatcatcctgaacaacaaggagtgcgacaacttctaccacaacttcaccaagatccccaccctggtgcagatcatcaagagccagatgatgtgcgccgaggacacccacagagagaagttctgctacgagctgaccggcgagcccctggtgtgcagcatggagggcacctggtacctggtgggcctggtgagctggggcgccggctgccagaagagcgaggccccccccatctacctgcaggtgagcagctaccagcactggatctgggactgcctgaacggccaggccctggccctgcccgcccccagcagaaccctgctgctggccctgcccctgcccctgagcctgctggccgccctgtag

SEQ ID NO: 9881 - DNA, 750 bp, Artificial Sequence
  Description of Artificial Sequence: Synthetic coding sequence
atggtggacagactggccaacagcgaggccaacaccagaagaatcagcatcgtggagaactgcttcggcgccgccggccagcccctgaccatccccggcagagtgctgatcggcgagggcgtgctgaccaagctgtgcagaaagaagcccaaggccagacagttcttcctgttcaacgacatcctggtgtacggcaacatcgtgatccagaagaagaagtacaacaagcagcacatcatccccctggagaacgtgaccatcgacagcatcaaggacgagggcgacctgagaaacggctggctgatcaagacccccaccaagagcttcgccgtgtacgccgccaccgccaccgagaagagcgagtggatgaaccacatcaacaagtgcgtgaccgacctgctgagcaagagcggcaagacccccagcaacgagcacgccgccgtgtgggtgcccgacagcgaggccaccgtgtgcatgagatgccagaaggccaagttcacccccgtgaacagaagacaccactgcagaaagtgcggcttcgtggtgtgcggcccctgcagcgagaagagattcctgctgcccagccagagcagcaagcccgtgagaatctgcgacttctgctacgacctgctgagcgccggcgacatggccacctgccagcccgccagaagcgacagctacagccagagcctgaagagccccctgaacgacatgagcgacgacgacgacgacgacgacagcagcgactag

SEQ ID NO: 9882 - DNA, 2745 bp, Artificial Sequence
  Description of Artificial Sequence: Synthetic coding sequence
atgggcgacagcagagacctgtgcccccacctggacagcatcggcgaggtgaccaaggaggacctgctgctgaagagcaagggcacctgccagagctgcggcgtgaccggccccaacctgtgggcctgcctgcaggtggcctgcccctacgtgggctgcggcgagagcttcgccgaccacagcaccatccacgcccaggccaagaagcacaacctgaccgtgaacctgaccaccttcagactgtggtgctacgcctgcgagaaggaggtgttcctggagcagagactggccgcccccctgctgggcagcagcagcaagttcagcgagcaggacagccccccccccagccaccccctgaaggccgtgcccatcgccgtggccgacgagggcgagagcgagagcgaggacgacgacctgaagcccagaggcctgaccggcatgaagaacctgggcaacagctgctacatgaacgccgccctgcaggccctgagcaactgcccccccctgacccagttcttcctggagtgcggcggcctggtgagaaccgacaagaagcccgccctgtgcaagagctaccagaagctggtgagcgaggtgtggcacaagaagagacccagctacgtggtgcccaccagcctgagccacggcatcaagctggtgaaccccatgttcagaggctacgcccagcaggacacccaggagttcctgagatgcctgatggaccagctgcacgaggagctgaaggagcccgtggtggccaccgtggccctgaccgaggccagagacagcgacagcagcgacaccgacgagaagagagagggcgacagaagccccagcgaggacgagttcctgagctgcgacagcagcagcgacagaggcgagggcgacggccagggcagaggcggcggcagcagccaggccgagaccgagctgctgatccccgacgaggccggcagagccatcagcgagaaggagagaatgaaggacagaaagttcagctggggccagcagagaaccaacagcgagcaggtggacgaggacgccgacgtggacaccgccatggccgccctggacgaccagcccgccgaggcccagccccccagccccagaagcagcagcccctgcagaacccccgagcccgacaacgacgcccacctgagaagcagcagcagaccctgcagccccgtgcaccaccacgagggccacgccaagctgagcagcagcccccccagagccagccccgtgagaatggcccccagctacgtgctgaagaaggcccaggtgctgagcgccggcagcagaagaagaaaggagcagagatacagaagcgtgatcagcgacatcttcgacggcagcatcctgagcctggtgcagtgcctgacctgcgacagagtgagcaccaccgtggagaccttccaggacctgagcctgcccatccccggcaaggaggacctggccaagctgcacagcgccatctaccagaacgtgcccgccaagcccggcgcctgcggcgacagctacgccgcccagggctggctggccttcatcgtggagtacatcagaagattcgtggtgagctgcacccccagctggttctggggccccgtggtgaccctggaggactgcctggccgccttcttcgccgccgacgagctgaagggcgacaacatgtacagctgcgagagatgcaagaagctgagaaacggcgtgaagtactgcaaggtgctgagactgcccgagatcctgtgcatccacctgaagagattcagacacgaggtgatgtacagcttcaagatcaacagccacgtgagcttccccctggagggcctggacctgagacccttcctggccaaggagtgcaccagccagatcaccacctacgacctgctgagcgtgatctgccaccacggcaccgccggcagcggccactacatcgcctactgccagaacgtgatcaacggccagtggtacgagttcgacgaccagtacgtgaccgaggtgcacgagaccgtggtgcagaacgccgagggctacgtgctgttctacagaaagagcagcgaggaggccatgagagagagacagcaggtggtgagcctggccgccatgagagagcccagcctgctgagattctacgtgagcagagagtggctgaacaagttcaacaccttcgccgagcccggccccatcaccaaccagaccttcctgtgcagccacggcggcatccccccccacaagtaccactacatcgacgacctggtggtgatcctgccccagaacgtgtgggagcacctgtacaacagattcggcggcggccccgccgtgaaccacctgtacgtgtgcagcatctgccaggtggagatcgaggccctggccaagagaagaagaatcgagatcgacaccttcatcaagctgaacaaggccttccaggccgaggagagccccggcgtgatctactgcatcagcatgcagtggttcagagagtgggaggccttcgtgaagggcaaggacaacgagccccccggccccatcgacaacagcagaatcgcccaggtgaagggcagcggccacgtgcagctgaagcagggcgccgactacggccagatcagcgaggagacctggacctacctgaacagcctgtacggcggcggccccgagatcgccatcagacagagcgtggcccagcccctgggccccgagaacctgcacggcgagcagaagatcgaggccgagaccagagccgtgtag

SEQ ID NO: 9883 - DNA, 1341 bp, Artificial Sequence
  Description of Artificial Sequence: Synthetic coding sequence
atgagagccgccagaagaggcctgcactgcgccggcgccgagagacccagaagaagaggcagactgtgggacagcagcggcgtgccccagagacagaagagacccggcccctggagaacccagacccaggagcagatgagcagagacgtgtgcatccacacctggccctgcacctactacctggagcccaagagaagatgggtgaccggccagctgagcctgaccagcctgagcctgagattcatgaccgacagcaccggcgagatcctggtgagcttccccctgagcagcatcgtggagatcaagaaggaggccagccacttcatcttcagcagcatcaccatcctggagaagggccacgccaagcactggttcagcagcctgagacccagcagaaacgtggtgttcagcatcatcgagcacttctggagagagctgctgctgagccagcccggcgccgtggccgacgccagcgtgcccagaaccagaggcgaggagctgaccggcctgatggccggcagccagaagagactggaggacaccgccagagtgctgcaccaccagggccagcagctggacagcgtgatgagaggcctggacaagatggagagcgacctggaggtggccgacagactgctgaccgagctggagagccccgcctggtggcccttcagcagcaagctgtggaagaccccccccgagaccaagcccagagaggacgtgagcatgaccagctgcgagcccttcggcaaggagggcatcctgatcaagatccccgccgtgatcagccacagaaccgagagccacgtgaagcccggcagactgaccgtgctggtgagcggcctggagatccacgacagcagcagcctgctgatgcacagattcgagagagaggacgtggacgacatcaaggtgcacagcccctacgagatcagcatcagacagagattcatcggcaagcccgacatggcctacagactgatcagcgccaagatgcccgaggtgatccccatcctggaggtgcagttcagcaagaagatggagctgctggaggacgccctggtgctgagaagcgccagaaccagcagccccgccgagaagagctgcagcgtgtggcacgccgccagcggcctgatgggcagaaccctgcacagagagccccccgccggcgaccaggagggcaccgccctgcacctgcagaccagcctgcccgccctgagcgaggccgacacccaggagctgacccagggcttcagacccatgagcctgagcacccagaccgtgctggtgatgctgtgcagcgagagcgccggcgccctgtggagacagagactgagctag

SEQ ID NO: 9884 - DNA, 1896 bp, Artificial Sequence
  Description of Artificial Sequence: Synthetic coding sequence
atggccatcgtgcagaccctgcccgtgcccctggagcccgcccccgaggccgccaccgccccccaggcccccgtgatgggcagcgtgagcagcctgatcagcggcagaccctgccccggcggccccgccccccccagacaccacggcccccccggccccaccttcttcagacagcaggacggcctgctgagaggcggctacgaggcccaggagcccctgtgccccgccgtgccccccagaaaggccgtgcccgtgaccagcttcacctacatcaacgaggacttcagaaccgagagcccccccagccccagcagcgacgtggaggacgccagagagcagagagcccacaacgcccacctgagaggccccccccccaagctgatccccgtgagcggcaagctggagaagaacatggagaagatcctgatcagacccaccgccttcaagcccgtgctgcccaagcccagaggcgcccccagcctgcccagcttcatgggccccagagccaccggcctgagcggcagccagggcagcctgacccagctgttcggcggccccgccagcagcagcagcagcagcagcagcagcagcgccgccgacaagcccctggccttcagcggctgggccagcggctgccccagcggcaccctgagcgacagcggcagaaacagcctgagcagcctgcccacctacagcaccggcggcgccgagcccaccaccagcagccccggcggccacctgcccagccacggcagcggcagaggcgccctgcccggccccgccagaggcgtgcccaccggccccagccacagcgacagcggcagaagcagcagcagcaagagcaccggcagcctgggcggcagagtggccggcggcctgctgggcagcggcaccagagccagccccgacagcagcagctgcggcgagagaagcccccccccccccccccccccccccagcgacgaggccctgctgcactgcgtgctggagggcaagctgagagacagagaggccgagctgcagcagctgagagacagcctggacgagaacgaggccaccatgtgccaggcctacgaggagagacagagacactggcagagagagagagaggccctgagagaggactgcgccgcccaggcccagagagcccagagagcccagcagctgctgcagctgcaggtgttccagctgcagcaggagaagagacagctgcaggacgacttcgcccagctgctgcaggagagagagcagctggagagaagatgcgccaccctggagagagagcagagagagctgggccccagactggaggagaccaagtgggaggtgtgccagaagagcggcgagatcagcctgctgaagcagcagctgaaggagagccaggccgagctggtgcagaagggcagcgagctggtggccctgagagtggccctgagagaggccagagccaccctgagagtgagcgagggcagagccagaggcctgcaggaggccgccagagccagagagctggagctggaggcctgcagccaggagctgcagagacacagacaggaggccgagcagctgagagagaaggccggccagctggacgccgaggccgccggcctgagagagccccccgtgccccccgccaccgccgaccccttcctgctggccgagagcgacgaggccagcgccaccgccaaccccgtgcacagaagattccagcccacccccgccagaggcgccggcaagaagaagggcctgccccccctgcacatcccccccgaccccaaggccagagagagccagatggcccccgccgcccccgacgtgcccgcccacatcggcggccagggcagagcctgggccagattccccggcctgagcagcgccgccagcctgctggagtag

SEQ ID NO: 9885 - DNA, 1473 bp, Artificial Sequence
  Description of Artificial Sequence: Synthetic coding sequence
atgaacggcgccctggaccacagcgaccagcccgaccccgacgccatcaagatgttcgtgggccagatccccagaagctggagcgagaaggagctgaaggagctgttcgagccctacggcgccgtgtaccagatcaacgtgctgagagacagaagccagaaccccccccagagcaagggctgctgcttcgtgaccttctacaccagaaaggccgccctggaggcccagaacgccctgcacaacatcaagaccctgcccggcatgcaccaccccatccagatgaagcccgccgacagcgagaagagcaacgccgtggaggacagaaagctgttcatcggcatggtgagcaagaagtgcaacgagaacgacatcagagtgatgttcagccccttcggccagatcgaggagtgcagaatcctgagaggccccgacggcctgagcagaggctgcgccttcgtgaccttcagcaccagagccatggcccagaacgccatcaaggccatgcaccagagccagaccatggagggctgcagcagccccatcgtggtgaagttcgccgacacccagaaggacaaggagcagagaagactgcagcagcagctggcccagcagatgcagcagctgaacaccgccacctggggcaacctgaccggcctgggcggcctgaccccccagtacctggccctgctgcagcaggccaccagcagcagcaacctgggcgccttcagcggcatccagcagatggccggcatgaacgccctgcagctgcagaacctggccaccctggccgccgccgccgccgccgcccagaccagcgccaccagcaccaacgccaaccccctgagcaccaccagcagcgccctgggcgccctgaccagccccgtggccgccagcacccccaacagcaccgccggcgccgccatgaacagcctgaccagcctgggcaccctgcagggcctggccggcgccaccgtgggcctgaacaacatcaacgccctggccgtggcccagatgctgagcggcatggccgccctgaacggcggcctgggcgccaccggcctgaccaacggcaccgccggcaccatggacgccctgacccaggcctacagcggcatccagcagtacgccgccgccgccctgcccaccctgtacagccagagcctgctgcagcagcagagcgccgccggcagccagaaggagggccccgagggcgccaacctgttcatctaccacctgccccaggagttcggcgaccaggacatcctgcagatgttcatgcccttcggcaacgtgatcagcgccaaggtgttcatcgacaagcagaccaacctgagcaagtgcttcggcttcgtgagctacgacaaccccgtgagcgcccaggccgccatccaggccatgaacggcttccagatcggcatgaagagactgaaggtgcagctgaagagaagcaagaacgacagcaagccctactag

SEQ ID NO: 9886 - DNA, 627 bp, Artificial Sequence
  Description of Artificial Sequence: Synthetic coding sequence
atggccgccagcgtggagcagagagagggcaccatccaggtgcagggccaggccctgttcttcagagaggccctgcccggcagcggccaggccagattcagcgtgctgctgctgcacggcatcagattcagcagcgagacctggcagaacctgggcaccctgcacagactggcccaggccggctacagagccgtggccatcgacctgcccggcctgaagggcgagccccccgcccaggagcccctgctgagccagagcagagccagcttcctggccgccgtggtggacgccctggagctgggcccccccgtggtgatcagccccagcctgagcggcatgtacagcctgcccttcctgaccgcccccggcagccagctgcccggcttcgtgcccgtggcccccatctgcaccgacaagatcaacgccgccaactacgccagcgtgaagacccccgccctgatcgtgtacggcgaccaggaccccatgggccagaccagcttcgagcacctgaagcagctgcccaaccacagagtgctgatcatgaagggcgccggccacccctgctacctggacaagcccgaggagtggcacaccggcctgctggacttcctgcagggcctgcagtag

SEQ ID NO: 9887 - DNA, 546 bp, Artificial Sequence
  Description of Artificial Sequence: Synthetic coding sequence
atggagagcagaagcgtggcccaggccggcgtgcagtggtgcgacctgggcagcctgcagccccccccccccggcttcaagcagttcagctacttcagcctgcagagcagctgggactacagatacgtgcccccctgccccgccaacttcgtgttcctggtggagatgggcttcctgcacgtggaccaggccggcctgaagctgctgaccagcggcatcgacttcgccaccagaaagatcgccaagctgctgaagccccagaaggtgatcgagcagaacggcgacagcttcaccatccacaccaacagcagcctgagaaactacttcgtgaagttcaaggtgggcgaggagttcgacgaggacaacagaggcctggacaacagaaagtgcaagagcctggtgatctgggacaacgacagactgacctgcatccagaagggcgagaagaagaacagaggctggacccactggatcgagggcgacaagctgcacctggagatgttctgcgagggccaggtgtgcaagcagaccttccagagagcctag

SEQ ID NO: 9888 - DNA, 1647 bp, Artificial Sequence
  Description of Artificial Sequence: Synthetic coding sequence
atgagcgccagcctgaactacaagagcttcagcaaggagcagcagaccatggacaacctggagaagcagctgatctgccccatctgcctggagatgttcaccaagcccgtggtgatcctgccctgccagcacaacctgtgcagaaagtgcgccagcgacatcttccaggccagcaacccctacctgcccaccagaggcggcaccaccatggccagcggcggcagattcagatgccccagctgcagacacgaggtggtgctggacagacacggcgtgtacggcctgcagagaaacctgctggtggagaacatcatcgacatctacaagcaggagagcaccagacccgagaagaagagcgaccagcccatgtgcgaggagcacgaggaggagagaatcaacatctactgcctgaactgcgaggtgcccacctgcagcctgtgcaaggtgttcggcgcccacaaggactgccaggtggcccccctgacccacgtgttccagagacagaagagcgagctgagcgacggcatcgccatcctggtgggcagcaacgacagagtgcagggcgtgatcagccagctggaggacacctgcaagaccatcgaggagtgctgcagaaagcagaagcaggagctgtgcgagaagttcgactacctgtacggcatcctggaggagagaaagaacgagatgacccaggtgatcaccagaacccaggaggagaagctggagcacgtgagagccctgatcaagaagtacagcgaccacctggagaacgtgagcaagctggtggagagcggcatccagttcatggacgagcccgagatggccgtgttcctgcagaacgccaagaccctgctgaagaagatcagcgaggccagcaaggccttccagatggagaagatcgagcacggctacgagaacatgaaccacttcaccgtgaacctgaacagagaggagaagatcatcagagagatcgacttctacagagaggacgaggacgaggaggaggaggagggcggcgagggcgagaaggagggcgagggcgaggtgggcggcgaggccgtggaggtggaggaggtggagaacgtgcagaccgagttccccggcgaggacgagaaccccgagaaggccagcgagctgagccaggtggagctgcaggccgcccccggcgccctgcccgtgagcagccccgagcccccccccgccctgccccccgccgccgacgcccccgtgacccagggcgaggtggtgcccaccggcagcgagcagaccaccgagagcgagacccccgtgcccgccgccgccgagaccgccgaccccctgttctaccccagctggtacaagggccagaccagaaaggccaccaccaaccccccctgcacccccggcagcgagggcctgggccagatcggcccccccggcagcgaggacagcaacgtgagaaaggccgaggtggccgccgccgccgccagcgagagagccgccgtgagcggcaaggagaccagcgcccccgccgccaccagccagatcggcttcgaggccccccccctgcagggccaggccgccgcccccgccagcggcagcggcgccgacagcgagcccgccagacacatcttcagcttcagctggctgaacagcctgaacgagtag

SEQ ID NO: 9889 - DNA, 1374 bp, Artificial Sequence
  Description of Artificial Sequence: Synthetic coding sequence
atgttccccaagttcagcctgagaagcatgttccacggcgccggcggcggcaacgacatccagtggtgcttcagccaggtgaagggcgccgtggacgacgacgtggccgaggccgacatcatcagcaccgtggagttcaaccacagcggcgagctgctggccaccggcgacaagggcggcagagtggtgatcttccagcaggagcaggagaacaagatccagagccacagcagaggcgagtacaacgtgtacagcaccttccagagccacgagcccgagttcgactacctgaagagcctggagatcgaggagaagatcaacaagatcagatggctgccccagaagaacgccgcccagttcctgctgagcaccaacgacaagaccatcaagctgtggaagatcagcgagagagacaagagacccgagggctacaacctgaaggaggaggacggcagatacagagaccccaccaccgtgaccaccctgagagtgcccgtgttcagacccatggacctgatggtggaggccagccccagaagaatcttcgccaacgcccacacctaccacatcaacagcatcagcatcaacagcgactacgagacctacctgagcgccgacgacctgagaatcaacctgtggcacctggagatcaccgacagaagcttcaacatcgtggacatcaagcccgccaacatggaggagctgaccgaggtgatcaccgccgccgagttccaccccaacagctgcaacaccttcgtgtacagcagcagcaagggcaccatcagactgtgcgacatgagagccagcgccctgtgcgacagacacagcaagctgttcgaggagcccgaggaccccagcaacagaagcttcttcagcgagatcatcagcagcatcagcgacgtgaagttcagccacagcggcagatacatgatgaccagagactacctgagcgtgaagatctgggacctgaacatggagaacagacccgtggagacctaccaggtgcacgagtacctgagaagcaagctgtgcagcctgtacgagaacgactgcatcttcgacaagttcgagtgctgctggaacggcagcgacagcgtggtgatgaccggcagctacaacaacttcttcagaatgttcgacagaaacaccaagagagacatcaccctggaggccagcagagagaacaacaagcccagaaccgtgctgaagcccagaaaggtgtgcgccagcggcaagagaaagaaggacgagatcagcgtggacagcctggacttcaacaagaagatcctgcacaccgcctggcaccccaaggagaacatcatcgccgtggccaccaccaacaacctgtacatcttccaggacaaggtgaactag

SEQ ID NO: 9890 - DNA, 738 bp, Artificial Sequence
  Description of Artificial Sequence: Synthetic coding sequence
atggccggcctggagctgctgagcgaccagggctacagagtggacggcagaagagccggcgagctgagaaagatccaggccagaatgggcgtgttcgcccaggccgacggcagcgcctacatcgagcagggcaacaccaaggccctggccgtggtgtacggcccccacgagatcagaggcagcagagccagagccctgcccgacagagccctggtgaactgccagtacagcagcgccaccttcagcaccggcgagagaaagagaagaccccacggcgacagaaagagctgcgagatgggcctgcagctgagacagaccttcgaggccgccatcctgacccagctgcaccccagaagccagatcgacatctacgtgcaggtgctgcaggccgacggcggcacctacgccgcctgcgtgaacgccgccaccctggccgtgctggacgccggcatccccatgagagacttcgtgtgcgcctgcagcgccggcttcgtggacggcaccgccctggccgacctgagccacgtggaggaggccgccggcggcccccagctggccctggccctgctgcccgccagcggccagatcgccctgctggagatggacgccagactgcacgaggaccacctggagagagtgctggaggccgccgcccaggccgccagagacgtgcacaccctgctggacagagtggtgagacagcacgtgagagaggccagcatcctgctgggcgactag

SEQ ID NO: 9891 - DNA, 2631 bp, Artificial Sequence
  Description of Artificial Sequence: Synthetic coding sequence
atgatggccgacggcgccgccgccggcgccggcggcagccccagcctgagagagctgagagccagaatggtggccgccgccaacgagatcgccaaggagagaagaaagcaggacgtggtgaacagagtggccacccacagcagcaacatcagaagcaccttcaagcccgtgatcgacggcagcatgctgaagaacgacatcaagcagagactggccagagagagaagagaggagaagagaagacagcaggacgccaacaaggagacccagctgctggagaaggagagaaagaccaagctgcagtacgagaagcagatggaggagagacagagaaagctgaaggagagaaaggagaaggaggagcagagaagaatcgccgccgaggagaagagacaccagaaggacgaggcccagaaggagaagttcaccgccatcctgtacagaaccctggagagaagaagactggccgacgactaccagcagaagagatggagctggggcggcagcgccatggccaacagcgagagcaagaccgccaacaagagaagcgccagcaccgagaagctggagcagggcaccagcgccctgatcagacagatgcccctgagcagcgccggcctgcagaacagcgtggccaagagaaagaccgacaaggagagaagcagcagcctgaacagaagagacagcaacctgcacagcagcaccgacaaggagcaggccgagagaaagcccagagtgaccggcgtgaccaactacgtgatgcagtacgtgaccgtgcccctgagaaagtgcaccagcgacgagctgagagccgtgatgttccccatgagcaccatgaagatccccccccagaccaaggtggaggagagccccctggagaaggtggagaccccccccaaggccagcgtggacgcccccccccaggtgaacgtggaggtgttctgcaacaccagcatggaggccagccccaaggccggcgtgggcatggcccccgaggtgagcaccgacagcttccccgtggtgagcgtggacgtgagccccgtggtgagcacctacgacagcgagatgagcatggacgccagccccgagctgagcatcgaggccctgcccaaggtggacctggagaccgtgcccaaggtgagcatcgtggccagccccgaggccagcctggaggccccccccgaggtgagcctggaggccctgcccgaggtgagcgtggaggccgcccccgagggcagcctggaggccccccccaagggcagcgccgaggtggcccccaaggagagcgtgaagggcagccccaaggagagcatggaggccagccccgaggccatggtgaaggccagccccaagaccagcctggaggccagcatggaggccagccccaaggccaaggccagagacgcccccaagaagagcgagatggacaagcaggccctgatccccatcgccaagaagagactgagcagctacaccgagtgctacaagtggagcagcagccccgagaacgcctgcggcctgcccagccccatcagcaccaacagacagatccagaagaactgcccccccagccccctgcccctgatcagcaagcagagcccccagaccagcttcccctacaagatcatgcccatccagcacaccctgagcgtgcagagcgccagcagcaccgtgaagaagaagaaggagaccgtgagcaagaccaccaacagatgcgaggccctgagccagagacacatgatctacgaggagagcggcaacaagagcaccgccggcatcatgaacgccgaggccgccaccaagatcctgaccgagctgagaagactggccagagagcagagagagaaggaggaggaggagagacagagagaggagatgcagcagagagtgatcaagaagagcaaggacatggccaaggaggccgtgggcggccaggccgaggaccacctgaagctgaaggacggccagcagcagaacgagaccaagaagaagaagggctggctggaccaggaggaccaggaggcccccctgcagaagggcgacgccaagatcaaggcccaggaggaggccgacaagagaaagaaggagcacgagagaatcatgctgcagaacctgcaggagagactggagagaaagaagagaatcgaggagatcatgaagagaaccagaaagaccgacgtgaacgccagcaaggtgaccgagaccagcagccacgacatctacgaggaggccgaggccgacaacgaggagagcgacaaggacagcctgaacgagatgttccccagcgccatcctgaacggcaccggcagccccaccaagttcaagatgcccttcaacaacgccaagaagatgacccacaagctggtgttcctggaggacggcaccagccaggtgagaaaggagcccaagacctacttcaacggcgacctgaagaacttcagacagaagagcatgaaggacaccagcatccaggaggtggtgagcagacccagcagcaagagaatgaccagccacaccaccaagaccagaaaggccgacgagaccaacaccaccagcagaagcagcgcccagaccaagagcgagggcttccacgacatcctgcccaagagcagcgacaccttcagacagtag

SEQ ID NO: 9892 - DNA, 6291 bp, Artificial Sequence
  Description of Artificial Sequence: Synthetic coding sequence
atgtgcagcacccccggcatgcccgcccccggcgccagcctggccctgagagtgagcttcgtggacgtgcaccccgacgtgatccccgtgcagctgtggggcctggtgggcgagagaagaggcgagtacctgagactgagcagagagatccaggaggccgccgccaccagaggccagtgggccctgggcagcgccagcgccagccccggcgagctgtgcctggtgcaggtgggcctgctgtggcacagatgcagagtggtgagcagacaggcccaggagagcagagtgttcctgctggacgagggcagaaccatcaccgccggcgccggcagcctggcccccggcagaagagagttcttcaacctgcccagcgaggtgctgggctgcgtgctggccggcctggtgcccgccggctgcggcgccggcagcggcgagcccccccagcactggcccgccgacgccgtggacttcctgagcaacctgcagggcaaggaggtgcacggctgcgtgctggacgtgctgctgctgcacagactggtgctgctggaggtgcccgacgtgttccagcagatgagagagctgggcctggccagaagagtgcccgacagcctgttcagaagcctgctggagagatacctgaccgccgccaccgccagcgtgggcagcggcgtgcccgtgctgagcagagtgcccctgaagcagaagcagcccggcctggactacttctacccccagctgcagctgggcgtgaccgaggccgtggtgatcacccaggtgtgccacccccacagaatccactgccagctgagaagcgtgagccaggagatccacagactgagcgagagcatggcccaggtgtacagaggcagcaccggcaccggcgacgagaacagcaccagcgccacctgggaggagagagaggagagccccgacaagcccggcagcccctgcgccagctgcggcctggacggccactggtacagagccctgctgctggagaccttcagaccccagagatgcgcccaggtgctgcacgtggactacggcagaaaggagctggtgagctgcagcagcctgagatacctgctgcccgagtacttcagaatgcccgtggtgacctacccctgcgccctgtacggcctgtgggacggcggcagaggctggagcagaagccaggtgggcgacctgaagaccctgatcctgggcaaggccgtgaacgccaagatcgagttctactgcagcttcgagcacgtgtactacgtgagcctgtacggcgaggacggcatcaacctgaacagagtgttcggcgtgcagagctgctgcctggccgacagagtgctgcagagccaggccaccgaggaggaggagcccgagaccagccagagccagagccccgccgaggaggtggacgaggagatcagcctgcccgccctgagaagcatcagactgaagatgaacgccttctacgacgcccaggtggagttcgtgaagaaccccagcgagttctggatcagactgagaaagcacaacgtgaccttcagcaagctgatgagaagaatgtgcggcttctacagcagcgccagcaagctggacggcgtggtgctgaagcccgagcccgacgacctgtgctgcgtgaagtggaaggagaacggctactacagagccatcgtgaccaagctggacgacaagagcgtggacgtgttcctggtggacagaggcaacagcgagaacgtggactggtacgacgtgagaatgctgctgccccagttcagacagctgcccatcctggccgtgaagtgcaccctggccgacatctggcccctgggcaagacctggagccaggaggccgtgagcttcttcaagaagaccgtgctgcacaaggagctggtgatccacatcctggacaagcaggaccaccagtacgtgatcgagatcctggacgagagcagaaccggcgaggagaacatcagcaaggtgatcgcccaggccggctacgccaagtaccaggagttcgagaccaaggagaacatcctggtgaacgcccacagccccggccacgtgagcaaccacttcaccaccgagagcaacaagatccccttcgccaagaccggcgagggcgagcagaaggccaagagagagaacaagaccaccagcgtgagcaaggccctgagcgacaccaccgtggtgaccaacggcagcaccgagctggtggtgcaggagaaggtgaagagagccagcgtgtacttccccctgatgcagaactgcctggagatcaagcccggcagcagcagcaagggcgagctggaggtgggcagcaccgtggaggtgagagtgagctacgtggagaaccccggctacttctggtgccagctgaccagaaacatccagggcctgaagaccctgatgagcgacatccagtactactgcaagaacaccgccgccccccaccagagaaacaccctggcctgcctggccaagagaaccgtgaacagacagtggagcagagccctgatcagcggcatccagagcgtggagcacgtgaacgtgaccttcgtggactacggcgacagagagatggtgagcgtgaagaacatctacagcatcagcgaggagttcctgaaggtgaaggcccaggccttcagatgcagcctgtacaacctgatccagcccgtgggccagaaccccttcgtgtgggacgtgaaggccatccaggccttcaacgagttcatcgacaacgcctggcagaagaacctggagctgaagtgcaccatcttcgccctggccagcatcaacgaggagctgttcaacatcgtggacctgctgacccccttccagagcgcctgccacttcctggtggagaagagactggccagacccgtgaagctgcagaagcccctggagagcagcgtgcagctgcacagctacttctacagcacccacgacatgaagatcggcagcgaggagctggtgtacatcacccacatcgacgacccctggaccttctactgccagctggccagaaacgccaacatcctggagcagctgagctgcagcatcacccagctgagcaaggtgctgctgaacctgaagaccagccccctgaaccccggcaccctgtgcctggccaagtacaccgacggcaactggtacagaggcatcgtgatcgagaaggagcccaagaaggtgttcttcgtggacttcggcaacatctacgtggtgaccagcgacgacctgctgcccatccccagcgacgcctacgacgtgctgctgctgcccatgcaggccgtgagatgcagcctgagcgacatccccgaccacatccccgaggaggtggtggtgtggttccaggagaccatcctggacaagagcctgaaggccctggtggtggccaaggaccccgacggcaccctgatcatcgagctgtacggcgacaacatccagatcagcgccagcatcaacaagaagctgggcctgctgagctacaaggacagaatcagaaagaaggagagcgaggtgctgtgcagcaccaccgagaccctggaggagaagaacgagaacatgaagctgccctgcaccgagtacctgagcaagagcgtgggctacaagctgcccaacaaggagatcctggaggagagctacaagccccagatcaacagcagctacaaggagctgaagctgctgcagagcctgaccaagaccaacctggtgacccagtaccaggacagcgtgggcaacaagaacagccaggtgttccccctgaccaccgagaagaaggaggagatcagcgccgagacccccctgaagaccgccagagtggaggccaccctgagcgagagaaagatcggcgacagctgcgacaaggacctgcccctgaagttctgcgagttcccccagaagaccatcatgcccggcttcaagaccaccgtgtacgtgagccacatcaacgacctgagcgacttctacgtgcagctgatcgaggacgaggccgagatcagccacctgagcgagagactgaacagcgtgaagaccagacccgagtactacgtgggcccccccctgcagagaggcgacatgatctgcgccgtgttccccgaggacaacctgtggtacagagccgtgatcaaggagcagcagcccaacgacctgctgagcgtgcagttcatcgactacggcaacgtgagcgtggtgcacaccaacaagatcggcagactggacctggtgaacgccatcctgcccggcctgtgcatccactgcagcctgcagggcttcgaggtgcccgacaacaagaacagcaagaagatgatgcactacttcagccagagaaccagcgaggccgccatcagatgcgagttcgtgaagttccaggacagatgggaggtgatcctggccgacgagcacggcatcatcgccgacgacatgatcagcagatacgccctgagcgagaagagccaggtggagctgagcacccaggtgatcaagagcgccagcagcaagagcgtgaacaagagcgacatcgacaccagcgtgttcctgaactggtacaaccccgagaagaagatgatcagagcctacgccaccgtgatcgacggccccgagtacttctggtgccagttcgccgacaccgagaagctgcagtgcctggaggtggaggtgcagaccgccggcgagcaggtggccgacagaagaaactgcatcccctgcccctacatcggcgacccctgcatcgtgagatacagagaggacggccactactacagagccctgatcaccaacatctgcgaggactacctggtgagcgtgagactggtggacttcggcaacatcgaggactgcgtggaccccaaggccctgtgggccatccccagcgagctgctgagcgtgcccatgcaggccttcccctgctgcctgagcggcttcaacatcagcgagggcctgtgcagccaggagggcaacgactacttctacgagatcatcaccgaggacgtgctggagatcaccatcctggagatcagaagagacgtgtgcgacatccccctggccatcgtggacctgaagagcaagggcaagagcatcaacgagaagatggagaagtacagcaagaccggcatcaagagcgccctgccctacgagaacatcgacagcgagatcaagcagaccctgggcagctacaacctggacgtgggcctgaagaagctgagcaacaaggccgtgcagaacaagatctacatggagcagcagaccgacgagctggccgagatcaccgagaaggacgtgaacatcatcggcaccaagcccagcaacttcagagaccccaagaccgacaacatctgcgagggcttcgagaacccctgcaaggacaagatcgacaccgaggagctggagggcgagctggagtgccacctggtggacaaggccgagttcgacgacaagtacctgatcaccggcttcaacaccctgctgccccacgccaacgagaccaaggagatcctggagctgaacagcctggaggtgcccctgagccccgacgacgagagcaaggagttcctggagctggagagcatcgagctgcagaacagcctggtggtggacgaggagaagggcgagctgagccccgtgccccccaacgtgcccctgagccaggagtgcgtgaccaagggcgccatggagctgttcaccctgcagctgcccctgagctgcgaggccgagaagcagcccgagctggagctgcccaccgcccagctgcccctggacgacaagatggaccccctgagcctgggcgtgagccagaaggcccaggagagcatgtgcaccgaggacatgagaaagagcagctgcgtggagagcttcgacgaccagagaagaatgagcctgcacctgcacggcgccgactgcgaccccaagacccagaacgagatgaacatctgcgaggaggagttcgtggagtacaagaacagagacgccatcagcgccctgatgcccctgttcagcgaggaggagagcagcgacggcagcaagcacaacaacggcctgcccgaccacatcagcgcccagctgcagaacacctacaccctgaaggccttcaccgtgggcagcaagtgcgtggtgtggagcagcctgagaaacacctggagcaagtgcgagatcctggagaccgccgaggagggcaccagagtgctgaacctgagcaacggcatggaggagatcgtgaaccccgagaacgtgtggaacggcatccccaagctggacaagagcccccccgagaagagaggcctggaggtgatggagatctag

SEQ ID NO: 9893 - DNA, 690 bp, Artificial Sequence
  Description of Artificial Sequence: Synthetic coding sequence
atgggcaagagctgcaaggtggtggtgtgcggccaggccagcgtgggcaagaccagcatcctggagcagctgctgtacggcaaccacgtggtgggcagcgagatgatcgagacccaggaggacatctacgtgggcagcatcgagaccgacagaggcgtgagagagcaggtgagattctacgacaccagaggcctgagagacggcgccgagctgcccagacactgcttcagctgcaccgacggctacgtgctggtgtacagcaccgacagcagagagagcttccagagagtggagctgctgaagaaggagatcgacaagagcaaggacaagaaggagggcctgaccctgccccccagactggagtgcagcggcatgatcaccgcccactgcagcctgaacctgcccagactgagatggagcagctgcctgagccccctgctgagactgcaggtgaccatcgtggtgctgggcaacaagtgcgacctgcaggagcagagaagagtggaccccgacgtggcccagcactgggccaagagcgagaaggtgaagctgtgggaggtgagcgtggccgacagaagaagcctgctggagcccttcgtgtacctggccagcaagatgacccagccccagagcaagagcgccttccccctgagcagaaagaacaagggcagcggcagcctggacggctag

SEQ ID NO: 9894 - DNA, 2412 bp, Artificial Sequence
  Description of Artificial Sequence: Synthetic coding sequence
atggagagcggccccagagccgagctgggcgccggcgccccccccgccgtggtggccagaaccccccccgagcccagacccagccccgagggcgaccccagccccccccccccccccatgagcgccctggtgcccgacaccccccccgacaccccccccgccatgaagaacgccaccagcagcaagcagctgcccctggagcccgagagccccagcggccaggtgggccccagacccgcccccccccaggaggagagccccagcagcgaggccaagagcagaggccccaccccccccgccatgggccccagagacgccagaccccccagaagaagcagccagcccagccccaccgccgtgcccgccagcgacagcccccccaccaagcaggaggtgaagaaggccggcgagagacacaagctggccaaggagagaagagaggagagagccaagtacctggccgccaagaaggccgtgtggctggagaaggaggagaaggccaaggccctgagagagaagcagctgcaggagagaagaagaagactggaggagcagagactgaaggccgagcagagaagagccgccctggaggagagacagagacagaagctggagaagaacaaggagagatacgaggccgccatccagagaagcgtgaagaagacctgggccgagatcagacagcagagatggagctgggccggcgccctgcaccacagcagccccggccacaagaccaacagaagcctgcagctgagcgcctgggagagcagcatcgtggacagactgatgacccccaccctgagcttcctggccagaagcagaagcgccgtgaccctgcccagaaacggcagagaccagggcagaggctgcgaccccggcagaggccccacctggggcagagccggcgccagcctggccagaggcccccagcccgacagaacccaccccagcgccgccgtgcccgtgtgccccagaagcgccagcgccagccccctgaccccctgcagcgtgaccagaagcgtgcacagatgcgcccccgccggcgagagaggcgagagaagaaagcccaacgccggcggcagccccgcccccgtgagaagaagacccgaggccagccccgtgcagaagaaggagaagaaggacaaggagagagagaacgagaaggagaagagcgccctggccagagagagaagcctgaagaagagacagagcctgcccgccagccccagagccagactgagcgccagcaccgccagcgagctgagccccaagagcaaggccagacccagcagccccagcaccagctggcacagacccgccagcccctgccccagccccggccccggccacaccctgccccccaagccccccagccccagaggcaccaccgccagccccaagggcagagtgagaagaaaggaggaggccaaggagagccccagcgccgccggccccgaggacaagagccagagcaagagaagagccagcaacgagaaggagagcgccgcccccgccagccccgcccccagccccgcccccagccccacccccgcccccccccagaaggagcagccccccgccgagacccccaccgacgccgccgtgctgaccagcccccccgcccccgccccccccgtgacccccagcaagcccatggccggcaccaccgacagagaggaggccaccagactgctggccgagaagagaagacaggccagagagcagagagagagagaggagcaggagagaagactgcaggccgagagagacaagagaatgagagaggagcagctggccagagaggccgaggccagagccgagagagaggccgaggccagaagaagagaggagcaggaggccagagagaaggcccaggccgagcaggaggagcaggagagactgcagaagcagaaggaggaggccgaggccagaagcagagaggaggccgagagacagagactggagagagagaagcacttccagcagcaggagcaggagagacaggagagaagaaagagactggaggagatcatgaagagaaccagaaagagcgaggtgagcgagaccaagaagcaggacagcaaggaggccaacgccaacggcagcagccccgagcccgtgaaggccgtggaggccagaagccccggcctgcagaaggaggccgtgcagaaggaggagcccatcccccaggagccccagtggagcctgcccagcaaggagctgcccgccagcctggtgaacggcctgcagcccctgcccgcccaccaggagaacggcttcagcaccaacggccccagcggcgacaagagcctgagcagaacccccgagaccctgctgcccttcgccgaggccgaggccttcctgaagaaggccgtggtgcagagcccccaggtgaccgaggtgctgtag

SEQ ID NO: 9895 - DNA, 1125 bp, Artificial Sequence
  Description of Artificial Sequence: Synthetic coding sequence
atgagagcccccatgctgcagaagcagcaggcccccagaatggacacccccccccccgaggagagactggagaagcagaacgagaagctgaacaaccaggaggaggagaccgagttcaaggagctggacggcctgagagaggccctggccaacctgagaggcctgagcgaggaggagagaagcgagaaggccatgctgagaagcagaatcgaggagcagagccagctgatctgcatcctgaagagaagaagcgacgaggccctggagagatgccagatcctggagctgctgaacgccgagctggaggagaagatgatgcaggaggccgagaagctgaaggcccagggcgagtacagcagaaagctggaggagagattcatgaccctggccgccaaccacgagctgatgctgagattcaaggacgagtacaagagcgagaacatcaagctgagagaggagaacgagaagctgagactggagaacagcagcctgttcagccaggccctgaaggacgaggaggccaaggtgctgcagctgaccgtgagatgcgaggccctgaccggcgagctggagaccctgaaggagagatgcgcccaggacgcctgccaggcccaggccagagagaaggagctgctggagctgcagagccagcaggcctgcacccacaccaaggagaccgagcagctgagaagccagctgcagaccctgaagcagcagcaccagcaggccgtggagcagatcgccaaggccgaggagacccacagcagcctgagccaggagctgcaggccagactgcagaccgtgaccagagagaaggaggagctgctgcagctgagcatcgagagaggcaaggtgctgcagaacaagcaggccgagatctgccagctggaggagaagctggagatcgccaacgaggacagaaagcacgccctggagagattcgagcaggaggccgtggccgtggacagcaacctgagagtgagagagctgcagagaaaggtggacggcatccagaaggcctacgacgagctgagactgcagagcgaggccttcaagaagcacagcctggacctgctgagcaaggagagagagctgaacggcaagctgagacacctgagcccctag

SEQ ID NO: 9896 - DNA, 585 bp, Artificial Sequence
  Description of Artificial Sequence: Synthetic coding sequence
atggaggacggcctgctggagatcatgaccaaggacggcggcgacatgcccgcccccctggaggtgagcaccgtgcccgccgtgggcgacgtgatcagcggcgagtacaacggcggcatgaaggagctgatggagcacctgaaggcccagctgcaggccctgttcgaggacgtgagagccatgagaggcgccctggacgagcaggccagccacatccaggtgctgagcgacgacgtgtgcgccaaccagagagccatcgtgagcatgtgccagatcatgaccaccgcccccagacagggcggcctgggcgtggtgggcggcaagggcagcttccagagcgacccccaggagcccgagacccccagccccggcatcggcgacagcggcctgctgggcagagaccccgaggacgaggaggaggaggaggaggagaaggagatgcccagccccgccacccccagcagccactgcgagagacccgagagcccctgcgccggcctgctgggcggcgacggccccctggtggagcccctggacatgcccgacatcaccctgctgcagctggagggcgaggccagcctgtag

SEQ ID NO: 9897 - DNA, 1281 bp, Artificial Sequence
  Description of Artificial Sequence: Synthetic coding sequence
atggcccacctgagaggcttcgccaaccagcacagcagagtggaccccgaggagctgttcaccaagctggacagaatcggcaagggcagcttcggcgaggtgtacaagggcatcgacaaccacaccaaggaggtggtggccatcaagatcatcgacctggaggaggccgaggacgagatcgaggacatccagcaggagatcaccgtgctgagccagtgcgacagcccctacatcaccagatacttcggcagctacctgaagagcaccaagctgtggatcatcatggagtacctgggcggcggcagcgccctggacctgctgaagcccggccccctggaggagacctacatcgccaccatcctgagagagatcctgaagggcctggactacctgcacagcgagagaaagatccacagagacatcaaggccgccaacgtgctgctgagcgagcagggcgacgtgaagctggccgacttcggcgtggccggccagctgaccgacacccagatcaagagaaacaccttcgtgggcacccccttctggatggcccccgaggtgatcaagcagagcgcctacgacttcaaggccgacatctggagcctgggcatcaccgccatcgagctggccaagggcgagccccccaacagcgacctgcaccccatgagagtgctgttcctgatccccaagaacagcccccccaccctggagggccagcacagcaagcccttcaaggagttcgtggaggcctgcctgaacaaggaccccagattcagacccaccgccaaggagctgctgaagcacaagttcatcaccagatacaccaagaagaccagcttcctgaccgagctgatcgacagatacaagagatggaagagcgagggccacggcgaggagagcagcagcgaggacagcgacatcgacggcgaggccgaggacggcgagcagggccccatctggaccttcccccccaccatcagacccagcccccacagcaagctgcacaagggcaccgccctgcacagcagccagaagcccgccgagcccgtgaagagacagcccagaagccagtgcctgagcaccctggtgagacccgtgttcggcgagctgaaggagaagcacaagcagagcggcggcagcgtgggcgccctggaggagctggagaacgccttcagcctggccgaggagagctgccccggcatcagcgacaagctgatggtgcacctggtggagagagtgcagagattcagccacaacagaaaccacctgaccagcaccagatag

SEQ ID NO: 9898 - DNA, 1350 bp, Artificial Sequence
  Description of Artificial Sequence: Synthetic coding sequence
atgatgctgagcaccgagggcagagagggcttcgtggtgaaggtgagaggcctgccctggagctgcagcgccgacgaggtgatgagattcttcagcgactgcaagatccagaacggcaccagcggcatcagattcatctacaccagagagggcagacccagcggcgaggccttcgtggagctggagagcgaggaggaggtgaagctggccctgaagaaggacagagagaccatgggccacagatacgtggaggtgttcaagagcaacagcgtggagatggactgggtgctgaagcacaccggccccaacagccccgacaccgccaacgacggcttcgtgagactgagaggcctgcccttcggctgcagcaaggaggagatcgtgcagttcttcagcggcctggagatcgtgcccaacggcatgaccctgcccgtggacttccagggcagaagcaccggcgaggccttcgtgcagttcgccagccaggagatcgccgagaaggccctgaagaagcacaaggagagaatcggccacagatacatcgagatcttcaagagcagcagagccgaggtgagaacccactacgacccccccagaaagctgatggccatgcagagacccggcccctacgacagacccggcgccggcagaggctacaacagcatcggcagaggcgccggcttcgagagaatgagaagaggcgcctacggcggcggctacggcggctacgacgactacggcggctacaacgacggctacggcttcggcagcgacagattcggcagagacctgaactactgcttcagcggcatgagcgaccacagatacggcgacggcggcagcagcttccagagcaccaccggccactgcgtgcacatgagaggcctgccctacagagccaccgagaacgacatctacaacttcttcagccccctgaaccccatgagagtgcacatcgagatcggccccgacggcagagtgaccggcgaggccgacgtggagttcgccacccacgaggacgccgtggccgccatggccaaggacaaggccaacatgcagcacagatacgtggagctgttcctgaacagcaccgccggcaccagcggcggcgcctacgaccacagctacgtggagctgttcctgaacagcaccgccggcgccagcggcggcgcctacggcagccagatgatgggcggcatgggcctgagcaaccagagcagctacggcggccccgccagccagcagctgagcggcggctacggcggcggctacggcggccagagcagcatgagcggctacgaccaggtgctgcaggagaacagcagcgactaccagagcaacctggcctag

SEQ ID NO: 9899 - DNA, 1317 bp, Artificial Sequence
  Description of Artificial Sequence: Synthetic coding sequence
atgtgccccaagaacgccagctactacggcaacagagccgccaccctgatgatgctgggcagattcagagaggccctgggcgacgcccagcagagcgtgagactggacgacagcttcgtgagaggccacctgagagagggcaagtgccacctgagcctgggcaacgccatggccgcctgcagaagcttccagagagccctggagctggaccacaagaacgcccaggcccagcaggagttcaagaacgccaacgccgtgatggagtacgagaagatcgccgagaccgacttcgagaagagagacttcagaaaggtggtgttctgcatggacagagccctggagttcgcccccgcctgccacagattcaagatcctgaaggccgagtgcctggccatgctgggcagataccccgaggcccagagcgtggccagcgacatcctgagaatggacagcaccaacgccgacgccctgtacgtgagaggcctgtgcctgtactacgaggactgcatcgagaaggccgtgcagttcttcgtgcaggccctgagaatggcccccgaccacgagaaggcctgcatcgcctgcagaaacgccaaggccctgaaggccaagaaggaggacggcaacaaggccttcaaggagggcaactacaagctggcctacgagctgtacaccgaggccctgggcatcgaccccaacaacatcaagaccaacgccaagctgtactgcaacagaggcaccgtgaacagcaagctgagaaagctggacgacgccatcgaggactgcaccaacgccgtgaagctggacgacacctacatcaaggcctacctgagaagagcccagtgctacatggacaccgagcagtacgaggaggccgtgagagactacgagaaggtgtaccagaccgagaagaccaaggagcacaagcagctgctgaagaacgcccagctggagctgaagaagagcaagagaaaggactactacaagatcctgggcgtggacaagaacgccagcgaggacgagatcaagaaggcctacagaaagagagccctgatgcaccaccccgacagacacagcggcgccagcgccgaggtgcagaaggaggaggagaagaagttcaaggaggtgggcgaggccttcaccatcctgagcgaccccaagaagaagaccagatacgacagcggccaggacctggacgaggagggcatgaacatgggcgacttcgaccccaacaacatcttcaaggccttcttcggcggccccggcggcttcagcttcgaggccagcggccccggcaacttcttcttccagttcggctag

SEQ ID NO: 9900 - DNA, 165 bp, Artificial Sequence
  Description of Artificial Sequence: Synthetic coding sequence
atgcccggcaagaaggccagaaagaacgcccagcccagccccgccagagcccccgccgagctggaggtggagtgcgccacccagctgagaagattcggcgacaagctgaacttcagacagaagctgctgaacctgatcagcaagctgttctgcagcggcacctag

SEQ ID NO: 9901 - DNA, 1404 bp, Artificial Sequence
  Description of Artificial Sequence: Synthetic coding sequence
atggccagcgtggccgccgccagagccgtgcccgtgggcagcggcctgagaggcctgcagagaaccctgcccctggtggtgatcctgggcgccaccggcaccggcaagagcaccctggccctgcagctgggccagagactgggcggcgagatcgtgagcgccgacagcatgcaggtgtacgagggcctggacatcatcaccaacaaggtgagcgcccaggagcagagaatctgcagacaccacatgatcagcttcgtggaccccctggtgaccaactacaccgtggtggacttcagaaacagagccaccgccctgatcgaggacatcttcgccagagacaagatccccatcgtggtgggcggcaccaactactacatcgagagcctgctgtggaaggtgctggtgaacaccaagccccaggagatgggcaccgagaaggtgatcgacagaaaggtggagctggagaaggaggacggcctggtgctgcacaagagactgagccaggtggaccccgagatggccgccaagctgcacccccacgacaagagaaaggtggccagaagcctgcaggtgttcgaggagaccggcatcagccacagcgagttcctgcacagacagcacaccgaggagggcggcggccccctgggcggccccctgaagttcagcaacccctgcatcctgtggctgcacgccgaccaggccgtgctggacgagagactggacaagagagtggacgacatgctggccgccggcctgctggaggagctgagagacttccacagaagatacaaccagaagaacgtgagcgagaacagccaggactaccagcacggcatcttccagagcatcggcttcaaggagttccacgagtacctgatcaccgagggcaagtgcaccctggagaccagcaaccagctgctgaagaagggcatcgaggccctgaagcaggtgaccaagagatacgccagaaagcagaacagatgggtgaagaacagattcctgagcagacccggccccatcgtgccccccgtgtacggcctggaggtgagcgacgtgagcaagtgggaggagagcgtgctggagcccgccctggagatcgtgcagagcttcatccagggccacaagcccaccgccacccccatcaagatgccctacaacgaggccgagaacaagagaagctaccacctgtgcgacctgtgcgacagaatcatcatcggcgacagagagtgggccgcccacatcaagagcaagagccacctgaaccagctgaagaagagaagaagactggacagcgacgccgtgaacaccatcgagagccagagcgtgagccccgaccacaacaaggagcccaaggagaagggcagccccggccagaacgaccaggagctgaagtgcagcgtgtag

SEQ ID NO: 9902 - DNA, 558 bp, Artificial Sequence
  Description of Artificial Sequence: Synthetic coding sequence
atgggcgtgaacctgaccagaagcaacaaggagaccgtgaagcacagcgacgtgctgttcctggccgtgaagccccacatcatccccttcatcctggacgagatcggcgccgacgtgcaggccagacacatcgtggtgagctgcgccgccggcgtgaccatcagcagcgtggagaagaagctgatggccttccagcccgcccccaaggtgatcagatgcatgaccaacacccccgtggtggtgcaggagggcgccaccgtgtacgccaccggcacccacgccctggtggaggacggccagctgctggagcagctgatgagcagcgtgggcttctgcaccgaggtggaggaggacctgatcgacgccgtgaccggcctgagcggcagcggccccgcctaccagagcatggccgaccaggagaagatcagccccgccgccctgaagaagaccctgctggacagagtgaagctggagagccccaccgtgagcaccctgacccccagcagccccggcaagctgctgaccagaagcctggccctgggcggcaagaaggactag

SEQ ID NO: 9903 - DNA, 960 bp, Artificial Sequence
  Description of Artificial Sequence: Synthetic coding sequence
atgagcgtgggcttcatcggcgccggccagctggccatgctgtggagaggcgccagcagaccccagcaccccgtgggcagccaggacaacagccagctgcccagaaacgagcccgcccacggcgtgagagcccaggaggacggctgcgagcccgacacccagcagcagggcgacggcgaggcccagagaagacccgtgagcggctgcgaggcccacatcatccccttcatcctggacgagatcggcgccgacgtgcaggccagacacatcgtggtgagctgcgccgccggcgtgaccatcagcagcgtggagaagaagctgatggccttccagcccgcccccaaggtgatcagatgcatgaccaacacccccgtggtggtgcaggagggcgccaccgtgtacgccaccggcacccacgccctggtggaggacggccagctgctggagcagctgatgagcagcgtgggcttctgcaccgaggtggaggaggacctgatcgacgccgtgaccggcctgagcggcagcggccccgcctacgccttcatggccctggacgccctggccgacggcggcgtgaagatgggcctgcccagaagactggccatccagctgggcgcccaggccctgctgggcgccgccaagatgctgctggacagcgagcagcacccctgccagctgaaggacaacgtgtgcagccccggcggcgccaccatccacgccctgcacttcctggagagcggcggcttcagaagcctgctgatcaacgccgtggaggccagctgcatcagaaccagagagctgcagagcatggccgaccaggagaagatcagccccgccgccctgaagaagaccctgctggacagagtgaagctggagagccccaccgtgagcaccctgacccccagcagccccggcaagctgctgaccagaagcctggccctgggcggcaagaaggactag

SEQ ID NO: 9904 - DNA, 708 bp, Artificial Sequence
  Description of Artificial Sequence: Synthetic coding sequence
atgctgagcgccaccagaagagcctgccagctgctgctgctgcacagcctgttccccgtgcccagaatgggcaacagcgccagcaacatcgtgagcccccaggaggccctgcccggcagaaaggagcagacccccgtggccgccaagcaccacgtgaacggcaacagaaccgtggagcccttccccgagggcacccagatggccgtgttcggcatgggctgcttctggggcgccgagagaaagttctgggtgctgaagggcgtgtacagcacccaggtgggcttcgccggcggctacaccagcaaccccacctacaaggaggtgtgcagcgagaagaccggccacgccgaggtggtgagagtggtgtaccagcccgagcacatgagcttcgaggagctgctgaaggtgttctgggagaaccacgaccccacccagggcatgagacagggcaacgaccacggcacccagtacagaagcgccatctaccccaccagcgccaagcagatggaggccgccctgagcagcaaggagaactaccagaaggtgctgagcgagcacggcttcggccccatcaccaccgacatcagagagggccagaccttctactacgccgaggactaccaccagcagtacctgagcaagaaccccaacggctactgcggcctgggcggcaccggcgtgagctgccccgtgggcatcaagaagtag

SEQ ID NO: 9905 - DNA, 3873 bp, Artificial Sequence
  Description of Artificial Sequence: Synthetic coding sequence
atgagcggccccctggagggcgccgacggcggcggcgaccccagacccggcgagagcttctgccccggcggcgtgcccagccccggccccccccagcacagaccctgccccggccccagcctggccgacgacaccgacgccaacagcaacggcagcagcggcaacgagagcaacggccacgagagcagaggcgccagccagagaagcagccacagcagcagcagcggcaacggcaaggacagcgccctgctggagaccaccgagagcagcaagagcaccaacagccagagccccagcccccccagcagcagcatcgcctacagcctgctgagcgccagcagcgagcaggacaaccccagcaccagcggctgcagcagcgagcagagcgccagagccagaacccagaaggagctgatgaccgccctgagagagctgaagctgagactgccccccgagagaagaggcaagggcagaagcggcaccctggccaccctgcagtacgccctggcctgcgtgaagcaggtgcaggccaaccaggagtactaccagcagtggagcctggaggagggcgagccctgcagcatggacatgagcacctacaccctggaggagctggagcacatcaccagcgagtacaccctgcagaaccaggacaccttcagcgtggccgtgagcttcctgaccggcagaatcgtgtacatcagcgagcaggccgccgtgctgctgagatgcaagagagacgtgttcagaggcaccagattcagcgagctgctggccccccaggacgtgggcgtgttctacggcagcaccgcccccagcagactgcccacctggggcaccggcgccagcgccggcagcggcctgagagacttcacccaggagaagagcgtgttctgcagaatcagaggcggccccgacagagaccccggccccagataccagcccttcagactgaccccctacgtgaccaagatcagagtgagcgacggcgcccccgcccagccctgctgcctgctgatcgccgagagaatccacagcggctacgaggcccccagaatcccccccgacaagagaatcttcaccaccagacacacccccagctgcctgttccaggacgtggacgagagagccgcccccctgctgggctacctgccccaggacctgctgggcgcccccgtgctgctgttcctgcaccccgaggacagacccctgatgctggccatccacaagaagatcctgcagctggccggccagcccttcgaccacagccccatcagattctgcgccagaaacggcgagtacgtgaccatggacaccagctgggccggcttcgtgcacccctggagcagaaaggtggccttcgtgctgggcagacacaaggtgagaaccgcccccctgaacgaggacgtgttcaccccccccgcccccagccccgcccccagcctggacaccgacatccaggagctgagcgagcagatccacagactgctgctgcagcccgtgcacagccccagccccaccggcctgtgcggcgtgggcgccgtgaccagccccggccccctgcacagccccggcagcagcagcgacagcaacggcggcgacgccgagggccccggcccccccgcccccgtgaccttccagcagatctgcaaggacgtgcacctggtgaagcaccagggccagcagctgttcatcgagagcagagccagaccccagagcagacccagactgcccgccaccggcaccttcaaggccaaggccctgccctgccagagccccgaccccgagctggaggccggcagcgcccccgtgcaggcccccctggccctggtgcccgaggaggccgagagaaaggaggccagcagctgcagctaccagcagatcaactgcctggacagcatcctgagatacctggagagctgcaacctgcccagcaccaccaagagaaagtgcgccagcagcagcagctacaccaccagcagcgccagcgacgacgacagacagagaaccggccccgtgagcgtgggcaccaagaaggacccccccagcgccgccctgagcggcgagggcgccacccccagaaaggagcccgtggtgggcggcaccctgagccccctggccctggccaacaaggccgagagcgtggtgagcgtgaccagccagtgcagcttcagcagcaccatcgtgcacgtgggcgacaagaagccccccgagagcgacatcatcatgatggaggacctgcccggcctggcccccggccccgcccccagccccgcccccagccccaccgtggcccccgaccccgcccccgacgcctacagacccgtgggcctgaccaaggccgtgctgagcctgcacacccagaaggaggagcaggccttcctgagcagattcagagacctgggcagactgagaggcctggacagcagcagcaccgcccccagcgccctgggcgagagaggctgccaccacggccccgccccccccagcagaagacaccactgcagaagcaaggccaagagaagcagacaccaccagaaccccagagccgaggccccctgctacgtgagccaccccagccccgtgccccccagcaccccctggcccaccccccccgccaccacccccttccccgccgtggtgcagccctaccccctgcccgtgttcagccccagaggcggcccccagcccctgccccccgcccccaccagcgtgccccccgccgccttccccgcccccctggtgacccccatggtggccctggtgctgcccaactacctgttccccacccccagcagctacccctacggcgccctgcagacccccgccgagggcccccccacccccgccagccacagccccagccccagcctgcccgccctggcccccagccccccccacagacccgacagccccctgttcaacagcagatgcagcagccccctgcagctgaacctgctgcagctggaggagctgcccagagccgagggcgccgccgtggccggcggccccggcagcagcgccggcccccccccccccagcgccgaggccgccgagcccgaggccagactggccgaggtgaccgagagcagcaaccaggacgccctgagcggcagcagcgacctgctggagctgctgctgcaggaggacagcagaagcggcaccggcagcgccgccagcggcagcctgggcagcggcctgggcagcggcagcggcagcggcagccacgagggcggcagcaccagcgccagcatcaccagaagcagccagagcagccacaccagcaagtacttcggcagcatcgacagcagcgaggccgaggccggcgccgccagaggcggcgccgagcccggcgaccaggtgatcaagtacgtgctgcaggaccccatctggctgctgatggccaacgccgaccagagagtgatgatgacctaccaggtgcccagcagagacatgaccagcgtgctgaagcaggacagagagagactgagagccatgcagaagcagcagcccagattcagcgaggaccagagaagagagctgggcgccgtgcacagctgggtgagaaagggccagctgcccagagccctggacgtgatggcctgcgtggactgcggcagcagcacccaggaccccggccaccccgacgaccccctgttcagcgagctggacggcctgggcctggagcccatggaggagggcggcggcgagcagggcagcagcggcggcggcagcggcgagggcgagggctgcgaggaggcccagggcggcgccaaggccagcagcagccaggacctggccatggaggaggaggaggagggcagaagcagcagcagccccgccctgcccaccgccggcaactgcaccagctag

SEQ ID NO: 9906 - DNA, 2022 bp, Artificial Sequence
  Description of Artificial Sequence: Synthetic coding sequence
atggagaaggccgtgaacgacggcagccacagcgaggagctgttctgccacctgaagaccatcagcgagaaggaggacctgcccagatgcaccagcgagagccacctgagctgcctgaagcaggacatcctgaacgagaagaccgagctggaggccaccctgaaggaggccgagctggtgacccacagcgtggagctgctgctgcccctgttcaaggacaccatcgagaagatcaacttcgagaacgccaacctgagcgccctgaacctgaagatcagcgagcagaaggagatcctgatcaaggagctggacaccttcaagagcgtgaagctggccctggagcacctgctgagaaagagagactacaagcagaccggcgacaacctgagcagcatgctgctggagaacctgaccgacaacgagagcgagaacaccaacctgaagaagaaggtgttcgagaaggaggcccacatccaggagctgagctgcctgttccagagcgagaaggccaacaccctgaaggccaacagattcagccagagcgtgaaggtggtgcacgagagactgcagatccagatccacaagagagaggccgagaacgacaagctgaaggagtacgtgaagagcctggagaccaagatcgccaagtggaacctgcagagcagaatgaacaagaacgaggccatcgtgatgaaggaggccagcagacagaagaccgtggccctgaagaaggccagcaaggtgtacaagcagagactggaccacttcaccggcgccatcgagaagctgaccagccagatcagagaccaggaggccaagctgagcgagaccatcagcgccagcaacgcctggaagagccactacgagaagatcgtgatcgagaagaccgagctggaggtgcagatcgagaccatgaagaagcagatcatcaacctgctggaggacctgaagaagatggaggaccacggcaagaacagctgcgaggagatcctgagaaaggtgcacagcatcgagtacgagaacgagaccctgaacctggagaacaccaagctgaagctgagattcccctgcagaatcaccgagagcaagaacatgaacatcctgatcgtgctggacatgctgtgctacatcagcagcgagaagaccaccctggccgccctgaaggacgaggtggtgagcgtggagaacgagctgagcgagctgcaggaggtggagaagaagcagaagaccctgatcgagatgtacaagacccaggtgcagaagctgcaggaggccgccgagatcgtgaagagcagatgcgagaacctgctgcacaagaacaaccagatcaccaagaccaagaacaagaacgtggagaagatgagaggccagatggagagccacctgaaggagctggagagagtgtgcgacagcctgaccgccgccgagagaagactgcacgagtgccaggagagcctgcagtgctgcaagggcaagtgcgccgaccaggagcacaccatcagagagctgcagggccaggtggacggcaaccacaacctgctgaccaagctgagcctggaggaggagaactgcctgatccagctgaagtgcgagaacctgcagcagaagctggagcagatggacgccgagaacaaggagctggagaagaagctggccaaccaggaggagtgcctgaagcacagcaacctgaagttcaaggagaagagcgccgagtacaccgccctggccagacagctggaggccgccctggaggagggcagacagaaggtggccgaggagatcgagaagatgagcagcagagagagcgccctgcagatcaagatcctggacctggagaccgagctgagaaagaagaacgaggagcagaaccagctggtgtgcaagatgaacagcaaggcccagcaccaggaggtgtgcctgaaggaggtgcagaacagcctggagaagagcgagaaccagaacgagagcatcaagaactacctgcagttcctgaagaccagctacgtgaccatgttcgagtag

SEQ ID NO: 9907 - DNA, 798 bp, Artificial Sequence
  Description of Artificial Sequence: Synthetic coding sequence
atggacgacaaggccagcgtgggcaagatcagcgtgagcagcgacagcgtgagcaccctgaacagcgaggacttcgtgctggtgagcagacagggcgacgagacccccagcaccaacaacggcagcgacgacgagaagaccggcctgaagatcgtgggcaacggcagcgagcagcagctgcagaaggagctggccgacgtgctgatggacccccccatggacgaccagcccggcgagaaggagctggtgaagagaagccagctggacggcgagggcgacggccccctgagcaaccagctgagcgccagcagcaccatcaaccccgtgcccctggtgggcctgcagaagcccgagatgagcctgcccgtgaagcccggccagggcgacagcgaggccagcagccccttcacccccgtggccgacgaggacagcgtggtgttcagcaagctgacctacctgggctgcgccagcgtgaacgcccccagaagcgaggtggaggccctgagaatgatgagcatcctgagaagccagtgccagatcagcctggacgtgaccctgagcgtgcccaacgtgagcgagggcatcgtgagactgctggacccccagaccaacaccgagatcgccaactaccccatctacaagatcctgttctgcgtgagaggccacgacggcacccccgagagcgactgcttcgccttcaccgagagccactacaacgccgagctgttcagaatccacgtgttcagatgcgagatccaggaggccgtgagcccccaggagaagaccctgtgcaagtag

SEQ ID NO: 9908 - DNA, 636 bp, Artificial Sequence
  Description of Artificial Sequence: Synthetic coding sequence
atgtgggccagcctgagcctggaccaccccagcgccaaggagaaccaggccctgagactgatcgagatgagagaggagaacggcaacgtgcccaagaccgagcaggccggcagcctgaagcccctgagagacaccggcaagagcaacctgaaggagaagaaggccaacagcaagctgaagcagatcgagaaggagtacacccagaagctggccaagagcagccagatcatcgccgagctgcagaccaccatcagcagcctgaaggaggagaacagccagcagcagctggccgccgagagaagactgcaggacgtgagacagaagttcgaggacgagaagaagcagctgatcagagacaacgaccaggccatcaaggtgctgcaggacgagctggagaacagaagcaaccaggtgagatgcgccgagaagaagctgcagcacaaggagctggagagccaggagcagatcacctacatcagacaggagtacgagaccaagctgaagggcctgatgcccgccagcctgagacaggagctggaggacaccatcagcagcctgaagagccaggtgaacttcctgcagaagagagccagcatcctgcaggaggagctgaccacctaccagggcagaagatag

SEQ ID NO: 9909 - DNA, 867 bp, Artificial Sequence
  Description of Artificial Sequence: Synthetic coding sequence
atgagcagcagcatgtggtacatcatgcagagcatccagagcaagtacagcctgagcgagagactgatcagaaccatcgccgccatcagaagcttcccccacgacaacgtggaggacctgatcagaggcggcgccgacgtgaactgcacccacggcaccctgaagcccctgcactgcgcctgcatggtgagcgacgccgactgcgtggagctgctgctggagaagggcgccgaggtgaacgccctggacggctacaacagaaccgccctgcactacgccgccgagaaggacgaggcctgcgtggaggtgctgctggagtacggcgccaaccccaacgccctggacggcaacagagacacccccctgcactgggccgccttcaagaacaacgccgagtgcgtgagagccctgctggagagcggcgccagcgtgaacgccctggactacaacaacgacacccccctgagctgggccgccatgaagggcaacctggagagcgtgagcatcctgctggactacggcgccgaggtgagagtgatcaacctgatcggccagacccccatcagcagactggtggccctgctggtgagaggcctgggcaccgagaaggaggacagctgcttcgagctgctgcacagagccgtgggccacttcgagctgagaaagaacggcaccatgcccagagaggtggccagagacccccagctgtgcgagaagctgaccgtgctgtgcagcgcccccggcaccctgaagaccctggccagatacgccgtgagaagaagcctgggcctgcagtacctgcccgacgccgtgaagggcctgcccctgcccgccagcctgaaggagtacctgctgctgctggagtag

SEQ ID NO: 9910 - DNA, 1341 bp, Artificial Sequence
  Description of Artificial Sequence: Synthetic coding sequence
atgagagagatcgtgcacatccaggccggccagtgcggcaaccagatcggcaccaagttctgggaggtgatcagcgacgagcacggcatcgaccccgccggcggctacgtgggcgacagcgccctgcagctggagagaatcaacgtgtactacaacgagagcagcagccagaagtacgtgcccagagccgccctggtggacctggagcccggcaccatggacagcgtgagaagcggccccttcggccagctgttcagacccgacaacttcatcttcggccagaccggcgccggcaacaactgggccaagggccactacaccgagggcgccgagctggtggacgccgtgctggacgtggtgagaaaggagtgcgagcactgcgactgcctgcagggcttccagctgacccacagcctgggcggcggcaccggcagcggcatgggcaccctgctgatcagcaagatcagagaggagttccccgacagaatcatgaacaccttcagcgtgatgcccagccccaaggtgagcgacaccgtggtggagccctacaacgccaccctgagcgtgcaccagctggtggagaacaccgacgagacctactgcatcgacaacgaggccctgtacgacatctgcttcagaaccctgaagctgaccacccccacctacggcgacctgaaccacctggtgagcgccaccatgagcggcgtgaccaccagcctgagattccccggccagctgaacgccgacctgagaaagctggccgtgaacatggtgcccttccccagactgcacttcttcatgcccggcttcgcccccctgaccagcagaggcagccagcagtacagagccctgaccgtgcccgagctgacccagcagatgttcgacgccagaaacatgatggccgcctgcgaccccagacacggcagatacctgaccgtggccaccgtgttcagaggccccatgagcatgaaggaggtggacgagcagatgctggccatccagagcaagaacagcagctacttcgtggagtggatccccaacaacgtgaaggtggccgtgtgcgacatcccccccagaggcctgaagatggccagcaccttcatcggcaacagcaccgccatccaggagctgttcaagagaatcagcgagcagttcagcgccatgttcagaagaaaggccttcctgcactggttcaccggcgagggcatggacgagatggagttcaccgaggccgagagcaacatgaacgacctggtgagcgagtaccagcagtaccaggacgccaccgccaacgacggcgaggaggccttcgaggacgaggaggaggagatcgacggctag

SEQ ID NO: 9911 - DNA, 792 bp, Artificial Sequence
  Description of Artificial Sequence: Synthetic coding sequence
atgctgagcagcaagggcctgaccgtggtggacgtgtaccagggctggtgcggcccctgcaagcccgtggtgagcctgttccagaagatgagaatcgaggtgggcctggacctgctgcacttcgccctggccgaggccgacagactggacgtgctggagaagtacagaggcaagtgcgagcccaccttcctgttctacgccatcaaggacgaggccctgagcgacgaggacgagtgcgtgagccacggcaagaacaacggcgaggacgaggacatggtgagcagcgagagaacctgcaccctggccatcatcaagcccgacgccgtggcccacggcaagaccgacgagatcatcatgaagatccaggaggccggcttcgagatcctgaccaacgaggagagaaccatgaccgaggccgaggtgagactgttctaccagcacaaggccggcgaggaggccttcgagaagctggtgcaccacatgtgcagcggccccagccacctgctgatcctgaccagaaccgagggcttcgaggacgtggtgaccacctggagaaccgtgatgggccccagagaccccaacgtggccagaagagagcagcccgagagcctgagagcccagtacggcaccgagatgcccttcaacgccgtgcacggcagcagagacagagaggacgccgacagagagctggccctgctgttccccagcctgaagttcagcgacaaggacaccgaggccccccagggcgagagcagcacccagcccagactgaagatcaccgacctggactag

SEQ ID NO: 9912 - DNA, 1089 bp, Artificial Sequence
  Description of Artificial Sequence: Synthetic coding sequence
atgctgaagaacaagggccacagcagcaagaaggacaacctggccgtgaacgccgtggccctgcaggaccacatcctgcacgacctgcagctgagaaacctgagcgtggccgaccacagcaagacccaggtgcagaagaaggagaacaagagcctgaagagagacaccaaggccatcatcgacaccggcctgaagaagaccacccagtgccccaagctggaggacagcgagaaggagtacgtgctggaccccaagcccccccccctgaccctggcccagaagctgggcctgatcggccccccccccccccccctgagcagcgacgagtgggagaaggtgaagcagagaagcctgctgcagggcgacagcgtgcagccctgccccatctgcaaggaggagttcgagctgagaccccaggtgctgctgagctgcagccacgtgttccacaaggcctgcctgcaggccttcgagaagttcaccaacaagaagacctgccccctgtgcagaaagaaccagtaccagaccagagtgatccacgacggcgccagactgttcagaatcaagtgcgtgaccagaatccaggcctactggagaggctgcgtggtgagaaagtggtacagaaacctgagaaagaccgtgccccccaccgacgccaagctgagaaagaagttcttcgagaagaagttcaccgagatcagccacagaatcctgtgcagctacaacaccaacatcgaggagctgttcgccgagatcgaccagtgcctggccatcaacagaagcgtgctgcagcagctggaggagaagtgcggccacgagatcaccgaggaggagtgggagaagatccaggtgcaggccctgagaagagagacccacgagtgcagcatctgcctggcccccctgagcgccgccggcggccagagagtgggcgccggcagaagaagcagagagatggccctgctgagctgcagccacgtgttccaccacgcctgcctgctggccctggaggagttcagcgtgggcgacagaccccccttccacgcctgccccctgtgcagaagctgctaccagaagaagatcctggagtgctag

SEQ ID NO: 9913 - DNA, 291 bp, Artificial Sequence
  Description of Artificial Sequence: Synthetic coding sequence
atgatcgagaagatgcagggcagcagaatggacgagcagagatgcagcttccccccccccctgaagaccgaggaggactacatcccctaccccagcgtgcacgaggtgctgggcagagagggccccttccccctgatcctgctgccccagttcggcggctactggatcgagggcaccaaccacgagatcaccagcatccccgagaccgagcccctgcagagccccaccaccaaggtgaagctggagtgcaaccccaccgccagaatctacagaaagcacttcctgggctag

SEQ ID NO: 9914 - DNA, 459 bp, Artificial Sequence
  Description of Artificial Sequence: Synthetic coding sequence
atggccggcctgcccagaagaatcatcaaggagacccagagactgctggccgagcccgtgcccggcatcaaggccgagcccgacgagagcaacgccagatacttccacgtggtgatcgccggcccccaggacagccccttcgagggcggcaccttcaagctggagctgttcctgcccgaggagtaccccatggccgcccccaaggtgagattcatgaccaagatctaccaccccaacgtggacaagctgggcagaatctgcctggacatcctgaaggacaagtggagccccgccctgcagatcagaaccgtgctgctgagcatccaggccctgctgagcgcccccaaccccgacgaccccctggccaacgacgtggccgagcagtggaagaccaacgaggcccaggccatcgagaccgccagagcctggaccagactgtacgccatgaacaacatctag

SEQ ID NO: 9915 - DNA, 3354 bp, Artificial Sequence
  Description of Artificial Sequence: Synthetic coding sequence
atgtacagaagcagcgccagaagcagcgtgagcagccacagacccaaggacgacggcggcggcggccccagaagcggcagaagcagcggcagcagcagcggccccgccagaagaagcagccccccccccccccccagcggcagcagcagcagaacccccgccagaagacccagaagccccagcggccacagaggcagaagagccagccccagcccccccagaggcagaagagtgagccccagcccccccagagccagaagaggcagccccagcccccccagaggcagaagactgttcccccccggccccgccggcttcagaggcagcagcagaggcgagagcagagccgactacgccagagacggcagaggcgaccaccccggcgacagcggcagcagaagaagaagccccggcctgtgcagcgacagcctggagaagagcctgagaatcaccgtgggcaacgaccacttctgcgtgagcacccccgagagaagaagactgagcgacagactgggcagccccgtggacaacctggaggacatggacagagacgacctgaccgacgacagcgtgttcaccagaagcagccagtgcagcagaggcctggagagatacatcagccaggaggagggccccctgagccccttcctgggccagctggacgaggactacagaaccaaggagaccttcctgcacagaagcgactacagcccccacatcagctgccacgacgagctgctgagaggcaccgagagaaacagagagaagctgaagggctacagcatcagaagcgaggagagaagcagagaggccaagagacccagatacgacgacaccgtgaagatcaacagcatgggcggcgaccaccccagcttcaccagcggcaccagaaactacagacagagaagaagaagccccagccccagattcctggaccccgagttcagagagctggacctggccagaagaaagagagaggaggaggaggagagaagcagaagcctgagccaggagctggtgggcgtggacggcggcggcaccggctgcagcatccccggcctgagcggcgtgctgaccgccagcgagcccggctacagcctgcacagacccgaggaggtgagcgtgatgcccaagaagagcatcctgaagaagagaatcgaggtggacatcatggagcccagcatgcagctggagagcttcagcagcagcaccagcagcagccaggaccaccccctgtacagcggccaccccagcctgcccctgagcggcgccatcgccgccttcgccagcgagatcgagaacaagggcaccatggtggagaccgccctgaaggagccccagggcaacctgtaccagtggggccccctgcccggcatccccaaggacaacagccccctgagagagaagttcggcagcttcctgtgccacaaggacaacctggacctgaaggccgagggccccgagagacacaccgacttcctgctgccccacgagagagccagccaggacggcagcggcttcagcagaatcctgagcatgctggccgacagcaccagcacccaggagaagagaagaagaagcttccccgacatcgaggacgaggagaagttcctgtacggcgacgaggaggaggacctgaaggccgagagcgtgcccaagcccctgggcagcagcgagagcgaggtgatgagacagaaggccagcagcctgcccagcagcgcccccgccgtgaagctggagagcctggaggagaccaaccccgagtacgccaagatccacgacctgctgaagaccatcggcctggacatcggcgtggccgagatcagccagctggccgccagaacccaggagagactgcacggcaagaagcccagcctgagaagcagcgccgacagaagaagcagcgtggacagatacttcagcgccgaccactgcagcagcgtggaccacagattcagcgccgacagatgcagcagcgtggaccactgcttcagcgccgacagaagaagcagcgacccccacagactggagagcagagaggcccaccacagcaacacccacagccccgaggtgagccacccccacccccccagccccgtggacccctacctgctgaccaagaacagcccccccttcctgaagagcgaccaccccgtgggccacatcagcggccccgaggtggtgggcagcggcttccagagcagcgtggccgtgagatgcatgctgcccagcgcccccagcgcccccatcagactgccccacaccgccgccctgagccagttccacatgcccagagccagccagttcgccgccgccagaatcccccccaactaccagggccccgccatcccccccgccagcttcgacgcctacagacactacatggcctacgccgccagcagatggcccatgtaccccaccagccagcccagcaaccaccccgtgcccgagccccacagaatcatgcccatcaccaagcaggccaccagaagcagacccaacctgagagtgatccccaccgtgacccccgacaagcccaagcagaaggagagcctgagaggcagcatccccgccgcccaggtgcccgtgcaggtgagcatccccagcctgatcagatacaaccccgagaagatcagcgacgagaagaacagagccagccagaagcagaaggtgatcgaggagagagagaagctgaagaacgacagagaggccagacagaagaagatgtactacctgagaaccgagctggagagactgcacaagcagcagggcgagatgctgagaaagaagagaagagagaaggacggccacaaggaccccctgctggtggaggtgagcagactgcaggacaacatcatgaaggacatcgccgagctgagacaggaggccgaggaggccgagaagaagcagagcgagctggacaaggtggcccagatcctgggcatcaacatcttcgacaagagccagaagagcctgagcgacagcagagagcccaccgagaagcccggcaaggccgagaagagcaagagccccgagaaggtgagcagcttcagcaacagcagcagcaacaaggagagcaaggtgaacaacgagaagttcagaaccaagagccccaagcccgccgagagcccccagagcgccaccaagcagctggaccagcccaccgccgcctacgagtactacgacgccggcaaccactggtgcaaggactgcaacaccatctgcggcaccatgttcgacttcttcacccacatgcacaacaagaagcacacccagggccagttccagaagagcagcgacttccagaaggagggcctgcagcagaccttcctgccccccgagagacagggctag

SEQ ID NO: 9916 - DNA, 576 bp, Artificial Sequence
  Description of Artificial Sequence: Synthetic coding sequence
atgtacgtgtgcctgtgcgtgagcgtggccaaggtgaccatggccgacagagccgccgccgagagagcctgcaaggaccccaaccccatcatcgacggcagaaaggccaacgtgaacctggcctacctgggcgccaagcccagaatcatgcagcccggcttcgccttcggcgtgcagcagctgcaccccgccctgatccagagacccttcggcatccccgcccactacgtgtacccccaggccttcgtgcagcccggcgtggtgatcccccacgtgcagcccaccgccgccgccgccagcaccaccccctacatcgactacaccggcgccgcctacgcccagtacagcgccgccgccgccgccgccgccgccgccgccgcctacgaccagtacccctacgccgccagccccgccgccgccggctacgtgaccgccggcggctacggctacgccgtgcagcagcccatcaccgccgccgcccccggcaccgccgccgccgccgccgccgccgccgccgccgccgccgccttcggccagtaccagccccagcagctgcagaccgacagaatgcagtag

SEQ ID NO: 9917 - DNA, 330 bp, Artificial Sequence
  Description of Artificial Sequence: Synthetic coding sequence
atggccggcgcccccaccgtgagcctgcccgagctgagaagcctgctggccagcggcagagccagactgttcgacgtgagaagcagagaggaggccgccgccggcaccatccccggcgccctgaacatccccgtgagcgagctggagagcgccctgcagatggagcccgccgccttccaggccctgtacagcgccgagaagcccaagctggaggacgagcacctggtgttcttctgccagatgggcaagagaggcctgcaggccacccagctggccagaagcctgggctacaccggctacggcgaggtgtggctgctggccggcagatag

SEQ ID NO: 9918 - DNA, 630 bp, Artificial Sequence
  Description of Artificial Sequence: Synthetic coding sequence
atggccctgctggccgagcacctgctgaagcccctgcccgccgacaagcagatcgagaccggccccttcctggaggccgtgagccacctgccccccttcttcgactgcctgggcagccccgtgttcacccccatcaaggccgacatcagcggcaacatcaccaagatcaaggccgtgtacgacaccaaccccgccaagttcagaaccctgcagaacatcctggaggtggagaaggagatgtacggcgccgagtggcccaaggtgggcgccaccctggccctgatgtggctgaagagaggcctgagattcatccaggtgttcctgcagagcatctgcgacggcgagagagacgagaaccaccccaacctgatcagagtgaacgccaccaaggcctacgagatggccctgaagaagtaccacggctggatcgtgcagaagatcttccaggccgccctgtacgccgccccctacaagagcgacttcctgaaggccctgagcaagggccagaacgtgaccgaggaggagtgcctggagaagatcagactgttcctggtgaactacaccgccaccatcgacgtgatctacgagatgtacacccagatgaacgccgagctgaactacaaggtgtag

SEQ ID NO: 9919 - DNA, 474 bp, Artificial Sequence
  Description of Artificial Sequence: Synthetic coding sequence
atggaggaggcccagagaaagagaacccagctgagagaggccttcgagcagctgcaggccaagaagcagatggccatggagaagagaagagccgtgcagaaccagtggcagctgcagcaggagaagcacctgcagcacctggccgaggtgagcgccgaggtgagagagagaaagaccggcacccagcaggagctggacagagtgttccagaagctgggcaacctgaagcagcaggccgagcaggagagagacaagctgcagagataccagaccttcctgcagctgctgtacaccctgcagggcaagctgctgttccccgaggccgaggccgaggccgagaacctgcccgacgacaagccccagcagcccaccagaccccaggagcagagcaccggcgacaccatgggcagagaccccggcgtgagcttcaaggccgtgggcctgcagcccgccggcgacgtgaacctgccctag

SEQ ID NO: 9920 - DNA, 639 bp, Artificial Sequence
  Description of Artificial Sequence: Synthetic coding sequence
atggaggtgctgagaagaagcagcgtgttcgccgccgagatcatggacgccttcgacagaagccccaccgacaaggagctggtggcccaggccaaggccctgggcagagagtacgtgcacgccagactgctgagagccggcctgagctggagcgcccccgagagagccgcccccgtgcccggcagactggccgaggtgtgcgccgtgctgctgagactgggcgacgagctggagatgatcagacccagcgtgtacagaaacgtggccagacagctgcacatcagcctgcagagcgagcccgtggtgaccgacgccttcctggccgtggccggccacatcttcagcgccggcatcacctggggcaaggtggtgagcctgtacgccgtggccgccggcctggccgtggactgcgtgagacaggcccagcccgccatggtgcacgccctggtggactgcctgggcgagttcgtgagaaagaccctggccacctggctgagaagaagaggcggctggaccgacgtgctgaagtgcgtggtgagcaccgaccccggcctgagaagccactggctggtggccgccctgtgcagcttcggcagattcctgaaggccgccttcttcgtgctgctgcccgagagatag

SEQ ID NO: 9921 - DNA, 2148 bp, Artificial Sequence
  Description of Artificial Sequence: Synthetic coding sequence
atgagccagagcggcgccgtgagctgctgccccggcgccaccaacggcagcctgggcagaagcgacggcgtggccaagatgagccccaaggacctgttcgagcagagaaagaagtacagcaacagcaacgtgatcatgcacgagaccagccagtaccacgtgcagcacctggccaccttcatcatggacaagagcgaggccatcaccagcgtggacgacgccatcagaaagctggtgcagctgagcagcaaggagaagatctggacccaggagatgctgctgcaggtgaacgaccagagcctgagactgctggacatcgagagccaggaggagctggaggacttccccctgcccaccgtgcagagaagccagaccgtgctgaaccagctgagataccccagcgtgctgctgctggtgtgccaggacagcgagcagagcaagcccgacgtgcacttcttccactgcgacgaggtggaggccgagctggtgcacgaggacatcgagagcgccctggccgactgcagactgggcaagaagatgagaccccagaccctgaagggccaccaggagaagatcagacagagacagagcatcctgccccccccccagggccccgcccccatccccttccagcacagaggcggcgacagccccgaggccaagaacagagtgggcccccaggtgcccctgagcgagcccggcttcagaagaagagagagccaggaggagcccagagccgtgctggcccagaagatcgagaaggagacccagatcctgaactgcgccctggacgacatcgagtggttcgtggccagactgcagaaggccgccgaggccttcaagcagctgaaccagagaaagaagggcaagaagaagggcaagaaggcccccgccgagggcgtgctgaccctgagagccagaccccccagcgagggcgagttcatcgactgcttccagaagatcaagctggccatcaacctgctggccaagctgcagaagcacatccagaaccccagcgccgccgagctggtgcacttcctgttcggccccctggacctgatcgtgaacacctgcagcggccccgacatcgccagaagcgtgagctgccccctgctgagcagagacgccgtggacttcctgagaggccacctggtgcccaaggagatgagcctgtgggagagcctgggcgagagctggatgagacccagaagcgagtggcccagagagccccaggtgcccctgtacgtgcccaagttccacagcggctgggagccccccgtggacgtgctgcaggaggccccctgggaggtggagggcctggccagcgcccccatcgaggaggtgagccccgtgagcagacagagcatcagaaacagccagaagcacagccccaccagcgagcccaccccccccggcgacgccctgccccccgtgagcagcccccacacccacagaggctaccagcccacccccgccatggccaagtacgtgaagatcctgtacgacttcaccgccagaaacgccaacgagctgagcgtgctgaaggacgaggtgctggaggtgctggaggacggcagacagtggtggaagctgagaagcagaagcggccaggccggctacgtgccctgcaacatcctgggcgaggccagacccgaggacgccggcgcccccttcgagcaggccggccagaagtactggggccccgccagccccacccacaagctgccccccagcttccccggcaacaaggacgagctgatgcagcacatggacgaggtgaacgacgagctgatcagaaagatcagcaacatcagagcccagccccagagacacttcagagtggagagaagccagcccgtgagccagcccctgacctacgagagcggccccgacgaggtgagagcctggctggaggccaaggccttcagccccagaatcgtggagaacctgggcatcctgaccggcccccagctgttcagcctgaacaaggaggagctgaagaaggtgtgcggcgaggagggcgtgagagtgtacagccagctgaccatgcagaaggccttcctggagaagcagcagagcggcagcgagctggaggagctgatgaacaagttccacagcatgaaccagagaagaggcgaggacagctag

SEQ ID NO: 9922 - DNA, 600 bp, Artificial Sequence
  Description of Artificial Sequence: Synthetic coding sequence
atggcctggccctgcatcagcagactgtgctgcctggccagaagatggaaccagctggacagaagcgacgtggccgtgcccctgaccctgcacggctacagcgacctggacagcgaggagcccggcaccggcggcgccgccagcagaagaggccagccccccgccggcgccagagacagcggcagagacgtgcccctgacccagtaccagagagacttcggcctgtggaccacccccgccggccccaaggaccccccccccggcagaggccccggcgccggcggcagaagaggcaagagcagcgcccagagcagcgccccccccgcccccggcgccagaggcgtgtacgtgctgcccatcggcgacgccgacgccgccgccgccgtgaccaccagctacagacaggagttccaggcctggaccggcgtgaagcccagcagaagcaccaagaccaagcccgccagagtgatcaccacccacaccagcggctgggacagcagccccggcgccggcttccaggtgcccgaggtgagaaagaagttcacccccaaccccagcgccatcttccaggccagcgcccccagaatcctgaacgtgtag

SEQ ID NO: 9923 - DNA, 5106 bp, Artificial Sequence
  Description of Artificial Sequence: Synthetic coding sequence
atgggcaacagcgacagccagtacaccctgcagggcagcaagaaccacagcaacaccatcaccggcgccaagcagatcccctgcagcctgaagatcagaggcatccacgccaaggaggagaagagcctgcacggctggggccacggcagcaacggcgccggctacaagagcagaagcctggccagaagctgcctgagccacttcaagagcaaccagccctacgccagcagactgggcggccccacctgcaaggtgagcagaggcgtggcctacagcacccacagaaccaacgcccccggcaaggacttccagggcatcagcgccgccttcagcaccgagaacggcttccacagcgtgggccacgagctggccgacaaccacatcaccagcagagactgcaacggccacctgctgaactgctacggcagaaacgagagcatcgccagcaccccccccggcgaggacagaaagagccccagagtgctgatcaagaccctgggcaagctggacggctgcctgagagtggagttccacaacggcggcaaccccagcaaggtgcccgccgaggactgcagcgagcccgtgcagctgctgagatacagccccaccctggccagcgagaccagccccgtgcccgaggccagaagaggcagcagcgccgacagcctgcccagccacagacccagccccaccgacagcagactgagaagcagcaagggcagcagcctgagcagcgagagcagctggtacgacagcccctggggcaacgccggcgagctgagcgaggccgagggcagcttcctggcccccggcatgcccgaccccagcctgcacgccagcttcccccccggcgacgccaagaagcccttcaaccagagcagcagcctgagcagcctgagagagctgtacaaggacgccaacctgggcagcctgagccccagcggcatcagactgagcgacgagtacatgggcacccacgccagcctgagcaacagagtgagcttcgccagcgacatcgacgtgcccagcagagtggcccacggcgaccccatccagtacagcagcttcaccctgccctgcagaaagcccaaggccttcgtggaggacaccgccaagaaggacagcctgaaggccagaatgagaagaatcagcgactggaccggcagcctgagcagaaagaagagaaagctgcaggagcccagaagcaaggagggcagcgactacttcgacagcagaagcgacggcctgaacaccgacgtgcagggcagcagccaggccagcgccttcctgtggagcggcggcagcacccagatcctgagccagagaagcgagagcacccacgccatcggcagcgaccccctgagacagaacatctacgagaacttcatgagagagctggagatgagcagaaccaacaccgagaacatcgagaccagcaccgagaccgccgagagcagcagcgagagcctgagcagcctggagcagctggacctgctgttcgagaaggagcagggcgtggtgagaaaggccggctggctgttcttcaagcccctggtgaccgtgcagaaggagagaaagctggagctggtggccagaagaaagtggaagcagtactgggtgaccctgaagggctgcaccctgctgttctacgagacctacggcaagaacagcatggaccagagcagcgcccccagatgcgccctgttcgccgaggacagcatcgtgcagagcgtgcccgagcaccccaagaaggagaacgtgttctgcctgagcaacagcttcggcgacgtgtacctgttccaggccaccagccagaccgacctggagaactgggtgaccgccgtgcacagcgcctgcgccagcctgttcgccaagaagcacggcaaggaggacaccctgagactgctgaagaaccagaccaagaacctgctgcagaagatcgacatggacagcaagatgaagaagatggccgagctgcagctgagcgtggtgagcgaccccaagaacagaaaggccatcgagaaccagatccagcagtgggagcagaacctggagaagttccacatggacctgttcagaatgagatgctacctggccagcctgcagggcggcgagctgcccaaccccaagagcctgctggccgccgccagcagacccagcaagctggccctgggcagactgggcatcctgagcgtgagcagcttccacgccctggtgtgcagcagagacgacagcgccctgagaaagagaaccctgagcctgacccagagaggcagaaacaagaagggcatcttcagcagcctgaagggcctggacaccctggccagaaagggcaaggagaagagacccagcatcacccaggtggacgagctgctgcacatctacggcagcaccgtggacggcgtgcccagagacaacgcctgggagatccagacctacgtgcacttccaggacaaccacggcgtgaccgtgggcatcaagcccgagcacagagtggaggacatcctgaccctggcctgcaagatgagacagctggagcccagccactacggcctgcagctgagaaagctggtggacgacaacgtggagtactgcatccccgccccctacgagtacatgcagcagcaggtgtacgacgagatcgaggtgttccccctgaacgtgtacgacgtgcagctgaccaagaccggcagcgtgtgcgacttcggcttcgccgtgaccgcccaggtggacgagagacagcacctgagcagaatcttcatcagcgacgtgctgcccgacggcctggcctacggcgagggcctgagaaagggcaacgagatcatgaccctgaacggcgaggccgtgagcgacctggacctgaagcagatggaggccctgttcagcgagaagagcgtgggcctgaccctgatcgccagaccccccgacaccaaggccaccctgtgcaccagctggagcgacagcgacctgttcagcagagaccagaagagcctgctgcccccccccaaccagagccagctgctggaggagttcctggacaacttcaagaagaacaccgccaacgacttcagcaacgtgcccgacatcaccaccggcctgaagagaagccagaccgacggcaccctggaccaggtgagccacagagagaagatggagcagaccttcagaagcgccgagcagatcaccgccctgtgcagaagcttcaacgacagccaggccaacggcatggagggccccagagagaaccaggaccccccccccagaagcctggccagacacctgagcgacgccgacagactgagaaaggtgatccaggagctggtggacaccgagaagagctacgtgaaggacctgagctgcctgttcgagctgtacctggagcccctgcagaacgagaccttcctgacccaggacgagatggagagcctgttcggcagcctgcccgagatgctggagttccagaaggtgttcctggagaccctggaggacggcatcagcgccagcagcgacttcaacaccctggagacccccagccagttcagaaagctgctgttcagcctgggcggcagcttcctgtactacgccgaccacttcaagctgtacagcggcttctgcgccaaccacatcaaggtgcagaaggtgctggagagagccaagaccgacaaggccttcaaggccttcctggacgccagaaaccccaccaagcagcacagcagcaccctggagagctacctgatcaagcccgtgcagagagtgctgaagtaccccctgctgctgaaggagctggtgagcctgaccgaccaggagagcgaggagcactaccacctgaccgaggccctgaaggccatggagaaggtggccagccacatcaacgagatgcagaagatctacgaggactacggcaccgtgttcgaccagctggtggccgagcagagcggcaccgagaaggaggtgaccgagctgagcatgggcgagctgctgatgcacagcaccgtgagctggctgaaccccttcctgagcctgggcaaggccagaaaggacctggagctgaccgtgttcgtgttcaagagagccgtgatcctggtgtacaaggagaactgcaagctgaagaagaagctgcccagcaacagcagacccgcccacaacagcaccgacctggaccccttcaagttcagatggctgatccccatcagcgccctgcaggtgagactgggcaaccccgccggcaccgagaacaacagcatctgggagctgatccacaccaagagcgagatcgagggcagacccgagaccatcttccagctgtgctgcagcgacagcgagagcaagaccaacatcgtgaaggtgatcagaagcatcctgagagagaacttcagaagacacatcaagtgcgagctgcccctggagaagacctgcaaggacagactggtgcccctgaagaacagagtgcccgtgagcgccaagctggccagcagcagaagcctgaaggtgctgaagaacagcagcagcaacgagtggaccggcgagaccggcaagggcaccctgctggacagcgacgagggcagcctgagcagcggcacccagagcagcggctgccccaccgccgagggcagacaggacagcaagagcaccagccccggcaagtacccccaccccggcctggccgacttcgccgacaacctgatcaaggagagcgacatcctgagcgacgaggacgacgaccacagacagaccgtgaagcagggcagccccaccaaggacatcgagatccagttccagagactgagaatcagcgaggaccccgacgtgcaccccgaggccgagcagcagcccggccccgagagcggcgagggccagaagggcggcgagcagcccaagctggtgagaggccacttctgccccatcaagagaaaggccaacagcaccaagagagacagaggcaccctgctgaaggcccagatcagacaccagagcctggacagccagagcgagaacgccaccatcgacctgaacagcgtgctggagagagagttcagcgtgcagagcctgaccagcgtggtgagcgaggagtgcttctacgagaccgagagccacggcaagagctag

SEQ ID NO: 9924 - DNA, 3177 bp, Artificial Sequence
  Description of Artificial Sequence: Synthetic coding sequence
atggacctgggccccctgaacatctgcgaggagatgaccatcctgcacggcggcttcctgctggccgagcagctgttccaccccaaggccctggccgagctgaccaagagcgactgggagagagtgggcagacccatcgtggaggccctgagagagatcagcagcgccgccgcccacagccagcccttcgcctggaagaagaaggccctgatcatcatctgggccaaggtgctgcagccccaccccgtgacccccagcgacaccgagaccagatggcaggaggacctgttcttcagcgtgggcaacatgatccccaccatcaaccacaccatcctgttcgagctgctgaagagcctggaggccagcggcctgttcatccagctgctgatggccctgcccaccaccatctgccacgccgagctggagagattcctggagcacgtgaccgtggacaccagcgccgaggacgtggccttcttcctggacgtgtggtgggaggtgatgaagcacaagggccacccccaggaccccctgctgagccagttcagcgccatggcccacaagtacctgcccgccctggacgagttcccccacccccccaagagactgagaagcgaccccgacgcctgccccaccatgcccctgctggccatgctgctgagaggcctgacccagatccagagcagaatcctgggccccggcagaaagtgctgcgccctggccaacctggccgacatgctgaccgtgttcgccctgaccgaggacgacccccaggaggtgagcgccaccgtgtacctggacaagctggccaccgtgatcagcgtgtggaacagcgacacccagaacccctaccaccagcaggccctggccgagaaggtgaaggaggccgagagagacgtgagcctgaccagcctggccaagctgcccagcgagaccatcttcgtgggctgcgagttcctgcaccacctgctgagagagtggggcgaggagctgcaggccgtgctgagaagcagccagggcaccagctacgacagctacagactgtgcgacagcctgaccagcttcagccagaacgccaccctgtacctgaacagaaccagcctgagcaaggaggacagacaggtggtgagcgagctggccgagtgcgtgagagacttcctgagaaagaccagcaccgtgctgaagaacagagccctggaggacatcaccgccagcatcgccatggccgtgatccagcagaagatggacagacacatggaggtgtgctacatcttcgccagcgagaagaagtgggccttcagcgacgagtgggtggcctgcctgggcagcaacagagccctgttcagacagcccgacctggtgctgagactgctggagaccgtgatcgacgtgagcaccgccgacagagccatccccgagagccagatcagacaggtgatccacctgatcctggagtgctacgccgacctgagcctgcccggcaagaacaaggtgctggccggcatcctgagaagctggggcagaaagggcctgagcgagaagctgctggcctacgtggagggcttccaggaggacctgaacaccaccttcaaccagctgacccagagcgccagcgagcagggcctggccaaggccgtggccagcgtggccagactggtgatcgtgcaccccgaggtgaccgtgaagaagatgtgcagcctggccgtggtgaacctgggcacccacaagttcctggcccagatcctgaccgccttccccgccctgagattcgtggaggagcagggccccaacagcagcgccaccttcatggtgagctgcctgaaggagaccgtgtggatgaagttcagcacccccaaggaggagaagcagttcctggagctgctgaactgcctgatgagccccgtgaagccccagggcatccccgtggccgccctgctggagcccgacgaggtgctgaaggagttcgtgctgcccttcctgagactggacgtggaggaggtggacctgagcctgagaatcttcatccagaccctggaggccaacgcctgcagagaggagtactggctgcagacctgcagccccttccccctgctgttcagcctgtgccagctgctggacagattcagcaagtactggcagctgcccaaggagaagagatgcctgagcctggacagaaaggacctggccatccacatcctggagctgctgtgcgagatcgtgagcgccaacgccgagaccttcagccccgacgtgtggatcaagagcctgagctggctgcacagaaagctggagcagctggactggaccgtgggcctgagactgaagagcttcttcgagggccacttcaagtgcgaggtgcccgccaccctgttcgagatctgcaagctgagcgaggacgagtggaccagccaggcccaccccggctacggcgccggcaccggcctgctggcctggatggagtgctgctgcgtgagcagcggcatcagcgagagaatgctgagcctgctggtggtggacgtgggcaaccccgaggaggtgagactgttcagcaagggcttcctggtggccctggtgcaggtgatgccctggtgcagcccccaggagtggcagagactgcaccagctgaccagaagactgctggagaagcagctgctgcacgtgccctacagcctggagtacatccagttcgtgcccctgctgaacctgaagcccttcgcccaggagctgcagctgagcgtgctgttcctgagaaccttccagttcctgtgcagccacagctgcagagactggctgcccctggagggctggaaccacgtggtgaagctgctgtgcggcagcctgaccagactgctggacagcgtgagagccatccaggccgccggcccctgggtgcagggccccgagcaggacctgacccaggaggccctgttcgtgtacacccaggtgttctgccacgccctgcacatcatggccatgctgcaccccgaggtgtgcgagcccctgtacgtgctggccctggagaccctgacctgctacgagaccctgagcaagaccaaccccagcgtgagcagcctgctgcagagagcccacgagcagagattcctgaagagcatcgccgagggcatcggccccgaggagagaagacagaccctgctgcagaagatgagcagcttctag

SEQ ID NO: 9925 - DNA, 267 bp, Artificial Sequence
  Description of Artificial Sequence: Synthetic coding sequence
atgagcggcctgagagtgtacagcaccagcgtgaccggcagcagagagatcaagagccagcagagcgaggtgaccagaatcctggacggcaagagaatccagtaccagctggtggacatcagccaggacaacgccctgagagacgagatgagagccctggccggcaaccccaaggccacccccccccagatcgtgaacggcgaccagtactgcggcgtgtgggccggcggcagaggcggcggcggcagcgtgggcagaggcctgtag

SEQ ID NO: 9926 - DNA, 933 bp, Artificial Sequence
  Description of Artificial Sequence: Synthetic coding sequence
atggacggcagcttcgtgcagcacagcgtgagagtgctgcaggagctgaacaagcagagagagaagggccagtactgcgacgccaccctggacgtgggcggcctggtgttcaaggcccactggagcgtgctggcctgctgcagccacttcttccagagcctgtacggcgacggcagcggcggcagcgtggtgctgcccgccggcttcgccgagatcttcggcctgctgctggacttcttctacaccggccacctggccctgaccagcggcaacagagaccaggtgctgctggccgccagagagctgagagtgcccgaggccgtggagctgtgccagagcttcaagcccaagaccagcgtgggccaggccgccggcggccagagcggcctgggcccccccgccagccagaacgtgaacagccacgtgaaggagcccgccggcctggaggaggaggaggtgagcagaaccctgggcctggtgcccagagaccaggagcccagaggcagccacagcccccagagaccccagctgcacagccccgcccagagcgagggccccagcagcctgtgcggcaagctgaagcaggccctgaagccctgccccctggaggacaagaagcccgaggactgcaaggtgccccccagacccctggaggccgagggcgcccagctgcagggcggcagcaacgagtgggaggtggtggtgcaggtggaggacgacggcgacggcgactacatgagcgagcccgaggccgtgctgaccagaagaaagagcaacgtgatcagaaagccctgcgccgccgagcccgccctgagcgccggcagcctggccgccgagcccgccgagaacagaaagggcaccgccgtgcccgtggagtgccccacctgccacaagaagttcctgagcaagtactacctgaaggtgcacaactag

SEQ ID NO: 9927 - DNA, 600 bp, Artificial Sequence; identical to SEQ ID NO: 9437
  Description of Artificial Sequence: Synthetic coding sequence

SEQ ID NO: 9928 - DNA, 513 bp, Artificial Sequence
  Description of Artificial Sequence: Synthetic coding sequence
atgagcgtggccggcggcgagatcagaggcgacaccggcggcgaggacaccgccgcccccggcagattcagcttcagccccgagcccaccctggaggacatcagaagactgcacgccgagttcgccgccgagagagactgggagcagttccaccagcccagaaacctgctgctggccctggtgggcgaggtgggcgagctggccgagctgttccagtggaagaccgacggcgagcccggcccccagggctggagccccagagagagagccgccctgcaggaggagctgagcgacgtgctgatctacctggtggccctggccgccagatgcagagtggacctgcccctggccgtgctgagcaagatggacatcaacagaagaagataccccgcccacctggccagaagcagcagcagaaagtacaccgagctgccccacggcgccatcagcgaggaccaggccgtgggccccgccgacatcccctgcgacagcaccggccagaccagcacctag

SEQ ID NO: 9929 - DNA, 702 bp, Artificial Sequence
  Description of Artificial Sequence: Synthetic coding sequence
atgagcgccaagagagccgagctgaagaagacccacctgagcaagaactacaaggccgtgtgcctggagctgaagcccgagcccaccaagaccttcgactacaaggccgtgaagcaggagggcagattcaccaaggccggcgtgacccaggacctgaagaacgagctgagagaggtgagagaggagctgaaggagaagatggaggagatcaagcagatcaaggacctgatggacaaggacttcgacaagctgcacgagttcgtggagatcatgaaggagatgcagaaggacatggacgagaagatggacatcctgatcaacacccagaagaactacaagctgcccctgagaagagcccccaaggagcagcaggagctgagactgatgggcaagacccacagagagccccagctgagacccaagaagatggacggcgccagcggcgtgaacggcgccccctgcgccctgcacaagaagaccatggccccccagaagaccaagcagggcagcctggaccccctgcaccactgcggcacctgctgcgagaagtgcctgctgtgcgccctgaagaacaactacaacagaggcaacatccccagcgaggccagcggcctgtacaagggcggcgaggagcccgtgaccacccagcccagcgtgggccacgccgtgcccgcccccaagagccagaccgagggcagatag

SEQ ID NO: 9930 - DNA, 2196 bp, Artificial Sequence
  Description of Artificial Sequence: Synthetic coding sequence
atgagcgtgaccctgaccagcgtgaagagagtgcagagcagccccaacctgctggccgccggcagagacagccagagccccgacagcgcctggagaagctacaacgacggcaaccaggagaccctgaacggcgacgccacctacagcagcctggccgccaagggcttcagaagcgtgagacccaacctgcaggacaagagaagccccacccagagccagatcaccgtgaacggcaacagcggcggcgccgtgagccccatgagctactaccagagacccttcagccccagcgcctacagcctgcccgccagcctgaacagcagcatcgtgatgcagcacggcaccagcctggacagcaccgacacctacccccagcacgcccagagcctggacggcaccaccagcagcagcatccccctgtacagaagcagcgaggaggagaagagagtgaccgtgatcaaggccccccactaccccggcatcggccccgtggacgagagcggcatccccaccgccatcagaaccaccgtggacagacccaaggactggtacaagaccatgttcaagcagatccacatggtgcacaagcccgacgacgacaccgacatgtacaacaccccctacacctacaacgccggcctgtacaaccccccctacagcgcccagagccaccccgccgccaagacccagacctacagacccctgagcaagagccacagcgacaacagccccaacgccttcaaggacgccagcagccccgtgccccccccccacgtgcccccccccgtgccccccctgagacccagagacagaagcagcaccgagaagcacgactgggacccccccgacagaaaggtggacaccagaaagttcagaagcgagcccagaagcatcttcgagtacgagcccggcaagagcagcatcctgcagcacgagagacccccccccctgcccaccacccccacccccgtgcccagagagcccggcagaaagcccctgagcagcagcagactgggcgaggtgaccggcagccccagccccccccccagaagcggcgcccccacccccagcagcagagcccccgccctgagccccaccagaccccccaagaagcccctggactacgtgcaggaccacagcagcggcgtgttcaacgaggccagcctgtaccagagcagcatcgacagaagcctggagagacccatgagcagcgccagcatggccagcgacttcagaaagagaagaaagagcgagcccgccgtgggcccccccagaggcctgggcgaccagagcgccagcagaaccagccccggcagagtggacctgcccggcagcagcaccaccctgaccaagagcttcaccagcagcagccccagcagccccagcagagccaaggacagagagagccccagaagctacagcagcaccctgaccgacatgggcagaagcgcccccagagagagaagaggcacccccgagaaggagaagctgcccgccaaggccgtgtacgacttcaaggcccagaccagcaaggagctgagcttcaagaagggcgacaccgtgtacatcctgagaaagatcgaccagaactggtacgagggcgagcaccacggcagagtgggcatcttccccatcagctacgtggagaagctgaccccccccgagaaggcccagcccgccagaccccccccccccgcccagcccggcgagatcggcgaggccatcgccaagtacaacttcaacgccgacaccaacgtggagctgagcctgagaaagggcgacagagtgatcctgctgaagagagtggaccagaactggtacgagggcaagatccccggcaccaacagacagggcatcttccccgtgagctacgtggaggtggtgaagaagaacaccaagggcgccgaggactaccccgacccccccatcccccacagctacagcagcgacagaatccacagcctgagcagcaacaagccccagagacccgtgttcacccacgagaacatccagggcggcggcgagcccttccaggccctgtacaactacacccccagaaacgaggacgagctggagctgagagagagcgacgtgatcgacgtgatggagaagtgcgacgacggctggttcgtgggcaccagcagaagaaccaagttcttcggcaccttccccggcaactacgtgaagagactgtag

SEQ ID NO: 9931 - DNA, 969 bp, Artificial Sequence
  Description of Artificial Sequence: Synthetic coding sequence
atgaccctggaggccatcagatacagcagaggcagcctgcagatcctggaccagctgctgctgcccaagcagagcagatacgaggccgtgggcagcgtgcaccaggcctgggaggccatcagagccatgaaggtgagaggcgcccccgccatcgccctggtgggctgcctgagcctggccgtggagctgcaggccggcgccggcggccccggcctggccgccctggtggccttcgtgagagacaagctgagcttcctggtgaccgccagacccaccgccgtgaacatggccagagccgccagagacctggccgacgtggccgccagagaggccgagagagagggcgccaccgaggaggccgtgagagagagaagagagaccgagctgtgcgagcactgggaggagcacaccagacagagagagctgcccctgagaggccccctgggcggcaccgtgctggagaccagaccctacaaccagggcgccagactgaccgccttcgagctggtgtacgagcagatccccgccaccctgatcaccgacagcatggtggccgccgccatggcccacagaggcgtgagcgccgtggtggtgggcgccgacagagtggtggccaacggcgacaccgccaacaaggtgggcacctaccagctggccatcgtggccaagcaccacggcatccccttctacgtggccgcccccagcagcagctgcgacctgagactggagaccggcaaggagatcatcatcgaggagagacccggccaggagctgaccgacgtgaacggcgtgagaatcgccgcccccggcatcggcgtgtggaaccccgccttcgacgtgaccccccacgacctgatcaccggcggcatcatcaccgagctgggcgtgttcgcccccgaggagctgagaaccgccctgaccaccaccatcagcagcagagacggcaccctggacggcccccagatgtag

SEQ ID NO: 9932 - DNA, 5169 bp, Artificial Sequence
  Description of Artificial Sequence: Synthetic coding sequence
atgggcaaccaggacggcaagctgaagagaagcgccggcgacgccctgcacgagggcggcggcggcgccgaggacgccctgggccccagagacgtggaggccaccaagaagggcagcggcggcaagaaggccctgggcaagcacggcaagggcggcggcggcggcggcggcggcggcgagagcggcaagaagaagagcaagagcgacagcagagccagcgtgttcagcaacctgagaatcagaaagaacctgagcaagggcaagggcgccggcggcagcagagaggacgtgctggacagccaggccctgcagaccggcgagctggacagcgcccacagcctgctgaccaagacccccgacctgagcctgagcgccgacgaggccggcctgagcgacaccgagtgcgccgaccccttcgaggtgaccggccccggcggccccggccccgccgaggccagagtgggcggcagacccatcgccgaggacgtggagaccgccgccggcgcccaggacggccagagaaccagcagcggcagcgacaccgacatctacagcttccacagcgccaccgagcaggaggacctgctgagcgacatccagcaggccatcagactgcagcagcagcagcagcagcagctgcagctgcagctgcagcagcagcagcagcagcagcagctgcagggcgccgaggagcccgccgccccccccaccgccgtgagcccccagcccggcgccttcctgggcctggacagattcctgctgggccccagcggcggcgccggcgaggcccccggcagccccgacaccgagcaggccctgagcgccctgagcgacctgcccgagagcctggccgccgagcccagagagccccagcagccccccagccccggcggcctgcccgtgagcgaggcccccagcctgcccgccgcccagcccgccgccaaggacagccccagcagcaccgccttccccttccccgaggccggccccggcgaggaggccgccggcgcccccgtgagaggcgccggcgacaccgacgaggagggcgaggaggacgccttcgaggacgcccccagaggcagccccggcgaggagtgggcccccgaggtgggcgaggacgccccccagagactgggcgaggagcccgaggaggaggcccagggccccgacgcccccgccgccgccagcctgcccggcagccccgcccccagccagagatgcttcaagccctaccccctgatcaccccctgctacatcaagaccaccaccagacagctgagcagccccaaccacagccccagccagagccccaaccagagccccagaatcaagagaagacccgagcccagcctgagcagaggcagcagaaccgccctggccagcgtggccgcccccgccaagaagcacagagccgacggcggcctggccgccggcctgagcagaagcgccgactggaccgaggagctgggcgccagaacccccagagtgggcggcagcgcccacctgctggagagaggcgtggccagcgacagcggcggcggcgtgagccccgccctggccgccaaggccagcggcgcccccgccgccgccgacggcttccagaacgtgttcaccggcagaaccctgctggagaagctgttcagccagcaggagaacggcccccccgaggaggccgagaagttctgcagcagaatcatcgccatgggcctgctgctgcccttcagcgactgcttcagagagccctgcaaccagaacgcccagaccaacgccgccagcttcgaccaggaccagctgtacacctgggccgccgtgagccagcccacccacagcctggactacagcgagggccagttccccagaagagtgcccagcatgggcccccccagcaagccccccgacgaggagcacagactggaggacgccgagaccgagagccagagcgccgtgagcgagaccccccagaagagaagcgacgccgtgcagaaggaggtggtggacatgaagagcgagggccaggccaccgtgatccagcagctggagcagaccatcgaggacctgagaaccaagatcgccgagctggagagacagtaccccgccctggacaccgaggtggccagcggccaccagggcctggagaacggcgtgaccgccagcggcgacgtgtgcctggaggccctgagactggaggagaaggaggtgagacaccacagaatcctggaggccaagagcatccagaccagccccaccgaggagggcggcgtgctgaccctgccccccgtggacggcctgcccggcagacccccctgcccccccggcgccgagagcggcccccagaccaagttctgcagcgagatcagcctgatcgtgagccccagaagaatcagcgtgcagctggacagccaccagcccacccagagcatcagccagcccccccccccccccagcctgctgtggagcgccggccagggccagcccggcagccagcccccccacagcatcagcaccgagttccagaccagccacgagcacagcgtgagcagcgccttcaagaacagctgcaacatccccagccccccccccctgccctgcaccgagagcagcagcagcatgcccggcctgggcatggtgccccccccccccccccccctgcccggcatgaccgtgcccaccctgcccagcaccgccatcccccagcccccccccctgcagggcaccgagatgctgccccccccccccccccccctgcccggcgccggcatccccccccccccccccctgcccggcgccggcatcctgcccctgccccccctgcccggcgccggcatccccccccccccccccctgcccggcgccgccatccccccccccccccccctgcccggcgccggcatccccctgcccccccccctgcccggcgccggcatccccccccccccccccctgcccggcgccggcatccccccccccccccccctgcccggcgccggcatccccccccccccccccctgcccggcgccggcatccccccccccccccccctgcccggcgccggcatccccccccccccccccctgcccggcgccggcatccccccccccccccccctgcccggcgccggcatccccccccccccccccctgcccggcgccggcatccccccccccccccccctgcccggcgccggcatccccccccccccccccctgcccggcgccggcatccccccccccccccccctgcccggcgccggcatccccccccccccccccctgcccggcgccggcatccccccccccccccccctgcccggcgtgggcatccccccccccccccccctgcccggcgccggcatccccccccccccccccctgcccggcgccggcatccccccccccccccccctgcccggcgccggcatccccccccccccccccctgcccagagtgggcatccccccccccccccccctgcccggcgccggcatccccccccccccccccctgcccggcgccggcatccccccccccccccccctgcccggcgtgggcatccccccccccccccccctgcccggcgtgggcatccccccccccccccccctgcccggcgccggcatccccccccccccccccctgcccggcatgggcatcccccccgcccccgccccccccctgcccccccccggcaccggcatcccccccccccccctgctgcccgtgagcggcccccccctgctgccccaggtgggcagcagcaccctgcccaccccccaggtgtgcggcttcctgcccccccccctgcccagcggcctgttcggcctgggcatgaaccaggacaagggcagcagaaagcagcccatcgagccctgcagacccatgaagcccctgtactggaccagaatccagctgcacagcaagagagacagcagcaccagcctgatctgggagaagatcgaggagcccagcatcgactgccacgagttcgaggagctgttcagcaagaccgccgtgaaggagagaaagaagcccatcagcgacaccatcagcaagaccaaggccaagcaggtggtgaagctgctgagcaacaagagaagccaggccgtgggcatcctgatgagcagcctgcacctggacatgaaggacatccagcacgccgtggtgaacctggacaacagcgtggtggacctggagaccctgcaggccctgtacgagaacagagcccagagcgacgagctggagaagatcgagaagcacggcagaagcagcaaggacaaggagaacgccaagagcctggacaagcccgagcagttcctgtacgagctgagcctgatccccaacttcagcgagagagtgttctgcatcctgttccagagcaccttcagcgagagcatctgcagcatcagaagaaagctggagctgctgcagaagctgtgcgagaccctgaagaacggccccggcgtgatgcaggtgctgggcctggtgctggccttcggcaactacatgaacggcggcaacaagaccagaggccaggccgacggcttcggcctggacatcctgcccaagctgaaggacgtgaagagcagcgacaacagcagaagcctgctgagctacatcgtgagctactacctgagaaacttcgacgaggacgccggcaaggagcagtgcctgttccccctgcccgagccccaggacctgttccaggccagccagatgaagttcgaggacttccagaaggacctgagaaagctgaagaaggacctgaaggcctgcgaggtggaggccggcaaggtgtaccaggtgagcagcaaggagcacatgcagcccttcaaggagaacatggagcagttcatcatccaggccaagatcgaccaggaggccgaggagaacagcctgaccgagacccacaagtgcttcctggagaccaccgcctacttcttcatgaagcccaagctgggcgagaaggaggtgagccccaacgccttcttcagcatctggcacgagttcagcagcgacttcaaggacttctggaagaaggagaacaagctgctgctgcaggagagagtgaaggaggccgaggaggtgtgcagacagaagaagggcaagagcctgtacaagatcaagcccagacacgacagcggcatcaaggccaagatcagcatgaagacctag

SEQ ID NO: 9933 - DNA, 3048 bp, Artificial Sequence
  Description of Artificial Sequence: Synthetic coding sequence
atgaccgtgagccagaagggcggcccccagcccacccccagccccgccggccccggcacccagctgggccccatcaccggcgagatggacgaggccgacagcgccttcctgaagttcaagcagaccgccgacgacagcctgagcctgaccagccccaacaccgagagcatcttcgtggaggacccctacaccgccagcctgagaagcgagatcgagagcgacggccacgagttcgaggccgagagctggagcctggccgtggacgccgcctacgccaagaagcagaagagagaggtggtgaagagacaggacgtgctgtacgagctgatgcagaccgaggtgcaccacgtgagaaccctgaagatcatgctgaaggtgtacagcagagccctgcaggaggagctgcagttcagcagcaaggccatcggcagactgttcccctgcgccgacgacctgctggagacccacagccacttcctggccagactgaaggagagaagacaggagagcctggaggagggcagcgacagaaactacgtgatccagaagatcggcgacctgctggtgcagcagttcagcggcgagaacggcgagagaatgaaggagaagtacggcgtgttctgcagcggccacaacgaggccgtgagccactacaagctgctgctgcagcagaacaagaagttccagaacctgatcaagaagatcggcaacttcagcatcgtgagaagactgggcgtgcaggagtgcatcctgctggtgacccagagaatcaccaagtaccccgtgctggtggagagaatcatccagaacaccgaggccggcaccgaggactacgaggacctgacccaggccctgaacctgatcaaggacatcatcagccaggtggacgccaaggtgagcgagtgcgagaagggccagagactgagagagatcgccggcaagatggacctgaagagcagcagcaagctgaagaacggcctgaccttcagaaaggaggacatgctgcagagacagctgcacctggagggcatgctgtgctggaagaccaccagcggcagactgaaggacatcctggccatcctgctgaccgacgtgctgctgctgctgcaggagaaggaccagaagtacgtgttcgccagcgtggacagcaagccccccgtgatcagcctgcagaagctgatcgtgagagaggtggccaacgaggagaaggccatgttcctgatcagcgccagcctgcagggccccgagatgtacgagatctacaccagcagcaaggaggacagaaacgcctggatggcccacatccagagagccgtggagagctgccccgacgaggaggagggccccttcagcctgcccgaggaggagagaaaggtggtggaggccagagccaccagactgagagacttccaggagagactgagcatgaaggaccagctgatcgcccagagcctgctggagaagcagcagatctacctggagatggccgagatgggcggcctggaggacctgccccagcccagaggcctgttcagaggcggcgaccccagcgagaccctgcagggcgagctgatcctgaagagcgccatgagcgagatcgagggcatccagagcctgatctgcagacagctgggcagcgccaacggccaggccgaggacggcggcagcagcaccggcccccccagaagagccgagaccttcgccggctacgactgcaccaacagccccaccaagaacggcagcttcaagaagaaggtgagcagcaccgaccccagacccagagactggagaggcccccccaacagccccgacctgaagctgagcgacagcgacatccccggcagcagcgaggagagcccccaggtggtggaggcccccggcaccgagagcgaccccagactgcccaccgtgctggagagcgagctggtgcagagaatccagaccctgagccagctgctgctgaacctgcaggccgtgatcgcccaccaggacagctacgtggagacccagagagccgccatccaggagagagagaagcagttcagactgcagagcaccagaggcaacctgctgctggagcaggagagacagagaaacttcgagaagcagagagaggagagagccgccctggagaagctgcagagccagctgagacacgagcagcagagatgggagagagagagacagtggcagcaccaggagctggagagagccggcgccagactgcaggagagagagggcgaggccagacagctgagagagagactggagcaggagagagccgagctggagagacagagacaggcctaccagcacgacctggagagactgagagaggcccagagagccgtggagagagagagagagagactggagctgctgagaagactgaagaagcagaacaccgcccccggcgccctgccccccgacaccctggccgaggcccagccccccagccacccccccagcttcaacggcgagggcctggagggccccagagtgagcatgctgcccagcggcgtgggccccgagtacgccgagagacccgaggtggccagaagagacagcgcccccaccgagaacagactggccaagagcgacgtgcccatccagctgctgagcgccaccaaccagttccagagacaggccgccgtgcagcagcagatccccaccaagctggccgccagcaccaagggcggcaaggacaagggcggcaagagcagaggcagccagagatgggagagcagcgccagcttcgacctgaagcagcagctgctgctgaacaagctgatgggcaaggacgagagcaccagcagaaacagaagaagcctgagccccatcctgcccggcagacacagccccgcccccccccccgaccccggcttccccgcccccagccccccccccgccgacagccccagcgagggcttcagcctgaaggccggcggcaccgccctgctgcccggcccccccgcccccagccccctgcccgccacccccctgagcgccaaggaggacgccagcaaggaggacgtgatcttcttctag

SEQ ID NO: 9934 - DNA, 2544 bp, Artificial Sequence
  Description of Artificial Sequence: Synthetic coding sequence
atggaggccctgggccccggcggcgacagagccagccccgccagcagcaccagcagcctggacctgtggcacctgagcatgagagccgacagcgcctacagcagcttcagcgccgccagcggcggccccgagcccagaacccagagccccggcaccgacctgctgccctacctggactgggactacgtgagagtggtgtggggcggccccggccccgccccccccgacgccgccctgtgcaccagccccagacccagacccgccgtggccgccagaagcggcccccagcccaccgaggtgcccggcacccccggccccctgaacagacaggccacccccctgctgtacgccctggccgccgaggccgaggccgccgcccaggccgccgagccccccagcccccccgccagcagagccgcctacagacagagactgcagggcgcccagagaagagtgctgagagagaccagcttccagagaaaggagctgagaatgagcctgcccgccagactgagacccaccgtgcccgccagaccccccgccacccaccccagaagcgccagcctgagccaccccggcggcgagggcgagcccgccagaagcagagcccccgcccccggcaccgccggcagaggccccctggccaaccagcagagaaagtggtgcttcagcgagcccggcaagctggacagagtgggcagaggcggcggccccgccagagagtgcctgggcgaggcctgcagcagcagcggcctgcccggccccgagcccctggagttccagcaccccgccctggccaagttcgaggaccacgaggtgggctggctgcccgagacccagccccagggcagcatgaacctggacagcggcagcctgaagctgggcgacgccttcagacccgccagcagaagcagaagcgccagcggcgaggtgctgggcagctggggcggcagcggcggcaccatccccatcgtgcaggccgtgccccagggcgccgagacccccagacccctgttccagaccaagctgagcagattcctgccccagaaggaggccgccgtgatgtaccccgccgagctgccccagagcagccccgccgacagcgagcagagagtgagcgagacctgcatcgtgcccgcctggctgcccagcctgcccgacgaggtgttcctggaggaggcccccctggtgagaatgagaagcccccccgacccccacgccagccagggcccccccgccagcgtgcacgccagcgaccagccctacggcaccggcctgggccagagaaccggccaggtgaccgtgcccaccgagtaccccctgcacgagtgccccggcaccgccggcgccgacgactgctggcagggcgtgaacggcagcgtgggcatcagcagacccaccagccacacccccaccggcaccgccaacgacaacatccccaccatcgaccccaccggcctgaccaccaacccccccaccgccgccgagagcgacctgctgaagcccgtgcccgccgacgccctgggcctgagcggcaacgacacccccggccccagccacaacaccgccctggccagaggcaccggccagcccggcagcagacccacctggcccagccagtgcctggaggagctggtgcaggagctggccagactggaccccagcctgtgcgaccccctggccagccagcccagccccgagccccccctgggcctgctggacggcctgatccccctggccgaggtgagagccgccatgagacccgcctgcggcgaggccggcgaggaggccgccagcaccttcgagcccggcagctaccagttcagcttcacccagctgctgcccgcccccagagaggagaccagactggagaaccccgccacccaccccgtgctggaccagccctgcggccagggcctgcccgcccccaacaacagcatccagggcaagaaggtggagctggccgccagactgcagaagatgctgcaggacctgcacaccgagcaggagagactgcagggcgaggcccaggcctgggccagaagacaggccgccctggaggccgccgtgagacaggcctgcgccccccaggagctggagagattcagcagattcatggccgacctggagagagtgctgggcctgctgctgctgctgggcagcagactggccagagtgagaagagccctggccagagccgccagcgacagcgaccccgacgagcagagactgagactgctgcagagacaggaggaggacgccaaggagctgaaggagcacgtggccagaagagagagagccgtgagagaggtgctggtgagagccctgcccgtggaggagctgagagtgtactgcgccctgctggccggcaaggccgccgtgctggcccagcagagaaacctggacgagagaatcagactgctgcaggaccagctggacgccatcagagacgacctgggccaccacgcccccagccccagccccgccagaccccccggcacctgcccccccgtgcagccccccttccccctgctgctgacctag

SEQ ID NO: 9935 - DNA, 2502 bp, Artificial Sequence
  Description of Artificial Sequence: Synthetic coding sequence
atgaagttcaccaacaccaaggtgcagatgatgcagaacgtgcacctggcccccgagaccgacgaggacgacctgtacagcggctacaacgactacaaccccatctacgacatcgaggagctggagaacgacgccgccttccagcaggccgtgagaaccagccacggcagaagaccccccatcaccgccaagatcagcagcaccgccgtgaccagacccatcgccaccggctacggcagcaagaccagcctggccagcagcatcggcagacccatgaccggcgccatccaggacggcgtgaccagacccatgaccgccgtgagagccgccggcttcaccaaggccgccctgagaggcagcgccttcgaccccctgagccagagcagaggccccgccagccccctggaggccaagaagaaggacagccccgaggagaagatcaagcagctggagaaggaggtgaacgagctggtggaggagagctgcatcgccaacagctgcggcgacctgaagctggccctggagaaggccaaggacgccggcagaaaggagagagtgctggtgagacagagagagcaggtgaccacccccgagaacatcaacctggacctgacctacagcgtgctgttcaacctggccagccagtacagcgtgaacgagatgtacgccgaggccctgaacacctaccaggtgatcgtgaagaacaagatgttcagcaacgccggcatcctgaagatgaacatgggcaacatctacctgaagcagagaaactacagcaaggccatcaagttctacagaatggccctggaccaggtgcccagcgtgaacaagcagatgagaatcaagatcatgcagaacatcggcgtgaccttcatccaggccggccagtacagcgacgccatcaacagctacgagcacatcatgagcatggcccccaacctgaaggccggctacaacctgaccatctgctacttcgccatcggcgacagagagaagatgaagaaggccttccagaagctgatcaccgtgcccctggagatcgacgaggacaagtacatcagccccagcgacgacccccacaccaacctggtgaccgaggccatcaagaacgaccacctgagacagatggagagagagagaaaggccatggccgagaagtacatcatgaccagcgccaagctgatcgcccccgtgatcgagaccagcttcgccgccggctacgactggtgcgtggaggtggtgaaggccagccagtacgtggagctggccaacgacctggagatcaacaaggccgtgacctacctgagacagaaggactacaaccaggccgtggagatcctgaaggtgctggagaagaaggacagcagagtgaagagcgccgccgccaccaacctgagcgccctgtactacatgggcaaggacttcgcccaggccagcagctacgccgacatcgccgtgaacagcgacagatacaaccccgccgccctgaccaacaagggcaacaccgtgttcgccaacggcgactacgagaaggccgccgagttctacaaggaggccctgagaaacgacagcagctgcaccgaggccctgtacaacatcggcctgacctacgagaagctgaacagactggacgaggccctggactgcttcctgaagctgcacgccatcctgagaaacagcgccgaggtgctgtaccagatcgccaacatctacgagctgatggagaaccccagccaggccatcgagtggctgatgcaggtggtgagcgtgatccccaccgacccccaggtgctgagcaagctgggcgagctgtacgacagagagggcgacaagagccaggccttccagtactactacgagagctacagatacttcccctgcaacatcgaggtgatcgagtggctgggcgcctactacatcgacacccagttctgggagaaggccatccagtacttcgagagagccagcctgatccagcccacccaggtgaagtggcagctgatggtggccagctgcttcagaagaagcggcaactaccagaaggccctggacacctacaaggacacccacagaaagttccccgagaacgtggagtgcctgagattcctggtgagactgtgcaccgacctgggcctgaaggacgcccaggagtacgccagaaagctgaagagactggagaagatgaaggagatcagagagcagagaatcaagagcggcagagacggcagcggcggcagcagaggcaagagagagggcagcgccagcggcgacagcggccagaactacagcgccagcagcaagggcgagagactgagcgccagactgagagccctgcccggcaccaacgagccctacgagagcagcagcaacaaggagatcgacgccagctacgtggaccccctgggcccccagatcgagagacccaagaccgccgccaagaagagaatcgacgaggacgacttcgccgacgaggagctgggcgacgacctgctgcccgagtag

SEQ ID NO: 9936 - DNA, 918 bp, Artificial Sequence; identical to SEQ ID NO: 9729
  Description of Artificial Sequence: Synthetic coding sequence

SEQ ID NO: 9937 - DNA, 1119 bp, Artificial Sequence
  Description of Artificial Sequence: Synthetic coding sequence
atggacgtgctgagccccctgagcttcatcaaggtgagccacgtgagaatgcagggcatcctgctgctggtgttcgccaagtaccagcacctgccctacatccagatcctgagcaccaagagcacccccaccggcctgttcggctactggggcaacaagggcggcgtgaacatctgcctgaagctgtacggctactacgtgagcatcatcaactgccacctgcccccccacatcagcaacaactaccagagactggagcacttcgacagaatcctggagatgcagaactgcgagggcagagacatccccaacatcctggaccacgacctgatcatctggttcggcgacatgaacttcagaatcgaggacttcggcctgcacttcgtgagagagagcatcaagaacagatgctacggcggcctgtgggagaaggaccagctgagcatcgccaagaagcacgaccccctgctgagagagttccaggagggcagactgctgttcccccccacctacaagttcgacagaaacagcaacgactacgacaccagcgagaagaagagaaagcccgcctggaccgacagaatcctgtggagactgaagagacagccctgcgccggccccgacacccccatcccccccgccagccacttcagcctgagcctgagaggctacagcagccacatgacctacggcatcagcgaccacaagcccgtgagcggcaccttcgacctggagctgaagcccctggtgagcgcccccctgatcgtgctgatgcccgaggacctgtggaccgtggagaacgacatgatggtgagctacagcagcaccagcgacttccccagcagcccctgggactggatcggcctgtacaaggtgggcctgagagacgtgaacgactacgtgagctacgcctgggtgggcgacagcaaggtgagctgcagcgacaacctgaaccaggtgtacatcgacatcagcaacatccccaccaccgaggacgagttcctgctgtgctactacagcaacagcctgagaagcgtggtgggcatcagcagacccttccagatcccccccggcagcctgagagaggaccccctgggcgaggcccagccccagatctag

SEQ ID NO: 9938 - DNA, 1692 bp, Artificial Sequence
  Description of Artificial Sequence: Synthetic coding sequence
atgagactggacctggccagcctgatgagcgcccccaagagcctgggcagcgccttcaagagctggagactggacaaggcccccagcccccagcacaccttccccagcaccagcatccccggcatggccttcgccctgctggccagcgtgccccccgtgttcggcctgtacaccagcttcttccccgtgctgatctacagcctgctgggcaccggcagacacctgagcaccggcaccttcgccatcctgagcctgatgaccggcagcgccgtggagagactggtgcccgagcccctggtgggcaacctgagcggcatcgagaaggagcagctggacgcccagagagtgggcgtggccgccgccgtggccttcggcagcggcgccctgatgctgggcatgttcgtgctgcagctgggcgtgctgagcaccttcctgagcgagcccgtggtgaaggccctgaccagcggcgccgccctgcacgtgctgctgagccagctgcccagcctgctgggcctgagcctgcccagacagatcggctgcttcagcctgttcaagaccctggccagcctgctgaccgccctgcccagaagcagccccgccgagctgaccatcagcgccctgagcctggccctgctggtgcccgtgaaggagctgaacgtgagattcagagacagactgcccacccccatccccggcgaggtggtgctggtgctgctggccagcgtgctgtgcttcaccagcagcgtggacaccagataccaggtgcagatcgtgggcctgctgcccggcggcttcccccagcccctgctgcccaacctggccgagctgcccagaatcctggccgacagcctgcccatcgccctggtgagcttcgccgtgagcgccagcctggccagcatccacgccgacaagtacagctacaccatcgacagcaaccaggagttcctggcccacggcgccagcaacctgatcagcagcctgttcagctgcttccccaacagcgccaccctggccaccaccaacctgctggtggacgccggcggcaagacccagctggccggcctgttcagctgcaccgtggtgctgagcgtgctgctgtggctgggccccttcttctactacctgcccaaggccgtgctggcctgcatcaacatcagcagcatgagacaggtgttctgccagatgcaggagctgccccagctgtggcacatcagcagagtggacttcctgctgcaggtgcccggcctgtgcatcctgagctaccccacccccctgtacttcggcaccagaggccagttcagatgcaacctggagtggcacctgggcctgggcgagggcgagaaggagaccagcaagcccgacggccccatggtggccgtggccgagcccgtgagagtggtggtgctggacttcagcggcgtgaccttcgccgacgccgccggcgccagagaggtggtgcaggtgagagagagactggccagcagatgcagagacgccagaatcagactgctgctggcccagtgcaacgccctggtgcagggcaccctgaccagagtgggcctgctggacagagtgacccccgaccagctgttcgtgagcgtgcaggacgccgccgcctacgccctgggcagcctgctgagaggcagcagcaccagaagcggcagccaggaggccctgggctgcggcaagtag

SEQ ID NO: 9939 - DNA, 2892 bp, Artificial Sequence
  Description of Artificial Sequence: Synthetic coding sequence
atggccgagagaggcggcgccggcggcggccccggcggcgccggcggcggcagcggccagagaggcagcggcgtggcccagagcccccagcagccccccccccagcagcagcagcagcagcccccccagcagcccaccccccccaagctggcccaggccaccagcagcagcagcagcaccagcgccgccgccgccagcagcagcagcagcagcaccagcaccagcatggccgtggccgtggccagcggcagcgccccccccggcggccccggccccggcagaacccccgcccccgtgcagatgaacctgtacgccacctgggaggtggacagaagcagcagcagctgcgtgcccagactgttcagcctgaccctgaagaagctggtgatgctgaaggagatggacaaggacctgaacagcgtggtgatcgccgtgaagctgcagggcagcaagagaatcctgagaagcaacgagatcgtgctgcccgccagcggcctggtggagaccgagctgcagctgaccttcagcctgcagtacccccacttcctgaagagagacgccaacaagctgcagatcatgctgcagagaagaaagagatacaagaacagaaccatcctgggctacaagaccctggccgtgggcctgatcaacatggccgaggtgatgcagcaccccaacgagggcgccctggtgctgggcctgcacagcaacgtgaaggacgtgagcgtgcccgtggccgagatcaagatctacagcctgagcagccagcccatcgaccacgagggcatcaagagcaagctgagcgacagaagccccgacatcgacaactacagcgaggaggaggaggagagcttcagcagcgagcaggagggcagcgacgaccccctgcacggccaggacctgttctacgaggacgaggacctgagaaaggtgaagaagaccagaagaaagctgaccagcaccagcgccatcaccagacagcccaacatcaagcagaagttcgtggccctgctgaagagattcaaggtgagcgacgaggtgggcttcggcctggagcacgtgagcagagagcagatcagagaggtggaggaggacctggacgagctgtacgacagcctggagatgtacaaccccagcgacagcggccccgagatggaggagaccgagagcatcctgagcacccccaagcccaagctgaagcccttcttcgagggcatgagccagagcagcagccagaccgagatcggcagcctgaacagcaagggcagcctgggcaaggacaccaccagccccatggagctggccgccctggagaagatcaagagcacctggatcaagaaccaggacgacagcctgaccgagaccgacaccctggagatcaccgaccaggacatgttcggcgacgccagcaccagcctggtggtgcccgagaaggtgaagacccccatgaagagcagcaagaccgacctgcagggcagcgccagccccagcaaggtggagggcgtgcacacccccagacagaagagaagcacccccctgaaggagagacagctgagcaagcccctgagcgagagaaccaacagcagcgacagcgagagaagccccgacctgggccacagcacccagatccccagaaaggtggtgtacgaccagctgaaccagatcctggtgagcgacgccgccctgcccgagaacgtgatcctggtgaacaccaccgactggcagggccagtacgtggccgagctgctgcaggaccagagaaagcccgtggtgtgcacctgcagcaccgtggaggtgcaggccgtgctgagcgccctgctgaccagaatccagagatactgcaactgcaacagcagcatgcccagacccgtgaaggtggccgccgtgggcggccagagctacctgagcagcatcctgagattcttcgtgaagagcctggccaacaagaccagcgactggctgggctacatgagattcctgatcatccccctgggcagccaccccgtggccaagtacctgggcagcgtggacagcaagtacagcagcagcttcctggacagcggctggagagacctgttcagcagaagcgagccccccgtgagcgagcagctggacgtggccggcagagtgatgcagtacgtgaacggcgccgccaccacccaccagctgcccgtggccgaggccatgctgacctgcagacacaagttccccgacgaggacagctaccagaagttcatccccttcatcggcgtggtgaaggtgggcctggtggaggacagccccagcaccgccggcgacggcgacgacagccccgtggtgagcctgaccgtgcccagcaccagcccccccagcagcagcggcctgagcagagacgccaccgccaccccccccagcagccccagcatgagcagcgccctggccatcgtgggcagccccaacagcccctacggcgacgtgatcggcctgcaggtggactactggctgggccaccccggcgagagaagaagagagggcgacaagagagacgccagcagcaagaacaccctgaagagcgtgttcagaagcgtgcaggtgagcagactgccccacagcggcgaggcccagctgagcggcaccatggccatgaccgtggtgaccaaggagaagaacaagaaggtgcccaccatcttcctgagcaagaagcccagagagaaggaggtggacagcaagagccaggtgatcgagggcatcagcagactgatctgcagcgccaagcagcagcagaccatgctgagagtgagcatcgacggcgtggagtggagcgacatcaagttcttccagctggccgcccagtggcccacccacgtgaagcacttccccgtgggcctgttcagcggcagcaaggccacctag

SEQ ID NO: 9940 - DNA, 546 bp, Artificial Sequence
  Description of Artificial Sequence: Synthetic coding sequence
atggaggagatccccgcccaggaggccgccggcagccccagagtgcagttccagagcctggagacccagagcgagtgcctgagccccgagccccagttcgtgcaggacaccgacatggagcagggcctgaccggcgccccccccgtgccccaggtgcccgccctgcccagagagggcagccccggcgaccaggccgccgccctgctgaccgccagataccaggagttcgtgaccttcgaggacgtggccgtgcacctgaccagagaggagtggggctacctggaccccgtgcagagagacctgtacagagaggtgatgctggagaactacggcaacgtggtgagcctgggcatcctgctgagactgcccaccaccagaatccacagcgtgaacagctgccccgccctgagccacacccaggccagcgccttcagcggcgagaccctggccgtgctgaccgccggcatcagcaagagatggcccaagtacagactgcccatcgacatcgccagaccctgcagcgagacccccttccccagactgtag

SEQ ID NO: 9941 - DNA, 1410 bp, Artificial Sequence
  Description of Artificial Sequence: Synthetic coding sequence
atggtgctggagggcaaccccgaggtgggcagccccagaaccagcgacctgcagcacagaggcaacaagggcagctgcgtgctgagcagccccggcgaggacgcccagcccggcgaggagcccatcaagtacggcgagctgatcgtgctgggctgctgcgaggagggcggcgaggagaccgaggcccagagaggcgaggtgaccggccccagagcccacagctgctacaacggctgcctggccagcggcgacaagggcagaagaagaagcagactggccctgagcagaagaagccacgccaacggcgtgaagcccgacgtgatgcaccacatcagcacccccctggtgagcaaggccctgagcaacagaggccagcacagcatcagctacaccctgagcagaagccacagcgtgatcgtggagtacacccacgacagcgacaccgacatgttccagatcggcagaagcaccgagaacatgatcgacttcgtggtgaccgacaccagccccggcggcggcgccgccgagggccccagcgcccagagcaccatcagcagatacgcctgcagaatcctgtgcgacagaagacccccctacaccgccagaatctacgccgccggcttcgacgccagcagcaacatcttcctgggcgagagagccgccaagtggagaacccccgacggcctgatggacggcctgaccaccaacggcgtgctggtgatgcaccccgccggcggcttcagcgaggacagcgcccccggcgtgtggagagagatcagcgtgtgcggcaacgtgtacaccctgagagacagcagaagcgcccagcagagaggcaagctggtggagaacgagagcaacgtgctgcaggacggcagcctgatcgacctgtgcggcgccaccctgctgtggagaacccccgccggcctgctgagagcccccaccctgaagcagctggaggcccagagacaggaggccaacgccgccagaccccagtgccccgtgggcctgagcaccctggccttccccagccccgccagaggcagaaccgcccccgacaagcagcagccctgggtgtacgtgagatgcggccacgtgcacggctaccacggctggggctgcagaagagagagaggcccccaggagagagagtgccccctgtgcagactggtgggcccctacgtgcccctgtggctgggccaggaggccggcctgtgcctggaccccggcccccccagccacgccttcgccccctgcggccacgtgtgcagcgagaagaccgccagatactgggcccagacccccctgccccacggcacccacgccttccacgccgcctgccccttctgcggcgcctggctgaccggcgagcacggctgcgtgagactgatcttccagggccccctggactag

SEQ ID NO: 9942 - DNA, 3312 bp, Artificial Sequence
  Description of Artificial Sequence: Synthetic coding sequence
atggccggcgccagcgtgaaggtggccgtgagagtgagacccttcaacgccagagagaccagccaggacgccaagtgcgtggtgagcatgcagggcaacaccaccagcatcatcaaccccaagcagagcaaggacgcccccaagagcttcaccttcgactacagctactggagccacaccagcaccgaggacccccagttcgccagccagcagcaggtgtacagagacatcggcgaggagatgctgctgcacgccttcgagggctacaacgtgtgcatcttcgcctacggccagaccggcgccggcaagagctacaccatgatgggcagacaggagcccggccagcagggcatcgtgccccagctgtgcgaggacctgttcagcagagtgagcgagaaccagagcgcccagctgagctacagcgtggaggtgagctacatggagatctactgcgagagagtgagagacctgctgaaccccaagagcagaggcagcctgagagtgagagagcaccccatcctgggcccctacgtgcaggacctgagcaagctggccgtgaccagctacgccgacatcgccgacctgatggactgcggcaacaaggccagaaccgtggccgccaccaacatgaacgagaccagcagcagaagccacgccgtgttcaccatcgtgttcacccagagatgccacgaccagctgaccggcctggacagcgagaaggtgagcaagatcagcctggtggacctggccggcagcgagagagccgacagcagcggcgccagaggcatgagactgaaggagggcgccaacatcaacaagagcctgaccaccctgggcaaggtgatcagcgccctggccgacatgcagagcaagaagagaaagagcgacttcatcccctacagagacagcgtgctgacctggctgctgaaggagaacctgggcggcaacagcagaaccgccatgatcgccgccctgagccccgccgacatcaactacgaggagaccctgagcaccctgagatacgccgacagaaccaagcagatcagatgcaacgccatcatcaacgaggaccccaacgccagactgatcagagagctgcaggaggaggtggccagactgagagagctgctgatggcccagggcctgagcgccagcgccctggagggcctgaagaccgaggagggcagcgtgagaggcgccctgcccgccgtgagcagcccccccgcccccgtgagccccagcagccccaccacccacaacggcgagctggagcccagcttcagccccaacaccgagagccagatcggccccgaggaggccatggagagactgcaggagaccgagaagatcatcgccgagctgaacgagacctgggaggagaagctgagaaagaccgaggccctgagaatggagagagaggccctgctggccgagatgggcgtggccgtgagagaggacggcggcaccgtgggcgtgttcagccccaagaagaccccccacctggtgaacctgaacgaggaccccctgatgagcgagtgcctgctgtaccacatcaaggacggcgtgaccagagtgggccaggtggacatggacatcaagctgaccggccagttcatcagagagcagcactgcctgttcagaagcatcccccagcccgacggcgaggtggtggtgaccctggagccctgcgagggcgccgagacctacgtgaacggcaagctggtgaccgagcccctggtgctgaagagcggcaacagaatcgtgatgggcaagaaccacgtgttcagattcaaccaccccgagcaggccagactggagagagagagaggcgtgccccccccccccggcccccccagcgagcccgtggactggaacttcgcccagaaggagctgctggagcagcagggcatcgacatcaagctggagatggagaagagactgcaggacctggagaaccagtacagaaaggagaaggaggaggccgacctgctgctggagcagcagagactgtacgccgacagcgacagcggcgacgacagcgacaagagaagctgcgaggagagctggagactgatcagcagcctgagagagcagctgccccccaccaccgtgcagaccatcgtgaagagatgcggcctgcccagcagcggcaagagaagagcccccagaagagtgtaccagatcccccagagaagaagactgcagggcaaggaccccagatgggccaccatggccgacctgaagatgcaggccgtgaaggagatctgctacgaggtggccctggccgacttcagacacggcagagccgagatcgaggccctggccgccctgaagatgagagagctgtgcagaacctacggcaagcccgacggccccggcgacgcctggagagccgtggccagagacgtgtgggacaccgtgggcgaggaggagggcggcggcgccggcagcggcggcggcagcgaggagggcgccagaggcgccgaggtggaggacctgagagcccacatcgacaagctgaccggcatcctgcaggaggtgaagctgcagaacagcagcaaggacagagagctgcaggccctgagagacagaatgctgagaatggagagagtgatccccctggcccaggaccacgaggacgagaacgaggagggcggcgaggtgccctgggccccccccgagggcagcgaggccgccgaggaggccgcccccagcgacagaatgcccagcgccagaccccccagcccccccctgagcagctgggagagagtgagcagactgatggaggaggaccccgccttcagaagaggcagactgagatggctgaagcaggagcagctgagactgcagggcctgcagggcagcggcggcagaggcggcggcctgagaagaccccccgccagattcgtgcccccccacgactgcaagctgagattccccttcaagagcaacccccagcacagagagagctggcccggcatgggcagcggcgaggcccccacccccctgcagccccccgaggaggtgaccccccaccccgccacccccgccagaagaccccccagccccagaagaagccaccaccccagaagaaacagcctggacggcggcggcagaagcagaggcgccggcagcgcccagcccgagccccagcacttccagcccaagaagcacaacagctacccccagcccccccagccctaccccgcccagagaccccccggccccagataccccccctacaccaccccccccagaatgagaagacagagaagcgcccccgacctgaaggagagcggcgccgccgtgtag

SEQ ID NO: 9943 - DNA, 1260 bp, Artificial Sequence
  Description of Artificial Sequence: Synthetic coding sequence
atggccgagcccgtgggcaagagaggcagatggagcggcggcagcggcgccggcagaggcggcagaggcggctggggcggcagaggcagaagacccagagcccagagaagccccagcagaggcaccctggacgtggtgagcgtggacctggtgaccgacagcgacgaggagatcctggaggtggccaccgccagaggcgccgccgacgaggtggaggtggagccccccgagccccccggccccgtggccagcagagacaacagcaacagcgacagcgagggcgaggacagaagacccgccggcccccccagagagcccgtgagaagaagaagaagactggtgctggaccccggcgaggcccccctggtgcccgtgtacagcggcaaggtgaagagcagcctgagactgatccccgacgacctgagcctgctgaagctgtacccccccggcgacgaggaggaggccgagctggccgacagcagcggcctgtaccacgagggcagccccagccccggcagcccctggaagaccaagctgagaaccaaggacaaggaggagaagaagaagaccgagttcctggacctggacaacagccccctgagcccccccagccccagaaccaagagcagaacccacaccagagccctgaagaagctgagcgaggtgaacaagagactgcaggacctgagaagctgcctgagccccaagcccccccagggccaggagcagcagggccaggaggacgaggtggtgctggtggagggccccaccctgcccgagacccccagactgttccccctgaagatcagatgcagagccgacctggtgagactgcccctgagaatgagcgagcccctgcagagcgtggtggaccacatggccacccacctgggcgtgagccccagcagaatcctgctgctgttcggcgagaccgagctgagccccaccgccacccccagaaccctgaagctgggcgtggccgacatcatcgactgcgtggtgctgaccagcagccccgaggccaccgagaccagccagcagctgcagctgagagtgcagggcaaggagaagcaccagaccctggaggtgagcctgagcagagacagccccctgaagaccctgatgagccactacgaggaggccatgggcctgagcggcagaaagctgagcttcttcttcgacggcaccaagctgagcggcagagagctgcccgccgacctgggcatggagagcggcgacctgatcgaggtgtggggctag

SEQ ID NO: 9944 - DNA, 384 bp, Artificial Sequence
  Description of Artificial Sequence: Synthetic coding sequence
atgagacccctggacatcgtggagctggccgagcccgaggaggtggaggtgctggagcccgaggaggacttcgagcagttcctgctgcccgtgatcaacgagatgagagaggacatcgccagcctgaccagagagcacggcagagcctacctgagaaacagaagcaagctgtgggagatggacaacatgctgatccagatcaagacccaggtggaggccagcgaggagagcgccctgaaccacctgcagaaccccggcgacgccgccgagggcagagccgccaagagatgcgagaaggccgaggagaaggccaaggagatcgccaagatggccgagatgctggtggagctggtgagaagaatcgagaagagcgagagcagctag

SEQ ID NO: 9945 - DNA, 1263 bp, Artificial Sequence
  Description of Artificial Sequence: Synthetic coding sequence
atgcccctgcaggtgagcgactacagctggcagcagaccaagaccgccgtgttcctgagcctgcccctgaagggcgtgtgcgtgagagacaccgacgtgttctgcaccgagaactacctgaaggtgaacttcccccccttcctgttcgaggccttcctgtacgcccccatcgacgacgagagcagcaaggccaagatcggcaacgacaccatcgtgttcaccctgtacaagaaggaggccgccatgtgggagaccctgagcgtgaccggcgtggacaaggagatgatgcagagaatcagagagaagagcatcctgcaggcccaggagagagccaaggaggccaccgaggccaaggccgccgccaagagagaggaccagaagtacgccctgagcgtgatgatgaagatcgaggaggaggagagaaagaagatcgaggacatgaaggagaacgagagaatcaaggccaccaaggccctggaggcctggaaggagtaccagagaaaggccgaggagcagaagaagatccagagagaggagaagctgtgccagaaggagaagcagatcaaggaggagagaaagaagatcaagtacaagagcctgaccagaaacctggccagcagaaacctggcccccaagggcagaaacagcgagaacatcttcaccgagaagctgaaggaggacagcatccccgcccccagaagcgtgggcagcatcaagatcaacttcacccccagagtgttccccaccgccctgagagagagccaggtggccgaggaggaggagtggctgcacaagcaggccgaggccagaagagccatgaacaccgacatcgccgagctgtgcgacctgaaggaggaggagaagaaccccgagtggctgaaggacaagggcaacaagctgttcgccaccgagaactacctggccgccatcaacgcctacaacctggccatcagactgaacaacaagatgcccctgctgtacctgaacagagccgcctgccacctgaagctgaagaacctgcacaaggccatcgaggacagcagcaaggccctggagctgctgatgccccccgtgaccgacaacgccaacgccagaatgaaggcccacgtgagaagaggcaccgccttctgccagctggagctgtacgtggagggcctgcaggactacgaggccgccctgaagatcgaccccagcaacaagatcgtgcagatcgacgccgagaagatcagaaacgtgatccagggcaccgagctgaagagctag

SEQ ID NO: 9946 - DNA, 348 bp, Artificial Sequence
  Description of Artificial Sequence: Synthetic coding sequence
atgagatacgtggccagctacctgctggccgccctgggcggcaacagcagccccagcgccaaggacatcaagaagatcctggacagcgtgggcatcgaggccgacgacgacagactgaacaaggtgatcagcgagctgaacggcaagaacatcgaggacgtgatcgcccagggcatcggcaagctggccagcgtgcccgccggcggcgccgtggccgtgagcgccgcccccggcagcgccgcccccgccgccggcagcgcccccgccgccgccgaggagaagaaggacgagaagaaggaggagagcgaggagagcgacgacgacatgggcttcggcctgttcgactag

SEQ ID NO: 9947 - DNA, 1233 bp, Artificial Sequence
  Description of Artificial Sequence: Synthetic coding sequence
ctgaacagagcctgcttctgcgtgaccggcgtgcccgagctggaggtgatctgcggcctgcagcaggccgagtggcccagactgggcctgagccacctgggcgccgtgggcggcggctggggcggcctgcccaccagcacctgggtgagcctgcacacccaggaggtggacctggccagcgaggtggccctggaggtggtgagaaccgccgagcccggcgtgtggctggaggcccaggcccccgtggccctggtggcccagcccgagcccctgcccgccaccgccggcgtgaagagagagagcgtgggcatggaggtggccgtgctgaccgacgaccccctgcccgtggtggaccagcagcaggtgctggccagactgcagctgctggagcagcaggtggtgggcggcgagcaggccaagaacaaggacctgaaggagaagcacaagagaagaaagagatacgccgacgagagaagaaagcagctggtggccgccctgcagaacagcgacgaggacagcggcgactgggtgctgctgaacgtgtacgacagcatccaggaggaggtgagagccaagagcaagctgctggagaagatgcagagaaagctgagagccgccgaggtggagatcaaggacctgcagagcgagttccagctggagaagatcgactacctggccaccatcagaagacaggagagagacagcatgctgctgcagcagctgctggagcaggtgcagcccctgatcagaagagactgcaactacagcaacctggagaagatcctgagagagagctgctgggacgaggacaacggcttctggaagatcccccaccccgtgatcaccaagaccagcctgcccgtggccgtgagcaccggcccccagaacaagcccgccagaaagaccagcgccgccgacaacggcgagcccaacatggaggacgacagatacagactgatgctgagcagaagcaacagcgagaacatcgccagcaactacttcagaagcaagagagccagccagatcctgagcaccgacgccagaaagagcctgacccaccacaacagcccccccggcctgagctgccccctgagcaacaacagcgccatcccccccacccaggcccccgagatgccccagcccagacccttcagactggagagcctggacatccccttcaccaaggccaagagaaagaagagcaagagcaacttcggcagcgagcccctgtag

SEQ ID NO: 9948 - DNA, 1353 bp, Artificial Sequence
  Description of Artificial Sequence: Synthetic coding sequence
atgagagagtgcatcagcatccacgtgggccaggccggcgtgcagatcggcaacgcctgctgggagctgtactgcctggagcacggcatccagcccgacggccagatgcccagcgacaagaccatcggcggcggcgacgacagcttcaacaccttcttcagcgagaccggcgccggcaagcacgtgcccagagccgtgttcgtggacctggagcccaccgtggtggacgaggtgagaaccggcacctacagacagctgttccaccccgagcagctgatcaccggcaaggaggacgccgccaacaactacgccagaggccactacaccatcggcaaggagatcgtggacctggtgctggacagaatcagaaagctggccgacctgtgcaccggcctgcagggcttcctgatcttccacagcttcggcggcggcaccggcagcggcttcgccagcctgctgatggagagactgagcgtggactacggcaagaagagcaagctggagttcgccatctaccccgccccccaggtgagcaccgccgtggtggagccctacaacagcatcctgaccacccacaccaccctggagcacagcgactgcgccttcatggtggacaacgaggccatctacgacatctgcagaagaaacctggacatcgagagacccacctacaccaacctgaacagactgatcggccagatcgtgagcagcatcaccgccagcctgagattcgacggcgccctgaacgtggacctgaccgagttccagaccaacctggtgccctaccccagaatccacttccccctggccacctacgcccccgtgatcagcgccgagaaggcctaccacgagcagctgagcgtggccgagatcaccaacgcctgcttcgagcccgccaaccagatggtgaagtgcgaccccagacacggcaagtacatggcctgctgcatgctgtacagaggcgacgtggtgcccaaggacgtgaacgccgccatcgccaccatcaagaccaagagaaccatccagttcgtggactggtgccccaccggcttcaaggtgggcatcaactaccagccccccaccgtggtgcccggcggcgacctggccaaggtgcagagagccgtgtgcatgctgagcaacaccaccgccatcgccgaggcctgggccagactggaccacaagttcgacctgatgtacgccaagagagccttcgtgcactggtacgtgggcgagggcatggaggagggcgagttcagcgaggccagagaggacctggccgccctggagaaggactacgaggaggtgggcgtggacagcgtggaggccgaggccgaggagggcgaggagtactag

SEQ ID NO: 9949 - DNA, 471 bp, Artificial Sequence
  Description of Artificial Sequence: Synthetic coding sequence
atgagcggcggcctgctgaaggccctgagaagcgacagctacgtggagctgagccagtacagagaccagcacttcagaggcgacaacgaggagcaggagaagctgctgaagaagagctgcaccctgtacgtgggcaacctgagcttctacaccaccgaggagcagatctacgagctgttcagcaagagcggcgacatcaagaagatcatcatgggcctggacaagatgaagaagaccgcctgcggcttctgcttcgtggagtactacagcagagccgacgccgagaacgccatgagatacatcaacggcaccagactggacgacagaatcatcagaaccgactgggacgccggcttcaaggagggcagacagtacggcagaggcagaagcggcggccaggtgagagacgagtacagacaggactacgacgccggcagaggcggctacggcaagctggcccagaaccagtag

SEQ ID NO: 9950 - DNA, 996 bp, Artificial Sequence
  Description of Artificial Sequence: Synthetic coding sequence
atgggcggcgagcaggaggaggagagattcgacggcatgctgctggccatggcccagcagcacgagggcggcgtgcaggagctggtgaacaccttcttcagcttcctgagaagaaagaccgacttcttcatcggcggcgaggagggcatggccgagaagctgatcacccagaccttcagccaccacaaccagctggcccagaagaccagaagagagaagagagccagacaggaggccgagagaagagagaaggccgagagagccgccagactggccaaggaggccaagagcgagaccagcggcccccagatcaaggagctgaccgacgaggaggccgagagactgcagctggagatcgaccagaagaaggacgccgagaaccacgaggcccagctgaagaacggcagcctggacagccccggcaagcaggacaccgaggaggacgaggaggaggacgagaaggacaagggcaagctgaagcccaacctgggcaacggcgccgacctgcccaactacagatggacccagaccctgagcgagctggacctggccgtgcccttctgcgtgaacttcagactgaagggcaaggacatggtggtggacatccagagaagacacctgagagtgggcctgaagggccagcccgccatcatcgacggcgagctgtacaacgaggtgaaggtggaggagagcagctggctgatcgaggacggcaaggtggtgaccgtgcacctggagaagatcaacaagatggagtggtggagcagactggtgagcagcgaccccgagatcaacaccaagaagatcaaccccgagaacagcaagctgagcgacctggacagcgagaccagaagcatggtggagaagatgatgtacgaccagagacagaagagcatgggcctgcccaccagcgacgagcagaagaagcaggagatcctgaagaagttcatggaccagcaccccgagatggacttcagcaaggccaagttcaactag

SEQ ID NO: 9951 - DNA, 1860 bp, Artificial Sequence
  Description of Artificial Sequence: Synthetic coding sequence
atggccggccccggcgtgcccggcgcccccgccgccagatggaagagacacatcgtgagacagctgagactgagagacagaacccagaaggccctgttcctggagctggtgcccgcctacaaccacctgctggagaaggccgagctgctggacaagttcagcaagaagctgcagcccgagcccaacagcgtgacccccaccacccaccagggcccctgggaggagagcgagctggacagcgaccaggtgcccagcctggtggccctgagagtgaagtggcaggaggaggaggagggcctgagactggtgtgcggcgagatggcctaccaggtggtggagaagggcgccgccctgggcaccctggagagcgagctgcagcagagacagagcagactggccgccctggaggccagagtggcccagctgagagaggccagagcccagcaggcccagcaggtggaggagtggagagcccagaacgccgtgcagagagccgcctacgaggccctgagagcccacgtgggcctgagagaggccgccctgagaagactgcaggaggaggccagagacctgctggagagactggtgcagagaaaggccagagccgccgccgagagaaacctgagaaacgagagaagagagagagccaagcaggccagagtgagccaggagctgaagaaggccgccaagagaaccgtgagcatcagcgagggccccgacaccctgggcgacggcatgagagagagaagagagaccctggccctggcccccgagcccgagcccctggagaaggaggcctgcgagaagtggaagagacccttcagaagcgccagcgccaccagcctgaccctgagccactgcgtggacgtggtgaagggcctgctggacttcaagaagagaagaggccacagcatcggcggcgcccccgagcagagataccagatcatccccgtgtgcgtggccgccagactgcccaccagagcccaggacgtgctggacgcccacctgagcgaggtgaacgccgtgagattcggccccaacagcagcctgctggccaccggcggcgccgacagactgatccacctgtggaacgtggtgggcagcagactggaggccaaccagaccctggagggcgccggcggcagcatcaccagcgtggacttcgaccccagcggctaccaggtgctggccgccacctacaaccaggccgcccagctgtggaaggtgggcgaggcccagagcaaggagaccctgagcggccacaaggacaaggtgaccgccgccaagttcaagctgaccagacaccaggccgtgaccggcagcagagacagaaccgtgaaggagtgggacctgggcagagcctactgcagcagaaccatcaacgtgctgagctactgcaacgacgtggtgtgcggcgaccacatcatcatcagcggccacaacgaccagaagatcagattctgggacagcagaggcccccactgcacccaggtgatccccgtgcagggcagagtgaccagcctgagcctgagccacgaccagctgcacctgctgagctgcagcagagacaacaccctgaaggtgatcgacctgagagtgagcaacatcagacaggtgttcagagccgacggcttcaagtgcggcagcgactggaccaaggccgtgttcagccccgacagaagctacgccctggccggcagctgcgacggcgccctgtacatctgggacgtggacaccggcaagctggagagcagactgcagggcccccactgcgccgccgtgaacgccgtggcctggtgctacagcggcagccacatggtgagcgtggaccagggcagaaaggtggtgctgtggcagtag

SEQ ID NO: 9952 - DNA, 5049 bp, Artificial Sequence
  Description of Artificial Sequence: Synthetic coding sequence
atggagggcaacggcaccgagaacagctgcagcagaaccagaggctggctgcagcaggacaacgacgccaagccctggctgtggaagttcagcaactgcttcagcagacccgagcagaccctgccccacagcccccagaccaaggagtacatggagaacaagaaggtggccgtggagctgaaggacgtgcccagccccctgcacgccggcagcaagctgttccccgccgtgcccctgcccgacatcagaagcctgcagcagcccaagatccagctgagcagcgtgcccaaggtgagctgctgcgcccactgccccaacgagcccagcaccagccccatgagattcggcggcggcggcggcggcagcggcggcaccagcagcctgatccaccccggcgccctgctggacagccagagcaccagaaccatcacctgccaggtgggcagcggcttcgccttccagagcgccagcagcctgcagaacgccagcgccagaaacaacctggccggcatcgccagcgacttccccagcatgtgcctggagagcaacctgagcagctgcaagcacctgccctgctgcggcaagctgcacttccagagctgccacggcaacgtgcacaagctgcaccagttccccagcctgcagggctgcaccagcgccggctacttcccctgcagcgacttcaccagcggcgcccccggccacctggaggagcacatcagccagagcgagctgaccccccacctgtgcaccaacagcctgcacctgaacgtggtgccccccgtgtgcctgaagggcagcctgtactgcgaggactgcctgaacaagcccgccagaaacagcatcatcgacgccgccaaggtgtggcccaacatccccccccccaacacccagcccgcccccctggccgtgcccctgtgcaacggctgcggcaccaagggcaccggcaaggagaccaccctgctgctggccaccagcctgggcaaggccgccagcaagttcggcagccccgaggtggccgtggccggccaggtgctggagaacctgccccccatcggcgtgttctgggacatcgagaactgcagcgtgcccagcggcagaagcgccaccgccgtggtgcagagaatcagagagaagttcttcaagggccacagagaggccgagttcatctgcgtgtgcgacatcagcaaggagaacaaggaggtgatccaggagctgaacaactgccaggtgaccgtggcccacatcaacgccaccgccaagaacgccgccgacgacaagctgagacagagcctgagaagattcgccaacacccacaccgcccccgccaccgtggtgctggtgagcaccgacgtgaacttcgccctggagctgagcgacctgagacacagacacggcttccacatcatcctggtgcacaagaaccaggccagcgaggccctgctgcaccacgccaacgagctgatcagattcgaggagttcatcagcgacctgccccccagactgcccctgaagatgccccagtgccacaccctgctgtacgtgtacaacctgcccgccaacaaggacggcaagagcgtgagcaacagactgagaagactgagcgacaactgcggcggcaaggtgctgagcatcaccggctgcagcgccatcctgagattcatcaaccaggacagcgccgagagagcccagaagagaatggagaacgaggacgtgttcggcaacagaatcatcgtgagcttcacccccaagaacagagagctgtgcgagaccaagagcagcaacgccatcgccgacaaggtgaagagccccaagaagctgaagaaccccaagctgtgcctgatcaaggacgccagcgagcagagcagcagcgccaaggccacccccggcaagggcagccaggccaacagcggcagcgccaccaagaacaccaacgtgaagagcctgcaggagctgtgcagaatggagagcaagaccggccacagaaacagcgagcaccagcagggccacctgagactggtggtgcccacccacggcaacagcagcgccgccgtgagcacccccaagaacagcggcgtggccgagcccgtgtacaagaccagccagaagaaggagaacctgagcgccagaagcgtgaccagcagccccgtggagaagaaggacaaggaggagaccgtgttccaggtgagctaccccagcgccttcagcaagctggtggccagcagacaggtgagccccctgctggccagccagagctggagcagcagaagcatgagccccaacctgctgaacagagccagccccctggccttcaacatcgccaacagcagcagcgaggccgactgccccgaccccttcgccaacggcgccgacgtgcaggtgagcaacatcgactacagactgagcagaaaggagctgcagcagctgctgcaggaggccttcgccagacacggcaaggtgaagagcgtggagctgagcccccacaccgactaccagctgaaggccgtggtgcagatggagaacctgcaggacgccatcggcgccgtgaacagcctgcacagatacaagatcggcagcaagaagatcctggtgagcctggccaccggcgccgccagcaagagcctgagcctgctgagcgccgagaccatgagcgtgctgcaggacgcccccgcctgctgcctgcccctgttcaagttcaccgacatctacgagaagaagttcggccacaagctgaacgtgagcgacctgtacaagctgaccgacaccgtggccatcagagagcagggcaacggcagactggtgtgcctgctgcccagcagccaggccagacagagccccctgggcagcagccagagccacgacggcagcagcaccaactgcagccccatcatcttcgaggagctggagtaccacgagcccgtgtgcagacagcactgcagcaacaaggacttcagcgagcacgagttcgaccccgacagctacaagatccccttcgtgatcctgagcctgaagaccttcgccccccaggtgcacagcctgctgcagacccacgagggcaccgtgcccctgctggacccctggctgctgagaagcaagagccccgtgggcaacccccagctgatccagttcagcagagaggtgatcgacctgctgaagagccagcccagctgcgtgatccccatcagccacttcatccccagctaccaccaccacttcgccaagcagtgcagagtgagcgactacggctacagcaagctgatcgagctgctggaggccgtgccccacgtgctgcagatcctgggcatgggcagcaagagactgctgaccctgacccacagagcccaggtgaagagattcacccaggacctgctgaagctgctgaagagccaggccagcaagcaggtgatcgtgagagagttcagccaggcctaccactggtgcttcagcaaggactgggacgtgaccgagtacggcgtgtgcgagctgatcgacatcgtgagcgagatccccgacaccaccatctgcctgagccagcaggacaacgagatggtgatctgcatccccaagagagagagaacccaggacgagatcgagagaaccaagcagttcagcaaggacgtggtggacctgctgagacaccagccccacttcagaatgcccttcaacaagttcatccccagctaccaccaccacttcggcagacagtgcaagctggcctactacggcttcaccaagctgctggagctgttcgaggccatccccgacaccctgcaggtgctggagtgcggcgaggagaagatcctgaccctgaccgaggtggagagattcaaggccctggccgcccagttcgtgaagctgctgagaagccagaaggacaactgcctgatgatgaccgacctgctgaccgagtacgccaagaccttcggctacaccttcagactgcaggactacgacgtgagcagcatcagcgccctgacccagaagctgtgccacgtggtgaaggtggccgacatcgagagcggcagacagatccagctgatcaacagaaagagcctgagaagcctgaccgcccagctgctggtgctgctgatgagctgggagggcaccacccacctgagcgtggaggagctgaagagacactacgagagcacccacaacacccccctgaacccctgcgagtacggcttcatgaccctgaccgagctgctgaagagcctgccctacctggtggaggtgttcaccaacgacaagatggaggagtgcgtgaagctgaccagcctgtacctgttcgccaagaacgtgagaagcctgctgcacacctaccactaccagcagatcttcctgcacgagttcagcatggcctacaccaagtacgtgggcgagaccctgcagcccaagacctacggccacagcagcgtggaggagctgctgggcgccatcccccaggtggtgtggatcaagggccacggccacaagagaatcgtggtgctgaagaacgacatgaagagcagactgagcagcctgagcctgagccccgccaaccacgagaaccagcccagcgagggcgagagaatcctggaggtgcccgagagccacaccgccagcgagctgaagctgggcgccgacggcagcggccccagccacaccgagcaggagctgctgagactgaccgacgacagccccgtggacctgctgtgcgcccccgtgcccagctgcctgcccagcccccagctgagacccgaccccgtgatcctgcagagcgccgacctgatccagttcgaggagagaccccaggagcccagcgagatcatgatcctgaaccaggaggagaagatggagatccccatccccggcaagagcaagaccctgaccagcgacagcagcagcagctgcatcagcgccgccgtgcccgtgcccccctgccccagcagcgagaccagcgagagcctgctgagcaaggaccccgtggagagccccgccaagaagcagcccaagaacagagtgaagctggccgccaacttcagcctggcccccatcaccaagctgtag

SEQ ID NO: 9953 - DNA, 735 bp, Artificial Sequence
  Description of Artificial Sequence: Synthetic coding sequence
ggcggcggctacgacctgaacctgttcgccagcccccccgacagcaacttcgtgtgcagcgtgtgccacggcgtgctgaagagacccgccagactgccctgcagccacatcttctgcaagaagtgcatcctgagatggctggccagacagaagacctgcccctgctgcagaaaggaggtgaagagaaagaaggtggtgcacatgaacaagctgagaaagaccatcggcagactggaggtgaagtgcaagaacgccgacgccggctgcatcgtgacctgccccctggcccacagaaagggccaccaggacagctgccccttcgagctgaccgcctgccccaacgagggctgcaccagccaggtgcccagaggcaccctggccgagcacagacagcactgccagcagggcagccagcagagatgccccctgggctgcggcgccaccctggaccccgccgagagagccagacacaactgctacagagagctgcacaacgcctggagcgtgagacaggagagaagaagacccctgctgctgagcctgctgagaagagtgagatggctggaccaggccaccagcgtggtgagaagagagctggccgagctgagcaacttcctggaggaggacaccgccctgctggagggcgccccccaggaggaggccgaggccgcccccgagggcaacgtgggcgccgaggtggtgggcgagcccagagccaacatcccctgcaagtag

SEQ ID NO: 9954 - DNA, 705 bp, Artificial Sequence
  Description of Artificial Sequence: Synthetic coding sequence
ctgccctgcaagagatgcagacccagcgtgtacagcctgagctacatcaagagaggcaagaccagaaactacctgtaccccatctggagcccctacgcctactacctgtactgctacaagtacagaatcaccctgagagagaagatgctgcccagatgctacaagagcatcacctacaaggaggaggaggacctgaccctgcagcccagaagctgcctgcagtgcgagagcctggtgggcctgcaggagggcaagagcaccgagcagggcaaccacgaccagctgaaggagctgtacagcgccggcaacctgaccgtgctggccaccgaccccctgctgcaccaggaccccgtgcagctggacttccacttcagactgaccagccagaccagcgcccactggcacggcctgctgtgcgacagaagactgttcctggacatcccctaccaggccctggaccagggcaacagagagagcctgaccgccaccctggagtacgtggaggagaagaccaacgtggacagcgtgttcgtgaacttccagaacgacagaaacgacagaggcgccctgctgagagccttcagctacatgggcttcgaggtggtgagacccgaccaccccgccctgccccccctggacaacgtgatcttcatggtgtaccccctggagagagacgtgggccacctgcccagcgagcccccctag

SEQ ID NO: 9955 - DNA, 2403 bp, Artificial Sequence
  Description of Artificial Sequence: Synthetic coding sequence
atggccgccgccgccagcgtgaccggcagagtgacctgggccgccagccccatgagaagcctgggcctgggcagaagactgagcctgcccggccccagactggacgccgtgaccgccgccgtgaaccccagcctgagcgaccacggcaacggcctgggcagaggcaccagaggcagcggctgcagcggcggcagcctggtggccgactggggcggcggcgccgccgccgccgccgccgtggccctggccctggcccccgccctgagcaccatgagaagaggcagcagcgagagcgagctggccgccagatgggaggccgaggccgtggccgccgccaaggccgccgccaaggccgaggccgaggccaccgccgagaccgtggccgagcaggtgagagtggacgccggcgccgccggcgagcccgagtgcaaggccggcgaggagcagcccaaggtgctggcccccgcccccgcccagcccagcgccgccgaggagggcaacacccaggtgctgcagagacccccccccaccctgccccccagcaagcccaagcccgtgcagggcctgtgcccccacggcaagcccagagacaagggcagaagctgcaagagaagcagcggccacggcagcggcgagaacggcagccagagacccgtgaccgtggacagcagcaaggccagaaccagcctggacgccctgaagatcagcatcagacagctgaagtggaaggagttccccttcggcagaagactgccctgcgacatctactggcacggcgtgagcttccacgacaacgacatcttcagcggccaggtgaacaagttccccggcatgaccgagatggtgagaaagatcaccctgagcagagccgtgagaaccatgcagaacctgttccccgaggagtacaacttctaccccagaagctggatcctgcccgacgagttccagctgttcgtggcccaggtgcagatggtgaaggacgacgaccccagctggaagcccaccttcatcgtgaagcccgacggcggctgccagggcgacggcatctacctgatcaaggaccccagcgacatcagactggccggcaccctgcagagcagacccgccgtggtgcaggagtacatctgcaagcccctgctgatcgacaagctgaagttcgacatcagactgtacgtgctgctgaagagcctggaccccctggagatctacatcgccaaggacggcctgagcagattctgcaccgagccctaccaggagcccacccccaagaacctgcacagaatcttcatgcacctgaccaactacagcctgaacatccacagcggcaacttcatccacagcgacagcgccagcaccggcagcaagagaaccttcagcagcatcctgtgcagactgagcagcaagggcgtggacatcaagaaggtgtggagcgacatcatcagcgtggtgatcaagaccgtgatcgccctgacccccgagctgaaggtgttctaccagagcgacatccccaccggcagacccggccccacctgcttccagatcctgggcttcgacatcctgctgatgaagaacctgaagcccatcctgctggaggtgaacgccaaccccagcatgagaatcgagcacgagcacgagctgagccccggcgtgttcgagaacgtgcccagcctggtggacgaggaggtgaaggtggccgtgatcagagacaccctgagactgatggaccccctgaagaagaagagagagaaccagagccagcagctggagaagcccttcgccggcaaggaggacgccctggacggcgagctgaccagcgcccccgactgcaacgccaaccccgaggcccacctgcccagcatctgcctgaagcaggtgttccccaagtacgccaagcagttcaactacctgagactggtggacagaatggccaacctgttcatcagattcctgggcatcaagggcaccatgaagctgggccccaccggcttcagaaccttcatcagaagctgcaagctgagcagcagcagcctgagcatggccgccgtggacatcctgtacatcgacatcaccagaagatggaacagcatgaccctggaccagagagacagcggcatgtgcctgcaggccttcgtggaggccttcttcttcctggcccagagaaagttcaagatgctgcccctgcacgagcaggtggccagcctgatcgacctgtgcgagtaccacctgagcctgctggacgagaagagactggtgtgcggcagaggcgtgcccagcggcggcagacccccccacagaggccccccccaggagcccagccccagcgcccagcccgccggcgacaaccccccccccagaaccagctgcgccaacaagctgagccaccccagacacaccctgagctag

SEQ ID NO: 9956 - DNA, 981 bp, Artificial Sequence
  Description of Artificial Sequence: Synthetic coding sequence
atgagagagtgcatcagcatccacgtgggccaggccggcgtgcagatcggcaacgcctgctgggagctgtactgcctggagcacggcatccagcccgacggccagatgcccagcgacaagaccatcggcggcggcgacgacagcttcaacaccttcttcagcgagaccggcgccggcaagcacgtgcccagagccgtgttcgtggacctggagcccaccgtgatcgacgaggtgagaaccggcacctacagacagctgttccaccccgagcagctgatcaccggcaaggaggacgccgccaacaactacgccagaggccactacaccatcggcaaggagatcatcgacctggtgctggacagaatcagaaagctgaagagcttcttcgccaccaagcccagaatccacttccccctggccacctacgcccccgtgatcagcgccgagaaggcctaccacgagcagctgaccgtggccgagatcaccaacgcctgcttcgagcccgccaaccagatggtgaagtgcgaccccagacacggcaagtacatggcctgctgcctgctgtacagaggcgacgtggtgcccaaggacgtgaacgccgccatcgccaccatcaagaccaagagaaccatccagttcgtggactggtgccccaccggcttcaaggtgggcatcaactaccagccccccaccgtggtgcccggcggcgacctggccaaggtgcagagagccgtgtgcatgctgagcaacaccaccgccgtggccgaggcctgggccagactggaccacaagttcgacctgatgcccctgagaagaatcatgagaagactggagcagatcgtgctgaccgagagaatgagagtgaagagcatcaacctgtgcgccgtgctgctgcacagcttcgtgctggagctgagctacttctgcagcgtgaacgtgtactgcagaaagctgctgatcaagctgaagttccccttctag

SEQ ID NO: 9957 - DNA, 1005 bp, Artificial Sequence
  Description of Artificial Sequence: Synthetic coding sequence
atggtgggcagagagaaggagctgagcatccacttcgtgcccggcagctgcagactggtggaggaggaggtgaacatccccaacagaagagtgctggtgaccggcgccaccggcctgctgggcagagccgtgcacaaggagttccagcagaacaactggcacgccgtgggctgcggcttcagaagagccagacccaagttcgagcaggtgaacctgctggacagcaacgccgtgcaccacatcatccacgacttccagccccacgtgatcgtgcactgcgccgccgagagaagacccgacgtggtggagaaccagcccgacgccgccagccagctgaacgtggacgccagcggcaacctggccaaggaggccgccgccgtgggcgccttcctgatctacatcagcagcgactacgtgttcgacggcaccaaccccccctacagagaggaggacatccccgcccccctgaacctgtacggcaagaccaagctggacggcgagaaggccgtgctggagaacaacctgggcgccgccgtgctgagaatccccatcctgtacggcgaggtggagaagctggaggagagcgccgtgaccgtgatgttcgacaaggtgcagttcagcaacaagagcgccaacatggaccactggcagcagagattccccacccacgtgaaggacgtggccaccgtgtgcagacagctggccgagaagagaatgctggaccccagcatcaagggcaccttccactggagcggcaacgagcagatgaccaagtacgagatggcctgcgccatcgccgacgccttcaacctgcccagcagccacctgagacccatcaccgacagccccgtgctgggcgcccagagacccagaaacgcccagctggactgcagcaagctggagaccctgggcatcggccagagaacccccttcagaatcggcatcaaggagagcctgtggcccttcctgatcgacaagagatggagacagaccgtgttccactag

SEQ ID NO: 9958 - DNA, 513 bp, Artificial Sequence
  Description of Artificial Sequence: Synthetic coding sequence
atggccagcgaggccgagaagaccttccacagattcgccgccttcggcgagagcagcagcagcggcaccgagatgaacaacaagaacttcagcaagctgtgcaaggactgcggcatcatggacggcaagaccgtgaccagcaccgacgtggacatcgtgttcagcaaggtgaaggccaagaacgccagaaccatcaccttccagcagttcaaggaggccgtgaaggagctgggccagaagagattcaagggcaagagccccgacgaggtgctggagaacatctacggcctgatggagggcaaggaccccgccaccaccggcgccaccaaggccaccaccgtgggcgccgtggacagactgaccgacaccagcaagtacaccggcacccacaaggagagattcgacgagagcggcaagggcaagggcatcgccggcagagaggagatgaccgacaacaccggctacgtgagcggctacaagggcagcggcacctacgacaagaagaccaagtag

SEQ ID NO: 9959 - DNA, 3582 bp, Artificial Sequence
  Description of Artificial Sequence: Synthetic coding sequence
atgtggagagtgaagaagctgagcctgagcctgagccccagcccccagaccggcaagcccagcatgagaacccccctgagagagctgaccctgcagcccggcgccctgaccaacagcggcaagagaagccccgcctgcagcagcctgacccccagcctgtgcaagctgggcctgcaggagggcagcaacaacagcagccccgtggacttcgtgaacaacaagagaaccgacctgagcagcgagcacttcagccacagcagcaagtggctggagacctgccagcacgagagcgacgagcagcccctggaccccatcccccagatcagcagcacccccaagaccagcgaggaggccgtggaccccctgggcaactacatggtgaagaccatcgtgctggtgcccagccccctgggccagcagcaggacatgatcttcgaggccagactggacaccatggccgagaccaacagcatcagcctgaacggccccctgagaaccgacgacctggtgagagaggaggtggccccctgcatgggcgacagattcagcgaggtggccgccgtgagcgagaagcccatcttccaggagagccccagccacctgctggaggagagcccccccaacccctgcagcgagcagctgcactgcagcaaggagagcctgagcagcagaaccgaggccgtgagagaggacctggtgcccagcgagagcaacgccttcctgcccagcagcgtgctgtggctgagccccagcaccgccctggccgccgacttcagagtgaaccacgtggaccccgaggaggagatcgtggagcacggcgccatggaggagagagagatgagattccccacccaccccaaggagagcgagaccgaggaccaggccctggtgagcagcgtggaggacatcctgagcacctgcctgacccccaacctggtggagatggagagccaggaggcccccggccccgccgtggaggacgtgggcagaatcctgggcagcgacaccgagagctggatgagccccctggcctggctggagaagggcgtgaacaccagcgtgatgctggagaacctgagacagagcctgagcctgcccagcatgctgagagacgccgccatcggcaccacccccttcagcacctgcagcgtgggcacctggttcacccccagcgccccccaggagaagagcaccaacaccagccagaccggcctggtgggcaccaagcacagcaccagcgagaccgagcagctgctgtgcggcagaccccccgacctgaccgccctgagcagacacgacctggaggacaacctgctgagcagcctggtgatcctggaggtgctgagcagacagctgagagactggaagagccagctggccgtgccccaccccgagacccaggacagcagcacccagaccgacaccagccacagcggcatcaccaacaagctgcagcacctgaaggagagccacgagatgggccaggccctgcagcaggccagaaacgtgatgcagagctgggtgctgatcagcaaggagctgatcagcctgctgcacctgagcctgctgcacctggaggaggacaagaccaccgtgagccaggagagcagaagagccgagaccctggtgtgctgctgcttcgacctgctgaagaagctgagagccaagctgcagagcctgaaggccgagagagaggaggccagacacagagaggagatggccctgagaggcaaggacgccgccgagatcgtgctggaggccttctgcgcccacgccagccagagaatcagccagctggagcaggacctggccagcatgagagagttcagaggcctgctgaaggacgcccagacccagctggtgggcctgcacgccaagcaggaggagctggtgcagcagaccgtgagcctgaccagcaccctgcagcaggactggagaagcatgcagctggactacaccacctggaccgccctgctgagcagaagcagacagctgaccgagaagctgaccgtgaagagccagcaggccctgcaggagagagacgtggccatcgaggagaagcaggaggtgagcagagtgctggagcaggtgagcgcccagctggaggagtgcaagggccagaccgagcagctggagctggagaacagcagactggccaccgacctgagagcccagctgcagatcctggccaacatggacagccagctgaaggagctgcagagccagcacacccactgcgcccaggacctggccatgaaggacgagctgctgtgccagctgacccagagcaacgaggagcaggccgcccagtggcagaaggaggagatggccctgaagcacatgcaggccgagctgcagcagcagcaggccgtgctggccaaggaggtgagagacctgaaggagaccctggagttcgccgaccaggagaaccaggtggcccacctggagctgggccaggtggagtgccagctgaagaccaccctggaggtgctgagagagagaagcctgcagtgcgagaacctgaaggacaccgtggagaacctgaccgccaagctggccagcaccatcgccgacaaccaggagcaggacctggagaagaccagacagtacagccagaagctgggcctgctgaccgagcagctgcagagcctgaccctgttcctgcagaccaagctgaaggagaagaccgagcaggagaccctgctgctgagcaccgcctgcccccccacccaggagcaccccctgcccaacgacagaaccttcctgggcagcatcctgaccgccgtggccgacgaggagcccgagagcacccccgtgcccctgctgggcagcgacaagagcgccttcaccagagtggccagcatggtgagcctgcagcccgccgagacccccggcatggaggagagcctggccgagatgagcatcatgaccaccgagctgcagagcctgtgcagcctgctgcaggagagcaaggaggaggccatcagaaccctgcagagaaagatctgcgagctgcaggccagactgcaggcccaggaggagcagcaccaggaggtgcagaaggccaaggaggccgacatcgagaagctgaaccaggccctgtgcctgagatacaagaacgagaaggagctgcaggaggtgatccagcagcagaacgagaagatcctggagcagatcgacaagagcggcgagctgatcagcctgagagaggaggtgacccacctgaccagaagcctgagaagagccgagaccgagaccaaggtgctgcaggaggccctggccggccagctggacagcaactgccagcccatggccaccaactggatccaggagaaggtgtggctgagccaggaggtggacaagctgagagtgatgttcctggagatgaagaacgagaaggagaagctgatgatcaagttccagagccacagaaacatcctggaggagaacctgagaagaagcgacaaggagctggagaagctggacgacatcgtgcagcacatctacaagaccctgctgagcatccccgaggtggtgagaggctgcaaggagctgcagggcctgctggagttcctgagctag

SEQ ID NO: 9960 - DNA, 9141 bp, Artificial Sequence
  Description of Artificial Sequence: Synthetic coding sequence
atgagaggcagaagaggcagaccccccaagcagcccgccgcccccgccgccgagagatgcgcccccgccccccccccccccccccccccccccaccagcggccccatcggcggcctgagaagcagacacagaggcagcagcagaggcagatgggccgccgcccaggccgaggtggcccccaagaccagactgagcagccccagaggcggcagcagcagcagaagaaagccccccccccccccccccgccccccccagcaccagcgcccccggcagaggcggcagaggcggcggcggcggcagaaccggcggcggcggcggcggcggccacctggccagaaccaccgccgccagaagagccgtgaacaaggtggtgtacgacgaccacgagagcgaggaggaggaggaggaggaggacatggtgagcgaggaggaggaggaggaggacggcgacgccgaggagacccaggacagcgaggacgacgaggaggacgagatggaggaggacgacgacgacagcgactaccccgaggagatggaggacgacgacgacgacgccagctactgcaccgagagcagcttcagaagccacagcacctacagcagcacccccggcagaagaaagcccagagtgcacagacccagaagccccatcctggaggagaaggacatcccccccctggagttccccaagagcagcgaggacctgatggtgcccaacgagcacatcatgaacgtgatcgccatctacgaggtgctgagaaacttcggcaccgtgctgagactgagccccttcagattcgaggacttctgcgccgccctggtgagccaggagcagtgcaccctgatggccgagatgcacgtggtgctgctgaaggccgtgctgagagaggaggacaccagcaacaccaccttcggccccgccgacctgaaggacagcgtgaacagcaccctgtacttcatcgacggcatgacctggcccgaggtgctgagagtgtactgcgagagcgacaaggagtaccaccacgtgctgccctaccaggaggccgaggactacccctacggccccgtggagaacaagatcaaggtgctgcagttcctggtggaccagttcctgaccaccaacatcgccagagaggagctgatgagcgagggcgtgatccagtacgacgaccactgcagagtgtgccacaagctgggcgacctgctgtgctgcgagacctgcagcgccgtgtaccacctggagtgcgtgaagccccccctggaggaggtgcccgaggacgagtggcagtgcgaggtgtgcgtggcccacaaggtgcccggcgtgaccgactgcgtggccgagatccagaagaacaagccctacatcagacacgagcccatcggctacgacagaagcagaagaaagtactggttcctgaacagaagactgatcatcgaggaggacaccgagaacgagaacgagaagaagatctggtactacagcaccaaggtgcagctggccgagctgatcgactgcctggacaaggactactgggaggccgagctgtgcaagatcctggaggagatgagagaggagatccacagacacatggacatcaccgaggacctgaccaacaaggccagaggcagcaacaagagcttcctggccgccgccaacgaggagatcctggagagcatcagagccaagaagggcgacatcgacaacgtgaagagccccgaggagaccgagaaggacaagaacgagaccgagaacgacagcaaggacgccgagaagaacagagaggagttcgaggaccagagcctggagaaggacagcgacgacaagacccccgacgacgaccccgagcagggcaagagcgaggagcccaccgaggtgggcgacaagggcaacagcgtgagcgccaacctgggcgacaacaccaccaacgccaccagcgaggagaccagccccagcgagggcagaagccccgtgggctgcctgagcgagacccccgacagcagcaacatggccgagaagaaggtggccagcgagctgccccaggacgtgcccgaggagcccaacaagacctgcgagagcagcaacaccagcgccaccaccaccagcatccagcccaacctggagaacagcaacagcagcagcgagctgaacagcagccagagcgagagcgccaaggccgccgacgaccccgagaacggcgagagagagagccacacccccgtgagcatccaggaggagatcgtgggcgacttcaagagcgagaagagcaacggcgagctgagcgagagccccggcgccggcaagggcgccagcggcagcaccagaatcatcaccagactgagaaaccccgacagcaagctgagccagctgaagagccagcaggtggccgccgccgcccacgaggccaacaagctgttcaaggagggcaaggaggtgctggtggtgaacagccagggcgagatcagcagactgagcaccaagaaggaggtgatcatgaagggcaacatcaacaactacttcaagctgggccaggagggcaagtacagagtgtaccacaaccagtacagcaccaacagcttcgccctgaacaagcaccagcacagagaggaccacgacaagagaagacacctggcccacaagttctgcctgacccccgccggcgagttcaagtggaacggcagcgtgcacggcagcaaggtgctgaccatcagcaccctgagactgaccatcacccagctggagaacaacatccccagcagcttcctgcaccccaactgggccagccacagagccaactggatcaaggccgtgcagatgtgcagcaagcccagagagttcgccctggccctggccatcctggagtgcgccgtgaagcccgtggtgatgctgcccatctggagagagagcctgggccacaccagactgcacagaatgaccagcatcgagagagaggagaaggagaaggtgaagaagaaggagaagaagcaggaggaggaggagaccatgcagcaggccacctgggtgaagtacaccttccccgtgaagcaccaggtgtggaagcagaagggcgaggagtacagagtgaccggctacggcggctggagctggatcagcaagacccacgtgtacagattcgtgcccaagctgcccggcaacaccaacgtgaactacagaaagagcctggagggcaccaagaacaacatggacgagaacatggacgagagcgacaagagaaagtgcagcagaagccccaagaagatcaagatcgagcccgacagcgagaaggacgaggtgaagggcagcgacgccgccaagggcgccgaccagaacgagatggacatcagcaagatcaccgagaagaaggaccaggacgtgaaggagctgctggacagcgacagcgacaagccctgcaaggaggagcccatggaggtggacgacgacatgaagaccgagagccacgtgaactgccaggagagcagccaggtggacgtggtgaacgtgagcgagggcttccacctgagaaccagctacaagaagaagaccaagagcagcaagctggacggcctgctggagagaagaatcaagcagttcaccctggaggagaagcagagactggagaagatcaagctggagggcggcatcaagggcatcggcaagaccagcaccaacagcagcaagaacctgagcgagagccccgtgatcaccaaggccaaggagggctgccagagcgacagcatgagacaggagcagagccccaacgccaacaacgaccagcccgaggacctgatccagggctgcagcgagagcgacagcagcgtgctgagaatgagcgaccccagccacaccaccaacaagctgtaccccaaggacagagtgctggacgacgtgagcatcagaagccccgagaccaagtgccccaagcagaacagcatcgagaacgacatcgaggagaaggtgagcgacctggccagcagaggccaggagcccagcaagagcaagaccaagggcaacgacttcttcatcgacgacagcaagctggccagcgccgacgacatcggcaccctgatctgcaagaacaagaagcccctgatccaggaggagagcgacaccatcgtgagcagcagcaagagcgccctgcacagcagcgtgcccaagagcaccaacgacagagacgccacccccctgagcagagccatggacttcgagggcaagctgggctgcgacagcgagagcaacagcaccctggagaacagcagcgacaccgtgagcatccaggacagcagcgaggaggacatgatcgtgcagaacagcaacgagagcatcagcgagcagttcagaaccagagagcaggacgtggaggtgctggagcccctgaagtgcgagctggtgagcggcgagagcaccggcaactgcgaggacagactgcccgtgaagggcaccgaggccaacggcaagaagcccagccagcagaagaagctggaggagagacccgtgaacaagtgcagcgaccagatcaagctgaagaacaccaccgacaagaagaacaacgagaacagagagagcgagaagaagggccagagaaccagcaccttccagatcaacggcaaggacaacaagcccaagatctacctgaagggcgagtgcctgaaggagatcagcgagagcagagtggtgagcggcaacgtggagcccaaggtgaacaacatcaacaagatcatccccgagaacgacatcaagagcctgaccgtgaaggagagcgccatcagacccttcatcaacggcgacgtgatcatggaggacttcaacgagagaaacagcagcgagaccaagagccacctgctgagcagcagcgacgccgagggcaactacagagacagcctggagaccctgcccagcaccaaggagagcgacagcacccagaccaccacccccagcgccagctgccccgagagcaacagcgtgaaccaggtggaggacatggagatcgagaccagcgaggtgaagaaggtgaccagcagccccatcaccagcgaggaggagagcaacctgagcaacgacttcatcgacgagaacggcctgcccatcaacaagaacgagaacgtgaacggcgagagcaagagaaagaccgtgatcaccgaggtgaccaccatgaccagcaccgtggccaccgagagcaagaccgtgatcaaggtggagaagggcgacaagcagaccgtggtgagcagcaccgagaactgcgccaagagcaccgtgaccaccaccaccaccaccgtgaccaagctgagcacccccagcaccggcggcagcgtggacatcatcagcgtgaaggagcagagcaagaccgtggtgaccaccaccgtgaccgacagcctgaccaccaccggcggcaccctggtgaccagcatgaccgtgagcaaggagtacagcaccagagacaaggtgaagctgatgaagttcagcagacccaagaagaccagaagcggcaccgccctgcccagctacagaaagttcgtgaccaagagcagcaagaagagcatcttcgtgctgcccaacgacgacctgaagaagctggccagaaagggcggcatcagagaggtgccctacttcaactacaacgccaagcccgccctggacatctggccctaccccagccccagacccaccttcggcatcacctggagatacagactgcagaccgtgaagagcctggccggcgtgagcctgatgctgagactgctgtgggccagcctgagatgggacgacatggccgccaaggccccccccggcggcggcaccaccagaaccgagaccagcgagaccgagatcaccaccaccgagatcatcaagagaagagacgtgggcccctacggcatcagaagcgagtactgcatcagaaagatcatctgccccatcggcgtgcccgagacccccaaggagacccccaccccccagagaaagggcctgagaagcagcgccctgagacccaagagacccgagacccccaagcagaccggccccgtgatcatcgagacctgggtggccgaggaggagctggagctgtgggagatcagagccttcgccgagagagtggagaaggagaaggcccaggccgtggagcagcaggccaagaagagactggagcagcagaagcccaccgtgatcgccaccagcaccaccagccccaccagcagcaccaccagcaccatcagccccgcccagaaggtgatggtggcccccatcagcggcagcgtgaccaccggcaccaagatggtgctgaccaccaaggtgggcagccccgccaccgtgaccttccagcagaacaagaacttccaccagaccttcgccacctgggtgaagcagggccagagcaacagcggcgtggtgcaggtgcagcagaaggtgctgggcatcatccccagcagcaccggcaccagccagcagaccttcaccagcttccagcccagaaccgccaccgtgaccatcagacccaacaccagcggcagcggcggcaccaccagcaacagccaggtgatcaccggcccccagatcagacccggcatgaccgtgatcagaacccccctgcagcagagcaccctgggcaaggccatcatcagaacccccgtgatggtgcagcccggcgccccccagcaggtgatgacccagatcatcagaggccagcccgtgagcaccgccgtgagcgcccccaacaccgtgagcagcacccccggccagaagagcctgaccagcgccaccagcaccagcaacatccagagcagcgccagccagccccccagaccccagcagggccaggtgaagctgaccatggcccagctgacccagctgacccagggccacggcggcaaccagggcctgaccgtggtgatccagggccagggccagaccaccggccagctgcagctgatcccccagggcgtgaccgtgctgcccggccccggccagcagctgatgcaggccgccatgcccaacggcaccgtgcagagattcctgttcacccccctggccaccaccgccaccaccgccagcaccaccaccaccaccgtgagcaccaccgccgccggcaccggcgagcagagacagagcaagctgagcccccagatgcaggtgcaccaggacaagaccctgccccccgcccagagcagcagcgtgggccccgccgaggcccagccccagaccgcccagcccagcgcccagccccagccccagacccagccccagagccccgcccagcccgaggtgcagacccagcccgaggtgcagacccagaccaccgtgagcagccacgtgcccagcgaggcccagcccacccacgcccagagcagcaagccccaggtggccgcccagagccagccccagagcaacgtgcagggccagagccccgtgagagtgcagagccccagccagaccagaatcagacccagcacccccagccagctgagccccggccagcagagccaggtgcagaccaccaccagccagcccatccccatccagccccacaccagcctgcagatccccagccagggccagccccagagccagccccaggtgcagagcagcacccagaccctgagcagcggccagaccctgaaccaggtgaccgtgagcagccccagcagaccccagctgcagatccagcagccccagccccaggtgatcgccgtgccccagctgcagcagcaggtgcaggtgctgagccagatccagagccaggtggtggcccagatccaggcccagcagagcggcgtgccccagcagatcaagctgcagctgcccatccagatccagcagagcagcgccgtgcagacccaccagatccagaacgtggtgaccgtgcaggccgccagcgtgcaggagcagctgcagagagtgcagcagctgagagaccagcagcagaagaagaagcagcagcagatcgagatcaagagagagcacaccctgcaggccagcaaccagagcgagatcatccagaagcaggtggtgatgaagcacaacgccgtgatcgagcacctgaagcagaagaagagcatgacccccgccgagagagaggagaaccagagaatgatcgtgtgcaaccaggtgatgaagtacatcctggacaagatcgacaaggaggagaagcaggccgccaagaagagaaagagagaggagagcgtggagcagaagagaagcaagcagaacgccaccaagctgagcgccctgctgttcaagcacaaggagcagctgagagccgagatcctgaagaagagagccctgctggacaaggacctgcagatcgaggtgcaggaggagctgaagagagacctgaagatcaagaaggagaaggacctgatgcagctggcccaggccaccgccgtggccgccccctgcccccccgtgacccccgccccccccgccccccccgcccccccccccagccccccccccccccccgccgtgcagcacaccggcctgctgagcacccccaccctgcccgccgccagccagaagagaaagagagaggaggagaaggacagcagcagcaagagcaagaagaagaagatgatcagcaccaccagcaaggagaccaagaaggacaccaagctgtactgcatctgcaagaccccctacgacgagagcaagttctacatcggctgcgacagatgccagaactggtaccacggcagatgcgtgggcatcctgcagagcgaggccgagctgatcgacgagtacgtgtgcccccagtgccagagcaccgaggacgccatgaccgtgctgacccccctgaccgagaaggactacgagggcctgaagagagtgctgagaagcctgcaggcccacaagatggcctggcccttcctggagcccgtggaccccaacgacgcccccgactactacggcgtgatcaaggagcccatggacctggccaccatggaggagagagtgcagagaagatactacgagaagctgaccgagttcgtggccgacatgaccaagatcttcgacaactgcagatactacaaccccagcgacagccccttctaccagtgcgccgaggtgctggagagcttcttcgtgcagaagctgaagggcttcaaggccagcagaagccacaacaacaagctgcagagcaccgccagctag

SEQ ID NO: 9961 - DNA, 927 bp, Artificial Sequence
  Description of Artificial Sequence: Synthetic coding sequence
atggccagcagcaacaccgtgctgatgagactggtggccagcgcctacagcatcgcccagaaggccggcatgatcgtgagaagagtgatcgccgagggcgacctgggcatcgtggagaagacctgcgccaccgacctgcagaccaaggccgacagactggcccagatgagcatctgcagcagcctggccagaaagttccccaagctgaccatcatcggcgaggaggacctgcccagcgaggaggtggaccaggagctgatcgaggacagccagtgggaggagatcctgaagcagccctgccccagccagtacagcgccatcaaggaggaggacctggtggtgtgggtggaccccctggacggcaccaaggagtacaccgagggcctgctggacaacgtgaccgtgctgatcggcatcgcctacgagggcaaggccatcgccggcgtgatcaaccagccctactacaactacgaggccggccccgacgccgtgctgggcagaaccatctggggcgtgctgggcctgggcgccttcggcttccagctgaaggaggtgcccgccggcaagcacatcatcaccaccaccagaagccacagcaacaagctggtgaccgactgcgtggccgccatgaaccccgacgccgtgctgagagtgggcggcgccggcaacaagatcatccagctgatcgagggcaaggccagcgcctacgtgttcgccagccccggctgcaagaagtgggacacctgcgcccccgaggtgatcctgcacgccgtgggcggcaagctgaccgacatccacggcaacgtgctgcagtaccacaaggacgtgaagcacatgaacagcgccggcgtgctggccaccctgagaaactacgactactacgccagcagagtgcccgagagcatcaagaacgccctggtgccctag

SEQ ID NO: 9962 - DNA, 1212 bp, Artificial Sequence
  Description of Artificial Sequence: Synthetic coding sequence
atgagcggcagcgacggcggcctggaggaggagcccgagctgagcatcaccctgaccctgagaatgctgatgcacggcaaggaggtgggcagcatcatcggcaagaagggcgagaccgtgaagagaatcagagagcagagcagcgccagaatcaccatcagcgagggcagctgccccgagagaatcaccaccatcaccggcagcaccgccgccgtgttccacgccgtgagcatgatcgccttcaagctggacgaggacctgtgcgccgcccccgccaacggcggcaacgtgagcagaccccccgtgaccctgagactggtgatccccgccagccagtgcggcagcctgatcggcaaggccggcaccaagatcaaggagatcagagagaccaccggcgcccaggtgcaggtggccggcgacctgctgcccaacagcaccgagagagccgtgaccgtgagcggcgtgcccgacgccatcatcctgtgcgtgagacagatctgcgccgtgatcctggagagcccccccaagggcgccaccatcccctaccaccccagcctgagcctgggcaccgtgctgctgagcgccaaccagggcttcagcgtgcagggccagtacggcgccgtgacccccgccgaggtgaccaagctgcagcagctgagcagccacgccgtgcccttcgccacccccagcgtggtgcccggcctggaccccggcacccagaccagcagccaggagttcctggtgcccaacgacctgatcggctgcgtgatcggcagacagggcagcaagatcagcgagatcagacagatgagcggcgcccacatcaagatcggcaaccaggccgagggcgccggcgagagacacgtgaccatcaccggcagccccgtgagcatcgccctggcccagtacctgatcaccgcctgcctggagaccgccaagagcaccagcggcggcacccccagcagcgcccccgccgacctgcccgcccccttcagcccccccctgaccgccctgcccaccgccccccccggcctgctgggcaccccctacgccatcagcctgagcaacttcatcggcctgaagcccatgcccttcctggccctgccccccgccagccccggccccccccccggcctggccgcctacaccgccaagatggccgccgccaacggcagcaagaaggccgagagacagaagttcagcccctactag

SEQ ID NO: 9963 - DNA, 654 bp, Artificial Sequence
  Description of Artificial Sequence: Synthetic coding sequence
atgagcagcaaggtgagcagagacaccctgtacgaggccgtgagagaggtgctgcacggcaaccagagaaagagaagaaagttcctggagaccgtggagctgcagatcagcctgaagaactacgacccccagaaggacaagagattcagcggcaccgtgagactgaagagcacccccagacccaagttcagcgtgtgcgtgctgggcgaccagcagcactgcgacgaggccaaggccgtggacatcccccacatggacatcgaggccctgaagaagctgaacaagaacaagaagctggtgaagaagctggccaagaagtacgacgccttcctggccagcgagagcctgatcaagcagatccccagaatcctgggccccggcctgaacaaggccggcaagttccccagcctgctgacccacaacgagaacatggtggccaaggtggacgaggtgaagagcaccatcaagttccagatgaagaaggtgctgtgcctggccgtggccgtgggccacgtgaagatgaccgacgacgagctggtgtacaacatccacctggccgtgaacttcctggtgagcctgctgaagaagaactggcagaacgtgagagccctgtacatcaagagcaccatgggcaagccccagagactgtactag

SEQ ID NO: 9964 - DNA, 3159 bp, Artificial Sequence
  Description of Artificial Sequence: Synthetic coding sequence
atggagggcagcgagcccgtggccgcccaccagggcgaggaggccagctgcagcagctggggcaccggcagcaccaacaagaacctgcccatcatgagcaccgccagcgtggagatcgacgacgccctgtacagcagacagagatacgtgctgggcgacaccgccatgcagaagatggccaagagccacgtgttcctgagcggcatgggcggcctgggcctggagatcgccaagaacctggtgctggccggcatcaaggccgtgaccatccacgacaccgagaagtgccaggcctgggacctgggcaccaacttcttcctgagcgaggacgacgtggtgaacaagagaaacagagccgaggccgtgctgaagcacatcgccgagctgaacccctacgtgcacgtgaccagcagcagcgtgcccttcaacgagaccaccgacctgagcttcctggacaagtaccagtgcgtggtgctgaccgagatgaagctgcccctgcagaagaagatcaacgacttctgcagaagccagtgcccccccatcaagttcatcagcgccgacgtgcacggcatctggagcagactgttctgcgacttcggcgacgagttcgaggtgctggacaccaccggcgaggagcccaaggagatcttcatcagcaacatcacccaggccaaccccggcatcgtgacctgcctggagaaccacccccacaagctggagaccggccagttcctgaccttcagagagatcaacggcatgaccggcctgaacggcagcatccagcagatcaccgtgatcagccccttcagcttcagcatcggcgacaccaccgagctggagccctacctgcacggcggcatcgccgtgcaggtgaagacccccaagaccgtgttcttcgagagcctggagagacagctgaagcaccccaagtgcctgatcgtggacttcagcaaccccgaggcccccctggagatccacaccgccatgctggccctggaccagttccaggagaagtacagcagaaagcccaacgtgggctgccagcaggacagcgaggagctgctgaagctggccaccagcatcagcgagaccctggaggagaagcccgacgtgaacgccgacatcgtgcactggctgagctggaccgcccagggcttcctgagccccctggccgccgccgtgggcggcgtggccagccaggaggtgctgaaggccgtgaccggcaagttcagccccctgtgccagtggctgtacctggaggccgccgacatcgtggagagcctgggcaagcccgagtgcgaggagttcctgcccagaggcgacagatacgacgccctgagagcctgcatcggcgacaccctgtgccagaagctgcagaacctgaacatcttcctggtgggctgcggcgccatcggctgcgagatgctgaagaacttcgccctgctgggcgtgggcaccagcaaggagaagggcatgatcaccgtgaccgaccccgacctgatcgagaagagcaacctgaacagacagttcctgttcagaccccaccacatccagaagcccaagagctacaccgccgccgacgccaccctgaagatcaacagccagatcaagatcgacgcccacctgaacaaggtgtgccccaccaccgagaccatctacaacgacgagttctacaccaagcaggacgtgatcatcaccgccctggacaacgtggaggccagaagatacgtggacagcagatgcctggccaacctgagacccctgctggacagcggcaccatgggcaccaagggccacaccgaggtgatcgtgccccacctgaccgagagctacaacagccacagagacccccccgaggaggagatccccttctgcaccctgaagagcttccccgccgccatcgagcacaccatccagtgggccagagacaagttcgagagcagcttcagccacaagcccagcctgttcaacaagttctggcagacctacagcagcgccgaggaggtgctgcagaagatccagagcggccacagcctggagggctgcttccaggtgatcaagctgctgagcagaagacccagaaactggagccagtgcgtggagctggccagactgaagttcgagaagtacttcaaccacaaggccctgcagctgctgcactgcttccccctggacatcagactgaaggacggcagcctgttctggcagagccccaagagaccccccagccccatcaagttcgacctgaacgagcccctgcacctgagcttcctgcagaacgccgccaagctgtacgccaccgtgtactgcatccccttcgccgaggaggacctgagcgccgacgccctgctgaacatcctgagcgaggtgaagatccaggagttcaagcccagcaacaaggtggtgcagaccgacgagaccgccagaaagcccgaccacgtgcccatcagcagcgaggacgagagaaacgccatcttccagctggagaaggccatcctgagcaacgaggccaccaagagcgacctgcagatggccgtgctgagcttcgagaaggacgacgaccacaacggccacatcgacttcatcaccgccgccagcaacctgagagccaagatgtacagcatcgagcccgccgacagattcaagaccaagagaatcgccggcaagatcatccccgccatcgccaccaccaccgccaccgtgagcggcctggtggccctggagatgatcaaggtgaccggcggctaccccttcgaggcctacaagaactgcttcctgaacctggccatccccatcgtggtgttcaccgagaccaccgaggtgagaaagaccaagatcagaaacggcatcagcttcaccatctgggacagatggaccgtgcacggcaaggaggacttcaccctgctggacttcatcaacgccgtgaaggagaagtacggcatcgagcccaccatggtggtgcagggcgtgaagatgctgtacgtgcccgtgatgcccggccacgccaagagactgaagctgaccatgcacaagctggtgaagcccaccaccgagaagaagtacgtggacctgaccgtgagcttcgcccccgacatcgacggcgacgaggacctgcccggcccccccgtgagatactacttcagccacgacaccgactag

SEQ ID NO: 9965 - DNA, 1134 bp, Artificial Sequence
  Description of Artificial Sequence: Synthetic coding sequence
atgctgagactggtgcccaccggcgccagagccatcgtggacatgagctacgccagacacttcctggacttccagggcagcgccatcccccaggccatgcagaagctggtggtgaccagactgagccccaacttcagagaggccgtgaccctgagcagagactgccccgtgcccctgcccggcgacggcgacctgctggtgagaaacagattcgtgggcgtgaacgccagcgacatcaactacagcgccggcagatacgaccccagcgtgaagccccccttcgacatcggcttcgagggcatcggcgaggtggtggccctgggcctgagcgccagcgccagatacaccgtgggccaggccgtggcctacatggcccccggcagcttcgccgagtacaccgtggtgcccgccagcatcgccacccccgtgcccagcgtgaagcccgagtacctgaccctgctggtgagcggcaccaccgcctacatcagcctgaaggagctgggcggcctgagcgagggcaagaaggtgctggtgaccgccgccgccggcggcaccggccagttcgccatgcagctgagcaagaaggccaagtgccacgtgatcggcacctgcagcagcgacgagaagagcgccttcctgaagagcctgggctgcgacagacccatcaactacaagaccgagcccgtgggcaccgtgctgaagcaggagtaccccgagggcgtggacgtggtgtacgagagcgtgggcggcgccatgttcgacctggccgtggacgccctggccaccaagggcagactgatcgtgatcggcttcatcagcggctaccagacccccaccggcctgagccccgtgaaggccggcaccctgcccgccaagctgctgaagaagagcgccagcgtgcagggcttcttcctgaaccactacctgagcaagtaccaggccgccatgagccacctgctggagatgtgcgtgagcggcgacctggtgtgcgaggtggacctgggcgacctgagccccgagggcagattcaccggcctggagagcatcttcagagccgtgaactacatgtacatgggcaagaacaccggcaagatcgtggtggagctgccccacagcgtgaacagcaagctgtag

SEQ ID NO: 9966 - DNA, 2538 bp, Artificial Sequence
  Description of Artificial Sequence: Synthetic coding sequence
atgagcaacagcagacccagaagcagaagagacgccggcggcggcgccggcgccgccggcagagacgagctggtgagcagaagcctgcagagcgccgagcactgcctgggcgtgcaggacttcggcaccgcctacgcccactacctgctggtgctgagcctggcccccgagctgaagcacgacgtgaaggagaccttccagtacaccctgttcagatgggccgaggagctggacgccctgagcagaatccaggacctgctgggctgctacgagcaggccctggagctgttccccgacgacgaggtgatctgcaacagcatgggcgagcacctgttcagaatgggcttcagagacgaggccgccggctacttccacaaggccgtgaagctgaaccccgacttcagcgacgccaaggagaacttctacagagtggccaactggctggtggagagatggcacttcatcatgctgaacgacaccaagagaaacaccatctacaacgccgccatccagaaggccgtgtgcctgggcagcaagagcgtgctggacatcggcgccggcaccggcatcctgagcatgttcgccaagaaggccggcgcccacagcgtgtacgcctgcgagctgagcaagaccatgtacgagctggcctgcgacgtggtggccgccaacaagatggaggccggcatcaagctgctgcacaccaagagcctggacatcgagatccccaagcacatccccgagagagtgagcctggtggtgaccgagaccgtggacgccggcctgttcggcgagggcatcgtggagagcctgatccacgcctgggagcacctgctgctgcagcccaagaccaagggcgagagcgccaactgcgagaagtacggcaaggtgatccccgccagcgccgtgatcttcggcatggccgtggagtgcgccgagatcagaagacaccacagagtgggcatcaaggacatcgccggcatccacctgcccaccaacgtgaagttccagagccccgcctacagcagcgtggacaccgaggagaccatcgagccctacaccaccgagaagatgagcagagtgcccggcggctacctggccctgaccgagtgcttcgagatcatgaccgtggacttcaacaacctgcaggagctgaagagcctggccaccaagaagcccgacaagatcggcatccccgtgatcaaggagggcatcctggacgccatcatggtgtggttcgtgctgcagctggacgacgagcacagcctgagcaccagccccagcgaggagacctgctgggagcaggccgtgtaccccgtgcaggacctggccgactactggatcaagcccggcgaccacgtgatgatggaggtgagctgccaggactgctacctgagaatccagagcatcagcgtgctgggcctggagtgcgagatggacgtggccaagagcttcacccagaacaaggacctgctgagcctgggcaacgaggccgagctgtgcagcgccctggccaacctgcagaccagcaagcccgacgccgtggagcagacctgcatcctggagagcaccgagatcgccctgctgaacaacatcccctaccacgagggcttcaagatggccatgagcaaggtgctgagcagcctgacccccgagaagctgtaccagaccatggacacccactgccagaacgagatgagcagcggcaccggccagagcaacaccgtgcagaacatcctggagcccttctacgtgctggacgtgagcgagggcttcagcgtgctgcccgtgatcgccggcaccctgggccaggtgaagccctacagcagcgtggagaaggaccagcacagaatcgccctggacctgatcagcgaggccaaccacttccccaaggagaccctggagttctggctgagacacgtggaggacgagagcgccatgctgcagagacccaagagcgacaagctgtggagcatcatcatcctggacgtgatcgagcccagcggcctgatccagcaggagatcatggagaaggccgccatcagcagatgcctgctgcagagcggcggcaagatcttcccccagtacgtgctgatgttcggcctgctggtggagagccagaccctgctggaggagaacgccgtgcagggcaccgagagaaccctgggcctgaacatcgcccccttcatcaaccagttccaggtgcccatcagagtgttcctggacctgagcagcctgccctgcatccccctgagcaagcccgtggagctgctgagactggacctgatgaccccctacctgaacaccagcaacagagaggtgaaggtgtacgtgtgcaagagcggcagactgaccgccatccccttctggtaccacatgtacctggacgaggagatcagactggacaccagcagcgaggccagccactggaagcaggccgccgtggtgctggacaaccccatccaggtggagatgggcgaggagctggtgctgagcatccagcaccacaagagcaacgtgagcatcaccgtgaagcagtag

SEQ ID NO: 9967 - DNA, 756 bp, Artificial Sequence
  Description of Artificial Sequence: Synthetic coding sequence
atggccgacctgaccagcgtgctgaccagcgtgatgttcagccccagcagcaagatgttcatcggcggcctgagctggcagaccagccccgacagcctgagagactacttcagcaagttcggcgagatcagagagtgcatggtgatgagagaccccaccaccaagagaagcagaggcttcggcttcgtgaccttcgccgaccccgccagcgtggacaaggtgctgggccagccccaccacgagctggacagcaagaccatcgaccccaaggtggccttccccagaagagcccagcccaagatggtgaccagaaccaagaagatcttcgtgggcggcctgagcgccaacaccgtggtggaggacgtgaagcagtacttcgagcagttcggcaaggtggaggacgccatgctgatgttcgacaagaccaccaacagacacagaggcttcggcttcgtgaccttcgagaacgaggacgtggtggagaaggtgtgcgagatccacttccacgagatcaacaacaagatggtggagtgcaagaaggcccagcccaaggaggtgatgttcccccccggcaccagaggcagagccagaggcctgccctacaccatggacgccttcatgctgggcatgggcatgctgggctaccccaacttcgtggccacctacggcagaggctaccccggcttcgcccccagctacggctaccagttccccgactacctgcccgtgagccaggacatcatcttcatcaactag

SEQ ID NO: 9968 - DNA, 510 bp, Artificial Sequence
  Description of Artificial Sequence: Synthetic coding sequence
atggcccccaagagagccaagagaagaaccgtggagggcggcagcagcagcgtgttcagcatgttcgaccagacccagatccaggagttcaaggaggccttcaccgtgatcgaccagaacagagacggcatcatcgacaaggaggacctgagagacaccttcgccgccatgggcagactgaacgtgaagaacgaggagctggacgccatgatgaaggaggccagcggccccatcaacttcaccgtgttcctgaccatgttcggcgagaagctgaagggcgccgaccccgaggacgtgatcaccggcgccttcaaggtgctggaccccgagggcaagggcaccatcaagaagaagttcctggaggagctgctgaccacccagtgcgacagattcagccaggaggagatcaagaacatgtgggccgccttcccccccgacgtgggcggcaacgtggactacaagaacatctgctacgtgatcacccacggcgacgccaaggaccaggagtag

SEQ ID NO: 9969 - DNA, 546 bp, Artificial Sequence
  Description of Artificial Sequence: Synthetic coding sequence
atggccaccgagcccgaggccgccgagcccgtggtgcccagcctggtggacagatacttcaccagatggtacaagcccgacgtgaagggcaagttctgcgaggaccactgcatcctgcagcacagcaacagaatctgcgtgatcaccctggccgagagccaccccgtgctgcagagcggcaagaccatcaagagcatcagctaccagatcagcaccaactgcagcagactgcagaacaaggtgagcggcaagttcaagagaggcgcccagttcctgaccgagctggcccccctgtgcaagatctactgcagcgacggcgaggagtacaccgtgagcagctgcgtgagaggcagactgatggaggtgaacgagaacatcctgcacaagcccagcatcctgcaggagaagcccagcaccgagggctacatcgccgtggtgctgcccaagttcgaggagagcaagagcatcaccgagggcctgctgacccagaagcagtacgaggaggtgatggtgaagagaatcaacgccaccaccgccaccagctag

SEQ ID NO: 9970 - DNA, 2154 bp, Artificial Sequence
  Description of Artificial Sequence: Synthetic coding sequence
atggagctgagatgcggcggcctgctgttcagcagcagattcgacagcggcaacctggcccacgtggagaaggtggagagcctgagcagcgacggcgagggcgtgggcggcggcgccagcgccctgaccagcggcatcgccagcagccccgactacgagttcaacgtgtggaccagacccgactgcgccgagaccgagttcgagaacggcaacagaagctggttctacttcagcgtgagaggcggcatgcccggcaagctgatcaagatcaacatcatgaacatgaacaagcagagcaagctgtacagccagggcatggcccccttcgtgagaaccctgcccaccagacccagatgggagagaatcagagacagacccaccttcgagatgaccgagacccagttcgtgctgagcttcgtgcacagattcgtggagggcagaggcgccaccaccttcttcgccttctgctaccccttcagctacagcgactgccaggagctgctgaaccagctggaccagagattccccgagaaccaccccacccacagcagccccctggacaccatctactaccacagagagctgctgtgctacagcctggacggcctgagagtggacctgctgaccatcaccagctgccacggcctgagagaggacagagagcccagactggagcagctgttccccgacaccagcacccccagacccttcagattcgccggcaagagaatcttcttcctgagcagcagagtgcaccccggcgagacccccagcagcttcgtgttcaacggcttcctggacttcatcctgagacccgacgaccccagagcccagaccctgagaagactgttcgtgttcaagctgatccccatgctgaaccccgacggcgtggtgagaggccactacagaaccgacagcagaggcgtgaacctgaacagacagtacctgaagcccgacgccgtgctgcaccccgccatctacggcgccaaggccgtgctgctgtaccaccacgtgcacagcagactgaacagccagagcagcagcgagcaccagcccagcagctgcctgccccccgacgcccccgtgagcgacctggagaaggccaacaacctgcagaacgaggcccagtgcggccacagcgccgacagacacaacgccgaggcctggaagcagaccgagcccgccgagcagaagctgaacagcgtgtggatcatgccccagcagagcgccggcctggaggagagcgcccccgacaccatcccccccaaggagagcggcgtggcctactacgtggacctgcacggccacgccagcaagagaggctgcttcatgtacggcaacagcttcagcgacgagagcacccaggtggagaacatgctgtaccccaagctgatcagcctgaacagcgcccacttcgacttccagggctgcaacttcagcgagaagaacatgtacgccagagacagaagagacggccagagcaaggagggcagcggcagagtggccatctacaaggccagcggcatcatccacagctacaccctggagtgcaactacaacaccggcagaagcgtgaacagcatccccgccgcctgccacgacaacggcagagccagccccccccccccccccgccttccccagcagatacaccgtggagctgttcgagcaggtgggcagagccatggccatcgccgccctggacatggccgagtgcaacccctggcccagaatcgtgctgagcgagcacagcagcctgaccaacctgagagcctggatgctgaagcacgtgagaaacagcagaggcctgagcagcaccctgaacgtgggcgtgaacaagaagagaggcctgagaaccccccccaagagccacaacggcctgcccgtgagctgcagcgagaacaccctgagcagagccagaagcttcagcaccggcaccagcgccggcggcagcagcagcagccagcagaacagcccccagatgaagaacagccccagcttccccttccacggcagcagacccgccggcctgcccggcctgggcagcagcacccagaaggtgacccacagagtgctgggccccgtgagaggcaagcccgtgtgggagcccctgcagcacgtgttcggctgcctgggccactgctggggcaagtag

SEQ ID NO: 9971 - DNA, 678 bp, Artificial Sequence
  Description of Artificial Sequence: Synthetic coding sequence
atggtgatggccgagggcaccgccgtgctgagaagaaacagacccggcaccaaggcccaggacttctacaactggcccgacgagagcttcgacgagatggacagcaccctggccgtgcagcagtacatccagcagaacatcagagccgactgcagcaacatcgacaagatcctggagccccccgagggccaggacgagggcgtgtggaagtacgagcacctgagacagttctgcctggagctgaacggcctggccgtgaagctgcagagcgagtgccaccccgacacctgcacccagatgaccgccaccgagcagtggatcttcctgtgcgccgcccacaagacccccaaggagtgccccgccatcgactacaccagacacaccctggacggcgccgcctgcctgctgaacagcaacaagtacttccccagcagagtgagcatcaaggagagcagcgtggccaagctgggcagcgtgtgcagaagaatctacagaatcttcagccacgcctacttccaccacagacagatcttcgacgagtacgagaacgagaccttcctgtgccacagattcaccaagttcgtgatgaagtacaacctgatgagcaaggacaacctgatcgtgcccatcctggaggaggaggtgcagaacagcgtgagcggcgagagcgaggcctag

SEQ ID NO: 9972 - DNA, 1173 bp, Artificial Sequence
  Description of Artificial Sequence: Synthetic coding sequence
atggccgcccagaaggacctgtgggacgccatcgtgatcggcgccggcatccagggctgcttcaccgcctaccacctggccaagcacagaaagagaatcctgctgctggagcagttcttcctgccccacagcagaggcagcagccacggccagagcagaatcatcagaaaggcctacctggaggacttctacaccagaatgatgcacgagtgctaccagatctgggcccagctggagcacgaggccggcacccagctgcacagacagaccggcctgctgctgctgggcatgaaggagaaccaggagctgaagaccatccaggccaacctgagcagacagagagtggagcaccagtgcctgagcagcgaggagctgaagcagagattccccaacatcagactgcccagaggcgaggtgggcctgctggacaacagcggcggcgtgatctacgcctacaaggccctgagagccctgcaggacgccatcagacagctgggcggcatcgtgagagacggcgagaaggtggtggagatcaaccccggcctgctggtgaccgtgaagaccaccagcagaagctaccaggccaagagcctggtgatcaccgccggcccctggaccaaccagctgctgagacccctgggcatcgagatgcccctgcagaccctgagaatcaacgtgtgctactggagagagatggtgcccggcagctacggcgtgagccaggccttcccctgcttcctgtggctgggcctgtgcccccaccacatctacggcctgcccaccggcgagtaccccggcctgatgaaggtgagctaccaccacggcaaccacgccgaccccgaggagagagactgccccaccgccagaaccgacatcggcgacgtgcagatcctgagcagcttcgtgagagaccacctgcccgacctgaagcccgagcccgccgtgatcgagagctgcatgtacaccaacacccccgacgagcagttcatcctggacagacaccccaagtacgacaacatcgtgatcggcgccggcttcagcggccacggcttcaagctggcccccgtggtgggcaagatcctgtacgagctgagcatgaagctgacccccagctacgacctggcccccttcagaatcagcagattccccagcctgggcaaggcccacctgtag

SEQ ID NO: 9973 - DNA, 135 bp, Artificial Sequence
  Description of Artificial Sequence: Synthetic coding sequence
atgagcgacaagcccgacatggccgagatcgagaagttcgacaagagcaagctgaagaagaccgagatgcaggagaagaaccccctgcccagcaaggagaccatcgagcaggagaagcaggccagcgagagctag

SEQ ID NO: 9974 - DNA, 1323 bp, Artificial Sequence
  Description of Artificial Sequence: Synthetic coding sequence
atgcccatcccccccccccccccccccccccccggccccccccccccccccaccttccaccaggccaacaccgagcagcccaagctgagcagagacgagcagagaggcagaggcgccctgctgcaggacatctgcaagggcaccaagctgaagaaggtgaccaacatcaacgacagaagcgcccccatcctggagaagcccaagggcagcagcggcggctacggcagcggcggcgccgccctgcagcccaagggcggcctgttccagggcggcgtgctgaagctgagacccgtgggcgccaaggacggcagcgagaacctggccggcaagcccgccctgcagatccccagcagcagagccgccgcccccagaccccccgtgagcgccgccagcggcagaccccaggacgacaccgacagcagcagagccagcctgcccgagctgcccagaatgcagagacccagcctgcccgacctgagcagacccaacaccaccagcagcaccggcatgaagcacagcagcagcgccccccccccccccccccccggcagaagagccaacgccccccccacccccctgcccatgcacagcagcaaggcccccgcctacaacagagagaagcccctgccccccacccccggccagagactgcaccccggcagagagggcccccccgcccccccccccgtgaagcccccccccagccccgtgaacatcagaaccggccccagcggccagagcctggccccccccccccccccctacagacagccccccggcgtgcccaacggccccagcagccccaccaacgagagcgcccccgagctgccccagagacacaacagcctgcacagaaagacccccggccccgtgagaggcctggccccccccccccccaccagcgccagccccagcctgctgagcaacagaccccccccccccgccagagacccccccagcagaggcgccgccccccccccccccccccccgtgatcagaaacggcgccagagacgcccccccccccccccccccctacagaatgcacggcagcgagccccccagcagaggcaagcccccccccccccccagcagaacccccgccggcccccccccccccccccccccccccctgagaaacggccacagagacagcatcaccaccgtgagaagcttcctggacgacttcgagagcaagtacagcttccaccccgtggaggacttccccgcccccgaggagtacaagcacttccagagaatctaccccagcaagaccaacagagccgccagaggcgccccccccctgccccccatcctgagatag

SEQ ID NO: 9975 - DNA, 2703 bp, Artificial Sequence
  Description of Artificial Sequence: Synthetic coding sequence
atgaactaccccggcagaggcagccccagaagccccgagcacaacggcagaggcggcggcggcggcgcctgggagctgggcagcgacgccagacccgccttcggcggcggcgtgtgctgcttcgagcacctgcccggcggcgaccccgacgacggcgacgtgcccctggccctgctgagaggcgagcccggcctgcacctggcccccggcaccgacgaccacaaccaccacctggccctggacccctgcctgagcgacgagaactacgacttcagcagcgccgagagcggcagcagcctgagatactacagcgagggcgagagcggcggcggcggcagcagcctgagcctgcaccccccccagcagccccccctggtgcccaccaacagcggcggcggcggcgccaccggcggcagccccggcgagagaaagagaaccagactgggcggccccgccgccagacacagatacgaggtggtgaccgagctgggccccgaggaggtgagatggttctacaaggaggacaagaagacctggaagcccttcatcggctacgacagcctgagaatcgagctggccttcagaaccctgctgcagaccaccggcgccagaccccagggcggcgacagagacggcgaccacgtgtgcagccccaccggccccgccagcagcagcggcgaggacgacgacgaggacagagcctgcggcttctgccagagcaccaccggccacgagcccgagatggtggagctggtgaacatcgagcccgtgtgcgtgagaggcggcctgtacgaggtggacgtgacccagggcgagtgctaccccgtgtactggaaccaggccgacaagatccccgtgatgagaggccagtggttcatcgacggcacctggcagcccctggaggaggaggagagcaacctgatcgagcaggagcacctgaactgcttcagaggccagcagatgcaggagaacttcgacatcgaggtgagcaagagcatcgacggcaaggacgccgtgcacagcttcaagctgagcagaaaccacgtggactggcacagcgtggacgaggtgtacctgtacagcgacgccaccaccagcaagatcgccagaaccgtgacccagaagctgggcttcagcaaggccagcagcagcggcaccagactgcacagaggctacgtggaggaggccaccctggaggacaagcccagccagaccacccacatcgtgttcgtggtgcacggcatcggccagaagatggaccagggcagaatcatcaagaacaccgccatgatgagagaggccgccagaaagatcgaggagagacacttcagcaaccacgccacccacgtggagttcctgcccgtggagtggagaagcaagctgaccctggacggcgacaccgtggacagcatcacccccgacaaggtgagaggcctgagagacatgctgaacagcagcgccatggacatcatgtactacaccagccccctgtacagagacgagctggtgaagggcctgcagcaggagctgaacagactgtacagcctgttctgcagcagaaaccccgacttcgaggagaagggcggcaaggtgagcatcgtgagccacagcctgggctgcgtgatcacctacgacatcatgaccggctggaaccccgtgagactgtacgagcagctgctgcagaaggaggaggagctgcccgacgagagatggatgagctacgaggagagacacctgctggacgagctgtacatcaccaagagaagactgaaggagatcgaggagagactgcacggcctgaaggccagcagcatgacccagacccccgccctgaagttcaaggtggagaacttcttctgcatgggcagccccctggccgtgttcctggccctgagaggcatcagacccggcaacaccggcagccaggaccacatcctgcccagagagatctgcaacagactgctgaacatcttccaccccaccgaccccgtggcctacagactggagcccctgatcctgaagcactacagcaacatcagccccgtgcagatccactggtacaacaccagcaaccccctgccctacgagcacatgaagcccagcttcctgaaccccgccaaggagcccaccagcgtgagcgagaacgagggcatcagcaccatccccagccccgtgaccagccccgtgctgagcagaagacactacggcgagagcatcaccaacatcggcaaggccagcatcctgggcgccgccagcatcggcaagggcctgggcggcatgctgttcagcagattcggcagaagcagcaccacccagagcagcgagaccagcaaggacagcatggaggacgagaagaagcccgtggccagccccagcgccaccaccgtgggcacccagaccctgccccacagcagcagcggcttcctggacagcgcctacttcagactgcaggagagcttcttcaacctgccccagctgctgttccccgagaacgtgatgcagaacaaggacaacgccctggtggagctggaccacagaatcgacttcgagctgagagagggcctggtggagagcagatactggagcgccgtgaccagccacaccgcctactggagcagcctggacgtggccctgttcctgctgaccttcatgtacaagcacgagcacgacgacgacgccaagcccaacctggaccccatctag

SEQ ID NO: 9976 - DNA, 1278 bp, Artificial Sequence
  Description of Artificial Sequence: Synthetic coding sequence
atgaacaagatgcccgccggcgagcaggagtgcgagtacaacaaggagggcaagtactacagcaagggcgtgaagctggtgagaaagaagaagaagatccccggctacagatggggcgacatcaagatcaacatcatcggcgagaaggacgacctgcccatccacttctgcgacaagtgcgacctgcccatcaagatctacggcagaatcatcccctgcaagcacgccttctgctaccactgcgccaacctgtacgacaaggtgggctacaaggtgtgccccagatgcagataccccgtgctgagaatcgaggcccacaagagaggcagcgtgttcatgtgcagcatcgtgcagcagtgcaagagaacctacctgagccagaagagcctgcaggcccacatcaagagaagacacaagagagccagaaagcaggtgaccagcgccagcctggagaaggtgagaccccacatcgcccccccccagaccgagatcagcgacatccccaagagactgcaggacagagaccacctgagctacatcccccccgagcagcacaccatggtgagcctgcccagcgtgcagcacatgctgcaggagcagcacaaccagccccacaaggacatccaggcccccccccccgagctgagcctgagcctgcccttccccatccagtgggagaccgtgagcatcttcaccagaaagcacggcaacctgaccgtggaccacatccagaacaacagcgacagcggcgccaagaagcccaccccccccgactactaccccgagtgccagagccagcccgccgtgagcagcccccaccacatcatcccccagaagcagcactacgcccccccccccagccccagcagccccgtgaaccaccagatgccctaccccccccaggacgtggtgacccccaacagcgtgagaagccaggtgcccgccctgaccaccacctacgaccccagcagcggctacatcatcgtgaaggtgccccccgacatgaacagcccccccctgagagccccccagagccagaacggcaaccccagcgccagcgagttcgccagccaccactacaacctgaacatcctgccccagttcaccgagaaccaggagaccctgagcccccagttcacccagaccgacgccatggaccacagaagatggcccgcctggaagagactgagcccctgcccccccaccagaagccccccccccagcaccctgcacggcagaagccaccacagccaccagagaagacacagaagatactag

SEQ ID NO: 9977 - DNA, 1926 bp, Artificial Sequence
  Description of Artificial Sequence: Synthetic coding sequence
atgggcccccccctgaagctgttcaagaaccagaagtaccaggagctgaagcaggagtgcatcaaggacagcagactgttctgcgaccccaccttcctgcccgagaacgacagcctgttctacaacagactgctgcccggcaaggtggtgtggaagagaccccaggacatctgcgacgacccccacctgatcgtgggcaacatcagcaaccaccagctgacccagggcagactgggccacaagcccatggtgagcgccttcagctgcctggccgtgcaggagagccactggaccaagaccatccccaaccacaaggagcaggagtgggacccccagaagaccgagaagtacgccggcatcttccacttcagattctggcacttcggcgagtggaccgaggtggtgatcgacgacctgctgcccaccatcaacggcgacctggtgttcagcttcagcaccagcatgaacgagttctggaacgccctgctggagaaggcctacgccaagctgctgggctgctacgaggccctggacggcctgaccatcaccgacatcatcgtggacttcaccggcaccctggccgagaccgtggacatgcagaagggcagatacaccgagctggtggaggagaagtacaagctgttcggcgagctgtacaagaccttcaccaagggcggcctgatctgctgcagcatcgagagccccaaccaggaggagcaggaggtggagaccgactggggcctgctgaagggccacacctacaccatgaccgacatcagaaagatcagactgggcgagagactggtggaggtgttcagcgccgagaaggtgtacatggtgagactgagaaaccccctgggcagacaggagtggagcggcccctggagcgagatcagcgaggagtggcagcagctgaccgccagcgacagaaagaacctgggcctggtgatgagcgacgacggcgagttctggatgagcctggaggacttctgcagaaacttccacaagctgaacgtgtgcagaaacgtgaacaaccccatcttcggcagaaaggagctggagagcgtgctgggctgctggaccgtggacgacgaccccctgatgaacagaagcggcggctgctacaacaacagagacaccttcctgcagaacccccagtacatcttcaccgtgcccgaggacggccacaaggtgatcatgagcctgcagcagaaggacctgagaacctacagaagaatgggcagacccgacaactacatcatcggcttcgagctgttcaaggtggagatgaacagaaagttcagactgcaccacctgtacatccaggagagagccggcaccagcacctacatcgacaccagaaccgtgttcctgagcaagtacctgaagaagggcaactacgtgctggtgcccaccatgttccagcacggcagaaccagcgagttcctgctgagaatcttcagcgaggtgcccgtgcagctgagagagctgaccctggacatgcccaagatgagctgctggaacctggccagaggctaccccaaggtggtgacccagatcaccgtgcacagcgccgaggacctggagaagaagtacgccaacgagaccgtgaacccctacctggtgatcaagtgcggcaaggaggaggtgagaagccccgtgcagaagaacaccgtgcacgccatcttcgacacccaggccatcttctacagaagaaccaccgacatccccatcatcgtgcaggtgtggaacagcagaaagttctgcgaccagttcctgggccaggtgaccctggacgccgaccccagcgactgcagagacctgaagagcctgtacctgagaaagaagggcggccccaccgccaaggtgaagcagggccacatcagcttcaaggtgatcagcagcgacgacctgaccgagctgtag

SEQ ID NO: 9978 - DNA, 3180 bp, Artificial Sequence
  Description of Artificial Sequence: Synthetic coding sequence
atggccgccgtggccggcagcggcgccgccgccgcccccagcagcctgctgctggtggtgggcagcgagttcggcagccccggcctgctgacctacgtgctggaggagctggagagaggcatcagaagctgggacgtggaccccggcgtgtgcaacctggacgagcagctgaaggtgttcgtgagcagacacagcgccaccttcagcagcatcgtgaagggccagagaagcctgcaccacagaggcgacaacctggagaccctggtgctgctgaaccccagcgacaagagcctgtacgacgagctgagaaacctgctgctggaccccgccagccacaagctgctggtgctggccggcccctgcctggaggagaccggcgagctgctgctgcagaccggcggcttcagcccccaccacttcctgcaggtgctgaaggacagagagatcagagacatcctggccaccacccccccccccgtgcagccccccatcctgaccatcacctgccccaccttcggcgactgggcccagctggcccccgccgtgcccggcctgcagggcgccctgagactgcagctgagactgaacccccccgcccagctgcccaacagcgagggcctgtgcgagttcctggagtacgtggccgagagcctggagccccccagccccttcgagctgctggagccccccaccagcggcggcttcctgagactgggcagaccctgctgctacatcttccccggcggcctgggcgacgccgccttcttcgccgtgaacggcttcaccgtgctggtgaacggcggcagcaaccccaagagcagcttctggaagctggtgagacacctggacagagtggacgccgtgctggtgacccaccccggcgccgacagcctgcccggcctgaacagcctgctgagaagaaagctggccgagagaagcgaggtggccgccggcggcggcagctgggacgacagactgagaagactgatcagccccaacctgggcgtggtgttcttcaacgcctgcgaggccgccagcagactggccagaggcgaggacgaggccgagctggccctgagcctgctggcccagctgggcatcacccccctgcccctgagcagaggccccgtgcccgccaagcccaccgtgctgttcgagaagatgggcgtgggcagactggacatgtacgtgctgcacccccccagcgccggcgccgagagaaccctggccagcgtgtgcgccctgctggtgtggcaccccgccggccccggcgagaaggtggtgagagtgctgttccccggctgcaccccccccgcctgcctgctggacggcctggtgagactgcagcacctgagattcctgagagagcccgtggtgaccccccaggacctggagggccccggcagagccgagagcaaggagagcgtgggcagcagagacagcagcaagagagagggcctgctggccacccaccccagacccggccaggagagacccggcgtggccagaaaggagcccgccagagccgaggcccccagaaagaccgagaaggaggccaagacccccagagagctgaagaaggaccccaagcccagcgtgagcagaacccagcccagagaggtgagaagagccgccagcagcgtgcccaacctgaagaagaccaacgcccaggccgcccccaagcccagaaaggcccccagcaccagccacagcggcttcccccccgtggccaacggccccagaagcccccccagcctgagatgcggcgaggccagcccccccagcgccgcctgcggcagccccgccagccagctggtggccacccccagcctggagctgggccccatccccgccggcgaggagaaggccctggagctgcccctggccgccagcagcatccccagacccagaacccccagccccgagagccacagaagccccgccgagggcagcgagagactgagcctgagccccctgagaggcggcgaggccggccccgacgccagccccaccgtgaccacccccaccgtgaccacccccagcctgcccgccgaggtgggcagcccccacagcaccgaggtggacgagagcctgagcgtgagcttcgagcaggtgctgccccccagcgcccccaccagcgaggccggcctgagcctgcccctgagaggccccagagccagaagaagcgccagcccccacgacgtggacctgtgcctggtgagcccctgcgagttcgagcacagaaaggccgtgcccatggcccccgcccccgccagccccggcagcagcaacgacagcagcgccagaagccaggagagagccggcggcctgggcgccgaggagaccccccccaccagcgtgagcgagagcctgcccaccctgagcgacagcgaccccgtgcccctggcccccggcgccgccgacagcgacgaggacaccgagggcttcggcgtgcccagacacgaccccctgcccgaccccctgaaggtgcccccccccctgcccgaccccagcagcatctgcatggtggaccccgagatgctgccccccaagaccgccagacagaccgagaacgtgagcagaaccagaaagcccctggccagacccaacagcagagccgccgcccccaaggccacccccgtggccgccgccaagaccaagggcctggccggcggcgacagagccagcagacccctgagcgccagaagcgagcccagcgagaagggcggcagagcccccctgagcagaaagagcagcacccccaagaccgccaccagaggccccagcggcagcgccagcagcagacccggcgtgagcgccaccccccccaagagccccgtgtacctggacctggcctacctgcccagcggcagcagcgcccacctggtggacgaggagttcttccagagagtgagagccctgtgctacgtgatcagcggccaggaccagagaaaggaggagggcatgagagccgtgctggacgccctgctggccagcaagcagcactgggacagagacctgcaggtgaccctgatccccaccttcgacagcgtggccatgcacacctggtacgccgagacccacgccagacaccaggccctgggcatcaccgtgctgggcagcaacagcatggtgagcatgcaggacgacgccttccccgcctgcaaggtggagttctag

SEQ ID NO: 9979 - DNA, 4734 bp, Artificial Sequence
  Description of Artificial Sequence: Synthetic coding sequence
atggaggccggcagcgtggtgagagccatcttcgacttctgccccagcgtgagcgaggagctgcccctgttcgtgggcgacatcatcgaggtgctggccgtggtggacgagttctggctgctgggcaagaaggaggacgtgaccggccagttccccagcagcttcgtggagatcgtgaccatccccagcctgaaggagggcgagagactgttcgtgtgcatctgcgagttcaccagccaggagctggacaacctgcccctgcacagaggcgacctggtgatcctggacggcatccccaccgccggctggctgcagggcagaagctgctggggcgccagaggcttcttccccagcagctgcgtgagagagctgtgcctgagcagccagagcagacagtggcacagccagagcgccctgttccagatccccgagtacagcatgggccaggccagagccctgatgggcctgagcgcccagctggacgaggagctggacttcagagagggcgacgtgatcaccatcatcggcgtgcccgagcccggctggttcgagggcgagctggagggcagaagaggcatcttccccgagggcttcgtggagctgctgggccccctgagaaccgtggacgagagcgtgagcagcggcaaccaggacgactgcatcgtgaacggcgaggtggacacccccgtgggcgaggaggagatcggccccgacgaggacgaggaggagcccggcacctacggcgtggccctgtacagattccaggccctggagcccaacgagctggacttcgaggtgggcgacaagatcagaatcctggccaccctggaggacggctggctggagggcagcctgaagggcagaaccggcatcttcccctacagattcgtgaagctgtgccccgacaccagagtggaggagaccatggccctgccccaggagggcagcctggccagaatccccgagaccagcctggactgcctggagaacaccctgggcgtggaggagcagagacacgagaccagcgaccacgaggccgaggagcccgactgcatcatcagcgaggcccccaccagccccctgggccacctgaccagcgagtacgacaccgacagaaacagctaccaggacgaggacaccgccggcggcccccccagaagccccggcgtggagtgggagatgcccctggccaccgacagccccaccagcgaccccaccgaggtggtgaacggcatcagcagccagccccaggtgcccttccaccccaacctgcagaagagccagtactacagcaccgtgggcggcagccacccccacagcgagcagtaccccgacctgctgcccctggaggccagaaccagagactacgccagcctgccccccaagagaatgtacagccagctgaagaccctgcagaagcccgtgctgcccctgtacagaggcagcagcgtgagcgccagcagagtggtgaagcccagacagagcagcccccagctgcacaacctggccagctacaccaagaagcaccacaccagcagcgtgtacagcatcagcgagagactggagatgaagcccggcccccaggcccagggcctggtgatggaggccgccacccacagccagggcgacggcagcaccgacctggacagcaagctgacccagcagctgatcgagttcgagaagagcctggccggccccggcaccgagcccgacaagatcctgagacacttcagcatcatggacttcaacagcgagaaggacatcgtgagaggcagcagcaagctgatcaccgagcaggagctgcccgagagaagaaaggccctgagaccccccccccccagaccctgcacccccgtgagcaccagcccccacctgctggtggaccagaacctgaagcccgccccccccctggtggtgagacccagcagacccgcccccctgccccccagcgcccagcagagaaccaacgccgtgagccccaagctgctgagcagacacagacccacctgcgagaccctggagaaggagggccccggccacatgggcagaagcctggaccagaccagcccctgccccctggtgctggtgagaatcgaggagatggagagagacctggacatgtacagcagagcccaggaggagctgaacctgatgctggaggagaagcaggacgagagcagcagagccgagaccctggaggacctgaagttctgcgagagcaacatcgagagcctgaacatggagctgcagcagctgagagagatgaccctgctgagcagccagagcagcagcctggtggcccccagcggcagcgtgagcgccgagaaccccgagcagagaatgctggagaagagagccaaggtgatcgaggagctgctgcagaccgagagagactacatcagagacctggagatgtgcatcgagagaatcatggtgcccatgcagcaggcccaggtgcccaacatcgacttcgagggcctgttcggcaacatgcagatggtgatcaaggtgagcaagcagctgctggccgccctggagatcagcgacgccgtgggccccgtgttcctgggccacagagacgagctggagggcacctacaagatctactgccagaaccacgacgaggccatcgccctgctggagatctacgagaaggacgagaagatccagaagcacctgcaggacagcctggccgacctgaagagcctgtacaacgagtggggctgcaccaactacatcaacctgggcagcttcctgatcaagcccgtgcagagagtgatgagataccccctgctgctgatggagctgctgaacagcacccccgagagccaccccgacaaggtgcccctgaccaacgccgtgctggccgtgaaggagatcaacgtgaacatcaacgagtacaagagaagaaaggacctggtgctgaagtacagaaagggcgacgaggacagcctgatggagaagatcagcaagctgaacatccacagcatcatcaagaagagcaacagagtgagcagccacctgaagcacctgaccggcttcgccccccagatcaaggacgaggtgttcgaggagaccgagaagaacttcagaatgcaggagagactgatcaagagcttcatcagagacctgagcctgtacctgcagcacatcagagagagcgcctgcgtgaaggtggtggccgccgtgagcatgtgggacgtgtgcatggagagaggccacagagacctggagcagttcgagagagtgcacagatacatcagcgaccagctgttcaccaacttcaaggagagaaccgagagactggtgatcagccccctgaaccagctgctgagcatgttcaccggcccccacaagctggtgcagaagagattcgacaagctgctggacttctacaactgcaccgagagagccgagaagctgaaggacaagaagaccctggaggagctgcagagcgccagaaacaactacgaggccctgaacgcccagctgctggacgagctgcccaagttccaccagtacgcccagggcctgttcaccaactgcgtgcacggctacgccgaggcccactgcgacttcgtgcaccaggccctggagcagctgaagcccctgctgagcctgctgaaggtggccggcagagagggcaacctgatcgccatcttccacgaggagcacagcagagtgctgcagcagctgcaggtgttcaccttcttccccgagagcctgcccgccaccaagaagcccttcgagagaaagaccatcgacagacagagcgccagaaagcccctgctgggcctgcccagctacatgctgcagagcgaggagctgagagccagcctgctggccagatacccccccgagaagctgttccaggccgagagaaacttcaacgccgcccaggacctggacgtgagcctgctggagggcgacctggtgggcgtgatcaagaagaaggaccccatgggcagccagaacagatggctgatcgacaacggcgtgaccaagggcttcgtgtacagcagcttcctgaagccctacaaccccagaagaagccacagcgacgccagcgtgggcagccacagcagcaccgagagcgagcacggcagcagcagccccagattccccagacagaacagcggcagcaccctgaccttcaaccccagcagcatggccgtgagcttcaccagcggcagctgccagaagcagccccaggacgccagccccccccccaaggagtgcgaccagggcaccctgagcgccagcctgaaccccagcaacagcgagagcagccccagcagatgccccagcgaccccgacagcaccagccagcccagaagcggcgacagcgccgacgtggccagagacgtgaagcagcccaccgccacccccagaagctacagaaacttcagacaccccgagatcgtgggctacagcgtgcccggcagaaacggccagagccaggacctggtgaagggctgcgccagaaccgcccaggcccccgaggacagaagcaccgagcccgacggcagcgaggccgagggcaaccaggtgtacttcgccgtgtacaccttcaaggccagaaaccccaacgagctgagcgtgagcgccaaccagaagctgaagatcctggagttcaaggacgtgaccggcaacaccgagtggtggctggccgaggtgaacggcaagaagggctacgtgcccagcaactacatcagaaagaccgagtacacctag

SEQ ID NO: 9980 - DNA, 3186 bp, Artificial Sequence
  Description of Artificial Sequence: Synthetic coding sequence
atgctgagaaccgccggcagagacggcctgtgcagactgagcacctacctggaggagctggaggccgtggagctgaagaagttcaagctgtacctgggcaccgccaccgagctgggcgagggcaagatcccctggggcagcatggagaaggccggccccctggagatggcccagctgctgatcacccacttcggccccgaggaggcctggagactggccctgagcaccttcgagagaatcaacagaaaggacctgtgggagagaggccagagagaggacctggtgagagacaccccccccggcggccccagcagcctgggcaaccagagcacctgcctgctggaggtgagcctggtgacccccagaaaggacccccaggagacctacagagactacgtgagaagaaagttcagactgatggaggacagaaacgccagactgggcgagtgcgtgaacctgagccacagatacaccagactgctgctggtgaaggagcacagcaaccccatgcaggtgcagcagcagctgctggacaccggcagaggccacgccagaaccgtgggccaccaggccagccccatcaagatcgagaccctgttcgagcccgacgaggagagacccgagccccccagaaccgtggtgatgcagggcgccgccggcatcggcaagagcatgctggcccacaaggtgatgctggactgggccgacggcaagctgttccagggcagattcgactacctgttctacatcaactgcagagagatgaaccagagcgccaccgagtgcagcatgcaggacctgatcttcagctgctggcccgagcccagcgcccccctgcaggagctgatcagagtgcccgagagactgctgttcatcatcgacggcttcgacgagctgaagcccagcttccacgacccccagggcccctggtgcctgtgctgggaggagaagagacccaccgagctgctgctgaacagcctgatcagaaagaagctgctgcccgagctgagcctgctgatcaccaccagacccaccgccctggagaagctgcacagactgctggagcaccccagacacgtggagatcctgggcttcagcgaggccgagagaaaggagtacttctacaagtacttccacaacgccgagcaggccggccaggtgttcaactacgtgagagacaacgagcccctgttcaccatgtgcttcgtgcccctggtgtgctgggtggtgtgcacctgcctgcagcagcagctggagggcggcggcctgctgagacagaccagcagaaccaccaccgccgtgtacatgctgtacctgctgagcctgatgcagcccaagcccggcgcccccagactgcagcccccccccaaccagagaggcctgtgcagcctggccgccgacggcctgtggaaccagaagatcctgttcgaggagcaggacctgagaaagcacggcctggacggcgaggacgtgagcgccttcctgaacatgaacatcttccagaaggacatcaactgcgagagatactacagcttcatccacctgagcttccaggagttcttcgccgccatgtactacatcctggacgagggcgagggcggcgccggccccgaccaggacgtgaccagactgctgaccgagtacgccttcagcgagagaagcttcctggccctgaccagcagattcctgttcggcctgctgaacgaggagaccagaagccacctggagaagagcctgtgctggaaggtgagcccccacatcaagatggacctgctgcagtggatccagagcaaggcccagagcgacggcagcaccctgcagcagggcagcctggagttcttcagctgcctgtacgagatccaggaggaggagttcatccagcaggccctgagccacttccaggtgatcgtggtgagcaacatcgccagcaagatggagcacatggtgagcagcttctgcctgaagagatgcagaagcgcccaggtgctgcacctgtacggcgccacctacagcgccgacggcgaggacagagccagatgcagcgccggcgcccacaccctgctggtgcagctgcccgagagaaccgtgctgctggacgcctacagcgagcacctggccgccgccctgtgcaccaaccccaacctgatcgagctgagcctgtacagaaacgccctgggcagcagaggcgtgaagctgctgtgccagggcctgagacaccccaactgcaagctgcagaacctgagactgaagagatgcagaatcagcagcagcgcctgcgaggacctgagcgccgccctgatcgccaacaagaacctgaccagaatggacctgagcggcaacggcgtgggcttccccggcatgatgctgctgtgcgagggcctgagacacccccagtgcagactgcagatgatccagctgagaaagtgccagctggagagcggcgcctgccaggagatggccagcgtgctgggcaccaacccccacctggtggagctggacctgaccggcaacgccctggaggacctgggcctgagactgctgtgccagggcctgagacaccccgtgtgcagactgagaaccctgtggctgaagatctgcagactgaccgccgccgcctgcgacgagctggccagcaccctgagcgtgaaccagagcctgagagagctggacctgagcctgaacgagctgggcgacctgggcgtgctgctgctgtgcgagggcctgagacaccccacctgcaagctgcagaccctgagactgggcatctgcagactgggcagcgccgcctgcgagggcctgagcgtggtgctgcaggccaaccacaacctgagagagctggacctgagcttcaacgacctgggcgactggggcctgtggctgctggccgagggcctgcagcaccccgcctgcagactgcagaagctgtggctggacagctgcggcctgaccgccaaggcctgcgagaacctgtacttcaccctgggcatcaaccagaccctgaccgacctgtacctgaccaacaacgccctgggcgacaccggcgtgagactgctgtgcaagagactgagccaccccggctgcaagctgagagtgctgtggctgttcggcatggacctgaacaagatgacccacagcagactggccgccctgagagtgaccaagccctacctggacatcggctgctag

SEQ ID NO: 9981 - DNA, 3963 bp, Artificial Sequence
  Description of Artificial Sequence: Synthetic coding sequence
atggccaacgacagccccgccaagagcctggtggacatcgacctgagcagcctgagagaccccgccggcatcttcgagctggtggaggtggtgggcaacggcacctacggccaggtgtacaagggcagacacgtgaagaccggccagctggccgccatcaaggtgatggacgtgaccgaggacgaggaggaggagatcaagctggagatcaacatgctgaagaagtacagccaccacagaaacatcgccacctactacggcgccttcatcaagaagagcccccccggccacgacgaccagctgtggctggtgatggagttctgcggcgccggcagcatcaccgacctggtgaagaacaccaagggcaacaccctgaaggaggactggatcgcctacatcagcagagagatcctgagaggcctggcccacctgcacatccaccacgtgatccacagagacatcaagggccagaacgtgctgctgaccgagaacgccgaggtgaagctggtggacttcggcgtgagcgcccagctggacagaaccgtgggcagaagaaacaccttcatcggcaccccctactggatggcccccgaggtgatcgcctgcgacgagaaccccgacgccacctacgactacagaagcgacctgtggagctgcggcatcaccgccatcgagatggccgagggcgccccccccctgtgcgacatgcaccccatgagagccctgttcctgatccccagaaaccccccccccagactgaagagcaagaagtggagcaagaagttcttcagcttcatcgagggctgcctggtgaagaactacatgcagagacccagcaccgagcagctgctgaagcaccccttcatcagagaccagcccaacgagagacaggtgagaatccagctgaaggaccacatcgacagaaccagaaagaagagaggcgagaaggacgagaccgagtacgagtacagcggcagcgaggaggaggaggaggaggtgcccgagcaggagggcgagcccagcagcatcgtgaacgtgcccggcgagagcaccctgagaagagacttcctgagactgcagcaggagaacaaggagagaagcgaggccctgagaagacagcagctgctgcaggagcagcagctgagagagcaggaggagtacaagagacagctgctggccgagagacagaagagaatcgagcagcagaaggagcagagaagaagactggaggagcagcagagaagagagagagaggccagaagacagcaggagagagagcagagaagaagagagcaggaggagaagagaagactggaggagctggagagaagaagaaaggaggaggaggagagaagaagagccgaggaggagaagagaagagtggagagagagcaggagtacatcagaagacagctggaggaggagcagagacacctggaggtgctgcagcagcagctgctgcaggagcaggccatgctgctggagtgcagatggagagagatggaggagcacagacaggccgagagactgcagagacagctgcagcaggagcaggcctacctgctgagcctgcagcacgaccacagaagaccccacccccagcacagccagcagcccccccccccccagcaggagagaagcaagcccagcttccacgcccccgagcccaaggcccactacgagcccgccgacagagccagagaggtggaggacagattcagaaagaccaaccacagcagccccgaggcccagagcaagcagaccggcagagtgctggagccccccgtgcccagcagaagcgagagcttcagcaacggcaacagcgagagcgtgcaccccgccctgcagagacccgccgagccccaggtgcagtggagccacctggccagcctgaagaacaacgtgagccccgtgagcagaagccacagcttcagcgaccccagccccaagttcgcccaccaccacctgagaagccaggacccctgcccccccagcagaagcgaggtgctgagccagagcagcgacagcaagagcgaggcccccgaccccacccagaaggcctggagcagaagcgacagcgacgaggtgccccccagagtgcccgtgagaaccaccagcagaagccccgtgctgagcagaagagacagccccctgcagggcagcggccagcagaacagccaggccggccagagaaacagcaccagcagcatcgagcccagactgctgtgggagagagtggagaagctggtgcccagacccggcagcggcagcagcagcggcagcagcaacagcggcagccagcccggcagccaccccggcagccagagcggcagcggcgagagattcagagtgagaagcagcagcaagagcgagggcagccccagccagagactggagaacgccgtgaagaagcccgaggacaagaaggaggtgttcagacccctgaagcccgccgtgagaatcgacctgaccgccctggccaaggagctgagagccgtggaggacgtgagacccccccacaaggtgaccgactacagcagcagcagcgaggagagcggcaccaccgacgaggaggacgacgacgtggagcaggagggcgccgacgagagcaccagcggccccgaggacaccagagccgccagcagcctgaacctgagcaacggcgagaccgagagcgtgaagaccatgatcgtgcacgacgacgtggagagcgagcccgccatgacccccagcaaggagggcaccctgatcgtgagacagacccagagcgccagcagcaccctgcagaagcacaagagcagcagcagcttcacccccttcatcgaccccagactgctgcagatcagccccagcagcggcaccaccgtgaccagcgtggtgggcttcagctgcgacggcatgagacccgaggccatcagacaggaccccaccagaaagggcagcgtggtgaacgtgaaccccaccaacaccagaccccagagcgacacccccgagatcagaaagtacaagaagagattcaacagcgagatcctgtgcgccgccctgtggggcgtgaacctgctggtgggcaccgagagcggcctgatgctgctggacagaagcggccagggcaaggtgtaccccctgatcaacagaagaagattccagcagatggacgtgctggagggcctgaacgtgctggtgaccatcagcggcaagaaggacaagctgagagtgtactacctgagctggctgagaaacaagatcctgcacaacgaccccgaggtggagaagaagcagggctggaccaccgtgggcgacctggagggctgcgtgcactacaaggtggtgaagtacgagagaatcaagttcctggtgatcgccctgaagagcagcgtggaggtgtacgcctgggcccccaagccctaccacaagttcatggccttcaagagcttcggcgagctggtgcacaagcccctgctggtggacctgaccgtggaggagggccagagactgaaggtgatctacggcagctgcgccggcttccacgccgtggacgtggacagcggcagcgtgtacgacatctacctgcccacccacatccagtgcagcatcaagccccacgccatcatcatcctgcccaacaccgacggcatggagctgctggtgtgctacgaggacgagggcgtgtacgtgaacacctacggcagaatcaccaaggacgtggtgctgcagtggggcgagatgcccaccagcgtggcctacatcagaagcaaccagaccatgggctggggcgagaaggccatcgagatcagaagcgtggagaccggccacctggacggcgtgttcatgcacaagagagcccagagactgaagttcctgtgcgagagaaacgacaaggtgttcttcgccagcgtgagaagcggcggcagcagccaggtgtacttcatgaccctgggcagaaccagcctgctgagctggtag

SEQ ID NO: 9982 - DNA, 606 bp, Artificial Sequence
  Description of Artificial Sequence: Synthetic coding sequence
atgtacaccctgctgagcggcctgtacaagtacatgttccagaaggacgagtactgcatcctgatcctgggcctggacaacgccggcaagaccaccttcctggagcagagcaagaccagattcaacaagaactacaagggcatgagcctgagcaagatcaccaccaccgtgggcctgaacatcggcaccgtggacgtgggcaaggccagactgatgttctgggacctgggcggccaggaggagctgcagagcctgtgggacaagtactacgccgagtgccacggcgtgatctacgtgatcgacagcaccgacgaggagagactggccgagagcaagcaggccttcgagaaggtggtgaccagcgaggccctgtgcggcgtgcccgtgctggtgctggccaacaagcaggacgtggagacctgcctgagcatccccgacatcaagaccgccttcagcgactgcaccagcaagatcggcagaagagactgcctgacccaggcctgcagcgccctgaccggcaagggcgtgagagagggcatcgagtggatggtgaagtgcgtggtgagaaacgtgcacagaccccccagacagagagacatcacctag

SEQ ID NO: 9983 - DNA, 1329 bp, Artificial Sequence
  Description of Artificial Sequence: Synthetic coding sequence
atgagaggcgccatggagctggagcccgagctgctgctgcaggaggccagagagaacgtggaggccgcccagagctacagaagagagctgggccacagactggagggcctgagagaggccagaagacagatcaaggagagcgccagccagaccagagacgtgctgaagcagcacttcaacgacctgaagggcaccctgggcaagctgctggacgagagactggtgaccctgctgcaggaggtggacaccatcgagcaggagaccatcaagcccctggacgactgccagaagctgatcgagcacggcgtgaacaccgccgaggacctggtgagagagggcgagatcgccatgctgggcggcgtgggcgaggagaacgagaagctgtggagcttcaccaagaaggccagccacatccagctggacagcctgcccgaggtgcccctgctggtggacgtgccctgcctgagcgcccagctggacgacagcatcctgaacatcgtgaaggaccacatcttcaagcacggcaccgtggccagcagaccccccgtgcagatcgaggagctgatcgagaagcccggcggcatcatcgtgagatggtgcaaggtggacgacgacttcaccgcccaggactacagactgcagttcagaaagtgcaccagcaaccacttcgaggacgtgtacgtgggcagcgagaccgagttcatcgtgctgcacatcgaccccaacgtggactaccagttcagagtgtgcgccagaggcgacggcagacaggagtggagcccctggagcgtgccccagatcggccacagcaccctggtgccccacgagtggaccgccggcttcgagggctacagcctgagcagcagaagaaacatcgccctgagaaacgacagcgagagcagcggcgtgctgtacagcagagcccccacctacttctgcggccagaccctgaccttcagagtggagaccgtgggccagcccgacagaagagacagcatcggcgtgtgcgccgagaagcaggacggctacgacagcctgcagagagaccaggccgtgtgcatcagcaccaacggcgccgtgttcgtgaacggcaaggagatgaccaaccagctgcccgccgtgaccagcggcagcaccgtgaccttcgacatcgaggccgtgaccctgggcaccaccagcaacaacgagggcggccacttcaagctgagagtgaccatcagcagcaacaacagagaggtggtgttcgactggctgctggaccagagctgcggcagcctgtacttcggctgcagcttcttctaccccggctggaaggtgctggtgttctag

SEQ ID NO: 9984 - DNA, 1428 bp, Artificial Sequence
  Description of Artificial Sequence: Synthetic coding sequence
atggccgccctgaccaccctgttcaagtacatcgacgagaaccaggacagatacatcaagaagctggccaagtgggtggccatccagagcgtgagcgcctggcccgagaagagaggcgagatcagaagaatgatggaggtggccgccgccgacgtgaagcagctgggcggcagcgtggagctggtggacatcggcaagcagaagctgcccgacggcagcgagatccccctgccccccatcctgctgggcagactgggcagcgacccccagaagaagaccgtgtgcatctacggccacctggacgtgcagcccgccgccctggaggacggctgggacagcgagcccttcaccctggtggagagagacggcaagctgtacggcagaggcagcaccgacgacaagggccccgtggccggctggatcaacgccctggaggcctaccagaagaccggccaggagatccccgtgaacgtgagattctgcctggagggcatggaggagagcggcagcgagggcctggacgagctgatcttcgccagaaaggacaccttcttcaaggacgtggactacgtgtgcatcagcgacaactactggctgggcaagaagaagccctgcatcacctacggcctgagaggcatctgctacttcttcatcgaggtggagtgcagcaacaaggacctgcacagcggcgtgtacggcggcagcgtgcacgaggccatgaccgacctgatcctgctgatgggcagcctggtggacaagagaggcaacatcctgatccccggcatcaacgaggccgtggccgccgtgaccgaggaggagcacaagctgtacgacgacatcgacttcgacatcgaggagttcgccaaggacgtgggcgcccagatcctgctgcacagccacaagaaggacatcctgatgcacagatggagataccccagcctgagcctgcacggcatcgagggcgccttcagcggcagcggcgccaagaccgtgatccccagaaaggtggtgggcaagttcagcatcagactggtgcccaacatgacccccgaggtggtgggcgagcaggtgaccagctacctgaccaagaagttcgccgagctgagaagccccaacgagttcaaggtgtacatgggccacggcggcaagccctgggtgagcgacttcagccacccccactacctggccggcagaagagccatgaagaccgtgttcggcgtggagcccgacctgaccagagagggcggcagcatccccgtgaccctgaccttccaggaggccaccggcaagaacgtgatgctgctgcccgtgggcagcgccgacgacggcgcccacagccagaacgagaagctgaacagatacaactacatcgagggcaccaagatgctggccgcctacctgtacgaggtgagccagctgaaggactag

SEQ ID NO: 9985 - DNA, 6291 bp, Artificial Sequence
  Description of Artificial Sequence: Synthetic coding sequence
atggccgaggtgaccgtgcccagagtgtacgtggtgttcggcatccactgcatcatggccaaggccagcagcgacgtgcaggtgagcggcttccacagaaagatccagcacgtgaagaacgagctgtgccacatgctgagcctggaggaggtggcccccgtgctgcagcagaccctgctgcaggacaacctgctgggcagagtgcacttcgaccagttcaaggaggccctgatcctgatcctgagcagaaccctgagcaacgaggagcacttccaggagcccgactgcagcctggaggcccagcccaagtacgtgagaggcggcaagagatacggcagaagaagcctgcccgagttccaggagagcgtggaggagttccccgaggtgaccgtgatcgagcccctggacgaggaggccagacccagccacatccccgccggcgactgcagcgagcactggaagacccagagaagcgaggagtacgaggccgagggccagctgagattctggaaccccgacgacctgaacgccagccagagcggcagcagccccccccaggactggatcgaggagaagctgcaggaggtgtgcgaggacctgggcatcaccagagacggccacctgaacagaaagaagctggtgagcatctgcgagcagtacggcctgcagaacgtggacggcgagatgctggaggaggtgttccacaacctggaccccgacggcaccatgagcgtggaggacttcttctacggcctgttcaagaacggcaagagcctgacccccagcgccagcaccccctacagacagctgaagagacacctgagcatgcagagcttcgacgagagcggcagaagaaccaccaccagcagcgccatgaccagcaccatcggcttcagagtgttcagctgcctggacgacggcatgggccacgccagcgtggagagaatcctggacacctggcaggaggagggcatcgagaacagccaggagatcctgaaggccctggacttcagcctggacggcaacatcaacctgaccgagctgaccctggccctggagaacgagctgctggtgaccaagaacagcatccaccaggccgccctggccagcttcaaggccgagatcagacacctgctggagagagtggaccaggtggtgagagagaaggagaagctgagaagcgacctggacaaggccgagaagctgaagagcctgatggccagcgaggtggacgaccaccacgccgccatcgagagaagaaacgagtacaacctgagaaagctggacgaggagtacaaggagagaatcgccgccctgaagaacgagctgagaaaggagagagagcagatcctgcagcaggccggcaagcagagactggagctggagcaggagatcgagaaggccaagaccgaggagaactacatcagagacagactggccctgagcctgaaggagaacagcagactggagaacgagctgctggagaacgccgagaagctggccgagtacgagaacctgaccaacaagctgcagagaaacctggagaacgtgctggccgagaagttcggcgacctggaccccagcagcgccgagttcttcctgcaggaggagagactgacccagatgagaaacgagtacgagagacagtgcagagtgctgcaggaccaggtggacgagctgcagagcgagctggaggagtacagagcccagggcagagtgctgagactgcccctgaagaacagccccagcgaggaggtggaggccaacagcggcggcatcgagcccgagcacggcctgggcagcgaggagtgcaaccccctgaacatgagcatcgaggccgagctggtgatcgagcagatgaaggagcagcaccacagagacatctgctgcctgagactggagctggaggacaaggtgagacactacgagaagcagctggacgagaccgtggtgagctgcaagaaggcccaggagaacatgaagcagagacacgagaacgagacccacaccctggagaagcagatcagcgacctgaagaacgagatcgccgagctgcagggccaggccgccgtgctgaaggaggcccaccacgaggccacctgcagacacgaggaggagaagaagcagctgcaggtgaagctggaggaggagaagacccacctgcaggagaagctgagactgcagcacgagatggagctgaaggccagactgacccaggcccaggccagcttcgagagagagagagagggcctgcagagcagcgcctggaccgaggagaaggtgagaggcctgacccaggagctggagcagttccaccaggagcagctgaccagcctggtggagaagcacaccctggagaaggaggagctgagaaaggagctgctggagaagcaccagagagagctgcaggagggcagagagaagatggagaccgagtgcaacagaagaaccagccagatcgaggcccagttccagagcgactgccagaaggtgaccgagagatgcgagagcgccctgcagagcctggagggcagatacagacaggagctgaaggacctgcaggagcagcagagagaggagaagagccagtgggagttcgagaaggacgagctgacccaggagtgcgccgaggcccaggagctgctgaaggagaccctgaagagagagaagaccaccagcctggtgctgacccaggagagagagatgctggagaagacctacaaggagcacctgaacagcatggtggtggagagacagcagctgctgcaggacctggaggacctgagaaacgtgagcgagacccagcagagcctgctgagcgaccagatcctggagctgaagagcagccacaagagagagctgagagagagagaggaggtgctgtgccaggccggcgccagcgagcagctggccagccagagactggagagactggagatggagcacgaccaggagagacaggagatgatgagcaagctgctggccatggagaacatccacaaggccacctgcgagaccgccgacagagagagagccgagatgagcaccgagatcagcagactgcagagcaagatcaaggagatgcagcaggccaccagccccctgagcatgctgcagagcggctgccaggtgatcggcgaggaggaggtggagggcgacggcgccctgagcctgctgcagcagggcgagcagctgctggaggagaacggcgacgtgctgctgagcctgcagagagcccacgagcaggccgtgaaggagaacgtgaagatggccaccgagatcagcagactgcagcagagactgcagaagctggagcccggcctggtgatgagcagctgcctggacgagcccgccaccgagttcttcggcaacaccgccgagcagaccgagcagttcctgcagcagaacagaaccaagcaggtggagggcgtgaccagaagacacgtgctgagcgacctggaggacgacgaggtgagagacctgggcagcaccggcaccagcagcgtgcagagacaggaggtgaagatcgaggagagcgaggccagcgtggagggcttcagcgagctggagaacagcgaggagaccagaaccgagagctgggagctgaagaaccagatcagccagctgcaggagcagctgatgatgctgtgcgccgactgcgacagagccagcgagaagaagcaggacctgctgttcgacgtgagcgtgctgaagaagaagctgaagatgctggagagaatccccgaggccagccccaagtacaagctgctgtacgaggacgtgagcagagagaacgactgcctgcaggaggagctgagaatgatggagaccagatacgacgaggccctggagaacaacaaggagctgaccgccgaggtgttcagactgcaggacgagctgaagaagatggaggaggtgaccgagaccttcctgagcctggagaagagctacgacgaggtgaagatcgagaacgagggcctgaacgtgctggtgctgagactgcagggcaagatcgagaagctgcaggagagcgtggtgcagagatgcgactgctgcctgtgggaggccagcctggagaacctggagatcgagcccgacggcaacatcctgcagctgaaccagaccctggaggagtgcgtgcccagagtgagaagcgtgcaccacgtgatcgaggagtgcaagcaggagaaccagtacctggagggcaacacccagctgctggagaaggtgaaggcccacgagatcgcctggctgcacggcaccatccagacccaccaggagagacccagagtgcagaaccaggtgatcctggaggagaacaccaccctgctgggcttccaggacaagcacttccagcaccaggccaccatcgccgagctggagctggagaagaccaagctgcaggagctgaccagaaagctgaaggagagagtgaccatcctggtgaagcagaaggacgtgctgagccacggcgagaaggaggaggagctgaaggccatgatgcacgacctgcagatcacctgcagcgagatgcagcagaaggtggagctgctgagatacgagagcgagaagctgcagcaggagaacagcatcctgagaaacgagatcaccaccctgaacgaggaggacagcatcagcaacctgaagctgggcaccctgaacggcagccaggaggagatgtggcagaagaccgagaccgtgaagcaggagaacgccgccgtgcagaagatggtggagaacctgaagaagcagatcagcgagctgaagatcaagaaccagcagctggacctggagaacaccgagctgagccagaagaacagccagaaccaggagaagctgcaggagctgaaccagagactgaccgagatgctgtgccagaaggagaaggagcccggcaacagcgccctggaggagagagagcaggagaagttcaacctgaaggaggagctggagagatgcaaggtgcagagcagcaccctggtgagcagcctggaggccgagctgagcgaggtgaagatccagacccacatcgtgcagcaggagaaccacctgctgaaggacgagctggagaagatgaagcagctgcacagatgccccgacctgagcgacttccagcagaagatcagcagcgtgctgagctacaacgagaagctgctgaaggagaaggaggccctgagcgaggagctgaacagctgcgtggacaagctggccaagagcagcctgctggagcacagaatcgccaccatgaagcaggagcagaagagctgggagcaccagagcgccagcctgaagagccagctggtggccagccaggagaaggtgcagaacctggaggacaccgtgcagaacgtgaacctgcagatgagcagaatgaagagcgacctgagagtgacccagcaggagaaggaggccctgaagcaggaggtgatgagcctgcacaagcagctgcagaacgccggcggcaagagctgggcccccgagatcgccacccaccccagcggcctgcacaaccagcagaagagactgagctgggacaagctggaccacctgatgaacgaggagcagcagctgctgtggcaggagaacgagagactgcagaccatggtgcagaacaccaaggccgagctgacccacagcagagagaaggtgagacagctggagagcaacctgctgcccaagcaccagaagcacctgaaccccagcggcaccatgaaccccaccgagcaggagaagctgagcctgaagagagagtgcgaccagttccagaaggagcagagccccgccaacagaaaggtgagccagatgaacagcctggagcaggagctggagaccatccacctggagaacgagggcctgaagaagaagcaggtgaagctggacgagcagctgatggagatgcagcacctgagaagcaccgccacccccagccccagcccccacgcctgggacctgcagctgctgcagcagcaggcctgccccatggtgcccagagagcagttcctgcagctgcagagacagctgctgcaggccgagagaatcaaccagcacctgcaggaggagctggagaacagaaccagcgagaccaacaccccccagggcaaccaggagcagctggtgaccgtgatggaggagagaatgatcgaggtggagcagaagctgaagctggtgaagagactgctgcaggagaaggtgaaccagctgaaggagcaggtgagcctgcccggccacctgtgcagccccaccagccacagcagcttcaacagcagcttcaccagcctgtactgccactag

SEQ ID NO: 9986 - DNA, 1176 bp, Artificial Sequence
  Description of Artificial Sequence: Synthetic coding sequence
atggccgccctgaccaccctgttcaagtacatcgacgagaaccaggacagatacatcaagaagctggccaagtgggtggccatccagagcgtgagcgcctggcccgagaagagaggcgagatcagaagaatgatggaggtggccgccgccgacgtgaagcagctgggcggcagcgtggagctggtggacatcggcaagcagaaggagatccccgtgaacgtgagattctgcctggagggcatggaggagagcggcagcgagggcctggacgagctgatcttcgccagaaaggacaccttcttcaaggacgtggactacgtgtgcatcagcgacaactactggctgggcaagaagaagccctgcatcacctacggcctgagaggcatctgctacttcttcatcgaggtggagtgcagcaacaaggacctgcacagcggcgtgtacggcggcagcgtgcacgaggccatgaccgacctgatcctgctgatgggcagcctggtggacaagagaggcaacatcctgatccccggcatcaacgaggccgtggccgccgtgaccgaggaggagcacaagctgtacgacgacatcgacttcgacatcgaggagttcgccaaggacgtgggcgcccagatcctgctgcacagccacaagaaggacatcctgatgcacagatggagataccccagcctgagcctgcacggcatcgagggcgccttcagcggcagcggcgccaagaccgtgatccccagaaaggtggtgggcaagttcagcatcagactggtgcccaacatgacccccgaggtggtgggcgagcaggtgaccagctacctgaccaagaagttcgccgagctgagaagccccaacgagttcaaggtgtacatgggccacggcggcaagccctgggtgagcgacttcagccacccccactacctggccggcagaagagccatgaagaccgtgttcggcgtggagcccgacctgaccagagagggcggcagcatccccgtgaccctgaccttccaggaggccaccggcaagaacgtgatgctgctgcccgtgggcagcgccgacgacggcgcccacagccagaacgagaagctgaacagatacaactacatcgagggcaccaagatgctggccgcctacctgtacgaggtgagccagctgaaggactag

SEQ ID NO: 9987 - DNA, 5970 bp, Artificial Sequence
  Description of Artificial Sequence: Synthetic coding sequence
atggacgaggtggagcaggaccagcacgaggccagactgaaggagctgttcgacagcttcgacaccaccggcaccggcagcctgggccaggaggagctgaccgacctgtgccacatgctgagcctggaggaggtggcccccgtgctgcagcagaccctgctgcaggacaacctgctgggcagagtgcacttcgaccagttcaaggaggccctgatcctgatcctgagcagaaccctgagcaacgaggagcacttccaggagcccgactgcagcctggaggcccagcccaagtacgtgagaggcggcaagagatacggcagaagaagcctgcccgagttccaggagagcgtggaggagttccccgaggtgaccgtgatcgagcccctggacgaggaggccagacccagccacatccccgccggcgactgcagcgagcactggaagacccagagaagcgaggagtacgaggccgagggccagctgagattctggaaccccgacgacctgaacgccagccagagcggcagcagccccccccaggactggatcgaggagaagctgcaggaggtgtgcgaggacctgggcatcaccagagacggccacctgaacagaaagaagctggtgagcatctgcgagcagtacggcctgcagaacgtggacggcgagatgctggaggaggtgttccacaacctggaccccgacggcaccatgagcgtggaggacttcttctacggcctgttcaagaacggcaagagcctgacccccagcgccagcaccccctacagacagctgaagagacacctgagcatgcagagcttcgacgagagcggcagaagaaccaccaccagcagcgccatgaccagcaccatcggcttcagagtgttcagctgcctggacgacggcatgggccacgccagcgtggagagaatcctggacacctggcaggaggagggcatcgagaacagccaggagatcctgaaggccctggacttcagcctggacggcaacatcaacctgaccgagctgaccctggccctggagaacgagctgctggtgaccaagaacagcatccaccaggccgccctggccagcttcaaggccgagatcagacacctgctggagagagtggaccaggtggtgagagagaaggagaagctgagaagcgacctggacaaggccgagaagctgaagagcctgatggccagcgaggtggacgaccaccacgccgccatcgagagaagaaacgagtacaacctgagaaagctggacgaggagtacaaggagagaatcgccgccctgaagaacgagctgagaaaggagagagagcagatcctgcagcaggccggcaagcagagactggagctggagcaggagatcgagaaggccaagaccgaggagaactacatcagagacagactggccctgagcctgaaggagaacagcagactggagaacgagctgctggagaacgccgagaagctggccgagtacgagaacctgaccaacaagctgcagagaaacctggagaacgtgctggccgagaagttcggcgacctggaccccagcagcgccgagttcttcctgcaggaggagagactgacccagatgagaaacgagtacgagagacagtgcagagtgctgcaggaccaggtggacgagctgcagagcgagctggaggagtacagagcccagggcagagtgctgagactgcccctgaagaacagccccagcgaggaggtggaggccaacagcggcggcatcgagcccgagcacggcctgggcagcgaggagtgcaaccccctgaacatgagcatcgaggccgagctggtgatcgagcagatgaaggagcagcaccacagagacatctgctgcctgagactggagctggaggacaaggtgagacactacgagaagcagctggacgagaccgtggtgagctgcaagaaggcccaggagaacatgaagcagagacacgagaacgagacccacaccctggagaagcagatcagcgacctgaagaacgagatcgccgagctgcagggccaggccgccgtgctgaaggaggcccaccacgaggccacctgcagacacgaggaggagaagaagcagctgcaggtgaagctggaggaggagaagacccacctgcaggagaagctgagactgcagcacgagatggagctgaaggccagactgacccaggcccaggccagcttcgagagagagagagagggcctgcagagcagcgcctggaccgaggagaaggtgagaggcctgacccaggagctggagcagttccaccaggagcagctgaccagcctggtggagaagcacaccctggagaaggaggagctgagaaaggagctgctggagaagcaccagagagagctgcaggagggcagagagaagatggagaccgagtgcaacagaagaaccagccagatcgaggcccagttccagagcgactgccagaaggtgaccgagagatgcgagagcgccctgcagagcctggagggcagatacagacaggagctgaaggacctgcaggagcagcagagagaggagaagagccagtgggagttcgagaaggacgagctgacccaggagtgcgccgaggcccaggagctgctgaaggagaccctgaagagagagaagaccaccagcctggtgctgacccaggagagagagatgctggagaagacctacaaggagcacctgaacagcatggtggtggagagacagcagctgctgcaggacctggaggacctgagaaacgtgagcgagacccagcagagcctgctgagcgaccagatcctggagctgaagagcagccacaagagagagctgagagagagagaggaggtgctgtgccaggccggcgccagcgagcagctggccagccagagactggagagactggagatggagcacgaccaggagagacaggagatgatgagcaagctgctggccatggagaacatccacaaggccacctgcgagaccgccgacagagagagagccgagatgagcaccgagatcagcagactgcagagcaagatcaaggagatgcagcaggccaccagccccctgagcatgctgcagagcggctgccaggtgatcggcgaggaggaggtggagggcgacggcgccctgagcctgctgcagcagggcgagcagctgctggaggagaacggcgacgtgctgctgagcctgcagagagcccacgagcaggccgtgaaggagaacgtgaagatggccaccgagatcagcagactgcagcagagactgcagaagctggagcccggcctggtgatgagcagctgcctggacgagcccgccaccgagttcttcggcaacaccgccgagcagaccgagcagttcctgcagcagaacagaaccaagcaggtggagggcgtgaccagaagacacgtgctgagcgacctggaggacgacgaggtgagagacctgggcagcaccggcaccagcagcgtgcagagacaggaggtgaagatcgaggagagcgaggccagcgtggagggcttcagcgagctggagaacagcgaggagaccagaaccgagagctgggagctgaagaaccagatcagccagctgcaggagcagctgatgatgctgtgcgccgactgcgacagagccagcgagaagaagcaggacctgctgttcgacgtgagcgtgctgaagaagaagctgaagatgctggagagaatccccgaggccagccccaagtacaagctgctgtacgaggacgtgagcagagagaacgactgcctgcaggaggagctgagaatgatggagaccagatacgacgaggccctggagaacaacaaggagctgaccgccgaggtgttcagactgcaggacgagctgaagaagatggaggaggtgaccgagaccttcctgagcctggagaagagctacgacgaggtgaagatcgagaacgagggcctgaacgtgctggtgctgagactgcagggcaagatcgagaagctgcaggagagcgtggtgcagagatgcgactgctgcctgtgggaggccagcctggagaacctggagatcgagcccgacggcaacatcctgcagctgaaccagaccctggaggagtgcgtgcccagagtgagaagcgtgcaccacgtgatcgaggagtgcaagcaggagaaccagtacctggagggcaacacccagctgctggagaaggtgaaggcccacgagatcgcctggctgcacggcaccatccagacccaccaggagagacccagagtgcagaaccaggtgatcctggaggagaacaccaccctgctgggcttccaggacaagcacttccagcaccaggccaccatcgccgagctggagctggagaagaccaagctgcaggagctgaccagaaagctgaaggagagagtgaccatcctggtgaagcagaaggacgtgctgagccacggcgagaaggaggaggagctgaaggccatgatgcacgacctgcagatcacctgcagcgagatgcagcagaaggtggagctgctgagatacgagagcgagaagctgcagcaggagaacagcatcctgagaaacgagatcaccaccctgaacgaggaggacagcatcagcaacctgaagctgggcaccctgaacggcagccaggaggagatgtggcagaagaccgagaccgtgaagcaggagaacgccgccgtgcagaagatggtggagaacctgaagaagcagatcagcgagctgaagatcaagaaccagcagctggacctggagaacaccgagctgagccagaagaacagccagaaccaggagaagctgcaggagctgaaccagagactgaccgagatgctgtgccagaaggagaaggagcccggcaacagcgccctggaggagagagagcaggagaagttcaacctgaaggaggagctggagagatgcaaggtgcagagcagcaccctggtgagcagcctggaggccgagctgagcgaggtgaagatccagacccacatcgtgcagcaggagaaccacctgctgaaggacgagctggagaagatgaagcagctgcacagatgccccgacctgagcgacttccagcagaagatcagcagcgtgctgagctacaacgagaagctgctgaaggagaaggaggccctgagcgaggagctgaacagctgcgtggacaagctggccaagagcagcctgctggagcacagaatcgccaccatgaagcaggagcagaagagctgggagcaccagagcgccagcctgaagagccagctggtggccagccaggagaaggtgcagaacctggaggacaccgtgcagaacgtgaacctgcagatgagcagaatgaagagcgacctgagagtgacccagcaggagaaggaggccctgaagcaggaggtgatgagcctgcacaagcagctgcagaacgccggcggcaagagctgggcccccgagatcgccacccaccccagcggcctgcacaaccagcagaagagactgagctgggacaagctggaccacctgatgaacgaggagcagcagctgctgtggcaggagaacgagagactgcagaccatggtgcagaacaccaaggccgagctgacccacagcagagagaaggtgagacagctggagagcaacctgctgcccaagcaccagaagcacctgaaccccagcggcaccatgaaccccaccgagcaggagaagctgagcctgaagagagagtgcgaccagttccagaaggagcagagccccgccaacagaaaggtgagccagatgaacagcctggagcaggagctggagaccatccacctggagaacgagggcctgaagaagaagcaggtgaagctggacgagcagctgatggagaacagcgtggtgggcagcagcagagagggctgcagcagcctgcccgagatcgtgtgcgaggacgccgcccccgaggtgcactgcgacgcctag

SEQ ID NO: 9988 - DNA, 915 bp, Artificial Sequence
  Description of Artificial Sequence: Synthetic coding sequence
atgggccagtgcgtgaccaagtgcaagaaccccagcagcaccctgggcagcaagaacggcgacagagagcccagcaacaagagccacagcagaagaggcgccggccacagagaggagcaggtgcccccctgcggcaagcccggcggcgacatcctggtgaacggcaccaagaaggccgaggccgccaccgaggcctgccagctgcccaccagcagcggcgacgccggcagagagagcaagagcaacgccgaggagagcagcctgcagagactggaggagctgttcagaagatacaaggacgagagagaggacgccatcctggaggagggcatggagagattctgcaacgacctgtgcgtggaccccaccgagttcagagtgctgctgctggcctggaagttccaggccgccaccatgtgcaagttcaccagaaaggagttcttcgacggctgcaaggccatcagcgccgacagcatcgacggcatctgcgccagattccccagcctgctgaccgaggccaagcaggaggacaagttcaaggacctgtacagattcaccttccagttcggcctggacagcgaggagggccagagaagcctgcacagagagatcgccatcgccctgtggaagctggtgttcacccagaacaacccccccgtgctggaccagtggctgaacttcctgaccgagaaccccagcggcatcaagggcatcagcagagacacctggaacatgttcctgaacttcacccaggtgatcggccccgacctgagcaactacagcgaggacgaggcctggcccagcctgttcgacaccttcgtggagtgggagatggagagaagaaagagagagggcgagggcagaggcgccctgagcagcggccccgagggcctgtgccccgaggagcagacctag

SEQ ID NO: 9989 - DNA, 1914 bp, Artificial Sequence
  Description of Artificial Sequence: Synthetic coding sequence
atggccgccatggccgtgggcggcgccggcggcagcagagtgagcagcggcagagacctgaactgcgtgcccgagatcgccgacaccctgggcgccgtggccaagcagggcttcgacttcctgtgcatgcccgtgttccaccccagattcaagagagagttcatccaggagcccgccaagaacagacccggcccccagaccagaagcgacctgctgctgagcggcagagactggaacaccctgatcgtgggcaagctgagcccctggatcagacccgacagcaaggtggagaagatcagaagaaacagcgaggccgccatgctgcaggagctgaacttcggcgcctacctgggcctgcccgccttcctgctgcccctgaaccaggaggacaacaccaacctggccagagtgctgaccaaccacatccacaccggccaccacagcagcatgttctggatgagagtgcccctggtggcccccgaggacctgagagacgacatcatcgagaacgcccccaccacccacaccgaggagtacagcggcgaggagaagacctggatgtggtggcacaacttcagaaccctgtgcgactacagcaagagaatcgccgtggccctggagatcggcgccgacctgcccagcaaccacgtgatcgacagatggctgggcgagcccatcaaggccgccatcctgcccaccagcatcttcctgaccaacaagaagggcttccccgtgctgagcaagatgcaccagagactgatcttcagactgctgaagctggaggtgcagttcatcatcaccggcaccaaccaccacagcgagaaggagttctgcagctacctgcagtacctggagtacctgagccagaacagacccccccccaacgcctacgagctgttcgccaagggctacgaggactacctgcagagccccctgcagcccctgatggacaacctggagagccagacctacgaggtgttcgagaaggaccccatcaagtacagccagtaccagcaggccatctacaagtgcctgctggacagagtgcccgaggaggagaaggacaccaacgtgcaggtgctgatggtgctgggcgccggcagaggccccctggtgaacgccagcctgagagccgccaagcaggccgacagaagaatcaagctgtacgccgtggagaagaaccccaacgccgtggtgaccctggagaactggcagttcgaggagtggggcagccaggtgaccgtggtgagcagcgacatgagagagtgggtggcccccgagaaggccgacatcatcgtgagcgagctgctgggcagcttcgccgacaacgagctgagccccgagtgcctggacggcgcccagcacttcctgaaggacgacggcgtgagcatccccggcgagtacaccagcttcctggcccccatcagcagcagcaagctgtacaacgaggtgagagcctgcagagagaaggacagagaccccgaggcccagttcgagatgccctacgtggtgagactgcacaacttccaccagctgagcgccccccagccctgcttcaccttcagccaccccaacagagaccccatgatcgacaacaacagatactgcaccctggagttccccgtggaggtgaacaccgtgctgcacggcttcgccggctacttcgagaccgtgctgtaccaggacatcaccctgagcatcagacccgagacccacagccccggcatgttcagctggttccccatcctgttccccatcaagcagcccatcaccgtgagagagggccagaccatctgcgtgagattctggagatgcagcaacagcaagaaggtgtggtacgagtgggccgtgaccgcccccgtgtgcagcgccatccacaaccccaccggcagaagctacaccatcggcctgtag

SEQ ID NO: 9990 - DNA, 1041 bp, Artificial Sequence
  Description of Artificial Sequence: Synthetic coding sequence
atggcccccggcagcgtgaccagcgacatcagccccagcagcaccagcaccgccggcagcagcagaagccccgagagcgagaagcccggccccagccacggcggcgtgccccccggcggccccagccacagcagcctgcccgtgggcagaagacacccccccgtgctgagaatggtgctggaggccctgcaggccggcgagcagagaagaggcaccagcgtggccgccatcaagctgtacatcctgcacaagtaccccaccgtggacgtgctgagattcaagtacctgctgaagcaggccctggccaccggcatgagaagaggcctgctggccagacccctgaacagcaaggccagaggcgccaccggcagcttcaagctggtgcccaagcacaagaagaagatccagcccagaaagatggcccccgccaccgcccccagaagagccggcgaggccaagggcaagggccccaagaagcccagcgaggccaaggaggacccccccaacgtgggcaaggtgaagaaggccgccaagagacccgccaaggtgcagaagcccccccccaagcccggcgccgccaccgagaaggccagaaagcagggcggcgccgccaaggacaccagagcccagagcggcgaggccagaaaggtgccccccaagcccgacaaggccatgagagcccccagcagcgccggcggcctgagcagaaaggccaaggccaagggcagcagaagcagccagggcgacgccgaggcctacagaaagaccaaggccgagagcaagagcagcaagcccaccgccagcaaggtgaagaacggcgccgccagccccaccaagaagaaggtggtggccaaggccaaggcccccaaggccggccagggccccaacaccaaggccgccgcccccgccaagggcagcggcagcaaggtggtgcccgcccacctgagcagaaagaccgaggcccccaagggccccagaaaggccggcctgcccatcaaggccagcagcagcaaggtgagcagccagagagccgaggcctag

SEQ ID NO: 9991 - DNA, 1869 bp, Artificial Sequence
  Description of Artificial Sequence: Synthetic coding sequence
atggccatggcccccagccccagcctggtgcaggtgtacaccagccccgccgccgtggccgtgtgggagtggcaggacggcctgggcacctggcacccctacagcgccaccgtgtgcagcttcatcgagcagcagttcgtgcagcagaagggccagagattcggcctgggcagcctggcccacagcatccccctgggccaggccgaccccagcctggccccctacatcatcgacctgcccagctggacccagttcagacaggacaccggcaccatgagagccgtgagaagacacctgttcccccagcacagcgcccccggcagaggcgtggtgtgggagtggctgagcgacgacggcagctggaccgcctacgaggccagcgtgtgcgactacctggagcagcaggtggccagaggcaaccagctggtggacctggcccccctgggctacaactacaccgtgaactacaccacccacacccagaccaacaagaccagcagcttctgcagaagcgtgagaagacaggccggccccccctaccccgtgaccaccatcatcgccccccccggccacaccggcgtggcctgcagctgccaccagtgcctgagcggcagcagaaccggccccgtgagcggcagatacagacacagcatgaccaacctgcccgcctaccccgtgccccagcaccccccccacagaaccgccagcgtgttcggcacccaccaggccttcgccccctacaacaagcccagcctgagcggcgccagaagcgcccccagactgaacaccaccaacgcctggggcgccgccccccccagcctgggcagccagcccctgtacagaagcagcctgagccacctgggcccccagcacctgccccccggcagcagcaccagcggcgccgtgagcgccagcctgcccagcggccccagcagcagccccggcagcgtgcccgccaccgtgcccatgcagatgcccaagcccagcagagtgcagcaggccctggccggcatgaccagcgtgctgatgagcgccatcggcctgcccgtgtgcctgagcagagccccccagcccaccagcccccccgccagcagactggccagcaagagccacggcagcgtgaagagactgagaaagatgagcgtgaagggcgccacccccaagcccgagcccgagcccgagcaggtgatcaagaactacaccgaggagctgaaggtgccccccgacgaggactgcatcatctgcatggagaagctgagcaccgccagcggctacagcgacgtgaccgacagcaaggccatcggcagcctggccgtgggccacctgaccaagtgcagccacgccttccacctgctgtgcctgctggccatgtactgcaacggcaacaaggacggcagcctgcagtgccccagctgcaagaccatctacggcgagaagaccggcacccagccccagggcaagatggaggtgctgagattccagatgagcctgcccggccacgaggactgcggcaccatcctgatcgtgtacagcatcccccacggcatccagggccccgagcaccccaaccccggcaagcccttcaccgccagaggcttccccagacagtgctacctgcccgacaacgcccagggcagaaaggtgctggagctgctgaaggtggcctggaagagaagactgatcttcaccgtgggcaccagcagcaccaccggcgagaccgacaccgtggtgtggaacgagatccaccacaagaccgagatggacagaaacatcaccggccacggctaccccgaccccaactacctgcagaacgtgctggccgagctggccgcccagggcgtgaccgaggactgcctggagcagcagtag

SEQ ID NO: 9992 - DNA, 786 bp, Artificial Sequence
  Description of Artificial Sequence: Synthetic coding sequence
atggccgccaccgccagagaggacggcgccagcggccaggagagaggccagagaggctgcgagcactacgacagaggctgcctgctgaaggccccctgctgcgacaagctgtacacctgcagactgtgccacgacaacaacgaggaccaccagctggacagattcaaggtgaaggaggtgcagtgcatcaactgcgagaagatccagcacgcccagcagacctgcgaggagtgcagcaccctgttcggcgagtactactgcgacatctgccacctgttcgacaaggacaagaagcagtaccactgcgagaactgcggcatctgcagaatcggccccaaggaggacttcttccactgcctgaagtgcaacctgtgcctggccatgaacctgcagggcagacacaagtgcatcgagaacgtgagcagacagaactgccccatctgcctggaggacatccacaccagcagagtggtggcccacgtgctgccctgcggccacctgctgcacagaacctgctacgaggagatgctgaaggagggctacagatgccccctgtgcatgcacagcgccctggacatgaccagatactggagacagctggacgacgaggtggcccagacccccatgcccagcgagtaccagaacatgaccgtggacatcctgtgcaacgactgcaacggcagaagcaccgtgcagttccacatcctgggcatgaagtgcaagatctgcgagagctacaacaccgcccaggccggcggcagaagaatcagcctggaccagcagtag

SEQ ID NO: 9993 - DNA, 1983 bp, Artificial Sequence
  Description of Artificial Sequence: Synthetic coding sequence
ctgagcctgcccagcgtgacctacctgctgctggaggtgatccccgacagcatgagaaagcaggaggtgagaaccggcagagaggccggccagggccacggcaccggcagccccgccgagcaggtgaaggccctgatggacctgctggccggcaagggcagccagggcagccaggccccccaggccctggacagaacccccgacgcccccctgggcccctgcagcaacgacagcagaatccagagacacagaaaggccctgctgagcaaggtggaggccaccagaggcggcggccaccccgccagaaccgtggccctggacagactgttcctgcccctgagcagagtgagcgtgccccccagagtgagcatcaccatcggcgtggccggcatgggcaagaccaccctggtgagacacttcgtgagactgtgggcccacggccaggtgggcaaggacttcagcctggtgctgcccctgaccttcagagacctgaacacccacgagaagctgtgcgccgacagactgatctgcagcgtgttcccccacgtgggcgagcccagcctggccgtggccgtgcccgccagagccctgctgatcctggacggcctggacgagtgcagaacccccctggacttcagcaacaccgtggcctgcaccgaccccaagaaggagatccccgtggaccacctgatcaccaacatcatcagaggcaacctgttccccgaggtgagcatctggatcaccagcagacccagcgccagcggccagatccccggcggcctggtggacagaatgaccgagatcagaggcttcaacgaggaggagatcaaggtgtgcctggagcagatgttccccgaggaccaggccctgctgggctggatgctgagccaggtgcaggccgacagagccctgtacctgatgtgcaccgtgcccgccttctgcagactgaccggcatggccctgggccacctgtggagaagcagaaccggcccccaggacgccgagctgtggccccccagaaccctgtgcgagctgtacagctggtacttcagaatggccctgagcggcgagggccaggagaagggcaaggccagccccagaatcgagcaggtggcccacggcggcagaaagatggtgggcaccctgggcagactggccttccacggcctgctgaagaagaagtacgtgttctacgagcaggacatgaaggccttcggcgtggacctggccctgctgcagggcgccccctgcagctgcttcctgcagagagaggagaccctggccagcagcgtggcctactgcttcacccacctgagcctgcaggagttcgtggccgccgcctactactacggcgccagcagaagagccatcttcgacctgttcaccgagagcggcgtgagctggcccagactgggcttcctgacccacttcagaagcgccgcccagagagccatgcaggccgaggacggcagactggacgtgttcctgagattcctgagcggcctgctgagccccagagtgaacgccctgctggccggcagcctgctggcccagggcgagcaccaggcctacagaacccaggtggccgagctgctgcagggctgcctgagacccgacgccgccgtgtgcgccagagccatcaacgtgctgcactgcctgcacgagctgcagcacaccgagctggccagaagcgtggaggaggccatggagagcggcgccctggccagactgaccggccccgcccacagagccgccctggcctacctgctgcaggtgagcgacgcctgcgcccaggaggccaacctgagcctgagcctgagccagggcgtgctgcagagcctgctgccccagctgctgtactgcagaaagctgagatggatccccggccagggcgccggcgccggcgagggcgccgaggagagagccgaggccgtgcccagccccccccccagcttcagcgtgagcctgctgggcctgccctag

SEQ ID NO: 9994 - DNA, 1152 bp, Artificial Sequence
  Description of Artificial Sequence: Synthetic coding sequence
atgctgagcagaaagaagaccaagaacgaggtgagcaagcccgccgaggtgcagggcaagtacgtgaagaaggagaccagccccctgctgagaaacctgatgcccagcttcatcagacacggccccaccatccccagaagaaccgacatctgcctgcccgacagcagccccaacgccttcagcaccagcggcgacgtggtgagcagaaaccagagcttcctgagaacccccatccagagaaccccccacgagatcatgagaagagagagcaacagactgagcgcccccagctacctggccagaagcctggccgacgtgcccagagagtacggcagcagccagagcttcgtgaccgaggtgagcttcgccgtggagaacggcgacagcggcagcagatactactacagcgacaacttcttcgacggccagagaaagagacccctgggcgacagagcccacgaggactacagatactacgagtacaaccacgacctgttccagagaatgccccagaaccagggcagacacgccagcggcatcggcagagtggccgccaccagcctgggcaacctgaccaaccacggcagcgaggacctgcccctgccccccggctggagcgtggactggaccatgagaggcagaaagtactacatcgaccacaacaccaacaccacccactggagccaccccctggagagagagggcctgccccccggctgggagagagtggagagcagcgagttcggcacctactacgtggaccacaccaacaagaaggcccagtacagacacccctgcgcccccagcgtgcccagatacgaccagcccccccccgtgacctaccagccccagcagaccgagagaaaccagagcctgctggtgcccgccaacccctaccacaccgccgagatccccgactggctgcaggtgtacgccagagcccccgtgaagtacgaccacatcctgaagtgggagctgttccagctggccgacctggacacctaccagggcatgctgaagctgctgttcatgaaggagctggagcagatcgtgaagatgtacgaggcctacagacaggccctgctgaccgagctggagaacagaaagcagagacagcagtggtacgcccagcagcacggcaagaacttctag

SEQ ID NO: 9995 - DNA, 2376 bp, Artificial Sequence
  Description of Artificial Sequence: Synthetic coding sequence
atgagcaaccagcaggagaagtacgaggcccagaacatcgtgaacagcaccgaggagagcgacgacgccttcgacaccgtgaccatccccgtgcccagcgaggagccccaggagagcgaccagaccgaggagcacgagagcggcatcgagcagttcagcgagagccacgccatccacgtggaggagcagagcgaccagagcttcagcagcctggagcccgacaacgagcagctgatggaggaggtgatcagccccagacaggtgagctacaccccccagcaccacgagaagcagtacgccatgcagagacccaacgacgacagcctggccttcctggacaagatcaagagcgtgaaggagagcctgcaggagagcgtggaggacagcctggccaccgtgaaggtggtgctgatccccgtgggccaggagatcgtgatccccttcaaggtggacaccatcctgaagtacctgaaggaccacttcagccacctgctgggcatcccccacagcgtgctgcagatcagatacagcggcaagatcctgaagaacaacgagaccctggtgcagcacggcgtgaagccccaggagatcgtgcaggtggagatcttcagcaccaaccccgacctgtaccccgtgagaagaatcgacggcctgaccgacgtgagccagatcatcaccgtgaccgtgcagaccggcctggaccagtaccagcaggtgcccgtggagatcgtgaagagcgacttccacaagcccttcctgggcggcttcagacacaaggtgaccggcgtggagtaccacaacgccggcacccagaccgtgcccaagagaatccccgagagactgagcatcttctgcagagacacccagaccgtgttccagaagaagaacctgcagcagaccaccaacaccaccagcacccagatgaccaacatcggcgtgtacgtgagcaacatgaccgacaagctggtgacccccggcaagtacttcagcgccgccgagtaccacgcccagagactgaaggccgtgatcgtgatccagacctactacagacagtggcacgccaagatcttcgtggagaacctgagaagacagaagagcctgagactggagtgggagacccagcaggagctgagaaagatcagagagaaggaggagtggatcaagctggactaccacagaagacacaaccccaagaccaacgaggacttcgagttcctgtacaacgccctggagttctggagacaggaggagctgaccagaatcaaccagagcttcaccggcgccgagagaaaggccgccctgtgcgagctgctggagaaggagacccagatcatcgccagcatcggcagacacagatacatcgcctacatggccaaccaggaggccgccatccaggccttcctggacaagtgcagcgcccccaagatctggagaacccccaacggcaagaccatcgagatggacacccagttcaccatcagagccagagagctgcagaacatctacaagtgcatcatgctgaagaacatcagccaggacgagagactggacgtgctgctgaccctgaagcacaccgtgaaggagcacgagtgcaagctgacccaggagatcctggagctgatcgacagagaggtggacctgatgatgagaggcgtgaagcaccacaacctggagggcctgagaaagagaatcgccaccctgttcttccactacatcaagacccccctgttcaaccccgaggtggccaagtacctgaaggtgccccaggaccccctgaagttctacaagaagatctacttctgccacagctgccagctgtacctgcccagcaccgagttcagcgtgagcagcaccagcagaagaatctacagatgcagaaactgcatcaacctgcagaacgaggcccagaagagagagagcttcctgaagtacaagtgcctgctgcagcagctgtactacaccgaggccgactacgaggacgacagcaagatcgccttcctgatgcagctgcaggacatccagtacctgaccgagaacatctgggccagccagagcgtgctgagcgcctgcgacaacctgagcgacctggtgatggtgagatggaacaagagcctggagtggagcccctggaactgcatcctgctgaccaaggacgaggccgccgcccacctgaagctgaccagcatcgaggagggctacgagagaagcttcatccacaagatcaagcacaagcacatcctggccaagaactacttcagccaggtgcccgtgctggccagcttcatcctggacgacggcgagatcgacgagatcagatggaagtaccacagcgacaccacccccaagatcatcgagagccagagacccccccactag

SEQ ID NO: 9996 - DNA, 1767 bp, Artificial Sequence
  Description of Artificial Sequence: Synthetic coding sequence
atgagcagctgcgtgagcagccagcccagcagcaacagagccgccccccaggacgagctgggcggcagaggcagcagcagcagcgagagccagaagccctgcgaggccctgagaggcctgagcagcctgagcatccacctgggcatggagagcttcatcgtggtgaccgagtgcgagcccggctgcgccgtggacctgggcctggccagagacagacccctggaggccgacggccaggaggtgcccctggacaccagcggcagccaggccagaccccacctgagcggcagaaagctgagcctgcaggagagaagccagggcggcctggccgccggcggcagcctggacatgaacggcagatgcatctgccccagcctgccctacagccccgtgagcagcccccagagcagccccagactgcccagaagacccaccgtggagagccaccacgtgagcatcaccggcatgcaggactgcgtgcagctgaaccagtacaccctgaaggacgagatcggcaagggcagctacggcgtggtgaagctggcctacaacgagaacgacaacacctactacgccatgaaggtgctgagcaagaagaagctgatcagacaggccggcttccccagaagacccccccccagaggcaccagacccgcccccggcggctgcatccagcccagaggccccatcgagcaggtgtaccaggagatcgccatcctgaagaagctggaccaccccaacgtggtgaagctggtggaggtgctggacgaccccaacgaggaccacctgtacatggtgttcgagctggtgaaccagggccccgtgatggaggtgcccaccctgaagcccctgagcgaggaccaggccagattctacttccaggacctgatcaagggcatcgagtacctgcactaccagaagatcatccacagagacatcaagcccagcaacctgctggtgggcgaggacggccacatcaagatcgccgacttcggcgtgagcaacgagttcaagggcagcgacgccctgctgagcaacaccgtgggcacccccgccttcatggcccccgagagcctgagcgagaccagaaagatcttcagcggcaaggccctggacgtgtgggccatgggcgtgaccctgtactgcttcgtgttcggccagtgccccttcatggacgagagaatcatgtgcctgcacagcaagatcaagagccaggccctggagttccccgaccagcccgacatcgccgaggacctgaaggacctgatcaccagaatgctggacaagaaccccgagagcagaatcgtggtgcccgagatcaagctgcacccctgggtgaccagacacggcgccgagcccctgcccagcgaggacgagaactgcaccctggtggaggtgaccgaggaggaggtggagaacagcgtgaagcacatccccagcctggccaccgtgatcctggtgaagaccatgatcagaaagagaagcttcggcaaccccttcgagggcagcagaagagaggagagaagcctgagcgcccccggcaacctgctgaccaagaagcccaccagagagtgcgagagcctgagcgagctgaaggaggccagacagagaagacagccccccggccacagacccgcccccagaggcggcggcggcagcgccctggtgagaggcagcccctgcgtggagagctgctgggcccccgcccccggcagccccgccagaatgcaccccctgagacccgaggaggccatggagcccgagtag

SEQ ID NO: 9997 - DNA, 2052 bp, Artificial Sequence
  Description of Artificial Sequence: Synthetic coding sequence
atggccctgagcaagagagagctggacgagctgaagccctggatcgagaagaccgtgaagagagtgctgggcttcagcgagcccaccgtggtgaccgccgccctgaactgcgtgggcaagggcatggacaagaagaaggccgccgaccacctgaagcccttcctggacgacagcaccctgagattcgtggacaagctgttcgaggccgtggaggagggcagaagcagcagacacagcaagagcagcagcgacagaagcagaaagagagagctgaaggaggtgttcggcgacgacagcgagatcagcaaggagagcagcggcgtgaagaagagaagaatccccagattcgaggaggtggaggaggagcccgaggtgatccccggcccccccagcgagagccccggcatgctgaccaagctgcagatcaagcagatgatggaggccgccaccagacagatcgaggagagaaagaagcagctgagcttcatcagcccccccaccccccagcccaagacccccagcagcagccagcccgagagactgcccatcggcaacaccatccagcccagccaggccgccaccttcatgaacgacgccatcgagaaggccagaaaggccgccgagctgcaggccagaatccaggcccagctggccctgaagcccggcctgatcggcaacgccaacatggtgggcctggccaacctgcacgccatgggcatcgccccccccaaggtggagctgaaggaccagaccaagcccacccccctgatcctggacgagcagggcagaaccgtggacgccaccggcaaggagatcgagctgacccacagaatgcccaccctgaaggccaacatcagagccgtgaagagagagcagttcaagcagcagctgaaggagaagcccagcgaggacatggagagcaacaccttcttcgaccccagagtgagcatcgcccccagccagagacagagaagaaccttcaagttccacgacaagggcaagttcgagaagatcgcccagagactgagaaccaaggcccagctggagaagctgcaggccgagatcagccaggccgccagaaagaccggcatccacaccagcaccagactggccctgatcgcccccaagaaggagctgaaggagggcgacatccccgagatcgagtggtgggacagctacatcatccccaacggcttcgacctgaccgaggagaaccccaagagagaggactacttcggcatcaccaacctggtggagcaccccgcccagctgaacccccccgtggacaacgacacccccgtgaccctgggcgtgtacctgaccaagaaggagcagaagaagctgagaagacagaccagaagagaggcccagaaggagctgcaggagaaggtgagactgggcctgatgcccccccccgagcccaaggtgagaatcagcaacctgatgagagtgctgggcaccgaggccgtgcaggaccccaccaaggtggaggcccacgtgagagcccagatggccaagagacagaaggcccacgaggaggccaacgccgccagaaagctgaccgccgagcagagaaaggtgaagaagatcaagaagctgaaggaggacatcagccagggcgtgcacatcagcgtgtacagagtgagaaacctgagcaaccccgccaagaagttcaagatcgaggccaacgccggccagctgtacctgaccggcgtggtggtgctgcacaaggacgtgaacgtggtggtggtggagggcggccccaaggcccagaagaagttcaagagactgatgctgcacagaatcaagtgggacgagcagaccagcaacaccaagggcgacgacgacgaggagagcgacgaggaggccgtgaagaagaccaacaagtgcgtgctggtgtgggagggcaccgccaaggacagaagcttcggcgagatgaagttcaagcagtgccccaccgagaacatggccagagagcacttcaagaagcacggcgccgagcactactgggacctggccctgagcgagagcgtgctggagagcaccgactag

SEQ ID NO: 9998 - DNA, 1938 bp, Artificial Sequence
  Description of Artificial Sequence: Synthetic coding sequence
atgagcgacaagagcgacctgaaggccgagctggagagaaagaagcagagactggcccagatcagagaggagaagaagagaaaggaggaggagagaaagaagaaggaggccgacatgcagcagaagaaggagcccgtgcaggacgacagcgacctggacagaaagagaagagagaccgaggccctgctgcagagcatcggcatcagccccgagccccccctggtgcagcccctgcacttcctgacctgggacacctgctacttccactacctggtgcccacccccatgagccccagcagcaagagcgtgagcacccccagcgaggccggcagccaggacagcggcgacctgggccccctgaccagaaccctgcagtgggacaccgaccccagcgtgctgcagctgcagagcgacagcgagctgggcagaagactgcacaagctgggcgtgagcaaggtgacccaggtggacttcctgcccagagaggtggtgagctacagcaaggagacccagacccccctggccacccaccagagcgaggaggacgaggaggacgaggagatggtggagagcaaggtgggccaggacagcgagctggagaaccaggacaagaagcaggaggtgaaggaggccccccccagagagctgaccgaggaggagaagcagcagatcctgcacagcgaggagttcctgatcttcttcgacagaaccatcagagtgatcgagagagccctggccgaggacagcgacatcttcttcgactacagcggcagagagctggaggagaaggacggcgacgtgcaggccggcgccaacctgagcttcaacagacagttctacgacgagcactggagcaagcacagagtggtgacctgcatggactggagcctgcagtaccccgagctgatggtggccagctacaacaacaacgaggacgccccccacgagcccgacggcgtggccctggtgtggaacatgaagttcaagaagaccacccccgagtacgtgttccactgccagagcagcgtgatgagcgtgtgcttcgccagattccaccccaacctggtggtgggcggcacctacagcggccagatcgtgctgtgggacaacagaagccacagaagaacccccgtgcagagaacccccctgagcgccgccgcccacacccaccccgtgtactgcgtgaacgtggtgggcacccagaacgcccacaacctgatcaccgtgagcaccgacggcaagatgtgcagctggagcctggacatgctgagcaccccccaggagagcatggagctggtgtacaacaagagcaagcccgtggccgtgaccggcatggccttccccaccggcgacgtgaacaacttcgtggtgggcagcgaggagggcaccgtgtacaccgcctgcagacacggcagcaaggccggcatcggcgaggtgttcgagggccaccagggccccgtgaccggcatcaactgccacatggccgtgggccccatcgacttcagccacctgttcgtgaccagcagcttcgactggaccgtgaagctgtggaccaccaagcacaacaagcccctgtacagcttcgaggacaacgccgactacgtgtacgacgtgatgtggagccccgtgcaccccgccctgttcgcctgcgtggacggcatgggcagactggacctgtggaacctgaacaacgacaccgaggtgcccaccgccagcgtggccatcgagggcgccagcgccctgaacagagtgagatgggcccaggccggcaaggaggtggccgtgggcgacagcgagggcagaatctgggtgtacgacgtgggcgagctggccgtgccccacaacgacgagtggaccagattcgccagaaccctggtggagatcagagccaacagagccgacagcgaggaggagggcaccgtggagctgagcgcctag

SEQ ID NO: 9999 - DNA, 7806 bp, Artificial Sequence
  Description of Artificial Sequence: Synthetic coding sequence
atgaagagaaaggtggtgaacacccacaagctgagactgagccccaacgaggaggccttcatcctgaaggaggactacgagagaagaagaaagctgagactgctgcaggtgagagagcaggagagagacatcgccctgcagatcagagaggacatcaagcagagaagaaaccagcagttcaccagactggccgaggagctgagagccgagtgggaggagagccagacccagaagatccagaacctggagaagctgtacctggccagcctgagaagcatgggcgagggccacagacaggccaaggagaacgagcccgacctggacgccctggcccagagagccgccgagagaaagagaaaggccgacctgagacacaaggaggccctgaaggtgcagaagaaccagaaggagatcctgctgaagcagaagacctggcacatcaaggccagaaaggaggccctgctggtggagaaggagagaagcgccaagatcaccagcctgcccccccccccccccaccctgttcgagaacatcgaggtgaagagaatcagcgccgtgaagaccaacagcagcacctaccaccacctgcacaccttcgtgaacagagagaccgacaccaagagacccgacgccagactggccgccgaggaggaggccaagagactggaggagctgcagaagcaggccgcccaggagagaatggagagattcgagaaggcccacgtgagaggcttccaggccatgaagaagatccacctggcccagaaccaggagaagctgatgaaggagctgaagcagctgcagcaggaggacctggccagaagaagacagaccgtggcccagatgcccccccagctggtggagctgccctacaagagaagcgagatgaaggaggactggcagagagagctggagttcgccttcgaggacatgtacaacgccgacagaaaggtgaagggcaacctgatcctgcacctggagcccgagcccctgcccaccgtgaccaaccagatccaggacgaggagctggacctgagcatggagcaggagaacctgggcgccgccgaggacctgcccgtgaccgaggccgagatctgcagcagcgagaccgacgtgcccctggtgatgaagacccagcagatccccagcaaggtgctgttcaagaagctgctgaacaagatcagaagccagaagagcctgtggaccatcaagagcatgagcgaggacgagagcgagatgatcaccaccgtgagcgagatcgagagcaaggcccccaccgtggagagcggcaccatcgccagcaaggagagaaccctgagcagcggccaggagcaggtggtggagagcgacaccctgaccatcgagagcggccccctggccagcgaggacaagcccctgagctgcggcaccaacagcggcaaggagcaggagatcaacgagaccctgcccatcaccaccgtggcccagagcagcgtgctgctgcacccccaggaggccgccgccagaatcagaatgagcgccagacagaagcagatcatggagatcgaggagcagaagcagaagcagctggagctgctggagcagatcgagcagcagaagctgagactggagaccgactgcttcagagcccagctggaggaggagaagagaaagaagacccagcccaccggcgtgggcatcgcccccgccagctgccccgtgatcagcgacgaggacagccacagacagatgatcagaaactaccagcaccagctgctgcagcagaacagactgcacagacagagcgtggagaccgccagaaagcagctgctggagtaccagaccatgctgaagggcagatgccccagcgtgagcgcccccagcctgatcaccgacagcgtgatcagcgtgcccagctggaagagcgagagacccaccgccatcagcgagcactgggaccagggccagagactgaagctgagccccaacaagtaccagcccatccagcccatccagaccagcaagctggagcaggaccacttccaggtggccagacagaaccacttcccccagagacaggtggagaccaccgagaccctgagagccagcgacatcctgaccaaccaggccctggagagccaggagcacctgagacagttcagccagaccgagacccagcagagagactacaagctggtgcccaaggacagcgagaccctgagcagagccctgagccacgacagacagctgatcagccaggacgccagaaagatcagcgagaccttcggcgccaccaccttccagagcctggagagccagcagctgttcagcgagaacagcgagaacatcagctaccacctgaccgagcccagcagcttcgtgcccctggtgccccagcacagcttcagcagcctgcccgtgaaggtggagagcggcaagatccaggagcccttcagcgccatgagcaagagcaccgtgagcaccagccacagcatcatcagccagatgcacgacagacccctgctgcccagcgagaacatcaccgcccagcagggcaacatgaaggccctgcaggagcagctggacctgcagaagaaggtgctgcaggccacccaggaggcccaggagcagctgctgctgtgcaagcagaaggaggtggagcagcagaccggcctgagcgtgttcctgcccctggtgacccccgacagcagcgccctgctgcccagcgccaaggccgacctgggcagaatccaggagagcagccccaccaagaacaacatcgccgtgagcagcgaccaccacgtgatcagccagctgcaggacaagagactgagcctgagccagcccatcctgagccagcagaacaacttcaagttcctgcaggagcagctgaacatccagaaggacagcctgcaggccagaagagaggcccaggaggtgctgtacgtgcacaagcagagcgagctggacagaagagtgtgcagcgagcaggccgagcccagcttccccttccaggtggcccagcacaccttcaccagcctgcccagcgccgacaccaagagcggcaagatccaggagcagcacagcagcaagagcgagaagggcctggtgagctgccagagcgacatccccatcagccaggacggcagcctgagcttcctgcagcagttcctgcccctgcacgacagcctgaagctgctgcaggagcagctgaccaagcagagagacaccctgcaggccagacacgaggcccaggtggagctgctgctgcacagacagagagacctgggcgacagcaagagcggcctggtgagcagcagcagcagccccgtggtggtgcagcacagcgtggccagccaggccagcgccaaggccgagcccagaagaatccaggagctgtacctgagcgagaaggagaacgtgggccccagctgccacctgatcatccccaccttccaggacaagagcctgagcttcccccagcacagcctggcccagcaggagaacctgaccatcctgcaggagcagagccagatccagagagtgatcctgggcgccaaggagggcacccaggagttcgtgcacaccgagagcgagctggagaagagaatcagcagcgagcagaccggcaccagcagcagcctgagccaggtggacgagagcgagagattccaggagtgcatcagcatcaagagcgacagcaccatccccctgagccaccccaagatccccagatgccaggagagactgctgagagtgagccagcacatgctgcccctgcaggacaacctggaggagcaccaggcctggctggacaccgagaaggaggccttccacttcagccagaagacccaggagaacaccagcagcgagcagaccggcagcagcagcttcatcccccagctggtgcagctgagcttcaccagcctggccagcgccgagagcggcaccatcctggagcccctgttcaccgagagcgagagcaagatcttcagcagccacctgcagatcccccagctgcaggacagactgctgagaatcagccagctgatccagccccagcaggacaacctgaaggccctgcaggagcagctggccacccagagagaggccatcatcctggccagacaggaggccagagaggagctgctgctgcaccagagcgagtgggagggcagaatcagccccgagcaggtggacaccagcagcctgcccctggtgccccagcacagcttcgccagcctgcccctgaacgagagcgagagaaaccaggagccctgcagcatcaacagcgacaacatcgtgagcagcggccacagcgagatccccaccctgcccgacggcctgctgggcctgagccacctggtgctgccccagcaggacaacctgatcgccctggaggagcacctgcacgcccagaccgacttcctgcccagcatcgagaagacccagaaggagctggtgctgagcaagccctgcaagttcgaggagaaggtgagcagcgagcacttcatccagagccaccacggcgacctgcaggccctgcagcagcagctggacacccagaagaaggccatcagaagcatccaggaggtgcaggaggagctgctgctgcagagactgagcgagctggagaagagagtgagcagcgagcaggtgtgcagcagcagcttcgtgagccaggtgcccgtggccgacagcgagagaacccagaagagcttccccaccaagagcaacgacaccctgcccagcagccacagagagatccccagactgcaggacagactgctgagcctgagcaagcccatcctgccccagcaggacaacatgaccgcccagctggacgcccagagagaggtgatgtacagctacgagaagccccaggaggagctgagcctgaacaagcagagaaagctgaacaagagcgagagcgccgagcacaccatccccagcctgttcctgcccaaggagaccgagcacagcttcatccccctgcccttcgccgaggccaagcccaagagcacctgcgagctgtacagcagccagaacgagcacgccgccccccccagcaaccccgtgatccccggcttccaggacagactgctgagcttcagccagagcgtgctgacccagcaggacaacctgggcctgcagaagcagctggacctgcagagagaggtgctgcactacagccagaaggcccaggagaagctgctggtgcagagacagaccgccctgcagcagcagatccagaagcacgaggagaccctgaaggacttcttcaaggacagccagatcagcaagcccaccgtggagaacgacctgaagacccagaagatgggccagctgagagactggttccccaacacccaggacctggccggcaacgaccaggagaacatcagacacgccgacagaaacaacagcgacgacaaccacctggccagcgaggacaccagcgccaagcagagcggcgagcacctggagaaggacctgggcagaagaagcagcaagccccccgtggccaaggtgaagtgcggcctggacctgaaccagcacgagctgagcgccatccaggaggtggagagccccgccatcggcagaaccagcatcctgggcaagcccggcatctacgaggacagagaccccctgagagtgagcatcagcagagagcagagcttcttcggcagccccctggcccacgaccccttcagctgcctgcagctggtgggccaggagaacgtgtgcggcgacgactacgacgaggccgtgaagctgaaggagagcgtggtggagaaccacgccgtgctgagctacgccgtggaggaggagcacgcctacctgggccccaccgtgaagcccgacgacaaggccaagaccctgagctacgagcccctgagcagcgccaccgtgagcaccggcagcctgctgagctacgagaacaccgacctgagcctgaccgaccccgagagcttcagcgagcacatggacgacagcaagcaggagagcaccaccagcaaggaggaggagaccaacatcatcagcagcatcgtgcccagcacccaggacatctaccagagacagaacagcagcgacgtgcacaagagcctgctgcccgccgtggacgagaccacctgcggccacacccacttccagcagatgatcgacaagtacatcaacgaggccaacctgatccccgagaagaccgacctgcaggagctggagcacatcttccccaacctgcaccaccagctgttcaagcccctggagccccaccccgacttcgacctgagcagcagcagcagcggcatcagccccgacaacagagacttctaccagagaagcgacagcagcagcgagagccactgcgccaccggcctgagcaagagcaccgtgtacttcaccgccctgagaagaaccagcatgcacagcagcctgaacaccagccccaaccagcagcccgacaccaacctggcccacgtgggcgcccacagcttcgccaccgagaacatcatcggcggcagcgagcagtgcttcgagcagctgcagcccgagtacagcagccaggaggagagccagcacgccgacctgcccagcatcttcagcatcgaggccagagacagcagccagggcatgaagaaccagaactaccccagcgaggagcacaccgagatcctgcagaacaagaagaagatcgtgcacttccagctgagcatcggcaacctgagcagcgtgtacagcagcagcgacgaggccaacgtgttcgaccagctgaacgtgcagcacagcaccccctgcggcagcaacagcagcgagtgcagcaccaagcaccagctggagagcagaaaggagagcatgggcttcgaggagctgagcaagagaggcgtggtgaccatgctgcagagccagggcctgatcgaggacaacaagaacgagacctgcagagtgctggacatcaacccccaggtggaggagaccgacagcagactgtgcgtgagaaccgtggagatgggcaccagcatccaggccccctacagcctgaccacccagaacgagaagtacttcgagaacagcgccgagaccgacatccccaagatcaccaagaagctgagccagctgggcgagagcgagctgttcgccagcagcggcagcttcagcctgcagagcagcatccccgtgtgggagaccgagaccggccacggcatcatggaggagcccgagctgaccctgatcagcaccaccgacaccagcatcgccgagatggacttcgccaacctgaccctggaggagaagagcgagaacgaggccaagtgcttcttccaggtgagcgagttcctgcccctggtgagcgccaccgaggccagcgactaccccgccgtgagcgagctgagcatcgagaagcccagaaccgccagcaccgagacccccagaagactgacccccgtgcccggcagcctgcaggaggccttcatcaagagaaagaagagcttcatggagagaagccaccagagacagaaggagatcagaaacaagatccacgtgagcgagaacagccagatcaagaccgtgaaggagaagcccagcatcagcagcagcgtgagcagactgaagggcgtgaacaaggtgagagccagcttccccgaggacagaaagaccacccaggccctgagacaccagagaggcctgagactgtacaaccagctggccgaggtgaagcagcagaaggaggagaagaccaagcaggaggcctacgcccagaacagagccagagccaaggagttccacaagaagaccctggagaagctgagagccaagaacacctgctag

SEQ ID NO: 10000 - DNA, 2397 bp, Artificial Sequence
  Description of Artificial Sequence: Synthetic coding sequence
atggccgccagcctgcccggccccggcagcagactgttcagaacctacggcgccgccgacggcagaagacagagaagacccggcagagaggccgcccagtggttccccccccaggacagaagaagattcttcaacagcagcggcagcagcgacgccagcatcggcgaccccagccagagcgacgaccccgacgaccccgacgaccccgacttccccggcagccccgtgagaagaagaagaagaagacccggcggcagagtgcccaaggacagacccagcctgaccgtgacccccaagagatggaagctgagagccagacccagcctgaccgtgacccccagaagactgggcctgagagccagacccccccagaagtgcagcaccccctgcggccccctgagactgccccccttccccagcagagacagcggcagactgagccccgacctgagcgtgtgcggccagcccagagacggcgacgagctgggcatcagcgccagcctgttcagcagcctggccagcccctgccccggcagccccacccccagagacagcgtgatcagcatcggcaccagcgcctgcctggtggccgccagcgccgtgcccagcggcctgcacctgcccgaggtgagcctggacagagccagcctgccctgcagccaggaggaggccaccggcggcgccaaggacaccagaatggtgcaccagaccagagccagcctgagaagcgtgctgttcggcctgatgaacagcggcacccccgaggacagcgagttcagagccgacggcaagaacatgagagagagctgctgcaagagaaagctggtggtgggcaacggccccgagggccccggcctgagcagcaccggcaagagaagagccaccggccaggacagctgccaggagagaggcctgcaggaggccgtgagaagagagcaccaggaggccagcgtgcccaagggcagaatcgtgcccagaggcatcgacagactggagagaaccagaagcagcagaaagagcaagcaccaggaggccaccgagaccagcctgctgcacagccacagattcaagaagggccagaagctgggcaaggacagcttccccacccaggacctgacccccctgcagaacgtgtgcttctggaccaagaccagagccagcttcagcttccacaagaagaagatcgtgaccgacgtgagcgaggtgtgcagcatctacaccaccgccaccagcctgagcggcagcctgctgagcgagtgcagcaacagacccgtgatgaacagaaccagcggcgcccccagcagctggcacagcagcagcatgtacctgctgagccccctgaacaccctgagcatcagcaacaagaaggccagcgacgccgagaaggtgtacggcgagtgcagccagaagggccccgtgcccttcagccactgcctgcccaccgagaagctgcagagatgcgagaagatcggcgagggcgtgttcggcgaggtgttccagaccatcgccgaccacacccccgtggccatcaagatcatcgccatcgagggccccgacctggtgaacggcagccaccagaagaccttcgaggagatcctgcccgagatcatcatcagcaaggagctgagcctgctgagcggcgaggtgtgcaacagaaccgagggcttcatcggcctgaacagcgtgcactgcgtgcagggcagctacccccccctgctgctgaaggcctgggaccactacaacagcaccaagggcagcgccaacgacagacccgacttcttcaaggacgaccagctgttcatcgtgctggagttcgagttcggcggcatcgacctggagcagatgagaaccaagctgagcagcctggccaccgccaagagcatcctgcaccagctgaccgccagcctggccgtggccgaggccagcctgagattcgagcacagagacctgcactggggcaacgtgctgctgaagaagaccagcctgaagaagctgcactacaccctgaacggcaagagcagcaccatccccagctgcggcctgcaggtgagcatcatcgactacaccctgagcagactggagagagacggcatcgtggtgttctgcgacgtgagcatggacgaggacctgttcaccggcgacggcgactaccagttcgacatctacagactgatgaagaaggagaacaacaacagatggggcgagtaccacccctacagcaacgtgctgtggctgcactacctgaccgacaagatgctgaagcagatgaccttcaagaccaagtgcaacacccccgccatgaagcagatcaagagaaagatccaggagttccacagaaccatgctgaacttcagcagcgccaccgacctgctgtgccagcacagcctgttcaagtag

SEQ ID NO: 10001 - DNA, 765 bp, Artificial Sequence
  Description of Artificial Sequence: Synthetic coding sequence
atggtgagagaggccaacatcaagcaggccaccgccgagaagcagctgaaggaggcccagggcaagatcgacgtgctgcaggccgaggtggccgccctgaagaccctggtgctgagcagcagccccaccagccccacccaggagcccctgcccggcggcaagacccccttcaagaagggccacaccagaaacaagagcaccagcagcgccatgagcggcagccaccaggacctgagcgtgatccagcccatcgtgaaggactgcaaggaggccgacctgagcctgtacaacgagttcagactgtggaaggacgagcccaccatggacagaacctgccccttcctggacaagatctaccaggaggacatcttcccctgcctgaccttcagcaagagcgagctggccagcgccgtgctggaggccgtggagaacaacaccctgagcatcgagcccgtgggcctgcagcccatcagattcgtgaaggccagcgccgtggagtgcggcggccccaagaagtgcgccctgaccggccagagcaagagctgcaagcacagaatcaagctgggcgacagcagcaactactactacatcagccccttctgcagatacagaatcaccagcgtgtgcaacttcttcacctacatcagatacatccagcagggcctggtgaagcagcaggacgtggaccagatgttctgggaggtgatgcagctgagaaaggagatgagcctggccaagctgggctacttcaaggaggagctgtag

SEQ ID NO: 10002 - DNA, 1077 bp, Artificial Sequence
  Description of Artificial Sequence: Synthetic coding sequence
atgtacgccagccagtggttcctgaccctgttcaccgccaagttccccctgtgcatggtgttccacatcatcgacctgctgctgtgcgagggcctgaacatcatcttccacgtggccctggccctgctgaagaccagcaaggaggacctgctgcaggccgacttcgagggcgccctgaagttcttcagagtgcagctgcccaagagatacagagccgaggagaacgccagaagactgatggagcaggcctgcaacatcaaggtgcccaccaagaagctgaagaagtacgagaaggagtaccagaccatgagagagagccagctgcagcaggaggaccccatggacagatacaagagagagaacagaagactgcaggaggccagcatgagactggagcaggagaacgacgacctggcccacgagctggtgaccagcaagatcgccctgagaaacgacctggaccaggccgaggacaaggccgacgtgctgaacaaggagctgctgctgaccaagcagagactggtggagaccgaggaggagaagagaaagcaggaggaggagaccgcccagctgaaggaggtgttcagaaagcagctggagaaggccgagtacgagatcaagaagaccaccgccatcatcgccgagtacaagcagatctgcagccagctgagcaccagactggagaagcagcaggccgccagcaaggaggagctggaggtggtgaagggcaagatgatggcctgcaagcactgcagcgacatcttcagcaaggagggcgccctgaagctggccgccaccggcagagaggaccagggcatcgagaccgacgacgagaaggacagcctgaagaagcagctgagagagatggagctggagctggcccagaccaagctgcagctggtggaggccaagtgcaagatccaggagctggagcaccagagaggcgccctgatgaacgagatccaggccgccaagaacagctggttcagcaagaccctgaacagcatcaagaccgccaccggcacccagcccctgcagcccgcccccgtgacccagccccccaaggagagcacctag

SEQ ID NO: 10003 - DNA, 2436 bp, Artificial Sequence
  Description of Artificial Sequence: Synthetic coding sequence
atgcccctgagcagccccaacgccgccgccaccgccagcgacatggacaagaacagcggcagcaacagcagcagcgccagcagcggcagcagcaagggccagcagccccccagaagcgccagcgccggccccgccggcgagagcaagcccaagagcgacggcaagaacagcagcggcagcaagagatacaacagaaagagagagctgagctaccccaagaacgagagcttcaacaaccagagcagaagaagcagcagccagaagagcaagaccttcaacaagatgcccccccagagaggcggcggcagcagcaagctgttcagcagcagcttcaacggcggcagaagagacgaggtggccgaggcccagagagccgagttcagccccgcccagttcagcggccccaagaagatcaacctgaaccacctgctgaacttcaccttcgagcccagaggccagaccggccacttcgagggcagcggccacggcagctggggcaagagaaacaagtggggccacaagcccttcaacaaggagctgttcctgcaggccaactgccagttcgtggtgagcgaggaccaggactacaccgcccacttcgccgaccccgacaccctggtgaactgggacttcgtggagcaggtgagaatctgcagccacgaggtgcccagctgccccatctgcctgtacccccccaccgccgccaagatcaccagatgcggccacatcttctgctgggcctgcatcctgcactacctgagcctgagcgagaagacctggagcaagtgccccatctgctacagcagcgtgcacaagaaggacctgaagagcgtggtggccaccgagagccaccagtacgtggtgggcgacaccatcaccatgcagctgatgaagagagagaagggcgtgctggtggccctgcccaagagcaagtggatgaacgtggaccaccccatccacctgggcgacgagcagcacagccagtacagcaagctgctgctggccagcaaggagcaggtgctgcacagagtggtgctggaggagaaggtggccctggagcagcagctggccgaggagaagcacacccccgagagctgcttcatcgaggccgccatccaggagctgaagaccagagaggaggccctgagcggcctggccggcagcagaagagaggtgaccggcgtggtggccgccctggagcagctggtgctgatggcccccctggccaaggagagcgtgttccagcccagaaagggcgtgctggagtacctgagcgccttcgacgaggagaccaccgaggtgtgcagcctggacacccccagcagacccctggccctgcccctggtggaggaggaggaggccgtgagcgagcccgagcccgagggcctgcccgaggcctgcgacgacctggagctggccgacgacaacctgaaggagggcaccatctgcaccgagagcagccagcaggagcccatcaccaagagcggcttcaccagactgagcagcagcccctgctactacttctaccaggccgaggacggccagcacatgttcctgcaccccgtgaacgtgagatgcctggtgagagagtacggcagcctggagagaagccccgagaagatcagcgccaccgtggtggagatcgccggctacagcatgagcgaggacgtgagacagagacacagatacctgagccacctgcccctgacctgcgagttcagcatctgcgagctggccctgcagccccccgtggtgagcaaggagaccctggagatgttcagcgacgacatcgagaagagaaagagacagagacagaagaaggccagagaggagagaagaagagagagaagaatcgagatcgaggagaacaagaagcagggcaagtaccccgaggtgcacatccccctggagaacctgcagcagttccccgccttcaacagctacacctgcagcagcgacagcgccctgggccccaccagcaccgagggccacggcgccctgagcatcagccccctgagcagaagccccggcagccacgccgacttcctgctgacccccctgagccccaccgccagccagggcagccccagcttctgcgtgggcagcctggaggaggacagccccttccccagcttcgcccagatgctgagagtgggcaaggccaaggccgacgtgtggcccaagaccgcccccaagaaggacgagaacagcctggtgccccccgcccccgtggacagcgacggcgagagcgacaacagcgacagagtgcccgtgcccagcttccagaacagcttcagccaggccatcgaggccgccttcatgaagctggacacccccgccaccagcgaccccctgagcgaggagaagggcggcaagaagagaaagaagcagaagcagaagctgctgttcagcaccagcgtggtgcacaccaagtag

SEQ ID NO: 10004 - DNA, 5826 bp, Artificial Sequence
  Description of Artificial Sequence: Synthetic coding sequence
atgaagaccagcgacctggtgcccagcttcggctacttcatcagaagccccgagaagagagagcccatcgccctgatcagaaagagcgacgtgagcagaggcaacctggagaaggagatggcccacctgaaccacgacctgtacagcggcgacctgaacgagcagagccaggcccagctgagcgagggcagcatcaccctgcaggtggaggccgtggagagcaccagccaggtggacgagaacgacgtgaccctgaccgccgacaagggcaagaccgaggacaccttcttcatgagcaacaagccccagagatacaaggacaagctgcccgacagcggcgacagcatgctgagaatcagcaccatcgccagcgccatcgccgaggccagcgtgaacaccgaccccagccagctggccgccatgatcaaggccctgagcaacaagaccagagacaagaccttccaggaggacgagaagcagaaggactacagccacgtgagacacttcctgcccaacgacctggagaagagcaacggcagcaacgccctggacatggagaagtacctgaagaagaccgaggtgagcagatacgagagcgccctggagaacttcagcagagccagcatgagcgacacctgggacctgagcctgcccaaggagcagaccacccaggacatccaccccgtggacctgagcgccaccagcgtgagcgtgagagcccccgaggagaacaccgccgccatcgtgtacgtggagaacggcgagagcgagaaccaggagagcttcagaaccatcaacagcagcaacagcgtgaccaacagagagaacaacagcgccgtggtggacgtgaagacctgcagcatcgacaacaagctgcaggacgtgggcaacgacgagaaggccaccagcatcagcacccccagcgacagctacagcagcgtgagaaaccccagaatcaccagcctgtgcctgctgaaggactgcgaggagatcagagacaacagagagaaccagagacagaacgagtgcgtgagcgagatcagcaacagcgagaagcacgtgaccttcgagaaccacagaatcgtgagccccaagaacagcgacctgaagaacaccagccccgagcacggcggcagaggcagcgaggacgagcaggagagcttcagacccagcaccagccccctgagccacagcagccccagcgagatcagcggcaccagcagcagcggctgcgccctggagagcttcggcagcgccgcccagcagcagcagcccccctgcgagcaggagctgagccccctggtgtgcagccccgccggcgtgagcagactgacctacgtgagcgagcccgagagcagctaccccaccaccgccaccgacgacgccctggaggacagaaagagcgacatcaccagcgagctgagcaccaccatcatccagggcagccccgccgccctggaggagagagccatggagaagctgagagagaaggtgcccttccagaacagaggcaagggcaccctgagcagcatcatccagaacaacagcgacaccagaaaggccaccgagaccaccagcctgagcagcaagcccgagtacgtgaagcccgacttcagatggagcaaggaccccagcagcaagagcggcaacctgctggagaccagcgaggtgggctggaccagcaaccccgaggagctggaccccatcagactggccctgctgggcaagagcggcctgagctgccaggtgggcagcgccaccagccaccccgtgagctgccaggagcccatcgacgaggaccagagaatcagccccaaggacaagagcaccgccggcagagagttcagcggccaggtgagccaccagaccaccagcgagaaccagtgcacccccatccccagcagcaccgtgcacagcagcgtggccgacatgcagaacatgcccgccgccgtgcacgccctgctgacccagcccagcctgagcgccgcccccttcgcccagagatacctgggcaccctgcccagcaccggcagcaccaccctgccccagtgccacgccggcaacgccaccgtgtgcggcttcagcggcggcctgccctaccccgccgtggccggcgagcccgtgcagaacagcgtggccgtgggcatctgcctgggcagcaacatcggcagcggctggatgggcaccagcagcctgtgcaacccctacagcaacaccctgaaccagaacctgctgagcaccaccaagcccttccccgtgcccagcgtgggcaccaactgcggcatcgagccctgggacagcggcgtgaccagcggcctgggcagcgtgagagtgcccgaggagctgaagctgccccacgcctgctgcgtgggcatcgccagccagaccctgctgagcgtgctgaaccccaccgacagatggctgcaggtgagcatcggcgtgctgagcatcagcgtgaacggcgagaaggtggacctgagcacctacagatgcctggtgttcaagaacaaggccatcatcagaccccacgccaccgaggagatcaaggtgctgttcatccccagcagccccggcgtgttcagatgcaccttcagcgtggccagctggccctgcagcaccgacgccgagaccatcgtgcaggccgaggccctggccagcaccgtgaccctgaccgccatcgccgagagccccgtgatcgaggtggagaccgagaagaaggacgtgctggacttcggcgacctgacctacggcggctggaaggccctgcccctgaagctgatcaacagaacccacgccaccgtgcccatcagactgatcatcaacgccaacgccgtggcctggagatgcttcaccttcagcaaggagagcgtgagagcccccgtggaggtggccccctgcgccgacgtggtgaccagactggccggccccagcgtggtgaaccacatgatgcccgccagctacgacggccaggaccccgagttcctgatgatctgggtgctgttccacagccccaagaagcagatcagcagcagcgacatcctggacagcgccgaggagttcagcgccaaggtggacatcgaggtggacagccccaaccccacccccgtgctgagaagcgtgagcctgagagccagagccggcatcgccagaatccacgcccccagagacctgcagaccatgcacttcctggccaaggtggccagcagcagaaagcagcacctgcccctgaagaacgccggcaacatcgaggtgtacctggacatcaaggtgcccgagcagggcagccacttcagcgtggaccccaagaacctgctgctgaagcccggcgaggagcacgaggtgatcgtgagcttcacccccaaggaccccgaggcctgcgaggagagaatcctgaagatcttcgtgcagcccttcggcccccagtacgaggtggtgctgaagggcgaggtgatcagcagcggcagcaagcccctgagccccggcccctgcctggacatccccagcatcctgagcaacaagcagttcctggcctggggcggcgtgcccctgggcagaacccagctgcagaagctggccctgagaaacaacagcgccagcaccacccagcacctgagactgctgatcagaggccaggaccaggactgcttccagctgcagaacaccttcggcagcgagcagagactgaccagcaactgcgagatcagaatccaccccaaggaggacatcttcatcagcgtgctgttcgcccccaccagactgagctgcatgctggccagactggagatcaagcagctgggcaacagaagccagcccggcatcaagttcaccatccccctgagcggctacggcggcaccagcaacctgatcctggagggcgtgaagaagctgagcgacagctacatggtgaccgtgaacggcctggtgcccggcaaggagagcaagatcgtgttcagcgtgagaaacaccggcagcagagccgccttcgtgaaggccgtgggcttcaaggacagccagaagaaggtgctgctggaccccaaggtgctgagaatcttccccgacaagttcgtgctgaaggagagaacccaggagaacgtgaccctgatctacaaccccagcgacagaggcatcaacaacaagaccgccaccgagctgagcaccgtgtacctgttcggcggcgacgagatcagcagacagcagtacagaagagccctgctgcacaagcccgagatgatcaagcagatcctgcccgagcacagcgtgctgcagaacatcaacttcgtggaggccttccaggacgagctgctggtgaccgaggtgtacgacctgccccagagacccaacgacgtgcagctgttctacggcagcatgtgcaagatcatcctgagcgtgatcggcgagttcagagactgcatcagcagcagagagttcctgcagcccagcagcaaggccagcctggagagcaccagcgacctgggcgccagcggcaagcacggcggcaacgtgagcctggacgtgctgcccgtgaagggcccccagggcagccccctgctgagcagagccgccagaccccccctggaccagctggccagcgaggagccctggaccgtgctgcccgagcacctgatcctggtggcccccagcccctgcgacatggccaagaccggcagattccagatcgtgaacaacagcgtgagactgctgagattcgagctgtgctggcccgcccactgcctgaccgtgaccccccagcacggctgcgtggcccccgagagcaagctgcagatcctggtgagccccaacagcagcctgagcaccaagcagagcatgttcccctggagcggcctgatctacatccactgcgacgacggccagaagaagatcgtgaaggtgcagatcagagaggacctgacccaggtggagctgctgaccagactgaccagcaagcccttcggcatcctgagccccgtgagcgagcccagcgtgagccacctggtgaagcccatgaccaagccccccagcaccaaggtggagatcagaaacaagagcatcaccttccccaccaccgagcccggcgagaccagcgagagctgcctggagctggagaaccacggcaccaccgacgtgaagtggcacctgagcagcctggcccccccctacgtgaagggcgtggacgagagcggcgacgtgttcagagccacctacgccgccttcagatgcagccccatcagcggcctgctggagagccacggcatccagaaggtgagcatcaccttcctgcccagaggcagaggcgactacgcccagttctgggacgtggagtgccaccccctgaaggagccccacatgaagcacaccctgagattccagctgagcggccagagcatcgaggccgagaacgagcccgagaacgcctgcctgagcaccgacagcctgatcaagatcgaccacctggtgaagcccagaagacaggccgtgagcgaggccagcgccagaatccccgagcagctggacgtgaccgccagaggcgtgtacgcccccgaggacgtgtacagattcagacccaccagcgtgggcgagagcagaaccctgaaggtgaacctgagaaacaacagcttcatcacccacagcctgaagttcctgagccccagagagcccttctacgtgaagcacagcaagtacagcctgagagcccagcactacatcaacatgcccgtgcagttcaagcccaagagcgccggcaagttcgaggccctgctggtgatccagaccgacgagggcaagagcatcgccatcagactgatcggcgaggccctgggcaagaactag

SEQ ID NO: 10005 - DNA, 4167 bp, Artificial Sequence
  Description of Artificial Sequence: Synthetic coding sequence
atggcccccggctgcaagaccgagctgagaagcgtgaccaacggccagagcaaccagcccagcaacgagggcgacgccatcaaggtgttcgtgagaatcagaccccccgccgagagaagcggcagcgccgacggcgagcagaacctgtgcctgagcgtgctgagcagcaccagcctgagactgcacagcaaccccgagcccaagaccttcaccttcgaccacgtggccgacgtggacaccacccaggagagcgtgttcgccaccgtggccaagagcatcgtggagagctgcatgagcggctacaacggcaccatcttcgcctacggccagaccggcagcggcaagaccttcaccatgatgggccccagcgagagcgacaacttcagccacaacctgagaggcgtgatccccagaagcttcgagtacctgttcagcctgatcgacagagagaaggagaaggccggcgccggcaagagcttcctgtgcaagtgcagcttcatcgagatctacaacgagcagatctacgacctgctggacagcgccagcgccggcctgtacctgagagagcacatcaagaagggcgtgttcgtggtgggcgccgtggagcaggtggtgaccagcgccgccgaggcctaccaggtgctgagcggcggctggagaaacagaagagtggccagcaccagcatgaacagagagagcagcagaagccacgccgtgttcaccatcaccatcgagagcatggagaagagcaacgagatcgtgaacatcagaaccagcctgctgaacctggtggacctggccggcagcgagagacagaaggacacccacgccgagggcatgagactgaaggaggccggcaacatcaacagaagcctgagctgcctgggccaggtgatcaccgccctggtggacgtgggcaacggcaagcagagacacgtgtgctacagagacagcaagctgaccttcctgctgagagacagcctgggcggcaacgccaagaccgccatcatcgccaacgtgcaccccggcagcagatgcttcggcgagaccctgagcaccctgaacttcgcccagagagccaagctgatcaagaacaaggccgtggtgaacgaggacacccagggcaacgtgagccagctgcaggccgaggtgaagagactgaaggagcagctggccgagctggccagcggccagaccccccccgagagcttcctgaccagagacaagaagaagaccaactacatggagtacttccaggaggccatgctgttcttcaagaagagcgagcaggagaagaagagcctgatcgagaaggtgacccagctggaggacctgaccctgaagaaggagaagttcatccagagcaacaagatgatcgtgaagttcagagaggaccagatcatcagactggagaagctgcacaaggagagcagaggcggcttcctgcccgaggagcaggacagactgctgagcgagctgagaaacgagatccagaccctgagagagcagatcgagcaccaccccagagtggccaagtacgccatggagaaccacagcctgagagaggagaacagaagactgagactgctggagcccgtgaagagagcccaggagatggacgcccagaccatcgccaagctggagaaggccttcagcgagatcagcggcatggagaagagcgacaagaaccagcagggcttcagccccaaggcccagaaggagccctgcctgttcgccaacaccgagaagctgaaggcccagctgctgcagatccagaccgagctgaacaacagcaagcaggagtacgaggagttcaaggagctgaccagaaagagacagctggagctggagagcgagctgcagagcctgcagaaggccaacctgaacctggagaacctgctggaggccaccaaggcctgcaagagacaggaggtgagccagctgaacaagatccacgccgagaccctgaagatcatcaccacccccaccaaggcctaccagctgcacagcagacccgtgcccaagctgagccccgagatgggcagcttcggcagcctgtacacccagaacagcagcatcctggacaacgacatcctgaacgagcccgtgccccccgagatgaacgagcaggccttcgaggccatcagcgaggagctgagaaccgtgcaggagcagatgagcgccctgcaggccaagctggacgaggaggagcacaagaacctgaagctgcagcagcacgtggacaagctggagcaccacagcacccagatgcaggagctgttcagcagcgagagaatcgactggaccaagcagcaggaggagctgctgagccagctgaacgtgctggagaagcagctgcaggagacccagaccaagaacgacttcctgaagagcgaggtgcacgacctgagagtggtgctgcacagcgccgacaaggagctgagcagcgtgaagctggagtacagcagcttcaagaccaaccaggagaaggagttcaacaagctgagcgagagacacatgcacgtgcagctgcagctggacaacctgagactggagaacgagaagctgctggagagcaaggcctgcctgcaggacagctacgacaacctgcaggagatcatgaagttcgagatcgaccagctgagcagaaacctgcagaacttcaagaaggagaacgagaccctgaagagcgacctgaacaacctgatggagctgctggaggccgagaaggagagaaacaacaagctgagcctgcagttcgaggaggacaaggagaacagcagcaaggagatcctgaaggtgctggaggccgtgagacaggagaagcagaaggagaccgccaagtgcgagcagcagatggccaaggtgcagaagctggaggagagcctgctggccaccgagaaggtgatcagcagcctggagaagagcagagacagcgacaagaaggtggtggccgacctgatgaaccagatccaggagctgagaaccagcgtgtgcgagaagaccgagaccatcgacaccctgaagcaggagctgaaggacatcaactgcaagtacaacagcgccctggtggacagagaggagagcagagtgctgatcaagaagcaggaggtggacatcctggacctgaaggagaccctgagactgagaatcctgagcgaggacatcgagagagacatgctgtgcgaggacctggcccacgccaccgagcagctgaacatgctgaccgaggccagcaagaagcacagcggcctgctgcagagcgcccaggaggagctgaccaagaaggaggccctgatccaggagctgcagcacaagctgaaccagaagaaggaggaggtggagcagaagaagaacgagtacaacttcaagatgagacagctggagcacgtgatggacagcgccgccgaggacccccagagccccaagacccccccccacttccagacccacctggccaagctgctggagacccaggagcaggagatcgaggacggcagagccagcaagaccagcctggagcacctggtgaccaagctgaacgaggacagagaggtgaagaacgccgagatcctgagaatgaaggagcagctgagagagatggagaacctgagactggagagccagcagctgatcgagaagaactggctgctgcagggccagctggacgacatcaagagacagaaggagaacagcgaccagaaccaccccgacaaccagcagctgaagaacgagcaggaggagagcatcaaggagagactggccaagagcaagatcgtggaggagatgctgaagatgaaggccgacctggaggaggtgcagagcgccctgtacaacaaggagatggagtgcctgagaatgaccgacgaggtggagagaacccagaccctggagagcaaggccttccaggagaaggagcagctgagaagcaagctggaggagatgtacgaggagagagagagaaccagccaggagatggagatgctgagaaagcaggtggagtgcctggccgaggagaacggcaagctggtgggccaccagaacctgcaccagaagatccagtacgtggtgagactgaagaaggagaacgtgagactggccgaggagaccgagaagctgagagccgagaacgtgttcctgaaggagaagaagagaagcgagagctag

SEQ ID NO: 10006 - DNA, 4767 bp, Artificial Sequence
  Description of Artificial Sequence: Synthetic coding sequence
atgctgccccccaagcacctgagcgccaccaagcccaagaagagctgggcccccaacctgtacgagctggacagcgacctgaccaaggagcccgacgtgatcatcggcgagggccccaccgacagcgagttcttccaccagagattcagaaacctgatctacgtggagttcgtgggccccagaaagaccctgatcaagctgagaaacctgtgcctggactggctgcagcccgagaccagaaccaaggaggagatcatcgagctgctggtgctggagcagtacctgaccatcatccccgagaagctgaagccctgggtgagagccaagaagcccgagaactgcgagaagctggtgaccctgctggagaactacaaggagatgtaccagcccgaggacgacaacaacagcgacgtgaccagcgacgacgacatgaccagaaacagaagagagagcagccccccccacagcgtgcacagcttcagcgacagagactgggacagaagaggcagaagcagagacatggagcccagagacagatggagccacaccagaaaccccagaagcagaatgccccccagagacctgagcctgcccgtggtggccaagaccagcttcgagatggacagagaggacgacagagacagcagagcctacgagagcagaagccaggacgccgagagctaccagaacgtggtggacctggccgaggacagaaagccccacaacaccatccaggacaacatggagaactacagaaagctgctgagcctggtgcagctggccgaggacgacggccacagccacatgacccagggccacagcagcagaagcaagagaagcgcctaccccagcaccagcagaggcctgaagaccatgcccgaggccaagaagagcacccacagaagaggcatctgcgaggacgagagcagccacggcgtgatcatggagaagttcatcaaggacgtgagcagaagcagcaagagcggcagagccagagagagcagcgacagaagccagagattccccagaatgagcgacgacaactggaaggacatcagcctgaacaagagagagagcgtgatccagcagagagtgtacgagggcaacgccttcagaggcggcttcagattcaacagcaccctggtgagcagaaagagagtgctggagagaaagagaagataccacttcgacaccgacggcaagggcagcatccacgaccagaagggctgccccagaaagaagcccttcgagtgcggcagcgagatgagaaaggccatgagcgtgagcagcctgagcagcctgagcagccccagcttcaccgagagccagcccatcgacttcggcgccatgccctacgtgtgcgacgagtgcggcagaagcttcagcgtgatcagcgagttcgtggagcaccagatcatgcacaccagagagaacctgtacgagtacggcgagagcttcatccacagcgtggccgtgagcgaggtgcagaagagccaggtgggcggcaagagattcgagtgcaaggactgcggcgagaccttcaacaagagcgccgccctggccgagcacagaaagatccacgccagaggctacctggtggagtgcaagaaccaggagtgcgaggaggccttcatgcccagccccaccttcagcgagctgcagaagatctacggcaaggacaagttctacgagtgcagagtgtgcaaggagaccttcctgcacagcagcgccctgatcgagcaccagaagatccacttcggcgacgacaaggacaacgagagagagcacgagagagagagagagagagagagaggcgagaccttcagacccagccccgccctgaacgagttccagaagatgtacggcaaggagaagatgtacgagtgcaaggtgtgcggcgagaccttcctgcacagcagcagcctgaaggagcaccagaagatccacaccagaggcaaccccttcgagaacaagggcaaggtgtgcgaggagaccttcatccccggccagagcctgaagagaagacagaagacctacaacaaggagaagctgtgcgacttcaccgacggcagagacgccttcatgcagagcagcgagctgagcgagcaccagaagatccacagcagaaagaacctgttcgagggcagaggctacgagaagagcgtgatccacagcggccccttcaccgagagccagaagagccacaccatcaccagacccctggagagcgacgaggacgagaaggccttcaccatcagcagcaacccctacgagaaccagaagatccccaccaaggagaacgtgtacgaggccaagagctacgagagaagcgtgatccacagcctggccagcgtggaggcccagaagagccacagcgtggccggccccagcaagcccaaggtgatggccgagagcaccatccagagcttcgacgccatcaaccaccagagagtgagagccggcggcaacaccagcgagggcagagagtacagcagaagcgtgatccacagcctggtggccagcaagccccccagaagccacaacggcaacgagctggtggagagcaacgagaagggcgagagcagcatctacatcagcgacctgaacgacaagagacagaagatccccgccagagagaacccctgcgagggcggcagcaagaacagaaactacgaggacagcgtgatccagagcgtgttcagagccaagccccagaagagcgtgcccggcgagggcagcggcgagttcaagaaggacggcgagttcagcgtgcccagcagcaacgtgagagagtaccagaaggccagagccaagaagaagtacatcgagcacagaagcaacgagaccagcgtgatccacagcctgcccttcggcgagcagaccttcagacccagaggcatgctgtacgagtgccaggagtgcggcgagtgcttcgcccacagcagcgacctgaccgagcaccagaagatccacgacagagagaagcccagcggcagcagaaactacgagtggagcgtgatcagaagcctggcccccaccgacccccagaccagctacgcccaggagcagtacgccaaggagcaggccagaaacaagtgcaaggacttcagacagttcttcgccaccagcgaggacctgaacaccaaccagaagatctacgaccaggagaagagccacggcgaggagagccagggcgagaacaccgacggcgaggagacccacagcgaggagacccacggccaggagaccatcgaggaccccgtgatccagggcagcgacatggaggacccccagaaggacgaccccgacgacaagatctacgagtgcgaggactgcggcctgggcttcgtggacctgaccgacctgaccgaccaccagaaggtgcacagcagaaagtgcctggtggacagcagagagtacacccacagcgtgatccacacccacagcatcagcgagtaccagagagactacaccggcgagcagctgtacgagtgccccaagtgcggcgagagcttcatccacagcagcttcctgttcgagcaccagagaatccacgagcaggaccagctgtacagcatgaagggctgcgacgacggcttcatcgccctgctgcccatgaagcccagaagaaacagagccgccgagagaaaccccgccctggccggcagcgccatcagatgcctgctgtgcggccagggcttcatccacagcagcgccctgaacgagcacatgagactgcacagagaggacgacctgctggagcagagccagatggccgaggaggccatcatccccggcctggccctgaccgagttccagagaagccagaccgaggagagactgttcgagtgcgccgtgtgcggcgagagcttcgtgaaccccgccgagctggccgaccacgtgaccgtgcacaagaacgagccctacgagtacggcagcagctacacccacaccagcttcctgaccgagcccctgaagggcgccatccccttctacgagtgcaaggactgcggcaagagcttcatccacagcaccgtgctgaccaagcacaaggagctgcacctggaggaggaggaggaggacgaggccgccgccgccgccgccgccgccgcccaggaggtggaggccaacgtgcacgtgccccaggtggtgctgagaatccagggcctgaacgtggaggccgccgagcccgaggtggaggccgccgagcccgaggtggaggccgccgagcccgaggtggaggccgccgagcccaacggcgaggccgagggccccgacggcgaggccgccgagcccatcggcgaggccggccagcccaacggcgaggccgagcagcccaacggcgacgccgacgagcccgacggcgccggcatcgaggaccccgaggagagagccgaggagcccgagggcaaggccgaggagcccgagggcgacgccgacgagcccgacggcgtgggcatcgaggaccccgaggagggcgaggaccaggagatccaggtggaggagccctactacgactgccacgagtgcaccgagaccttcaccagcagcaccgccttcagcgagcacctgaagacccacgccagcatgatcatcttcgagcccgccaacgccttcggcgagtgcagcggctacatcgagagagccagcaccagcaccggcggcgccaaccaggccgacgagaagtacttcaagtgcgacgtgtgcggccagctgttcaacgacagactgagcctggccagacaccagaacacccacaccggctag

SEQ ID NO: 10007 - DNA, 2508 bp, Artificial Sequence
  Description of Artificial Sequence: Synthetic coding sequence
atgggcaactacaagagcagacccacccagacctgcaccgacgagtggaagaagaaggtgagcgagagctacgtgatcaccatcgagagactggaggacgacctgcagatcaaggagaaggagctgaccgagctgagaaacatcttcggcagcgacgaggccttcagcaaggtgaacctgaactacagaaccgagaacggcctgagcctgctgcacctgtgctgcatctgcggcggcaagaagagccacatcagaaccctgatgctgaagggcctgagacccagcagactgaccagaaacggcttcaccgccctgcacctggccgtgtacaaggacaacgccgagctgatcaccagcctgctgcacagcggcgccgacatccagcaggtgggctacggcggcctgaccgccctgcacatcgccaccatcgccggccacctggaggccgccgacgtgctgctgcagcacggcgccaacgtgaacatccaggacgccgtgttcttcacccccctgcacatcgccgcctactacggccacgagcaggtgaccagactgctgctgaagttcggcgccgacgtgaacgtgagcggcgaggtgggcgacagacccctgcacctggccagcgccaagggcttcctgaacatcgccaagctgctgatggaggagggcagcaaggccgacgtgaacgcccaggacaacgaggaccacgtgcccctgcacttctgcagcagattcggccaccacgacatcgtgaagtacctgctgcagagcgacctggaggtgcagccccacgtggtgaacatctacggcgacacccccctgcacctggcctgctacaacggcaagttcgaggtggccaaggagatcatccagatcagcggcaccgagagcctgaccaaggagaacatcttcagcgagaccgccttccacagcgcctgcacctacggcaagagcatcgacctggtgaagttcctgctggaccagaacgtgatcaacatcaaccaccagggcagagacggccacaccggcctgcacagcgcctgctaccacggccacatcagactggtgcagttcctgctggacaacggcgccgacatgaacctggtggcctgcgaccccagcagaagcagcggcgagaaggacgagcagacctgcctgatgtgggcctacgagaagggccacgacgccatcgtgaccctgctgaagcactacaagagaccccaggacgagctgccctgcaacgagtacagccagcccggcggcgacggcagctacgtgagcgtgcccagccccctgggcaagatcaagagcatgaccaaggagaaggccgacatcctgctgctgagagccggcctgcccagccacttccacctgcagctgagcgagatcgagttccacgagatcatcggcagcggcagcttcggcaaggtgtacaagggcagatgcagaaacaagatcgtggccatcaagagatacagagccaacacctactgcagcaagagcgacgtggacatgttctgcagagaggtgagcatcctgtgccagctgaaccacccctgcgtgatccagttcgtgggcgcctgcctgaacgaccccagccagttcgccatcgtgacccagtacatcagcggcggcagcctgttcagcctgctgcacgagcagaagagaatcctggacctgcagagcaagctgatcatcgccgtggacgtggccaagggcatggagtacctgcacaacctgacccagcccatcatccacagagacctgaacagccacaacatcctgctgtacgaggacggccacgccgtggtggccgacttcggcgagagcagattcctgcagagcctggacgaggacaacatgaccaagcagcccggcaacctgagatggatggcccccgaggtgttcacccagtgcaccagatacaccatcaaggccgacgtgttcagctacgccctgtgcctgtgggagatcctgaccggcgagatccccttcgcccacctgaagcccgccgccgccgccgccgacatggcctaccaccacatcagaccccccatcggctacagcatccccaagcccatcagcagcctgctgatcagaggctggaacgcctgccccgagggcagacccgagttcagcgaggtggtgatgaagctggaggagtgcctgtgcaacatcgagctgatgagccccgccagcagcaacagcagcggcagcctgagccccagcagcagcagcgactgcctggtgaacagaggcggccccggcagaagccacgtggccgccctgagaagcagattcgagctggagtacgccctgaacgccagaagctacgccgccctgagccagagcgccggccagtacagcagccagggcctgagcctggaggagatgaagagaagcctgcagtacacccccatcgacaagtacggctacgtgagcgaccccatgagcagcatgcacttccacagctgcagaaacagcagcagcttcgaggacagcagctag

SEQ ID NO: 10008 - DNA, 1767 bp, Artificial Sequence
  Description of Artificial Sequence: Synthetic coding sequence
atgaacaccagcatcccctaccagcagaacccctacaaccccagaggcagcagcaacgtgatccagtgctacagatgcggcgacacctgcaagggcgaggtggtgagagtgcacaacaaccacttccacatcagatgcttcacctgccaggtgtgcggctgcggcctggcccagagcggcttcttcttcaagaaccaggagtacatctgcacccaggactaccagcagctgtacggcaccagatgcgacagctgcagagacttcatcaccggcgaggtgatcagcgccctgggcagaacctaccaccccaagtgcttcgtgtgcagcctgtgcagaaagcccttccccatcggcgacaaggtgaccttcagcggcaaggagtgcgtgtgccagacctgcagccagagcatggccagcagcaagcccatcaagatcagaggccccagccactgcgccggctgcaaggaggagatcaagcacggccagagcctgctggccctggacaagcagtggcacgtgagctgcttcaagtgccagacctgcagcgtgatcctgaccggcgagtacatcagcaaggacggcgtgccctactgcgagagcgactaccacgcccagttcggcatcaagtgcgagacctgcgacagatacatcagcggcagagtgctggaggccggcggcaagcactaccaccccacctgcgccagatgcgtgagatgccaccagatgttcaccgagggcgaggagatgtacctgaccggcagcgaggtgtggcaccccatctgcaagcaggccgccagagccgagaagaagctgaagcacagaagaaccagcgagaccagcatcagcccccccggcagcagcatcggcagccccaacagagtgatctgcgacatctacgagaacctggacctgagacagagaagagccagcagccccggctacatcgacagccccacctacagcagacagggcatgagccccaccttcagcagaagcccccaccactactacagaagcgccggcgacagcaacatctacagaaagccccccatctacaagagacacggcgacctgagcaccgccaccaagagcaagaccagcgaggacatcagccagaccagcaagtacagccccatctacagccccgacccctactacgccagcgagagcgagtactggacctaccacggcagccccaaggtgcccagagccagaagattcagcagcggcggcgaggaggacgacttcgacagaagcatgcacaagctgcagagcggcatcggcagactgatcctgaaggaggagatgaaggccagaagcagcagctacgccgacccctggaccccccccagaagcagcaccagcagcagagaggccctgcacaccgccggctacgagatgagcctgaacggcagccccagaagccactacctggccgacagcgaccccctgatcagcaagagcgccagcctgcccgcctacagaagaaacggcctgcacagaacccccagcgccgacctgttccactacgacagcatgaacgccgtgaactggggcatgagagagtacaagatctacccctacgagctgctgctggtgaccaccagaggcagaaacagactgcccaaggacgtggacagaaccagactggagagacacctgagccaggaggagttctaccaggtgttcggcatgaccatcagcgagttcgacagactggccctgtggaagagaaacgagctgaagaagcaggccagactgttctag

SEQ ID NO: 10009 - DNA, 1050 bp, Artificial Sequence
  Description of Artificial Sequence: Synthetic coding sequence
atggccatccccatcaccgtgctggactgcgacctgctgctgtacggcagaggccacagaaccctggacagattcaagctggacgacgtgaccgacgagtacctgatgagcatgtacggcttccccagacagttcatctactacctggtggagctgctgggcgccaacctgagcagacccacccagagaagcagagccatcagccccgagacccaggtgctggccgccctgggcttctacaccagcggcagcttccagaccagaatgggcgacgccatcggcatcagccaggccagcatgagcagatgcgtggccaacgtgaccgaggccctggtggagagagccagccagttcatcagattccccgccgacgaggccagcatccaggccctgaaggacgagttctacggcctggccggcatgcccggcgtgatgggcgtggtggactgcatccacgtggccatcaaggcccccaacgccgaggacctgagctacgtgaacagaaagggcctgcacagcctgaactgcctgatggtgtgcgacatcagaggcaccctgatgaccgtggagaccaactggcccggcagcctgcaggactgcgccgtgctgcagcagagcagcctgagcagccagttcgaggccggcatgcacaaggacagctggctgctgggcgacagcagcttcttcctgagaacctggctgatgacccccctgcacatccccgagacccccgccgagtacagatacaacatggcccacagcgccacccacagcgtgatcgagaagaccttcagaaccctgtgcagcagattcagatgcctggacggcagcaagggcgccctgcagtacagccccgagaagagcagccacatcatcctggcctgctgcgtgctgcacaacatcagcctggagcacggcatggacgtgtggagcagccccatgaccggccccatggagcagccccccgaggaggagtacgagcacatggagagcctggacctggaggccgacagaatcagacaggagctgatgctgacccacttcagctag

SEQ ID NO: 10010 - DNA, 1794 bp, Artificial Sequence
  Description of Artificial Sequence: Synthetic coding sequence
atgagcagcaagggcagcagcaccgacggcagaaccgacctggccaacggcagcctgagcagcagccccgaggagatgagcggcgccgaggagggcagagagaccagcagcggcatcgaggtggaggccagcgacctgagcctgagcctgaccggcgacgacggcggccccaacagaaccagcaccgagagcagaggcaccgacaccgagagcagcggcgaggacaaggacagcgacagcatggaggacaccggccactacagcatcaacgacgagaacagagtgcacgacagaagcgaggaggaggaggaggaggaggaggaggaggaggaggagcagcccagaagaagagtgcagagaaagagagccaacagagaccaggacagcagcgacgacgagagagccctggaggactgggtgagcagcgagaccagcgccctgcccagacccagatggcaggccctgcccgccctgagagagagagagctgggcagcagcgccagattcgtgtacgaggcctgcggcgccagagtgttcgtgcagagattcagactgcagcacggcctggagggccacaccggctgcgtgaacaccctgcacttcaaccagagaggcacctggctggccagcggcagcgacgacctgaaggtggtggtgtgggactgggtgagaagacagcccgtgctggacttcgagagcggccacaagagcaacgtgttccaggccaagttcctgcccaacagcggcgacagcaccctggccatgtgcgccagagacggccaggtgagagtggccgagctgagcgccacccagtgctgcaagaacaccaagagagtggcccagcacaagggcgccagccacaagctggccctggagcccgacagcccctgcaccttcctgagcgccggcgaggacgccgtggtgttcaccatcgacctgagacaggacagacccgccagcaagctggtggtgaccaaggagaaggagaagaaggtgggcctgtacaccatctacgtgaaccccgccaacacccaccagttcgccgtgggcggcagagaccagttcgtgagaatctacgaccagagaaagatcgacgagaacgagaacaacggcgtgctgaagaagttctgcccccaccacctggtgaacagcgagagcaaggccaacatcacctgcctggtgtacagccacgacggcaccgagctgctggccagctacaacgacgaggacatctacctgttcaacagcagccacagcgacggcgcccagtacgtgaagagatacaagggccacagaaacaacgccaccgtgaagggcgtgaacttctacggccccaagagcgagttcgtggtgagcggcagcgactgcggccacatcttcctgtgggagaagagcagctgccagatcatccagttcatggagggcgacaagggcggcgtggtgaactgcctggagccccacccccacctgcccgtgctggccaccagcggcctggaccacgacgtgaagatctgggcccccaccgccgaggccagcaccgagctgaccggcctgaaggacgtgatcaagaagaacaagagagagagagacgaggacagcctgcaccagaccgacctgttcgacagccacatgctgtggttcctgatgcaccacctgagacagagaagacaccacagaagatggagagagcccggcgtgggcgccaccgacgccgacagcgacgagagccccagcagcagcgacaccagcgacgaggaggagggccccgacagagtgcagtgcatgcccagctag

SEQ ID NO: 10011 - DNA, 933 bp, Artificial Sequence
  Description of Artificial Sequence: Synthetic coding sequence
atgagccagcagctgaagaagagagccaagaccagacaccagaagggcctgggcggcagagcccccagcggcgccaagcccagacagggcaagagcagccaggacctgcaggccgagatcgagcccgtgagcgccgtgtgggccctgtgcgacggctacgtgtgctacgagcccggcccccaggccctgggcggcgacgacttcagcgactgctacatcgagtgcgtgatcagaggcgagttcagccagcccatcctggaggaggacagcctgttcgagagcctggagtacctgaagaagggcagcgagcagcagctgagccagaaggtgttcgaggccagcagcctggagtgcagcctggagtacatgaagaagggcgtgaagaaggagctgccccagaagatcgtgggcgagaacagcctggagtacagcgagtacatgaccggcaagaagctgccccccggcggcatccccggcatcgacctgagcgaccccaagcagctggccgagttcgccagaaagaagccccccatcaacaaggagtacgacagcctgagcgccatcgcctgcccccagagcggctgcaccagaaagctgagaaacagagccgccctgagaaagcacctgctgatccacggccccagagaccacgtgtgcgccgagtgcggcaaggccttcgtggagagcagcaagctgaagagacacttcctggtgcacaccggcgagaagcccttcagatgcaccttcgagggctgcggcaagagattcagcctggacttcaacctgagaacccacgtgagaatccacaccggcgagaagagattcgtgtgccccttccagggctgcaacagaagattcatccagagcaacaacctgaaggcccacatcctgacccacgccaacaccaacaagaacgagcaggagggcaagtag

SEQ ID NO: 10012 - DNA, 1149 bp, Artificial Sequence
  Description of Artificial Sequence: Synthetic coding sequence
atgctgagatggaccgtgcacctggagggcggccccagaagagtgaaccacgccgccgtggccgtgggccacagagtgtacagcttcggcggctactgcagcggcgaggactacgagaccctgagacagatcgacgtgcacatcttcaacgccgtgagcctgagatggaccaagctgccccccgtgaagagcgccatcagaggccaggcccccgtggtgccctacatgagatacggccacagcaccgtgctgatcgacgacaccgtgctgctgtggggcggcagaaacgacaccgagggcgcctgcaacgtgctgtacgccttcgacgtgaacacccacaagtggttcacccccagagtgagcggcaccgtgcccggcgccagagacggccacagcgcctgcgtgctgggcaagatcatgtacatcttcggcggctacgagcagcaggccgactgcttcagcaacgacatccacaagctggacaccagcaccatgacctggaccctgatctgcaccaagggcagccccgccagatggagagacttccacagcgccaccatgctgggcagccacatgtacgtgttcggcggcagagccgacagattcggccccttccacagcaacaacgagatctactgcaacagaatcagagtgttcgacaccagaaccgaggcctggctggactgcccccccacccccgtgctgcccgagggcagaagaagccacagcgccttcggctacaacggcgagctgtacatcttcggcggctacaacgccagactgaacagacacttccacgacctgtggaagttcaaccccgtgagcttcacctggaagaagatcgagcccaagggcaagggcccctgccccagaagaagacagtgctgctgcatcgtgggcgacaagatcgtgctgttcggcggcaccagccccagccccgaggagggcctgggcgacgagttcgacctgatcgaccacagcgacctgcacatcctggacttcagccccagcctgaagaccctgtgcaagctggccgtgatccagtacaacctggaccagagctgcctgccccacgacatcagatgggagctgaacgccatgaccaccaacagcaacatcagcagacccatcgtgagcagccacggctag

SEQ ID NO: 10013 - DNA, 1827 bp, Artificial Sequence
  Description of Artificial Sequence: Synthetic coding sequence
atggccgccgccgccgccgccgtgggccccggcgccggcggcgccggcagcgccgtgcccggcggcgccggcccctgcgccaccgtgagcgtgttccccggcgccagactgctgaccatcggcgacgccaacggcgagatccagagacacgccgagcagcaggccctgagactggaggtgagagccggccccgacagcgccggcatcgccctgtacagccacgaggacgtgtgcgtgttcaagtgcagcgtgagcagagagaccgagtgcagcagagtgggcaagcagagcttcatcatcaccctgggctgcaacagcgtgctgatccagttcgccacccccaacgacttctgcagcttctacaacatcctgaagacctgcagaggccacaccctggagagaagcgtgttcagcgagagaaccgaggagagcagcgccgtgcagtacttccagttctacggctacctgagccagcagcagaacatgatgcaggactacgtgagaaccggcacctaccagagagccatcctgcagaaccacaccgacttcaaggacaagatcgtgctggacgtgggctgcggcagcggcatcctgagcttcttcgccgcccaggccggcgccagaaagatctacgccgtggaggccagcaccatggcccagcacgccgaggtgctggtgaagagcaacaacctgaccgacagaatcgtggtgatccccggcaaggtggaggaggtgagcctgcccgagcaggtggacatcatcatcagcgagcccatgggctacatgctgttcaacgagagaatgctggagagctacctgcacgccaagaagtacctgaagcccagcggcaacatgttccccaccatcggcgacgtgcacctggcccccttcaccgacgagcagctgtacatggagcagttcaccaaggccaacttctggtaccagcccagcttccacggcgtggacctgagcgccctgagaggcgccgccgtggacgagtacttcagacagcccgtggtggacaccttcgacatcagaatcctgatggccaagagcgtgaagtacaccgtgaacttcctggaggccaaggagggcgacctgcacagaatcgagatccccttcaagttccacatgctgcacagcggcctggtgcacggcctggccttctggttcgacgtggccttcatcggcagcatcatgaccgtgtggctgagcaccgcccccaccgagcccctgacccactggtaccaggtgagatgcctgttccagagccccctgttcgccaaggccggcgacaccctgagcggcacctgcctgctgatcgccaacaagagacagagctacgacatcagcatcgtggcccaggtggaccagaccggcagcaagagcagcaacctgctggacctgaagaaccccttcttcagatacaccggcaccacccccagccccccccccggcagccactacaccagccccagcgagaacatgtggaacaccggcagcacctacaacctgagcagcggcatggccgtggccggcatgcccaccgcctacgacctgagcagcgtgatcgccagcggcagcagcgtgggccacaacaacctgatccccctggccaacaccggcatcgtgaaccacacccacagcagaatgggcagcatcatgagcaccggcatcgtgcagggcagcagcggcgcccagggcagcggcggcggcagcaccagcgcccactacgccgtgaacagccagttcaccatgggcggccccgccatcagcatggccagccccatgagcatccccaccaacaccatgcactacggcagctag

SEQ ID NO: 10014 - DNA, 2913 bp, Artificial Sequence
  Description of Artificial Sequence: Synthetic coding sequence
atgcagagcaccgacctgggcaacaaggagagcggcaagatctggcacagaaagcccagccccgccaccagagacggcatcatcgtgaacatcatccacaacaccagcgactaccaccccaaggtgctgagattcctgaacgtggccttcgacggcaccggcgactgcctgatcgccggcgaccaccagggcaacatctacgtgttcgacctgcacggcaacagattcaacctggtgcagagaaccgcccaggcctgcaccgccctggccttcaacctgagaagaaagagcgagttcctggtggccctggccgactacagcatcaagtgcttcgacaccgtgaccaaggagctggtgagctggatgagaggccacgagagcagcgtgttcagcatcagcgtgcacgccagcggcaagtacgccatcaccaccagcagcgacaccgcccagctgtgggacctggacaccttccagagaaagagaaagctgaacatcagacagagcgtgggcatccagaaggtgttcttcctgcccctgagcaacaccatcctgagctgcttcaaggacaacagcatcttcgcctgggagtgcgacaccctgttctgcaagtaccagctgcccgccccccccgagagcagcagcatcctgtacaaggtgttcgccgtgaccagagacggcagaatcctggccgccggcggcaagagcaaccacctgcacctgtggtgcctggaggccagacagctgttcagaatcatccagatgcccaccaaggtgagagccatcagacacctggagttcctgcccgacagcttcgacgccggcagcaaccaggtgctgggcgtgctgagccaggacggcatcatgagattcatcaacatgcagacctgcaagctgctgttcgagatcggcagcctggacgagggcatcagcagcagcgccatcagcccccacggcagatacatcgccagcatcatggagaacggcagcctgaacatctacagcgtgcaggccctgacccaggagatcaacaagccccccccccccctggtgaaggtgatcgaggacctgcccaagaacaagctgagcagcagcgacctgaagatgaaggtgaccagcggcagagtgcagcagcccgccaagagcagagagagcaagatgcagaccagaatcctgaagcaggacctgaccggcgacttcgagagcaagaagaacgagctgcccgacggcctgaacaagaagagactgcagatcctgctgaagggctacggcgagtaccccaccaagtacagaatgttcatctggagaagcctgctgcagctgcccgagaaccacaccgccttcagcaccctgatcgacaagggcacccacgtggccttcctgaacctgcagaagaagtaccccatcaagagcagaaagctgctgagagtgctgcagagaaccctgagcgccctggcccactggagcgtgatcttcagcgacaccccctacctgcccctgctggccttccccttcgtgaagctgttccagaacaaccagctgatctgcttcgaggtgatcgccaccctgatcatcaactggtgccagcactggttcgagtacttccccaacccccccatcaacatcctgagcatgatcgagaacgtgctggccttccacgacaaggagctgctgcagcacttcatcgaccacgacatcaccagccagctgtacgcctggcccctgctggagaccgtgttcagcgaggtgctgaccagagaggagtggctgaagctgttcgacaacatcttcagcaaccaccccagcttcctgctgatgaccgtggtggcctacaacatctgcagcagaacccccctgctgagctgcaacctgaaggacgacttcgagttcttcttccaccacagaaacaacctggacatcaacgtggtgatcagacaggtgtaccacctgatggagaccacccccaccgacatccaccccgacagcatgctgaacgtgttcgtggccctgaccaagggccagtaccccgtgttcaaccagtaccccaagttcatcgtggactaccagacccaggagagagagagaatcagaaacgacgagctggactacctgagagagagacagaccgtggaggacatgcaggccaaggtggaccagcagagagtggaggacgaggcctggtaccagaagcaggagctgctgagaaaggccgaggagaccagaagagagatgctgctgcaggaggaggagaagatgatccagcagagacagagactggccgccgtgaagagagagctgaaggtgaaggagatgcacctgcaggacgccgccagaagaagattcctgaagctgcagcaggaccagcaggagatggagctgagaagactggacgacgagatcggcagaaagaacctgaccgagaaccaggaggccctggccaaggagatgagagccgacgccgacgcctacagaagaaaggtggacctggaggagcacatgttccacaagctgatcgaggccggcgagacccagagccagaagacccagaagtggaaggaggccgagggcaaggagttcagactgagaagcgccaagaaggccagcgccctgagcgacgccagcagaaagtggttcctgaagcaggagatcaacgccgccgtggagcacgccgagaacccctgccacaaggaggagcccagattccagaacgagcaggacagcagctgcctgcccagaaccagccagctgaacgacagcagcgagatggaccccagcacccagatcagcctgaacagaagagccgtggagtgggacaccaccggccagaacctgatcaagaaggtgagaaacctgagacagagactgaccgccagagccagacacagatgccagaccccccacctgctggccgcctag

SEQ ID NO: 10015 - DNA, 648 bp, Artificial Sequence
  Description of Artificial Sequence: Synthetic coding sequence
atgagctgcaccatcgagaaggccctggccgacgccaaggccctggtggagagactgagagaccacgacgacgccgccgagagcctgatcgagcagaccaccgccctgaacaagagagtggaggccatgaagcagtaccaggaggagatccaggagctgaacgaggtggccagacacagacccagaagcaccctggtgatgggcatccagcaggagaacagacagatcagagagctgcagcaggagaacaaggagctgagaaccagcctggaggagcaccagagcgccctggagctgatcatgagcaagtacagagagcagatgttcagactgctgatggccagcaagaaggacgaccccggcatcatcatgaagctgaaggagcagcacagcaaggagctgcaggcccacgtggaccagatcaccgagatggccgccgtgatgagaaaggccatcgagatcgacgagcagcagggctgcaaggagcaggagagaatcttccagctggagcaggagaacaagggcctgagagagatcctgcagatcaccagagagagcttcctgaacctgagaaaggacgacgccagcgagagcaccagcctgagcgccctggtgaccaacagcgacctgagcctgagaaagagctag

SEQ ID NO: 10016 - DNA, 2676 bp, Artificial Sequence
  Description of Artificial Sequence: Synthetic coding sequence
atggccgtggccagagtggacgccgccctgccccccggcgagggcagcgtggtgaactggagcggccagggcctgcagaagctgggccccaacctgccctgcgaggccgacatccacaccctgatcctggacaagaaccagatcatcaagctggagaacctggagaagtgcaagagactgatccagctgagcgtggccaacaacagactggtgagaatgatgggcgtggccaagctgaccctgctgagagtgctgaacctgccccacaacagcatcggctgcgtggagggcctgaaggagctggtgcacctggagtggctgaacctggccggcaacaacctgaaggccatggagcagatcaacagctgcaccgccctgcagcacctggacctgagcgacaacaacatcagccagatcggcgacctgagcaagctggtgagcctgaagaccctgctgctgcacggcaacatcatcaccagcctgagaatggcccccgcctacctgcccagaagcctggccatcctgagcctggccgagaacgagatcagagacctgaacgagatcagcttcctggccagcctgaccgagctggagcagctgagcatcatgaacaacccctgcgtgatggccacccccagcatccccggcttcgactacagaccctacatcgtgagctggtgcctgaacctgagagtgctggacggctacgtgatcagccagaaggagagcctgaaggccgagtggctgtacagccagggcaagggcagagcctacagacccggccagcacatccagctggtgcagtacctggccaccgtgtgccccctgaccagcaccctgggcctgcagaccgccgaggacgccaagctggagaagatcctgagcaagcagagattccaccagagacagctgatgaaccagagccagaacgaggagctgagccccctggtgcccgtggagaccagagccagcctgatccccgagcacagcagccccgtgcaggactgccagatcagccaggagagcgagcccgtgatccaggtgaacagctgggtgggcatcaacagcaacgacgaccagctgttcgccgtgaagaacaacttccccgccagcgtgcacaccaccagatacagcagaaacgacctgcacctggaggacatccagaccgacgaggacaagctgaactgcagcctgctgagcagcgagagcaccttcatgcccgtggccagcggcctgagccccctgagccccaccgtggagctgagactgcagggcatcaacctgggcctggaggacgacggcgtggccgacgagagcgtgaagggcctggagagccaggtgctggacaaggaggaggagcagcccctgtgggccgccaacgagaacagcgtgcagatgatgagaagcgagatcaacaccgaggtgaacgagaaggccggcctgctgccctgccccgagcccaccatcatcagcgccatcctgaaggacgacaaccacagcctgaccttcttccccgagagcaccgagcagaagcagagcgacatcaagaagcccgagaacacccagcccgagaacaaggagaccatcagccaggccaccagcgagaagctgcccatgatcctgacccagagaagcgtggccctgggccaggacaaggtggccctgcagaagctgaacgacgccgccaccaagctgcaggcctgctggagaggcttctacgccagaaactacaacccccaggccaaggacgtgagatacgagatcagactgagaagaatgcaggagcacatcgtgtgcctgaccgacgagatcagaagactgagaaaggagagagacgaggagagaatcaagaagttcgtgcaggaggaggccttcagattcctgtggaaccagaagtggggcctggccatcctgcccagacccgtgagcaacttctgggcccaggccgtgttccccccccagccccccaaggtgagaagcctgcaggtgtggcagcagaccgtggaccagagactgagcagctggcacaccgacgtgccccccatcagcagcaccctggtgcccagcaagcaccccctgttcacccagagccaggagagcagctgcgaccagaacgccgactggttcatcgccagcgacgtggccccccaggagaagagcctgcccgagttccccgacagcggcttccacagcagcctgaccgagcaggtgcacagcctgcagcacagcctggacttcgagaagagcagcaccgagggcagcgagagcagcatcatgggcaacagcatcgacaccgtgagatacggcaaggagagcgacctgggcgacgtgagcgaggagcacggcgagtggaacaaggagagcagcaacaacgagcaggacaacagcctgctggagcagtacctgaccagcgtgcagcagctggaggacgccgacgagagaaccaacttcgacaccgagaccagagacagcaagctgcacatcgcctgcttccccgtgcagctggacaccctgagcgacggcgccagcgtggacgagagccacggcatcagcccccccctgcagggcgagatcagccagacccaggagaacagcaagctgaacgccgaggtgcagggccagcagcccgagtgcgacagcaccttccagctgctgcacgtgggcgtgaccgtgtag

SEQ ID NO: 10017 - DNA, 828 bp, Artificial Sequence
  Description of Artificial Sequence: Synthetic coding sequence
atggccgagcccgccagcgtggccgccgagagcctggccggcagcagagccagagccgccagaaccgtgctgggccaggtggtgctgcccggcgaggagctgctgctgcccgagcaggaggacgccgagggccccggcggcgccgtggagagacccctgagcctgaacgccagagcctgcagcagagtgagagtggtgtgcggccccggcctgagaagatgcggcgacagactgctggtgaccaagtgcggcagactgagacacaaggagcccggcagcggcagcggcggcggcgtgtactgggtggacagccagcagaagagatacgtgcccgtgaagggcgaccacgtgatcggcatcgtgaccgccaagagcggcgacatcttcaaggtggacgtgggcggcagcgagcccgccagcctgagctacctgagcttcgagggcgccaccaagagaaacagacccaacgtgcaggtgggcgacctgatctacggccagttcgtggtggccaacaaggacatggagcccgagatggtgtgcatcgacagctgcggcagagccaacggcatgggcgtgatcggccaggacggcctgctgttcaaggtgaccctgggcctgatcagaaagctgctggcccccgactgcgagatcatccaggaggtgggcaagctgtaccccctggagatcgtgttcggcatgaacggcagaatctgggtgaaggccaagaccatccagcagaccctgatcctggccaacatcctggaggcctgcgagcacatgaccagcgaccagagaaagcagatcttcagcagactggccgagagctag

SEQ ID NO: 10018 - DNA, 1620 bp, Artificial Sequence
  Description of Artificial Sequence: Synthetic coding sequence
atggccaccagcgcccccctgagaagcctggaggaggaggtgacctgcagcatctgcctggactacctgagagaccccgtgaccatcgactgcggccacgtgttctgcagaagctgcaccaccgacgtgagacccatcagcggcagcagacccgtgtgccccctgtgcaagaagcccttcaagaaggagaacatcagacccgtgtggcagctggccagcctggtggagaacatcgagagactgaaggtggacaagggcagacagcccggcgaggtgaccagagagcagcaggacgccaagctgtgcgagagacacagagagaagctgcactactactgcgaggacgacggcaagctgctgtgcgtgatgtgcagagagagcagagagcacagaccccacaccgccgtgctgatggagaaggccgcccagccccacagagagaagatcctgaaccacctgagcaccctgagaagagacagagacaagatccagggcttccaggccaagggcgaggccgacatcctggccgccctgaagaagctgcaggaccagagacagtacatcgtggccgagttcgagcagggccaccagttcctgagagagagagaggagcacctgctggagcagctggccaagctggagcaggagctgaccgagggcagagagaagttcaagagcagaggcgtgggcgagctggccagactggccctggtgatcagcgagctggagggcaaggcccagcagcccgccgccgagctgatgcaggacaccagagacttcctgaacagataccccagaaagaagttctgggtgggcaagcccatcgccagagtggtgaagaagaagaccggcgagttcagcgacaagctgctgagcctgcagagaggcctgagagagttccagggcaagctgctgagagacctggagtacaagaccgtgagcgtgaccctggacccccagagcgccagcggctacctgcagctgagcgaggactggaagtgcgtgacctacaccagcctgtacaagagcgcctacctgcacccccagcagttcgactgcgagcccggcgtgctgggcagcaagggcttcacctggggcaaggtgtactgggaggtggaggtggagagagagggctggagcgaggacgaggaggagggcgacgaggaggaggagggcgaggaggaggaggaggaggaggaggccggctacggcgacggctacgacgactgggagaccgacgaggacgaggagagcctgggcgacgaggaggaggaggaggaggaggaggaggaggaggtgctggagagctgcatggtgggcgtggccagagacagcgtgaagagaaagggcgacctgagcctgagacccgaggacggcgtgtgggccctgagactgagcagcagcggcatctgggccaacaccagccccgaggccgagctgttccccgccctgagacccagaagagtgggcatcgccctggactacgagggcggcaccgtgaccttcaccaacgccgagagccaggagctgatctacaccttcaccgccaccttcaccagaagactggtgcccttcctgtggctgaagtggcccggcaccagactgctgctgagaccctag

SEQ ID NO: 10019 - DNA, 1233 bp, Artificial Sequence
  Description of Artificial Sequence: Synthetic coding sequence
atgttcaacaacgagctgatggccgacgtgcacttcgtggtgggcccccccggcgccaccagaaccgtgcccgcccacaagtacgtgctggccgtgggcagcagcgtgttctacgccatgttctacggcgacctggccgaggtgaagagcgagatccacatccccgacgtggagcccgccgccttcctgatcctgctgaagtacatgtacagcgacgagatcgacctggaggccgacaccgtgctggccaccctgtacgccgccaagaagtacatcgtgcccgccctggccaaggcctgcgtgaacttcctggagaccagcctggaggccaagaacgcctgcgtgctgctgagccagagcagactgttcgaggagcccgagctgacccagagatgctgggaggtgatcgacgcccaggccgagatggccctgagaagcgagggcttctgcgagatcgacagacagaccctggagatcatcgtgaccagagaggccctgaacaccaaggaggccgtggtgttcgaggccgtgctgaactgggccgaggccgagtgcaagagacagggcctgcccatcacccccagaaacaagagacacgtgctgggcagagccctgtacctggtgagaatccccaccatgaccctggaggagttcgccaacggcgccgcccagagcgacatcctgaccctggaggagacccacagcatcttcctgtggtacaccgccaccaacaagcccagactggacttccccctgaccaagagaaagggcctggccccccagagatgccacagattccagagcagcgcctacagaagcaaccagtggagatacagaggcagatgcgacagcatccagttcgccgtggacagaagagtgttcatcgccggcctgggcctgtacggcagcagcagcggcaaggccgagtacagcgtgaagatcgagctgaagagactgggcgtggtgctggcccagaacctgaccaagttcatgagcgacggcagcagcaacaccttccccgtgtggttcgagcaccccgtgcaggtggagcaggacaccttctacaccgccagcgccgtgctggacggcagcgagctgagctacttcggccaggagggcatgaccgaggtgcagtgcggcaaggtggccttccagttccagtgcagcagcgacagcaccaacggcaccggcgtgcagggcggccagatccccgagctgatcttctacgcctag

SEQ ID NO: 10020 - DNA, 966 bp, Artificial Sequence
  Description of Artificial Sequence: Synthetic coding sequence
atgagagccctggccgccctgagcgccccccccaacgagagactgctgcccagagaccccgccgccaccagagaccccgacgccgccagacccgccagaagaagcgccgtggagagactggccgccgacagagccaagtacgtgagaggcagacccggcaccggcagaggcgtggccagcgagggcagcggccccggcgccatcaagtgccccggcaacgaccccggcccccccgccagagcccccgcccccgtggccagaagagccatcgccagaaagcccctgagacccgacagcctgatcatctacagacagaagtgcgagttcgtgagaggcagcggcgccgacggccccagagccagcctggtgaagaagctgttccagggccccggcaaggacaaggcccccgtgcccagaaccggcgacgagggcaaggccggcaaccccgagaccgtgcccaccacccccggccccgccgccgaccccgccatccccgagacccccgcccccgccgccagaagcgccgcccccagcagcgtgcccgccgccccccccggccccgagcccagagtggtgagaagaagaggcctgcagagaagccagagcgacctgagcagcagatacagcgccgccctggccgagagcgacaccttcttccagtactgcggcctggaccccgaggtggtggaggccctgggcagagagaacttcaccgccggcagcgactgcgtgaccctgaaggtgagaagcgtgagcgtggccaccagcggcagcggcttcagcagacacagcggcggcgacgacgagggcctgcaggaggaggagctgatcgagcaggtgcccagcaccaccagcgtgatcgagagaaacgccagaatcatcaagtggctgtacacctgcaagaaggccaaggagacccccagccaggagcagagcagaaccagaggcagcaagcccagcagatag

SEQ ID NO: 10021 - DNA, 945 bp, Artificial Sequence
  Description of Artificial Sequence: Synthetic coding sequence
atgagcgagaacgccgcccccggcctgatcagcgagctgaagctggccgtgccctggggccacatcgccgccaaggcctggggcagcctgcagggcccccccgtgctgtgcctgcacggctggctggacaacgccagcagcttcgacagactgatccccctgctgccccaggacttctactacgtggccatggacttcggcggccacggcctgagcagccactacagccccggcgtgccctactacctgcagaccttcgtgagcgagatcagaagagtggtggccgccctgaagtggaacagattcagcatcctgggccacagcttcggcggcgtggtgggcggcatgttcttctgcaccttccccgagatggtggacaagctgatcctgctggacacccccctgttcctgctggagagcgacgagatggagaacctgctgacctacaagagaagagccatcgagcacgtgctgcaggtggaggccagccaggagcccagccacgtgttcagcctgaagcagctgctgcagagactgctgaagagcaacagccacctgagcgaggagtgcggcgagctgctgctgcagagaggcaccaccaaggtggccaccggcctggtgctgaacagagaccagagactggcctgggccgagaacagcatcgacttcatcagcagagagctgtgcgcccacagcatcagaaagctgcaggcccacgtgctgctgatcaaggccgtgcacggctacttcgacagcagacagaactacagcgagaaggagagcctgagcttcatgatcgacaccatgaagagcaccctgaaggagcagttccagttcgtggaggtgcccggcaaccactgcgtgcacatgagcgagccccagcacgtggccagcatcatcagcagcttcctgcagtgcacccacatgctgcccgcccagctgtag

SEQ ID NO: 10022 - DNA, 3945 bp, Artificial Sequence
  Description of Artificial Sequence: Synthetic coding sequence
atggccagcaagggcgccggcatgagcttcagcagaaagagctacagactgaccagcgacgccgagaagagcagagtgaccggcatcgtgcaggagaagctgctgaacgactacctgaacagaatcttcagcagcagcgagcacgccccccccgccgccaccagcagaaagcccctgaacttccagaacctgcccgagcacctggaccagctgctgcaggtggacaacgaggaggaggagagccagggccaggtggagggcagactgggccccagcaccgtggtgctggaccacaccggcggcttcgagggcctgctgctggtggacgacgacctgctgggcgtgatcggccacagcaacttcggcaccatcagaagcaccacctgcgtgtacaagggcaagtggctgtacgaggtgctgatcagcagccagggcctgatgcagatcggctggtgcaccatcagctgcagattcaaccaggaggagggcgtgggcgacacccacaacagctacgcctacgacggcaacagagtgagaaagtggaacgtgaccaccaccaactacggcaaggcctgggccgccggcgacatcgtgagctgcctgatcgacctggacgacggcaccctgagcttctgcctgaacggcgtgagcctgggcaccgccttcgagaacctgagcagaggcctgggcatggcctacttccccgccatcagcctgagcttcaaggagagcgtggccttcaacttcggcagcagacccctgagataccccgtggccggctacagacccctgcaggacccccccagcgccgacctggtgagagcccagagactgctgggctgcttcagagccgtgctgagcgtggagctggaccccgtggagggcagactgctggacaaggagagcagcaagtggagactgagaggccagcccaccgtgctgctgaccctggcccacatcttccaccacttcgcccccctgctgagaaaggtgtacctggtggaggccgtgctgatgagcttcctgctgggcatcgtggagaagggcacccccacccaggcccagagcgtggtgcaccaggtgctggacctgctgtggctgttcatggaggactacgaggtgcaggactgcctgaagcagctgatgatgagcctgctgagactgtacagattcagccccatcgtgcccgacctgggcctgcagatccactacctgagactgaccatcgccatcctgagacacgagaagagcagaaagttcctgctgagcaacgtgctgttcgacgtgctgagaagcgtggtgttcttctacatcaagagccccctgagagtggaggaggccggcctgcaggagctgatccccaccacctggtggccccactgcagcagcagagagggcaaggagagcaccgagatgaaggaggagaccgccgaggagagactgagaagaagagcctacgagagaggctgccagagactgagaaagagaatcgaggtggtggaggagctgcaggtgcagatcctgaagctgctgctggacaacaaggacgacaacggcggcgaggccagcagatacatcttcctgaccaagttcagaaagttcctgcaggagaacgccagcggcagaggcaacatgcccatgctgtgcccccccgagtacatggtgtgcttcctgcacagactgatcagcgccctgagatactactgggacgagtacaaggccagcaacccccacgccagcttcagcgaggaggcctacatccccccccaggtgttctacaacggcaaggtggactacttcgacctgcagagactgggcggcctgctgagccacctgagaaagaccctgaaggacgacctggccagcaaggccaacatcgtgatcgaccccctggagctgcagagcaccgccatggacgacctggacgaggacgaggagcccgcccccgccatggcccagagacccatgcaggccctggccgtgggcggccccctgcccctgcccagacccggctggctgagcagccccaccctgggcagagccaacagattcctgagcaccgccgccgtgagcctgatgacccccagaagacccctgagcaccagcgagaaggtgaaggtgagaaccctgagcgtggagcagagaaccagagaggacatcgagggcagccactggaacgagggcctgctgctgggcagaccccccgaggagcccgagcagcccctgaccgagaacagcctgctggaggtgctggacggcgccgtgatgatgtacaacctgagcgtgcaccagcagctgggcaagatggtgggcgtgagcgacgacgtgaacgagtacgccatggccctgagagacaccgaggacaagctgagaagatgccccaagagaagaaaggacatcctggccgagctgaccaagagccagaaggtgttcagcgagaagctggaccacctgagcagaagactggcctgggtgcacgccaccgtgtacagccaggagaagatgctggacatctactggctgctgagagtgtgcctgagaaccatcgagcacggcgacagaaccggcagcctgttcgccttcatgcccgagttctacctgagcgtggccatcaacagctacagcgccctgaagaactacttcggccccgtgcacagcatggaggagctgcccggctacgaggagaccctgaccagactggccgccatcctggccaagcacttcgccgacgccagaatcgtgggcaccgacatcagagacagcctgatgcaggccctggccagctacgtgtgctacccccacagcctgagagccgtggagagaatccccgaggagcagagaatcgccatggtgagaaacctgctggccccctacgagcagagaccctgggcccagaccaactggatcctggtgagactgtggagaggctgcggcttcggctacagatacaccagactgccccacctgctgaagaccaagctggaggacgccaacctgcccagcctgcagaagccctgccccagcaccctgctgcagcagcacatggccgacctgctgcagcagggccccgacgtggcccccagcttcctgaacagcgtgctgaaccagctgaactgggccttcagcgagttcatcggcatgatccaggagatccagcaggccgccgagagactggagagaaacttcgtggacagcagacagctgaaggtgtgcgccacctgcttcgacctgagcgtgagcctgctgagagtgctggagatgaccatcaccctggtgcccgagatcttcctggactggaccagacccaccagcgagatgctgctgagaagactggcccagctgctgaaccaggtgctgaacagagtgaccgccgagagaaacctgttcgacagagtggtgaccctgagactgcccggcctggagagcgtggaccactaccccatcctggtggccgtgaccggcatcctggtgcagctgctggtgagaggccccgccagcgagagagagcaggccaccagcgtgctgctggccgacccctgcttccagctgagaagcatctgctacctgctgggccagcccgagccccccgcccccggcaccgccctgcccgcccccgacagaaagagattcagcctgcagagctacgccgactacatcagcgccgacgagctggcccaggtggagcagatgctggcccacctgaccagcgccagcgcccaggccgccgccgccagcctgcccaccagcgaggaggacctgtgccccatctgctacgcccaccccatcagcgccgtgttccagccctgcggccacaagagctgcaaggcctgcatcaaccagcacctgatgaacaacaaggactgcttcttctgcaagaccaccatcgtgagcgtggaggactgggagaagggcgccaacaccagcaccaccagcagcgccgcctag

SEQ ID NO: 10023 - DNA, 2646 bp, Artificial Sequence
  Description of Artificial Sequence: Synthetic coding sequence
atggccggcgccgcccccagagtgagatacctggccggcttctgctgccccctgggcggcctggccgccggcaagcccagagtgctgtgccacgaggccgaggtgttcctgagcaccggcagcgagctggtgtacgtgtacgaccaggagggcggcctgctgaccgccgccttcagattccccgaccaggtgtggcacctggagctgctggcccccagaagactgctgtacgccctgtgcgccagaagaggcctgtactgcctgagcctggaccaccccggcagaagcagaagcaccagccaggacgacagagacagcgaggacggcgaccagcccagccccgtgatccccgtggaccccgacgcctgcatcctgcccgacgccgccctgtgcgccttcaccctgctggacagcgtgctggtgaccctggtgcagggccccgccagatggaagatgcagctgttcgagcagccctgccccggcgaggaccccagacccggcggccagatcggcgaggtggagctgagcagctacaccccccccgccggcgtgcccggcaagcccgccgccccccacttcctgcccgtgctgtgcagcgtgagccccagcggcagcagagtgccccacgacctgctgggcggcagcggcggcttcaccctggaggacgccctgttcggcctgctgttcggcgccgacgccaccctgctgcagagccccgtggtgctgtgcggcctgcccgacggccagctgtgctgcgtgatcctgaaggccctggtgaccagcagaagcgcccccggcgaccccaacgccctggtgaagatcctgcaccacctggaggagcccgtgatcttcatcggcgccctgaagaccgagccccaggccgccgaggccgccgagaacttcctgcccgacgaggacgtgcactgcgactgcctggtggccttcggccaccacggcagaatgctggccatcaaggccagctgggacgagagcggcaagctggtgcccgagctgagagagtactgcctgcccggccccgtgctgtgcgccgcctgcggcggcggcggcagagtgtaccacagcacccccagcgacctgtgcgtggtggacctgagcagaggcagcacccccctgggccccgagcagcccgaggagggccccggcggcctgccccccatgctgtgccccgccagcctgaacatctgcagcgtggtgagcctgagcgccagccccagaacccacgagggcggcaccaagctgctggccctgagcgccaagggcagactgatgacctgcagcctggacctggacagcgagatgcccggccccgccagaatgaccaccgagagcgccggccagaagatcaaggagctgctgagcggcatcggcaacatcagcgagagagtgagcttcctgaagaaggccgtggaccagagaaacaaggccctgaccagcctgaacgaggccatgaacgtgagctgcgccctgctgagcagcggcaccggccccagacccatcagctgcaccaccagcaccacctggagcagactgcagacccaggacgtgctgatggccacctgcgtgctggagaacagcagcagcttcagcctggaccagggctggaccctgtgcatccaggtgctgaccagcagctgcgccctggacctggacagcgcctgcagcgccatcacctacaccatccccgtggaccagctgggccccggcgccagaagagaggtgaccctgcccctgggccccggcgagaacggcggcctggacctgcccgtgaccgtgagctgcaccctgttctacagcctgagagaggtggtgggcggcgccctggcccccagcgacagcgaggaccccttcctggacgagtgccccagcgacgtgctgcccgagcaggagggcgtgtgcctgcccctgagcagacacaccgtggacatgctgcagtgcctgagattccccggcctggcccccccccacaccagagcccccagccccctgggccccaccagagaccccgtggccaccttcctggagacctgcagagagcccggcagccagcccgccggccccgccagcctgagagccgagtacctgccccccagcgtggccagcatcaaggtgagcgccgagctgctgagagccgccctgaaggacggccacagcggcgtgcccctgtgctgcgccaccctgcagtggctgctggccgagaacgccgccgtggacgtggtgagagccagagccctgagcagcatccagggcgtggcccccgacggcgccaacgtgcacctgatcgtgagagaggtggccatgaccgacctgtgccccgccggccccatccaggccgtggagatccaggtggagagcagcagcctggccgacatctgcagagcccaccacgccgtggtgggcagaatgcagaccatggtgaccgagcaggccacccagggcagcagcgcccccgacctgagagtgcagtacctgagacagatccacgccaaccacgagaccctgctgagagaggtgcagaccctgagagacagactgtgcaccgaggacgaggccagcagctgcgccaccgcccagagactgctgcaggtgtacagacagctgagacaccccagcctgatcctgctgtag

SEQ ID NO: 10024 - DNA, 471 bp, Artificial Sequence
  Description of Artificial Sequence: Synthetic coding sequence
atgggcgacaagaagagccccaccagacccaagagacagcccaagcccagcagcgacgagggctactgggactgcagcgtgtgcaccttcagaaacagcgccgaggccttcaagtgcatgatgtgcgacgtgagaaagggcaccagcaccagaaaggagaagaaggacaaggtggagaaggagaagagcgagaaggagaccaccagcaagaagaacagccacaagaagaccagacccagactgaagaacgtggacagaagcagcgcccagcacctggaggtgaccgtgggcgacctgaccgtgatcatcaccgacttcaaggagaagaccaagagcccccccgccagcagcgccgccagcgccgaccagcacagccagagcggcagcagcagcgacaacaccgagagaggcatgagcagaagcagcagccccagaggcgaggccagcagcctgaacggcgagagccactag

SEQ ID NO: 10025 - DNA, 777 bp, Artificial Sequence
  Description of Artificial Sequence: Synthetic coding sequence
atgtgcgccctggagatggccgtgctggagatccagaccaacggcgacaccagagtgaccgaggaggccatcgccagagccagacacagcctgagcgaccccaacatgagagagttcatcctgtgctgcctggccagagaccccgccagaagacccagcgcccacagcctgctgttccacagagtgctgttcgaggtgcacagcctgaagctgctggccgcccactgcttcatccagcaccagtacctgatgcccgagaacgtggtggaggagaagaccaaggccatggacctgcacgccgtgctggccgagctgcccagacccagaagaccccccctgcagtggagatacagcgaggtgagcttcatggagctggacaagttcctggaggacgtgagaaacggcatctaccccctgatgaacttcgccgccaccagacccctgggcctgcccagagtgctggcccccccccccgaggaggtgcagaaggccaagacccccacccccgagcccttcgacagcgagaccagaaaggtgatccagatgcagtgcaacctggagagaagcgaggacaaggccagatggcacctgaccctgctgctggtgctggaggacagactgcacagacagctgacctacgacctgctgcccaccgacagcgcccaggacctggccagcgagctggtgcactacggcttcctgcacgaggacgacagaatgaagctggccgccttcctggagagcaccttcctgaagtacagaggcacccaggcctag

SEQ ID NO: 10026 - DNA, 564 bp, Artificial Sequence
  Description of Artificial Sequence: Synthetic coding sequence
atgctgggcagatacagagagtacagcaacggccaggccggcgccatcgagcacctgaaggagagcctggagcagagcatcgaccagctgagaagccagagactgctgagaaacagcggcggcagaagcatcagcgtgaccagcctgagcgccagcgacctggacggcggcaccggcagcgagctgcaccacttcccccccaccagccccctgaaggactacggcgacccccagggcatcaagagaatgagaagcagaaccggcgtgagattcgtgcaggagaccgacgacatgacccagctgcacggcttccaccagagcctgagagacctgagcagcgagcagatcagactgggcgacgacttcaacagagagctgagcagaagaagcagaagcgacgccgagaccaagagagccctggaggagctgaccgagaagctgaacgaggcccagaagcaggaggtgttcttcgtgaagagcctgggcaaggtgaagatccagtgcctgagcagcgccgaggtggacaacgtgttccccatcaacgtgtggcagtgcggcatctag

SEQ ID NO: 10027 - DNA, 927 bp, Artificial Sequence
  Description of Artificial Sequence: Synthetic coding sequence
atgatggacgtgagcggcgtgggcttccccagcaaggtgccctggaagaagatgagcgccgaggagctggagaaccagtactgccccagcagatgggtggtgagactgggcgccgaggaggccctgagaacctacagccagatcggcatcgaggccaccaccagagccagagccaccagaaagagcctgctgcacgtgccctacggcgacggcgagggcgagaaggtggacatctacttccccgacgagagcagcgaggccctgcccttcttcctgttcttccacggcggctactggcagagcggcagcaaggacgagagcgccttcatggtgcaccccctgaccgcccagggcgtggccgtggtgatcgtggcctacggcatcgcccccaagggcaccctggaccacatggtggaccaggtgaccagaagcgtggccttcgtgcagaagagataccccagcaacaagggcatctacctgtgcggccacagcgccggcgcccacctggccgccatgatgctgctggccgactggaccaagcacggcgtgacccccaacctgagaggcttcttcctggtgagcggcgtgttcgacctggagcccatcgtgtacaccagccagaacgtggccctgcagctgaccctggaggacgcccagagaaacagcccccagctgaaggtggcccaggcccagcccgtggaccccacctgcagagtgctggtggtggtgggccagttcgacagccccgagttccacagacagagctgggagttctaccaggtgctgcccgtgcagaccctgtgccagggcgagtggaaggccagcttcgaggagctgcacgacgtggaccacttcgagatcgtggagaacctgacccagaaggacaacgtgctgacccagatcatcctgaagaccatcttccagtag

SEQ ID NO: 10028 - DNA, 1461 bp, Artificial Sequence
  Description of Artificial Sequence: Synthetic coding sequence
atgagcggcagcacccccttccagatgagactggtgcacctggacctgaagggcgccccccccaaggtgagctacctgagcgagatcttccccctgttcagagccctgggcgccaacggcctgctgatcgagtacgaggacatgttcccctacgagggccccctgagactgctgagagccaagtacgcctacagccccagcgagatcaaggagatcctgcacctggccggcctgaacgagctggaggtgatccccctggtgcagaccttcggccacatggagttcgtgctgaagcacaccgccttcgcccacctgagagaggtgggcagcttcccctgcaccctgaacccccacgaggccgagagcctggccctggtgggcgccatgatcgaccaggtgctggagctgcaccccggcgcccagagactgcacatcggctgcgacgaggtgtactacctgggcgagggcgaggccagcagaagatggctgcagcaggagcagaacagcaccggcaagctgtgcctgagccacatgagagccgtggccagcggcgtgaaggccagaagacccagcgtgacccccctggtgtgggacgacatgctgagagacctgcccgaggaccagctggccgccagcggcgtgccccagctggtggagcccgtgctgtgggactacaccgccgacctggacgtgcacggcaaggtgctgctgatgcagaagtacagaagatgcggcttcccccagctgtgggccgccagcgccttcaagggcgccaccggccccagccaggccgtgccccccgtggagcaccacctgagaaaccacgtgcagtggctgcaggtggccggcagcggccccaccgacagcctgcagggcatcatcctgaccggctggcagagatacgaccactacagcgtgctgtgcgagctgctgcccgccggcgtgcccagcctggccgcctgcctgcagctgctgctgagaggcggcttcgacgaggacgtgaaggccaaggtggagaacctgctgggcatcagcagcctggagaagaccgaccccgtgagagagggcgccggcagcttccccggcagcaacatcctggccctggtgacccaggtgagcctgcacctgagaagcagcgtggacgccctgctggagggcaacagatacgtgaccggctggttcagcccctaccacagacagagaaagctgatccaccccgtgatggtgcagcacatccagcccgccgccctgagcctgctggcccagtggagcaccctggtgcaggagctggaggccgccctgcagctggccttctaccccgacgccgtggaggagtggctggaggagaacgtgcaccccagcctgcagagactgcaggccctgctgcaggacctgagcgaggtgagcgccccccccctgccccccaccagccccggcagagacgtggcccaggacccctag

SEQ ID NO: 10029 - DNA, 240 bp, Artificial Sequence
  Description of Artificial Sequence: Synthetic coding sequence
atgagcagccagcagcagcagagacagcagcagcagtgccccccccagagagcccagcagcagcaggtgaagcagccctgccagcccccccccgtgaagtgccaggagacctgcgcccccaagaccaaggacccctgcgccccccaggtgaagaagcagtgcccccccaagggcaccatcatccccgcccagcagaagtgccccagcgcccagcaggccagcaagagcaagcagaagtag

SEQ ID NO: 10030 - DNA, 822 bp, Artificial Sequence
  Description of Artificial Sequence: Synthetic coding sequence
atgggccagaaggtgaccggcggcatcaagaccgtggacatgagagaccccacctacagacccctgaagcaggagctgcagggcctggactactgcaagcccaccagactggacctgctgctggacatgccccccgtgagctacgacgtgcagctgctgcacagctggaacaacaacgacagaagcctgaacgtgttcgtgaaggaggacgacaagctgatcttccacagacaccccgtggcccagagcaccgacgccatcagaggcaaggtgggctacaccagaggcctgcacgtgtggcagatcacctgggccatgagacagagaggcacccacgccgtggtgggcgtggccaccgccgacgcccccctgcacagcgtgggctacaccaccctggtgggcaacaaccacgagagctggggctgggacctgggcagaaacagactgtaccacgacggcaagaaccagcccagcaagacctaccccgccttcctggagcccgacgagaccttcatcgtgcccgacagcttcctggtggccctggacatggacgacggcaccctgagcttcatcgtggacggccagtacatgggcgtggccttcagaggcctgaagggcaagaagctgtaccccgtggtgagcgccgtgtggggccactgcgagatcagaatgagatacctgaacggcctggaccccgagcccctgcccctgatggacctgtgcagaagaagcgtgagactggccctgggcagagagagactgggcgagatccacaccctgcccctgcccgccagcctgaaggcctacctgctgtaccagtag

SEQ ID NO: 10031 - DNA, 3315 bp, Artificial Sequence
  Description of Artificial Sequence: Synthetic coding sequence
atgggcaacgccgccggcagcgccgagcagcccgccggccccgccgcccccccccccaagcagcccgccccccccaagcagcccatgcccgccgccggcgagctggaggagagattcaacagagccctgaactgcatgaacctgccccccgacaaggtgcagctgctgagccagtacgacaacgagaagaagtgggagctgatctgcgaccaggagagattccaggtgaagaacccccccgccgcctacatccagaagctgaagagctacgtggacaccggcggcgtgagcagaaaggtggccgccgactggatgagcaacctgggcttcaagagaagagtgcaggagagcacccaggtgctgagagagctggagaccagcctgagaaccaaccacatcggctgggtgcaggagttcctgaacgaggagaacagaggcctggacgtgctgctggagtacctggccttcgcccagtgcagcgtgacctacgacatggagagcaccgacaacggcgccagcaacagcgagaagaacaagcccctggagcagagcgtggaggacctgagcaagggcccccccagcagcgtgcccaagagcagacacctgaccatcaagctgacccccgcccacagcagaaaggccctgagaaacagcagaatcgtgagccagaaggacgacgtgcacgtgtgcatcatgtgcctgagagccatcatgaactaccagagcggcttcagcctggtgatgaaccaccccgcctgcgtgaacgagatcgccctgagcctgaacaacaagaaccccagaaccaaggccctggtgctggagctgctggccgccgtgtgcctggtgagaggcggccacgacatcatcctggccgccttcgacaacttcaaggaggtgtgcggcgagcagcacagattcgagaagctgatggagtacttcagaaacgaggacagcaacatcgacttcatggtggcctgcatgcagttcatcaacatcgtggtgcacagcgtggagaacatgaacttcagagtgttcctgcagtacgagttcacccacctgggcctggacctgtacctggagagactgagactgaccgagagcgacaagctgcaggtgcagatccaggcctacctggacaacatcttcgacgtgggcgccctgctggaggacaccgagaccaagaacgccgtgctggagcacatggaggagctgcaggagcaggtggccctgctgaccgagagactgagagacgccgagaacgagagcatggccaagatcgccgagctggagaagcagctgagccaggccagaaaggagctggagaccctgagagagagattcagcgagagcaccgccatgggccccagcagaagaccccccgagcccgagaaggccccccccgccgcccccaccagacccagcgccctggagctgaaggtggaggagctggaggagaagggcctgatcagaatcctgagaggccccggcgacgccgtgagcatcgagatcctgcccgtggccgtggccacccccagcggcggcgacgcccccacccccggcgtgcccaccggcagccccagccccgacctggcccccgccgccgagcccgcccccggcgccgccccccccccccccccccccctgcccggcctgcccagcccccaggaggccccccccagcgcccccccccaggccccccccctgcccggcagccccgagcccccccccgccccccccctgcccggcgacctgcccccccccccccccccccccccccccccccccggcaccgacggccccgtgcccccccccccccccccccccccccccccccccggcggcccccccgacgccctgggcagaagagacagcgagctgggccccggcgtgaaggccaagaagcccatccagaccaagttcagaatgcccctgctgaactgggtggccctgaagcccagccagatcaccggcaccgtgttcaccgagctgaacgacgagaaggtgctgcaggagctggacatgagcgacttcgaggagcagttcaagaccaagagccagggccccagcctggacctgagcgccctgaagagcaaggccgcccagaaggcccccagcaaggccaccctgatcgaggccaacagagccaagaacctggccatcaccctgagaaagggcaacctgggcgccgagagaatctgccaggccatcgaggcctacgacctgcaggccctgggcctggacttcctggagctgctgatgagattcctgcccaccgagtacgagagaagcctgatcaccagattcgagagagagcagagacccatggaggagctgagcgaggaggacagattcatgctgtgcttcagcagaatccccagactgcccgagagaatgaccaccctgaccttcctgggcaacttccccgacaccgcccagctgctgatgccccagctgaacgccatcatcgccgccagcatgagcatcaagagcagcgacaagctgagacagatcctggagatcgtgctggccttcggcaactacatgaacagcagcaagagaggcgccgcctacggcttcagactgcagagcctggacgccctgctggagatgaagagcaccgacagaaagcagaccctgctgcactacctggtgaaggtgatcgccgagaagtacccccagctgaccggcttccacagcgacctgcacttcctggacaaggccggcagcgtgagcctggacagcgtgctggccgacgtgagaagcctgcagagaggcctggagctgacccagagagagttcgtgagacaggacgactgcatggtgctgaaggagttcctgagagccaacagccccaccatggacaagctgctggccgacagcaagaccgcccaggaggccttcgagagcgtggtggagtacttcggcgagaaccccaagaccaccagccccggcctgttcttcagcctgttcagcagattcatcaaggcctacaagaaggccgagcaggaggtggagcagtggaagaaggaggccgccgcccaggaggccggcgccgacacccccggcaagggcgagccccccgcccccaagagcccccccaaggccagaagaccccagatggacctgatcagcgagctgaagagaagacagcagaaggagcccctgatctacgagagcgacagagacggcgccatcgaggacatcatcaccgacctgagaaaccagccctacatcagagccgacaccggcagaagaagcgccagaagaagaccccccggcccccccctgcaggtgaccagcgacctgagcctgtag

SEQ ID NO: 10032 - DNA, 603 bp, Artificial Sequence
  Description of Artificial Sequence: Synthetic coding sequence
atggaggagaagcccagcaaggtgagcctgaagagcagcgacagacagggcagcgacgaggagagcgtgcacagcgacaccagagacctgtggaccaccaccaccctgagccaggcccagctgaacatgcccctgagcgaggtgtgcgagggcttcgacgaggagggcagaaacatcagcaagaccagaggctggcacagccccggcagaggcagcctggacgagggctacaaggccagccacaagcccgaggagctggacgagcacgccctggtggagctggagctgcacagaggcagcagcatggagatcaacctgggcgagaaggacaccgccagccagatcgaggccgagaagagcagcagcatgagcagcctgaacatcgccaagcacatgccccacagagcctactgggccgagcagcagagcagactgcccctgcccctgatggagctgatggagaacgaggccctggagatcctgaccaaggccctgagaagctaccagctgggcatcggcagagaccacttcctgaccaaggagctgcagagatacatcgagggcctgaagaagagaagaagcaagagactgtacgtgaactag

SEQ ID NO: 10033 - DNA, 1044 bp, Artificial Sequence
  Description of Artificial Sequence: Synthetic coding sequence
atgaagctgaccagcgagaagctgcccaagaaccccttctacgccagcgtgagccagtacgccgccaagaaccagaagttcttccagtggaagaaggagaagaccgactacacccacgccaacctggtggacaaggccctgcagctgctgaaggagagaatcctgaagggcgacaccctggcctacttcctgagaggccagctgtacttcgaggagggctggtacgaggaggccctggagcagttcgaggagatcaaggagaaggaccaccaggccacctaccagctgggcgtgatgtactacgacggcctgggcaccaccctggacgccgagaagggcgtggactacatgaagaagatcctggacagcccctgccccaaggccagacacctgaagttcgccgccgcctacaacctgggcagagcctactacgagggcaagggcgtgaagagaagcaacgaggaggccgagagactgtggctgatcgccgccgacaacggcaaccccaaggccagcgtgaaggcccagagcatgctgggcctgtactacagcaccaaggagcccaaggagctggagaaggccttctactggcacagcgaggcctgcggcaacggcaacctggagagccagggcgccctgggcctgatgtacctgtacggccagggcatcagacaggacaccgaggccgccctgcagtgcctgagagaggccgccgagagaggcaacgtgtacgcccagggcaacctggtggagtactactacaagatgaagttcttcaccaagtgcgtggccttcagcaagagaatcgccgactacgacgaggtgcacgacatccccatgatcgcccaggtgaccgactgcctgcccgagttcatcggcagaggcatggccatggccagcttctaccacgccagatgcctgcagctgggcctgggcatcaccagagacgagaccaccgccaagcactactacagcaaggcctgcagactgaaccccgccctggccgacgagctgcacagcctgctgatcagacagagaatctag

SEQ ID NO: 10034 - DNA, 3525 bp, Artificial Sequence
  Description of Artificial Sequence: Synthetic coding sequence
atgcccctgcccttcggcctgaagctgaagagaaccagaagatacaccgtgagcagcaagagctgcctggtggccagaatccagctgctgaacaacgagttcgtggagttcaccctgagcgtggagagcaccggccaggagagcctggaggccgtggcccagagactggagctgagagaggtgacctacttcagcctgtggtactacaacaagcagaaccagagaagatgggtggacctggagaagcccctgaagaagcagctggacaagtacgccctggagcccaccgtgtacttcggcgtggtgttctacgtgcccagcgtgagccagctgcagcaggagatcaccagataccagtactacctgcagctgaagaaggacatcctggagggcagcatcccctgcaccctggagcaggccatccagctggccggcctggccgtgcaggccgacttcggcgacttcgaccagtacgagagccaggacttcctgcagaagttcgccctgttccccgtgggctggctgcaggacgagaaggtgctggaggaggccacccagaaggtggccctgctgcaccagaagtacagaggcctgaccgcccccgacgccgagatgctgtacatgcaggaggtggagagaatggacggctacggcgaggagagctaccccgccaaggacagccagggcagcgacatcagcatcggcgcctgcctggagggcatcttcgtgaagcacaagaacggcagacaccccgtggtgttcagatggcacgacatcgccaacatgagccacaacaagagcttcttcgccctggagctggccaacaaggaggagaccatccagttccagaccgaggacatggagaccgccaagtacatctggagactgtgcgtggccagacacaagttctacagactgaaccagtgcaacctgcagacccagaccgtgaccgtgaaccccatcagaagaagaagcagcagcagaatgagcctgcccaagccccagccctacgtgatgcccccccccccccagctgcactacaacggccactacaccgagccctacgccagcagccaggacaacctgttcgtgcccaaccagaacggctactactgccacagccagaccagcctggacagagcccagatcgacctgaacggcagaatcagaaacggcagcgtgtacagcgcccacagcaccaacagcctgaacaacccccagccctacctgcagcccagccccatgagcagcaaccccagcatcaccggcagcgacgtgatgagacccgactacctgcccagccacagacacagcgccgtgatcccccccagctacagacccacccccgactacgagaccgtgatgaagcagctgaacagaggcctggtgcacgccgagagacagagccacagcctgagaaacctgaacatcggcagcagctacgcctacagcagacccgccgccctggtgtacagccagcccgagatcagagagcacgcccagctgcccagccccgccgccgcccactgccccttcagcctgagctacagcttccacagccccagcccctacccctaccccgccgagagaagacccgtggtgggcgccgtgagcgtgcccgagctgaccaacgcccagctgcaggcccaggactaccccagccccaacatcatgagaacccaggtgtacagacccccccccccctaccccccccccagacccgccaacagcacccccgacctgagcagacacctgtacatcagcagcagcaaccccgacctgatcaccagaagagtgcaccacagcgtgcagaccttccaggaggacagcctgcccgtggcccacagcctgcaggaggtgagcgagcccctgaccgccgccagacacgcccagctgcacaagagaaacagcatcgaggtggccggcctgagccacggcctggagggcctgagactgaaggagagaaccctgagcgccagcgccgccgaggtggcccccagagccgtgagcgtgggcagccagcccagcgtgttcaccgagagaacccagagagagggccccgaggaggccgagggcctgagatacggccacaagaagagcctgagcgacgccaccatgctgatccacagcagcgaggaggaggaggacgaggacttcgaggaggagagcggcgccagagccccccccgccagagccagagagcccagacccggcctggcccaggacccccccggctgccccagagtgctgctggccggccccctgcacatcctggagcccaaggcccacgtgcccgacgccgagaagagaatgatggacagcagccccgtgagaaccaccgccgaggcccagagaccctggagagacggcctgctgatgcccagcatgagcgagagcgacctgaccaccagcggcagatacagagccagaagagacagcctgaagaagagacccgtgagcgacctgctgagcggcaagaagaacatcgtggagggcctgccccccctgggcggcatgaagaagaccagagtggacgccaagaagatcggccccctgaagctggccgccctgaacggcctgagcctgagcagagtgcccctgcccgacgagggcaaggaggtggccaccagagccaccaacgacgagagatgcaagatcctggagcagagactggagcagggcatggtgttcaccgagtacgagagaatcctgaagaagagactggtggacggcgagtgcagcaccgccagactgcccgagaacgccgagagaaacagattccaggacgtgctgccctacgacgacgtgagagtggagctggtgcccaccaaggagaacaacaccggctacatcaacgccagccacatcaaggtgagcgtgagcggcatcgagtgggactacatcgccacccagggccccctgcagaacacctgccaggacttctggcagatggtgtgggagcagggcatcgccatcatcgccatggtgaccgccgaggaggagggcggcagagagaagagcttcagatactggcccagactgggcagcagacacaacaccgtgacctacggcagattcaagatcaccaccagattcagaaccgacagcggctgctacgccaccaccggcctgaagatgaagcacctgctgaccggccaggagagaaccgtgtggcacctgcagtacaccgactggcccgagcacggctgccccgaggacctgaagggcttcctgagctacctggaggagatccagagcgtgagaagacacaccaacagcaccagcgacccccagagccccaacccccccctgctggtgcactgcagcgccggcgtgggcagaaccggcgtggtgatcctgagcgagatcatgatcgcctgcctggagcacaacgaggtgctggacatccccagagtgctggacatgctgagacagcagagaatgatgctggtgcagaccctgtgccagtacaccttcgtgtacagagtgctgatccagttcctgaagagcagcagactgatctag

SEQ ID NO: 10035 - DNA, 2235 bp, Artificial Sequence
  Description of Artificial Sequence: Synthetic coding sequence
atggccgccgacaagcccgccgaccagggcgccgagaagcacgagggcaccggccagagcagcggcatcaccgaccaggagaaggagctgagcaccaacgccttccaggccttcaccagcggcaactacgacgcctgcctgcagcacctggcctgcctgcaggacatcaacaaggacgactacaagatcatcctgaacaccgccgtggccgagttcttcaagagcaaccagaccaccaccgacaacctgagacagaccctgaaccagctgaagaaccaggtgcacagcgccgtggaggagatggacggcctggacgacgtggagaacagcatgctgtactacaaccaggccgtgatcctgtaccacctgagacagtacaccgaggccatcagcgtgggcgagaagctgtaccagttcatcgagcccttcgaggagaagttcgcccaggccgtgtgcttcctgctggtggacctgtacatcctgacctaccaggccgagaaggccctgcacctgctggccgtgctggagaagatgatcagccagggcaacaacaacaagaacggcaagaacgagaccggcaacaacaacaacaaggacggcagcaaccacaaggccgagagcggcgccctgatcgaggccgccaagagcaagatccaccagtacaaggtgagagcctacatccagatgaagagcctgaaggcctgcaagagagagatcaagagcgtgatgaacaccgccggcaacagcgcccccagcctgttcctgaagagcaacttcgagtacctgagaggcaactacagaaaggccgtgaagctgctgaacagcagcaacatcgccgagcaccccggcttcatgaagaccggcgagtgcctgagatgcatgttctggaacaacctgggctgcatccacttcgccatgagcaagcacaacctgggcatcttctacttcaagaaggccctgcaggagaacgacaacgtgtgcgcccagctgagcgccggcagcaccgaccccggcaagaagttcagcggcagacccatgtgcaccctgctgaccaacaagagatacgagctgctgtacaactgcggcatccagctgctgcacatcggcagacccctggccgccttcgagtgcctgatcgaggccgtgcaggtgtaccacgccaaccccagactgtggctgagactggccgagtgctgcatcgccgccaacaagggcaccagcgagcaggagaccaagggcctgcccagcaagaagggcatcgtgcagagcatcgtgggccagggctaccacagaaagatcgtgctggccagccagagcatccagaacaccgtgtacaacgacggccagagcagcgccatccccgtggccagcatggagttcgccgccatctgcctgagaaacgccctgctgctgctgcccgaggagcagcaggaccccaagcaggagaacggcgccaagaacagcaaccagctgggcggcaacaccgagagcagcgagagcagcgagacctgcagcagcaagagccacgacggcgacaagttcatccccgccccccccagcagccccctgagaaagcaggagctggagaacctgaagtgcagcatcctggcctgcagcgcctacgtggccctggccctgggcgacaacctgatggccctgaaccacgccgacaagctgctgcagcagcccaagctgagcggcagcctgaagttcctgggccacctgtacgccgccgaggccctgatcagcctggacagaatcagcgacgccatcacccacctgaaccccgagaacgtgaccgacgtgagcctgggcatcagcagcaacgagcaggaccagggcagcgacaagggcgagaacgaggccatggagagcagcggcaagagagccccccagtgctaccccagcagcgtgaacagcgccagaaccgtgatgctgttcaacctgggcagcgcctactgcctgagaagcgagtacgacaaggccagaaagtgcctgcaccaggccgccagcatgatccaccccaaggaggtgccccccgaggccatcctgctggccgtgtacctggagctgcagaacggcaacacccagctggccctgcagatcatcaagagaaaccagctgctgcccgccgtgaagacccacagcgaggtgagaaagaagcccgtgttccagcccgtgcaccccatccagcccatccagatgcccgccttcaccaccgtgcagagaaagtag

SEQ ID NO: 10036 - DNA, 363 bp, Artificial Sequence
  Description of Artificial Sequence: Synthetic coding sequence
atgcacccccccccccccgccgccgccatggacttcagccagaacagcctgttcggctacatggaggacctgcaggagctgaccatcatcgagagacccgtgagaagaagcctgaagacccccgaggagatcgagagactgaccgtggacgaggacctgagcgacatcgagagagccgtgtacctgctgagcgccggccaggacgtgcagggcaccagcgtgatcgccaacctgcccttcctgatgagacagaaccccaccgagaccctgagaagagtgctgcccaaggtgagagtgcacgaggacgcccacctgttcatccagagagtgtggatcagccacatgttcgtgcagagagtgtag

SEQ ID NO: 10037 - DNA, 1335 bp, Artificial Sequence
  Description of Artificial Sequence: Synthetic coding sequence
atgagagagatcgtgctgacccagatcggccagtgcggcaaccagatcggcgccaagttctgggaggtgatcagcgacgagcacgccatcgacagcgccggcacctaccacggcgacagccacctgcagctggagagaatcaacgtgtactacaacgaggccagcggcggcagatacgtgcccagagccgtgctggtggacctggagcccggcaccatggacagcgtgagaagcggccccttcggccaggtgttcagacccgacaacttcatcttcggccagtgcggcgccggcaacaactgggccaagggccactacaccgagggcgccgagctgatggagagcgtgatggacgtggtgagaaaggaggccgagagctgcgactgcctgcagggcttccagctgacccacagcctgggcggcggcaccggcagcggcatgggcaccctgctgctgagcaagatcagagaggagtaccccgacagaatcatcaacaccttcagcatcctgcccagccccaaggtgagcgacaccgtggtggagccctacaacgccaccctgagcgtgcaccagctgatcgagaacgccgacgagaccttctgcatcgacaacgaggccctgtacgacatctgcagcaagaccctgaagctgcccacccccacctacggcgacctgaaccacctggtgagcgccaccatgagcggcgtgaccacctgcctgagattccccggccagctgaacgccgacctgagaaagctggccgtgaacatggtgcccttccccagactgcacttcttcatgcccggcttcgcccccctgaccagcagaggcagccagcagtacagagccctgaccgtggccgagctgacccagcagatgttcgacgccaagaacatgatggccgcctgcgaccccagacacggcagatacctgaccgccgccgccatcttcagaggcagaatgcccatgagagaggtggacgagcagatgttcaacatccaggacaagaacagcagctacttcgccgactggctgcccaacaacgtgaagaccgccgtgtgcgacatcccccccagaggcctgaagatgagcgccaccttcatcggcaacaacaccgccatccaggagctgttcaagagagtgagcgagcagttcaccgccatgttcagaagaaaggccttcctgcactggtacaccggcgagggcatggacgagatggagttcaccgaggccgagagcaacatgaacgacctggtgagcgagtaccagcagtaccaggacgccaccgccgaggaggaggaggacgaggagtacgccgaggaggaggtggcctag

SEQ ID NO: 10038 - DNA, 915 bp, Artificial Sequence
  Description of Artificial Sequence: Synthetic coding sequence
atggccaagatcgagaagaacgcccccaccatggagaagaagcccgagctgttcaacatcatggaggtggacggcgtgcccaccctgatcctgagcaaggagtggtgggagaaggtgtgcaacttccaggccaagcccgacgacctgatcctggccacctaccccaagagcggcaccacctggatgcacgagatcctggacatgatcctgaacgacggcgacgtggagaagtgcaagagagcccagaccctggacagacacgccttcctggagctgaagttcccccacaaggagaagcccgacctggagttcgtgctggagatgagcagcccccagctgatcaagacccacctgcccagccacctgatcccccccagcatctggaaggagaactgcaagatcgtgtacgtggccagaaaccccaaggactgcctggtgagctactaccacttccacagaatggccagcttcatgcccgacccccagaacctggaggagttctacgagaagttcatgagcggcaaggtggtgggcggcagctggttcgaccacgtgaagggctggtgggccgccaaggacatgcacagaatcctgtacctgttctacgaggacatcaagaaggaccccaagagagagatcgagaagatcctgaagttcctggagaaggacatcagcgaggagatcctgaacaagatcatctaccacaccagcttcgacgtgatgaagcagaaccccatgaccaactacaccaccctgcccaccagcatcatggaccacagcatcagccccttcatgagaaagggcatgcccggcgactggaagaactacttcaccgtggcccagaacgaggagttcgacaaggactaccagaagaagatggccggcagcaccctgaccttcagaaccgagatctag

SEQ ID NO: 10039 - DNA, 216 bp, Artificial Sequence
  Description of Artificial Sequence: Synthetic coding sequence
atgtgcggcagctactacggcaactactacggcacccccggctacggcttctgcggctacggcggcctgggctacggctacggcggcctgggctgcggctacggcagctgctgcggctgcggcttcagaagactgggctgcggctacggctacggcagcagaagcctgtgcggctacggctacggctgcggcagcggcagcggctactactactag

SEQ ID NO: 10040 - DNA, 2094 bp, Artificial Sequence
  Description of Artificial Sequence: Synthetic coding sequence
atggacaagaagagcaccgccgagaagctgggcaaggagctgggcctgcaggccaaggagctgagcgccgtgcacagcagccaccacgagatcggcgtgaacgacagcaacctgttcagcctggagatgagagagcccctggagagcagcaacaccaagagcttccacagcgccgtggagatcaagaacagaagccagcacgagctgccctgcttccagcaccacggcatcgacacccccaccagcctgcagaagagaagcgcctgctgcccccccagcctgctgagactggaggagaccgccagcagcagccaggacggcgacccccagatctgggacgacctgcccttcagcgagagcctgaacaagttcctggccgtgctggagagcgagatcgccgtgacccaggccgacgtgagcagcagaaagcaccacgtggacaacgacatcgacaagttccacgccgaccacagcagactgagcgtgaccccccagagaaccaccggcgccctgcacaccccccccatcgccctgagaagcagccaggtgatcgtgaaggccaactgcagcaaggacgacttcctgttcaactgcaagggcaacctgagccccagcgtggagaaggagagccagcccgacaacaaggtggaggccgtgagcgtgaaccacaacggcagagacatgagcgagtacttcctgcccaacccctacctgagcgccctgagcagcagcagcaaggacctggagaccatcgtgaccctgaagaagaccatcagaatcagcccccacagagagagcgaccacagcagcctgaacaacaagtacctgaacggctgcggcgagatcagcgtgagcgagatgaacgagaagctgaccaccctgtgctacagaaagtacaacgacgtgagcgacctgtgcaagctggagaacaagcagtactgcagatggagcaagaaccaggacgacagcttcaccatctgcagaaagctgacctaccccctggagaccctgtgcaacagccccaacagaagcaccaacaccctgaaggagatgccctggggccacatcaacaacaacgtgacccagagctacagcatcggctacgagggcagctacgacgccagcgccgacctgttcgacgacatcgccaaggagatggacatcgccaccgagatcaccaagaagagccaggacatcctgctgaagtggggcaccagcctggccgagagccaccccagcgagagcgacttcagcctgagaagcctgagcgaggacttcatccagcccagccagaagctgagcctgcagagcctgagcgacagcagacacagcagaacctgcagccccaccccccacttccagagcgacagcgagtacaacttcgagaacagccaggacttcgtgccctgcagccagagcacccccatcagcggcttccaccagaccagaatccacggcatcaacagagccttcaagaagcccgtgttctacagcgacctggacggcaactacgagaagatcagaatcttccccgagaacgacaagcagcaggccagccccagctgccccaagaacatcaagacccccagccagaagatcagaagccccatcgtgagcggcgtgagccagcccgacgtgttcaaccactaccccttcgccgagtgccacgagaccgacagcgacgagtgggtgccccccaccacccagaagatcttccccagcgacatgctgggcttccagggcatcggcctgggcaagtgcctggccgcctaccacttccccgaccagcaggagctgcccagaaagaagctgaagcacatcagacagggcaccaacaagggcctgatcaagaagaagctgaagaacatgctggccgccgtggtgaccaagaagaagacccacaagtacaactgcaagagcagcggctggatcagcaagtgccccgacatccaggtgctggccgccccccagctgcaccccatcctgggccccgacagctgcagcgaggtgaagtgctgcctgcccttcagcgagaagggcccccccagcgtgtgcgagaccagaagcgcctggagccccgagctgttcagctag

SEQ ID NO: 10041 - DNA, 306 bp, Artificial Sequence
  Description of Artificial Sequence: Synthetic coding sequence
atgagcaacacccaggccgagagaagcatcatcggcatgatcgacatgttccacaagtacaccggcagagacggcaagatcgagaagcccagcctgctgaccatgatgaaggagaacttccccaacttcctgagcgcctgcgacaagaagggcatccactacctggccaccgtgttcgagaagaaggacaagaacgaggacaagaagatcgacttcagcgagttcctgagcctgctgggcgacatcgccgccgactaccacaagcagagccacggcgccgccccctgcagcggcggcagccagtag

SEQ ID NO: 10042 - DNA, 678 bp, Artificial Sequence
  Description of Artificial Sequence: Synthetic coding sequence
atggccgtgagaagcctgtgggccggcagactgagagtgcagagactgctggcctggagcgccgcctgggagagcaagggctggcccctgcccttcagcaccgccacccagagaaccgccggcgaggactgcagaagcgaggacccccccgacgagctgggcccccccctggccgagagagccctgagagtgaaggccgtgaagctggagaaggaggtgcaggacctgaccgtgagataccagagagccatcgccgactgcgagaacatcagaagaagaacccagagatgcgtggaggacgccaagatcttcggcatccagagcttctgcaaggacctggtggaggtggccgacatcctggagaagaccaccgagtgcatcagcgaggagagcgagcccgaggaccagaagctgaccctggagaaggtgttcagaggcctgctgctgctggaggccaagctgaagagcgtgttcgccaagcacggcctggagaagctgacccccatcggcgacaagtacgacccccacgagcacgagctgatctgccacgtgcccgccggcgtgggcgtgcagcccggcaccgtggccctggtgagacaggacggctacaagctgcacggcagaaccatcagactggccagagtggaggtggccgtggagagccagagaagactgtag

SEQ ID NO: 10043 - DNA, 1203 bp, Artificial Sequence
  Description of Artificial Sequence: Synthetic coding sequence
atgaccaccaagaacctggagaccaaggtgaccgtgaccagcagccccatcagaggcgccggcgacggcatggagaccgaggagccccccaagagcgtggaggtgaccagcggcgtgcagagcagaaagcaccacagcctgcagagcccctggaagaaggccgtgcccagcgagagccccggcgtgctgcagctgggcaagatgctgaccgagaaggccatggaggtgaaggccgtgagaatcctggtgcccaaggccgccatcacccacgacatccccaacaagaacaccaaggtgaagagcctgggccaccacaagggcgagttcctgggccagagcgagggcgtgatcgagcccaacaaggagctgagcgaggtgaagaacgtgctggagaagctgaagaacagcgagagaagactgctgcaggacaaggagggcctgagcaaccagctgagagtgcagaccgaggtgaacagagagctgaagaagctgctggtggccagcgtgggcgacgacctgcagtaccacttcgagagactggccagagagaagaaccagctgatcctggagaacgaggccctgggcagaaacaccgcccagctgagcgagcagctggagagaatgagcatccagtgcgacgtgtggagaagcaagttcctggccagcagagtgatggccgacgagctgaccaacagcagagccgccctgcagagacagaacagagacgcccacggcgccatccaggacctgctgagcgagagagagcagttcagacaggagatgatcgccacccagaagctgctggaggagctgctggtgagcctgcagtggggcagagagcagacctacagccccagcgtgcagccccacagcaccgccgagctggccctgaccaaccacaagctggccaaggccgtgaacagccacctgctgggcaacgtgggcatcaacaaccagaagaagatccccagcaccgtggagttctgcagcacccccgccgagaagatggccgagaccgtgctgagaatcctggaccccgtgacctgcaaggagagcagccccgacaaccccttcttcgagagcagccccaccaccctgctggccaccaagaagaacatcggcagattccacccctacaccagatacgagaacatcaccttcaactgctgcaaccactgcagaggcgagctgatcgccctgtag

SEQ ID NO: 10044 - DNA, 735 bp, Artificial Sequence
  Description of Artificial Sequence: Synthetic coding sequence
atggaccccggcgccgccctgcagagaagagccggcggcggcggcggcctgggcgccggcagccccgccctgagcggcggccagggcagaagaagaaagcagccccccagacccgccgacttcaagctgcaggtgatcatcatcggcagcagaggcgtgggcaagaccagcctgatggagagattcaccgacgacaccttctgcgaggcctgcaagagcaccgtgggcgtggacttcaagatcaagaccgtggagctgagaggcaagaagatcagactgcagatctgggacaccgccggccaggagagattcaacagcatcaccagcgcctactacagaagcgccaagggcatcatcctggtgtacgacatcaccaagaaggagaccttcgacgacctgcccaagtggatgaagatgatcgacaagtacgccagcgaggacgccgagctgctgctggtgggcaacaagctggactgcgagaccgacagagagatcaccagacagcagggcgagaagttcgcccagcagatcaccggcatgagattctgcgaggccagcgccaaggacaacttcaacgtggacgagatcttcctgaagctggtggacgacatcctgaagaagatgcccctggacatcctgagaaacgagctgagcaacagcatcctgagcctgcagcccgagcccgagatcccccccgagctgcccccccccagaccccacgtgagatgctgctag

SEQ ID NO: 10045 - DNA, 1158 bp, Artificial Sequence
  Description of Artificial Sequence: Synthetic coding sequence
atggccctgccccacgacagcaacgagaccagctacctgctgccccccaacaacgaggactggggcagacagaccatccccgacttcgtgtacggccagaaggacctgatggccgagggcatccagtggcccagaaacgcccccggcatccccgacgccctgccccagagccccttcgacgccgccctgtgcagcgcctggaagcagagagtggagctgggcctgttcagatacagactgagagagctgcagacccagatcctgcccggcgccgtgggcttcgtggcccagctgaacgtggagagaggcgtgcagagaagacccccccagaccatcaagagcgtgagacaggccttcgaccccgtgcagttcaacttcaacaagatcagacccggcgaggtgctgttcagactgcacagagagcccgacctgcccggcaccctgctgcaggaggacatcctggtggtgatcaacgtgagccccctggagtggggccacgtgctgctggtgcccgagcccgccagacagctgccccagagactgctgcccggcgccctgagagccggcatcgaggccgtgctgctgagcctgcaccccggcttcagagtgggcttcaacagcctgggcggcctggccagcgtgaaccacctgcacctgcacggctactacctggcccacagactgcccgtggagcaggcccccagcgagcccctggaccccggcggccacctgcacctgctgcaggacctgcccgcccccggcttcctgttctacaccagaggccccggccccgacctggagagcctgatcagcagagtgtgcagagccaccgactacctgaccgaccacgagatcgcccacaacctgttcgtgaccagaggcgccccccccggcaagaccagccccagcagcgccctgaccggcgtgagagtgatcctgtgggccagaaagagcagcttcggcatcaaggacggcgaggccttcaacgtggccctgtgcgagctggccggccacctgcccgtgaagaccagccaggacttcagcagcctgaccgaggccgccgccgtggccctgatccaggactgcagactgccccccagccaggccgaggacgtgcaggccgccctggtggccctgatgagccaggaggagcagtag

SEQ ID NO: 10046 - DNA, 192 bp, Artificial Sequence
  Description of Artificial Sequence: Synthetic coding sequence
atgctgtgcgacaacttccccggcgccgtgttccccggctgctactggggcagctacggctaccccctgggctacagcgtgggctgcggctacggcagcacctacagccccgtgggctacggcttcggctacggctacaacggctgcggcgccttcggctacagaagatacagccccttcgccctgtactag

SEQ ID NO: 10047 - DNA, 1083 bp, Artificial Sequence
  Description of Artificial Sequence: Synthetic coding sequence
atgctgggcagcggcttcaaggccgagagactgagagtgaacctgagactggtgatcaacagactgaagctgctggagaagaagaagaccgagctggcccagaaggccagaaaggagatcgccgactacctggccgccggcaaggacgagagagccagaatcagagtggagcacatcatcagagaggactacctggtggaggccatggagatcctggagctgtactgcgacctgctgctggccagattcggcctgatccagagcatgaaggagctggacagcggcctggccgagagcgtgagcaccctgatctgggccgcccccagactgcagagcgaggtggccgagctgaagatcgtggccgaccagctgtgcgccaagtacagcaaggagtacggcaagctgtgcagaaccaaccagatcggcaccgtgaacgacagactgatgcacaagctgagcgtggaggccccccccaagatcctggtggagagatacctgatcgagatcgccaagaactacaacgtgccctacgagcccgacagcgtggtgatggccgaggccccccccggcgtggagaccgacctgatcgacgtgggcttcaccgacgacgtgaagaagggcggccccggcagaggcggcagcggcggcttcaccgcccccgtgggcggccccgacggcaccgtgcccatgcccatgcccatgcccatgcccatgcccagcgccaacacccccttcagctaccccctgcccaagggccccagcgacttcaacggcctgcccatgggcacctaccaggccttccccaacatccaccccccccagatccccgccaccccccccagctacgagagcatgaccctgatgctgatcagaatcagcctgctgcacagactgctggtgctggaccccagccagaagcccctgcagagcttcctgcccgacctgcagatcaccatgaccaccctgagctaccagagctgccacctgtgccagacccactaccagctgcacctgctggtgcccgccccccagcacctgaagaccctgaccctgatgatcttccccggcggcctgaagagctag

SEQ ID NO: 10048 - DNA, 528 bp, Artificial Sequence
  Description of Artificial Sequence: Synthetic coding sequence
atgcccaagagaagctgccccttcgccgacgtggcccccctgcagctgaaggtgagagtgagccagagagagctgagcagaggcgtgtgcgccgagagatacagccaggaggtgttcgagaagaccaagagactgctgttcctgggcgcccaggcctacctggaccacgtgtgggacgagggctgcgccgtggtgcacctgcccgagagccccaagcccggccccaccggcgcccccagagccgccagaggccagatgctgatcggccccgacggcagactgatcagaagcctgggccaggccagcgaggccgaccccagcggcgtggccagcatcgcctgcagcagctgcgtgagagccgtggacggcaaggccgtgtgcggccagtgcgagagagccctgtgcggccagtgcgtgagaacctgctggggctgcggcagcgtggcctgcaccctgtgcggcctggtggactgcagcgacatgtacgagaaggtgctgtgcaccagctgcgccatgttcgagacctag

SEQ ID NO: 10049 - DNA, 366 bp, Artificial Sequence
  Description of Artificial Sequence: Synthetic coding sequence
atggaggccgaggtggacaagctggagctgatgttccagaaggccgagagcgacctggactacatccagtacagactggagtacgagatcaagaccaaccaccccgacagcgccagcgagaagaaccccgtgaccctgctgaaggagctgagcgtgatcaagagcagataccagaccctgtacgccagattcaagcccgtggccgtggagcagaaggagagcaagagcagaatctgcgccaccgtgaagaagaccatgaacatgatccagaagctgcagaagcagaccgacctggagctgagccccctgaccaaggaggagaagaccgccgccgagcagttcaagttccacatgcccgacctgtag

SEQ ID NO: 10050 - DNA, 1968 bp, Artificial Sequence
  Description of Artificial Sequence: Synthetic coding sequence
atggtgaccaccctgggccccaagatggccgccgagtggggcggcggcgtgggctacagcggcagcggccccggcagaagcagatggagatggagcggcagcgtgtgggtgagaagcgtgctgctgctgctgggcggcctgagagccagcgccaccagcacccccgtgagcctgggcagcagccccccctgcagacaccacgtgcccagcgacaccgaggtgatcaacaaggtgcacctgaaggccaaccacgtggtgaagagagacgtggacgagcacctgagaatcaagaccgtgtacgacaagagcgtggaggagctgctgcccgagaagaagaacctggtgaagaacaagctgttcccccaggccatcagctacctggagaagaccttccaggtgagaagacccgccggcaccatcctgctgagcagacagtgcgccaccaaccagtacctgagaaaggagaacgacccccacagatactgcaccggcgagtgcgccgcccacaccaagtgcggccccgtgatcgtgcccgaggagcacctgcagcagtgcagagtgtacagaggcggcaagtggccccacggcgccgtgggcgtgcccgaccaggagggcatcagcgacgccgacttcgtgctgtacgtgggcgccctggccaccgagagatgcagccacgagaacatcatcagctacgccgcctactgccagcaggaggccaacatggacagacccatcgccggctacgccaacctgtgccccaacatgatcagcacccagccccaggagttcgtgggcatgctgagcaccgtgaagcacgaggtgatccacgccctgggcttcagcgccggcctgttcgccttctaccacgacaaggacggcaaccccctgaccagcagattcgccgacggcctgccccccttcaactacagcctgggcctgtaccagtggagcgacaaggtggtgagaaaggtggagagactgtgggacgtgagagacaacaagatcgtgagacacaccgtgtacctgctggtgacccccagagtggtggaggaggccagaaagcacttcgactgccccgtgctggagggcatggagctggagaaccagggcggcgtgggcaccgagctgaaccactgggagaagagactgctggagaacgaggccatgaccggcagccacacccagaacagagtgctgagcagaatcaccctggccctgatggaggacaccggcagacagatgctgagcccctactgcgacaccctgagaagcaaccccctgcagctgacctgcagacaggaccagagagccgtggccgtgtgcaacctgcagaagttccccaagcccctgccccaggagtaccagtacttcgacgagctgagcggcatccccgccgaggacctgccctactacggcggcagcgtggagatcgccgactactgccccttcagccaggagttcagctggcacctgagcggcgagtaccagagaagcagcgactgcagaatcctggagaaccagcccgagatcttcaagaactacggcgccgagaagtacggcccccacagcgtgtgcctgatccagaagagcgccttcgtgatggagaagtgcgagagaaagctgagctaccccgactggggcagcggctgctaccaggtgagctgcagcccccagggcctgaaggtgtgggtgcaggacaccagctacctgtgcagcagagccggccaggtgctgcccgtgagcatccagatgaacggctggatccacgacggcaacctgctgtgccccagctgctgggacttctgcgagctgtgcccccccgagaccgacccccccgccaccaacctgaccagagccctgcccctggacctgtgcagctgcagcagcagcctggtggtgaccctgtggctgctgctgggcaacctgttccccctgctggccggcttcctgctgtgcatctggcactag

SEQ ID NO: 10051 - DNA, 408 bp, Artificial Sequence
  Description of Artificial Sequence: Synthetic coding sequence
atgggcagagtgagaaccaagaccgtgaagaaggccgccagagtgatcatcgagaagtactacaccagactgggcaacgacttccacaccaacaagagagtgtgcgaggagatcgccatcatccccagcaagaagctgagaaacaagatcgccggctacgtgacccacctgatgaagagaatccagagaggccccgtgagaggcatcagcatcaagctgcaggaggaggagagagagagaagagacaactacgtgcccgaggtgagcgccctggaccaggagatcatcgaggtggaccccgacaccaaggagatgctgaagctgctggacttcggcagcctgagcaacctgcaggtgacccagcccaccgtgggcatgaacttcaagacccccagaggccccgtgtag

SEQ ID NO: 10052 - DNA, 1119 bp, Artificial Sequence
  Description of Artificial Sequence: Synthetic coding sequence
atgaaccactgccagctgcccgtggtgatcgacaacggcagcggcatgatcaaggccggcgtggccggctgcagagagccccagttcatctaccccaacatcatcggcagagccaagggccagagcagagccgcccagggcggcctggagctgtgcgtgggcgaccaggcccaggactggagaagcagcctgttcatcagctaccccgtggagagaggcctgatcaccagctgggaggacatggagatcatgtggaagcacatctacgactacaacctgaagctgaagccctgcgacggccccgtgctgatcaccgagcccgccctgaaccccctggccaacagacagcagatcaccgagatgttcttcgagcacctgggcgtgcccgccttctacatgagcatccaggccgtgctggccctgttcgccgccggcttcaccaccggcctggtgctgaacagcggcgccggcgtgacccagagcgtgcccatcttcgagggctactgcctgccccacggcgtgcagcagctggacctggccggcctggacctgaccaactacctgatggtgctgatgaagaaccacggcatcatgctgctgagcgccagcgacagaaagatcgtggaggacatcaaggagagcttctgctacgtggccatgaactacgaggaggagatggccaagaagcccgactgcctggagaaggtgtaccagctgcccgacggcaaggtgatccagctgcacgaccagctgttcagctgccccgaggccctgttcagcccctgccacatgaacctggaggcccccggcatcgacaagatctgcttcagcagcatcatgaagtgcgacaccggcctgagaaacagcttcttcagcaacatcatcctggccggcggcagcaccagcttccccggcctggacaagagactggtgaaggacatcgccaaggtggcccccgccaacaccgccgtgcaggtgatcgccccccccgagagaaagatcagcgtgtggatgggcggcagcatcctggccagcctgagcgccttccaggacatgtggatcaccgccgccgagttcaaggaggtgggccccaacatcgtgcaccagagatgcttctag

SEQ ID NO: 10053 - DNA, 3072 bp, Artificial Sequence
  Description of Artificial Sequence: Synthetic coding sequence
atggacgccaacagcaaggacaagccccccgagaccaaggagagcgccatgaacaacgccggcaacgccagcttcatcctgggcaccggcaagatcgtgaccccccagaagcacgccgagctgccccccaacccctgcacccccgacaccttcaagagccccctgaacttcagcaccgtgaccgtggagcagctgggcatcacccccgagagcttcgtgagaaacagcgccggcaagagcagcagctacctgaagaagtgcagaagaagaagcgccgtgggcgccagaggcagccccgagaccaaccacctgatcagattcatcgccagacagcagaacatcaagaacgccagaaagagccccctggcccaggacagccccagccagggcagccccgccctgtacagaaacgtgaacaccctgagagagagaatcagcgccttccagagcgccttccacagcatcaaggagaacgagaagatgaccggctgcctggagttcagcgaggccggcaaggagagcgagatgaccgacctgaccagaaaggagggcctgagcgcctgccagcagagcggcttccccgccgtgctgagcagcaagagaagaagaatcagctaccagagagacagcgacgagaacctgaccgacgccgagggcaaggtgatcggcctgcagatcttcaacatcgacaccgacagagcctgcgccgtggagaccagcgtggacctgagcgagatcagcagcaagctgggcagcacccagagcggcttcctggtggaggagagcctgcccctgagcgagctgaccgagaccagcaacgccctgaaggtggccgactgcgtggtgggcaagggcagcagcgacgccgtgagccccgacaccttcaccgccgaggtgagcagcgacgccgtgcccgacgtgagaagccccgccacccccgcctgcagaagagacctgcccacccccaagaccttcgtgctgagaagcgtgctgaagaagcccagcgtgaagatgtgcctggagagcctgcaggagcactgcaacaacctgtacgacgacgacggcacccaccccagcctgatcagcaacctgcccaactgctgcaaggagaaggaggccgaggacgaggagaacttcgaggcccccgccttcctgaacatgagaaagagaaagagagtgaccttcggcgaggacctgagccccgaggtgttcgacgagagcctgcccgccaacacccccctgagaaagggcggcacccccgtgtgcaagaaggacttcagcggcctgagcagcctgctgctggagcagagccccgtgcccgagcccctgccccagcccgacttcgacgacaagggcgagaacctggagaacatcgagcccctgcaggtgagcttcgccgtgctgagcagccccaacaagagcagcatcagcgagaccctgagcggcaccgacaccttcagcagcagcaacaaccacgagaagatcagcagccccaaggtgggcagaatcaccagaaccagcaacagaagaaaccagctggtgagcgtggtggaggagagcgtgtgcaacctgctgaacaccgaggtgcagccctgcaaggagaagaagatcaacagaagaaagagccaggagaccaagtgcaccaagagagccctgcccaagaagagccaggtgctgaagagctgcagaaagaagaagggcaagggcaagaagagcgtgcagaagagcctgtacggcgagagagacatcgccagcaagaagcccctgctgagccccatccccgagctgcccgaggtgcccgagatgacccccagcatccccagcatcagaagactgggcagcggctacttcagcagcaacggcaagctggaggaggtgaagacccccaagaaccccgtgaagagaaaggacctgctgagacacgaccccgacctgcacatgcaccagggctacgacaagtacgacgtgagcgagttctgcagctacatcaagagcagcagcagcctgggcaacgccaccagcgacgaggaccccaacaccaacatcatgaacatcaacgagaacaagaacatccccaaggccaagaacaagagcgagagcgagaacgagcccaaggccggcaccgacagccccgtgagctgcgccagcgtgaccgaggagagagtggccagcgacagccccaagcccgccctgaccctgcagcagggccaggagttcagcgccggcggccagaacgccgagaacctgtgccagttcttcaagatcagccccgacctgaacatcaagtgcgagagaaaggacgacttcctgggcgccgccgagggcaagctgcagtgcaacagactgatgcccaacagccagaaggactgccactgcctgggcgacgtgctgatcgagaacaccaaggagagcaagagccagagcgaggacctgggcagaaagcccatggagagcagcagcgtggtgagctgcagagacagaaaggacagaagaagaagcatgtgctacagcgacggcagaagcctgcacctggagaagaacggcaaccacacccccagcagcagcgtgggcagcagcgtggagatcagcctggagaacagcgagctgttcaaggacctgagcgacgccatcgagcagaccttccagagaagaaacagcgagaccaaggtgagaagaagcaccagactgcagaaggacctggagaacgagggcctggtgtggatcagcctgcccctgcccagcaccagccagaaggccaagagaagaaccatctgcaccttcgacagcagcggcttcgagagcatgagccccatcaaggagaccgtgagcagcagacagaagccccagatggccccccccgtgagcgaccccgagaacagccagggccccgccgccggcagcagcgacgagcccggcaagagaagaaagagcttctgcatcagcaccctggccaacaccaaggccaccagccagttcaagggctacagaagaagaagcagcctgaacggcaagggcgagagcagcctgaccgccctggagagaatcgagcacaacggcgagagaaagcagtag

SEQ ID NO: 10054 - DNA, 963 bp, Artificial Sequence
  Description of Artificial Sequence: Synthetic coding sequence
atgagcaagagcgagagccccaaggagcccgagcagctgagaaagctgttcatcggcggcctgagcttcgagaccaccgacgagagcctgagaagccacttcgagcagtggggcaccctgaccgactgcgtggtgatgagagaccccaacaccaagagaagcagaggcttcggcttcgtgacctacgccaccgtggaggaggtggacgccgccatgaacgccagaccccacaaggtggacggcagagtggtggagcccaagagagccgtgagcagagaggacagccagagacccggcgcccacctgaccgtgaagaagatcttcgtgggcggcatcaaggaggacaccgaggagcaccacctgagagactacttcgagcagtacggcaagatcgaggtgatcgagatcatgaccgacagaggcagcggcaagaagagaggcttcgccttcgtgaccttcgacgaccacgacagcgtggacaagatcgtgatccagaagtaccacaccgtgaacggccacaactgcgaggtgagaaaggccctgagcaagcaggagatggccagcgccagcagcagccagagaggcagaagcggcagcggcaacttcggcggcggcagaggcggcggcttcggcggcaacgacaacttcggcagaggcggcaacttcagcggcagaggcggcttcggcggcagcagaggcggcggcggctacggcggcagcggcgacggctacaacggcttcggcaacgacggcaacaacttcggcggcggcggcagctacaacgacttcggcaactacaacaaccagagcagcaacttcggccccatgaagggcggcaacttcggcggcagaagcagcggcccctacggcggcggcggccagtacttcgccaagcccagaaaccagggcggctacggcggcagcagcagcagcagcagctacggcagcggcagaagattctag

SEQ ID NO: 10055 - DNA, 141 bp, Artificial Sequence
  Description of Artificial Sequence: Synthetic coding sequence
atgtgcagcctggccagcggcgccaccggctacagccacctgctgaagaagcacttccacaccgtgagcctgagcatcagcctgatcctgaccgcctggttcatcaacatggacctgaacttcatggacaccctgagctag

SEQ ID NO: 10056 - DNA, 198 bp, Artificial Sequence
  Description of Artificial Sequence: Synthetic coding sequence
atgtgctactacagcaactactacggcggcctgagatacggctacggcgtgctgggcggcggctacggctgcggctgcggctacggccacggctacggcggcctgggctgcggctacggcagaggctacggcggctacggctacggctgctgcagacccagctgctacggcagatactggagctgcggcttctactag

SEQ ID NO: 10057 - DNA, 7059 bp, Artificial Sequence
  Description of Artificial Sequence: Synthetic coding sequence
atggagaaggccaccgtgcccgtggccgccgccaccgccgccgagggcgagggcagcccccccgccgtggccgccgtggccggcccccccgccgccgccgaggtgggcggcggcgtgggcggcagcagcagagccagaagcgccagcagccccagaggcatggtgagagtgtgcgacctgctgctgaagaagaagcccccccagcagcagcaccacaaggccaagagaaacagaacctgcagaccccccagcagcagcgagagcagcagcgacagcgacaacagcggcggcggcggcggcggcggcggcggcggcggcggcggcggcggcaccagcagcaacaacagcgaggaggaggaggacgacgacgacgaggaggaggaggtgagcgaggtggagagcttcatcctggaccaggacgacctggagaaccccatgctggagaccgccagcaagctgctgctgagcggcaccgccgacggcgccgacctgagaaccgtggaccccgagacccaggccagactggaggccctgctggaggccgccggcatcggcaagctgagcaccgccgacggcaaggccttcgccgaccccgaggtgctgagaagactgaccagcagcgtgagctgcgccctggacgaggccgccgccgccctgaccagaatgagagccgagagcaccgccaacgccggccagagcgacaacagaagcctggccgaggcctgcagcgagggcgacgtgaacgccgtgagaaagctgctgatcgagggcagaagcgtgaacgagcacaccgaggagggcgagagcctgctgtgcctggcctgcagcgccggctactacgagctggcccaggtgctgctggccatgcacgccaacgtggaggacagaggcatcaagggcgacatcacccccctgatggccgccgccaacggcggccacgtgaagatcgtgaagctgctgctggcccacaaggccgacgtgaacgcccagagcagcaccggcaacaccgccctgacctacgcctgcgccggcggctacgtggacgtggtgaaggtgctgctggagagcggcgccagcatcgaggaccacaacgagaacggccacacccccctgatggaggccggcagcgccggccacgtggaggtggccagactgctgctggagaacggcgccggcatcaacacccacagcaacgagttcaaggagagcgccctgaccctggcctgctacaagggccacctggagatggtgagattcctgctggaggccggcgccgaccaggagcacaagaccgacgagatgcacaccgccctgatggaggcctgcatggacggccacgtggaggtggccagactgctgctggacagcggcgcccaggtgaacatgcccgccgacagcttcgagagccccctgaccctggccgcctgcggcggccacgtggagctggccgccctgctgatcgagagaggcgccagcctggaggaggtgaacgacgagggctacacccccctgatggaggccgccagagagggccacgaggagatggtggccctgctgctgggccagggcgccaacatcaacgcccagaccgaggagacccaggagaccgccctgaccctggcctgctgcggcggcttcctggaggtggccgacttcctgatcaaggccggcgccgacatcgagctgggctgcagcacccccctgatggaggccgcccaggagggccacctggagctggtgaagtacctgctggccgccggcgccaacgtgcacgccaccaccgccaccggcgacaccgccctgacctacgcctgcgagaacggccacaccgacgtggccgacgtgctgctgcaggccggcgccgacctggagcacgagagcgagggcggcagaacccccctgatgaaggccgccagagccggccacgtgtgcaccgtgcagttcctgatcagcaagggcgccaacgtgaacagaaccaccgccaacaacgaccacaccgtgctgagcctggcctgcgccggcggccacctggccgtggtggagctgctgctggcccacggcgccgaccccacccacagactgaaggacggcagcaccatgctgatcgaggccgccaagggcggccacaccagcgtggtgtgctacctgctggactaccccaacaacctgctgagcgcccccccccccgacgtgacccagctgaccccccccagccacgacctgaacagagcccccagagtgcccgtgcaggccctgcccatggtggtgcccccccaggagcccgacaagccccccgccaacgtggccaccaccctgcccatcagaaacaaggccgtgagcggcagagccagcgccatgagcaacacccccacccacagcatcgccgccagcatcagccagccccagacccccacccccagccccatcatcagccccagcgccatgctgcccatctaccccgccatcgacatcgacgcccagaccgagagcaaccacgacaccgccctgaccctggcctgcgccggcggccacgaggagctggtgcagaccctgctggagagaggcgccagcatcgagcacagagacaagaagggcttcacccccctgatcctggccgccaccgccggccacgtgggcgtggtggagatcctgctggacaacggcgccgacatcgaggcccagagcgagagaaccaaggacacccccctgagcctggcctgcagcggcggcagacaggaggtggtggagctgctgctggccagaggcgccaacaaggagcacagaaacgtgagcgactacacccccctgagcctggccgccagcggcggctacgtgaacatcatcaagatcctgctgaacgccggcgccgagatcaacagcagaaccggcagcaagctgggcatcagccccctgatgctggccgccatgaacggccacaccgccgccgtgaagctgctgctggacatgggcagcgacatcaacgcccagatcgagaccaacagaaacaccgccctgaccctggcctgcttccagggcagaaccgaggtggtgagcctgctgctggacagaaaggccaacgtggagcacagagccaagaccggcctgacccccctgatggaggccgccagcggcggctacgccgaggtgggcagagtgctgctggacaagggcgccgacgtgaacgccccccccgtgcccagcagcagagacaccgccctgaccatcgccgccgacaagggccactacaagttctgcgagctgctgatcggcagaggcgcccacatcgacgtgagaaacaagaagggcaacacccccctgtggctggccgccaacggcggccacctggacgtggtgcagctgctggtgcaggccggcgccgacgtggacgccgccgacaacagaaagatcacccccctgatggccgccttcagaaagggccacgtgaaggtggtgagatacctggtgaaggaggtgaaccagttccccagcgacagcgagtgcatgagatacatcgccaccatcaccgacaaggagatgctgaagaagtgccacctgtgcatggagagcatcgtgcaggccaaggacagacaggccgccgaggccaacaagaacgccagcatcctgctggaggagctggacctggagaagctgagagaggagagcagaagactggccctggccgccaagagagagaagagaaaggagaagagaagaaagaagaaggaggagcagagaagaaagctggaggagatcgaggccaagaacaaggagaacttcgagctgcaggccgcccaggagaaggagaagctgaaggtggaggacgagcccgaggtgctgaccgagccccccagcgccaccaccaccaccaccatcggcatcagcgccacctggaccaccctggccggcagccacggcaagagaaacaacaccatcaccaccaccagcagcaagagaaagaacagaaagaacaagatcacccccgagaacgtgcagatcatcttcgacgaccccctgcccatcagctacagccagcccgagaaggtgaacggcgagagcaagagcagcagcaccagcgagagcggcgacagcgacaacatgagaatcagcagctgcagcgacgagagcagcaacagcaacagcagcagaaagagcgacaaccacagccccgccgtggtgaccaccaccgtgagcagcaagaagcagcccagcgtgctggtgaccttccccaaggaggagagaaagagcgtgagcggcaaggccagcatcaagctgagcgagaccatcagcgagggcaccagcaacagcctgagcacctgcaccaagagcggccccagccccctgagcagccccaacggcaagctgaccgtggccagccccaagagaggccagaagagagaggagggctggaaggaggtggtgagaagaagcaagaaggtgagcgtgcccagcaccgtgatcagcagagtgatcggcagaggcggctgcaacatcaacgccatcagagagttcaccggcgcccacatcgacatcgacaagcagaaggacaagaccggcgacagaatcatcaccatcagaggcggcaccgagagcaccagacaggccacccagctgatcaacgccctgatcaaggaccccgacaaggagatcgacgagctgatccccaagaacagactgaagagcagcagcgccaacagcaagatcggcagcagcgcccccaccaccaccgccgccaacaccagcctgatgggcatcaagatgaccaccgtggccctgagcagcaccagccagaccgccaccgccctgaccgtgcccgccatcagcagcgccagcacccacaagaccatcaagaaccccgtgaacaacgtgagacccggcttccccgtgagcctgcccctggcctacccccccccccagttcgcccacgccctgctggccgcccagaccttccagcagatcagaccccccagactgcccatgacccacttcggcggcaccttcccccccgcccagagcacctggggccccttccccgtgagacccctgagccccgccagagccaccaacagccccaagccccacatggtgcccagacacagcaaccagaacagcagcggcagccaggtgaacagcgccggcagcctgaccagcagccccaccaccaccaccagcagcagcgccagcaccgtgcccggcaccagcaccaacggcagccccagcagccccagcgtgagaagacagctgttcgtgaccgtggtgaagaccagcaacgccaccaccaccaccgtgaccaccaccgccagcaacaacaacaccgcccccaccaacgccacctaccccatgcccaccgccaaggagcactaccccgtgagcagccccagcagccccagcccccccgcccagcccggcggcgtgagcagaaacagccccctggactgcggcagcgccagccccaacaaggtggccagcagcagcgagcaggaggccggcagcccccccgtggtggagaccaccaacaccagaccccccaacagcagcagcagcagcggcagcagcagcgcccacagcaaccagcagcagccccccggcagcgtgagccaggagcccagaccccccctgcagcagagccaggtgcccccccccgaggtgagaatgaccgtgccccccctggccaccagcagcgcccccgtggccgtgcccagcaccgcccccgtgacctaccccatgccccagacccccatgggctgcccccagcccacccccaagatggagacccccgccatcagaccccccccccacggcaccaccgccccccacaagaacagcgccagcgtgcagaacagcagcgtggccgtgctgagcgtgaaccacatcaagagaccccacagcgtgcccagcagcgtgcagctgcccagcaccctgagcacccagagcgcctgccagaacagcgtgcaccccgccaacaagcccatcgcccccaacttcagcgcccccctgcccttcggccccttcagcaccctgttcgagaacagccccaccagcgcccacgccttctggggcggcagcgtggtgagcagccagagcacccccgagagcatgctgagcggcaagagcagctacctgcccaacagcgaccccctgcaccagagcgacaccagcaaggcccccggcttcagaccccccctgcagagacccgcccccagccccagcggcatcgtgaacatggacagcccctacggcagcgtgacccccagcagcacccacctgggcaacttcgccagcaacatcagcggcggccagatgtacggccccggcgcccccctgggcggcgcccccgccgccgccaacttcaacagacagcacttcagccccctgagcctgctgaccccctgcagcagcgccagcaacgacagcagcgcccagagcgtgagcagcggcgtgagagcccccagccccgcccccagcagcgtgcccctgggcagcgagaagcccagcaacgtgagccaggacagaaaggtgcccgtgcccatcggcaccgagagaagcgccagaatcagacagaccggcaccagcgcccccagcgtgatcggcagcaacctgagcaccagcgtgggccacagcggcatctggagcttcgagggcatcggcggcaaccaggacaaggtggactggtgcaaccccggcatgggcaaccccatgatccacagacccatgagcgaccccggcgtgttcagccagcaccaggccatggagagagacagcaccggcatcgtgacccccagcggcaccttccaccagcacgtgcccgccggctacatggacttccccaaggtgggcggcatgcccttcagcgtgtacggcaacgccatgatcccccccgtggcccccatccccgacggcgccggcggccccatcttcaacggcccccacgccgccgaccccagctggaacagcctgatcaagatggtgagcagcagcaccgagaacaacggcccccagaccgtgtggaccggcccctgggccccccacatgaacagcgtgcacatgaaccagctgggctag

SEQ ID NO: 10058 - DNA, 1374 bp, Artificial Sequence
  Description of Artificial Sequence: Synthetic coding sequence
atgagcggcaccagagccagcaacgacagaccccccggcgccggcggcgtgaagagaggcagactgcagcaggaggccgccgccaccggcagcagagtgaccgtggtgctgggcgcccagtggggcgacgagggcaagggcaaggtggtggacctgctggccaccgacgccgacatcatcagcagatgccagggcggcaacaacgccggccacaccgtggtggtggacggcaaggagtacgacttccacctgctgcccagcggcatcatcaacaccaaggccgtgagcttcatcggcaacggcgtggtgatccacctgcccggcctgttcgaggaggccgagaagaacgagaagaagggcctgaaggactgggagaagagactgatcatcagcgacagagcccacctggtgttcgacttccaccaggccgtggacggcctgcaggaggtgcagagacaggcccaggagggcaagaacatcggcaccaccaagaagggcatcggccccacctacagcagcaaggccgccagaaccggcctgagaatctgcgacctgctgagcgacttcgacgagttcagcagcagattcaagaacctggcccaccagcaccagagcatgttccccaccctggagatcgacatcgagggccagctgaagagactgaagggcttcgccgagagaatcagacccatggtgagagacggcgtgtacttcatgtacgaggccctgcacggcccccccaagaagatcctggtggagggcgccaacgccgccctgctggacatcgacttcggcacctaccccttcgtgaccagcagcaactgcaccgtgggcggcgtgtgcaccggcctgggcatccccccccagaacatcggcgacgtgtacggcgtggtgaaggcctacaccaccagagtgggcatcggcgccttccccaccgagcagatcaacgagatcggcggcctgctgcagaccagaggccacgagtggggcgtgaccaccggcagaaagagaagatgcggctggctggacctgatgatcctgagatacgcccacatggtgaacggcttcaccgccctggccctgaccaagctggacatcctggacgtgctgggcgaggtgaaggtgggcgtgagctacaagctgaacggcaagagaatcccctacttccccgccaaccaggagatgctgcagaaggtggaggtggagtacgagaccctgcccggctggaaggccgacaccaccggcgccagaagatgggaggacctgcccccccaggcccagaactacatcagattcgtggagaaccacgtgggcgtggccgtgaagtgggtgggcgtgggcaagagcagagagagcatgatccagctgttctag

SEQ ID NO: 10059 - DNA, 1596 bp, Artificial Sequence
  Description of Artificial Sequence: Synthetic coding sequence
atgtgcagcctggccagcggcgccaccggcggcagaggcgccgtggagaacgaggaggacctgcccgagctgagcgacagcggcgacgaggccgcctgggaggacgaggacgacgccgacctgccccacggcaagcagcagaccccctgcctgttctgcaacagactgttcaccagcgccgaggagaccttcagccactgcaagagcgagcaccagttcaacatcgacagcatggtgcacaagcacggcctggagttctacggctacatcaagctgatcaacttcatcagactgaagaaccccaccgtggagtacatgaacagcatctacaaccccgtgccctgggagaaggaggagtacctgaagcccgtgctggaggacgacctgctgctgcagttcgacgtggaggacctgtacgagcccgtgagcgtgcccttcagctaccccaacggcctgagcgagaacaccagcgtggtggagaagctgaagcacatggaggccagagccctgagcgccgaggccgccctggccagagccagagaggacctgcagaagatgaagcagttcgcccaggacttcgtgatgcacaccgacgtgagaacctgcagcagcagcaccagcgtgatcgccgacctgcaggaggacgaggacggcgtgtacttcagcagctacggccactacggcatccacgaggagatgctgaaggacaagatcagaaccgagagctacagagacttcatctaccagaacccccacatcttcaaggacaaggtggtgctggacgtgggctgcggcaccggcatcctgagcatgttcgccgccaaggccggcgccaagaaggtgctgggcgtggaccagagcgagatcctgtaccaggccatggacatcatcagactgaacaagctggaggacaccatcaccctgatcaagggcaagatcgaggaggtgcacctgcccgtggagaaggtggacgtgatcatcagcgagtggatgggctacttcctgctgttcgagagcatgctggacagcgtgctgtacgccaagaacaagtacctggccaagggcggcagcgtgtaccccgacatctgcaccatcagcctggtggccgtgagcgacgtgaacaagcacgccgacagaatcgccttctgggacgacgtgtacggcttcaagatgagctgcatgaagaaggccgtgatccccgaggccgtggtggaggtgctggaccccaagaccctgatcagcgagccctgcggcatcaagcacatcgactgccacaccaccagcatcagcgacctggagttcagcagcgacttcaccctgaagatcaccagaaccagcatgtgcaccgccatcgccggctacttcgacatctacttcgagaagaactgccacaacagagtggtgttcagcaccggcccccagagcaccaagacccactggaagcagaccgtgttcctgctggagaagcccttcagcgtgaaggccggcgaggccctgaagggcaaggtgaccgtgcacaagagcaagaaggaccccagaagcctgaccgtgaccctgaccctgaacaacagcacccagacctacggcctgcagtag

SEQ ID NO: 10060 - DNA, 1659 bp, Artificial Sequence
  Description of Artificial Sequence: Synthetic coding sequence
atgagcgtgctgagccccggcgacctgaagcccaagagaggcagcccccacagaggcagcctggacagaaccgacgccagcaccgacctggccatgagaagctggcccagcgagctgggcagcagaacctgcagcaccagcgccaccaccaccgcccccagcaacagcacccccatcgccagacaccccggcagaaccaagggctacaacagcgacgacaacctgtgcgagcccagcctggagttcgaggtgcccaaccacagacagtacgtgagcagacccagcagcctggagagcagcagaaacaccagcagcaacagcagccccctgaacctgaagggcagcagcgagcagctgcacggcagaagcgagagcttcagcagcgaggacctgatccccagcagagacctggccaccctgcccagagaggccagcacccccggcagaaacgccctgggcagacacgagtaccccctgcccagaaacggccccctgccccaggagggcgcccagaagagaggcaccgcccccccctacgtgggcgtgagaccctgcagcgccagccccagcagcgagatggtgaccctggaggagttcctggaggagagcaacagaagcagccccacccacgacacccccagctgcagagacgacctgctgagcgactacttcagaaaggccagcgacccccccgccatcggcggccagcccggcccccccgccaagaaggagggcgccaagatgcccaccaacttcgtggcccccaccgtgaagatggccgcccccaccagcgagggcagacccctgaagcccggccagtacgtgaagcccaacttcagactgaccgaggccgaggccccccccagcgtggcccccagacaggcccagcccccccagagcctgagcctgggcagacccagacaggcccccgtgccccccgccagccacgcccccgccagcagaagcgccagcctgagcagagccttcagcctggccagcgccgacctgctgagagccagcggccccgaggcctgcaagcaggagagcccccagaagctgggcgcccccgaggccctgggcggcagagagaccggcagccacaccctgcagagccccgccccccccagcagccacagcctggccagagagagaacccccctggtgggcaaggccggcagcagctgccagggccccggccccagaagcagacccctggacaccagaagattcagcctggccccccccaaggaggagagactggcccccctgcaccagagcgccaccgcccccgccatcgccaccgccggcgccggcgccgccgccgccggcagcggcagcaacagccagctgctgcacttcagccccgccgccgcccccgccgccagaaccaagcccaaggccccccccagaagcggcgaggtggccaccatcacccccgtgagagccggcctgagcctgagcgagggcgacggcgtgcccggccagggctgcagcgagggcctgcccgccaagagccccggcagaagccccgacctggccccccacctgggcagagccctggaggactgcagcagaggcagcgtgagcaagagcagccccgccagccccgagcccggcggcgacccccagaccgtgtggtacgagtacggctgcgtgtag

SEQ ID NO: 10061 - DNA, 774 bp, Artificial Sequence
  Description of Artificial Sequence: Synthetic coding sequence
atggccgacaagatggacatgagcctggacgacatcatcaagctgaacagaagccagagaggcggcagaggcggcggcagaggcagaggcagagccggcagccagggcggcagaggcggcggcgcccaggccgccgccagagtgaacagaggcggcggccccatcagaaacagacccgccatcgccagaggcgccgccggcggcggcggcagaaacagacccgccccctacagcagacccaagcagctgcccgacaagtggcagcacgacctgttcgacagcggcttcggcggcggcgccggcgtggagaccggcggcaagctgctggtgagcaacctggacttcggcgtgagcgacgccgacatccaggagctgttcgccgagttcggcaccctgaagaaggccgccgtgcactacgacagaagcggcagaagcctgggcaccgccgacgtgcacttcgagagaaaggccgacgccctgaaggccatgaagcagtacaacggcgtgcccctggacggcagacccatgaacatccagctggtgaccagccagatcgacgcccagagaagacccgcccagagcgtgaacagaggcggcatgaccagaaacagaggcgccggcggcttcggcggcggcggcggcaccagaagaggcaccagaggcggcgccagaggcagaggcagaggcgccggcagaaacagcaagcagcagctgagcgccgaggagctggacgcccagctggacgcctacaacgccagaatggacaccagctag

SEQ ID NO: 10062 - DNA, 876 bp, Artificial Sequence
  Description of Artificial Sequence: Synthetic coding sequence
atgggcgtggccgccagaccccccgccctgagacactggttcagccacagcatccccctggccatcttcgccctgctgctgctgtacctgagcgtgagaagcctgggcgccagaagcggctgcggccccagagcccagccctgcgtgcccggcgagaccgcccccttccaggtgagacaggagagcggcaccctggaggcccccgagagaaagcagcccccctgcctgggccccagaggcatgctgggcagaatgatgagaagattccacgccagcctgaagcccgagggcgacgtgggcctgagcccctacctggccggctggagagccctggtggagttcctgacccccctgggcagcgtgttcgccttcgccaccagagaggccttcaccaaggtgaccgacctggaggccagagtgcacggccccgacgccgagcactactggagcctggtggccatggccgcctgggagagaagagccggcctgctggagcagcccggcgccgcccccagagaccccaccagaagcagcggcagcagaaccctgctgctgctgcacagagccctgagatggagccagctgtgcctgcacagagtggccaccggcgccctgggcggccccgacgccggcgtgcagtgcagcgacgcctacagagccgccctgggcccccaccacccctggctggtgagacagaccgccagactggccttcctggccttccccggcagaagaagactgctggagctggcctgccccggcgccaccgaggccgaggccagagccgccctggtgagagccgccggcaccctggaggacgtgtacaacagaacccagagcctgctggccgagagaggcctgctgcagctggcctag

SEQ ID NO: 10063 - DNA, 3303 bp, Artificial Sequence
  Description of Artificial Sequence: Synthetic coding sequence
atgggcaacgccgccggcagcgccgagcagcccgccggccccgccgcccccccccccaagcagcccgccccccccaagcagcccatgcccgccgccggcgagctggaggagagattcaacagagccctgaactgcatgaacctgccccccgacaaggtgcagctgctgagccagtacgacaacgagaagaagtgggagctgatctgcgaccaggagagattccaggtgaagaacccccccgccgcctacatccagaagctgaagagctacgtggacaccggcggcgtgagcagaaaggtggccgccgactggatgagcaacctgggcttcaagagaagagtgcaggagagcacccaggtgctgagagagctggagaccagcctgagaaccaaccacatcggctgggtgcaggagttcctgaacgaggagaacagaggcctggacgtgctgctggagtacctggccttcgcccagtgcagcgtgacctacgacatggagagcaccgacaacggcgccagcaacagcgagaagaacaagcccctggagcagagcgtggaggacctgagcaagggcccccccagcagcgtgcccaagagcagacacctgaccatcaagctgacccccgcccacagcagaaaggccctgagaaacagcagaatcgtgagccagaaggacgacgtgcacgtgtgcatcatgtgcctgagagccatcatgaactaccagagcggcttcagcctggtgatgaaccaccccgcctgcgtgaacgagatcgccctgagcctgaacaacaagaaccccagaaccaaggccctggtgctggagctgctggccgccgtgtgcctggtgagaggcggccacgacatcatcctggccgccttcgacaacttcaaggaggtgtgcggcgagcagcacagattcgagaagctgatggagtacttcagaaacgaggacagcaacatcgacttcatggtggcctgcatgcagttcatcaacatcgtggtgcacagcgtggagaacatgaacttcagagtgttcctgcagtacgagttcacccacctgggcctggacctgtacctggagagactgagactgaccgagagcgacaagctgcaggtgcagatccaggcctacctggacaacatcttcgacgtgggcgccctgctggaggacaccgagaccaagaacgccgtgctggagcacatggaggagctgcaggagcaggtggccctgctgaccgagagactgagagacgccgagaacgagagcatggccaagatcgccgagctggagaagcagctgagccaggccagaaaggagctggagaccctgagagagagattcagcgagagcaccgccatgggccccagcagaagaccccccgagcccgagaaggccccccccgccgcccccaccagacccagcgccctggagctgaaggtggaggagctggaggagaagggcctgatcagaatcctgagaggccccggcgacgccgtgagcatcgagatcctgcccgtggccgtggccacccccagcggcggcgacgcccccacccccggcgtgcccaccggcagccccagccccgacctggcccccgccgccgagcccgcccccggcgccgccccccccccccccccccccctgcccggcctgcccagcccccaggaggccccccccagcgcccccccccaggccccccccctgcccggcagccccgagcccccccccgccccccccctgcccggcgacctgcccccccccccccccccccccccccccccccccggcaccgacggccccgtgcccccccccccccccccccccccccccccccccggcggcccccccgacgccctgggcagaagagacagcgagctgggccccggcgtgaaggccaagaagcccatccagaccaagttcagaatgcccctgctgaactgggtggccctgaagcccagccagatcaccggcaccgtgttcaccgagctgaacgacgagaaggtgctgcaggagctggacatgagcgacttcgaggagcagttcaagaccaagagccagggccccagcctggacctgagcgccctgaagagcaaggccgcccagaaggcccccagcaaggccaccctgatcgaggccaacagagccaagaacctggccatcaccctgagaaagggcaacctgggcgccgagagaatctgccaggccatcgaggcctacgacctgcaggccctgggcctggacttcctggagctgctgatgagattcctgcccaccgagtacgagagaagcctgatcaccagattcgagagagagcagagacccatggaggagctgagcgaggaggacagattcatgctgtgcttcagcagaatccccagactgcccgagagaatgaccaccctgaccttcctgggcaacttccccgacaccgcccagctgctgatgccccagctgaacgccatcatcgccgccagcatgagcatcaagagcagcgacaagctgagacagatcctggagatcgtgctggccttcggcaactacatgaacagcagcaagagaggcgccgcctacggcttcagactgcagagcctggacgccctgctggagatgaagagcaccgacagaaagcagaccctgctgcactacctggtgaaggtgatcgccgagaagtacccccagctgaccggcttccacagcgacctgcacttcctggacaaggccggcagcgtgagcctggacagcgtgctggccgacgtgagaagcctgcagagaggcctggagctgacccagagagagttcgtgagacaggacgactgcatggtgctgaaggagttcctgagagccaacagccccaccatggacaagctgctggccgacagcaagaccgcccaggaggccttcgagagcgtggtggagtacttcggcgagaaccccaagaccaccagccccggcctgttcttcagcctgttcagcagattcatcaaggcctacaagaaggccgagcaggaggtggagcagtggaagaaggaggccgccgcccaggaggccggcgccgacacccccggcaagggcgagccccccgcccccaagagcccccccaaggccagaagaccccagatggacctgatcagcgagctgaagagaagacagcagaaggagcccctgatctacgagagcgacagagacggcgccatcgaggacatcatcaccgtgatcaagaccgtgcccttcaccgccagaaccggcaagagaaccagcagactgctgtgcgaggccagcctgggcgaggagatgcccctgtag

SEQ ID NO: 10064 - DNA, 1839 bp, Artificial Sequence
  Description of Artificial Sequence: Synthetic coding sequence
atggagaaccagctggccaagagcaccgaggagagaaccttccagtaccaggacagcctgcccagcctgcccgtgcccagcctggaggagagcctgaagaagtacctggagagcgtgaagcccttcgccaaccaggaggagtacaagaagaccgaggagatcgtgcagaagttccagagcggcatcggcgagaagctgcaccagaagctgctggagagagccaagggcaagagaaactggctggaggagtggtggctgaacgtggcctacctggacgtgagaatccccagccagctgaacgtgaacttcgccggccccgccgcccacttcgagcactactggccccccaaggagggcacccagctggagagaggcagcatcaccctgtggcacaacctgaactactggcagctgctgagaaaggagaaggtgcccgtgcacaaggtgggcaacacccccctggacatgaaccagttcagaatgctgttcagcacctgcaaggtgcccggcatcaccagagacagcatcatgaactacttcagaaccgagagcgagggcagaagccccaaccacatcgtggtgctgtgcagaggcagagccttcgtgttcgacgtgatccacgagggctgcctggtgaccccccccgagctgctgagacagctgacctacatccacaagaagtgccacagcgagcccgacggccccggcatcgccgccctgaccagcgaggagagaaccagatgggccaaggccagagagtacctgatcggcctggaccccgagaacctggccctgctggagaagatccagagcagcctgctggtgtacagcatggaggacagcagcccccacgtgacccccgaggactacagcgagatcatcgccgccatcctgatcggcgaccccaccgtgagatggggcgacaagagctacaacctgatcagcttcagcaacggcgtgttcggctgcaactgcgaccacgcccccttcgacgccatgatcatggtgaacatcagctactacgtggacgagaagatcttccagaacgagggcagatggaagggcagcgagaaggtgagagacatccccctgcccgaggagctgatcttcatcgtggacgagaaggtgctgaacgacatcaaccaggccaaggcccagtacctgagagaggccagcgacctgcagatcgccgcctacgccttcaccagcttcggcaagaagctgaccaagaacaagatgctgcaccccgacaccttcatccagctggccctgcagctggcctactacagactgcacggccaccccggctgctgctacgagaccgccatgaccagacacttctaccacggcagaaccgagaccatgagaagctgcaccgtggaggccgtgagatggtgccagagcatgcaggaccccagcgtgaacctgagagagagacagcagaagatgctgcaggccttcgccaagcacaacaagatgatgaaggactgcagcgccggcaagggcttcgacagacacctgctgggcctgctgctgatcgccaaggaggagggcctgcccgtgcccgagctgttcaccgaccccctgttcagcaagagcggcggcggcggcaacttcgtgctgagcaccagcctggtgggctacctgagagtgcagggcgtggtggtgcccatggtgcacaacggctacggcttcttctaccacatcagagacgacagattcgtggtggcctgcagcgcctggaagagctgccccgagaccgacgccgagaagctggtgcagctgaccttctgcgccttccacgacatgatccagctgatgaacagcacccacctgtag

SEQ ID NO: 10065 - DNA, 1773 bp, Artificial Sequence
  Description of Artificial Sequence: Synthetic coding sequence
atgagcgacagccccgccggcagcaaccccagaacccccgagagcagcggcagcggcagcggcggcggcggcaagagacccgccgtgcccgccgccgtgagcctgctgccccccgccgaccccctgagacaggccaacagactgcccatcagagtgctgaagatgctgagcgcccacaccggccacctgctgcaccccgagtacctgcagcccctgagcagcacccccgtgagccccatcgagctggacgccaagaagagccccctggccctgctggcccagacctgcagccagatcggcaagcccgaccccccccccagcagcaagctgaacagcgtggccgccgccgccaacggcctgggcgccgagaaggaccccggcagaagcgcccccggcgccgccagcgccgccgccgccctgaagcagctgggcgacagccccgccgaggacaagagcagcttcaagccctacagcaagggcagcggcggcggcgacagcagaaaggacagcggcagcagcagcgtgagcagcaccagcagcagcagcagcagcagccccggcgacaaggccggcttcagagtgcccagcgccgcctgcccccccttccccccccacggcgcccccgtgagcgccagcagcagcagcagcagccccggcggcagcagaggcggcagcccccaccacagcgactgcaagaacggcggcggcgtgggcggcggcgagctggacaagaaggaccaggagcccaagcccagccccgagcccgccgccgtgagcagaggcggcggcggcgagcccggcgcccacggcggcgccgagagcggcgccagcggcagaaagagcgagccccccagcgccctggtgggcgccggccacgtggcccccgtgagcccctacaagcccggccacagcgtgttccccctgccccccagcagcatcggctaccacggcagcatcgtgggcgcctacgccggctaccccagccagttcgtgcccggcctggaccccagcaagagcggcctggtgggcggccagctgagcggcggcctgggcctgccccccggcaagccccccagcagcagccccctgaccggcgccagcccccccagcttcctgcagggcctgtgcagagacccctactgcctgggcggctaccacggcgccagccacctgggcggcagcagctgcagcacctgcagcgcccacgaccccgccggccccagcctgaaggccggcggctaccccctggtgtaccccggccaccccctgcagcccgccgccctgagcagcagcgccgcccaggccgccctgcccggccaccccctgtacacctacggcttcatgctgcagaacgagcccctgccccacagctgcaactgggtggccgccagcggcccctgcgacaagagattcgccaccagcgaggagctgctgagccacctgagaacccacaccgccctgcccggcgccgagaagctgctggccgcctaccccggcgccagcggcctgggcagcgccgccgccgccgccgccgccgccgccagctgccacctgcacctgcccccccccgccgcccccggcagccccggcagcctgagcctgagaaacccccacaccctgggcctgagcagataccacccctacggcaagagccacctgagcaccgccggcggcctggccgtgcccagcctgcccaccgccggcccctactacagcccctacgccctgtacggccagagactggccagcgccagcgccctgggctaccagtag

SEQ ID NO: 10066 - DNA, 1020 bp, Artificial Sequence
  Description of Artificial Sequence: Synthetic coding sequence
atgtggaccgccagaggccccttcagaagagacagatggagcagcgaggacgaggaggccgccggccccagccaggccctgagccccctgctgagcgacaccagaaagatcgtgagcgagggcgagctggaccagctggcccagatcagacccctgatcttcaacttccacgagcagaccgccatcaaggactgcctgaagatcctggaggagaagaccgccgcctacgacatcatgcaggagttcatggccctggagctgaagaacctgcccggcgagttcaacagcggcaaccagcccagcaacagagagaagaacagatacagagacatcctgccctacgacagcaccagagtgcccctgggcaagagcaaggactacatcaacgccagctacatcagaatcgtgaactgcggcgaggagtacttctacatcgccacccagggccccctgctgagcaccatcgacgacttctggcagatggtgctggagaacaacagcaacgtgatcgccatgatcaccagagagatcgagggcggcatcatcaagtgctaccactactggcccatcagcctgaagaagcccctggagctgaagcacttcagagtgttcctggagaactaccagatcctgcagtacttcatcatcagaatgttccaggtggtggagaagagcaccggcaccagccacagcgtgaagcagctgcagttcaccaagtggcccgaccacggcacccccgccagcgccgacagcttcatcaagtacatcagatacgccagaaagagccacctgaccggccccatggtggtgcactgcagcgccggcatcggcagaaccggcgtgttcctgtgcgtggacgtggtgttctgcgccatcgtgaagaactgcagcttcaacatcatggacatcgtggcccagatgagagagcagagaagcggcatggtgcagaccaaggagcagtaccacttctgctacgacatcgtgctggaggtgctgagaaagctgctgaccctggactag

SEQ ID NO: 10067 - DNA, 1917 bp, Artificial Sequence
  Description of Artificial Sequence: Synthetic coding sequence
atgagcgccctggccggcgaggacgtgtggagatgccccggctgcggcgaccacatcgcccccagccagatctggtacagaaccgtgaacgagacctggcacggcagctgcttcagatgcagcgagtgccaggacagcctgaccaactggtactacgagaaggacggcaagctgtactgccccaaggactactggggcaagttcggcgagttctgccacggctgcagcctgctgatgaccggccccttcatggtggccggcgagttcaagtaccaccccgagtgcttcgcctgcatgagctgcaaggtgatcatcgaggacggcgacgcctacgccctggtgcagcacgccaccctgtactgcggcaagtgccacaacgaggtggtgctggcccccatgttcgagagactgagcaccgagagcgtgcaggagcagctgccctacagcgtgaccctgatcagcatgcccgccaccaccgagggcagaagaggcttcagcgtgagcgtggagagcgcctgcagcaactacgccaccaccgtgcaggtgaaggaggtgaacagaatgcacatcagccccaacaacagaaacgccatccaccccggcgacagaatcctggagatcaacggcacccccgtgagaaccctgagagtggaggaggtggaggacgccatcagccagaccagccagaccctgcagctgctgatcgagcacgaccccgtgagccagagactggaccagctgagactggaggccagactggccccccacatgcagaacgccggccacccccacgccctgagcaccctggacaccaaggagaacctggagggcaccctgagaagaagaagcctgagaagaagcaacagcatcagcaagagccccggccccagcagccccaaggagcccctgctgttcagcagagacatcagcagaagcgagagcctgagatgcagcagcagctacagccagcagatcttcagaccctgcgacctgatccacggcgaggtgctgggcaagggcttcttcggccaggccatcaaggtgacccacaaggccaccggcaaggtgatggtgatgaaggagctgatcagatgcgacgaggagacccagaagaccttcctgaccgaggtgaaggtgatgagaagcctggaccaccccaacgtgctgaagttcatcggcgtgctgtacaaggacaagaagctgaacctgctgaccgagtacatcgagggcggcaccctgaaggacttcctgagaagcatggaccccttcccctggcagcagaaggtgagattcgccaagggcatcgccagcggcatggcctacctgcacagcatgtgcatcatccacagagacctgaacagccacaactgcctgatcaagctggacaagaccgtggtggtggccgacttcggcctgagcagactgatcgtggaggagagaaagagagcccccatggagaaggccaccaccaagaagagaaccctgagaaagaacgacagaaagaagagatacaccgtggtgggcaacccctactggatggcccccgagatgctgaacggcaagagctacgacgagaccgtggacatcttcagcttcggcatcgtgctgtgcgagatcatcggccaggtgtacgccgaccccgactgcctgcccagaaccctggacttcggcctgaacgtgaagctgttctgggagaagttcgtgcccaccgactgcccccccgccttcttccccctggccgccatctgctgcagactggagcccgagagcagacccgccttcagcaagctggaggacagcttcgaggccctgagcctgtacctgggcgagctgggcatccccctgcccgccgagctggaggagctggaccacaccgtgagcatgcagtacggcctgaccagagacagccccccctag

SEQ ID NO: 10068 - DNA, 606 bp, Artificial Sequence
  Description of Artificial Sequence: Synthetic coding sequence
atggccgccgccaaggacacccacgaggaccacgacaccagcaccgagaacaccgacgagagcaaccacgacccccagttcgagcccatcgtgagcctgcccgagcaggagatcaagaccctggaggaggacgaggaggagctgttcaagatgagagccaagctgttcagattcgccagcgagaacgacctgcccgagtggaaggagagaggcaccggcgacgtgaagctgctgaagcacaaggagaagggcgccatcagactgctgatgagaagagacaagaccctgaagatctgcgccaaccactacatcacccccatgatggagctgaagcccaacgccggcagcgacagagcctgggtgtggaacacccacgccgacttcgccgacgagtgccccaagcccgagctgctggccatcagattcctgaacgccgagaacgcccagaagttcaagaccaagttcgaggagtgcagaaaggagatcgaggagagagagaagaaggccggcagcggcaagaacgaccacgccgagaaggtggccgagaagctggaggccctgagcgtgaaggaggagaccaaggaggacgccgaggagaagcagtag

SEQ ID NO: 10069 - DNA, 2154 bp, Artificial Sequence
  Description of Artificial Sequence: Synthetic coding sequence
atggccgccgacaagcccgccgaccagggcgccgagaagcacgagggcaccggccagagcagcggcatcaccgaccaggagaaggagctgagcaccaacgccttccaggccttcaccagcggcaactacgacgcctgcctgcagcacctggcctgcctgcaggacatcaacaaggacgactacaagatcatcctgaacaccgccgtggccgagttcttcaagagcaaccagaccaccaccgacaacctgagacagaccctgaaccagctgaagaaccaggtgcacagcgccgtggaggagatggacggcctggacgacgtggagaacagcatgctgtactacaaccaggccgtgatcctgtaccacctgagacagtacaccgaggccatcagcgtgggcgagaagctgtaccagttcatcgagcccttcgaggagaagttcgcccaggccgtgtgcttcctgctggtggacctgtacatcctgacctaccaggccgagaaggccctgcacctgctggccgtgctggagaagatgatcagccagggcaacaacaacaagaacggcaagaacgagaccggcaacaacaacaacaaggacggcagcaaccacaaggccgagagcggcgccctgatcgaggccgccaagagcaagatccaccagtacaaggtgagagcctacatccagatgaagagcctgaaggcctgcaagagagagatcaagagcgtgatgaacaccgccggcaacagcgcccccagcctgttcctgaagagcaacttcgagtacctgagaggcaactacagaaaggccgtgaagctgctgaacagcagcaacatcgccgagcaccccggcttcatgaagaccggcgagtgcctgagatgcatgttctggaacaacctgggctgcatccacttcgccatgagcaagcacaacctgggcatcttctacttcaagaaggccctgcaggagaacgacaacgtgtgcgcccagctgagcgccggcagcaccgaccccggcaagaagttcagcggcagacccatgtgcaccctgctgaccaacaagagatacgagctgctgtacaactgcggcatccagctgctgcacatcggcagacccctggccgccttcgagtgcctgatcgaggccgtgcaggtgtaccacgccaaccccagactgtggctgagactggccgagtgctgcatcgccgccaacaagggcaccagcgagcaggagaccaagggcctgcccagcaagaagggcatcgtgcagagcatcgtgggccagggctaccacagaaagatcgtgctggccagccagagcatccagaacaccgtgtacaacgacggccagagcagcgccatccccgtggccagcatggagttcgccgccatctgcctgagaaacgccctgctgctgctgcccgaggagcagcaggaccccaagcaggagaacggcgccaagaacagcaaccagctgggcggcaacaccgagagcagcgagagcagcgagacctgcagatgcagcatcctggcctgcagcgcctacgtggccctggccctgggcgacaacctgatggccctgaaccacgccgacaagctgctgcagcagcccaagctgagcggcagcctgaagttcctgggccacctgtacgccgccgaggccctgatcagcctggacagaatcagcgacgccatcacccacctgaaccccgagaacgtgaccgacgtgagcctgggcatcagcagcaacgagcaggaccagggcagcgacaagggcgagaacgaggccatggagagcagcggcaagagagccccccagtgctaccccagcagcgtgaacagcgccagaaccgtgatgctgttcaacctgggcagcgcctactgcctgagaagcgagtacgacaaggccagaaagtgcctgcaccaggccgccagcatgatccaccccaaggaggtgccccccgaggccatcctgctggccgtgtacctggagctgcagaacggcaacacccagctggccctgcagatcatcaagagaaaccagctgctgcccgccgtgaagacccacagcgaggtgagaaagaagcccgtgttccagcccgtgcaccccatccagcccatccagatgcccgccttcaccaccgtgcagagaaagtag

SEQ ID NO: 10070 - DNA, 1488 bp, Artificial Sequence
  Description of Artificial Sequence: Synthetic coding sequence
atggaggccctgctggagggcatccagaacagaggccacggcggcggcttcctgaccagctgcgaggccgagctgcaggagctgatgaagcagatcgacatcatggtggcccacaagaagagcgagtgggagggcagaacccacgccctggagacctgcctgaagatcagagagcaggagctgaagagcctgagaagccagctggacgtgacccacaaggaggtgggcatgctgcaccagcaggtggaggagcacgagaagatcaagcaggagatgaccatggagtacaagcaggagctgaagaagctgcacgaggagctgtgcatcctgaagagaagctacgagaagctgcagaagaagcagatgagagagttcagaggcaacaccaagaaccacagagaggacagaagcgagatcgagagactgaccgccaagatcgaggagttcagacagaagagcctggactgggagaagcagagactgatctaccagcagcaggtgagcagcctggaggcccagagaaaggccctggccgagcagagcgagatcatccaggcccagctggtgaacagaaagcagaagctggagagcgtggagctgagcagccagagcgagatccagcacctgagcagcaagctggagagagccaacgacaccatctgcgccaacgagctggagatcgagagactgaccatgagagtgaacgacctggtgggcaccagcatgaccgtgctgcaggagcagcagcagaaggaggagaagctgagagagagcgagaagctgctggaggccctgcaggaggagaagagagagctgaaggccgccctgcagagccaggagaacctgatccacgaggccagaatccagaaggagaagctgcaggagaaggtgaaggccaccaacacccagcacgccgtggaggccatcagcctggagagcgtgagcgccacctgcaagcagctgagccaggagctgatggagaagtacgaggagctgaagagaatggaggcccacaacaacgagtacaaggccgagatcaagaagctgaaggagcagatcctgcagggcgagcagagctacagcagcgccctggagggcatgaagatggagatcagccacctgacccaggagctgcaccagagagacatcaccatcgccagcaccaagggcagcagcagcgacatggagaagagactgagagccgagatgcagaaggccgaggacaaggccgtggagcacaaggagatcctggaccagctggagagcctgaagctggagaacagacacctgagcgagatggtgatgaagctggagctgggcctgcacgagtgcagcctgcccgtgagccccctgggcagcatcgccaccagattcctggaggaggaggagctgagaagccaccacatcctggagagactggacgcccacatcgaggagctgaagagagagagcgagaagaccgtgagacagttcaccgccctgaagtag

SEQ ID NO: 10071 - DNA, 1962 bp, Artificial Sequence
  Description of Artificial Sequence: Synthetic coding sequence
atgatccccccccaggaggccagcgccagaagaagagagatcgaggacaagctgaagcaggaggaggagaccctgagcttcatcagagacagcctggagaagagcgaccagctgaccaagaacatggtgagcatcctgagcagcttcgagagcagactgatgaagctggagaacagcatcatccccgtgcacaagcagaccgagaacctgcagagactgcaggagaacgtggagaagaccctgagctgcctggaccacgtgatcagctactaccacgtggccagcgacaccgagaagatcatcagagagggccccaccggcagactggaggagtacctgggcagcatggccaagatccagaaggccgtggagtacttccaggacaacagccccgacagccccgagctgaacaaggtgaagctgctgttcgagagaggcaaggaggccctggagagcgagttcagaagcctgatgaccagacacagcaaggtggtgagccccgtgctgatcctggacctgatcagcggcgacgacgacctggaggcccaggaggacgtgaccctggagcacctgcccgagagcgtgctgcaggacgtgatcagaatcagcagatggctggtggagtacggcagaaaccaggacttcatgaacgtgtactaccagatcagaagcagccagctggacagaagcatcaagggcctgaaggagcacttccacaagagcagcagcagcagcggcgtgccctacagccccgccatccccaacaagagaaaggacacccccaccaagaagcccgtgaagagacccggcagagacgacatgctggacgtggagaccgacgcctacatccactgcgtgagcgccttcgtgaagctggcccagagcgagtaccagctgctggccgacatcatccccgagcaccaccagaagaagaccttcgacagcctgatccaggacgccctggacggcctgatgctggagggcgagaacatcgtgagcgccgccagaaaggccatcgtgagacacgacttcagcaccgtgctgaccgtgttccccatcctgagacacctgaagcagaccaagcccgagttcgaccaggtgctgcagggcaccgccgccagcaccaagaacaagctgcccggcctgatcaccagcatggagaccatcggcgccaaggccctggaggacttcgccgacaacatcaagaacgaccccgacaaggagtacaacatgcccaaggacggcaccgtgcacgagctgaccagcaacgccatcctgttcctgcagcagctgctggacttccaggagaccgccggcgccatgctggccagccaggagaccagcagcagcgccaccagctacagcagcgagttcagcaagagactgctgagcacctacatctgcaaggtgctgggcaacctgcagctgaacctgctgagcaagagcaaggtgtacgaggaccccgccctgagcgccatcttcctgcacaacaactacaactacatcctgaagagcctggagaagagcgagctgatccagctggtggccgtgacccagaagaccgccgagagaagctacagagagcacatcgagcagcagatccagacctaccagagaagctggctgaaggtgaccgactacatcgccgagaagaacctgcccgtgttccagcccggcgtgaagctgagagacaaggagagacagatcatcaaggagagattcaagggcttcaacgacggcctggaggagctgtgcaagatccagaaggcctgggccatccccgacaccgagcagagagacagaatcagacaggcccagaagaccatcgtgaaggagacctacggcgccttcctgcagaagttcggcagcgtgcccttcaccaagaaccccgagaagtacatcaagtacggcgtggagcaggtgggcgacatgatcgacagactgttcgacaccagcgcctag

SEQ ID NO: 10072 - DNA, 735 bp, Artificial Sequence
  Description of Artificial Sequence: Synthetic coding sequence
atggagctgaccatcttcatcctgagactggccatctacatcctgaccttccccctgtacctgctgaacttcctgggcctgtggagctggatctgcaagaagtggttcccctacttcctggtgagattcaccgtgatctacaacgagcagatggccagcaagaagagagagctgttcagcaacctgcaggagttcgccggccccagcggcaagctgagcctgctggaggtgggctgcggcaccggcgccaacttcaagttctacccccccggctgcagagtgacctgcatcgaccccaaccccaacttcgagaagttcctgatcaagagcatcgccgagaacagacacctgcagttcgagagattcgtggtggccgccggcgagaacatgcaccaggtggccgacggcagcgtggacgtggtggtgtgcaccctggtgctgtgcagcgtgaagaaccaggagagaatcctgagagaggtgtgcagagtgctgagacccggcggcgccttctacttcatggagcacgtggccgccgagtgcagcacctggaactacttctggcagcaggtgctggaccccgcctggcacctgctgttcgacggctgcaacctgaccagagagagctggaaggccctggagagagccagcttcagcaagctgaagctgcagcacatccaggcccccctgagctgggagctggtgagaccccacatctacggctacgccgtgaagtag

SEQ ID NO: 10073 - DNA, 3522 bp, Artificial Sequence
  Description of Artificial Sequence: Synthetic coding sequence
atggccgtggagaccctgagccccgactgggagttcgacagagtggacgacggcagccagaagatccacgccgaggtgcagctgaagaactacggcaagttcctggaggagtacaccagccagctgagaagaatcgaggacgccctggacgacagcatcggcgacgtgtgggacttcaacctggaccccatcgccctgaagctgctgccctacgagcagagcagcctgctggagctgatcaagaccgagaacaaggtgctgaacaaggtgatcaccgtgtacgccgccctgtgctgcgagatcaagaagctgaagtacgaggccgagaccaagttctacaacggcctgctgttctacggcgagggcgccaccgacgccagcatggtggagggcgactgccagatccagatgggcagattcatcagcttcctgcaggagctgagctgcttcgtgaccagatgctacgaggtggtgatgaacgtggtgcaccagctggccgccctgtacatcagcaacaagatcgcccccaagatcatcgagaccaccggcgtgcacttccagaccatgtacgagcacctgggcgagctgctgaccgtgctgctgaccctggacgagatcatcgacaaccacatcaccctgaaggaccactggaccatgtacaagagactgctgaagagcgtgcaccacaaccccagcaagttcggcatccaggaggagaagctgaagcccttcgagaagttcctgctgaagctggagggccagctgctggacggcatgatcttccaggcctgcatcgagcagcagttcgacagcctgaacggcggcgtgagcgtgagcaagaacagcaccttcgccgaggagttcgcccacagcatcagaagcatcttcgccaacgtggaggccaagctgggcgagcccagcgagatcgaccagagagacaagtacgtgggcatctgcggcctgttcgtgctgcacttccagatcttcagaaccatcgacaagaagttctacaagagcctgctggacatctgcaagaaggtgcccgccatcaccctgaccgccaacatcatctggttccccgacaacttcctgatccagaagatccccgccgccgccaagctgctggacagaaagagcctgcaggccatcaagatccacagagacaccttcctgcagcagaaggcccagagcctgaccaaggacgtgcagagctactacgtgttcgtgagcagctggatgatgaagatggagagcatcctgagcaaggagcagagaatggacaagttcgccgaggacctgaccaacagatgcaacgtgttcatccagggcttcctgtacgcctacagcatcagcaccatcatcaagaccaccatgaacctgtacatgagcatgcagaagcccatgaccaagaccagcgtgaaggccctgtgcagactggtggagctgctgaaggccatcgagcacatgttctacagaagaagcatggtggtggccgacagcgtgagccacatcacccagcacctgcagcaccaggccctgcacagcatcagcgtggccaagaagagagtgatcagcgacaagaagtacagcgagcagagactggacgtgctgagcgccctggtgctggccgagaacaccctgaacggccccagcaccaagcagagaagactgatcgtgagcctggccctgagcgtgggcacccagatgaagaccttcaaggacgaggagctgttccccctgcaggtggtgatgaagaagctggacctgatcagcgagctgagagagagagtgcagacccagtgcgactgctgcttcctgtactggcacagagccgtgttccccatctacctggacgacgtgtacgagaacgccgtggacgccgccagactgcactacatgttcagcgccctgagagactgcgtgcccgccatgatgcacgccagacacctggagagctacgagatcctgctggactgctacgacaaggagatcatggagatcctgaacgagcacctgctggacaagctgtgcaaggagatcgagaaggacctgagactgagcgtgcacacccacctgaagctggacgacagaaaccccttcaaggtgggcatgaaggacctggccctgttcttcagcctgaaccccatcagattcttcaacagattcatcgacatcagagcctacgtgacccactacctggacaagaccttctacaacctgaccaccgtggccctgcacgactgggccacctacagcgagatgagaaacctggccacccagagatacggcctggtgatgaccgaggcccacctgcccagccagaccctggagcagggcctggacgtgctggagatcatgagaaacatccacatcttcgtgagcagatacctgtacaacctgaacaaccagatcttcatcgagagaaccagcaacaacaagcacctgaacaccatcaacatcagacacatcgccaacagcatcagaacccacggcaccggcatcatgaacaccaccgtgaacttcacctaccagttcctgaagaagaagttctacatcttcagccagttcatgtacgacgagcacatcaagagcagactgatcaaggacatcagattcttcagagagatcaaggaccagaacgaccacaagtaccccttcgacagagccgagaagttcaacagaggcatcagaaagctgggcgtgacccccgagggccagagctacctggaccagttcagacagctgatcagccagatcggcaacgccatgggctacgtgagaatgatcagaagcggcggcctgcactgcagcagcaacgccatcagattcgtgcccgacctggaggacatcgtgaacttcgaggagctggtgaaggaggagggcctggccgaggagaccctgaaggccgccagacacctggacagcgtgctgagcgaccacaccagaaacagcgccgagggcaccgagtacttcaagatgctggtggacgtgttcgcccccgagttcagaagacccaagaacatccacctgagaaacttctacatcatcgtgccccccctgaccctgaacttcgtggagcacagcatcagctgcaaggagaagctgaacaagaagaacaagatcggcgccgccttcaccgacgacggcttcgccatgggcgtggcctacatcctgaagctgctggaccagtacagagagttcgacagcctgcactggttccagagcgtgagagagaagtacctgaaggagatcagagccgtggccaagcagcagaacgtgcagagcgccagccaggacgagaagctgctgcagaccatgaacctgacccagaagagactggacgtgtacctgcaggagttcgagctgctgtacttcagcctgagcagcgccagaatcttcttcagagccgacaagaccgccgccgaggagaaccaggagaagaaggagaaggaggaggagaccaagaccagcaacggcgacctgagcgacagcaccgtgagcgccgaccccgtggtgaagtag

SEQ ID NO: 10074 - DNA, 972 bp, Artificial Sequence
  Description of Artificial Sequence: Synthetic coding sequence
atgctgagatggaccgtgcacctggagggcggccccagaagagtgaaccacgccgccgtggccgtgggccacagagtgtacagcttcggcggctactgcagcggcgaggactacgagaccctgagacagatcgacgtgcacatcttcaacgccgacacccacaagtggttcacccccagagtgagcggcaccgtgcccggcgccagagacggccacagcgcctgcgtgctgggcaagatcatgtacatcttcggcggctacgagcagcaggccgactgcttcagcaacgacatccacaagctggacaccagcaccatgacctggaccctgatctgcaccaagggcagccccgccagatggagagacttccacagcgccaccatgctgggcagccacatgtacgtgttcggcggcagagccgacagattcggccccttccacagcaacaacgagatctactgcaacagaatcagagtgttcgacaccagaaccgaggcctggctggactgcccccccacccccgtgctgcccgagggcagaagaagccacagcgccttcggctacaacggcgagctgtacatcttcggcggctacaacgccagactgaacagacacttccacgacctgtggaagttcaaccccgtgagcttcacctggaagaagatcgagcccaagggcaagggcccctgccccagaagaagacagtgctgctgcatcgtgggcgacaagatcgtgctgttcggcggcaccagccccagccccgaggagggcctgggcgacgagttcgacctgatcgaccacagcgacctgcacatcctggacttcagccccagcctgaagaccctgtgcaagctggccgtgatccagtacaacctggaccagagctgcctgccccacgacatcagatgggagctgaacgccatgaccaccaacagcaacatcagcagacccatcgtgagcagccacggctag

SEQ ID NO: 10075 - DNA, 2517 bp, Artificial Sequence
  Description of Artificial Sequence: Synthetic coding sequence
atgaccggcgccgagatcgagcccagcgcccaggccaagcccgagaagaaggccggcgaggaggtgatcgccggccccgagagagagaacgacgtgcccctggtggtgagacccaaggtgagaacccaggccaccaccggcgccagacccaagaccgagaccaagagcgtgcccgccgccagacccaagaccgaggcccaggccatgagcggcgccagacccaagaccgaggtgcaggtgatgggcggcgccagacccaagaccgaggcccagggcatcaccggcgccagacccaagaccgacgccagagccgtgggcggcgccagaagcaagaccgacgccaaggccatccccggcgccagacccaaggacgaggcccaggcctgggcccagagcgagttcggcaccgaggccgtgagccaggccgagggcgtgagccagaccaacgccgtggcctggcccctggccaccgccgagagcggcagcgtgaccaagagcaagggcctgagcatggacagagagctggtgaacgtggacgccgagaccttccccggcacccagggccagaagggcatccagccctggttcggccccggcgaggagaccaacatgggcagctggtgctacagcagacccagagccagagaggaggccagcaacgagagcggcttctggagcgccgacgagaccagcaccgccagcagcttctggaccggcgaggagaccagcgtgagaagctggcccagagaggagagcaacaccagaagcagacacagagccaagcaccagaccaaccccagaagcagacccagaagcaagcaggaggcctacgtggacagctggagcggcagcgaggacgaggccagcaaccccttcagcttctgggtgggcgagaacaccaacaacctgttcagacccagagtgagagaggaggccaacatcagaagcaagctgagaaccaacagagaggactgcttcgagagcgagagcgaggacgagttctacaagcagagctgggtgctgcccggcgaggaggccaacagcagattcagacacagagacaaggaggaccccaacaccgccctgaagctgagagcccagaaggacgtggacagcgacagagtgaagcaggagcccagattcgaggaggaggtgatcatcggcagctggttctgggccgagaaggaggccagcctggagggcggcgccagcgccatctgcgagagcgagcccggcaccgaggagggcgccatcggcggcagcgcctactgggccgaggagaagagcagcctgggcgccgtggccagagaggaggccaagcccgagagcgaggaggaggccatcttcggcagctggttctgggacagagacgaggcctgcttcgacctgaacccctgccccgtgtacaaggtgagcgacagattcagagacgccgccgaggagctgaacgccagcagcagaccccagacctgggacgaggtgaccgtggagttcaagcccggcctgttccacggcgtgggcttcagaagcaccagccccttcggcatccccgaggaggccagcgagatgctggaggccaagcccaagaacctggagctgagccccgagggcgaggagcaggagagcctgctgcagcccgaccagcccagccccgagttcaccttccagtacgaccccagctacagaagcgtgagagagatcagagagcacctgagagccagagagagcgccgagagcgagagctggagctgcagctgcatccagtgcgagctgaagatcggcagcgaggagttcgaggagttcctgctgctgatggacaagatcagagaccccttcatccacgagatcagcaagatcgccatgggcatgagaagcgccagccagttcaccagagacttcatcagagacagcggcgtggtgagcctgatcgagaccctgctgaactaccccagcagcagagtgagaaccagcttcctggagaacatgatccacatggcccccccctaccccaacctgaacatgatcgagaccttcatctgccaggtgtgcgaggagaccctggcccacagcgtggacagcctggagcagctgaccggcatcagaatgctgagacacctgaccatgaccatcgactaccacaccctgatcgccaactacatgagcggcttcctgagcctgctgaccaccgccaacgccagaaccaagttccacgtgctgaagatgctgctgaacctgagcgagaaccccgccgtggccaagaagctgttcagcgccaaggccctgagcatcttcgtgggcctgttcaacatcgaggagaccaacgacaacatccagatcgtgatcaagatgttccagaacatcagcaacatcatcaagagcggcaagatgagcctgatcgacgacgacttcagcctggagcccctgatcagcgccttcagagagttcgaggagctggccaagcagctgcaggcccagatcgacaaccagaacgaccccgaggtgggccagcagagctag

SEQ ID NO: 10076 - DNA, 2649 bp, Artificial Sequence
  Description of Artificial Sequence: Synthetic coding sequence
atgcccggcagagccagaaccagagccagaggcagagccagaagaagagagagctaccagcaggaggcccccggcggccccagagcccccggcagcgccaccacccaggagcccccccagctgcagagcacccccagacccctgcaggaggaggtgcccgtggtgagacccctgcagcccagagccgccagaggcggcgccggcggcggcgcccagagccagggcgtgaaggagcccggccccgaggccggcctgcacaccgcccccctgcaggagagaagaatcggcggcgtgttccaggacctggtggtgaacaccagacaggacatgaagcacgtgaaggacagcaagaccggcagcgagggcaccgtggtgcagctgctggccaaccacttcagagtgatcagcagaccccagtgggtggcctacaagtacaacgtggactacaagcccgacatcgaggacggcaacctgagaaccatcctgctggaccagcacagaagaaagttcggcgagagacacatcttcgacggcaacagcctgctgctgagcagacccctgaaggagagaagagtggagtggctgagcaccaccaaggacaagaacatcgtgaagatcaccgtggagttcagcaaggagctgacccccaccagccccgactgcctgagatactacaacatcctgttcagaagaaccttcaagctgctggacttcgagcaggtgggcagaaactactacaccaagaagaaggccatccagctgtacagacacggcaccagcctggagatctggctgggctacgtgaccagcgtgctgcagtacgagaacagcatcaccctgtgcgccgacgtgagccacaagctgctgagaatcgagaccgcctacgacttcatcaagagaaccagcgcccaggcccagaccggcaacatcagagaggaggtgaccaacaagctgatcggcagcatcgtgctgaccaagtacaacaacaagacctacagagtggacgacatcgactggaagcagaaccccgaggacaccttcaacaagagcgacggcagcaagatcacctacatcgactactacagacagcagcacaaggagatcgtgaccgtgaagaagcagcccctgctggtgagccagggcagatggaagaagggcctgaccggcacccagagagagcccatcctgctgatcccccagctgtgccacatgaccggcctgaccgacgagatctgcaaggactacagcatcgtgaaggagctggccaagcacaccagactgagccccagaagaagacaccacaccctgaaggagttcatcaacaccctgcaggacaacaagaaggtgagagagctgctgcagctgtgggacctgaagttcgacaccaacttcctgagcgtgcccggcagagtgctgaagaacgccaacatcgtgcagggcagaagaatggtgaaggccaacagccagggcgactggagcagagagatcagagagctgcccctgctgaacgccatgcccctgcacagctggctgatcctgtacagcagaagcagccacagagaggccatgagcctgaagggccacctgcagagcgtgaccgcccccatgggcatcaccatgaagcccgccgagatgatcgaggtggacggcgacgccaacagctacatcgacaccctgagaaagtacaccagacccaccctgcagatgggcatgagctgcctgctggtgttcaaggtgatctgcatcctgcccaacgacgacaagagaagatacgacagcatcaagagatacctgtgcaccaagtgccccatccccagccagtgcgtggtgaagaagaccctggagaaggtgcaggccagaaccatcgtgaccaagatcgcccagcagatgaactgcaagatgggcggcgccctgtggaaggtggagaccgacgtgcagagaaccatgttcgtgggcatcgactgcttccacgacatcgtgaacagacagaagagcatcgccggcttcgtggccagcaccaacgccgagctgaccaagtggtacagccagtgcgtgatccagaagaccggcgaggagctggtgaaggagctggagatctgcctgaaggccgccctggacgtgtggtgcaagaacgagagcagcatgccccacagcgtgatcgtgtacagagacggcgtgggcgacggccagctgcaggccctgctggaccacgaggccaagaagatgagcacctacctgaagaccatcagccccaacaacttcaccctggccttcatcgtggtgaagaagagaatcaacaccagattcttcctgaagcacggcagcaacttccagaaccccccccccggcaccgtgatcgacgtggagctgaccagaaacgagtggtacgacttcttcatcgtgagccagagcgtgcaggacggcaccgtgacccccacccactacaacgtgatctacgacaccatcggcctgagccccgacaccgtgcagagactgacctactgcctgtgccacatgtactacaacctgcccggcatcatcagagtgcccgccccctgccactacgcccacaagctggcctacctggtgggccagagcatccaccaggagcccaacagaagcctgagcaccagactgttctacctgtag

SEQ ID NO: 10077 - DNA, 1917 bp, Artificial Sequence
  Description of Artificial Sequence: Synthetic coding sequence
atgaacagacaggtgtgcaagaagagcttcagcggcagaagccagggcttcagcggcagaagcgccgtggtgagcggcagcagcagaatgagctgcgtggccagaagcggcggcgccggcggcggcgcctgcggcttcagaagcggcgccggcagcttcggcagcagaagcctgtacaacctgggcagcaacaagagcatcagcatcagcgtggccgccggcagcagcagagccggcggcttcggcggcggcagaagcagctgcggcttcgccggcggctacggcggcggcttcggcggcagctacggcggcggcttcggcggcggcagaggcgtgggcagcggcttcggcggcgccggcggcttcggcggcgccggcggcttcggcggccccggcgtgttcggcggccccggcagcttcggcggccccggcggcttcggccccggcggcttccccggcggcatccaggaggtgatcgtgaaccagagcctgctgcagcccctgaacgtggagatcgacccccagatcggccaggtgaaggcccaggagagagagcagatcaagaccctgaacaacaagttcgccagcttcatcgacaaggtgagattcctggagcagcagaacaaggtgctggagaccaagtgggagctgctgcagcagcagaccaccggcagcggccccagcagcctggagccctgcttcgagagctacatcagcttcctgtgcaagcagctggacagcctgctgggcgagagaggcaacctggagggcgagctgaagagcatgcaggacctggtggaggacttcaagaagaagtacgaggacgagatcaacaagagaaccgccgccgagaacgagttcgtgggcctgaagaaggacgtggacgccgccttcatgaacaaggtggagctgcaggccaaggtggacagcctgaccgacgaggtgagcttcctgagaaccctgtacgagatggagctgagccagatgcagagccacgccagcgacaccagcgtggtgctgagcatggacaacaacagatgcctggacctgggcagcatcatcgccgaggtgagagcccagtacgaggagatcgcccagagaagcaagagcgaggccgaggccctgtaccagaccaagctgggcgagctgcagaccaccgccggcagacacggcgacgacctgagaaacaccaagagcgagatcatggagctgaacagaatgatccagagactgagagccgagatcgagaacgtgaagaagcagaacgccaacctgcagaccgccatcgccgaggccgagcagagaggcgagatggccctgaaggacgccaacgccaagctgcaggacctgcagaccgccctgcagaaggccaaggacgacctggccagactgctgagagactaccaggagctgatgaacgtgaagctggccctggacgtggagatcgccacctacagaaagctgctggagggcgaggagtgcagaatgagcggcgagtgccagagcgccgtgtgcatcagcgtggtgagcaacgtgaccagcaccagcggcagcagcggcagcagcagaggcgtgttcggcggcgtgagcggcagcggcagcggcggctacaagggcggcagcagcagcagcagcagcagcggctacggcgtgagcggcggcagcggcagcggctacggcggcgtgagcagcggcagcaccggcggcagaggcagcagcggcagctaccagagcagcagcagcggcagcagactgggcggcgccggcagcatcagcgtgagccacagcggcatgggcagcagcagcggcagcatccagaccagcggcggcagcggctacaagagcggcggcggcggcagcaccagcatcagattcagccagaccaccagcagcagccagcacagcagcaccaagtag

SEQ ID NO: 10078 - DNA, 1080 bp, Artificial Sequence
  Description of Artificial Sequence: Synthetic coding sequence
atggccgagcccttcctgagcgagtaccagcaccagccccagaccagcaactgcaccggcgccgccgccgtgcaggaggagctgaaccccgagagaccccccggcgccgaggagagagtgcccgaggaggacagcagatggcagagcagagccttcccccagctgggcggcagacccggccccgagggcgagggcagcctggagagccagcccccccccctgcagacccaggcctgccccgagagcagctgcctgagagagggcgagaagggccagaacggcgacgacagcagcgccggcggcgacttccccccccccgccgaggtggagcccacccccgaggccgagctgctggcccagccctgccacgacagcgaggccagcaagctgggcgcccccgccgccggcggcgaggaggagtggggccagcagcagagacagctgggcaagaagaagcacagaagaagacccagcaagaagaagagacactggaagccctactacaagctgacctgggaggagaagaagaagttcgacgagaagcagagcctgagagccagcagaatcagagccgagatgttcgccaagggccagcccgtggccccctacaacaccacccagttcctgatggacgaccacgaccaggaggagcccgacctgaagaccggcctgtacagcaagagagccgccgccaagagcgacgacaccagcgacgacgacttcatggaggagggcggcgaggaggacggcggcagcgacggcatgggcggcgacggcagcgagttcctgcagagagacttcagcgagacctacgagagataccacaccgagagcctgcagaacatgagcaagcaggagctgatcaaggagtacctggagctggagaagtgcctgagcagaatggaggacgagaacaacagactgagactggagagcaagagactgggcggcgacgacgccagagtgagagagctggagctggagctggacagactgagagccgagaacctgcagctgctgaccgagaacgagctgcacagacagcaggagagagcccccctgagcaagttcggcgactag

SEQ ID NO: 10079 - DNA, 2889 bp, Artificial Sequence
  Description of Artificial Sequence: Synthetic coding sequence
atggacgagcaggccctgctgggcctgaaccccaacgccgacagcgacttcagacagagagccctggcctacttcgagcagctgaagatcagccccgacgcctggcaggtgtgcgccgaggccctggcccagagaacctacagcgacgaccacgtgaagttcttctgcttccaggtgctggagcaccaggtgaagtacaagtacagcgagctgaccaccgtgcagcagcagctgatcagagagaccctgatcagctggctgcaggcccagatgctgaacccccagcccgagaagaccttcatcagaaacaaggccgcccaggtgttcgccctgctgttcgtgaccgagtacctgaccaagtggcccaagttcttcttcgacatcctgagcgtggtggacctgaaccccagaggcgtggacctgtacctgagaatcctgatggccatcgacagcgagctggtggacagagacgtggtgcacaccagcgaggaggccagaagaaacaccctgatcaaggacaccatgagagagcagtgcatccccaacctggtggagagctggtaccagatcctgcagaactaccagttcaccaacagcgaggtgacctgccagtgcctggaggtggtgggcgcctacgtgagctggatcgacctgagcctgatcgccaacgacagattcatcaacatgctgctgggccacatgagcatcgaggtgctgagagaggaggcctgcgactgcctgttcgaggtggtgaacaagggcatggaccccgtggacaagatgaagctggtggagagcctgtgccaggtgctgcagagcgccggcttcttcagcatcgaccaggaggaggacgtggacttcctggccagattcagcaagctggtgaacggcatgggccagagcctgatcgtgagctggagcaagctgatcaagaacggcgacatcaagaacgcccaggaggccctgcaggccatcgagaccaaggtggccctgatgctgcagctgctgatccacgaggacgacgacatcagcagcaacatcatcggcttctgctacgactacctgcacatcctgaagcagctgaccgtgctgagcgaccagcagaaggccaacgtggaggccatcatgctggccgtgatgaagaagctgacctacgacgaggagtacaacttcgagaacgagggcgaggacgaggccatgttcgtggagtacagaaagcagctgaagctgctgctggacagactggcccaggtgagccccgagctgctgctggccagcgtgagaagagtgttcagcagcaccctgcagaactggcagaccaccagattcatggaggtggaggtggccatcagactgctgtacatgctggccgaggccctgcccgtgagccacggcgcccacttcagcggcgacgtgagcaaggccagcgccctgcaggacatgatgagaaccctggtgaccagcggcgtgagcagctaccagcacaccagcgtgaccctggagttcttcgagaccgtggtgagatacgagaagttcttcaccgtggagccccagcacatcccctgcgtgctgatggccttcctggaccacagaggcctgagacacagcagcgccaaggtgagaagcagaaccgcctacctgttcagcagattcgtgaagagcctgaacaagcagatgaaccccttcatcgaggacatcctgaacagaatccaggacctgctggagctgagcccccccgagaacggccaccagagcctgctgagcagcgacgaccagctgttcatctacgagaccgccggcgtgctgatcgtgaacagcgagtaccccgccgagagaaagcaggccctgatgagaaacctgctgacccccctgatggagaagttcaagatcctgctggagaagctgatgctggcccaggacgaggagagacaggccagcctggccgactgcctgaaccacgccgtgggcttcgccagcagaaccagcaaggccttcagcaacaagcagaccgtgaagcagtgcggctgcagcgaggtgtacctggactgcctgcagaccttcctgcccgccctgagctgccccctgcagaaggacatcctgagaagcggcgtgagaaccttcctgcacagaatgatcatctgcctggaggaggaggtgctgcccttcatccccagcgccagcgagcacatgctgaaggactgcgaggccaaggacctgcaggagttcatccccctgatcaaccagatcaccgccaagttcaagatccaggtgagccccttcctgcagcagatgttcatgcccctgctgcacgccatcttcgaggtgctgctgagacccgccgaggagaacgaccagagcgccgccctggagaagcagatgctgagaagaagctacttcgccttcctgcagaccgtgaccggcagcggcatgagcgaggtgatcgccaaccagggcgccgagaacgtggagagagtgctggtgaccgtgatccagggcgccgtggagtaccccgaccccatcgcccagaagacctgcttcatcatcctgagcaagctggtggagctgtggggcggcaaggacggccccgtgggcttcgccgacttcgtgtacaagcacatcgtgcccgcctgcttcctggcccccctgaagcagaccttcgacctggccgacgcccagaccgtgctggccctgagcgagtgcgccgtgaccctgaagaccatccacctgaagagaggccccgagtgcgtgcagtacctgcagcaggagtacctgcccagcctgcaggtggcccccgagatcatccaggagttctgccaggccctgcagcagcccgacgccaaggtgttcaagaactacctgaaggtgttcttccagagagccaagccctag

SEQ ID NO: 10080 - DNA, 2976 bp, Artificial Sequence
  Description of Artificial Sequence: Synthetic coding sequence
atggccgagagcttcttcagcgacttcggcctgctgtggtacctgaaggagctgagaaaggaggagttctggaagttcaaggagctgctgaagcagcccctggagaagttcgagctgaagcccatcccctgggccgagctgaagaaggccagcaaggaggacgtggccaagctgctggacaagcactaccccggcaagcaggcctgggaggtgaccctgaacctgttcctgcagatcaacagaaaggacctgtggaccaaggcccaggaggagatgagaaacaagctgaacccctacagaaagcacatgaaggagaccttccagctgatctgggagaaggagacctgcctgcacgtgcccgagcacttctacaaggagaccatgaagaacgagtacaaggagctgaacgacgcctacaccgccgccgccagaagacacaccgtggtgctggagggccccgacggcatcggcaagaccaccctgctgagaaaggtgatgctggactgggccgagggcaacctgtggaaggacagattcaccttcgtgttcttcctgaacgtgtgcgagatgaacggcatcgccgagaccagcctgctggagctgctgagcagagactggcccgagagcagcgagaagatcgaggacatcttcagccagcccgagagaatcctgttcatcatggacggcttcgagcagctgaagttcaacctgcagctgaaggccgacctgagcgacgactggagacagagacagcccatgcccatcatcctgagcagcctgctgcagaagaagatgctgcccgagagcagcctgctgatcgccctgggcaagctggccatgcagaagcactacttcatgctgagacaccccaagctgatcaagctgctgggcttcagcgagagcgagaagaagagctacttcagctacttcttcggcgagaagagcaaggccctgaaggtgttcaacttcgtgagagacaacggccccctgttcatcctgtgccacaaccccttcacctgctggctggtgtgcacctgcgtgaagcagagactggagagaggcgaggacctggagatcaacagccagaacaccacctacctgtacgccagcttcctgaccaccgtgttcaaggccggcagccagagcttcccccccaaggtgaacagagccagactgaagagcctgtgcgccctggccgccgagggcatctggacctacaccttcgtgttcagccacggcgacctgagaagaaacggcctgagcgagagcgagggcgtgatgtgggtgggcatgagactgctgcagagaagaggcgactgcttcgccttcatgcacctgtgcatccaggagttctgcgccgccatgttctacctgctgaagagacccaaggacgaccccaaccccgccatcggcagcatcacccagctggtgagagccagcgtggtgcagccccagaccctgctgacccaggtgggcatcttcatgttcggcatcagcaccgaggagatcgtgagcatgctggagaccagcttcggcttccccctgagcaaggacctgaagcaggagatcacccagtgcctggagagcctgagccagtgcgaggccgacagagaggccatcgccttccaggagctgttcatcggcctgttcgagacccaggagaaggagttcgtgaccaaggtgatgaacttcttcgaggaggtgttcatctacatcggcaacatcgagcacctggtgatcgccagcttctgcctgaagcactgccagcacctgaccaccctgagaatgtgcgtggagaacatcttccccgacgacagcggctgcatcagcgactacaacgagaagctggtgtactggagagagctgtgcagcatgttcatcaccaacaagaacttccagatcctggacatggagaacaccagcctggacgaccccagcctggccatcctgtgcaaggccctggcccagcccgtgtgcaagctgagaaagctgatcttcaccagcgtgtacttcggccacgacagcgagctgttcaaggccgtgctgcacaacccccacctgaagctgctgagcctgtacggcaccagcctgagccagagcgacatcagacacctgtgcgagaccctgaagcaccccatgtgcaagatcgaggagctgatcctgggcaagtgcgacatcagcagcgaggtgtgcgaggacatcgccagcgtgctggcctgcaacagcaagctgaagcacctgagcctggtggagaaccccctgagagacgagggcatgaccctgctgtgcgaggccctgaagcacagccactgcgccctggagagactgatgctgatgtactgctgcctgaccagcgtgagctgcgacagcatcagcgaggtgctgctgtgcagcaagagcctgagcctgctggacctgggcagcaacgccctggaggacaacggcgtggccagcctgtgcgccgccctgaagcaccccggctgcagcatcagagagctgtggctgatgggctgcttcctgaccagcgacagctgcaaggacatcgccgccgtgctgatctgcaacggcaagctgaagaccctgaagctgggccacaacgagatcggcgacaccggcgtgagacagctgtgcgccgccctgcagcacccccactgcaagctggagtgcctgggcctgcagacctgccccatcaccagagcctgctgcgacgacatcgccgccgccctgatcgcctgcaagaccctgagaagcctgaacctggactggatcgccctggacgccgacgccgtggtggtgctgtgcgaggccctgagccaccccgactgcgccctgcagatgctgggcctgcacaagagcggcttcgacgaggagacccagaagatcctgatgagcgtggaggagaagatcccccacctgaccatcagccacggcccctggatcgacgaggagtacaagatcagaggcgtgctgctgtag

SEQ ID NO: 10081 - DNA, 534 bp, Artificial Sequence
  Description of Artificial Sequence: Synthetic coding sequence
atggccgccgtgaaggccagcaccagcaaggccaccagaccctggtacagccaccccgtgtacgccagatactggcagcactaccaccaggccatggcctggatgcagagccaccacaacgcctacagaaaggccgtggagagctgcttcaacctgccctggtacctgcccagcgccctgctgccccagagcagctacgacaacgaggccgcctacccccagagcttctacgaccaccacgtggcctggcaggactacccctgcagcagcagccacttcagaagaagcggccagcaccccagatacagcagcagaatccaggccagcaccaaggaggaccaggccctgagcaaggaggaggagatggagaccgagagcgacgccgaggtggagtgcgacctgagcaacatggagatcaccgaggagctgagacagtacttcgccgagaccgagagacacagagaggagagaagaagacagcagcagctggacgccgagagactggacagctacgtgaacgccgaccacgactag

SEQ ID NO: 10082 - DNA, 1503 bp, Artificial Sequence
  Description of Artificial Sequence: Synthetic coding sequence
atggtgggcagaagctgcggcgtggccacccagagacagggcggcggccagagacccaccaacctggccctgaccctgagcagcagccccgcccacagcaccgccctgccctggctgccccccagaagcctgcagctgctgagcggccacagcgtgcccgcccagcccaccccccacctgcccagcgcctgcggcggccccaccagagtgaccctgggcgaggagagagcctggagaagccacggcagcaacgccggcggccacacctgcctgcccagaagaaccgccggcgccggcagcctgacccccggcggcgagagaggcggcaacaacgccggccacaccgtggtggtggacggcaaggagtacgacttccacctgctgcccagcggcatcatcaacaccaaggccgtgagcttcatcggcaacggcgtggtgatccacctgcccggcctgttcgaggaggccgagaagaacgagaagaagggcctgaaggactgggagaagagactgatcatcagcgacagagcccacctggtgttcgacttccaccaggccgtggacggcctgcaggaggtgcagagacaggcccaggagggcaagaacatcggcaccaccaagaagggcatcggccccacctacagcagcaaggccgccagaaccggcctgagaatctgcgacctgctgagcgacttcgacgagttcagcagcagattcaagaacctggcccaccagcaccagagcatgttccccaccctggagatcgacatcgagggccagctgaagagactgaagggcttcgccgagagaatcagacccatggtgagagacggcgtgtacttcatgtacgaggccctgcacggcccccccaagaagatcctggtggagggcgccaacgccgccctgctggacatcgacttcggcacctaccccttcgtgaccagcagcaactgcaccgtgggcggcgtgtgcaccggcctgggcatccccccccagaacatcggcgacgtgtacggcgtggtgaaggcctacaccaccagagtgggcatcggcgccttccccaccgagcagatcaacgagatcggcggcctgctgcagaccagaggccacgagtggggcgtgaccaccggcagaaagagaagatgcggctggctggacctgatgatcctgagatacgcccacatggtgaacggcttcaccgccctggccctgaccaagctggacatcctggacgtgctgggcgaggtgaaggtgggcgtgagctacaagctgaacggcaagagaatcccctacttccccgccaaccaggagatgctgcagaaggtggaggtggagtacgagaccctgcccggctggaaggccgacaccaccggcgccagaagatgggaggacctgcccccccaggcccagaactacatcagattcgtggagaaccacgtgggcgtggccgtgaagtgggtgggcgtgggcaagagcagagagagcatgatccagctgttctag

SEQ ID NO: 10083 - DNA, 468 bp, Artificial Sequence
  Description of Artificial Sequence: Synthetic coding sequence
atggtgaacagctgctgcggcagcgtgtgcagcgaccagggctgcggccaggacctgtgccaggagacctgctgctgccccagctgctgccagaccacctgctgcagaaccacctgctacagacccagctacagcgtgagctgctgctgcagaccccagtgctgccagagcgtgtgctgccagcccacctgctgcagacccagctgctgcgtgcccacctgctgccaccccagctgctgcatcagcagctgctgcagacccagctgctgcgtgagcagctgctgcaagccccagtgctgccagagcgtgtgctgccagcccaactgctgcagacccagctgctgcagaccctgctgctgcctgagacccgtgtgcggcagagtgagctgccacaccacctgctacagacccgcctgcgtgatcagcacctgccccagacccgtgtgctgcgccagcagctgctgctag

SEQ ID NO: 10084 - DNA, 2124 bp, Artificial Sequence
  Description of Artificial Sequence: Synthetic coding sequence
atggccgccgaggccctggccgccgaggccgtggccagcagactggagagacaggaggaggacatcagatggctgtggagcgaggtggagagactgagagacgagcagctgaacgccccctacagctgccaggccgagggcccctgcctgaccagagaggtggcccagctgagagccgagaactgcgacctgagacacagactgtgcagcctgagactgtgcctggccgaggagagaagcagacaggccaccctggagagcgccgagctggaggccgcccaggaggccggcgcccagcccccccccagccagagccaggacaaggacatgaagaagaagaagatgaaggagagcgaggccgacagcgaggtgaagcaccagcccatcttcatcaaggagagactgaagctgttcgagatcctgaagaaggaccaccagctgctgctggccatctacggcaagaagggcgacaccagcaacatcatcaccgtgagagtggccgacggccagaccgtgcagggcgaggtgtggaagaccaccccctaccaggtggccgccgagatcagccaggagctggccgagagcaccgtgatcgccaaggtgaacggcgagctgtgggacctggacagacccctggagggcgacagcagcctggagctgctgaccttcgacaacgagaaggtgaacaccgccaccaccaccgtgtacagatgcggccccctgatcgacctgtgcaagggcccccacgtgagacacaccggcaagatcaagaccatcaagatcttcaagaacagcagcacctactgggagggcaaccccgagatggagaccctgcagagaatctacggcatcagcttccccgacaacaagatgatgagagactgggagaagttccaggaggaggccaagaacagagaccacagaaagatcggcaaggagcaggagctgttcttcttccacgacctgagccccggcagctgcttcttcctgcccagaggcgccttcatctacaacaccctgaccgacttcatcagagaggagtaccacaagagagacttcaccgaggtgctgagccccaacatgtacaacagcaagctgtgggaggccagcggccactggcagcactacagcgagaacatgttcaccttcgagatcgagaaggacaccttcgccctgaagcccatgaactgccccggccactgcctgatgttcgcccacagacccagaagctggagagagatgcccatcagattcgccgacttcggcgtgctgcacagaaacgagctgagcggcaccctgagcggcctgaccagagtgagaagattccagcaggacgacgcccacatcttctgcaccgtggagcagatcgaggaggagatcaagggctgcctgcagttcctgcagagcgtgtacagcaccttcggcttcagcttccagctgaacctgagcaccagacccgagaacttcctgggcgagatcgagatgtggaacgaggccgagaagcagctgcagaacagcctgatggacttcggcgagccctggaagatgaaccccggcgacggcgccttctacggccccaagatcgacatcaagatcaaggacgccatcggcagataccaccagtgcgccaccatccagctggacttccagctgcccatcagattcaacctgacctacgtgagcaaggacggcgacgacaagaagagacccgtgatcatccacagagccatcctgggcagcgtggagagaatgatcgccatcctgagcgagaactacggcggcaagtggcccttctggctgagccccagacaggtgatggtgatccccgtgggccccacctgcgagaagtacgccctgcaggtgagcagcgagttcttcgaggagggcttcatggccgacgtggacctggaccacagctgcaccctgaacaagaagatcagaaacgcccagctggcccagtacaacttcatcctggtggtgggcgagaaggagaagatcgacaacgccgtgaacgtgagaaccagagacaacaagatccacggcgagatcctggtgaccagcgccatcgacaagctgaagaacctgagaaagaccagaaccctgaacgccgaggaggccttctag

SEQ ID NO: 10085 - DNA, 816 bp, Artificial Sequence
  Description of Artificial Sequence: Synthetic coding sequence
atggccggcctggaggtgctgttcgccagcgccgcccccgccatcacctgcagacaggacgccctggtgtgcttcctgcactgggaggtggtgacccacggctacttcggcctgggcgtgggcgaccagcccggccccaacgacaagaagagcgagctgctgcccgccggctggaacaacaacaaggacctgtacgtgctgagatacgagtacaaggacggcagcagaaagctgctggtgaaggccatcaccgtggagagcagcatgatcctgaacgtgctggagtacggcagccagcaggtggccgacctgaccctgaacctggacgactacatcgacgccgagcacctgggcgacttccacagaacctacaagaacagcgaggagctgagaagcagaatcgtgagcggcatcatcacccccatccacgagcagtgggagaaggccaacgtgagcagcccccacagagagttcccccccgccaccgccagagaggtggaccccctgagaatccccccccaccacccccacaccagcagacagcccccctggtgcgaccccctgggccccttcgtggtgggcggcgaggacctggaccccttcggccccagaagaggcggcatgatcgtggaccccctgagaagcggcttccccagagccctgatcgaccccagcagcggcctgcccaacagactgccccccggcgccgtgccccccggcgccagattcgaccccttcggccccatcggcaccagcccccccggccccaaccccgaccacctgcccccccccggctacgacgacatgtacctgtag

SEQ ID NO: 10086 - DNA, 474 bp, Artificial Sequence
  Description of Artificial Sequence: Synthetic coding sequence
atggccaccccccccaagagaagagccgtggaggccaccggcgagaaggtgctgagatacgagaccttcatcagcgacgtgctgcagagagacctgagaaaggtgctggaccacagagacaaggtgtacgagcagctggccaagtacctgcagctgagaaacgtgatcgagagactgcaggaggccaagcacagcgagctgtacatgcaggtggacctgggctgcaacttcttcgtggacaccgtggtgcccgacaccagcagaatctacgtggccctgggctacggcttcttcctggagctgaccctggccgaggccctgaagttcatcgacagaaagagcagcctgctgaccgagctgagcaacagcctgaccaaggacagcatgaacatcaaggcccacatccacatgctgctggagggcctgagagagctgcagggcctgcagaacttccccgagaagccccaccactag

SEQ ID NO: 10087 - DNA, 543 bp, Artificial Sequence
  Description of Artificial Sequence: Synthetic coding sequence
atgcaggccgagggcagaggcaccggcggcagcaccggcgacgccgacggccccggcggccccggcatccccgacggccccggcggcaacgccggcggccccggcgaggccggcgccaccggcggcagaggccccagaggcgccggcgccgccagagccagcggccccggcggcggcgcccccagaggcccccacggcggcgccgccagcggcctgaacggctgctgcagatgcggcgccagaggccccgagagcagactgctggagttctacctggccatgcccttcgccacccccatggaggccgagctggccagaagaagcctggcccaggacgccccccccctgcccgtgcccggcgtgctgctgaaggagttcaccgtgagcggcaacatcctgaccatcagactgaccgccgccgaccacagacagctgcagctgagcatcagcagctgcctgcagcagctgagcctgctgatgtggatcacccagtgcttcctgcccgtgttcctggcccagccccccagcggccagagaagatag

SEQ ID NO: 10088 - DNA, 621 bp, Artificial Sequence
  Description of Artificial Sequence: Synthetic coding sequence
atgaccgccagcgtgctgagaagcatcagcctggccctgagacccaccagcggcctgctgggcacctggcagacccagctgagagagacccaccagagagccagcctgctgagcttctgggagctgatccccatgagaagcgagcccctgagaaagaagaagaaggtggaccccaagaaggaccaggaggccaaggagagactgaagagaaagatcagaaagctggagaaggccacccaggagctgatccccatcgaggacttcatcacccccctgaagttcctggacaaggccagagagagaccccaggtggagctgaccttcgaggagaccgagagaagagccctgctgctgaagaagtggagcctgtacaagcagcaggagagaaagatggagagagacaccatcagagccatgctggaggcccagcaggaggccctggaggagctgcagctggagagccccaagctgcacgccgaggccatcaagagagaccccaacctgttccccttcgagaaggagggcccccactacaccccccccatccccaactaccagccccccgagggcagatacaacgacatcaccaaggtgtacacccaggtggagttcaagagatag

SEQ ID NO: 10089 - DNA, 6963 bp, Artificial Sequence
  Description of Artificial Sequence: Synthetic coding sequence
atggccgagcccagcagcgccagaagacccgtgcccctgatcgagagcgagctgtacttcctgatcgccagatacctgagcgccggcccctgcagaagagccgcccaggtgctggtgcaggagctggagcagtaccagctgctgcccaagagactggactgggagggcaacgagcacaacagaagctacgaggagctggtgctgagcaacaagcacgtggcccccgaccacctgctgcagatctgccagagaatcggccccatgctggacaaggagatcccccccagcatcagcagagtgaccagcctgctgggcgccggcagacagagcctgctgagaaccgccaaggactgcagacacaccgtgtggaagggcagcgccttcgccgccctgcacagaggcagaccccccgagatgcccgtgaactacggcagcccccccaacctggtggagatccacagaggcaagcagctgaccggctgcagcaccttcagcaccgccttccccggcaccatgtaccagcacatcaagatgcacagaagaatcctgggccacctgagcgccgtgtactgcgtggccttcgacagaaccggccacagaatcttcaccggcagcgacgactgcctggtgaagatctggagcacccacaacggcagactgctgagcaccctgagaggccacagcgccgagatcagcgacatggccgtgaactacgagaacaccatgatcgccgccggcagctgcgacaagatcatcagagtgtggtgcctgagaacctgcgcccccgtggccgtgctgcagggccacaccggcagcatcaccagcctgcagttcagccccatggccaagggcagccagagatacatggtgagcaccggcgccgacggcaccgtgtgcttctggcagtgggacctggagagcctgaagttcagccccagacccctgaagttcaccgagaagcccagacccggcgtgcagatgctgtgcagcagcttcagcgtgggcggcatgttcctggccaccggcagcaccgaccacgtgatcagaatgtacttcctgggcttcgaggcccccgagaagatcgccgagctggagagccacaccgacaaggtggacagcatccagttctgcaacaacggcgacagattcctgagcggcagcagagacggcaccgccagaatctggagattcgagcagctggagtggagaagcatcctgctggacatggccaccagaatcagcggcgacctgagcagcgaggaggagagattcatgaagcccaaggtgaccatgatcgcctggaaccagaacgacagcatcgtggtgaccgccgtgaacgaccacgtgctgaaggtgtggaacagctacaccggccagctgctgcacaacctgatgggccacgccgacgaggtgttcgtgctggagacccaccccttcgacagcagaatcatgctgagcgccggccacgacggcagcatcttcatctgggacatcaccaagggcaccaagatgaagcactacttcaacatgatcgagggccagggccacggcgccgtgttcgactgcaagttcagccaggacggccagcacttcgcctgcaccgacagccacggccacctgctgatcttcggcttcggctgcagcaagccctacgagaagatccccgaccagatgttcttccacaccgactacagacccctgatcagagacagcaacaactacgtgctggacgagcagacccagcaggccccccacctgatgcccccccccttcctggtggacgtggacggcaacccccaccccaccaagtaccagagactggtgcccggcagagagaacagcgccgacgagcacctgatcccccagctgggctacgtggccaccagcgacggcgaggtgatcgagcagatcatcagcctgcagaccaacgacaacgacgagagaagccccgagagcagcatcctggacggcatgatcagacagctgcagcagcagcaggaccagagaatgggcgccgaccaggacaccatccccagaggcctgagcaacggcgaggagacccccagaagaggcttcagaagactgagcctggacatccagagcccccccaacatcggcctgagaagaagcggccaggtggagggcgtgagacagatgcaccagaacgcccccagaagccagatcgccaccgagagagacctgcaggcctggaagagaagagtggtggtgcccgaggtgcccctgggcatcttcagaaagctggaggacttcagactggagaagggcgaggaggagagaaacctgtacatcatcggcagaaagagaaagaccctgcagctgagccacaagagcgacagcgtggtgctggtgagccagagcagacagagaacctgcagaagaaagtaccccaactacggcagaagaaacagaagctggagagagctgagcagcggcaacgagagcagcagcagcgtgagacacgagaccagctgcgaccagagcgagggcagcggcagcagcgaggaggacgagtggagaagcgacagaaagagcgagagctacagcgagagcagcagcgacagcagcagcagatacagcgactggaccgccgacgccggcatcaacctgcagccccccctgagaaccagctgcagaagaagaatcaccagattctgcagcagcagcgaggacgagatcagcaccgagaacctgagcccccccaagagaagaagaaagagaaagaaggagaacaagcccaagaaggagaacctgagaagaatgacccccgccgagctggccaacatggagcacctgtacgagttccacccccccgtgtggatcaccgacaccaccctgagaaagagccccttcgtgccccagatgggcgacgaggtgatctacttcagacagggccacgaggcctacatcgaggccgtgagaagaaacaacatctacgagctgaaccccaacaaggagccctggagaaagatggacctgagagaccaggagctggtgaagatcgtgggcatcagatacgaggtgggcccccccaccctgtgctgcctgaagctggccttcatcgaccccgccaccggcaagctgatggacaagagcttcagcatcagataccacgacatgcccgacgtgatcgacttcctggtgctgagacagttctacgacgaggccagacagagaaactggcagagctgcgacagattcagaagcatcatcgacgacgcctggtggttcggcaccgtgctgagccaggagccctaccagccccagtaccccgacagccacttccagtgctacatcgtgagatgggacaacaccgagatcgagaagctgagcccctgggacatggagcccatccccgacaacgtggacccccccgaggagctgggcgccagcatcagcgtgaccaccgacgagctggagaagctgctgtacaagccccaggccggcgagtggggccagaagagcagagacgaggagtgcgacagaatcatcagcggcatcgaccagctgctgaacctggacatcgccgccgccttcgccggccccgtggacctgtgcacctaccccaagtactgcaccgtggtggcctaccccaccgacctgtacaccatcagaatgagactggtgaacagattctacagaagactgagcgccctggtgtgggaggtgagatacatcgagcacaacgccagaaccttcaacgagcccgagagcgtgatcgccagaagcgccaagaagatcaccgaccagctgctgaagttcatcaagaaccagcactgcaccaacatcagcgagctgagcaacaccagcgagaacgacgagcagaacgccgaggacctggacgacagcgacctgcccaagaccagcagcggcagaagaagagtgcacgacggcaagaagagcatcagagccaccaactacgtggagagcaactggaagaagcagtgcaaggagctggtgaacctgatcttccagtgcgaggacagcgagcccttcagacagcccgtggacctggtggagtaccccgactacagagacatcatcgacacccccatggacttcggcaccgtgagagagaccctggacgccggcaactacgacagccccctggagttctgcaaggacatcagactgatcttcagcaacgccaaggcctacacccccaacaagagaagcaagatctacagcatgaccctgagactgagcgccctgttcgaggagaagatgaagaagatcagcagcgacttcaagatcggccagaagttcaacgagaagctgagaagaagccagagattcaagcagagacagaactgcaagggcgacagccagcccaacaagagcatcagaaacctgaagcccaagagactgaagagccagaccaagatcatccccgagctggtgggcagccccacccagagcaccagcagcagaaccgcctacctgggcacccacaagaccagcgccggcatcagcagcggcgtgaccagcggcgacagcagcgacagcgccgagagcagcgagagaagaaagagaaacagacccatcaccaacggcagcaccctgagcgagagcgaggtggaggacagcctggccaccagcctgagcagcagcgccagcagcagcagcgaggagagcaaggagagcagcagagccagagagagcagcagcagaagcggcctgagcagaagcagcaacctgagagtgaccagaaccagagccgcccagagaaagaccggccccgtgagcctggccaacggctgcggcagaaaggccaccagaaagagagtgtacctgagcgacagcgacaacaacagcctggagaccggcgagatcctgaaggccagagccggcaacaacagaaaggtgctgagaaagtgcgccgccgtggccgccaacaagatcaagctgatgagcgacgtggaggagaacagcagcagcgagagcgtgtgcagcggcagaaagctgccccacagaaacgccagcgccgtggccagaaagaagctgctgcacaacagcgaggacgagcagagcctgaagagcgagatcgaggaggaggagctgaaggacgagaaccagctgctgcccgtgagcagcagccacaccgcccagagcaacgtggacgagagcgagaacagagacagcgagagcgagagcgacctgagagtggccagaaagaactggcacgccaacggctacaagagccacacccccgcccccagcaagaccaagttcctgaagatcgagagcagcgaggaggacagcaagagccacgacagcgaccacgcctgcaacagaaccgccggccccagcaccagcgtgcagaagctgaaggccgagagcatcagcgaggaggccgacagcgagcccggcagaagcggcggcagaaagtacaacaccttccacaagaacgccagcttcttcaagaagaccaagatcctgagcgacagcgaggacagcgagagcgaggagcaggacagagaggacggcaagtgccacaagatggagatgaaccccatcagcggcaacctgaactgcgaccccatcgccatgagccagtgcagcagcgaccacggctgcgagaccgacctggacagcgacgacgacaagatcgagaagcccaacaacttcatgaaggacagcgccagccaggacaacggcctgagcagaaagatcagcagaaagagagtgtgcagcagcgacagcgacagcagcctgcaggtggtgaagaagagcagcaaggccagaaccggcctgctgagaatcaccagaagatgcgccgccaccgccgccaacaagatcaagctgatgagcgacgtggaggacgtgagcctggagaacgtgcacaccagaagcaagaacggcagaaagaagcccctgcacctggcctgcaccaccgccaagaagaagctgagcgactgcgagggcagcgtgcactgcgaggtgcccagcgagcagtacgcctgcgagggcaagccccccgaccccgacagcgagggcagcaccaaggtgctgagccaggccctgaacggcgacagcgacagcgaggacatgctgaacagcgagcacaagcacagacacaccaacatccacaagatcgacgcccccagcaagagaaagagcagcagcgtgaccagcagcggcgaggacagcaagagccacatccccggcagcgagaccgacagaaccttcagcagcgagagcaccctggcccagaaggccaccgccgagaacaacttcgaggtggagctgaactacggcctgagaagatggaacggcagaagactgagaacctacggcaaggcccccttcagcaagaccaaggtgatccacgacagccaggagaccgccgagaaggaggtgaagagaaagagaagccaccccgagctggagaacgtgaagatcagcgagaccaccggcaacagcaagttcagacccgacaccagcagcaagagcagcgacctgggcagcgtgaccgagagcgacatcgactgcaccgacaacaccaagaccaagagaagaaagaccaagggcaaggccaaggtggtgagaaaggagttcgtgcccagagacagagagcccaacaccaaggtgagaacctgcatgcacaaccagaaggacgccgtgcagatgcccagcgagaccctgaaggccaagatggtgcccgagaaggtgcccagaagatgcgccaccgtggccgccaacaagatcaagatcatgagcaacctgaaggagaccatcagcggccccgagaacgtgtggatcagaaagagcagcagaaagctgccccacagaaacgccagcgccgccgccaagaagaagctgctgaacgtgtacaaggaggacgacaccaccatcaacagcgagagcgagaaggagctggaggacatcaacagaaagatgctgttcctgagaggcttcagaagctggaaggagaacgcccagtag

SEQ ID NO: 10090 - DNA, 2961 bp, Artificial Sequence
  Description of Artificial Sequence: Synthetic coding sequence
atggccgagagcttcttcagcgacttcggcctgctgtggtacctgaaggagctgagaaaggaggagttctggaagttcaaggagctgctgaagcagcccctggagaagttcgagctgaagcccatcccctgggccgagctgaagaaggccagcaaggaggacgtggccaagctgctggacaagcactaccccggcaagcaggcctgggaggtgaccctgaacctgttcctgcagatcaacagaaaggacctgtggaccaaggcccaggaggagatgagaaacaagctgaacccctacagaaagcacatgaaggagaccttccagctgatctgggagaaggagacctgcctgcacgtgcccgagcacttctacaaggagaccatgaagaacgagtacaaggagctgaacgacgcctacaccgccgccgccagaagacacaccgtggtgctggagggccccgacggcatcggcaagaccaccctgctgagaaaggtgatgctggactgggccgagggcaacctgtggaaggacagattcaccttcgtgttcttcctgaacgtgtgcgagatgaacggcatcgccgagaccagcctgctggagctgctgagcagagactggcccgagagcagcgagaagatcgaggacatcttcagccagcccgagagaatcctgttcatcatggacggcttcgagcagctgaagttcaacctgcagctgaaggccgacctgagcgacgactggagacagagacagcccatgcccatcatcctgagcagcctgctgcagaagaagatgctgcccgagagcagcctgctgatcgccctgggcaagctggccatgcagaagcactacttcatgctgagacaccccaagctgatcaagctgctgggcttcagcgagagcgagaagaagagctacttcagctacttcttcggcgagaagagcaaggccctgaaggtgttcaacttcgtgagagacaacggccccctgttcatcctgtgccacaaccccttcacctgctggctggtgtgcacctgcgtgaagcagagactggagagaggcgaggacctggagatcaacagccagaacaccacctacctgtacgccagcttcctgaccaccgtgttcaaggccggcagccagagcttcccccccaaggtgaacagagccagactgaagagcctgtgcgccctggccgccgagggcatctggacctacaccttcgtgttcagccacggcgacctgagaagaaacggcctgagcgagagcgagggcgtgatgtgggtgggcatgagactgctgcagagaagaggcgactgcttcgccttcatgcacctgtgcatccaggagttctgcgccgccatgttctacctgctgaagagacccaaggacgaccccaaccccgccatcggcagcatcacccagctggtgagagccagcgtggtgcagccccagaccctgctgacccaggtgggcatcttcatgttcggcatcagcaccgaggagatcgtgagcatgctggagaccagcttcggcttccccctgagcaaggacctgaagcaggagatcacccagtgcctggagagcctgagccagtgcgaggccgacagagaggccatcgccttccaggagctgttcatcggcctgttcgagacccaggagaaggagttcgtgaccaaggtgatgaacttcttcgaggaggtgttcatctacatcggcaacatcgagcacctggtgatcgccagcttctgcctgaagcactgccagcacctgaccaccctgagaatgtgcgtggagaacatcttccccgacgacagcggctgcatcagcgactacaacgagaagctggtgtactggagagagctgtgcagcatgttcatcaccaacaagaacttccagatcctggacatggagaacaccagcctggacgaccccagcctggccatcctgtgcaaggccctggcccagcccgtgtgcaagctgagaaagctgatcttcaccagcgtgtacttcggccacgacagcgagctgttcaaggccgtgctgcacaacccccacctgaagctgctgagcctgtacggcaccagcctgagccagagcgacatcagacacctgtgcgagaccctgaagcaccccatgtgcaagatcgaggagctgatcctgggcaagtgcgacatcagcagcgaggtgtgcgaggacatcgccagcgtgctggcctgcaacagcaagctgaagcacctgagcctggtggagaaccccctgagagacgagggcatgaccctgctgtgcgaggccctgaagcacagccactgcgccctggagagactgatgctgatgtactgctgcctgaccagcgtgagctgcgacagcatcagcgaggtgctgctgtgcagcaagagcctgagcctgctggacctgggcagcaacgccctggaggacaacggcgtggccagcctgtgcgccgccctgaagcaccccggctgcagcatcagagagctgtggctgatgggctgcttcctgaccagcgacagctgcaaggacatcgccgccgtgctgatctgcaacggcaagctgaagaccctgaagctgggccacaacgagatcggcgacaccggcgtgagacagctgtgcgccgccctgcagcacccccactgcaagctggagtgcctgggcctgcagacctgccccatcaccagagcctgctgcgacgacatcgccgccgccctgatcgcctgcaagaccctgagaagcctgaacctggactggatcgccctggacgccgacgccgtggtggtgctgtgcgaggccctgagccaccccgactgcgccctgcagatgctgggcaactgccagaagagcctgggcgacaccgtggcccccggcgagaaccactgcagcatcaagcacctgctgctgaccctgcccatcaacatgcagagacagctgagactgcagaagtag

SEQ ID NO: 10091 - DNA, 3039 bp, Artificial Sequence
  Description of Artificial Sequence: Synthetic coding sequence
atggacgccctggacgccagcaagctgctggacgaggagctgtacagcagacagctgtacgtgctgggcagccccgccatgcagagaatccagggcgccagagtgctggtgagcggcctgcagggcctgggcgccgaggtggccaagaacctggtgctgatgggcgtgggcagcctgaccctgcacgacccccaccccacctgctggagcgacctggccgcccagttcctgctgagcgagcaggacctggagagaagcagagccgaggccagccaggagctgctggcccagctgaacagagccgtgcaggtggtggtgcacaccggcgacatcaccgaggacctgctgctggacttccaggtggtggtgctgaccgccgccaagctggaggagcagctgaaggtgggcaccctgtgccacaagcacggcgtgtgcttcctggccgccgacaccagaggcctggtgggccagctgttctgcgacttcggcgaggacttcaccgtgcaggaccccaccgaggccgagcccctgaccgccgccatccagcacatcagccagggcagccccggcatcctgaccctgagaaagggcgccaacacccactacttcagagacggcgacctggtgaccttcagcggcatcgagggcatggtggagctgaacgactgcgaccccagaagcatccacgtgagagaggacggcagcctggagatcggcgacaccaccaccttcagcagatacctgagaggcggcgccatcaccgaggtgaagagacccaagaccgtgagacacaagagcctggacaccgccctgctgcagccccacgtggtggcccagagcagccaggaggtgcaccacgcccactgcctgcaccaggccttctgcgccctgcacaagttccagcacctgcacggcagacccccccagccctgggaccccgtggacgccgagaccgtggtgggcctggccagagacctggagcccctgaagagaaccgaggaggagcccctggaggagcccctggacgaggccctggtgagaaccgtggccctgagcagcgccggcgtgctgagccccatggtggccatgctgggcgccgtggccgcccaggaggtgctgaaggccatcagcagaaagttcatgcccctggaccagtggctgtacttcgacgccctggactgcctgcccgaggacggcgagctgctgcccagccccgaggactgcgccctgagaggcagcagatacgacggccagatcgccgtgttcggcgccggcttccaggagaagctgagaagacagcactacctgctggtgggcgccggcgccatcggctgcgagctgctgaaggtgttcgccctggtgggcctgggcgccggcaacagcggcggcctgaccgtggtggacatggaccacatcgagagaagcaacctgagcagacagttcctgttcagaagccaggacgtgggcagacccaaggccgaggtggccgccgccgccgccagaggcctgaaccccgacctgcaggtgatccccctgacctaccccctggaccccaccaccgagcacatctacggcgacaacttcttcagcagagtggacggcgtggccgccgccctggacagcttccaggccagaagatacgtggccgccagatgcacccactacctgaagcccctgctggaggccggcaccagcggcacctggggcagcgccaccgtgttcatgccccacgtgaccgaggcctacagagcccccgccagcgccgccgccagcgaggacgccccctaccccgtgtgcaccgtgagatacttccccagcaccgccgagcacaccctgcagtgggccagacacgagttcgaggagctgttcagactgagcgccgagaccatcaaccaccaccagcaggcccacaccagcctggccgacatggacgagccccagaccctgaccctgctgaagcccgtgctgggcgtgctgagagtgagaccccagaactggcaggactgcgtggcctgggccctgggccactggaagctgtgcttccactacggcatcaagcagctgctgagacacttcccccccaacaaggtgctggaggacggcacccccttctggagcggccccaagcagtgcccccagcccctggagttcgacaccaaccaggacacccacctgctgtacgtgctggccgccgccaacctgtacgcccagatgcacggcctgcccggcagccaggactggaccgccctgagagagctgctgaagctgctgccccagcccgacccccagcagatggcccccatcttcgccagcaacctggagctggccagcgccagcgccgagttcggccccgagcagcagaaggagctgaacaaggccctggaggtgtggagcgtgggcccccccctgaagcccctgatgttcgagaaggacgacgacagcaacttccacgtggacttcgtggtggccgccgccagcctgagatgccagaactacggcatcccccccgtgaacagagcccagagcaagagaatcgtgggccagatcatccccgccatcgccaccaccaccgccgccgtggccggcctgctgggcctggagctgtacaaggtggtgagcggccccagacccagaagcgccttcagacacagctacctgcacctggccgagaactacctgatcagatacatgcccttcgcccccgccatccagaccttccaccacctgaagtggaccagctgggacagactgaaggtgcccgccggccagcccgagagaaccctggagagcctgctggcccacctgcaggagcagcacggcctgagagtgagaatcctgctgcacggcagcgccctgctgtacgccgccggctggagccccgagaagcaggcccagcacctgcccctgagagtgaccgagctggtgcagcagctgaccggccaggcccccgcccccggccagagagtgctggtgctggagctgagctgcgagggcgacgacgaggacaccgccttcccccccctgcactacgagctgtag

SEQ ID NO: 10092 - DNA, 360 bp, Artificial Sequence
  Description of Artificial Sequence: Synthetic coding sequence
atggtgagaaccaagacctggaccctgaagaagcacttcgtgggctaccccaccaacagcgacttcgagctgaagaccgccgagctgccccccctgaagaacggcgaggtgctgctggaggccctgttcctgaccgtggacccctacatgagagtggtggagagcaagaacgtggccctgcccaagggcaccatcgtgctggccagccccggctggaccacccacagcatcagcgacggcaaggacctggagaagctgctgaccgagtggcccgacaccatccccctgagcctggccctgggcaccgtgggcatgcccggcctgaccgcctacttcggcctgctggagatctgcggctag

SEQ ID NO: 10093 - DNA, 1797 bp, Artificial Sequence
  Description of Artificial Sequence: Synthetic coding sequence
atgggcggctgcttcagcaagcccaagcccgtggagctgaagatcgaggtggtgctgcccgagaaggagagaggcaaggaggagctgagcgccagcggcaagggcagccccagagcctaccagggcaacggcaccgccagacacttccacaccgaggagagactgagcaccccccacccctaccccagcccccaggactgcgtggaggccgccgtgtgccacgtgaaggacctggagaacggccagatgagagaggtggagctgggctggggcaaggtgctgctggtgaaggacaacggcgagttccacgccctgggccacaagtgcccccactacggcgcccccctggtgaagggcgtgctgagcagaggcagagtgagatgcccctggcacggcgcctgcttcaacatcagcaccggcgacctggaggacttccccggcctggacagcctgcacaagttccaggtgaagatcgagaaggagaaggtgtacgtgagagccagcaagcaggccctgcagctgcagagaagaaccaaggtgatggccaagtgcatcagccccagcgccggctacagcagcagcaccaacgtgctgatcgtgggcgccggcgccgccggcctggtgtgcgccgagaccctgagacaggagggcttcagcgacagaatcgtgctgtgcaccctggacagacacctgccctacgacagacccaagctgagcaagagcctggacacccagcccgagcagctggccctgagacccaaggagttcttcagagcctacggcatcgaggtgctgaccgaggcccaggtggtgaccgtggacgtgagaaccaagaaggtggtgttcaaggacggcttcaagctggagtacagcaagctgctgctggcccccggcagcagccccaagaccctgagctgcaagggcaaggaggtggagaacgtgttcaccatcagaacccccgaggacgccaacagagtggtgagactggccagaggcagaaacgtggtggtggtgggcgccggcttcctgggcatggaggtggccgcctacctgaccgagaaggcccacagcgtgagcgtggtggagctggaggagacccccttcagaagattcctgggcgagagagtgggcagagccctgatgaagatgttcgagaacaacagagtgaagttctacatgcagaccgaggtgagcgagctgagaggccaggagggcaagctgaaggaggtggtgctgaagagcagcaaggtggtgagagccgacgtgtgcgtggtgggcatcggcgccgtgcccgccaccggcttcctgagacagagcggcatcggcctggacagcagaggcttcatccccgtgaacaagatgatgcagaccaacgtgcccggcgtgttcgccgccggcgacgccgtgaccttccccctggcctggagaaacaacagaaaggtgaacatcccccactggcagatggcccacgcccagggcagagtggccgcccagaacatgctggcccaggaggccgagatgagcaccgtgccctacctgtggaccgccatgttcggcaagagcctgagatacgccggctacggcgagggcttcgacgacgtgatcatccagggcgacctggaggagctgaagttcgtggccttctacaccaagggcgacgaggtgatcgccgtggccagcatgaactacgaccccatcgtgagcaaggtggccgaggtgctggccagcggcagagccatcagaaagagagaggtggagaccggcgacatgagctggctgaccggcaagggcagctag

SEQ ID NO: 10094 - DNA, 1854 bp, Artificial Sequence
  Description of Artificial Sequence: Synthetic coding sequence
atgggcagctacctgagcgtgcccgcctacttcaccagcagagacctgttcagatgcagcgagtgccaggacagcctgaccaactggtactacgagaaggacggcaagctgtactgccccaaggactactggggcaagttcggcgagttctgccacggctgcagcctgctgatgaccggccccttcatggtggccggcgagttcaagtaccaccccgagtgcttcgcctgcatgagctgcaaggtgatcatcgaggacggcgacgcctacgccctggtgcagcacgccaccctgtactgcggcaagtgccacaacgaggtggtgctggcccccatgttcgagagactgagcaccgagagcgtgcaggagcagctgccctacagcgtgaccctgatcagcatgcccgccaccaccgagggcagaagaggcttcagcgtgagcgtggagagcgcctgcagcaactacgccaccaccgtgcaggtgaaggaggtgaacagaatgcacatcagccccaacaacagaaacgccatccaccccggcgacagaatcctggagatcaacggcacccccgtgagaaccctgagagtggaggaggtggaggacgccatcagccagaccagccagaccctgcagctgctgatcgagcacgaccccgtgagccagagactggaccagctgagactggaggccagactggccccccacatgcagaacgccggccacccccacgccctgagcaccctggacaccaaggagaacctggagggcaccctgagaagaagaagcctgagaagaagcaacagcatcagcaagagccccggccccagcagccccaaggagcccctgctgttcagcagagacatcagcagaagcgagagcctgagatgcagcagcagctacagccagcagatcttcagaccctgcgacctgatccacggcgaggtgctgggcaagggcttcttcggccaggccatcaaggtgacccacaaggccaccggcaaggtgatggtgatgaaggagctgatcagatgcgacgaggagacccagaagaccttcctgaccgaggtgaaggtgatgagaagcctggaccaccccaacgtgctgaagttcatcggcgtgctgtacaaggacaagaagctgaacctgctgaccgagtacatcgagggcggcaccctgaaggacttcctgagaagcatggaccccttcccctggcagcagaaggtgagattcgccaagggcatcgccagcggcatggcctacctgcacagcatgtgcatcatccacagagacctgaacagccacaactgcctgatcaagctggacaagaccgtggtggtggccgacttcggcctgagcagactgatcgtggaggagagaaagagagcccccatggagaaggccaccaccaagaagagaaccctgagaaagaacgacagaaagaagagatacaccgtggtgggcaacccctactggatggcccccgagatgctgaacggcaagagctacgacgagaccgtggacatcttcagcttcggcatcgtgctgtgcgagatcatcggccaggtgtacgccgaccccgactgcctgcccagaaccctggacttcggcctgaacgtgaagctgttctgggagaagttcgtgcccaccgactgcccccccgccttcttccccctggccgccatctgctgcagactggagcccgagagcagacccgccttcagcaagctggaggacagcttcgaggccctgagcctgtacctgggcgagctgggcatccccctgcccgccgagctggaggagctggaccacaccgtgagcatgcagtacggcctgaccagagacagccccccctag

SEQ ID NO: 10095 - DNA, 1338 bp, Artificial Sequence
  Description of Artificial Sequence: Synthetic coding sequence
atgagagagatcgtgcacatccaggccggccagtgcggcaaccagatcggcgccaagttctgggaggtgatcagcgacgagcacggcatcgaccccaccggcagctaccacggcgacagcgacctgcagctggagagaatcaacgtgtactacaacgaggccgccggcaacaagtacgtgcccagagccatcctggtggacctggagcccggcaccatggacagcgtgagaagcggccccttcggccagatcttcagacccgacaacttcgtgttcggccagagcggcgccggcaacaactgggccaagggccactacaccgagggcgccgagctggtggacagcgtgctggacgtggtgagaaaggagagcgagagctgcgactgcctgcagggcttccagctgacccacagcctgggcggcggcaccggcagcggcatgggcaccctgctgatcagcaagatcagagaggagtaccccgacagaatcatgaacaccttcagcgtgatgcccagccccaaggtgagcgacaccgtggtggagccctacaacgccaccctgagcgtgcaccagctggtggagaacaccgacgagacctacagcatcgacaacgaggccctgtacgacatctgcttcagaaccctgaagctgaccacccccacctacggcgacctgaaccacctggtgagcgccaccatgagcggcgtgaccacctgcctgagattccccggccagctgaacgccgacctgagaaagctggccgtgaacatggtgcccttccccagactgcacttcttcatgcccggcttcgcccccctgaccagcagaggcagccagcagtacagagccctgaccgtgcccgagctgacccagcagatgttcgacagcaagaacatgatggccgcctgcgaccccagacacggcagatacctgaccgtggccgccatcttcagaggcagaatgagcatgaaggaggtggacgagcagatgctgaacgtgcagaacaagaacagcagctacttcgtggagtggatccccaacaacgtgaagaccgccgtgtgcgacatcccccccagaggcctgaagatgagcgccaccttcatcggcaacagcaccgccatccaggagctgttcaagagaatcagcgagcagttcaccgccatgttcagaagaaaggccttcctgcactggtacaccggcgagggcatggacgagatggagttcaccgaggccgagagcaacatgaacgacctggtgagcgagtaccagcagtaccaggacgccaccgccgacgagcagggcgagttcgaggaggaggagggcgaggacgaggcctag

SEQ ID NO: 10096 - DNA, 2028 bp, Artificial Sequence
  Description of Artificial Sequence: Synthetic coding sequence
atggccaagcacggcgccgacgagcccagcagcagaagcggcagccccgacagagagggcagagccagcgaggacagaagcctgctgcaccagagactggccgtgagagagctgatcgacaccgaggtgagctacctgcacatgctgcagctgtgcgccagcgacatcagaagcagactgcagcagctgccccagggcgacctggacgtgctgttcagcaacatcgacgacatcatcaaggtgaacagcagattcctgcacgacctgcaggagaccgccagcaaggaggaggagcaggtgcagctggtgggcaacatcttcctggagttccaggaggagctggagcaggtgtacaaggtgtactgcgccagctacgaccaggccctgctgctggtggacacctacagaaaggagcccgagctgcagagacacatccagggcatcgtggaggccgtggtgccccaggccggcagcagcggcctgagcttcctgctggtgatccccctgcagagaatcaccagataccccctgctgctgcagaagatcctggagaacaccgtgcccgacgccagcgcctaccccgtgctgcagagagccgtgagcgccctgcaggacgtgaacaccaacatcaacgagtacaagatgagaaaggaggtggccagcaagtacaccaaggtggagcagctgaccctgagagagagactggccagaatcaacacccacaccctgagcaagaagaccaccagactgagccagctgctgaagcaggaggccggcctgatccccagaaccgaggacaaggagttcgacgacctggaggagagattccagtgggtgagcctgtgcgtgaccgagctgaagaacaacgtggccgcctacctggacaacctgcaggccttcctgtacttcagaccccacgagtacaacctggacatccccgagggccccgccgtgcagtactgcaacctggccagagacctgcacctggaggccttcctgaagttcaagcagagactggagggcctggtgtggcagcccctgtgcagcctggccaaggccctgctgggcccccagaacctgatcaagaagagactggacaagctgctggacttcgagagagtggaggagaagctgctggaggtgggcagcgtgacctaccaggaggaggccgccagacacacctaccaggccctgaacagcctgctggtggccgagctgccccagttcaaccagctggtgatgcagtggctgggccagatcatgtgcaccttcgtgaccctgcagagagacctggccaagcaggtgctgcagagagccgagggcagcatggcccagctgccccaccaccacgtgcccgagcccgccttcagaaagctggtggaggacgccctgggcagaaccagcaaccagctgagaagcttccaggagaccttcgagaaggtgcagcccccccccaccacccagcccctgctgcccggcagcgagagacaggtgcaggccctgctgagcagatacggccccggcaagctgtaccaggtgaccagcaacatcagcggcaccggcaccctggacctgaccctgcccagaggccagatcgtggccatcctgcagaacaaggacaccaagggcaacagcggcagatggctggtggacaccggcggccacagaggctacgtgcccgccggcaagctgcagctgtaccacgtggtgcccagcgccgaggagctgagaagacaggccggcctgaacaaggaccccagatgcctgacccccgagcccagccccgccctggtgcccagcatccccaccatgaaccaggtgatcgccgcctaccccttcgtggccagaagcagccacgaggtgagcctgcaggccggccagcccgtgaccatcctggaggcccaggacaagaagggcaaccccgagtggagcctggtggaggtgaacggccagagaggctacgtgcccagcggcttcctggccagagccagaagccccgtgctgtggggctggagcctgcccagctag

SEQ ID NO: 10097 - DNA, 3399 bp, Artificial Sequence
  Description of Artificial Sequence: Synthetic coding sequence
atggccagcgacggcgccagcgccctgcccggccccgacatgagcatgaagcccagcgccgcccccagccccagccccgccctgcccttcctgccccccaccagcgacccccccgaccacccccccagagagccccccccccagcccatcatgcccagcgtgttcagccccgacaaccccctgatgctgagcgccttccccagcagcctgctggtgaccggcgacggcggcccctgcctgagcggcgccggcgccggcaaggtgatcgtgaaggtgaagaccgagggcggcagcgccgagcccagccagacccagaacttcatcctgacccagaccgccctgaacagcaccgcccccggcaccccctgcggcggcctggagggccccgccccccccttcgtgaccgccagcaacgtgaagaccatcctgcccagcaaggccgtgggcgtgagccaggagggcccccccggcctgcccccccagccccccccccccgtggcccagctggtgcccatcgtgcccctggagaaggcctggcccggcccccacggcaccaccggcgagggcggccccgtggccaccctgagcaagcccagcctgggcgacagaagcaagatcagcaaggacgtgtacgagaacttcagacagtggcagagatacaaggccctggccagaagacacctgagccagagccccgacaccgaggccctgagctgcttcctgatccccgtgctgagaagcctggccagactgaagcccaccatgaccctggaggagggcctgcccctggccgtgcaggagtgggagcacaccagcaacttcgacagaatgatcttctacgagatggccgagagattcatggagttcgaggccgaggagatgcagatccagaacacccagctgatgaacggcagccagggcctgagccccgccacccccctgaagctggaccccctgggccccctggccagcgaggtgtgccagcagcccgtgtacatccccaagaaggccgccagcaagaccagagcccccagaagaagacagagaaaggcccagagaccccccgcccccgaggcccccaaggagatcccccccgaggccgtgaaggagtacgtggacatcatggagtggctggtgggcacccacctggccaccggcgagagcgacggcaagcaggaggaggagggccagcagcaggaggaggagggcatgtaccccgaccccggcctgctgagctacatcaacgagctgtgcagccagaaggtgttcgtgagcaaggtggaggccgtgatccacccccagttcctggccgacctgctgagccccgagaagcagagagaccccctggccctgatcgaggagctggagcaggaggagggcctgaccctggcccagctggtgcagaagagactgatggccctggaggaggaggaggacgccgaggccccccccagcttcagcggcgcccagctggacagcagccccagcggcagcgtggaggacgaggacggcgacggcagactgagacccagccccggcctgcagggcgccggcggcgccgcctgcctgggcaaggtgagcagcagcggcaagagagccagagaggtgcacggcggccaggagcaggccctggacagccccagaggcatgcacagagacggcaacaccctgcccagccccagcagctgggacctgcagcccgagctggccgccccccagggcacccccggccccctgggcgtggagagaagaggcagcggcaaggtgatcaaccaggtgagcctgcaccaggacggccacctgggcggcgccggcccccccggccactgcctggtggccgacagaaccagcgaggccctgcccctgtgctggcagggcggcttccagcccgagagcacccccagcctggacgccggcctggccgagctggcccccctgcagggccagggcctggagaagcaggtgctgggcctgcagaagggccagcagaccggcggcagaggcgtgctgccccagggcaaggagcccctggccgtgccctgggagggcagcagcggcgccatgtggggcgacgacagaggcacccccatggcccagagctacgaccagaaccccagccccagagccgccggcgagagagacgacgtgtgcctgagccccggcgtgtggctgagcagcgagatggacgccgtgggcctggagctgcccgtgcagatcgaggaggtgatcgagagcttccaggtggagaagtgcgtgaccgagtaccaggagggctgccagggcctgggcagcagaggcaacatcagcctgggccccggcgagaccctggtgcccggcgacaccgagagcagcgtgatcccctgcggcggcaccgtggccgccgccgccctggagaagagaaactactgcagcctgcccggccccctgagagccaacagcccccccctgagaagcaaggagaaccaggagcagagctgcgagaccgtgggccaccccagcgacctgtgggccgagggctgcttccccctgctggagagcggcgacagcaccctgggcagcagcaaggagaccctgccccccacctgccagggcaacctgctgatcatgggcaccgaggacgccagcagcctgcccgaggccagccaggaggccggcagcagaggcaacagcttcagccccctgctggagaccatcgagcccgtgaacatcctggacgtgaaggacgactgcggcctgcagctgagagtgagcgaggacacctgccccctgaacgtgcacagctacgacccccagggcgagggcagagtggaccccgacctgagcaagcccaagaacctggcccccctgcaggagagccaggagagctacaccaccggcacccccaaggccaccagcagccaccagggcctgggcagcaccctgcccagaagaggcaccagaaacgccatcgtgcccagagagaccagcgtgagcaagacccacagaagcgccgacagagccaagggcaaggagaagaagaagaaggaggccgaggaggaggacgaggagctgagcaacttcgcctacctgctggccagcaagctgagcctgagccccagagagcaccccctgagcccccaccacgccagcggcggccagggcagccagagagccagccacctgctgcccgccggcgccaagggccccagcaagctgccctaccccgtggccaagagcggcaagagagccctggccggcggccccgcccccaccgagaagaccccccacagcggcgcccagctgggcgtgcccagagagaagcccctggccctgggcgtggtgagacccagccagcccagaaagagaagatgcgacagcttcgtgaccggcagaagaaagaagagaagaagaagccagtag

SEQ ID NO: 10098 - DNA, 522 bp, Artificial Sequence
  Description of Artificial Sequence: Synthetic coding sequence
atggccgtggccgtgggcgtgagagccgcccccgtgctgggcctggccagagccctggtgctgggcctgagaggcagccaggccgccagatggagaggctggggcaccgccgcccccggcagcctgtgggccctgtgcgagtgccccgccggctgcagagagctgtggttcagaggcagagccgcctgggccgccagaagcgagagactgctgcaccccgcccaggacagcgacggcgagagagaggacagcgccgccgagagagccagacagcagctggaggccctgctgaacaagaccatgagaatcagaatgaccgacggcagaaccctggtgggctgcttcctgtgcaccgacagagactgcaacgtgatcctgggcagcgcccaggagttcctgaagcccagcgacagcttcagcgccggcgagcccagagtgctgggcctggccatggtgcccggccaccacatcgtgagcatcgaggtgcagagagagagcctgaccggccccccctacctgtag

SEQ ID NO: 10099 - DNA, 558 bp, Artificial Sequence
  Description of Artificial Sequence: Synthetic coding sequence
atggtgaacagctgctgcggcagcgtgtgcagcgaccagggctgcggccaggacctgtgccaggagacctgctgctgccccagctgctgccagaccacctgctgcagaaccacctgctacagacccagctacagcgtgagctgctgctgcagaccccagtgctgccagagcgtgtgctgccagcccacctgctgcagacccagctgctgcgtgagcagctgctgcaagccccagtgctgccagagcgtgtgctgccagcccacctgctgccaccccagctgctgcatcagcagctgctgcagacccagctgctgcgtgagcagctgctgcaagccccagtgctgccagagcgtgtgctgccagcccaactgctgcagacccagctgcagcatcagcagctgctgcagacccagctgctgcgagagcagctgctgcagaccctgctgctgcctgagacccgtgtgcggcagagtgagctgccacaccacctgctacagacccgcctgcgtgatcagcacctgccccagacccgtgtgctgcgccagcagctgctgctag

SEQ ID NO: 10100 - DNA, 252 bp, Artificial Sequence
  Description of Artificial Sequence: Synthetic coding sequence
atgtgctgcaactactacagaaactgctgcggcggctgcggctacggcagcggctggagcagcggctgcggctacggctgcggctacggctgcggctacggcagcggctgcagatacggcagcggctacggcaccggctgcggctacggctgcggctacggcagcggctgcggctacggctgcggctacagcagcagctgctgcggctacagacccctgtgctacagaagatgctacagcagctgctactag

SEQ ID NO: 10101 - DNA, 993 bp, Artificial Sequence
  Description of Artificial Sequence: Synthetic coding sequence
atgggcagcagaaagaaggagatcgccctgcaggtgaacatcagcacccaggagctgtgggaggagatgctgagcagcaagggcctgaccgtggtggacgtgtaccagggctggtgcggcccctgcaagcccgtggtgagcctgttccagaagatgagaatcgaggtgggcctggacctgctgcacttcgccctggccgaggccgacagactggacgtgctggagaagtacagaggcaagtgcgagcccaccttcctgttctacgccggcggcgagctggtggccgtggtgagaggcgccaacgcccccctgctgcagaagaccatcctggaccagctggaggccgagaagaaggtgctggccgagggcagagagagaaaggtgatcaaggacgaggccctgagcgacgaggacgagtgcgtgagccacggcaagaacaacggcgaggacgaggacatggtgagcagcgagagaacctgcaccctggccatcatcaagcccgacgccgtggcccacggcaagaccgacgagatcatcatgaagatccaggaggccggcttcgagatcctgaccaacgaggagagaaccatgaccgaggccgaggtgagactgttctaccagcacaaggccggcgaggaggccttcgagaagctggtgcaccacatgtgcagcggccccagccacctgctgatcctgaccagaaccgagggcttcgaggacgtggtgaccacctggagaaccgtgatgggccccagagaccccaacgtggccagaagagagcagcccgagagcctgagagcccagtacggcaccgagatgcccttcaacgccgtgcacggcagcagagacagagaggacgccgacagagagctggccctgctgttccccagcctgaagttcagcgacaaggacaccgaggccccccagggcggcgaggccgaggccaccgccggccccaccgaggccctgtgcttccccgaggacgtggactag

SEQ ID NO: 10102 - DNA, 606 bp, Artificial Sequence
  Description of Artificial Sequence: Synthetic coding sequence
atggtgagcagctgctgcggcagcgtgtgcagcgaccagggctgcggccaggacctgtgccaggagacctgctgcagacccagctgctgcgagaccacctgctgcagaaccacctgctgcagacccagctgctgcgtgagcagctgctgcagaccccagtgctgccagagcgtgtgctgccagcccacctgcagcagacccagctgctgccagaccacctgctgcagaaccacctgctacagacccagctgctgcgtgagcagctgctgcagaccccagtgctgccagcccgcctgctgccagcccacctgctgcagaccccccagatgctgcatcagcagctgctgcagacccagctgctgcgtgagcagctgctgcaagccccagtgctgccagagcgtgtgctgccagcccaactgctgcagacccagctgcagcatcagcagctgctgcagacccagctgctgcgagagcagctgctgcagaccctgctgctgcgtgagacccgtgtgcggcagagtgagctgccacaccacctgctacagacccacctgcgtgatcagcagctgccccagacccctgtgctgcgccagcagctgctgctag

SEQ ID NO: 10103 - DNA, 792 bp, Artificial Sequence
  Description of Artificial Sequence: Synthetic coding sequence
atgggcgacatccccgccgtgggcctgagcagctggaaggccagccccggcaaggtgaccgaggccgtgaaggaggccatcgacgccggctacagacacttcgactgcgcctacttctaccacaacgagagagaggtgggcgccggcatcagatgcaagatcaaggagggcgccgtgagaagagaggacctgttcatcgccaccaagctgtggtgcacctgccacaagaagagcctggtggagaccgcctgcagaaagagcctgaaggccctgaagctgaactacctggacctgtacctgatccactggcccatgggcttcaagcccccccaccccgagtggatcatgagctgcagcgagctgagcttctgcctgagccaccccagagtgcaggacctgcccctggacgagagcaacatggtgatccccagcgacaccgacttcctggacacctgggaggccatggaggacctggtgatcaccggcctggtgaagaacatcggcgtgagcaacttcaaccacgagcagctggagagactgctgaacaagcccggcctgagattcaagcccctgaccaaccagatcctgatcagattccagatccagagaaacgtgatcgtgatccccggcagcatcacccccagccacatcaaggagaacatccaggtgttcgacttcgagctgacccagcacgacatggacaacatcctgagcctgaacagaaacctgagactggccatgttccccatcaccaagaaccacaaggactaccccttccacatcgagtactag

SEQ ID NO: 10104 - DNA, 177 bp, Artificial Sequence
  Description of Artificial Sequence: Synthetic coding sequence
atgagatactacggcagctactacagaggcctgggctacggctgcggcggcttcggcggcctgggctacggctgcggctgcggcggctacagatacggcagcggctacggcggctacagatacggctgctgcagacccagctgcagagagggctacggcttcagcggcttctactag

SEQ ID NO: 10105 - DNA, 159 bp, Artificial Sequence
  Description of Artificial Sequence: Synthetic coding sequence
atgtgctacggctacggctgcggctgcggcagcttctgcagactgggctacggctgcggctacgagggctgcagatacggctgcggccacagaggctgcggcgacggctgctgctgccccagctgctacagaagatacagattcaccggcttctactag

SEQ ID NO: 10106 - DNA, 255 bp, Artificial Sequence
  Description of Artificial Sequence: Synthetic coding sequence
atgagctactacggcagctactacagaggcctgggctacggctgcggcggcttcggcggcctgggctacggctacggctgcggctgcggcagcttcagaagactgggctacggctgcggcttcggcggcaacggctacggctactgcagacccagctgctacggcggctacggcttcagcatcctgctgaagagctaccccgaggacaccatcagcgaggtgatcagaagaagcttcaacctgaccaagtactag

SEQ ID NO: 10107 - DNA, 246 bp, Artificial Sequence
  Description of Artificial Sequence: Synthetic coding sequence
atgagctactacggcagctactacggcggcctgggctacggctgcggcggcttcggcggcctgggctacggctacggctgcggctgcggcagcttcagaagactgggcagcggctgcggctacggcggctacggctacggcagcggcttcggcggctacggctacggcagcggcttcggcggctacggctacggctgctacagacccagctactacggcggctacggcttcagcggcttctactag

SEQ ID NO: 10108 - DNA, 414 bp, Artificial Sequence
  Description of Artificial Sequence: Synthetic coding sequence
atgagctacaactgcagcagcggcaacttcagcagctgctgcttcggcagctacctgagataccccgtgagcacctacaacctgttctaccccagcaacgccatctacagccccaacacctgccagctgggcagcagcctgtacaacggctgccaggagacctactgcgagcccaccagctgccagaccagctgcaccctggccagaagctaccagaccagctgctactgccccaagaacagcatcttctgcagccccagacagaccaactacatcagaagcctgggctgcggcaacaccggcctgggcagcctgggctgcggcagcaccggcttccagagcctggactgcggcagcagcttctaccaccccaccaccttcagcagcagaaacttccaggccacctgctactag

SEQ ID NO: 10109 - DNA, 483 bp, Artificial Sequence
  Description of Artificial Sequence: Synthetic coding sequence
atgagctacaactgctgcagcagaaacttcagcagcagaagcttcggcggctacctgtactaccccggcagctaccccagcagcctggtgtacagcaccgccctgtgcagccccagcacctgccagctgagaagcagcctgtacagagactgccagaagacctgctgggagcccgccagctgccagaagagctgctacagacccagaaccagcatcctgtgctgcccctgccagaccacctgcagcggcagcctgggcttcagaagcagcagctgcagaagccagggctacggcagcagatgctgctacagcctgggcaacggcagcagcggcttcagattcctgaagtacggcggctgcggcttccccagcctgagctacggcagcagattctgctaccccaactacctggccagcggcgcctggcagagcagctgctacagacccatctgcggcagcagattctaccagttcacctgctag

SEQ ID NO: 10110 - DNA, 684 bp, Artificial Sequence
  Description of Artificial Sequence: Synthetic coding sequence
atgctgaaccccgacggcgtgtacctgggcaactacagatgcagcctgatgggcttcgacctgaacagacactggctggaccccagcccctgggtgcaccccaccctgcacggcgtgaagcagctgatcgtgcagatgtacaacgaccccaagaccagcctggagttctacatcgacatccacgcccacagcaccatgatgaacggcttcatgtacggcaacatcttcgaggacgaggagagattccagagacaggccatcttccccaagctgctgtgccagaacgccgaggacttcagctacagcagcaccagcttcaacagagacgccgtgaaggccggcaccggcagaagattcctgggcggcctgctggaccacaccagctactgctacaccctggaggtgagcttctacagctacatcatcagcggcaccaccgccgccgtgccctacaccgaggaggcctacatgaagctgggcagaaacgtggccagaaccttcctggactactacagactgaaccccgtggtggagaaggtggccatccccatgcccagactgagaaaggagaagagccccccctacaagcaccccctgctgagaggccccgccagcaactaccccaacagcaagggcgacaagaagagcagcgtgaaccacaaggaccccagcacccccttctag

SEQ ID NO: 10111 - DNA, 465 bp, Artificial Sequence
  Description of Artificial Sequence: Synthetic coding sequence
atgacccactgctgcagcccctgctgccagcccacctgctgcagaaccacctgctgcagaaccacctgctggaagcccaccaccgtgaccacctgcagcagcaccccctgctgccagcccagctgctgcgtgagcagctgctgccagccctgctgcagacccacctgctgccagaacacctgctgccagcccacctgcgtgaccagctgctgccagcccagctgctgcagcaccccctgctgccagcccacctgctgcggcagcagctgcgaccagagcagcagctgcgcccccgtgtactgcagaagaacctgctactaccccaccaccgtgtgcctgcccggctgcctgaaccagagctgcggcagcaactgctgccagccctgctgcagacccgcctgctgcgagaccacctgcttccagcccacctgcgtgagcagctgctgccagcccttctgctgctag

SEQ ID NO: 10112 - DNA, 7062 bp, Artificial Sequence
  Description of Artificial Sequence: Synthetic coding sequence
atgaagcagagaaagggccagggcagcggcggcagcagaggcagaaagaagagaggcctgagcgacatcagccccagcaccagcctgccccccctggtggagggccagctgagatgcttcctgaagctgaccgtgaacagagtgatctggaagatcgccaagccccccacctgcgtgctggtgagagtgagatggtggggcgagaccagcgacggcaccctgttctgccccagagacgccctgcagaccgagcccaaggccgtgagaaccaccaccagatacgccatcagatgcggccccaagcagttcaccagctacctgaccgacatggccgtgctggtgctggaggtgatcaccaagctggacggcctgcccatcggcagagtgcagatcaacggcctggcccagctgagccccacccaccagatcaacggcttcttcaccatcgtgagcagcaccagcaagaagctgggcgagctgcaggtgagcctggccctggagcccctgagcgagacctacgacagctaccaccccctgcccaccaccgacatgaccgagaacgtgctgctgagcaagcagggcttcagagagaacaccgagcccagcagcacccagttccaggtgcccagcagacccagagacatccacaccatcaagatcgacggcaaggagctggccgccaacagcagcagaagcaccacccccagaggcaaggaccacgtgtgcttcgccgagaaccccgacaccatcaaggacagcagcttcggcctgcagcacagcctgaacagcggccagagcctggagagcgtgaccctgaagggcagagcccccagaaagcagatgagcctgctgaacagcagcgagttccagccccagatcagaaccgtggccaagagccacagcgacagctgcatcctgagcagcaacaacctgcccaccaaggacctgctgagcgccctgctggagcagggcaacaagctgagaaacgccatggtgatcagcgccatgaagagcagccccgagaccagcatgctgctggaccaggtgcacccccccatcaacgaggacagcctgagagccagcacccagatcagagccttcagcagaaacagattcaaggaccacatcgaggaccacctgctgcccagcaccgagaacaccttctggagacacgacaccaaggccgacaccagagccatccagctgctgctgggcagcgccgagctgagccagggcaacttctgggacggcctgggcagcccccccgacagccccagccccggcagcgacgtgtactgcatcagcgagctgaacgacccccagtacgaccagagcctgctggagaacctgttctacaccgcccccaagagcgacaccagcatcagcgacttcctgagcgaggaggacgacatcgtgcccagcaagaagatcagccagagcaccgccctggccagaagcagcaaggtgctggagagcagcgaccacaagctgaagaagagaagcgccggcaagagaaacagaaacctggtggagcagcagatgctgagcgagacccccgaggacgcccagaccatgaccctgagcgtggacagactggccctgctgggcagaacccacagcgtgagaatcatcatcgagaccatgggcgtgccccccgacagcccccagatgacccccggcaagaagagctacgccggccccccccccaaggtgaccaccgccaagaagagaaccttcttcgtggagtaccacttccccgtgggcttcagcgagagcggcctgggcaagaccgccctgatcaccgaggtggtgagactggccagcagcaagatcaccgacggcaaggtgaagttccagcagagattcgtgttccccgtgcagttcggcggccccatgatcgagcactggtggaacagcaacctgaccttccagatctacgtgaagaagaccccccagaagaagcccgaggtgatcggcagcgtgagcctgagcctgagagccgtgatccagagcgagctgctgagcttcagcgaccagctgcccgtgcagcaggagaacggccagagccccttcggccccctgaaggtgaccatggagctgatcaccgacaacaaggacttcaccggcatcaacaccaagctgagcggcaacacccactacacccccctgtgcgcccccaccagccccaacaaggccctgcccgagctgaaccaggacatgacctgcaccaagaacccccagaacctgaaccagatccacgaggagaccgccaagaaggcccagaacctggtgctgcccaacagaaagagccccagccccgtggccccccaccccagcaccttcgtggccacccccgccagccacaacctggtgaaccagaccaacggcaccaccaaggagagcgccctgctgctgcacgtgctgctgatggtgcccgacggcaaggacttcatcagcggcgagagcgagaagcagagcccctgcaacgtgtacctgaactgcaagctgttcagcaccgaggaggtgaccagaagcgtgatcgcctggggcaccacccagcccgtgttcaacttcagccaggtgatccccgtgagcctgagcagcaagtacctggagagactgaagaacaacgtgatggtgatcgagacctggaacaaggtgagaagccccggccaggacaagctgctgggcctggtgaagctgcccctgcaccagttctacatgagcttcaaggacgccaagatcagcagactgctgctggacgcccagtaccccgtggtggccgtggacagctacatgcccgtgatcgacgtgttcagcggccaccagaacggcagcctgagagtgttcctggccatgggcagcagcaaccagatcatggccctgcagagactgaagaacgaggagggcaccctgccccccttcagccccagacccgcccacttcctggaccagcccaccgccgccagcgtggccatggccgaggacagaggcaacggcctgatggagcactgcttcgagatccacatcgagatggtgaagggcctggcccccctgcaggccaccgtgtggggcgaggccgactgctacgtgcagtactacttccccgtgcagcacagccagagcagcgtgctgaagggccccgagttcctggagaacggcatcaccctgaagcccttcagaaccgccaccaccctgtgcgtgcccgaccccatcttcaacagcgagcaccaccacagcctgctgctgcccgccgaggtgcccgtgcagagactgctgctgagcgccttcagcgcccagggcctggtgcccggcggcggcgtgcagttcgagatctggtgcagatactactaccccaacgtgagagaccagaaggtggccaagggcaccctgcccctgagcagaatctgcgccatggtgaccacccagcacagagaggacgtgggcatccagaccttcaacctgcccctgacccccagaatcgagaacagaaaggagctgagaaaccagagcagcggcctgctggacgtgggcctgagatacagaagaagccccagaaccgccgagggcgtgctggccgccagaaccgtgagcatcagcgtgcagatcatcagagcctgcggcctgcaggccgccgccaaggccctggccgagagagagcccgccctgcagttcagcgccaccgtgggcgtgaacgccagcgtgaccacccacctgagcttcctgccccagggcgagcagagaagaacccaccccgtggcctgcagcttctgccccgagttcagccaccacgtggagttcacctgcaacctggtgacccagcactgcagcggcgaggcctgcttcctggccgagctgctggagttcgccgaggtgatcttcgccgtgtaccacgagaacaccaagagcgccagcgacatcatcagcatcgagagctgcaaggagtacctgctgggcgtggtgaaggtgcccaccaaggagctgctgatcaagagaagcggcatcaccggctggtaccccatcatcctgcccgaggacggcggcctgccccacggcctggagctgatgcagaagatcgtgggcggcctggagctgagcatcagcttcacccacagaggcgacagagagagagtgctggaggccgccgagcacctgggctggagcttcgagaacagcctgaaggacttcgtgagaatggacgagggcgagcccgccaccgtgaccatcagcacccccagactgtggctgcccatccactgcgtgctgctggccggccacaaccacatccacaagaacacctactgctacctgagatacaagttctacgaccacgaggccttctggacccccctgaagaagcccaaggagagcgtgaacaagaagcagatcatggtgaccttcaaggccagcaagagagccgaggtgaccagaggccccagcctgctgtggtacttcagagaggagagactggagatccaggtgtggagagcctacggcaacgacagcgtggagagaccccaccagaccgacagctggatcggcagcgcctacgtggacctggccagactgggcgagagaagcgccagaaccctgaccgtgagcggcgtgtaccccctgttcggcagaaacgccagcaacctgagcggcgccgccctgagagtgcacgtggtgctgagcagcctgagcagccacctggagcccacccacgagctggacagcatggactgcagcagccacagcgagagcgagcagctgcccagaagaaacgacgaggtgcagctgagcccccccgaggtgatcagctgccaccagaagagccccgccagcacccaggtgccctgcagcagcaccaccgccgaggtgagactgacccaggagggccccgccgacctggacggcaccttcgccgtgagcatcctggtggagagagccatgcacctgagcctgaagggcagccccctgaccgagagaaaggtgagcatccccagctgctgcgtgagcttcgccaccgccgacgagagcagccccgtgtacacccaggtggtggagaacaccgacagccccatctggaacttccagcagcagagcagactgagcaaggagctgctgctggacccccagcagaccctggtgttcaaggtgtggcacaagggcgacgaggagagagtgatcggcttcgccagcgtggacctgagccccctgctgagcggcttccagttcgtgtgcggctggtacaacatcaccgacttcagcggcgagtgccagggccagatcaaggtggccgtgagccccctggagagcctgatccacttcaaggaggagagacaggccagaagaggcgtggagaccagcaagagcctgatccccatctacagccccttcagcttccccgccagcgacacctacgccgccttcagcagccacatggccagacagaccctggaccagctggcccacgccagcagcaaggagctggacttcagcagccccggcagaagcgacaccaccagaagccaggccagcagacacgaggagcacgtgcagaacatcagaagattccacgagagcctgcacctgcagggcgaggcccccctgccctgcgacgacaagctgaccaccagccccctgagcagccagaccagcatcctgaccagcctgagaaagaacctgagcgagctggaccagatccagagatacttcagacagaagctgaccaagcccttcctgcccctgagcccccagacccagaccgccatcagccagcaccaggagagctgcagagaccacctgggccccggcgccagcagcctggaccccggcagccagtgcatcctggagaagagcagcaacctggtgctgcaggtgagcagcctgatcaccgacctgcagaccatcaccagagacagccaggccgccctgagcagccacagagccagaagcagaagcaacaaggccaccaccctgcccgacgcccaggacaccgaggccctgcaggagagatgcaccatgcccgacgagcccctggtgagagcccccgacaagggcaccgacagccccagccccccccccctggaggagaccagcaacggcggcagaatgctgcacgagagcctgagacacgccgtgcccatcaccagaatgcagagcagcgaggacaccgaggccggccccgcctacagcgacgaggactacgaggaggacatcatcgagcccagaaccctgaacgagatcaccaccgtgaccgacaagaccagcccctggagcagcgtgatcagcgacaccagcgaggtgatcagcccccagcccgacgaggtgcagagagagggccccagctgccccagccccggccccttctgcagagaggagctgatggtgaagagcagcttcctgagcagccccgagagagccgtgaacccccacctgcccagacagggcagccccagccagagcctggtggcctgcgagtgcgaggccagcaaggccagagtgggcggcgagagcgccagcgccaacccccagcccatcccctgccccaccctgagcggcgcccagcagagcagcaccttcgtgggctggagcagcccccagaccgaccagaacaaggagcccaagagcgaggcccccgccgagaacgaggccgccaccagcgagctgggcgacagcgccgacagcttcaagaagctgcccctgaacctggccagccagagcagaagagagaaccacaagggcccccccatcgacagcagcgacatcagacagagacaggtgaccaccggcagcgagaccagcaccaagcagagcctgctgctgcccggccccatcgtggtgcccaacttcttcctgcccccccagcagctggaggccagcctgagaatgctgagcctgagcgccaccctgccccccgccgccaccaccgaccaggacaagagcgaggccaccagaggcgccctgagccagagaccctgcagacccagacccaacagcctgcccctgaacctgcccgaggaggagaccctgagaatcgccagaatcttcagcagccagtacagccagaaggactag

SEQ ID NO: 10113 - DNA, 219 bp, Artificial Sequence
  Description of Artificial Sequence: Synthetic coding sequence
atgaactactacggcaactactacggcggcctgggctacggctacggcggcttcgacgacctgggctacggctacggctgcggctgcggcagcttcagaagactgggctacggcggcggctacggcggctacggctacggcagcggcttcggcggctacggctacagaagctgcagacccagctgctacggcggctacggcttcagcggcttctactag

SEQ ID NO: 10114 - DNA, 198 bp, Artificial Sequence
  Description of Artificial Sequence: Synthetic coding sequence
atgagctacaactgctgctgcggcaacttcagcagccacagctgcgagggctacctgtgctacagcggctacagcagaggcggcagcagctaccccagcaacctggtgtacagcaccgagcccctgatcagccagcacctgcccgccggcttcctgagcctgcagggcctgagcggcgacctgctgggcaacccctag

SEQ ID NO: 10115 - DNA, 384 bp, Artificial Sequence
  Description of Artificial Sequence: Synthetic coding sequence
atggtgaacagctgctgcggcagcgtgtgcagcgaccagggctgcgaccagggcctgtgccaggagacctgctgcagacccagctgctgccagaccacctgctgctgccccagctgcgtggtgagcagctgctgcagacccagctgcagccagaccacctgctgccagaccacctgctgcagacccagctgctgccaccccgtgtgctgccagaccacctgcagacccagctgcggcgtgagcagctgctgcagacccctgtgctgccagaccacctgcagacccagctgcggcgtgagcagctgctgcagacccctgtgctgccagaccacctgctgcagagccacctgctgcagacccagctgctgcggcagcagctgctag

SEQ ID NO: 10116 - DNA, 318 bp, Artificial Sequence
  Description of Artificial Sequence: Synthetic coding sequence
atgggctgctgccccggcgactgcttcacctgctgcacccaggagcagaactgctgcgaggagtgctgctgccagcccggctgctgcggctgctgcggcagctgctgcggctgcggcggcagcggctgcggcggcagcggctgcggcggcagctgctgcggcagcagctgctgcggcagcggctgcggcggctgcggcggctgcggcggctgcggcggcggctgctgcggcagcagctgctgcggcagcagctgctgcggcagcggctgctgcggccccgtgtgctgccagcccacccccatctgcgacaccaagtag

SEQ ID NO: 10117 - DNA, 3915 bp, Artificial Sequence
  Description of Artificial Sequence: Synthetic coding sequence
atggaggagatccccgtgaaggtggccgtgagaatcagacccctgctgtgcaaggaggccctgcacaaccaccaggtgtgcgtgagagtgatccccaacagccagcaggtgatcatcggcagagacagagtgttcaccttcgacttcgtgttcggcaagaacagcacccaggacgaggtgtacaacacctgcatcaagcccctggtgctgagcctgatcgagggctacaacgccaccgtgttcgcctacggccagaccggcagcggcaagacctacaccatcggcggcggccacatcgccagcgtggtggagggccagaagggcatcatccccagagccatccaggagatcttccagagcatcagcgagcaccccagcatcgacttcaacgtgaaggtgagctacatcgaggtgtacaaggaggacctgagagacctgctggagctggagaccagcatgaaggacctgcacatcagagaggacgagaagggcaacaccgtgatcgtgggcgccaaggagtgccacgtggagagcgccggcgaggtgatgagcctgctggagatgggcaacgccgccagacacaccggcaccacccagatgaacgagcacagcagcagaagccacgccatcttcaccatcagcatctgccaggtgcacaagaacatggaggccgccgaggacggcagctggtacagccccagacacatcgtgagcaagttccacttcgtggacctggccggcagcgagagagtgaccaagaccggcaacaccggcgagagattcaaggagagcatccagatcaacagcggcctgctggccctgggcaacgtgatcagcgccctgggcgaccccagaagaaagagcagccacatcccctacagagacgccaagatcaccagactgctgaaggacagcctgggcggcagcgccaagaccgtgatgatcacctgcgtgagccccagcagcagcaacttcgacgagagcctgaacagcctgaagtacgccaacagagccagaaacatcagaaacaagcccaccgtgaacttcagccccgagagcgacagaatcgacgagatggagttcgagatcaagctgctgagagaggccctgcagagccagcaggccggcgtgagccagaccacccagatcaacagagagggcagccccgacaccaacagaatccacagcctggaggagcaggtggcccagctgcagggcgagtgcctgggctaccagtgctgcgtggaggaggccttcaccttcctggtggacctgaaggacaccgtgagactgaacgagaagcagcagcacaagctgcaggagtggttcaacatgatccaggaggtgagaaaggccgtgctgaccagcttcagaggcatcggcggcaccgccagcctggaggagggcccccagcacgtgaccgtgctgcagctgaagagagagctgaagaagtgccagtgcgtgctggccgccgacgaggtggtgttcaaccagaaggagctggaggtgaaggagctgaagaaccaggtgcagatgatggtgcaggagaacaagggccacgccgtgagcctgaaggaggcccagaaggtgaacagactgcagaacgagaagatcatcgagcagcagctgctggtggaccagctgagcgaggagctgaccaagctgaacctgagcgtgaccagcagcgccaaggagaactgcggcgacggccccgacgccagaatccccgagagaagaccctacaccgtgcccttcgacacccacctgggccactacatctacatccccagcagacaggacagcagaaaggtgcacaccagcccccccatgtacagcctggacagaatcttcgccggcttcagaaccagaagccagatgctgctgggccacatcgaggagcaggacaaggtgctgcactgccagttcagcgacaacagcgacgacgaggagagcgagggccaggagaagagcggcaccagatgcagaagcagaagctggatccagaagcccgacagcgtgtgcagcctggtggagctgagcgacacccaggacgagacccagaagagcgacctggagaacgaggacctgaagatcgactgcctgcaggagagccaggagctgaacctgcagaagctgaagaacagcgagagaatcctgaccgaggccaagcagaagatgagagagctgaccatcaacatcaagatgaaggaggacctgatcaaggagctgatcaagaccggcaacgacgccaagagcgtgagcaagcagtacagcctgaaggtgaccaagctggagcacgacgccgagcaggccaaggtggagctgatcgagacccagaagcagctgcaggagctggagaacaaggacctgagcgacgtggccatgaaggtgaagctgcagaaggagttcagaaagaagatggacgccgccaagctgagagtgcaggtgctgcagaagaagcagcaggacagcaagaagctggccagcctgagcatccagaacgagaagagagccaacgagctggagcagagcgtggaccacatgaagtaccagaagatccagctgcagagaaagctgagagaggagaacgagaagagaaagcagctggacgccgtgatcaagagagaccagcagaagatcaaggccctgaacaccgacagcctgaagatcagcaccagactgaacctgctggagcaggagctgagcgagaagaacgtgcagctgcagaccagcaccgccgaggagaagaccaagatcagcgagcaggtggaggtgctgcagaaggagaaggaccagctgcagaagagaagacacaacgtggacgagaagctgaagaacggcagagtgctgagccccgaggaggagcacgtgctgttccagctggaggagggcatcgaggccctggaggccgccatcgagtacagaaacgagagcatccagaacagacagaagagcctgagagccagcttccacaacctgagcagaggcgaggccaacgtgctggagaagctggcctgcctgagccccgtggagatcagaaccatcctgttcagatacttcaacaaggtggtgaacctgagagaggccgagagaaagcagcagctgtacaacgaggagatgaagatgaaggtgctggagagagacaacatggtgagagagctggagagcgccctggaccacctgaagctgcagtgcgacagaagactgaccctgcagcagaaggagcacgagcagaagatgcagctgctgctgcaccacttcaaggagcaggacggcgagggcatcatggagaccttcaagacctacgaggacaagatccagcagctggagaaggacctgtacttctacaagaagaccagcagagaccacaagaagaagctgaaggagctggtgggcgaggccatcagaagacagctggcccccagcgagtaccaggaggccggcgacggcgtgctgaagcccgagggcggcggcatgctgagcgaggagctgaagtgggccagcagacccgagagcatgaagctgagcggcagagagagagagatggacagcagcgccagcagcctgagaacccagcccaacccccagaagctgtgggaggacatccccgagctgccccccatccacagcagcctggccccccccagcggccacatgctgggcaacgagaacaagaccgagaccgacgacaaccagttcaccaagagccacagcagactgagcagccagatccaggtggtgggcaacgtgggcagactgcacggcgtgacccccgtgaagctgtgcagaaaggagctgagacagatcagcgccctggagctgagcctgagaagaagcagcctgggcgtgggcatcggcagcatggccgccgacagcatcgaggtgagcagaaagcccagagacctgaagacctag

SEQ ID NO: 10118 - DNA, 903 bp, Artificial Sequence
  Description of Artificial Sequence: Synthetic coding sequence
atggaggaggaggccagcagccccggcctgggctgcagcaagccccacctggagaagctgaccctgggcatcaccagaatcctggagagcagccccggcgtgaccgaggtgaccatcatcgagaagccccccgccgagagacacatgatcagcagctgggagcagaagaacaactgcgtgatgcccgaggacgtgaagaacttctacctgatgaccaacggcttccacatgacctggagcgtgaagctggacgagcacatcatccccctgggcagcatggccatcaacagcatcagcaagctgacccagctgacccagagcagcatgtacagcctgcccaacgcccccaccctggccgacctggaggacgacacccacgaggccagcgacgaccagcccgagaagccccacttcgacagcagaagcgtgatcttcgagctggacagctgcaacggcagcggcaaggtgtgcctggtgtacaagagcggcaagcccgccctggccgaggacaccgagatctggttcctggacagagccctgtactggcacttcctgaccgacaccttcaccgcctactacagactgctgatcacccacctgggcctgccccagtggcagtacgccttcaccagctacggcatcagcccccaggccaagcagtggttcagcatgtacaagcccatcacctacaacaccaacctgctgaccgaggagaccgacagcttcgtgaacaagctggaccccagcaaggtgttcaagagcaagaacaagatcgtgatccccaagaagaagggccccgtgcagcccgccggcggccagaagggccccagcggccccagcggccccagcaccagcagcaccagcaagagcagcagcggcagcggcaaccccaccagaaagtag

SEQ ID NO: 10119 - DNA, 390 bp, Artificial Sequence
  Description of Artificial Sequence: Synthetic coding sequence
atgatgaccgacctgaagcagagccacagcgtgagactgaacgacggccccttcatgcccgtgctgggcttcggcacctacgcccccgaccacacccccaagagccaggccgccgaggccaccaaggtggccatcgacgtgggcttcagacacatcgacagcgcctacctgtaccagaacgaggaggaggtgggccaggccatctgggagaagatcgccgacggcaccgtgaagagagaggagatcttctacaccatcaagctgtgggccaccttcttcagagccgagctggtgcaccccgccctggagagaagcctgaagaagctgggccccgactacgtggacctgttcatcatccacgtgcccttcgccatgaagggcagcagctag

SEQ ID NO: 10120 - DNA, 1257 bp, Artificial Sequence
  Description of Artificial Sequence: Synthetic coding sequence
atgcaccccgagcccagcgagcccgccaccggcggcgccgccgagctggactgcgcccaggagcccggcgtggaggagagcgccggcgaccacggcagcgccggcagaggcggctgcaaggaggagatcaacgaccccaaggagatctgcgtgggcagcagcgacaccagctaccacagccagcagaagcagagcggcgacaacggcagcggcggccacttcgcccaccccagagaggacagagaggacagaggccccagaatgaccaagagcagcctgcagaagctgtgcaagcagcacaagctgtacatcacccccgccctgaacgacaccctgtacctgcacttcaagggcttcgacagaatcgagaacctggaggagtacaccggcctgagatgcctgtggctgcagagcaacggcatccagaagatcgagaacctggaggcccagaccgagctgagatgcctgttcctgcagatgaacctgctgagaaagatcgagaacctggagcccctgcagaagctggacgccctgaacctgagcaacaactacatcaagaccatcgagaacctgagctgcctgcccgtgctgaacaccctgcagatggcccacaaccacctggagaccgtggaggacatccagcacctgcaggagtgcctgagactgtgcgtgctggacctgagccacaacaagctgagcgaccccgagatcctgagcatcctggagagcatgcccgacctgagagtgctgaacctgatgggcaaccccgtgatcagacagatccccaactacagaagaaccgtgaccgtgagactgaagcacctgacctacctggacgacagacccgtgttccccaaggacagagcctgcgccgaggcctgggccagaggcggctacgccgccgagaaggaggagagacagcagtgggagagcagagagagaaagaagatcaccgacagcatcgaggccctggccatgatcaagcagagagccgaggagagaaagagacagagagagagccaggagagaggcgagatgaccagcagcgacgacggcgagaacgtgcccgccagcgccgagggcaaggaggagccccccggcgacagagagaccagacagaagatggagctgttcgtgaaggagagcttcgaggccaaggacgagctgtgccccgagaagcccagcggcgaggagccccccgtggaggccaagagagaggacggcgaccccgccaccgtgaccgcctgcgagggctag

SEQ ID NO: 10121 - DNA, 2472 bp, Artificial Sequence
  Description of Artificial Sequence: Synthetic coding sequence
atgggcaagaagagaaccaagggcaagaccgtgcccatcgacgacagcagcgagaccctggagcccgtgtgcagacacatcagaaagggcctggagcagggcaacctgaagaaggccctggtgaacgtggagtggaacatctgccaggactgcaagaccgacaacaaggtgaaggacaaggccgaggaggagaccgaggagaagcccagcgtgtggctgtgcctgaagtgcggccaccagggctgcggcagaaacagccaggagcagcacgccctgaagcactacctgacccccagaagcgagccccactgcctggtgctgagcctggacaactggagcgtgtggtgctacgtgtgcgacaacgaggtgcagtactgcagcagcaaccagctgggccaggtggtggactacgtgagaaagcaggccagcatcaccacccccaagcccgccgagaaggacaacggcaacatcgagctggagaacaagaagctggagaaggagagcaagaacgagcaggagagagagaagaaggagaacatggccaaggagaacccccccatgaacagcccctgccagatcaccgtgaagggcctgagcaacctgggcaacacctgcttcttcaacgccgtgatgcagaacctgagccagacccccgtgctgagagagctgctgaaggaggtgaagatgagcggcaccatcgtgaagatcgagccccccgacctggccctgaccgagcccctggagatcaacctggagccccccggccccctgaccctggccatgagccagttcctgaacgagatgcaggagaccaagaagggcgtggtgacccccaaggagctgttcagccaggtgtgcaagaaggccgtgagattcaagggctaccagcagcaggacagccaggagctgctgagatacctgctggacggcatgagagccgaggagcaccagagagtgagcaagggcatcctgaaggccttcggcaacagcaccgagaagctggacgaggagctgaagaacaaggtgaaggactacgagaagaagaagagcatgcccagcttcgtggacagaatcttcggcggcgagctgaccagcatgatcatgtgcgaccagtgcagaaccgtgagcctggtgcacgagagcttcctggacctgagcctgcccgtgctggacgaccagagcggcaagaagagcgtgaacgacaagaacctgaagaagaccgtggaggacgaggaccaggacagcgaggaggagaaggacaacgacagctacatcaaggagagaagcgacatccccagcggcaccagcaagcacctgcagaagaaggccaagaagcaggccaagaagcaggccaagaaccagagaagacagcagaagatccagggcaaggtgctgcacctgaacgacatctgcaccatcgaccaccccgaggacagcgagtacgaggccgagatgagcctgcagggcgaggtgaacatcaagagcaaccacatcagccaggagggcgtgatgcacaaggagtactgcgtgaaccagaaggacctgaacggccaggccaagatgatcgagagcgtgaccgacaaccagaagagcaccgaggaggtggacatgaagaacatcaacatggacaacgacctggaggtgctgaccagcagccccaccagaaacctgaacggcgcctacctgaccgagggcagcaacggcgaggtggacatcagcaacggcttcaagaacctgaacctgaacgccgccctgcaccccgacgagatcaacatcgagatcctgaacgacagccacacccccggcaccaaggtgtacgaggtggtgaacgaggaccccgagaccgccttctgcaccctggccaacagagaggtgttcaacaccgacgagtgcagcatccagcactgcctgtaccagttcaccagaaacgagaagctgagagacgccaacaagctgctgtgcgaggtgtgcaccagaagacagtgcaacggccccaaggccaacatcaagggcgagagaaagcacgtgtacaccaacgccaagaagcagatgctgatcagcctggccccccccgtgctgaccctgcacctgaagagattccagcaggccggcttcaacctgagaaaggtgaacaagcacatcaagttccccgagatcctggacctggcccccttctgcaccctgaagtgcaagaacgtggccgaggagaacaccagagtgctgtacagcctgtacggcgtggtggagcacagcggcaccatgagaagcggccactacaccgcctacgccaaggccagaaccgccaacagccacctgagcaacctggtgctgcacggcgacatcccccaggacttcgagatggagagcaagggccagtggttccacatcagcgacacccacgtgcaggccgtgcccaccaccaaggtgctgaacagccaggcctacctgctgttctacgagagaatcctgtag

SEQ ID NO: 10122 - DNA, 3204 bp, Artificial Sequence
  Description of Artificial Sequence: Synthetic coding sequence
atgaacagcatggacagacacatccagcagaccaacgacagactgcagtgcatcaagcagcacctgcagaaccccgccaacttccacaacgccgccaccgagctgctggactggtgcggcgaccccagagccttccagagacccttcgagcagagcctgatgggctgcctgaccgtggtgagcagagtggccgcccagcagggcttcgacctggacctgggctacagactgctggccgtgtgcgccgccaacagagacaagttcacccccaagagcgccgccctgctgagcagctggtgcgaggagctgggcagactgctgctgctgagacaccagaagagcagacagagcgacccccccggcaagctgcccatgcagccccccctgagcagcatgagcagcatgaagcccaccctgagccacagcgacggcagcttcccctacgacagcgtgccctggcagcagaacaccaaccagccccccggcagcctgagcgtggtgaccaccgtgtggggcgtgaccaacaccagccagagccaggtgctgggcaaccccatggccaacgccaacaaccccatgaaccccggcggcaaccccatggccagcggcatgaccaccagcaaccccggcctgaacagcccccagttcgccggccagcagcagcagttcagcgccaaggccggccccgcccagccctacatccagcagagcatgtacggcagacccaactaccccggcagcggcggcttcggcgccagctaccccggcggccccaacgcccccgccggcatgggcatccccccccacaccagaccccccgccgacttcacccagcccgccgccgccgccgccgccgccgccgtggccgccgccgccgccaccgccaccgccaccgccaccgccaccgtggccgccctgcaggagacccagaacaaggacatcaaccagtacggccccatgggccccacccaggcctacaacagccagttcatgaaccagcccggccccagaggccccgccagcatgggcggcagcatgaaccccgccagcatggccgccggcatgacccccagcggcatgagcggcccccccatgggcatgaaccagcccagaccccccggcatcagccccttcggcacccacggccagagaatgccccagcagacctaccccggccccagaccccagagcctgcccatccagaacatcaagagaccctaccccggcgagcccaactacggcaaccagcagtacggccccaacagccagttccccacccagcccggccagtaccccgcccccaacccccccagacccctgaccagccccaactaccccggccagagaatgcccagccagcccagcagcggccagtaccccccccccaccgtgaacatgggccagtactacaagcccgagcagttcaacggccagaacaacaccttcagcggcagcagctacagcaactacagccagggcaacgtgaacagaccccccagacccgtgcccgtggccaactacccccacagccccgtgcccggcaaccccaccccccccatgacccccggcagcagcatccccccctacctgagccccagccaggacgtgaagccccccttcccccccgacatcaagcccaacatgagcgccctgccccccccccccgccaaccacaacgacgagctgagactgaccttccccgtgagagacggcgtggtgctggagcccttcagactggagcacaacctggccgtgagcaaccacgtgttccacctgagacccaccgtgcaccagaccctgatgtggagaagcgacctggagctgcagttcaagtgctaccaccacgaggacagacagatgaacaccaactggcccgccagcgtgcaggtgagcgtgaacgccacccccctgaccatcgagagaggcgacaacaagaccagccacaagcccctgcacctgaagcacgtgtgccagcccggcagaaacaccatccagatcaccgtgaccgcctgctgctgcagccacctgttcgtgctgcagctggtgcacagacccagcgtgagaagcgtgctgcagggcctgctgaagaagagactgctgcccgccgagcactgcatcaccaagatcaagagaaacttcagcagcgtggccgccagcagcggcaacaccaccctgaacggcgaggacggcgtggagcagaccgccatcaaggtgagcctgaagtgccccatcaccttcagaagaatccagctgcccgccagaggccacgactgcaagcacgtgcagtgcttcgacctggagagctacctgcagctgaactgcgagagaggcacctggagatgccccgtgtgcaacaagaccgccctgctggagggcctggaggtggaccagtacatgtggggcatcctgaacgccatccagcacagcgagttcgaggaggtgaccatcgaccccacctgcagctggagacccgtgcccatcaagagcgacctgcacatcaaggacgaccccgacggcatccccagcaagagattcaagaccatgagccccagccagatgatcatgcccaacgtgatggagatgatcgccgccctgggccccggccccagcccctaccccctgccccccccccccggcggcaccaacagcaacgactacagcagccagggcaacaactaccagggccacggcaacttcgacttcccccacggcaaccccggcggcaccagcatgaacgacttcatgcacggccccccccagctgagccacccccccgacatgcccaacaacatggccgccctggagaagcccctgagccaccccatgcaggagaccatgccccacgccggcagcagcgaccagccccaccccagcatccagcagggcctgcacgtgccccaccccagcagccagagcggcccccccctgcaccacagcggcgcccccccccccccccccagccagccccccagacagcccccccaggccgcccccagcagccacccccacagcgacctgaccttcaaccccagcagcgccctggagggccaggccggcgcccagggcgccagcgacatgcccgagcccagcctggacctgctgcccgagctgaccaaccccgacgagctgctgagctacctggacccccccgacctgcccagcaacagcaacgacgacctgctgagcctgttcgagaacaactag

SEQ ID NO: 10123 - DNA, 1038 bp, Artificial Sequence
  Description of Artificial Sequence: Synthetic coding sequence
atggacggcgaggacatccccgacttcagcagcctgaaggaggagaccgcctactggaaggagctgagcctgaagtacaagcagagcttccaggaggccagagacgagctggtggagttccaggagggcagcagagagctggaggccgagctggaggcccagctggtgcaggccgagcagagaaacagagacctgcaggccgacaaccagagactgaagtacgaggtggaggccctgaaggagaagctggagcaccagtacgcccagagctacaagcaggtgagcgtgctggaggacgacctgagccagaccagagccatcaaggagcagctgcacaagtacgtgagagagctggagcaggccaacgacgacctggagagagccaagagagccaccatcgtgagcctggaggacttcgagcagagactgaaccaggccatcgagagaaacgccttcctggagagcgagctggacgagaaggagagcctgctggtgagcgtgcagagactgaaggacgaggccagagacctgagacaggagctggccgtgagagagagacagcaggaggtgaccagaaagagcgcccccagcagccccaccctggactgcgagaagatggacagcgccgtgcaggccagcctgagcctgcccgccacccccgtgggcaagggcaccgagaacaccttccccagccccaaggccatccccaacggcttcggcaccagccccctgacccccagcgccagaatcagcgccctgaacatcgtgggcgacctgctgagaaaggtgggcgccctggagagcaagctggccgcctgcagaaacttcgccaaggaccaggccagcagaaagagctacatcagcggcaacgtgaactgcggcgtgctgaacggcaacggcaccaagttcagcagaagcggccacaccagcttcttcgacaagggcgccgtgaacggcttcgaccccgccccccccccccccggcctgggcagcagcagacccagcagcgcccccggcatgctgcccctgagcgtgtag

SEQ ID NO: 10124 - DNA, 588 bp, Artificial Sequence
  Description of Artificial Sequence: Synthetic coding sequence
atgggcagcagagccagcaccctgctgagagacgaggagctggaggagatcaagaaggagaccggcttcagccacagccagatcaccagactgtacagcagattcaccagcctggacaagggcgagaacggcaccctgagcagagaggacttccagagaatccccgagctggccatcaaccccctgggcgacagaatcatcaacgccttcttccccgagggcgaggaccaggtgaacttcagaggcttcatgagaaccctggcccacttcagacccatcgaggacaacgagaagagcaaggacgtgaacggccccgagcccctgaacagcagaagcaacaagctgcacttcgccttcagactgtacgacctggacaaggacgagaagatcagcagagacgagctgctgcaggtgctgagaatgatggtgggcgtgaacatcagcgacgagcagctgggcagcatcgccgacagaaccatccaggaggccgaccaggacggcgacagcgccatcagcttcaccgagttcgtgaaggtgctggagaaggtggacgtggagcagaagatgagcatcagattcctgcactag

SEQ ID NO: 10125 - DNA, 780 bp, Artificial Sequence
  Description of Artificial Sequence: Synthetic coding sequence
atggccgacgcctgctgcaccagaacctacgtgatcgccgccagcaccatgagcgtgtgcagcagcgacgtgggccacgtgagcagagtgagcagccccagcacctgcaccggcagcagctggcaggtggacaactgccaggagagctgctgcgagcccagaagctgcgccagcagctgctgcacccccagctgctgcgcccccgccccctgcctggccctggtgtgcgcccccgtgagctgcgagcccagcccctgccagagcggctgcaccgacagctgcacccccagctgctgccagcagagcagctgccagcccgcctgctgcaccagcagcccctgccagcaggcctgctgcgtgcccgtgtgctgcaagagcaactgctgcaagcccgtgtgctgcgtgagcatctgcagcggcgccagcagcccctgctgccagcagagcagctgccagagcgcctgctgcaccttcagcccctgccagcaggcctgctgcgtgcccatctgctgcaagcccatctgctgcgtgcccgtgtgcagcggcgccagcagcctgtgctgccagaagagcagctgccagcccgcctgctgcaccaccagctgctgcagacccagcagcagcgtgagcctgctgtgcagacccgtgtgcagacccgcctgctgcgtgcccgtgcccagctgctgcgtgcccgccagcagctgccagcccagctgctgccaccccgccagctgcctgagcttcctgtgcagacccgcctgcagcagactggcctgctag

SEQ ID NO: 10126 - DNA, 171 bp, Artificial Sequence
  Description of Artificial Sequence: Synthetic coding sequence
atgatctactacagcaactactacggcggctacggctacggcggcctgggctgcggctacggctgcggctacagaggctacggctgcggctacggcggctacggcggctacggcaacggctactactgccccagctgctacggcagatactggagctacggcttctactag

SEQ ID NO: 10127 - DNA, 897 bp, Artificial Sequence
  Description of Artificial Sequence: Synthetic coding sequence
atggccgccagcaccatgagcgtgtgcagcagcgcctacagcgacagctggcaggtggacgactgccccgagagctgctgcgagcccccctgcagcgcccccagctgctgcgcccccgcccccagcctgagcctggtgtgcacccccgtgagctgcgtgagcagcccctgctgccaggccgcctgcgagcccagcgcctgccagagcggctgcaccagcagctgcacccccagctgctgccagcagagcagctgccagcccgcctgctgcaccagcagcccctgccagcaggcctgctgcgtgcccgtgtgctgcaagaccgtgtgctgcaagcccgtgtgctgcgtgcccgtgtgctgcggcgccgccagcagctgctgcagacagagcagctgccagcccgcctgctgcgccagcagcagctgccagcccgcctgctgcgtgcccgtgtgctgcaagcccgtgtgctgcgtgagcacctgcagcgaggacagcagcagctgctgccagcagagcagctgccagcccgcctgctgcaccagcagcagctaccagcaggcctgctgcgtgcccgtgtgctgcaagaccgtgtactgcaagcccatctgctgcgtgcccgtgtgcagcagagccagcagcagcagatgccagcagcccagctgccagcccgcctgctgcaccaccagctgctgcagacccagcagcagcgtgagcctgctgtgccaccccgtgtgcagaagcacctgctgcgtgcccgtgagcagctgctgcgcccccaccagcagctgccagagcagctgctgcagacccgccagctgcgtgagcctgctgtgcagacccgccagcagcagactggcctgctacagcctgtgcagcggcaagaagagcagctgctag

SEQ ID NO: 10128 - DNA, 567 bp, Artificial Sequence
  Description of Artificial Sequence: Synthetic coding sequence
atgaccgcccccagctgcgccttccccgtgcagttcagacagcccagcgtgagcggcctgagccagatcaccaagagcctgtacatcagcaacggcgtggccgccaacaacaagctgatgctgagcagcaaccagatcaccatggtgatcaacgtgagcgtggaggtggtgaacaccctgtacgaggacatccagtacatgcaggtgcccgtggccgacagccccaacagcagactgtgcgacttcttcgaccccatcgccgaccacatccacagcgtggagatgaagcagggcagaaccctgctgcactgcgccgccggcgtgagcagaagcgccgccctgtgcctggcctacctgatgaagtaccacgccatgagcctgctggacgcccacacctggaccaagagctgcagacccatcatcagacccaacagcggcttctgggagcagctgatccactacgagttccagctgttcggcaagaacaccgtgcacatggtgagcagccccgtgggcatgatccccgacatctacgagaaggaggtgagactgatgatccccctgtag

SEQ ID NO: 10129 - DNA, 147 bp, Artificial Sequence
  Description of Artificial Sequence: Synthetic coding sequence
atgagcttcgacaacaactaccacggcggccagggctacgccaagggcggcctgggctgcagctacggctgcggcctgagcggctacggctacgcctgctactgcccctggtgctacgagagaagctggttcagcggctgcttctag

SEQ ID NO: 10130 - DNA, 192 bp, Artificial Sequence
  Description of Artificial Sequence: Synthetic coding sequence
atgagctacagcggcagctactacggcggcctgggctacggctgcggcggcttcggcggcctgggctacggctacagctgcggctgcggcagcttcagaagactgggctacggctgcggctacggcggctacagatacagctgctgccaccccagctgctacggcggctactggagcagcggcttctactag

SEQ ID NO: 10131 - DNA, 189 bp, Artificial Sequence
  Description of Artificial Sequence: Synthetic coding sequence
atgtgcggcagctactacggcaactactacggcgaccacggctacggctgctgcggctacgagggcctgggctacggctacggcagcctgagatgcggctacagcagctgctgcggctacggccacggctacggcagcagattcttctgcggctgcggctacggctgcggcagcggctactactactag

SEQ ID NO: 10132 - DNA, 4227 bp, Artificial Sequence
  Description of Artificial Sequence: Synthetic coding sequence
atgtggagcctgaccgccagcgagggcgagagcaccaccgcccacttcttcctgggcgccggcgacgagggcctgggcaccagaggcatcggcatgagacccgaggagagcgacagcgagctgctggaggacgaggaggacgaggtgccccccgagccccagatcatcgtgggcatctgcgccatgaccaagaagagcaagagcaagcccatgacccagatcctggagagactgtgcagattcgactacctgaccgtggtgatcctgggcgaggacgtgatcctgaacgagcccgtggagaactggcccagctgccactgcctgatcagcttccacagcaagggcttccccctggacaaggccgtggcctacagcaagctgagaaaccccttcctgatcaacgacctggccatgcagtactacatccaggacagaagagaggtgtacagaatcctgcaggaggagggcatcgacctgcccagatacgccgtgctgaacagagaccccgccagacccgaggagtgcaacctgatcgagggcgaggaccaggtggaggtgaacggcgccgtgttccccaagcccttcgtggagaagcccgtgagcgccgaggaccacaacgtgtacatctactaccccagcagcgccggcggcggcagccagagactgttcagaaagatcggcagcagaagcagcgtgtacagccccgagagcagcgtgagaaagaccggcagctacatctacgaggagttcatgcccaccgacggcaccgacgtgaaggtgtacaccgtgggccccgactacgcccacgccgaggccagaaagagccccgccctggacggcaaggtggagagagacagcgagggcaaggagatcagataccccgtgatgctgaccgccatggagaagctggtggccagaaaggtgtgcgtggccttcaagcagaccgtgtgcggcttcgacctgctgagagccaacggccacagcttcgtgtgcgacgtgaacggcttcagcttcgtgaagaacagcatgaagtactacgacgactgcgccaagatcctgggcaacaccatcatgagagagctggccccccagttccagatcccctggagcatccccaccgaggccgaggacatccccatcgtgcccaccaccagcggcaccatgatggagctgagatgcgtgatcgccatcatcagacacggcgacagaacccccaagcagaagatgaagatggaggtgaagcaccccagattcttcgccctgttcgagaagcacggcggctacaagaccggcaagctgaagctgaagagacccgagcagctgcaggaggtgctggacatcaccagactgctgctggccgagctggagaaggagcccggcggcgagatcgaggagaagaccggcaagctggagcagctgaagagcgtgctggagatgtacggccacttcagcggcatcaacagaaaggtgcagctgacctactacccccacggcgtgaaggccagcaacgagggccaggacccccagagagagaccctggcccccagcctgctgctggtgctgaagtggggcggcgagctgacccccgccggcagagtgcaggccgaggagctgggcagagccttcagatgcatgtaccccggcggccagggcgactacgccggcttccccggctgcggcctgctgagactgcacagcaccttcagacacgacctgaagatctacgccagcgacgagggcagagtgcagatgaccgccgccgccttcgccaagggcctgctggccctggagggcgagctgacccccatcctggtgcagatggtgaagagcgccaacatgaacggcctgctggacagcgacggcgacagcctgagcagctgccagcacagagtgaaggccagactgcaccacatcctgcagcaggacgcccccttcggccccgaggactacgaccagctggcccccaccagaagcaccagcctgctgaacagcatgaccatcatccagaaccccgtgaaggtgtgcgaccaggtgttcgccctgatcgagaacctgacccaccagatcagagagagaatgcaggaccccagaagcgtggacctgcagctgtaccacagcgagaccctggagctgatgctgcagagatggagcaagctggagagagacttcagacagaagagcggcagatacgacatcagcaagatccccgacatctacgactgcgtgaagtacgacgtgcagcacaacggcagcctgggcctgcagggcaccgccgagctgctgagactgagcaaggccctggccgacgtggtgatcccccaggagtacggcatcagcagagaggagaagctggagatcgccgtgggcttctgcctgcccctgctgagaaagatcctgctggacctgcagagaacccacgaggacgagagcgtgaacaagctgcaccccctgtacagcagaggcgtgctgagccccggcagacacgtgagaaccagactgtacttcaccagcgagagccacgtgcacagcctgctgagcgtgttcagatacggcggcctgctggacgagacccaggacgcccagtggcagagagccctggactacctgagcgccatcagcgagctgaactacatgacccagatcgtgatcatgctgtacgaggacaacacccaggaccccctgagcgaggagagattccacgtggagctgcacttcagccccggcgtgaagggcgtggaggaggagggcagcgcccccgccggctgcggcttcagacccgccagcagcgagaacgaggagatgaagaccaaccagggcagcatggagaacctgtgccccggcaaggccagcgacgagcccgacagagccctgcagaccagcccccagccccccgagggccccggcctgcccagaagaagccccctgatcagaaacagaaaggccggcagcatggaggtgctgagcgagaccagcagcagcagacccggcggctacagactgttcagcagcagcagaccccccaccgagatgaagcagagcggcctgggcagccagtgcaccggcctgttcagcaccaccgtgctgggcggcagcagcagcgcccccaacctgcaggactacgccagaagccacggcaagaagctgccccccgccagcctgaagcacagagacggcttcgagggctgcagcatggtgcccaccatctaccccctggagaccctgcacaacgccctgagcctgagacaggtgagcgagttcctgagcagagtgtgccagagacacaccgacgcccaggcccaggccagcgccgccctgttcgacagcatgcacagcagccaggccagcgacaaccccttcagcccccccagaaccctgcacagcccccccctgcagctgcagcagagaagcgagaagcccccctggtacagcagcggccccagcagcaccgtgagcagcgccggccccagcagccccaccaccgtggacggcaacagccagttcggcttcagcgaccagcccagcctgaacagccacgtggccgaggagcaccagggcctgggcctgctgcaggagacccccggcagcggcgcccaggagctgagcatcgagggcgagcaggagctgttcgagcccaaccagagcccccaggtgccccccatggagaccagccagccctacgaggaggtgagccagccctgccaggaggtgcccgacatcagccagccctgccaggacatcagcgaggccctgagccagccctgccagaaggtgcccgacatcagccagcagtgccaggagaaccacgacaacggcaaccacacctgccaggaggtgccccacatcagccagccctgccagaagagcagccagctgtgccagaaggtgagcgaggaggtgtgccagctgtgcctggagaacagcgaggaggtgagccagccctgccagggcgtgagcgtggaggtgggcaagctggtgcacaagttccacgtgggcgtgggcagcctggtgcaggagaccctggtggaggtgggcagccccgccgaggagatccccgaggaggtgatccagccctaccaggagttcagcgtggaggtgggcagactggcccaggagaccagcgccatcaacctgctgagccagggcatccccgagatcgacaagcccagccaggagttccccgaggagatcgacctgcaggcccaggaggtgcccgaggagatcaactag

SEQ ID NO: 10133 - DNA, 705 bp, Artificial Sequence
  Description of Artificial Sequence: Synthetic coding sequence
atggagggcgccagcagaaacctggccagcacccccagagtgcacgccaaggtgatgatgtacagaaaggagcagtacctggacgtgctgcacgccctgaaggtggtgagattcgtgagcgacgccaccccccaggccgaggtgtacctgagaatgtaccagctggagagcggcaagctgcccagaagccccagcttccccctggagcccgacgacgaggtgttcctggccatcgccaaggccatggaggagatggtggaggacagcgtggactgctactggatcaccagaagattcgtgaaccagctgaacaccaagtacagagacagcctgccccagctgcccaaggccttcgagcagtacctgaacctggaggacggcagactgctgacccacctgagaatgtgcagcgccgcccccaagctgccctacgacctgtggttcaagagatgcttcgccggctgcctgcccgagagcagcctgcagagagtgtgggacaaggtggtgagcggcagctgcaagatcctggtgttcgtggccgtggagatcctgctgaccttcaagatcaaggtgatggccctgaacagcgccgagaagatcaccaagttcctggagaacatcccccaggacagcagcgacgccatcgtgagcaaggccatcgacctgtggcacaagcactgcggcacccccgtgcacagcagctag

SEQ ID NO: 10134 - DNA, 537 bp, Artificial Sequence
  Description of Artificial Sequence: Synthetic coding sequence
atgaccaccctgagagccttcacctgcgacgacctgttcagattcaacaacatcaacctggaccccctgaccgagacctacggcatccccttctacctgcagtacctggcccactggcccgagtacttcatcgtggccgaggcccccggcggcgagctgatgggctacatcatgggcaaggccgagggcagcgtggccagagaggagtggcacggccacgtgaccgccctgagcgtggcccccgagttcagaagactgggcctggccgccaagctgatggagctgctggaggagatcagcgagagaaagggcggcttcttcgtggacctgttcgtgagagtgagcaaccaggtggccgtgaacatgtacaagcagctgggctacagcgtgtacagaaccgtgatcgagtactacagcgccagcaacggcgagcccgacgaggacgcctacgacatgagaaaggccctgagcagagacaccgagaagaagagcatcatccccctgccccaccccgtgagacccgaggacatcgagtag

SEQ ID NO: 10135 - DNA, 2373 bp, Artificial Sequence; identical to SEQ ID NO: 9490
  Description of Artificial Sequence: Synthetic coding sequence

SEQ ID NO: 10136 - DNA, 3588 bp, Artificial Sequence
  Description of Artificial Sequence: Synthetic coding sequence
atgtggagcctgaccgccagcgagggcgagagcaccaccgcccacttcttcctgggcgccggcgacgagggcctgggcaccagaggcatcggcatgagacccgaggagagcgacagcgagctgctggaggacgaggaggacgaggtgccccccgagccccagatcatcgtgggcatctgcgccatgaccaagaagagcaagagcaagcccatgacccagatcctggagagactgtgcagattcgactacctgaccgtggtgatcctgggcgaggacgtgatcctgaacgagcccgtggagaactggcccagctgccactgcctgatcagcttccacagcaagggcttccccctggacaaggccgtggcctacagcaagctgagaaaccccttcctgatcaacgacctggccatgcagtactacatccagggcgacagaagagaggtgtacagaatcctgcaggaggagggcatcgacctgcccagatacgccgtgctgaacagagaccccgccagacccgaggagtgcaacctgatcgagggcgaggaccaggtggaggtgaacggcgccgtgttccccaagcccttcgtggagaagcccgtgagcgccgaggaccacaacgtgtacatctactaccccagcagcgccggcggcggcagccagagactgttcagaaagatcggcagcagaagcagcgtgtacagccccgagagcagcgtgagaaagaccggcagctacatctacgaggagttcatgcccaccgacggcaccgacgtgaaggtgtacaccgtgggccccgactacgcccacgccgaggccagaaagagccccgccctggacggcaaggtggagagagacagcgagggcaaggagatcagataccccgtgatgctgaccgccatggagaagctggtggccagaaaggtgtgcgtggccttcaagcagaccgtgtgcggcttcgacctgctgagagccaacggccacagcttcgtgtgcgacgtgaacggcttcagcttcgtgaagaacagcatgaagtactacgacgactgcgccaagatcctgggcaacaccatcatgagagagctggccccccagttccagatcccctggagcatccccaccgaggccgaggacatccccatcgtgcccaccaccagcggcaccatgatggagctgagatgcgtgatcgccatcatcagacacggcgacagaacccccaagcagaagatgaagatggaggtgaagcaccccagattcttcgccctgttcgagaagcacggcggctacaagaccggcaagctgaagctgaagagacccgagcagctgcaggaggtgctggacatcaccagactgctgctggccgagctggagaaggagcccggcggcgagatcgaggagaagaccggcaagctggagcagctgaagagcgtgctggagatgtacggccacttcagcggcatcaacagaaaggtgcagctgacctactacccccacggcgtgaaggccagcaacgagggccaggacccccagagagagaccctggcccccagcctgctgctggtgctgaagtggggcggcgagctgacccccgccggcagagtgcaggccgaggagctgggcagagccttcagatgcatgtaccccggcggccagggcgactacgccggcttccccggctgcggcctgctgagactgcacagcaccttcagacacgacctgaagatctacgccagcgacgagggcagagtgcagatgaccgccgccgccttcgccaagggcctgctggccctggagggcgagctgacccccatcctggtgcagatggtgaagagcgccaacatgaacggcctgctggacagcgacggcgacagcctgagcagctgccagcacagagtgaaggccagactgcaccacatcctgcagcaggacgcccccttcggccccgaggactacgaccagctggcccccaccagaagcaccagcctgctgaacagcatgaccatcatccagaaccccgtgaaggtgtgcgaccaggtgttcgccctgatcgagaacctgacccaccagatcagagagagaatgcaggaccccagaagcgtggacctgcagctgtaccacagcgagaccctggagctgatgctgcagagatggagcaagctggagagagacttcagacagaagagcggcagatacgacatcagcaagatccccgacatctacgactgcgtgaagtacgacgtgcagcacaacggcagcctgggcctgcagggcaccgccgagctgctgagactgagcaaggccctggccgacgtggtgatcccccaggagtacggcatcagcagagaggagaagctggagatcgccgtgggcttctgcctgcccctgctgagaaagatcctgctggacctgcagagaacccacgaggacgagtacagcagaggcgtgctgagccccggcagacacgtgagaaccagactgtacttcaccagcgagagccacgtgcacagcctgctgagcgtgttcagatacggcggcctgctggacgagacccaggacgccgacagagccctgcagaccagcccccagccccccgagggccccggcctgcccagaagaagccccctgatcagaaacagaaaggccggcagcatggaggtgctgagcgagaccagcagcagcagacccggcggctacagactgttcagcagcagcagaccccccaccgagatgaagcagagcggcctgggcagccagtgcaccggcctgttcagcaccaccgtgctgggcggcagcagcagcgcccccaacctgcaggactacgccagaagccacggcaagaagctgccccccgccagcctgaagcacagagacgagctgctgttcgtgcccgccgtgaagagattcagcgtgagcttcgccaagcaccccaccaacggcttcgagggctgcagcatggtgcccaccatctaccccctggagaccctgcacaacgccctgagcctgagacaggtgccccccatggagaccagccagccctacgaggaggtgagccagccctgccaggaggtgcccgacatcagccagccctgccaggacatcagcgaggccctgagccagccctgccagaaggtgcccgacatcagccagcagtgccaggagaaccacgacaacggcaaccacacctgccaggaggtgccccacatcagccagccctgccagaagagcagccagctgtgccagaaggtgagcgaggaggtgtgccagctgtgcctggagaacagcgaggaggtgagccagccctgccagggcgtgagcgtggaggtgggcaagctggtgcacaagttccacgtgggcgtgggcagcctggtgcaggagaccctggtggaggtgggcagccccgccgaggagatccccgaggaggtgatccagccctaccaggagttcagcgtggaggtgggcagactggcccaggagaccagcgccatcaacctgctgagccagggcatccccgagatcgacaagcccagccaggagttccccgaggagatcgacctgcaggcccaggaggtgcccgaggagatcaactag

SEQ ID NO: 10137 - DNA, 240 bp, Artificial Sequence
  Description of Artificial Sequence: Synthetic coding sequence
atgtgctgcaactactacggcaacagctgcggctacggcagcggctgcggctgcggctacggcagcggcagcggctgcggctgcggctacggcaccggctacggctgcggctacggctgcggcttcggcagccactacggctgcggctacggcaccggctacggctgcggctacggcagcggcagcggctactgcggctacagacccttctgcttcagaagatgctacagcagctgctag

SEQ ID NO: 10138 - DNA, 1767 bp, Artificial Sequence
  Description of Artificial Sequence: Synthetic coding sequence
atgaagctggagttcaccgagaagaactacaacagcttcgtgctgcagaacctgaacagacagagaaagagaaaggagtactgggacatggccctgagcgtggacaaccacgtgttcttcgcccacagaaacgtgctggccgccgtgagccccctggtgagaagcctgatcagcagcaacgacatgaagaccgccgacgagctgttcatcaccatcgacaccagctacctgagccccgtgaccgtggaccagctgctggactacttctacagcggcaaggtggtgatcagcgagcagaacgtggaggagctgctgagaggcgcccagtacttcaacacccccagactgagagtgcactgcaacgacttcctgatcaagagcatctgcagagccaactgcctgagatacctgttcctggccgagctgttcgagctgaaggaggtgagcgacgtggcctacagcggcatcagagacaacttccactactgggccagccccgagggcagcatgcacttcatgagatgcccccccgtgatcttcggcagactgctgagagacgagaacctgcacgtgctgaacgaggaccaggccctgagcgccctgatcaactgggtgtacttcagaaaggaggacagagagaagtacttcaagaagttcttcaactacatcaacctgaacgccgtgagcaacaagaccctggtgttcgccagcaacaagctggtgggcatggagaacaccagcagccacaccaccctgatcgagagcgtgctgatggacagaaagcaggagagaccctgcagcctgctggtgtaccagagaaagggcgccctgctggacagcgtggtgatcctgggcggccagaaggcccacggccagttcaacgacggcgtgttcgcctacatcatccaggagaacctgtggatgaagctgagcgacatgccctacagagccgccgccctgagcgccaccagcgccggcagatacatctacatcagcggcggcaccaccgagcagatcagcggcctgaagaccgcctggagatacgacatggacgacaacagctggaccaagctgcccgacctgcccatcggcctggtgttccacaccatggtgacctgcggcggcaccgtgtacagcgtgggcggcagcatcgcccccagaagatacgtgagcaacatctacagatacgacgagagaaaggaggtgtggtgcctggccggcaagatgagcatccccatggacggcaccgccgtgatcaccaagggcgacagacacctgtacatcgtgaccggcagatgcctggtgaagggctacatcagcagagtgggcgtggtggactgcttcgacaccagcaccggcgacgtggtgcagtgcatcaccttccccatcgagttcaaccacagacccctgctgagcttccagcaggacaacatcctgtgcgtgcacagccacagacagagcgtggagatcaacctgcagaaggtgaaggccagcaagaccaccaccagcgtgcccgtgctgcccaacagctgccccctggacgtgagccacgccatctgcagcatcggcgacagcaaggtgttcgtgtgcggcggcgtgaccaccgccagcgacgtgcagaccaaggactacaccatcaaccccaacgccttcctgctggaccagaagaccggcaagtggaagaccctggcccccccccccgaggccctggactgccccgcctgctgcctggccaagctgccctgcaagatcctgcagagaatctag

SEQ ID NO: 10139 - DNA, 2208 bp, Artificial Sequence
  Description of Artificial Sequence: Synthetic coding sequence
atgatccccccccaggaggccagcgccagaagaagagagatcgaggacaagctgaagcaggaggaggagaccctgagcttcatcagagacagcctggagaagagcgaccagctgaccaagaacatggtgagcatcctgagcagcttcgagagcagactgatgaagctggagaacagcatcatccccgtgcacaagcagaccgagaacctgcagagactgcaggagaacgtggagaagaccctgagctgcctggaccacgtgatcagctactaccacgtggccagcgacaccgagaagatcatcagagagggccccaccggcagactggaggagtacctgggcagcatggccaagatccagaaggccgtggagtacttccaggacaacagccccgacagccccgagctgaacaaggtgaagctgctgttcgagagaggcaaggaggccctggagagcgagttcagaagcctgatgaccagacacagcaaggtggtgagccccgtgctgatcctggacctgatcagcggcgacgacgacctggaggcccaggaggacgtgaccctggagcacctgcccgagagcgtgctgcaggacgtgatcagaatcagcagatggctggtggagtacggcagaaaccaggacttcatgaacgtgtactaccagatcagaagcagccagctggacagaagcatcaagggcctgaaggagcacttccacaagagcagcagcagcagcggcgtgccctacagccccgccatccccaacaagagaaaggacacccccaccaagaagcccgtgaagagacccggcaccatcagaaaggcccagaacctgctgaagcagtacagccagcacggcctggacggcaagaagggcggcagcaacctgatccccctggagggcctgctgccctgcacccccagaggcggcctgcccggcccctggatcaacgccgcctgcgtgtgcgccgccgacatcagccccggccacgagcacgacttcagagtgaagcacctgagcgaggccctgaacgacaagcacggccccctggccggcagagacgacatgctggacgtggagaccgacgcctacatccactgcgtgagcgccttcgtgaagctggcccagagcgagtaccagctgctggccgacatcatccccgagcaccaccagaagaagaccttcgacagcctgatccaggacgccctggacggcctgatgctggagggcgagaacatcgtgagcgccgccagaaaggccatcgtgagacacgacttcagcaccgtgctgaccgtgttccccatcctgagacacctgaagcagaccaagcccgagttcgaccaggtgctgcagggcaccgccgccagcaccaagaacaagctgcccggcctgatcaccagcatggagaccatcggcgccaaggccctggaggacttcgccgacaacatcaagaacgaccccgacaaggagtacaacatgcccaaggacggcaccgtgcacgagctgaccagcaacgccatcctgttcctgcagcagctgctggacttccaggagaccgccggcgccatgctggccagccaggagaccagcagcagcgccaccagctacagcagcgagttcagcaagagactgctgagcacctacatctgcaaggtgctgggcaacctgcagctgaacctgctgagcaagagcaaggtgtacgaggaccccgccctgagcgccatcttcctgcacaacaactacaactacatcctgaagagcctggagaagagcgagctgatccagctggtggccgtgacccagaagaccgccgagagaagctacagagagcacatcgagcagcagatccagacctaccagagaagctggctgaaggtgaccgactacatcgccgagaagaacctgcccgtgttccagcccggcgtgaagctgagagacaaggagagacagatcatcaaggagagattcaagggcttcaacgacggcctggaggagctgtgcaagatccagaaggcctgggccatccccgacaccgagcagagagacagaatcagacaggcccagaagaccatcgtgaaggagacctacggcgccttcctgcagaagttcggcagcgtgcccttcaccaagaaccccgagaagtacatcaagtacggcgtggagcaggtgggcgacatgatcgacagactgttcgacaccagcgcctag

SEQ ID NO: 10140 - DNA, 378 bp, Artificial Sequence
  Description of Artificial Sequence: Synthetic coding sequence
atggccggcgccggccccaccatgctgctgagagaggagaacggctgctgcagcagaagacagagcagcagcagcgccggcgacagcgacggcgagagagaggacagcgccgccgagagagccagacagcagctggaggccctgctgaacaagaccatgagaatcagaatgaccgacggcagaaccctggtgggctgcttcctgtgcaccgacagagactgcaacgtgatcctgggcagcgcccaggagttcctgaagcccagcgacagcttcagcgccggcgagcccagagtgctgggcctggccatggtgcccggccaccacatcgtgagcatcgaggtgcagagagagagcctgaccggccccccctacctgtag

SEQ ID NO: 10141 - DNA, 477 bp, Artificial Sequence
  Description of Artificial Sequence: Synthetic coding sequence
atgctgctgctggactgcaaccccgaggtggacggcctgaagcacctgctggagaccggcgccagcgtgaacgccccccccgacccctgcaagcagagccccgtgcacctggccgccggcagcggcctggcctgcttcctgctgtggcagctgcagaccggcgccgacctgaaccagcaggacgtgctgggcgaggcccccctgcacaaggccgccaaggtgggcagcctggagtgcctgagcctgctggtggccagcgacgcccagatcgacctgtgcaacaagaacggccagaccgccgaggacctggcctggagctgcggcttccccgactgcgccaagttcctgaccaccatcaagtgcatgcagaccatcaaggccagcgagcaccccgacagaaacgactgcgtggccgtgctgagacagaagagaagcctgggcagcgtggagaacaccagcggcaagagaaagtgctag

SEQ ID NO: 10142 - DNA, 8712 bp, Artificial Sequence
  Description of Artificial Sequence: Synthetic coding sequence
atgagaggcagaagaggcagaccccccaagcagcccgccgcccccgccgccgagagatgcgcccccgccccccccccccccccccccccccccaccagcggccccatcggcggcctgagaagcagacacagaggcagcagcagaggcagatgggccgccgcccaggccgaggtggcccccaagaccagactgagcagccccagaggcggcagcagcagcagaagaaagccccccccccccccccccgccccccccagcaccagcgcccccggcagaggcggcagaggcggcggcggcggcagaaccggcggcggcggcggcggcggccacctggccagaaccaccgccgccagaagagccgtgaacaaggtggtgtacgacgaccacgagagcgaggaggaggaggaggaggaggacatggtgagcgaggaggaggaggaggaggacggcgacgccgaggagacccaggacagcgaggacgacgaggaggacgagatggaggaggacgacgacgacagcgactaccccgaggagatggaggacgacgacgacgacgccagctactgcaccgagagcagcttcagaagccacagcacctacagcagcacccccggcagaagaaagcccagagtgcacagacccagaagccccatcctggaggagaaggacatcccccccctggagttccccaagagcagcgaggacctgatggtgcccaacgagcacatcatgaacgtgatcgccatctacgaggtgctgagaaacttcggcaccgtgctgagactgagccccttcagattcgaggacttctgcgccgccctggtgagccaggagcagtgcaccctgatggccgagatgcacgtggtgctgctgaaggccgtgctgagagaggaggacaccagcaacaccaccttcggccccgccgacctgaaggacagcgtgaacagcaccctgtacttcatcgacggcatgacctggcccgaggtgctgagagtgtactgcgagagcgacaaggagtaccaccacgtgctgccctaccaggaggccgaggactacccctacggccccgtggagaacaagatcaaggtgctgcagttcctggtggaccagttcctgaccaccaacatcgccagagaggagctgatgagcgagggcgtgatccagtacgacgaccactgcagagtgtgccacaagctgggcgacctgctgtgctgcgagacctgcagcgccgtgtaccacctggagtgcgtgaagccccccctggaggaggtgcccgaggacgagtggcagtgcgaggtgtgcgtggcccacaaggtgcccggcgtgaccgactgcgtggccgagatccagaagaacaagccctacatcagacacgagcccatcggctacgacagaagcagaagaaagtactggttcctgaacagaagactgatcatcgaggaggacaccgagaacgagaacgagaagaagatctggtactacagcaccaaggtgcagctggccgagctgatcgactgcctggacaaggactactgggaggccgagctgtgcaagatcctggaggagatgagagaggagatccacagacacatggacatcaccgaggacctgaccaacaaggccagaggcagcaacaagagcttcctggccgccgccaacgaggagatcctggagagcatcagagccaagaagggcgacatcgacaacgtgaagagccccgaggagaccgagaaggacaagaacgagaccgagaacgacagcaaggacgccgagaagaacagagaggagttcgaggaccagagcctggagaaggacagcgacgacaagacccccgacgacgaccccgagcagggcaagagcgaggagcccaccgaggtgggcgacaagggcaacagcgtgagcgccaacctgggcgacaacaccaccaacgccaccagcgaggagaccagccccagcgagggcagaagccccgtgggctgcctgagcgagacccccgacagcagcaacatggccgagaagaaggtggccagcgagctgccccaggacgtgcccgaggagcccaacaagacctgcgagagcagcaacaccagcgccaccaccaccagcatccagcccaacctggagaacagcaacagcagcagcgagctgaacagcagccagagcgagagcgccaaggccgccgacgaccccgagaacggcgagagagagagccacacccccgtgagcatccaggaggagatcgtgggcgacttcaagagcgagaagagcaacggcgagctgagcgagagccccggcgccggcaagggcgccagcggcagcaccagaatcatcaccagactgagaaaccccgacagcaagctgagccagctgaagagccagcaggtggccgccgccgcccacgaggccaacaagctgttcaaggagggcaaggaggtgctggtggtgaacagccagggcgagatcagcagactgagcaccaagaaggaggtgatcatgaagggcaacatcaacaactacttcaagctgggccaggagggcaagtacagagtgtaccacaaccagtacagcaccaacagcttcgccctgaacaagcaccagcacagagaggaccacgacaagagaagacacctggcccacaagttctgcctgacccccgccggcgagttcaagtggaacggcagcgtgcacggcagcaaggtgctgaccatcagcaccctgagactgaccatcacccagctggagaacaacatccccagcagcttcctgcaccccaactgggccagccacagagccaactggatcaaggccgtgcagatgtgcagcaagcccagagagttcgccctggccctggccatcctggagtgcgccgtgaagcccgtggtgatgctgcccatctggagagagagcctgggccacaccagactgcacagaatgaccagcatcgagagagaggagaaggagaaggtgaagaagaaggagaagaagcaggaggaggaggagaccatgcagcaggccacctgggtgaagtacaccttccccgtgaagcaccaggtgtggaagcagaagggcgaggagtacagagtgaccggctacggcggctggagctggatcagcaagacccacgtgtacagattcgtgcccaagctgcccggcaacaccaacgtgaactacagaaagagcctggagggcaccaagaacaacatggacgagaacatggacgagagcgacaagagaaagtgcagcagaagccccaagaagatcaagatcgagcccgacagcgagaaggacgaggtgaagggcagcgacgccgccaagggcgccgaccagaacgagatggacatcagcaagatcaccgagaagaaggaccaggacgtgaaggagctgctggacagcgacagcgacaagccctgcaaggaggagcccatggaggtggacgacgacatgaagaccgagagccacgtgaactgccaggagagcagccaggtggacgtggtgaacgtgagcgagggcttccacctgagaaccagctacaagaagaagaccaagagcagcaagctggacggcctgctggagagaagaatcaagcagttcaccctggaggagaagcagagactggagaagatcaagctggagggcggcatcaagggcatcggcaagaccagcaccaacagcagcaagaacctgagcgagagccccgtgatcaccaaggccaaggagggctgccagagcgacagcatgagacaggagcagagccccaacgccaacaacgaccagcccgaggacctgatccagggctgcagcgagagcgacagcagcgtgctgagaatgagcgaccccagccacaccaccaacaagctgtaccccaaggacagagtgctggacgacgtgagcatcagaagccccgagaccaagtgccccaagcagaacagcatcgagaacgacatcgaggagaaggtgagcgacctggccagcagaggccaggagcccagcaagagcaagaccaagggcaacgacttcttcatcgacgacagcaagctggccagcgccgacgacatcggcaccctgatctgcaagaacaagaagcccctgatccaggaggagagcgacaccatcgtgagcagcagcaagagcgccctgcacagcagcgtgcccaagagcaccaacgacagagacgccacccccctgagcagagccatggacttcgagggcaagctgggctgcgacagcgagagcaacagcaccctggagaacagcagcgacaccgtgagcatccaggacagcagcgaggaggacatgatcgtgcagaacagcaacgagagcatcagcgagcagttcagaaccagagagcaggacgtggaggtgctggagcccctgaagtgcgagctggtgagcggcgagagcaccggcaactgcgaggacagactgcccgtgaagggcaccgaggccaacggcaagaagcccagccagcagaagaagctggaggagagacccgtgaacaagtgcagcgaccagatcaagctgaagaacaccaccgacaagaagaacaacgagaacagagagagcgagaagaagggccagagaaccagcaccttccagatcaacggcaaggacaacaagcccaagatctacctgaagggcgagtgcctgaaggagatcagcgagagcagagtggtgagcggcaacgtggagcccaaggtgaacaacatcaacaagatcatccccgagaacgacatcaagagcctgaccgtgaaggagagcgccatcagacccttcatcaacggcgacgtgatcatggaggacttcaacgagagaaacagcagcgagaccaagagccacctgctgagcagcagcgacgccgagggcaactacagagacagcctggagaccctgcccagcaccaaggagagcgacagcacccagaccaccacccccagcgccagctgccccgagagcaacagcgtgaaccaggtggaggacatggagatcgagaccagcgaggtgaagaaggtgaccagcagccccatcaccagcgaggaggagagcaacctgagcaacgacttcatcgacgagaacggcctgcccatcaacaagaacgagaacgtgaacggcgagagcaagagaaagaccgtgatcaccgaggtgaccaccatgaccagcaccgtggccaccgagagcaagaccgtgatcaaggtggagaagggcgacaagcagaccgtggtgagcagcaccgagaactgcgccaagagcaccgtgaccaccaccaccaccaccgtgaccaagctgagcacccccagcaccggcggcagcgtggacatcatcagcgtgaaggagcagagcaagaccgtggtgaccaccaccgtgaccgacagcctgaccaccaccggcggcaccctggtgaccagcatgaccgtgagcaaggagtacagcaccagagacaaggtgaagctgatgaagttcagcagacccaagaagaccagaagcggcaccgccctgcccagctacagaaagttcgtgaccaagagcagcaagaagagcatcttcgtgctgcccaacgacgacctgaagaagctggccagaaagggcggcatcagagaggtgccctacttcaactacaacgccaagcccgccctggacatctggccctaccccagccccagacccaccttcggcatcacctggagatacagactgcagaccgtgaagagcctggccggcgtgagcctgatgctgagactgctgtgggccagcctgagatgggacgacatggccgccaaggccccccccggcggcggcaccaccagaaccgagaccagcgagaccgagatcaccaccaccgagatcatcaagagaagagacgtgggcccctacggcatcagaagcgagtactgcatcagaaagatcatctgccccatcggcgtgcccgagacccccaaggagacccccaccccccagagaaagggcctgagaagcagcgccctgagacccaagagacccgagacccccaagcagaccggccccgtgatcatcgagacctgggtggccgaggaggagctggagctgtgggagatcagagccttcgccgagagagtggagaaggagaaggcccaggccgtggagcagcaggccaagaagagactggagcagcagaagcccaccgtgatcgccaccagcaccaccagccccaccagcagcaccaccagcaccatcagccccgcccagaaggtgatggtggcccccatcagcggcagcgtgaccaccggcaccaagatggtgctgaccaccaaggtgggcagccccgccaccgtgaccttccagcagaacaagaacttccaccagaccttcgccacctgggtgaagcagggccagagcaacagcggcgtggtgcaggtgcagcagaaggtgctgggcatcatccccagcagcaccggcaccagccagcagaccttcaccagcttccagcccagaaccgccaccgtgaccatcagacccaacaccagcggcagcggcggcaccaccagcaacagccaggtgatcaccggcccccagatcagacccggcatgaccgtgatcagaacccccctgcagcagagcaccctgggcaaggccatcatcagaacccccgtgatggtgcagcccggcgccccccagcaggtgatgacccagatcatcagaggccagcccgtgagcaccgccgtgagcgcccccaacaccgtgagcagcacccccggccagaagagcctgaccagcgccaccagcaccagcaacatccagagcagcgccagccagccccccagaccccagcagggccaggtgaagctgaccatggcccagctgacccagctgacccagggccacggcggcaaccagggcctgaccgtggtgatccagggccagggccagaccaccggccagctgcagctgatcccccagggcgtgaccgtgctgcccggccccggccagcagctgatgcaggccgccatgcccaacggcaccgtgcagagattcctgttcacccccctggccaccaccgccaccaccgccagcaccaccaccaccaccgtgagcaccaccgccgccggcaccggcgagcagagacagagcaagctgagcccccagatgcaggtgcaccaggacaagaccctgccccccgcccagagcagcagcgtgggccccgccgaggcccagccccagaccgcccagcccagcgcccagccccagccccagacccagccccagagccccgcccagcccgaggtgcagacccagcccgaggtgcagacccagaccaccgtgagcagccacgtgcccagcgaggcccagcccacccacgcccagagcagcaagccccaggtggccgcccagagccagccccagagcaacgtgcagggccagagccccgtgagagtgcagagccccagccagaccagaatcagacccagcacccccagccagctgagccccggccagcagagccaggtgcagaccaccaccagccagcccatccccatccagccccacaccagcctgcagatccccagccagggccagccccagagccagccccaggtggtgatgaagcacaacgccgtgatcgagcacctgaagcagaagaagagcatgacccccgccgagagagaggagaaccagagaatgatcgtgtgcaaccaggtgatgaagtacatcctggacaagatcgacaaggaggagaagcaggccgccaagaagagaaagagagaggagagcgtggagcagaagagaagcaagcagaacgccaccaagctgagcgccctgctgttcaagcacaaggagcagctgagagccgagatcctgaagaagagagccctgctggacaaggacctgcagatcgaggtgcaggaggagctgaagagagacctgaagatcaagaaggagaaggacctgatgcagctggcccaggccaccgccgtggccgccccctgcccccccgtgacccccgccccccccgccccccccgcccccccccccagccccccccccccccccgccgtgcagcacaccggcctgctgagcacccccaccctgcccgccgccagccagaagagaaagagagaggaggagaaggacagcagcagcaagagcaagaagaagaagatgatcagcaccaccagcaaggagaccaagaaggacaccaagctgtactgcatctgcaagaccccctacgacgagagcaagttctacatcggctgcgacagatgccagaactggtaccacggcagatgcgtgggcatcctgcagagcgaggccgagctgatcgacgagtacgtgtgcccccagtgccagagcaccgaggacgccatgaccgtgctgacccccctgaccgagaaggactacgagggcctgaagagagtgctgagaagcctgcaggcccacaagatggcctggcccttcctggagcccgtggaccccaacgacgcccccgactactacggcgtgatcaaggagcccatggacctggccaccatggaggagagagtgcagagaagatactacgagaagctgaccgagttcgtggccgacatgaccaagatcttcgacaactgcagatactacaaccccagcgacagccccttctaccagtgcgccgaggtgctggagagcttcttcgtgcagaagctgaagggcttcaaggccagcagaagccacaacaacaagctgcagagcaccgccagctag

SEQ ID NO: 10143 - DNA, 2628 bp, Artificial Sequence
  Description of Artificial Sequence: Synthetic coding sequence
atgaacttccaggccggcggcggccagagcccccagcagcagcagcagctggccggcggccccccccagcagttcgccctgagcaacagcgccgccatcagagccgagatccagagattcgagagcgtgcaccccaacatctacgccatctacgacctgatcgagagaatcgaggacctggccctgcagaaccagatcagagagcacgtgatcagcatcgaggacagcttcgtgaacagccaggagtggaccctgagcagaagcgtgcccgagctgaaggtgggcatcgtgggcaacctgagcagcggcaagagcgccctggtgcacagatacctgaccggcacctacgtgcaggaggagagccccgagggcggcagattcaagaaggagatcgtggtggacggccagagctacctgctgctgatcagagacgagggcggcccccccgagctgcagttcgccgcctgggtggacgccgtggtgttcgtgttcagcctggaggacgagatcagcttccagaccgtgtacaactacttcctgagactgtgcagcttcagaaacgccagcgaggtgcccatggtgctggtgggcacccaggacgccatcagcgccgccaaccccagagtgatcgacgacagcagagccagaaagctgagcaccgacctgaagagatgcacctactacgagacctgcgccacctacggcctgaacgtggagagagtgttccaggacgtggcccagaaggtggtggccctgagaaagaagcagcagctggccatcggcccctgcaagagcctgcccaacagccccagccacagcgccgtgagcgccgccagcatccccgccgtgcacatcaaccaggccaccaacggcggcggcagcgccttcagcgactacagcagcagcgtgcccagcacccccagcatcagccagagagagctgagaatcgagaccatcgccgccagcagcacccccacccccatcagaaagcagagcaagagaagaagcaacatcttcaccagcagaaagggcgccgacctggacagagagaagaaggccgccgagtgcaaggtggacagcatcggcagcggcagagccatccccatcaagcagggcatcctgctgaagagaagcggcaagagcctgaacaaggagtggaagaagaagtacgtgaccctgtgcgacaacggcctgctgacctaccaccccagcctgcacgactacatgcagaacatccacggcaaggagatcgacctgctgagaaccaccgtgaaggtgcccggcaagagactgcccagagccacccccgccaccgcccccggcaccagccccagagccaacggcctgagcgtggagagaagcaacacccagctgggcggcggcaccggcgccccccacagcgccagcagcgccagcctgcacagcgagagacccctgagcagcagcgcctgggccggccccagacccgagggcctgcaccagagaagctgcagcgtgagcagcgccgaccagtggagcgaggccaccaccagcctgccccccggcatgcagcaccccgccagcggccccgccgaggtgctgagcagcagccccaagctggaccccccccccagcccccacagcaacagaaagaagcacagaagaaagaagagcaccggcacccccagacccgacggccccagcagcgccaccgaggaggccgaggagagcttcgagttcgtggtggtgagcctgaccggccagacctggcacttcgaggccagcaccgccgaggagagagagctgtgggtgcagagcgtgcaggcccagatcctggccagcctgcagggctgcagaagcgccaaggacaagaccagactgggcaaccagaacgccgccctggccgtgcaggccgtgagaaccgtgagaggcaacagcttctgcatcgactgcgacgcccccaaccccgactgggccagcctgaacctgggcgccctgatgtgcatcgagtgcagcggcatccacagacacctgggcgcccacctgagcagagtgagaagcctggacctggacgactggccccccgagctgctggccgtgatgaccgccatgggcaacgccctggccaacagcgtgtgggagggcgccctgggcggctacagcaagcccggccccgacgcctgcagagaggagaaggagagatggatcagagccaagtacgagcagaagctgttcctggcccccctgcccagcagcgacgtgcccctgggccagcagctgctgagagccgtggtggaggacgacctgagactgctggtgatgctgctggcccacggcagcaaggaggaggtgaacgagacctacggcgacggcgacggcagaaccgccctgcacctgagcagcgccatggccaacgtggtgttcacccagctgctgatctggtacggcgtggacgtgagaagcagagacgccagaggcctgacccccctggcctacgccagaagagccggcagccaggagtgcgccgacatcctgatccagcacggctgccccggcgagggctgcggcctggcccccacccccaacagagagcccgccaacggcaccaaccccagcgccgagctgcacagaagccccagcctgctgtag

SEQ ID NO: 10144 - DNA, 1761 bp, Artificial Sequence
  Description of Artificial Sequence: Synthetic coding sequence
atgggcggcgccctgggcctgagacagctgcccatctgcgcccccgcctgcagacccagcagcggccacagcccctgggccgccgccagccccaaccccaaccagtggagcagcagaagcagatggtgctgcctgagaagaagcgaggccagaagaagctgcagacccgtgggcagagccgcccccggccccaccagagccatggccagacccgccaccagcaccagaagaagcgcctgcccccccctgacccccacccccgccctgagaatcgcctggagactgctgagcgccaccagcagaaccagcagaatggccagcgtgctgagcagaggcagagtgagatgcccctggcacggcgcctgcttcaacatcagcaccggcgacctggaggacttccccggcctggacagcctgcacaagttccaggtgaagatcgagaaggagaaggtgtacgtgagagccagcaagcaggccctgcagctgcagagaagaaccaaggtgatggccaagtgcatcagccccagcgccggctacagcagcagcaccaacgtgctgatcgtgggcgccggcgccgccggcctggtgtgcgccgagaccctgagacaggagggcttcagcgacagaatcgtgctgtgcaccctggacagacacctgccctacgacagacccaagctgagcaagagcctggacacccagcccgagcagctggccctgagacccaaggagttcttcagagcctacggcatcgaggtgctgaccgaggcccaggtggtgaccgtggacgtgagaaccaagaaggtggtgttcaaggacggcttcaagctggagtacagcaagctgctgctggcccccggcagcagccccaagaccctgagctgcaagggcaaggaggtggagaacgtgttcaccatcagaacccccgaggacgccaacagagtggtgagactggccagaggcagaaacgtggtggtggtgggcgccggcttcctgggcatggaggtggccgcctacctgaccgagaaggcccacagcgtgagcgtggtggagctggaggagacccccttcagaagattcctgggcgagagagtgggcagagccctgatgaagatgttcgagaacaacagagtgaagttctacatgcagaccgaggtgagcgagctgagaggccaggagggcaagctgaaggaggtggtgctgaagagcagcaaggtggtgagagccgacgtgtgcgtggtgggcatcggcgccgtgcccgccaccggcttcctgagacagagcggcatcggcctggacagcagaggcttcatccccgtgaacaagatgatgcagaccaacgtgcccggcgtgttcgccgccggcgacgccgtgaccttccccctggcctggagaaacaacagaaaggtgaacatcccccactggcagatggcccacgcccagggcagagtggccgcccagaacatgctggcccaggaggccgagatgagcaccgtgccctacctgtggaccgccatgttcggcaagagcctgagatacgccggctacggcgagggcttcgacgacgtgatcatccagggcgacctggaggagctgaagttcgtggccttctacaccaagggcgacgaggtgatcgccgtggccagcatgaactacgaccccatcgtgagcaaggtggccgaggtgctggccagcggcagagccatcagaaagagagaggtggagaccggcgacatgagctggctgaccggcaagggcagctag

SEQ ID NO: 10145 - DNA, 1521 bp, Artificial Sequence
  Description of Artificial Sequence: Synthetic coding sequence
atgcccgtgcaggccgcccagtggaccgagttcctgagctgccccatctgctacaacgagttcgacgagaacgtgcacaagcccatcagcctgggctgcagccacaccgtgtgcaagacctgcctgaacaagctgcacagaaaggcctgccccttcgaccagaccgccatcaacaccgacatcgacgtgctgcccgtgaacttcgccctgctgcagctggtgggcgcccaggtgcccgaccaccagagcatcaagctgagcaacctgggcgagaacaagcactacgaggtggccaagaagtgcgtggaggacctggccctgtacctgaagcccctgagcggcggcaagggcgtggccagcctgaaccagagcgccctgagcagacccatgcagagaaagctggtgaccctggtgaactgccagctggtggaggaggagggcagagtgagagccatgagagccgccagaagcctgggcgagagaaccgtgaccgagctgatcctgcagcaccagaacccccagcagctgagcgccaacctgtgggccgccgtgagagccagaggctgccagttcctgggccccgccatgcaggaggaggccctgaagctggtgctgctggccctggaggacggcagcgccctgagcagaaaggtgctggtgctgttcgtggtgcagagactggagcccagattcccccaggccagcaagaccagcatcggccacgtggtgcagctgctgtacagagccagctgcttcaaggtgaccaagagagacgaggacagcagcctgatgcagctgaaggaggagttcagaagctacgaggccctgagaagagagcacgacgcccagatcgtgcacatcgccatggaggccggcctgagaatcagccccgagcagtggagcagcctgctgtacggcgacctggcccacaagagccacatgcagagcatcatcgacaagctgcagagccccgagagcttcgccaagagcgtgcaggagctgaccatcgtgctgcagagaaccggcgaccccgccaacctgaacagactgagaccccacctggagctgctggccaacatcgaccccaaccccgacgccgtgagccccacctgggagcagctggagaacgccatggtggccgtgaagaccgtggtgcacggcctggtggacttcatccagaactacagcagaaagggccacgagaccccccagccccagcccaacagcaagtacaagaccagcatgtgcagagacctgagacagcagggcggctgccccagaggcaccaactgcaccttcgcccacagccaggaggagctggagaagtgcaaccccagaggcctgtacctgcactgctgcctgctgagcagcgtggccagcctgggcaccgtgcacaacgagctgtacaagcagcagcactgcgacagagagaagatcagcgtgtgcgccgtgaagagagccgagacctgcttcagcagccagttcttcagccccctggaggtgcccagagaggaggactag

SEQ ID NO: 10146 - DNA, 783 bp, Artificial Sequence
  Description of Artificial Sequence: Synthetic coding sequence
atgcccagagccagaagcggcagaagaagcagaggcgccggcggcagagaggagaccttcctgagagtgagagccaacagacagaccagactgaacgccagaatcggcaagatgaagagaagaaagcaggacgagggccaggtgtgccccctgtgcaacagacccctggccggcagcgagcaggagatgagcagacacgtggagcactgcctgagcaagagagagggcagctgcatggccgaggacgacgccgtggacatcgagcacgagaacaacaacagattcgaggagtacgagtggtgcggccagaagagaatcagagccaccaccctgctggagggcggcttcagaggcagcggcttcatcatgtgcagcggcaaggagaaccccgacagcgacgccgacctggacgtggacggcgacgacaccctggagtacggcaagccccagtacaccgaggccgacgtgatcccctgcaccggcgaggagcccggcgaggccaaggagagagaggccctgagaggcgccgtgctgaacggcggcccccccagcaccagaatcacccccgagttcagcaagtgggccagcgacgagatgcccagcaccagcaacggcgagagcagcaagcaggaggccatgcagaagacctgcaagaacagcgacatcgagaagatcaccgaggacagcgccgtgaccaccttcgaggccctgaaggccagagtgagagagctggagagacagctgagcagaggcgacagatacaagtgcctgatctgcatgtag

SEQ ID NO: 10147 - DNA, 1461 bp, Artificial Sequence
  Description of Artificial Sequence: Synthetic coding sequence
atggccgccgtgaagaccctgaaccccaaggccgaggtggccagagcccaggccgccctggccgtgaacatcagcgccgccagaggcctgcaggacgtgctgagaaccaacctgggccccaagggcaccatgaagatgctggtgagcggcgccggcgacatcaagctgaccaaggacggcaacgtgctgctgcacgagatgggcctgcaccccagaatcatcaccgagggcttcgaggccgccaaggagaaggccctgcagttcctggaggaggtgaaggtgagcagagagatggacagagagaccctgatcgacgtggccagaaccagcctgagaaccaaggtgcacgccgagctggccgacgtgctgaccgaggccgtggtggacagcatcctggccatcaagaagcaggacgagcccatcgacctgttcatgatcgagatcatggagatgaagcacaagagcgagaccgacaccagcctgatcagaggcctggtgctggaccacggcgccagacaccccgacatgaagaagagagtggaggacgcctacatcctgacctgcaacgtgagcctggagtacgagaagaccgaggtgaacagcggcttcttctacaagagcgccgaggagagagagaagctggtgaaggccgagagaaagttcatcgaggacagagtgaagaagatcatcgagctgaagagaaaggtgtgcggcgacagcgacaagggcttcgtggtgatcaaccagaagggcatcgaccccttcagcctggacgccctgagcaaggagggcatcgtggccctgagaagagccaagagaagaaacatggagagactgaccctggcctgcggcggcgtggccctgaacagcttcgacgacctgagccccgactgcctgggccacgccggcctggtgtacgagtacaccctgggcgaggagaagttcaccttcatcgagaagtgcaacaaccccagaagcgtgaccctgctgatcaagggccccaacaagcacaccctgacccagatcaaggacgccgtgagagacggcctgagagccgtgaagaacgccatcgacgacggctgcgtggtgcccggcgccggcgccgtggaggtggccatggccgaggccctgatcaagcacaagcccagcgtgaagggcagagcccagctgggcgtgcaggccttcgccgacgccctgctgatcatccccaaggtgctggcccagaacagcggcttcgacctgcaggagaccctggtgaagatccaggccgagcacagcgagagcggccagctggtgggcgtggacctgaacaccggcgagcccatggtggccgccgaggtgggcgtgtgggacaactactgcgtgaagaagcagctgctgcacagctgcaccgtgatcgccaccaacatcctgctggtggacgagatcatgagagccggcatgagcagcctgaagggctag

SEQ ID NO: 10148 - DNA, 1407 bp, Artificial Sequence
  Description of Artificial Sequence: Synthetic coding sequence
atgagcttcagactgagcggcggcagcagaagaatctgcagcagaaccggcagcggcagactgagcggcggcggcaccggcttcgtggccggcaacgtgtgcgtgggcagcggcgccagaagcagcttcagctgcaccctggagggcatcagcagcggcggcagcttctgcaacagcggcggcggcctgggcagcggcgcctgcgccggcttcctgggcaacgagcacagcctgctgagcggcaacgagaaggtgaccatgcagaacctgaacgacagactggccagctacctggaccacgtgcacgccctggaggaggccaacgccgacctggagcagaagatcaagggctggtacgagaagtgcgagcccggcagcagcagagagcacgaccacgactacagcagatacttcagcgtgatcgaggacctgaagagacagatcatcagcgccaccatctgcaacgccagcatcgtgctgcagaacgacaacgccagactgaccgccgacgacttcagactgaagtacgagaacgagctggccctgcaccacagcgtggaggccgacaccagcggcctgagaagagtgctggacgagctgaccctgtgcaccaccgacctggagatccagtgcgagaccctgagcgaggagctgacctacctgaagaagagccacgaggaggagatggaggtgctgcagtacaccgccggcggcaacgtgaacgtggagatgaacgccacccccggcgtggacctgaccgtgctgctgaacaacatgagagccgagtacgaggacctggccgagcagaacagaaaggacgccgaggcctggttcaacgagagaagcgccaccctgcagcagcagatcagcgaccacgagggcgccgccaccgccgccagaaacgagctgaccgagctgaagagaaacctgcagaccctggagatcgagctgcagagcctgatggccgtgaagcacagctacgagtgcagcctggccgagaccgagggcaactactgcaaccagctgcagcagatccaggaccagatcggcgtgatggaggagcagctgcagcagatcagaaccgagaccgagggccagaagctggagtacgagcagctgctggacgtgaagatcttcctggagaaggagatcgacatctactgcaacctgctggacggcgaggagagaaagagcaagagcacctgctacaagagcaagggctacagacccgtgaacagcggcaaccaggccaaggacagcaccgaggagaccatcgtgaagaccgtggtggaggagctggaccagatcggcaacctgctgagcctgagagtgcacagcgtggaggagaagagcagcaagatcagcaacatcaccgtggagcagagagtgcccagcaaggccccctag

SEQ ID NO: 10149 - DNA, 816 bp, Artificial Sequence; identical to SEQ ID NO: 10085
  Description of Artificial Sequence: Synthetic coding sequence

SEQ ID NO: 10150 - DNA, 753 bp, Artificial Sequence
  Description of Artificial Sequence: Synthetic coding sequence
atgagcgagaacgccgcccccgacttctactacgtggccatggacttcggcggccacggcctgagcagccactacagccccggcgtgccctactacctgcagaccttcgtgagcgagatcagaagagtggtggccggcggcgtggtgggcggcatgttcttctgcaccttccccgagatggtggacaagctgatcctgctggacacccccctgttcctgctggagagcgacgagatggagaacctgctgacctacaagagaagagccatcgagcacgtgctgcaggtggaggccagccaggagcccagccacgtgttcagcctgaagcagctgctgcagagactgctgaagagcaacagccacctgagcgaggagtgcggcgagctgctgctgcagagaggcaccaccaaggtggccaccggcctggtgctgaacagagaccagagactggcctgggccgagaacagcatcgacttcatcagcagagagctgtgcgcccacagcatcagaaagctgcaggcccacgtgctgctgatcaaggccgtgcacggctacttcgacagcagacagaactacagcgagaaggagagcctgagcttcatgatcgacaccatgaagagcaccctgaaggagcagttccagttcgtggaggtgcccggcaaccactgcgtgcacatgagcgagccccagcacgtggccagcatcatcagcagcttcctgcagtgcacccacatgctgcccgcccagctgtag

SEQ ID NO: 10151 - DNA, 510 bp, Artificial Sequence
  Description of Artificial Sequence: Synthetic coding sequence
atggtgttccccctgcccaccccccaggagcccatcatggccaccccccccaagagaagagccgtggaggccaccggcgagaaggtgctgagatacgagaccttcatcagcgacgtgctgcagagagacctgagaaaggtgctggaccacagagacaaggtgtacgagcagctggccaagtacctgcagctgagaaacgtgatcgagagactgcaggaggccaagcacagcgagctgtacatgcaggtggacctgggctgcaacttcttcgtggacaccgtggtgcccgacaccagcagaatctacgtggccctgggctacggcttcttcctggagctgaccctggccgaggccctgaagttcatcgacagaaagagcagcctgctgaccgagctgagcaacagcctgaccaaggacagcatgaacatcaaggcccacatccacatgctgctggagggcctgagagagctgcagggcctgcagaacttccccgagaagccccaccactag

SEQ ID NO: 10152 - DNA, 3177 bp, Artificial Sequence
  Description of Artificial Sequence: Synthetic coding sequence
atgaccaccgtggtggtgcacgtggacagcaaggccgagctgaccaccctgctggagcagtgggagaaggagcacggcagcggccaggacatggtgcccatcctgaccagaatgagccagctgatcgagaaggagaccgaggagtacagaaagggcgaccccgaccccttcgacgacagacaccccggcagagccgaccccgagtgcatgctgggccacctgctgagaatcctgttcaagaacgacgacttcatgaacgccctggtgaacgcctacgtgatgaccagcagagagccccccctgaacaccgccgcctgcagactgctgctggacatcatgcccggcctggagaccgccgtggtgttccaggagaaggagggcatcgtggagaacctgttcaagtgggccagagaggccgaccagcccctgagaacctacagcaccggcctgctgggcggcgccatggagaaccaggacatcgccgccaactacagagacgagaacagccagctggtggccatcgtgctgagaagactgagagagctgcagctgcaggaggtggccctgagacaggagaacaagagacccagccccagaaagctgagcagcgagcccctgctgcccctggacgaggaggccgtggacatggactacggcgacatggccgtggacgacgccgagatccagaagagcgccctgcagatcatcatcaactgcgtgtgcggccccgacaacagaatcagcagcatcggcaagttcatcagcggcacccccagaagaaagctgccccagaaccccaagagcagcgagcacaccctggccaagatgtggaacgtggtgcagagcaacaacggcatcaaggtgctgctgagcctgctgagcatcaagatgcccatcaccgacgccgaccagatcagagccctggcctgcaaggccctggtgggcctgagcagaagcagcaccgtgagacagatcatcagcaagctgcccctgttcagcagctgccagatccagcagctgatgaaggagcccgtgctgcaggacaagagaagcgaccacgtgaagttctgcaagtacgccgccgagctgatcgagagagtgagcggcaagcccctgctgatcggcaccgacgtgagcctggccagactgcagaaggccgacgtggtggcccagagcagaatcagcttccccgagaaggagctgctgctgctgatcagaaaccacctgatcagcaagggcctgggcgagaccgccaccgtgctgaccaaggaggccgacctgcccatgaccgccgccagccacagcagcgccttcacccccgtgaccgccgccgccagccccgtgagcctgcccagaacccccagaatcgccaacggcatcgccaccagactgggcagccacgccgccgtgggcgccagcgcccccagcgcccccaccgcccacccccagcccagacccccccagggccccctggccctgcccggccccagctacgccggcaacagccccctgatcggcagaatcagcttcatcagagagagacccagcccctgcaacggcagaaagatcagagtgctgagacagaagagcgaccacggcgcctacagccagagccccgccatcaagaagcagctggacagacacctgcccagcccccccaccctggacagcatcatcaccgagtacctgagagagcagcacgccagatgcaagaaccccgtggccacctgcccccccttcagcctgttcaccccccaccagtgccccgagcccaagcagagaagacaggcccccatcaacttcaccagcagactgaacagaagagccagcttccccaagtacggcggcgtggacggcggctgcttcgacagacacctgatcttcagcagattcagacccatcagcgtgttcagagaggccaacgaggacgagagcggcttcacctgctgcgccttcagcgccagagagagattcctgatgctgggcacctgcaccggccagctgaagctgtacaacgtgttcagcggccaggaggaggccagctacaactgccacaacagcgccatcacccacctggagcccagcagagacggcagcctgctgctgaccagcgccacctggagccagcccctgagcgccctgtggggcatgaagagcgtgttcgacatgaagcacagcttcaccgaggaccactacgtggagttcagcaagcacagccaggacagagtgatcggcaccaagggcgacatcgcccacatctacgacatccagaccggcaacaagctgctgaccctgttcaaccccgacctggccaacaactacaagagaaactgcgccaccttcaaccccaccgacgacctggtgctgaacgacggcgtgctgtgggacgtgagaagcgcccaggccatccacaagttcgacaagttcaacatgaacatcagcggcgtgttccaccccaacggcctggaggtgatcatcaacaccgagatctgggacctgagaaccttccacctgctgcacaccgtgcccgccctggaccagtgcagagtggtgttcaaccacaccggcaccgtgatgtacggcgccatgctgcaggccgacgacgaggacgacctgatggaggagagaatgaagagccccttcggcagcagcttcagaaccttcaacgccaccgactacaagcccatcgccaccatcgacgtgaagagaaacatcttcgacctgtgcaccgacaccaaggactgctacctggccgtgatcgagaaccagggcagcatggacgccctgaacatggacaccgtgtgcagactgtacgaggtgggcagacagagactggccgaggacgaggacgaggaggaggaccaggaggaggaggagcaggaggaggaggacgacgacgaggacgacgacgacaccgacgacctggacgagctggacaccgaccagctgctggaggccgagctggaggaggacgacaacaacgagaacgccggcgaggacggcgacaacgacttcagccccagcgacgaggagctggccaacctgctggaggagggcgaggacggcgaggacgaggacagcgacgccgacgaggaggtggagctgatcctgggcgacaccgacagcagcgacaacagcgacctggaggacgacatcatcctgagcctgaacgagtag

SEQ ID NO: 10153 - DNA, 2409 bp, Artificial Sequence
  Description of Artificial Sequence: Synthetic coding sequence
atggccgccgaggccctggccgccgaggccgtggccagcagactggagagacaggaggaggacatcagatggctgtggagcgaggtggagagactgagagacgagcagctgaacgccccctacagctgccaggccgagggcccctgcctgaccagagaggtggcccagctgagagccgagaactgcgacctgagacacagactgtgcagcctgagactgtgcctggccgaggagagaagcagacaggccaccctggagagcgccgagctggaggccgcccaggaggccggcgcccagcccccccccagccagagccaggacaaggacatgaagaagaagaagatgaaggagagcgaggccgacagcgaggtgaagcaccagcccatcttcatcaaggagagactgaagctgttcgagatcctgaagaaggaccaccagctgctgctggccatctacggcaagaagggcgacaccagcaacatcatcaccgtgagagtggccgacggccagaccgtgcagggcgaggtgtggaagaccaccccctaccaggtggccgccgagatcagccaggagctggccgagagcaccgtgatcgccaaggtgaacggcgagctgtgggacctggacagacccctggagggcgacagcagcctggagctgctgaccttcgacaacgaggaggcccaggccgtgtactggcacagcagcgcccacatcctgggcgaggccatggagctgtactacggcggccacctgtgctacggcccccccatcgagaacggcttctactacgacatgttcatcgaggacagagccgtgagcagcaccgagctgagcgccctggagaacatctgcaaggccatcatcaaggagaagcagcccttcgagagactggaggtgagcaaggagatcctgctggagatgttcaagtacaacaagttcaagtgcagaatcctgaacgagaaggtgaacaccgccaccaccaccgtgtacagatgcggccccctgatcgacctgtgcaagggcccccacgtgagacacaccggcaagatcaagaccatcaagatcttcaagaacagcagcacctactgggagggcaaccccgagatggagaccctgcagagaatctacggcatcagcttccccgacaacaagatgatgagagactgggagaagttccaggaggaggccaagaacagagaccacagaaagatcggcaaggagcaggagctgttcttcttccacgacctgagccccggcagctgcttcttcctgcccagaggcgccttcatctacaacaccctgaccgacttcatcagagaggagtaccacaagagagacttcaccgaggtgctgagccccaacatgtacaacagcaagctgtgggaggccagcggccactggcagcactacagcgagaacatgttcaccttcgagatcgagaaggacaccttcgccctgaagcccatgaactgccccggccactgcctgatgttcgcccacagacccagaagctggagagagatgcccatcagattcgccgacttcggcgtgctgcacagaaacgagctgagcggcaccctgagcggcctgaccagagtgagaagattccagcaggacgacgcccacatcttctgcaccgtggagcagatcgaggaggagatcaagggctgcctgcagttcctgcagagcgtgtacagcaccttcggcttcagcttccagctgaacctgagcaccagacccgagaacttcctgggcgagatcgagatgtggaacgaggccgagaagcagctgcagaacagcctgatggacttcggcgagccctggaagatgaaccccggcgacggcgccttctacggccccaagatcgacatcaagatcaaggacgccatcggcagataccaccagtgcgccaccatccagctggacttccagctgcccatcagattcaacctgacctacgtgagcaaggacggcgacgacaagaagagacccgtgatcatccacagagccatcctgggcagcgtggagagaatgatcgccatcctgagcgagaactacggcggcaagtggcccttctggctgagccccagacaggtgatggtgatccccgtgggccccacctgcgagaagtacgccctgcaggtgagcagcgagttcttcgaggagggcttcatggccgacgtggacctggaccacagctgcaccctgaacaagaagatcagaaacgcccagctggcccagtacaacttcatcctggtggtgggcgagaaggagaagatcgacaacgccgtgaacgtgagaaccagagacaacaagatccacggcgagatcctggtgaccagcgccatcgacaagctgaagaacctgagaaagaccagaaccctgaacgccgaggaggccttctag

SEQ ID NO: 10154 - DNA, 1149 bp, Artificial Sequence
  Description of Artificial Sequence: Synthetic coding sequence
atgttcaagatccagctggagcccctgaagctgagagcctggaccctgaacggcttcgtgaagttcagaaacaaggagaccagcgccggccccgtggccgtgatgggcaaggactactacaagatcctgggcatccccagcggcgccaacgaggacgagatcaagaaggcctacagaaagatggccctgaagtaccaccccgacaagaacaaggagcccaacgccgaggagaagttcaaggagatcgccgaggcctacgacgtgctgagcgaccccaagaagagaggcctgtacgaccagtacggcgaggagggcctgaagaccggcggcggcaccagcggcggcagcagcggcagcttccactacaccttccacggcgacccccacgccaccttcgccagcttcttcggcggcagcaaccccttcgacatcttcttcgccagcagcagaagcaccagacccttcagcggcttcgaccccgacgacatggacgtggacgaggacgaggaccccttcggcgccttcggcagattcggcttcaacggcctgagcagaggccccagaagagcccccgagcccctgtaccccagaagaaaggtgcaggacccccccgtggtgcacgagctgagagtgagcctggaggagatctaccacggcagcaccaagagaatgaagatcaccagaagaagactgaaccccgacggcagaaccgtgagaaccgaggacaagatcctgcacatcgtgatcaagagaggctggaaggagggcaccaagatcaccttccccaaggagggcgacgccacccccgacaacatccccgccgacatcgtgttcgtgctgaaggacaagccccacgcccacttcagaagagacggcaccaacgtgctgtacagcgccctgatcagcctgaaggaggccctgtgcggctgcaccgtgaacatccccaccatcgacggcagagtgatccccctgccctgcaacgacgtgatcaagcccggcaccgtgaagagactgagaggcgagggcctgcccttccccaaggtgcccacccagagaggcgacctgatcgtggagttcaaggtgagattccccgacagactgaccccccagaccagacagatcctgaagcagcacctgccctgcagctag

SEQ ID NO: 10155 - DNA, 1356 bp, Artificial Sequence
  Description of Artificial Sequence: Synthetic coding sequence
atgagagagtgcatcagcatccacgtgggccaggccggcgtgcagatcggcaacgcctgctgggagctgtactgcctggagcacggcatccagcccgacggccagatgcccagcgacaagaccatcggcggcggcgacgacagcttcaacaccttcttcagcgagaccggcgccggcaagcacgtgcccagagccgtgttcgtggacctggagcccaccgtgatcgacgaggtgagaaccggcacctacagacagctgttccaccccgagcagctgatcaccggcaaggaggacgccgccaacaactacgccagaggccactacaccatcggcaaggagatcatcgacctggtgctggacagaatcagaaagctggccgaccagtgcaccggcctgcagggcttcctggtgttccacagcttcggcggcggcaccggcagcggcttcaccagcctgctgatggagagactgagcgtggactacggcaagaagagcaagctggagttcagcatctaccccgccccccaggtgagcaccgccgtggtggagccctacaacagcatcctgaccacccacaccaccctggagcacagcgactgcgccttcatggtggacaacgaggccatctacgacatctgcagaagaaacctggacatcgagagacccacctacaccaacctgaacagactgatcagccagatcgtgagcagcatcaccgccagcctgagattcgacggcgccctgaacgtggacctgaccgagttccagaccaacctggtgccctaccccagaatccacttccccctggccacctacgcccccgtgatcagcgccgagaaggcctaccacgagcagctgagcgtggccgagatcaccaacgcctgcttcgagcccgccaaccagatggtgaagtgcgaccccagacacggcaagtacatggcctgctgcctgctgtacagaggcgacgtggtgcccaaggacgtgaacgccgccatcgccaccatcaagaccaagagaagcatccagttcgtggactggtgccccaccggcttcaaggtgggcatcaactaccagccccccaccgtggtgcccggcggcgacctggccaaggtgcagagagccgtgtgcatgctgagcaacaccaccgccatcgccgaggcctgggccagactggaccacaagttcgacctgatgtacgccaagagagccttcgtgcactggtacgtgggcgagggcatggaggagggcgagttcagcgaggccagagaggacatggccgccctggagaaggactacgaggaggtgggcgtggacagcgtggagggcgagggcgaggaggagggcgaggagtactag

SEQ ID NO: 10156 - DNA, 444 bp, Artificial Sequence
  Description of Artificial Sequence: Synthetic coding sequence
tgaaccgccagaggccccgagcccgagcagatgggcctggccccctgctgcacccaggccctgtgcggcctggccctgagacaccacagccacctgcagcagatcagactggagttccacagactgagcgaggagaacaccctgctgaagaacgacctgggcagagtgagacaggagctggaggccgccgagagcacccacgacgcccagagaaaggagatcgaggtgctgaagaaggacaaggagaaggcctgcagcgagatggaggtgctgaacagacagaaccagaactacaaggaccagctgagccagctgaacgtgagagtgctgcagctgggccaggaggccagcacccaccaggcccagaacgaggagcacagagtgaccatccagatgctgacccagagcctggaggaggtggtgagaagcggccagcagcagtag

SEQ ID NO: 10157 - DNA, 771 bp, Artificial Sequence
  Description of Artificial Sequence: Synthetic coding sequence
atggccacccagagaaagcacctggtgaaggacttcaacccctacatcacctgctacatctgcaagggctacctgatcaagcccaccaccgtgaccgagtgcctgcacaccttctgcaagacctgcatcgtgcagcacttcgaggacagcaacgactgccccagatgcggcaaccaggtgcacgagaccaaccccctggagatgctgagactggacaacaccctggaggagatcatcttcaagctggtgcccggcctgagagagcaggagctggagagagagagcgagttctggaagaagaacaagccccaggagaacggccaggacgacaccagcaaggccgacaagcccaaggtggacgaggagggcgacgagaacgaggacgacaaggactaccacagaagcgacccccagatcgccatctgcctggactgcctgagaaacaacggccagagcggcgacaacgtggtgaagggcctgatgaagaagttcatcagatgcagcaccagagtgaccgtgggcaccatcaagaagttcctgagcctgaagctgaagctgcccagcagctacgagctggacgtgctgtgcaacggcgagatcatgggcaaggaccacaccatggagttcatctacatgaccagatggagactgagaggcgagaacttcagatgcctgaactgcagcgccagccaggtgtgcagccaggacggccccctgtaccagagctaccccatggtgctgcagtacagacccagaatcgacttcggctag

SEQ ID NO: 10158 - DNA, 6672 bp, Artificial Sequence
  Description of Artificial Sequence: Synthetic coding sequence
atggcccccaagaaggagaagggcggcaccgtgaacaccagcagcaagatctgggagcccagcctgatcgccgcccagttcaaccagaacgactggcaggccagcatcgccttcgtggtgggcaaccagatcgaggacgacctgctgatccaggccctgaccgtggccgtgcaggtgccccagagaaagctgttcagcatggtgagctggcaggacatcctgcagcagatcaacgagatcaacaccctggtgggcagcgccagcagcaagaaggccaagaagcccgtgggcggcaacgcccccctgtactacgaggtgctgaccgccgccaaggccatcatggacagcggcgagaagctgaccctgcccctgatcggcaagctgctgaagttccagctgctgcagatcaagttcaaggaccagcagagaagagagaacgagaagaaggtgatcgaggacaagcccaagctggagaaggacaagggcaaggccaagagccccaaggagaagaaggcccccagcgccaagcccgccaagggcaagggcaaggaccagcccgaggccaacgcccccgtgaagaagaccacccagctgaagagaagaggcgaggacgaccacaccaacagatacatcgacgacgagcccgacgacggcgcccagcactacatcatcgtggtgggcttcaacaacccccagctgctggccatcatggccgagctgggcatccccatcaccagcgtgatcaagatcagcagcgagaactacgagcccctgcagacccacctggccgccgtgaaccagcagcaggaggtgctgctgcagagcgaggacctggaggccgagaagctgaagaaggagaacgccatcaaggagctgaagaccttctggaagtacctggagcccgtgctgaacaacgagaagcccgagaccaacctgttcgacgtggccagactggagtacatggtgaaggccgccgacttccccagcgactggagcgacggcgagatgatgctgaagctgggcaccgacatcttcgagaacatcgcctgcctgatgtacgacatcctggactggaagagacagcaccagcactacctggagagcatgcagctgatcaacgtgccccaggtggtgaacgagaagcccgtgctggaggccatgcccaccagcgaggccccccagcccgccgtgcccgcccccggcaagaagaaggcccagtacgaggagccccaggcccccccccccgtgaccagcgtgatcaccaccgaggtggacatgagatactacaactacctgctgaaccccatcagagaggagttcatcagcgtgcccctgatcctgcactgcatgctggagcaggtggtggccaccgaggaggacctggtgccccccagcctgagagagcccagccccagagccgacggcctggaccacagaatcgccgcccacatcgtgagcctgctgcccagcctgtgcctgagcgagagagagaagaagaacctgcacgacatcttcctgagcgaggaggagaacgagagcaaggccgtgcccaagggccccctgctgctgaactaccacgacgcccacgcccacaagaagtacgccctgcaggaccagaagaacttcgaccccgtgcagatcgagcaggagatgcagagcaagctgcccctgtgggagttcctgcagttccccctgccccccccctggaacaacaccaagagactggccaccatccacgagctgatgcacttctgcaccagcgacgtgctgagctggaacgaggtggagagagccttcaaggtgttcaccttcgagagcctgaagctgagcgaggtggacgagaagggcaagctgaagcccagcggcatgatgtgcggcagcgacagcgagatgttcaacatcccctgggacaaccccgccagattcgccaagcagatcagacagcagtacgtgatgaagatgaacacccaggaggccaagcagaaggccgacatcaagatcaaggacagaaccctgttcgtggaccagaacctgagcatgagcgtgcaggacaacgagagcaacagagagcccagcgaccccagccagtgcgacgccaacaacatgaagcacagcgacctgaacaacctgaagctgagcgtgcccgacaacagacagctgctggagcaggagagcatcatgaaggcccagccccagcacgagagcctggagcagaccaccaacaacgagatcaaggacgacgccgtgaccaaggccgacagccacgagaagaagcccaagaagatgatggtggaggccgacctggaggacatcaagaagacccagcagagaagcctgatggactggagcttcaccgagcacttcaagcccaaggtgctgctgcaggtgctgcaggaggcccacaagcagtacagatgcgtggacagctactaccacacccaggacaacagcctgctgctggtgttccacaaccccatgaacagacagagactgcactgcgagtactggaacatcgccctgcacagcaacgtgggcttcagaaactacctggagctggtggccaagagcatccaggactggatcaccaaggaggaggccatctaccaggagagcaagatgaacgagaagatcatcagaaccagagccgagctggagctgaagagcagcgccaacgccaagctgaccagcgccagcaagatcttcagcatcaaggagagcaagagcaacaagggcatcagcaagaccgagatcagcgaccaggagaaggagaaggagaaggagaagatccccttcatcctggagggcagcctgaaggcctggaaggaggagcagcacagactggccgaggaggagagactgagagaggagaagaaggccgagaagaagggcaaggaggccggcaagaagaagggcaaggacaacgccgagaaggaggacagcagaagcctgaagaagaagagcccctacaaggagaagagcaaggaggagcaggtgaagatccaggaggtgaccgaggagagcccccaccagcccgagcccaagatcacctaccccttccacggctacaacatgggcaacatccccacccagatcagcggcagcaactactacctgtaccccagcgacggcggccagatcgaggtggagaagaccatgttcgagaagggccccaccttcatcaaggtgagagtggtgaaggacaaccacaacttcatgatccacctgaacgaccccaaggagatcgtgaagaaggaggagaagggcgactactacctggaggaggaggaggagggcgacgaggagcagagcctggagaccgaggtgagcgacgccaagaacaaggccttcagcaagttcggcagcttcagcgccaccctggagaacggcatctgcctgagcatcagctactacggcagcaacggcatggcccccgaggacaaggaccccgacctggagaccatcctgaacatccccagcgccctgacccccaccgtggtgcccgtgatcgtgaccgtgccccagagcaaggccaagggcaagatcaagggcaaggagaagcccaaggagagcctgaaggaggaggagcaccccaaggaggaggagaagaaggaggaggaggtggagcccgagcccgtgctgcaggagaccctggacgtgcccaccttccagagcctgaacgtgagctgccccagcggcctgctgctgaccttcatcggccaggagagcaccggccagtacgtgatcgacgaggagcccacctgggacatcatggtgagacagagctacccccagagagtgaagcactacgagttctacaagaccgtgatgccccccgccgagcaggaggccagcagagtgatcaccagccagggcaccgtggtgaagtacatgctggacggcagcacccagatcctgttcgccgacggcgccgtgagcagaagccccaacagcggcctgatctgcccccccagcgagatgcccgccaccccccacagcggcgacctgatggacagcatcagccagcagaagagcgagaccatccccagcgagatcaccaacaccaagaagggcaagagccacaagagccagagcagcatggcccacaagggcgagatccacgaccccccccccgaggccgtgcagaccgtgacccccgtggaggtgcacatcggcacctggttcaccaccacccccgagggcaacagaatcggcaccaagggcctggagagaatcgccgacctgacccccctgctgagcttccaggccaccgaccccgtgaacggcaccgtgatgaccaccagagaggacaaggtggtgatcgtggagagaaaggacggcaccagaatcgtggaccacgccgacggcaccagaatcaccaccttctaccaggtgtacgaggaccagatcatcctgcccgacgaccaggagaccaccgagggccccagaaccgtgaccagacaggtgaagtgcatgagagtggagagcagcagatacgccaccgtgatcgccaactgcgaggacagcagctgctgcgccaccttcggcgacggcaccaccatcatcgccaagccccagggcacctaccaggtgctgccccccaacaccggcagcctgtacatcgacaaggactgcagcgccgtgtactgccacgagagcagcagcaacatctactaccccttccagaagagagagcagctgagagccggcagatacatcatgagacacaccagcgaggtgatctgcgaggtgctggaccccgagggcaacaccttccaggtgatggccgacggcagcatcagcaccatcctgcccgagaagaagctggaggacgacctgaacgagaagaccgagggctacgacagcctgagcagcatgcacctggagaagaaccaccagcagatctacggcgagcacgtgcccagattcttcgtgatgtacgccgacggcagcggcatggagctgctgagagacagcgacatcgaggagtacctgagcctggcctacaaggagagcaacaccgtggtgctgcaggagcccgtgcaggagcagcccggcaccctgaccatcaccgtgctgagacccttccacgaggccagcccctggcaggtgaagaaggaggacaccatcgtgccccccaacctgagaagcagaagctgggagaccttccccagcgtggagaagaagacccccggcccccccttcggcacccagatctggaagggcctgtgcatcgagagcaagcagctggtgagcgcccccggcgccatcctgaagagccccagcgtgctgcagatgagacagttcatccagcacgaggtgatcaagaacgaggtgaagctgagactgcaggtgagcctgaaggactacatcaactacatcctgaagaaggaggacgagctgcaggagatgatggtgaaggacagcagaaccgaggaggagagaggcaacgccgccgacctgctgaagctggtgatgagcttccccaagatggaggagaccaccaagagccacgtgaccgaggtggccgcccacctgaccgacctgttcaagcagagcctggccaccccccccaagtgcccccccgacaccttcggcaaggacttcttcgagaagacctggagacacaccgccagcagcaagagatggaaggagaagatcgacaagaccagaaaggagatcgagaccacccagaactacctgatggacatcaagaacagaatcatcccccccttcttcaagagcgagctgaaccagctgtaccagagccagtacaaccacctggacagcctgagcaagaagctgcccagcttcaccaagaagaacgaggacgccaacgagaccgccgtgcaggacaccagcgacctgaacctggacttcaagccccacaaggtgagcgagcagaagagcagcagcgtgcccagcctgcccaagcccgagatcagcgccgacaagaaggacttcaccgcccagaaccagaccgagaacctgaccaagagccccgaggaggccgagagctacgagcccgtgaagatccccacccagagcctgctgcaggacgtggccggccagaccagaaaggagaaggtgaagctgccccactacctgctgagcagcaagcccaagagccagcccctggccaaggtgcaggacagcgtgggcggcaaggtgaacaccagcagcgtggccagcgccgccatcaacaacgccaagagcagcctgttcggcttccacctgctgcccagcagcgtgaagttcggcgtgctgaaggagggccacacctacgccaccgtggtgaagctgaagaacgtgggcgtggacttctgcagattcaaggtgaagcagcccccccccagcaccggcctgaaggtgacctacaagcccggccccgtggccgccggcatgcagaccgagctgaacatcgagctgttcgccaccgccgtgggcgaggacggcgccaagggcagcgcccacatcagccacaacatcgagatcatgaccgagcacgaggtgctgttcctgcccgtggaggccaccgtgctgaccagcagcaactacgacaagagacccaaggacttcccccagggcaaggagaaccccatggtgcagagaaccagcaccatctacagcagcaccctgggcgtgttcatgagcagaaaggtgagcccccactag

SEQ ID NO: 10159 - DNA, 2337 bp, Artificial Sequence
  Description of Artificial Sequence: Synthetic coding sequence
atgcccgccttcctgggcctgaagtgcctgggcaagctgtgcagcagcgagaagagcaaggtgaccagcagcgagagaaccagcgccagaggcagcaacagaaagagactgatcgtggaggacagaagagtgagcggcaccagcttcaccgcccacagaagagccaccatcacccacctgctgtacctgtgccccaaggactactgccccagaggcagagtgtgcaacagcgtggaccccttcgtggcccacccccaggacccccaccaccccagcgagaagcccgtgatccactgccacaagtgcggcgagccctgcaagggcgaggtgctgagagtgcagaccaagcacttccacatcaagtgcttcacctgcaaggtgtgcggctgcgacctggcccagggcggcttcttcatcaagaacggcgagtacctgtgcaccctggactaccagagaatgtacggcaccagatgccacggctgcggcgagttcgtggagggcgaggtggtgaccgccctgggcaagacctaccaccccaactgcttcgcctgcaccatctgcaagagacccttcccccccggcgacagagtgaccttcaacggcagagactgcctgtgccagctgtgcgcccagcccatgagcagcagccccaaggagaccaccttcagcagcaactgcgccggctgcggcagagacatcaagaacggccaggccctgctggccctggacaagcagtggcacctgggctgcttcaagtgcaagagctgcggcaaggtgctgaccggcgagtacatcagcaaggacggcgccccctactgcgagaaggactaccagggcctgttcggcgtgaagtgcgaggcctgccaccagttcatcaccggcaaggtgctggaggccggcgacaagcactaccaccccagctgcgccagatgcagcagatgcaaccagatgttcaccgagggcgaggagatgtacctgcagggcagcaccgtgtggcaccccgactgcaagcagagcaccaagaccgaggagaagctgagacccaccagaaccagcagcgagagcatctacagcagacccggcagcagcatccccggcagccccggccacaccatctacgccaaggtggacaacgagatcctggactacaaggacctggccgccatccccaaggtgaaggccatctacgacatcgagagacccgacctgatcacctacgagcccttctacaccagcggctacgacgacaagcaggagagacagagcctgggcgagagccccagaaccctgagccccacccccagcgccgagggctaccaggacgtgagagacagaatgatccacagaagcaccagccagggcagcatcaacagccccgtgtacagcagacacagctacacccccaccaccagcagaagcccccagcacttccacagacccggcaacgagcccagcagcggcagaaacagccccctgccctacagacccgacagcagacccctgacccccacctacgcccaggcccccaagcacttccacgtgcccgaccagggcatcaacatctacagaaagccccccatctacaagcagcacgccgccctggccgcccagagcaagagcagcgaggacatcatcaagttcagcaagttccccgccgcccaggcccccgaccccagcgagacccccaagatcgagaccgaccactggcccggcccccccagcttcgccgtggtgggccccgacatgaagagaagaagcagcggcagagaggaggacgacgaggagctgctgagaagaagacagctgcaggaggagcagctgatgaagctgaacagcggcctgggccagctgatcctgaaggaggagatggagaaggagagcagagagagaagcagcctgctggccagcagatacgacagccccatcaacagcgccagccacatccccagcagcaagaccgccagcctgcccggctacggcagaaacggcctgcacagacccgtgagcaccgacttcgcccagtacaacagctacggcgacgtgagcggcggcgtgagagactaccagaccctgcccgacggccacatgcccgccatgagaatggacagaggcgtgagcatgcccaacatgctggagcccaagatcttcccctacgagatgctgatggtgaccaacagaggcagaaacaagatcctgagagaggtggacagaaccagactggagagacacctggcccccgaggtgttcagagagatcttcggcatgagcatccaggagttcgacagactgcccctgtggagaagaaacgacatgaagaagaaggccaagctgttctag

SEQ ID NO: 10160 - DNA, 1689 bp, Artificial Sequence
  Description of Artificial Sequence: Synthetic coding sequence
atgaaccccctgttcggccccaacctgttcctgctgcagcaggagcagcagggcctggccggccccctgggcgacagcctgggcggcgaccacttcgccggcggcggcgacctgccccccgcccccctgagccccgccggccccgccgcctacagcccccccggccccggccccgccccccccgccgccatggccctgagaaacgacctgggcagcaacatcaacgtgctgaagaccctgaacctgagattcagatgcttcctggccaaggtgcacgagctggagagaagaaacagactgctggagaagcagctgcagcaggccctggaggagggcaagcagggcagaagaggcctgggcagaagagaccaggccgtgcagaccggcttcgtgagccccatcagacccctgggcctgcagctgggcgccagacccgccgccgtgtgcagccccagcgccagagtgctgggcagccccgccagaagccccgccggccccctggcccccagcgccgccagcctgagcagcagcagcaccagcaccagcaccacctacagcagcagcgccagattcatgcccggcaccatctggagcttcagccacgccagaagactgggccccggcctggagcccaccctggtgcagggccccggcctgagctgggtgcaccccgacggcgtgggcgtgcagatcgacaccatcacccccgagatcagagccctgtacaacgtgctggccaaggtgaagagagagagagacgagtacaagagaagatgggaggaggagtacaccgtgagaatccagctgcaggacagagtgaacgagctgcaggaggaggcccaggaggccgacgcctgccaggaggagctggccctgaaggtggagcagctgaaggccgagctggtggtgttcaagggcctgatgagcaacaacctgagcgagctggacaccaagatccaggagaaggccatgaaggtggacatggacatctgcagaagaatcgacatcaccgccaagctgtgcgacgtggcccagcagagaaactgcgaggacatgatccagatgttccagaagaagctggtgcccagcatgggcggcagaaagagagagagaaaggccgccgtggaggaggacaccagcctgagcgagagcgagggccccagacagcccgacggcgacgaggaggagagcaccgccctgagcatcaacgaggagatgcagagaatgctgaaccagctgagagagtacgacttcgaggacgactgcgacagcctgacctgggaggagaccgaggagaccctgctgctgtgggaggacttcagcggctacgccatggccgccgccgaggcccagggcgagcaggaggacagcctggagaaggtgatcaaggacaccgagagcctgttcaagaccagagagaaggagtaccaggagaccatcgaccagatcgagctggagctggccaccgccaagaacgacatgaacagacacctgcacgagtacatggagatgtgcagcatgaagagaggcctggacgtgcagatggagacctgcagaagactgatcacccagagcggcgacagaaagagccccgccttcaccgccgtgcccctgagcgaccccccccccccccccagcgaggccgaggacagcgacagagacgtgagcagcgacagcagcatgagatag

SEQ ID NO: 10161 - DNA, 2415 bp, Artificial Sequence
  Description of Artificial Sequence: Synthetic coding sequence
atgaactaccagcagcagctggccaacagcgccgccatcagagccgagatccagagattcgagagcgtgcaccccaacatctacagcatctacgagctgctggagagagtggaggagcccgtgctgcagaaccagatcagagagcacgtgatcgccatcgaggacgccttcgtgaacagccaggagtggaccctgagcagaagcgtgcccgagctgaaggtgggcatcgtgggcaacctggccagcggcaagagcgccctggtgcacagatacctgaccggcacctacgtgcaggaggagagccccgagggcggcagattcaagaaggagatcgtggtggacggccagagctacctgctgctgatcagagacgagggcggcccccccgaggcccagttcgccatgtgggtggacgccgtgatcttcgtgttcagcctggaggacgagatcagcttccagaccgtgtaccactactacagcagaatggccaactacagaaacaccagcgagatccccctggtgctggtgggcacccaggacgccatcagcagcgccaaccccagagtgatcgacgacgccagagccagaaagctgagcaacgacctgaagagatgcacctactacgagacctgcgccacctacggcctgaacgtggagagagtgttccaggacgtggcccagaagatcgtggccaccagaaagaagcagcagctgagcatcggcccctgcaagagcctgcccaacagccccagccacagcagcgtgtgcagcgcccaggtgagcgccgtgcacatcagccagaccagcaacggcggcggcagcctgagcgactacagcagcagcgtgcccagcacccccagcaccagccagaaggagctgagaatcgacgtgccccccaccgccaacacccccacccccgtgagaaagcagagcaagagaagaagcaacctgttcaccagcagaaagggcagcgaccccgacaaggagaagaagggcctggagagcagagccgacagcatcggcagcggcagagccatccccatcaagcagggcatgctgctgaagagaagcggcaagagcctgaacaaggagtggaagaagaagtacgtgaccctgtgcgacaacggcgtgctgacctaccaccccagcctgcacgactacatgcagaacgtgcacggcaaggagatcgacctgctgagaaccaccgtgaaggtgcccggcaagagaccccccagagccaccagcgcctgcgcccccatcagcagccccaagaccaacggcctgagcaaggacatgagcagcctgcacatcagccccaacagcgacaccggcctgggcgacagcgtgtgcagcagccccagcatcagcagcaccaccagccccaagctggaccccccccccagcccccacgccaacagaaagaagcacagaagaaagaagagcaccagcaacttcaaggccgacggcctgagcggcaccgccgaggagcaggaggagaacttcgagttcatcatcgtgagcctgaccggccagacctggcacttcgaggccaccacctacgaggagagagacgcctgggtgcaggccatcgagagccagatcctggccagcctgcagagctgcgagagcagcaagaacaagagcagactgaccagccagagcgaggccatggccctgcagagcatcagaaacatgagaggcaacagccactgcgtggactgcgagacccagaaccccaactgggccagcctgaacctgggcgccctgatgtgcatcgagtgcagcggcatccacagaaacctgggcacccacctgagcagagtgagaagcctggacctggacgactggcccgtggagctgatcaaggtgatgagcagcatcggcaacgagctggccaacagcgtgtgggaggagagcagccagggcagaaccaagcccagcgtggacagcaccagagaggagaaggagagatggatcagagccaagtacgagcagaagctgttcctggcccccctgccctgcaccgagctgagcctgggccagcacctgctgagagccaccgccgacgaggacctgagaaccgccatcctgctgctggcccacggcagcagagacgaggtgaacgagacctgcggcgagggcgacggcagaaccgccctgcacctggcctgcagaaagggcaacgtggtgctggcccagctgctgatctggtacggcgtggacgtgaccgccagagacgcccacggcaacaccgccctggcctacgccagacaggccagcagccaggagtgcatcgacgtgctgctgcagtacggctgccccgacgagagattcgtgctgatggccacccccaacctgagcagaagaaacaacaacagaaacaacagcagcggcagagtgcccaccatcatctag

SEQ ID NO: 10162 - DNA, 2712 bp, Artificial Sequence
  Description of Artificial Sequence: Synthetic coding sequence
atgcccgagcagttcagcgtggccgagttcctggccgtgaccgccgaggacctgagcagccccgccggcgccgccgccttcgccgccaagatgcccagatacagaggcgccgccctggccagagaggagatcctggagggcgaccaggccatcctgcagagaatcaagaaggccgtgagagccatccacagcagcggcctgggccacgtggagaacgaggagcagtacagagaggccgtggagagcctgggcaacagccacctgagccagaacagccacgagctgagcaccggcttcctgaacctggccgtgttcaccagagaggtggccgccctgttcaagaacctgatccagaacctgaacaacatcgtgagcttccccctggacagcctgatgaagggccagctgagagacggcagacaggacagcaagaagcagctggagaaggcctggaaggactacgaggccaagatggccaagctggagaaggagagagacagagccagagtgaccggcggcatccccggcgaggtggcccaggacatgcagagagagagaagaatcttccagctgcacatgtgcgagtacctgctgaaggccggcgagagccagatgaagcagggccccgacttcctgcagagcctgatcaagttcttccacgcccagcacaacttcttccaggacggctggaaggccgcccagagcctgttccccttcatcgagaagctggccgccagcgtgcacgccctgcaccaggcccaggaggacgagctgcagaagctgacccagctgagagacagcctgagaggcaccctgcagctggagagcagagaggagcacctgagcagaaagaacagcggctgcggctacagcatccaccagcaccagggcaacaagcagttcggcaccgagaaggtgggcttcctgtacaagaagagcgacggcatcagaagagtgtggcagaagagaaagtgcggcgtgaagtacggctgcctgaccatcagccacagcaccatcaacagaccccccgtgaagctgaccctgctgacctgccaggtgagacccaaccccgaggagaagaagtgcttcgacctggtgacccacaacagaacctaccacttccaggccgaggacgagcacgagtgcgaggcctgggtgagcgtgctgcagaacagcaaggacgaggccctgagcagcgccttcctgggcgagcccagcgccggccccggcagctggggcagcgccggccacgacggcgagccccacgacctgaccaagctgctgatcgccgaggtgaagagcagacccggcaacagccagtgctgcgactgcggcgccgccgaccccacctggctgagcaccaacctgggcgtgctgacctgcatccagtgcagcggcgtgcacagagagctgggcgtgagattcagcagaatgcagagcctgaccctggacctgctgggccccagcgagctgctgctggccctgaacatgggcaacaccagcttcaacgaggtgatggaggcccagctgcccagccacggcggccccaagcccagcgccgagagcgacatgggcaccagaagagactacatcatggccaagtacgtggagcacagattcgccagaagatgcacccccgagccccagagactgtggaccgccatctgcaacagagacctgctgagcgtgctggaggccttcgccaacggccaggacttcggccagcccctgcccggccccgacgcccaggcccccgaggagctggtgctgcacctggccgtgaaggtggccaaccaggccagcctgcccctggtggacttcatcatccagaacggcggccacctggacgccaaggccgccgacggcaacaccgccctgcactacgccgccctgtacaaccagcccgactgcctgaagctgctgctgaagggcagagccctggtgggcaccgtgaacgaggccggcgagaccgccctggacatcgccagaaagaagcaccacaaggagtgcgaggagctgctggagcaggcccaggccggcaccttcgccttccccctgcacgtggactacagctgggtgatcagcaccgagcccggcagcgacagcgaggaggacgaggaggagaagagatgcctgctgaagctgcccgcccaggcccactgggccagcggcagactggacatcagcaacaagacctacgagaccgtggccagcctgggcgccgccaccccccagggcgagagcgaggactgccccccccccctgcccgtgaagaacagcagcagaaccctggtgcagggctgcgccagacacgccagcggcgacagaagcgaggtgagcagcctgagcagcgaggcccccgagacccccgagagcctgggcagccccgccagcagcagcagcctgatgagccccctggagcccggcgaccccagccaggccccccccaacagcgaggagggcctgagagagccccccggcaccagcagacccagcctgaccagcggcaccacccccagcgagatgtacctgcccgtgagattcagcagcgagagcaccagaagctacagaagaggcgccagaagccccgaggacggccccagcgccagacagcccctgcccagaagaaacgtgcccgtgggcatcaccgagggcgacggcagcagaaccggcagcctgcccgccagcagcgtgcagctgctgcaggactag

SEQ ID NO: 10163 - DNA, 1359 bp, Artificial Sequence
  Description of Artificial Sequence: Synthetic coding sequence
atgatgaagagacagctgcacagaatgagacagctggcccagaccggcagcctgggcagaacccccgagaccgccgagttcctgggcgaggacctgctgcaggtggagcagagactggagcccgccaagagagccgcccacaacatccacaagagactgcaggcctgcctgcagggccagagcggcgccgacatggacaagagagtgaagaagctgcccctgatggccctgagcaccaccatggccgagagcttcaaggagctggaccccgacagcagcatgggcaaggccctggagatgagctgcgccatccagaaccagctggccagaatcctggccgagttcgagatgaccctggagagagacgtgctgcagcccctgagcagactgagcgaggaggagctgcccgccatcctgaagcacaagaagagcctgcagaagctggtgagcgactggaacaccctgaagagcagactgagccaggccaccaagaacagcggcagcagccagggcctgggcggcagccccggcagccacagccacaccaccatggccaacaaggtggagaccctgaaggaggaggaggaggagctgaagagaaaggtggagcagtgcagagacgagtacctggccgacctgtaccacttcgtgaccaaggaggacagctacgccaactacttcatcagactgctggagatccaggccgactaccacagaagaagcctgagcagcctggacaccgccctggccgagctgagagagaaccacggccaggccgaccacagccccagcatgaccgccacccacttccccagagtgtacggcgtgagcctggccacccacctgcaggagctgggcagagagatcgccctgcccatcgaggcctgcgtgatgatgctgctgagcgagggcatgaaggaggagggcctgttcagactggccgccggcgccagcgtgctgaagagactgaagcagaccatggccagcgacccccacagcctggaggagttctgcagcgacccccacgccgtggccggcgccctgaagagctacctgagagagctgcccgagcccctgatgaccttcgacctgtacgacgactggatgagagccgccagcctgaaggagcccggcgccagactgcaggccctgcaggaggtgtgcagcagactgccccccgagaacctgagcaacctgagatacctgatgaagttcctggccagactggccgaggagcaggaggtgaacaagatgacccccagcaacatcgccatcgtgctgggccccaacctgctgtggccccccgagaaggagggcaccgagcccgccagagagctgggcagccagaccctgtgctag

SEQ ID NO: 10164 - DNA, 1137 bp, Artificial Sequence
  Description of Artificial Sequence: Synthetic coding sequence
atgaacaacagcggcgccgacgagatcggcaagctgttcgtgggcggcctggactggagcaccacccaggagaccctgagaagctacttcagccagtacggcgaggtggtggactgcgtgatcatgaaggacaagaccaccaaccagagcagaggcttcggcttcgtgaagttcaaggaccccaactgcgtgggcaccgtgctggccagcagaccccacaccctggacggcagaaacatcgaccccaagccctgcacccccagaggcatgcagcccgagagaaccagacccaaggagggctggcagaagggccccagaagcgacaacagcaagagcaacaagatcttcgtgggcggcatcccccacaactgcggcgagaccgagctgagagagtacttcaagaagttcggcgtggtgaccgaggtggtgatgatctacgacgccgagaagcagagacccagaggcttcggcttcatcaccttcgaggacgagcagagcgtggaccaggccgtgaacatgcacttccacgacatcatgggcaagaaggtggaggtgaagagagccgagcccagagacagcaagagccaggcccccggccagcccggcgccagccagtggggcagcagagtggtgcccaacgccgccaacggctgggccggccagcccccccccacctggcagcagggctacggcccccagggcatgtgggtgcccgccggccaggccatcggcggctacggccccccccccgccggcagaggcgccccccccccccccccccccttcaccagctacatcgtgagcaccccccccggcggcttcccccccccccagggcttcccccagggctacggcgcccccccccagttcagcttcggctacggcccccccccccccccccccgaccagttcgccccccccggcgtgccccccccccccgccacccccggcgccgcccccctggccttcccccccccccccagccaggccgcccccgacatgagcaagccccccaccgcccagcccgacttcccctacggccagtacggcctgggcagctacagccccgccccccccggctgcggcccccacttcgtgtacagcctgatggtgagactgagcagcgacgtggcctag

SEQ ID NO: 10165 - DNA, 2430 bp, Artificial Sequence
  Description of Artificial Sequence: Synthetic coding sequence
atggaggtgctgagagagaaggtggaggaggaggaggaggccgagagagaggaggccgccgagtgggccgagtgggccagaatggagaagatgatgagacccgtggaggtgagaaaggaggagatcaccctgaagcaggagaccctgagagacctggagaagaagctgagcgagatccagatcaccgtgagcgccgagctgcccgccttcaccaaggacaccatcgacatcagcaagctgcccatcagctacaagaccaacacccccaaggaggagcacctgctgcaggtggccgacaacttcagcagacagtacagccacctgtgccccgacagagtgcccctgttcctgcaccccctgaacgagtgcgaggtgcccaagttcgtgagcaccaccctgagacccaccctgatgccctaccccgagctgtacaactgggacagctgcgcccagttcgtgagcgacttcctgaccatggtgcccctgcccgaccccctgaagcccaccatcaagaaggaggagaaggtgctgcccaagaagtacaccatcaagccccccagagacctgtgcagcagattcgagcaggagcaggaggtgaagaagcagcaggagatcagagcccaggagaagaagagactgagagaggaggaggagagactgatggaggccgagaaggccaagcccgacgccctgcacggcctgagagtgcacagctgggtgctggtgctgagcggcaagagagaggtgcccgagaacttcttcatcgaccccttcaccggccacagctacagcacccaggacgagcacttcctgggcatcgagagcctgtggaaccacaagaactactggatcaacatgcaggactgctggaactgctgcaaggacctgatcttcgacctgggcgaccccgtgagatgggagtacatgctgctgggcaccgacaagagccagctgagcctgaccgaggaggacgacagcggcatcaacgacgaggacgacgtggagaacctgggcaaggaggacgaggacaagagcttcgacatgccccacagctgggtggagcagatcgagatcagccccgaggccttcgagaccagatgccccaacggcaagaaggtgatccagtacaagagagccaagctggagaagtgggccccctacctgaacagcaacggcctggtgagcagactgaccacctacgaggacctgcagtgcaccaacatcctggagatcaaggagtggtaccagaacagagaggacatgctggagctgaagcacatcaacaagaccaccgacctgaagaccgactacttcaagcccggccacccccaggccctgagagtgcacagctacaagagcatgcagcccgagatggacagagtgatcgagttctacgagaccgccagagtggacggcctgatgaagagagaggagacccccagaaccatgaccgagtactaccagggcagacccgacttcctgagctacagacacgccagcttcggccccagagtgaagaagctgaccctgagcagcgccgagagcaaccccagacccatcgtgaagatcaccgagagattcttcagaaaccccgccaagcccgccgaggaggacgtggccgagagagtgttcctggtggccgaggagagaatccagctgagataccactgcagagaggaccacatcaccgccagcaagagagagttcctgagaagaaccgaggtggacagcaagggcaacaagatcatcatgacccccgacatgtgcatcagcttcgaggtggagcccatggagcacaccaagaagctgctgtaccagtacgaggccatgatgcacctgaagagagaggagaagctgagcagacaccaggtgtgggagagcgagctggaggtgctggagatcctgaagctgagagaggaggaggaggccgcccacaccctgaccatcagcatctacgacaccaagagaaacgagaagagcaaggagtacagagaggccatggagagaatgatgcacgaggagcacctgagacaggtggagacccagctggactacctggcccccttcctggcccagctgccccccggcgagaagctgacctgctggcaggccgtgagactgaaggacgagtgcctgagcgacttcaagcagagactgatcaacaaggccaacctgatccaggccagattcgagaaggagacccaggagctgcagaagaagcagcagtggtaccaggagaaccaggtgaccctgacccccgaggacgaggacctgtacctgagctactgcagccaggccatgttcagaatcagaatcctggagcagagactgaacagacacaaggagctggcccccctgaagtacctggccctggaggagaagctgtacaaggaccccagactgggcgagctgcagaagatcttcgcctag

SEQ ID NO: 10166 - DNA, 828 bp, Artificial Sequence
  Description of Artificial Sequence: Synthetic coding sequence
atgtggcccctgaccgccctgctgctgctggtgcccagcagcggccaggccgccaccctggagaagcccatcctgagcctgcaccccccctggaccaccatcttcaagggcgagagagtgaccctgaagtgcgacggctaccaccccctgctgctggagctgcagcccatcagcaccctgtggtacctgggccacctgctgctgcccagccacaagaagagcatcgaggtgcagacccccggcgtgtacagatgccagaccagaggcgcccccgtgagcgaccccatccacctgagcgtgagcaacgactggctgatcctgcaggtgccctacgcccccgtgttcgagggcgagcccctggtgctgagatgcagaggctggtacgacaaggtggtgtacaagctgcactactaccacgacggccaggccgtgagatacttccacagcagcgccaactacaccgtgctgcaggccagagccagcgacagcggcagataccagtgcagcggcaccatgagaatccccgtggagagcgcccccatgttcagcgccaaggtggccgtgaccgtgcaggaggccagacacgccgccgccgtgagagtgctgcaggtgcagcccagaggcgcccccctgagactgggcagaagagtgcacagccccggcgccagaggcagaggcgccagaatcgtgctggtgagaggcggctacagacacccccagtgccccgagacccagagcgtggccgccgcccccggcgccggcttcagccccggccccggcctgcaccacagacccagcagcatgggcagaagcctgggcagctggtag

SEQ ID NO: 10167 - DNA, 657 bp, Artificial Sequence
  Description of Artificial Sequence: Synthetic coding sequence
atgaactgcagaagcgaggtgctggaggtgagcgtggagggcagacaggtggaggaggccatgctggccgtgctgcacaccgtgctgctgcacagaagcaccggcaagttccactacaagaaggagggcacctacagcatcggcaccgtgggcacccaggacgtggactgcgacttcatcgacttcacctacgtgagagtgagcagcgaggagctggacagagccctgagaaaggtggtgggcgagttcaaggacgccctgagaaacagcggcggcgacggcctgggccagatgagcctggagttctaccagaagaagaagagcagatggcccttcagcgacgagtgcatcccctgggaggtgtggaccgtgaaggtgcacgtggtggccctggccaccgagcaggagagacagatctgcagagagaaggtgggcgagaagctgtgcgagaagatcatcaacatcgtggaggtgatgaacagacacgagtacctgcccaagatgcccacccagagcgaggtggacaacgtgttcgacaccggcctgagagacgtgcagccctacctgtacaagatcagcttccagatcaccgacgccctgggcaccagcgtgaccaccaccatgagaagactgatcaaggacaccctggccctgtag

SEQ ID NO: 10168 - DNA, 552 bp, Artificial Sequence
  Description of Artificial Sequence: Synthetic coding sequence
atgatgcagatctgcgacacctacaaccagaagcacagcctgttcaacgccatgaacagattcatcggcgccgtgaacaacatggaccagaccgtgatggtgcccagcctgctgagagacgtgcccctggccgaccccggcctggacaacgacgtgggcgtggaggtgggcggcagcggcggctgcctggaggagagaaccccccccgtgcccgacagcggcagcgccaacggcagcttcttcgcccccagcagagacatgtacagccactacgtgctgctgaagagcatcagaaacgacatcgagtggggcgtgctgcaccagccccccccccccgccggcagcgaggagggcagcgcctggaagagcaaggacatcctggtggacctgggccacctggagggcgccgacgccggcgaggaggacctggagcagcagttccactaccacctgagaggcctgcacaccgtgctgagcaagctgaccagaaaggccaacatcctgaccaacagatacaagcaggagatcggcttcggcaactggggccactag

SEQ ID NO: 10169 - DNA, 369 bp, Artificial Sequence
  Description of Artificial Sequence: Synthetic coding sequence
atgctgttcgccccctgctgccaccagtgcggcgagttcatcatcggcagagtgatcaaggccatgaacaacagctggcaccccgagtgcttcagatgcgacctgtgccaggaggtgctggccgacatcggcttcgtgaagaacgccggcagacacctgtgcagaccctgccacaacagagagaaggccagaggcctgggcaagtacatctgccagaagtgccacgccatcatcgacgagcagcccctgatcttcaagaacgacccctaccaccccgaccacttcaactgcgccaactgcggccaggagggcagcgactgcagatgcaccggcgccgagagaggcgccatcctgcccgccatgccctag

SEQ ID NO: 10170 - DNA, 1083 bp, Artificial Sequence
  Description of Artificial Sequence: Synthetic coding sequence
atggacagcgagctgatgcacagcatcgtgggcagctaccacaagccccccgagagagtgttcgtgcccagcttcacccagaacgagcccagccagaactgccaccccgccaacctggaggtgaccagccccaagatcctgcacagccccaacagccaggagaagcagctggagtacaccaagagaatggtgctgaacgtggagagagagaagaacatgatcctggagcagcaggcccagctgcagagagagaaggagcaggaccagatgaagctgtacgccaagctggagaagctggacgtgctggagaaggagtgcttcagactgaccaccacccagaagaccgccgaggacaagatcaagcacctggaggagaagctgaaggaggaggagcaccagagaaagctgttccaggacaaggccagcgagctgcagaccggcctggagatcagcaagatcatcatgagcagcgtgagcaacctgaagcacagcaaggagaagaagaagagcagcaagaagaccaagtgcatcaagagaagacccccctggcagatctgcagcaagttcggcgccctgcccttcgtggccgagaagcccagcagaaccaccagctggtgcaaggccatcccccccgacagcgagaagagcatcagcatctgcgacaacctgagcgagctgctgatggccatgcaggacgagctggaccagatgagcatggagcaccaggagctgctgaagcagatgaaggagaccgagagccacagcgtgtgcgacgacatcgagtgcgagctggagtgcctgctgaagaagatggagatcaagggcgagcagatcagcaagctgaagaagcaccaggacagcgtgtgcaagctgcagcagaaggtgcagaacagcaagatgagcgaggccagcggcatccagcaggaggacagctaccccaagggcagcaagaacatcaagaacagccccagaaagtgcctgaccgacaccaacctgttccagaagaacagcagcttccaccccatcagagtgcacaacctgcagatgaagctgagaagagacgacatcatgtgggagcagtag

SEQ ID NO: 10171 - DNA, 1758 bp, Artificial Sequence
  Description of Artificial Sequence: Synthetic coding sequence
atgagcggcagcacccccttccagatgagactggtgcacctggacctgaagggcgccccccccaaggtgagctacctgagcgagatcttccccctgttcagagccctgggcgccaacggcctgctgatcgagtacgaggacatgttcccctacgagggccccctgagactgctgagagccaagtacgcctacagccccagcgagatcaaggagatcctgcacctggccggcctgaacgagctggaggtgatccccctggtgcagaccttcggccacatggagttcgtgctgaagcacaccgccttcgcccacctgagagaggtgggcagcttcccctgcaccctgaacccccacgaggccgagagcctggccctggtgggcgccatgatcgaccaggtgctggagctgcaccccggcgcccagagactgcacatcggctgcgacgaggtgtactacctgggcgagggcgaggccagcagaagatggctgcagcaggagcagaacagcaccggcaagctgtgcctgagccacatgagagccgtggccagcggcgtgaaggccagaagacccagcgtgacccccctggtgtgggacgacatgctgagagacctgcccgaggaccagctggccgccagcggcgtgccccagctggtggagcccgtgctgtgggactacaccgccgacctggacgtgcacggcaaggtgctgctgatgcagaagtacagaagatgcggcttcccccagctgtgggccgccagcgccttcaagggcgccaccggccccagccaggccgtgccccccgtggagcaccacctgagaaaccacgtgcagtggctgcaggtggccggcagcggccccaccgacagcctgcagggcatcatcctgaccggctggcagagatacgaccactacagcgtgctgtgcgagctgctgcccgccggcgtgcccagcctggccgcctgcctgcagctgctgctgagaggcggcttcgacgaggacgtgaaggccaaggtggagaacctgctgggcatcagcagcctggagaagaccgaccccgtgagacaggccccctgcagccccccctgccccctgctgcccctgcccttccccagaccctggagacagctgttcagcgccggcctgagcgccggcagaggccccgcccccagcctggccgccaccagcctgcccctgagccacaagagcgccagcatctgcgccgccctgtggatgagatgctggagagccaccggcatgagcctggccggcagcgcccccaccaccgccagcggcagcagcagcaccagaagctggttcagcaccagcagcccccagagaagcgccagctggcacagcggcgcccccagctgcagaagctggagactgccctgcagctggctgagcaccagaatgccctggagaagcggctggagaaagacctgcacccccgcctgcagcggctgcaagctgtgctgcagaaccagcgccagatgcctgccccccagatgccacccccccgccctggccggcaccctgctgagaacccccgagggcagagcccacgccagaggcctgctgctggaggccggcggcgccctgcactgccagatggcctgggccatcagagcccacgtgggcgtggtgcccagcggccccgccgtgagctgcccccacagcgtgcccgagggccccggccagcccctgggcgagagactggagaacaccgagggcagcagcaccggcagacccgccctgtag

SEQ ID NO: 10172 - DNA, 2112 bp, Artificial Sequence
  Description of Artificial Sequence: Synthetic coding sequence
atggaggccctgctggagggcatccagaacagaggccacggcggcggcttcctgaccagctgcgaggccgagctgcaggagctgatgaagcagatcgacatcatggtggcccacaagaagagcgagtgggagggcagaacccacgccctggagacctgcctgaagatcagagagcaggagctgaagagcctgagaagccagctggacgtgacccacaaggaggtgggcatgctgcaccagcaggtggaggagcacgagaagatcaagcaggagatgaccatggagtacaagcaggagctgaagaagctgcacgaggagctgtgcatcctgaagagaagctacgagaagctgcagaagaagcagatgagagagttcagaggcaacaccaagaaccacagagaggacagaagcgagatcgagagactgaccgccaagatcgaggagttcagacagaagagcctggactgggagaagcagagactgatctaccagcagcaggtgagcagcctggaggcccagagaaaggccctggccgagcagagcgagatcatccaggcccagctggtgaacagaaagcagaagctggagagcgtggagctgagcagccagagcgagatccagcacctgagcagcaagctggagagagccaacgacaccatctgcgccaacgagctggagatcgagagactgaccatgagagtgaacgacctggtgggcaccagcatgaccgtgctgcaggagcagcagcagaaggaggagaagctgagagagagcgagaagctgctggaggccctgcaggaggagaagagagagctgaaggccgccctgcagagccaggagaacctgatccacgaggccagaatccagaaggagaagctgcaggagaaggtgaaggccaccaacacccagcacgccgtggaggccatcagacccagagaggagagcctggccgagaagaagtacaccagccagggccagggcgacctggacagcgtgctgagccagctgaacttcacccacaccagcgaggacctgctgcaggccgaggtgacctgcctggagggcagcctggagagcgtgagcgccacctgcaagcagctgagccaggagctgatggagaagtacgaggagctgaagagaatggaggcccacaacaacgagtacaaggccgagatcaagaagctgaaggagcagatcctgcagggcgagcagagctacagcagcgccctggagggcatgaagatggagatcagccacctgacccaggagctgcaccagagagacatcaccatcgccagcaccaagggcagcagcagcgacatggagaagagactgagagccgagatgcagaaggccgaggacaaggccgtggagcacaaggagatcctggaccagctggagagcctgaagctggagaacagacacctgagcgagatggtgatgaagctggagctgggcctgcacgaggccaaggagatcagcctggccgacctgcaggagaactacatcgaggccctgaacaagctggtgagcgagaaccagcagctgcagaaggacctgatgaacaccaagagccagctggagatcagcacccagatgtgcaagaagcagaacgacagaatcttcaagcccacccacagcagaaccaccgagttcaagaacaccgagttcaagcccacccacggccagcacagacacgacggcatcaagaccgagcactacaagaccgacctgcacagccccagaggccaggccagcgacagcatcaaccccatgagcagagtgctgagccccctgagcccccagatcagcccctgcagcagcaccagaagcctgaccagctacagcctgtgcaagacccacagcctgcccagcgccctggacaccaacgaggccaacttcagcgacaccatgagcgagagcatgaacgaccaggaggagttcatcagcagctgcagcctgcccgtgagccccctgggcagcatcgccaccagattcctggaggaggaggagctgagaagccaccacatcctggagagactggacgcccacatcgaggagctgaagagagagagcgagaagaccgtgagacagttcaccgccctgaagtag

SEQ ID NO: 10173 - DNA, 1626 bp, Artificial Sequence
  Description of Artificial Sequence: Synthetic coding sequence
atgagcagctgcgtgagcagccagcccagcagcaacagagccgccccccaggacgagctgggcggcagaggcagcagcagcagcgagagccagaagccctgcgaggccctgagaggcctgagcagcctgagcatccacctgggcatggagagcttcatcgtggtgaccgagtgcgagcccggctgcgccgtggacctgggcctggccagagacagacccctggaggccgacggccaggaggtgcccctggacaccagcggcagccaggccagaccccacctgagcggcagaaagctgagcctgcaggagagaagccagggcggcctggccgccggcggcagcctggacatgaacggcagatgcatctgccccagcctgccctacagccccgtgagcagcccccagagcagccccagactgcccagaagacccaccgtggagagccaccacgtgagcatcaccggcatgcaggactgcgtgcagctgaaccagtacaccctgaaggacgagatcggcaagggcagctacggcgtggtgaagctggcctacaacgagaacgacaacacctactacgccatgaaggtgctgagcaagaagaagctgatcagacaggccggcttccccagaagacccccccccagaggcaccagacccgcccccggcggctgcatccagcccagaggccccatcgagcaggtgtaccaggagatcgccatcctgaagaagctggaccaccccaacgtggtgaagctggtggaggtgctggacgaccccaacgaggaccacctgtacatggtgttcgagctggtgaaccagggccccgtgatggaggtgcccaccctgaagcccctgagcgaggaccaggccagattctacttccaggacctgatcaagggcatcgagtacctgcactaccagaagatcatccacagagacatcaagcccagcaacctgctggtgggcgaggacggccacatcaagatcgccgacttcggcgtgagcaacgagttcaagggcagcgacgccctgctgagcaacaccgtgggcacccccgccttcatggcccccgagagcctgagcgagaccagaaagatcttcagcggcaaggccctggacgtgtgggccatgggcgtgaccctgtactgcttcgtgttcggccagtgccccttcatggacgagagaatcatgtgcctgcacagcaagatcaagagccaggccctggagttccccgaccagcccgacatcgccgaggacctgaaggacctgatcaccagaatgctggacaagaaccccgagagcagaatcgtggtgcccgagatcaagctgcacccctgggtgaccagacacggcgccgagcccctgcccagcgaggacgagaactgcaccctggtggaggtgaccgaggaggaggtggagaacagcgtgaagcacatccccagcctggccaccgtgatcctggtgaagaccatgatcagaaagagaagcttcggcaaccccttcgagggcagcagaagagaggagagaagcctgagcgcccccggcaacctgctgaccaagcagggcagcgaggacaacctgcagggcaccgaccccccccccgtgggcgaggaggaggtgctgctgtag

SEQ ID NO: 10174 - DNA, 2463 bp, Artificial Sequence
  Description of Artificial Sequence: Synthetic coding sequence
atgaccgacaccagaagaagagtgaaggtgtacaccctgaacgaggacagacagtgggacgacagaggcaccggccacgtgagcagcggctacgtggagagactgaagggcatgagcctgctggtgagagccgagagcgacggcagcctgctgctggagagcaagatcaaccccaacaccgcctaccagaagcagcaggacaccctgatcgtgtggagcgaggccgagaactacgacctggccctgagcttccaggagaaggccggctgcgacgagatctgggagaagatctgccaggtgcagggcaaggaccccagcgtggacatcacccaggacctggtggacgagagcgaggaggagagattcgacgacatgagcagccccggcctggagctgcccagctgcgagctgagcagactggaggagatcgccgagctggtggccagcagcctgcccagccccctgagaagagagaagctggccctggccctggagaacgagggctacatcaagaagctgctggagctgttccacgtgtgcgaggacctggagaacatcgagggcctgcaccacctgtacgagatcatcaagggcatcttcctgctgaacagaaccgccctgttcgaggtgatgttcagcgaggagtgcatcatggacgtgatcggctgcctggagtacgaccccgccctgagccagcccagaaagcacagagagttcctgaccaagaccgccaagttcaaggaggtgatccccatcagcgaccccgagctgaagcagaagatccaccagacctacagagtgcagtacatccaggacatggtgctgcccacccccagcgtgttcgaggagaacatgctgagcaccctgcacagcttcatcttcttcaacaaggtggagatcgtgggcatgctgcaggaggacgagaagttcctgaccgacctgttcgcccagctgaccgacgaggccaccgacgaggagaagagacaggagctggtgaacttcctgaaggagttctgcgccttcagccagaccctgcagccccagaacagagacgccttcttcaagaccctgagcaacatgggcatcctgcccgccctggaggtgatcctgggcatggacgacacccaggtgagaagcgccgccaccgacatcttcagctacctggtggagtacaaccccagcatggtgagagagttcgtgatgcaggaggcccagcagaacgacgacgacatcctgctgatcaacctgatcatcgagcacatgatctgcgacaccgaccccgagctgggcggcgccgtgcagctgatgggcctgctgagaaccctggtggaccccgagaacatgctggccaccgccaacaagaccgagaagaccgagttcctgggcttcttctacaagcactgcatgcacgtgctgaccgcccccctgctggccaacaccaccgaggacaagcccagcaaggacgacttccagaccgcccagctgctggccctggtgctggagctgctgaccttctgcgtggagcaccacacctaccacatcaagaactacatcatcaacaaggacatcctgagaagagtgctggtgctgatggccagcaagcacgccttcctggccctgtgcgccctgagattcaagagaaagatcatcggcctgaaggacgagttctacaacagatacatcatgaagagcttcctgttcgagcccgtggtgaaggccttcctgaacaacggcagcagatacaacctgatgaacagcgccatcatcgagatgttcgagttcatcagagtggaggacatcaagagcctgaccgcccacgtgatcgagaactactggaaggccctggaggacgtggactacgtgcagaccttcaagggcctgaagctgagattcgagcagcagagagagagacaggacaaccccaagctggacagcatgagaagcatcctgagaaaccacagatacagaagagacgccagaaccctggaggacgaggaggagatgtggttcaacaccgacgaggacgacatggaggacggcgaggccgtggtgagccccagcgacaagaccaagaacgacgacgacatcatggaccccatcagcaagttcatggagagaaagaagctgaaggagagcgaggagaaggaggtgctgctgaagaccaacctgagcggcagacagagccccagcttcaagctgagcctgagcagcggcaccaagaccaacctgaccagccagagcagcaccaccaacctgcccggcagccccggcagccccggcagccccggcagccccggcagccccggcagcgtgcccaagaacaccagccagaccgccgccatcaccaccaagggcggcctggtgggcctggtggactaccccgacgacgacgaggacgacgacgaggacgaggacaaggaggacaccctgcccctgagcaagaaggccaagttcgacagctag

SEQ ID NO: 10175 - DNA, 2382 bp, Artificial Sequence
  Description of Artificial Sequence: Synthetic coding sequence
atgagcgagcagggcgacctgaaccaggccatcgccgaggagggcggcaccgagcaggagaccgccacccccgagaacggcatcgtgaagagcgagagcctggacgaggaggagaagctggagctgcagagaagactggaggcccagaaccaggagagaagaaagagcaagagcggcgccggcaagggcaagctgaccagaagcctggccgtgtgcgaggagagcagcgccagacccggcggcgagagcctgcaggaccaggagagcatccacctgcagctgagcagcttcagcagcctgcaggaggaggacaagagcagaaaggacgacagcgagagagagaaggagaaggacaagaacaaggacaagaccagcgagaagcccaagatcagaatgctgagcaaggactgcagccaggagtacaccgacagcaccggcatcgacctgcacgagttcctgatcaacaccctgaagaacaacagcagagacagaatgatcctgctgaagatggagcaggagatcatcgacttcatcgccgacaacaacaaccactacaagaagttcccccagatgagcagctaccagagaatgctggtgcacagagtggccgcctacttcggcctggaccacaacgtggaccagaccggcaagagcgtgatcatcaacaagaccagcagcaccagaatccccgagcagagattctgcgagcacctgaaggacgagaagggcgaggagagccagaagagattcatcctgaagagagacaacagcagcatcgacaaggaggacaaccagagcgtgtgcagccaggagagcctgttcgtggagaacagaggcaacagagacggcagcggcagaaccagcggcagcagacagagcagcagcgagaacgagctgaagtggagcgaccaccagagagcctggagcagcaccgacagcgacagcagcaacagaaacctgaagcccgccatgaccaagaccgccagcttcggcggcatcaccgtgctgaccagaggcgacagcaccagcagcaccagaagcaccggcaagctgagcaaggccggcagcgagagcagcagcagcgccggcagcagcggcagcctgagcagaacccacccccccctgcagagcacccccctggtgagcggcgtggccgccggcagccccggctgcgtgccctaccccgagaacggcatcggcggccaggtggcccccagcagcaccagctacatcctgctgcccctggaggccgccaccggcatcccccccggcagcatcctgctgaacccccacaccggccagcccttcgtgaaccccgacggcacccccgccatctacaacccccccaccagccagcagcccctgagaagcgccatggtgggccagagccagcagcagcccccccagcagcagcccagcccccagccccagcagcaggtgcagcccccccagccccagatggccggccccctggtgacccagagcgtgcagggcctgcaggccagcagccagagcgtgcagtaccccgccgtgagcttccccccccagcacctgctgcccgtgagccccacccagcacttccccatgagagacgacgtggccacccagttcggccagatgaccctgagcagacagagcagcggcgagacccccgagccccccagcggccccgtgtaccccagcagcctgatgccccagcccgcccagcagcccagctacgtgatcgccagcaccggccagcagctgcccaccggcggcttcagcggcagcggcccccccatcagccagcaggtgctgcagcccccccccagcccccagggcttcgtgcagcagcccccccccgcccagatgcccgtgtactactaccccagcggccagtaccccaccagcaccacccagcagtacagacccatggcccccgtgcagtacaacgcccagagaagccagcagatgccccaggccgcccagcaggccggctaccagcccgtgctgagcggccagcagggcttccagggcctgatcggcgtgcagcagcccccccagagccagaacgtgatcaacaaccagcagggcacccccgtgcagagcgtgatggtgagctaccccaccatgagcagctaccaggtgcccatgacccagggcagccagggcctgccccagcagagctaccagcagcccatcatgctgcccaaccaggccggccagggcagcctgcccgccaccggcatgcccgtgtactgcaacgtgaccccccccaccccccagaacaacctgagactgatcggcccccactgccccagcagcaccgtgcccgtgatgagcgccagctgcagaaccaactgcgccagcatgagcaacgccggctggcaggtgaagttctag

SEQ ID NO: 10176 - DNA, 1467 bp, Artificial Sequence
  Description of Artificial Sequence: Synthetic coding sequence
atgagattccactggctgcccaccctgagcgagcccttcgacagaaaccaggagctggagacctgcatcagacccctgtggacccccagcggcagcgcctgcgagaccgagcacaacaagagcatggacatgggcaaccagcaccccagcatcagcagactgcaggagatccagaaggaggtgaagagcgtggagcagcaggtgatcggcttcagcggcctgagcgacgacaagaactacaagaagctggagagaatcctgaccaagcagctgttcgagatcgacagcgtggacaccgagggcaagggcgacatccagcaggccagaaagagagccgcccaggagaccgagagactgctgaaggagctggagcagaacgccaaccacccccacagaatcgagatccagaacatcttcgaggaggcccagagcctggtgagagagaagatcgtgcccttctacaacggcggcaactgcgtgaccgacgagttcgaggagggcatccaggacatcatcctgagactgacccacgtgaagaccggcggcaagatcagcctgagaaaggccagataccacaccctgaccaagatctgcgccgtgcaggagatcatcgaggactgcatgaagaagcagcccagcctgcccctgagcgaggacgcccaccccagcgtggccaagatcaacttcgtgatgtgcgaggtgaacaaggccagaggcgtgctgatcgccctgctgatgggcgtgaacaacaacgagacctgcagacacctgagctgcgtgctgagcggcctgatcgccgacctggacgccctggacgtgtgcggcagaaccgagatcagaaactacagaagagaggtggtggaggacatcaacaagctgctgaagtacctggacctggaggaggaggccgacaccaccaaggccttcgacctgagacagaaccacagcatcctgaagatcgagaaggtgctgaagagaatgagagagatcaagaacgagctgctgcaggcccagaaccccagcgagctgtacctgagcagcaagaccgagctgcagggcctgatcggccagctggacgaggtgagcctggagaagaacccctgcatcagagaggccagaagaagagccgtgatcgaggtgcagaccctgatcacctacatcgacctgaaggaggccctggagaagagaaagctgttcgcctgcgaggagcaccccagccacaaggccgtgtggaacgtgctgggcaacctgagcgagatccagggcgaggtgctgagcttcgacggcaacagaaccgacaagaactacatcagactggaggagctgctgaccaagcagctgctggccctggacgccgtggacccccagggcgaggagaagtgcaaggccgccagaaagcaggccgtgagactggcccagaacatcctgagctacctggacctgaagagcgacgagtgggagtactag

SEQ ID NO: 10177 - DNA, 978 bp, Artificial Sequence
  Description of Artificial Sequence: Synthetic coding sequence
atgggcaagatggtgagcgtgatcaacaccgtggacaccagccacgaggacatgatccacgacgcccagatggactactacggcaccagactggccacctgcagcagcgacagaagcgtgaagatcttcgacgtgagaaacggcggccagatcctgatcgccgacctgagaggccacgagggccccgtgtggcaggtggcctgggcccaccccatgtacggcaacatcctggccagctgcagctacgacagaaaggtgatcatctggagagaggagaacggcacctgggagaagagccacgagcacgccggccacgacagcagcgtgaacagcgtgtgctgggccccccacgactacggcctgatcctggcctgcggcagcagcgacggcgccatcagcctgctgacctacaccggcgagggccagtgggaggtgaagaagatcaacaacgcccacaccatcggctgcaacgccgtgagctgggcccccgccgtggtgcccggcagcctgatcgaccaccccagcggccagaagcccaactacatcaagagattcgccagcggcggctgcgacaacctgatcaagctgtggaaggaggaggaggacggccagtggaaggaggagcagaagctggaggcccacagcgactgggtgagagacgtggcctgggcccccagcatcggcctgcccaccagcaccatcgccagctgcagccaggacggcagagtgttcatctggacctgcgacgacgccagcagcaacacctggagccccaagctgctgcacaagttcaacgacgtggtgtggcacgtgagctggagcatcaccgccaacatcctggccgtgagcggcggcgacaacaaggtgaccctgtggaaggagagcgtggacggccagtgggtgtgcatcagcgacgtgaacaagggccagggcagcgtgagcgccagcgtgaccgagggccagcagaacgagcagtag

SEQ ID NO: 10178 - DNA, 846 bp, Artificial Sequence
  Description of Artificial Sequence: Synthetic coding sequence
atgctgttcatcttccccctgagcctgccctggagacccagctgctggaaggagagctgcagcaccggccagagacaggccggcagaagcagagaggacagcgtgacccccccccccagcagcccctggcccaccccccccgccggcgccatgagcaccaagcaggaggccagaagagacgagggcgaggccagaaccagaggccaggaggcccagctgagagacagagcccacctgagccagcagagaagactgaagcaggccacccagttcctgcacaaggacagcgccgacctgctgcccctggacagcctgaagagactgggcaccagcaaggacctgcagcccagaagcgtgatccagagaagactggtggagggcaaccccaactggctgcagggcgagccccccagaatgcaggacctgatccacggccaggagagcagaagaaagaccagcagaaccgagatccccgccctgctggtgaactgcaagtgccaggaccagctgctgagagtggccgtggacaccggcacccagtacaacagaatcagcgccggctgcctgagcagactgggcctggagaagagagtgctgaaggccagcgccggcgacctggcccccggcccccccacccaggtggagcagctggagctgcagctgggccaggagaccgtggtgtgcagcgcccaggtggtggacgccgagagccccgagttctgcctgggcctgcagaccctgctgagcctgaagtgctgcatcgacctggagcacggcgtgctgagactgaaggcccccttcagcgagctgcccttcctgcccctgtaccaggagcccggccagtag

SEQ ID NO: 10179 - DNA, 1533 bp, Artificial Sequence
  Description of Artificial Sequence: Synthetic coding sequence
accggcggcggcgtggcccccgccggccaggtgagaaccgccacctgggccagaagagccagaccctacagaaagatggccgccagaaccggcaccgagctggccagcgccgccagcaccaccgcccccggcagcagcaagagaagaaagagacacccctggcacaccgtgagcagaagacccggcagaacccccaagtggagactgcccagaatcagcgccagagccccctacagactgagaagactgagaagacacacctactggccccccagaagacccgtggccgccagcagatgctggcccgtgggcgccacccccctgggcagcgtgggcggcagaaccggcaagatggacgccgccaccctgacctacgacaccctgagattcgccgagttcgaggacttccccgagaccagcgagcccgtgtggatcctgggcagaaagtacagcatcttcaccgagaaggacgagatcctgagcgacgtggccagcagactgtggttcacctacagaaagaacttccccgccatcggcggcaccggccccaccagcgacaccggctggggctgcatgctgagatgcggccagatgatcttcgcccaggccctggtgtgcagacacctgggcagagactggagatggacccagagaaagagacagcccgacagctacttcagcgtgctgaacgccttcatcgacagaaaggacagctactacagcatccaccagatcgcccagatgggcgtgggcgagggcaagagcatcggccagtggtacggccccaacaccgtggcccaggtgctgaagaagctggccgtgttcgacacctggagcagcctggccgtgcacatcgccatggacaacaccgtggtgatggaggagatcagaagactgtgcagaaccagcgtgccctgcgccggcgccaccgccttccccgccgacagcgacagacactgcaacggcttccccgccggcgccgaggtgaccaacagacccagcccctggagacccctggtgctgctgatccccctgagactgggcctgaccgacatcaacgaggcctacgtggagaccctgaagcactgcttcatgatgccccagagcctgggcgtgatcggcggcaagcccaacagcgcccactacttcatcggctacgtgggcgaggagctgatctacctggacccccacaccacccagcccgccgtggagcccaccgacggctgcttcatccccgacgagagcttccactgccagcaccccccctgcagaatgagcatcgccgagctggaccccagcatcgccgtgggcttcttctgcaagaccgaggacgacttcaacgactggtgccagcaggtgaagaagctgagcctgctgggcggcgccctgcccatgttcgagctggtggagctgcagcccagccacctggcctgccccgacgtgctgaacctgagcctggacagcagcgacgtggagagactggagagattcttcgacagcgaggacgaggacttcgagatcctgagcctgtag

SEQ ID NO: 10180 - DNA, 552 bp, Artificial Sequence
  Description of Artificial Sequence: Synthetic coding sequence
atggccagcaacaagaccaccctgcagaagatgggcaagaagcagaacggcaagagcaagaaggtggaggaggccgagcccgaggagttcgtggtggagaaggtgctggacagaagagtggtgaacggcaaggtggagtacttcctgaagtggaagggcttcaccgacgccgacaacacctgggagcccgaggagaacctggactgccccgagctgatcgaggccttcctgaacagccagaaggccggcaaggagaaggacggcaccaagagaaagagcctgagcgacagcgagagcgacgacagcaagagcaagaagaagagagacgccgccgacaagcccagaggcttcgccagaggcctggaccccgagagaatcatcggcgccaccgacagcagcggcgagctgatgttcctgatgaagtggaaggacagcgacgaggccgacctggtgctggccaaggaggccaacatgaagtgcccccagatcgtgatcgccttctacgaggagagactgacctggcacagctgccccgaggacgaggcccagtag

SEQ ID NO: 10181 - DNA, 1464 bp, Artificial Sequence
  Description of Artificial Sequence: Synthetic coding sequence
atggagagaagcggccagagagtgaccacctgggactgcgaccagggcaagcacagcgacagcgactacagagaggacggcatggacctgggcagcgacgccggcagcagcagcagcagcagcagagccagcagccagagcaacagcaccaaggtgaccccctgcagcgagtgcaagagcagcagcagccccggcggcagcctggacctggtgagcgccctggaggactacgaggagcccttccccgtgtaccagaagaaggtgatcgacgagtgggcccccgaggaggacggcgaggaggaggaggaggaggacgagagagaccagagaggctacagagacgacagaagccccgccagagagcccggcgacgtgagcgccagaaccagaagcggcggcggcggcggcagaagcgccaccaccgccatgcccccccccgtgcccaacggcaacctgcaccagcacgacccccaggacctgagacacaacggcaacgtggtggtggccggcagacccagctgcagcagaggccccagaagagccatccagaagccccagcccgccggcggcagaagaagcggcagaggccccgccgccggcggcctgtgcctgcagccccccgacggcggcacctgcgtgcccgaggagccccccgtgccccccatggactgggaggccctggagaagcacctggccggcctgcagttcagagagcaggaggtgagaaaccagggccaggccagaaccaacagcaccagcgcccagaagaacgagagagagagcatcagacagaagctggccctgggcagcttcttcgacgacggccccggcatctacaccagctgcagcaagagcggcaagcccagcctgagcagcagactgcagagcggcatgaacctgcagatctgcttcgtgaacgacagcggcagcgacaaggacagcgacgccgacgacagcaagaccgagaccagcctggacacccccctgagccccatgagcaagcagagcagcagctacagcgacagagacaccaccgaggaggagagcgagagcctggacgacatggacttcctgaccagacagaagaagctgcaggccgaggccaagatggccctggccatggccaagcccatggccaagatgcaggtggaggtggagaagcagaacagaaagaagagccccgtggccgacctgctgccccacatgccccacatcagcgagtgcctgatgaagagaagcctgaagcccaccgacctgagagacatgaccatcggccagctgcaggtgatcgtgaacgacctgcacagccagatcgagagcctgaacgaggagctggtgcagctgctgctgatcagagacgagctgcacaccgagcaggacgccatgctggtggacatcgaggacctgaccagacacgccgagagccagcagaagcacatggccgagaagatgcccgccaagtag

SEQ ID NO: 10182 - DNA, 927 bp, Artificial Sequence
  Description of Artificial Sequence: Synthetic coding sequence
atgaagagagcccaccccgagtacagcagcagcgacagcgagctggacgagaccatcgaggtggagaaggagagcgccgacgagaacggcaacctgagcagcgccctgggcagcatgagccccaccaccagcagccagatcctggccagaaagagaagaagaggcatcatcgagaagagaagaagagacagaatcaacaacagcctgagcgagctgagaagactggtgcccagcgccttcgagaagcaggtgatggagcagggcagcgccaagctggagaaggccgagatcctgcagatgaccgtggaccacctgaagatgctgcacaccgccggcggcaagggctacttcgacgcccacgccctggccatggactacagaagcctgggcttcagagagtgcctggccgaggtggccagatacctgagcatcatcgagggcctggacgccagcgaccccctgagagtgagactggtgagccacctgaacaactacgccagccagagagaggccgccagcggcgcccacgccggcctgggccacatcccctggggcaccgtgttcggccaccacccccacatcgcccaccccctgctgctgccccagaacggccacggcaacgccggcaccaccgccagccccaccgagccccaccaccagggcagactgggcagcgcccaccccgaggcccccgccctgagagccccccccagcggcagcctgggccccgtgctgcccgtggtgaccagcgccagcaagctgagcccccccctgctgagcagcgtggccagcctgagcgccttccccttcagcttcggcagcttccacctgctgagccccaacgccctgagccccagcgcccccacccaggccgccaacctgggcaagccctacagaccctggggcaccgagatcggcgccttctag

SEQ ID NO: 10183 - DNA, 1338 bp, Artificial Sequence
  Description of Artificial Sequence: Synthetic coding sequence
atgagcgtgacctacgacgacagcgtgggcgtggaggtgagcagcgacagcttctgggaggtgggcaactacaagagaaccgtgaagagaatcgacgacggccacagactgtgcagcgacctgatgaactgcctgcacgagagagccagaatcgagaaggcctacgcccagcagctgaccgagtgggccagaagatggagacagctggtggagaagggcccccagtacggcaccgtggagaaggcctggatggccttcatgagcgaggccgagagagtgagcgagctgcacctggaggtgaaggccagcctgatgaacgacgacttcgagaagatcaagaactggcagaaggaggccttccacaagcagatgatgggcggcttcaaggagaccaaggaggccgaggacggcttcagaaaggcccagaagccctgggccaagaagctgaaggaggtggaggccgccaagaaggcccaccacgccgcctgcaaggaggagaagctggccatcagcagagaggccaacagcaaggccgaccccagcctgaaccccgagcagctgaagaagctgcaggacaagatcgagaagtgcaagcaggacgtgctgaagaccaaggagaagtacgagaagagcctgaaggagctggaccagggcaccccccagtacatggagaacatggagcaggtgttcgagcagtgccagcagttcgaggagaagagactgagattcttcagagaggtgctgctggaggtgcagaagcacctggacctgagcaacgtggccggctacaaggccatctaccacgacctggagcagagcatcagagccgccgacgccgtggaggacctgagatggttcagagccaaccacggccccggcatggccatgaactggccccagttcgaggagtggagcgccgacctgaacagaaccctgagcagaagagagaagaagaaggccaccgacggcgtgaccctgaccggcatcaaccagaccggcgaccagagcctgcccagcaagcccagcagcgtgagcagctacgagaagacccagagctaccccaccgactggagcgacgacgagagcaacaaccccttcagcagcaccgacgccaacggcgacagcaaccccttcgacgacgacgccaccagcggcaccgaggtgagagtgagagccctgtacgactacgagggccaggagcacgacgagctgagcttcaaggccggcgacgagctgaccaagatggaggacgaggacgagcagggctggtgcaagggcagactggacaacggccaggtgggcctgtaccccgccaactacgtggaggccatccagtag

SEQ ID NO: 10184 - DNA, 1248 bp, Artificial Sequence
  Description of Artificial Sequence: Synthetic coding sequence
atgatgctgggccccgagggcggcgagggcttcgtggtgaagctgagaggcctgccctggagctgcagcgtggaggacgtgcagaacttcctgagcgactgcaccatccacgacggcgccgccggcgtgcacttcatctacaccagagagggcagacagagcggcgaggccttcgtggagctgggcagcgaggacgacgtgaagatggccctgaagaaggacagagagagcatgggccacagatacatcgaggtgttcaagagccacagaaccgagatggactgggtgctgaagcacagcggccccaacagcgccgacagcgccaacgacggcttcgtgagactgagaggcctgcccttcggctgcaccaaggaggagatcgtgcagttcttcagcggcctggagatcgtgcccaacggcatcaccctgcccgtggaccccgagggcaagatcaccggcgaggccttcgtgcagttcgccagccaggagctggccgagaaggccctgggcaagcacaaggagagaatcggccacagatacatcgaggtgttcaagagcagccaggaggaggtgagaagctacagcgacccccccctgaagttcatgagcgtgcagagacccggcccctacgacagacccggcaccgccagaagatacatcggcatcgtgaagcaggccggcctggagagaatgagacccggcgcctacagcaccggctacggcggctacgaggagtacagcggcctgagcgacggctacggcttcaccaccgacctgttcggcagagacctgagctactgcctgagcggcatgtacgaccacagatacggcgacagcgagttcaccgtgcagagcaccaccggccactgcgtgcacatgagaggcctgccctacaaggccaccgagaacgacatctacaacttcttcagccccctgaaccccgtgagagtgcacatcgagatcggccccgacggcagagtgaccggcgaggccgacgtggagttcgccacccacgaggaggccgtggccgccatgagcaaggacagagccaacatgcagcacagatacatcgagctgttcctgaacagcaccaccggcgccagcaacggcgcctacagcagccaggtgatgcagggcatgggcgtgagcgccgcccaggccacctacagcggcctggagagccagagcgtgagcggctgctacggcgccggctacagcggccagaacagcatgggcggctacgactag

SEQ ID NO: 10185 - DNA, 1770 bp, Artificial Sequence
  Description of Artificial Sequence: Synthetic coding sequence
atgagcgtgagcgtgcacgagaccagaaagagcagaagcagcaccggcagcatgaacgtgaccctgttccacaaggccagccaccccgactgcgtgctggcccacctgaacaccctgagaaagcactgcatgttcaccgacgtgaccctgtgggccggcgacagagccttcccctgccacagagccgtgctggccgccagcagcagatacttcgaggccatgttcagccacggcctgagagagagcagagacgacaccgtgaacttccaggacaacctgcaccccgaggtgctggagctgctgctggacttcgcctacagcagcagaatcgccatcaacgaggagaacgccgagagcctgctggaggccggcgacatgctgcagttccacgacgtgagagacgccgccgccgagttcctggagaagaacctgttccccagcaactgcctgggcatgatgctgctgagcgacgcccaccagtgcagaagactgtacgagttcagctggagaatgtgcctggtgcacttcgagaccgtgagacagagcgaggacttcaacagcctgagcaaggacaccctgctggacctgatcagcagcgacgagctggagaccgaggacgagagagtggtgttcgaggccatcctgcagtgggtgaagcacgacctggagcccagaaaggtgcacctgcccgagctgctgagaagcgtgagactggccctgctgcccagcgactgcctgcaggaggccgtgagcagcgaggccctgctgatggccgacgagagaaccaagctgatcatggacgaggccctgagatgcaagaccagaatcctgcagaacgacggcgtggtgaccagcccctgcgccagacccagaaaggccggccacaccctgctgatcctgggcggccagaccttcatgtgcgacaagatctaccaggtggaccacaaggccaaggagatcatccccaaggccgacctgcccagccccagaaaggagttcagcgccagcgccatcggctgcaaggtgtacgtgaccggcggcagaggcagcgagaacggcgtgagcaaggacgtgtgggtgtacgacaccgtgcacgaggagtggagcaaggccgcccccatgctgatcgccagattcggccacggcagcgccgagctggagaactgcctgtacgtggtgggcggccacaccagcctggccggcgtgttccccgccagccccagcgtgagcctgaagcaggtggagaagtacgaccccggcgccaacaagtggatgatggtggcccccctgagagacggcgtgagcaacgccgccgtggtgagcgccaagctgaagctgttcgtgttcggcggcaccagcatccacagagacatggtgagcaaggtgcagtgctacgaccccagcgagaacagatggaccatcaaggccgagtgcccccagccctggagatacaccgccgccgccgtgctgggcagccagatcttcatcatgggcggcgacaccgagttcaccgccgccagcgcctacagattcgactgcgagaccaaccagtggaccagaatcggcgacatgaccgccaagagaatgagctgccacgccctggccagcggcaacaagctgtacgtggtgggcggctacttcggcacccagagatgcaagaccctggactgctacgaccccaccagcgacacctggaactgcatcaccaccgtgccctacagcctgatccccaccgccttcgtgagcacctggaagcacctgcccgcctag

SEQ ID NO: 10186 - DNA, 1311 bp, Artificial Sequence
  Description of Artificial Sequence: Synthetic coding sequence
atgatgggcgaggccgccgtggccgccggcccctgccccctgagagaggacagcttcaccagattcagcagccagagcaacgtgtacggcctggccggcggcgccggcggcagaggcgagctgctggccgccaccctgaagggcaaggtgctgggcttcagataccaggacctgagacagaagatcagacccgtggccaaggagctgcagttcaactacatccccgtggacgccgagatcgtgagcatcgacaccttcaacaagagcccccccaagagaggcctggtggtgggcatcaccttcatcaaggacagcggcgacaagggcagccccttcctgaacatctactgcgactacgagcccggcagcgagtacaacctggacagcatcgcccagagctgcctgaacctggagctgcagttcacccccttccagctgtgccacgccgaggtgcaggtgggcgaccagctggagaccgtgttcctgctgagcggcaacgaccccgccatccacctgtacaaggagaacgagggcctgcaccagttcgaggagcagcccgtggagaacctgttccccgagctgaccaacctgaccagcagcgtgctgtggctggacgtgcacaacttccccggcaccagcagaagactgagcgccctgggctgccagagcggctacgtgagagtggcccacgtggaccagagaagcagagaggtgctgcagatgtggagcgtgctgcaggacggccccatcagcagagtgatcgtgttcagcctgagcgccgccaaggagaccaaggacagacccctgcaggacgagtacagcgtgctggtggccagcatgctggagcccgccgtggtgtacagagacctgctgaacagaggcctggaggaccagctgctgctgcccggcagcgaccagttcgacagcgtgctgtgcagcctggtgaccgacgtggacctggacggcagacccgaggtgctggtggccacctacggccaggagctgctgtgctacaagtacagaggccccgagagcggcctgcccgaggcccagcacggcttccacctgctgtggcagagaagcttcagcagccccctgctggccatggcccacgtggacctgaccggcgacggcctgcaggagctggccgtggtgagcctgaagggcgtgcacatcctgcagcacagcctgatccaggccagcgagctggtgctgaccagactgagacaccaggtggagcagagaagaagaagactgcagggcctggaggacggcgccggcgccggccccgccgagaacgccgccagctag

SEQ ID NO: 10187 - DNA, 642 bp, Artificial Sequence
  Description of Artificial Sequence: Synthetic coding sequence
atgctgctgcccttcatcagaaccctgcccctgctgtgctacaaccacctgctggtgagccccgacagcgccaccctgagccccccctacagcctggagaagatgaccgacctggtggccgtgtgggacgtggccctgagcgacggcgtgcacaagatcgagttcgagcacggcaccaccagcggcaagagagtggtgtacgtggacggcaaggaggagatcagaaaggagtggatgttcaagctggtgggcaaggagaccttctacgtgggcgccgccaagaccaaggccaccatcaacatcgacgccatcagcggcttcgcctacgagtacaccctggagatcaacggcaagagcctgaagaagtacatggaggacagaagcaagaccaccaacacctgggtgctgcacatggacggcgagaacttcagaatcgtgctggagaaggacgccatggacgtgtggtgcaacggcaagaagctggagaccgccggcgagttcgtggacgacggcaccgagacccacttcagcatcggcaaccacgactgctacatcaaggccgtgagcagcggcaagagaaaggagggcatcatccacaccctgatcgtggacaacagagagatccccgagatcgccagctag

SEQ ID NO: 10188 - DNA, 663 bp, Artificial Sequence
  Description of Artificial Sequence: Synthetic coding sequence
atgaccagcggcgaggtgaagaccagcctgaagaacgcctacagcagcgccaagagactgagccccaagatggaggaggagggcgaggaggaggactactgcacccccggcgccttcgagctggagagactgttctggaagggcagcccccagtacacccacgtgaacgaggtgtggcccaagctgtacatcggcgacgaggccaccgccctggacagatacagactgcagaaggccggcttcacccacgtgctgaacgccgcccacggcagatggaacgtggacaccggccccgactactacagagacatggacatccagtaccacggcgtggaggccgacgacctgcccaccttcgacctgagcgtgttcttctaccccgccgccgccttcatcgacagagccctgagcgacgaccacagcaagatcctggtgcactgcgtgatgggcagaagcagaagcgccaccctggtgctggcctacctgatgatccacaaggacatgaccctggtggacgccatccagcaggtggccaagaacagatgcgtgctgcccaacagaggcttcctgaagcagctgagagagctggacaagcagctggtgcagcagagaagaagaagccagagacaggacggcgaggaggaggacggcagagagctgtag

SEQ ID NO: 10189 - DNA, 1845 bp, Artificial Sequence
  Description of Artificial Sequence: Synthetic coding sequence
atgagccccgccgacagatgcagaagcgccaacaccatcgagcccgccaccaccagcagcctggccctgttcctgctgctgcagagagaccagagcagcagaaccagaggcctgcccgaggagaaggaggaggtgaccatggacaccagcgagaacagacccgagaacgacgtgcccgagccccccatgcccatcgccgaccaggtgagcaacgacgacagacccgagggcagcgtggaggacgaggagaagaaggagagcagcctgcccaagagcttcaagagaaagatcagcgtggtgagcgccaccaagggcgtgcccgccggcaacagcgacaccgagggcggccagcccggcagaaagagaagatggggcgccagcaccgccaccacccagaagaagcccagcatcagcatcaccaccgagagcctgaagagcctgatccccgacatcaagcccctggccggccaggaggccgtggtggacctgcacgccgacgacagcagaatcagcgaggacgagaccgagagaaacggcgacgacggcacccacgacaagggcctgaagatctgcagaaccgtgacccaggtggtgcccgccgagggccaggagaacggccagagagaggaggaggaggaggagaaggagcccgaggccgagccccccgtgcccccccaggtgagcgtggaggtggccctgcccccccccgccgagcacgaggtgaagaaggtgaccctgggcgacaccctgaccagaagaagcatcagccagcagaagagcggcgtgagcatcaccatcgacgaccccgtgagaaccgcccaggtgcccagcccccccagaggcaagatcagcaacatcgtgcacatcagcaacctggtgagacccttcaccctgggccagctgaaggagctgctgggcagaaccggcaccctggtggaggaggccttctggatcgacaagatcaagagccactgcttcgtgacctacagcaccgtggaggaggccgtggccaccagaaccgccctgcacggcgtgaagtggccccagagcaaccccaagttcctgtgcgccgactacgccgagcaggacgagctggactaccacagaggcctgctggtggacagacccagcgagaccaagaccgaggagcagggcatccccagacccctgcacccccccccccccccccccgtgcagcccccccagcaccccagagccgagcagagagagcaggagagagccgtgagagagcagtgggccgagagagagagagagatggagagaagagagagaaccagaagcgagagagagtgggacagagacaaggtgagagagggccccagaagcagaagcagaagcagagacagaagaagaaaggagagagccaagagcaaggagaagaagagcgagaagaaggagaaggcccaggaggagccccccgccaagctgctggacgacctgttcagaaagaccaaggccgccccctgcatctactggctgcccctgaccgacagccagatcgtgcagaaggaggccgagagagccgagagagccaaggagagagagaagagaagaaaggagcaggaggaggaggagcagaaggagagagagaaggaggccgagagagagagaaacagacagctggagagagagaagagaagagagcacagcagagagagagacagagagagagagagagagagagagagagacagaggcgacagagacagagacagagagagagacagagagagaggcagagagagagacagaagagacaccaagagacacagcagaagcagaagcagaagcacccccgtgagagacagaggcggcagaagatag

SEQ ID NO: 10190 - DNA, 1203 bp, Artificial Sequence
  Description of Artificial Sequence: Synthetic coding sequence
atgaagaacgagcccctgacccccggctaccacggcttccccgccagagacagccagggcaaccaggagcccaccaccacccccgacgccatggtgcagcccttcaccaccatccccttccccccccccccccagaacggcatccccaccgagtacggcgtgccccacacccaggactacgccggccagaccggcgagcacaacctgaccctgtacggcagcacccaggcccacggcgagcagagcagcaacagccccagcacccagaacggcagcctgaccaccgagggcggcgcccagaccgacggccagcagagccagacccagagcagcgagaacagcgagagcaagagcacccccaagagactgcacgtgagcaacatccccttcagattcagagaccccgacctgagacagatgttcggccagttcggcaagatcctggacgtggagatcatcttcaacgagagaggcagcaagggcttcggcttcgtgaccttcgagaacagcgccgacgccgacagagccagagagaagctgcacggcaccgtggtggagggcagaaagatcgaggtgaacaacgccaccgccagagtgatgaccaacaagaagatggtgaccccctacgccaacggctggaagctgagccccgtggtgggcgccgtgtacggccccgagctgtacgccgccagcagcttccaggccgacgtgagcctgggcaacgacgccgccgtgcccctgagcggcagaggcggcatcaacacctacatccccctgatcatccccggcttcccctaccccaccgccgccaccaccgccgccgccttcagaggcgcccacctgagaggcagaggcagaaccgtgtacggcgccgtgagagccgtgccccccaccgccatccccgcctaccccggcgtggtgtaccaggacggcttctacggcgccgacctgtacatcgagagcgccaactgcttcagaagcaacagagtggacatgcagcccaccgacatgcacagcctgctgctgcagccccagccccccctgctgcagcccctgcagcccctgaccgtgaccgtgatggccggctgcacccagcccacccccaccatgcccctgcccctgcccctggccatggagctggccctgtggagagtgtacaccgaggtggccaccgccgacctgccccccaccgaggtgacctag

SEQ ID NO: 10191 - DNA, 1545 bp, Artificial Sequence
  Description of Artificial Sequence: Synthetic coding sequence
atggacgagggcatggagatcagcagcgagggcaacagcctgatcaaggccgtgcaccagagcagactgagactgaccagactgctgctggagggcggcgcctacatcaacgagagcaacgacagaggcgagacccccctgatgatcgcctgcaagaccaagcacgtggaccaccagagcgtgagcaaggccaagatggtgaagtacctgctggagaacaacgccgaccccaacatccaggacaagagcggcaagaccgccctgatgcacgcctgcctggagaaggccggccccgaggtggtgagcctgctgctgaagagcggcgccgacctgagcctgcaggaccacagcagctacagcgccctggtgtacgccatcaacagcgaggacaccgagaccctgaaggtgctgctgagcgcctgcaaggccaagggcaaggaggtgatcatcatcaccaccgccaagctgccctgcggcaagcacaccaccaagcagtacctgaacatgccccccgtggacatcgacggctgccacagccccgccacctgcaccacccccagcgagatcgacatcaagaccgccagcagccccctgagccacagcagcgagaccgagctgaccctgttcggcttcaaggacctggagctggccggcagcaacgacgacacctgggaccccggcagccccgtgagaaagcccgccctggcccccaagggccccaagctgccccacgcccccccctgggtgaagagcccccccctgctgatgcaccagaacagagtggccagcctgcaggaggagctgcaggacatcacccccgaggaggagctgagctacaagaccaacggcctggccctgagcaagagattcatcaccagacaccagagcatcgacgtgaaggacaccgcccacctgctgagagccttcgaccaggccagcagcagaaagatgagctacgacgagatcaactgccagagctacctgagcgagggcaaccagcagtgcatcgaggtgcccgtggaccaggaccccgacagcaaccagaccatcttcgccagcaccctgagaagcatcgtgcagaagagaaacctgggcgccaaccactacagcagcgacagccagctgagcgccggcctgaccccccccaccagcgaggacggcaaggccctgatcggcaagaagaagatcctgagccccagccccagccagctgagcgagagcaaggagctgctggagaacatcccccccggccccctgagcagaagaaaccacgccgtgctggagagaagaggcagcggcgccttccccctggaccacagcgtgacccagaccagacagggcttcctgccccccctgaacgtgaacagccacccccccatcagcgacatcaacgtgaacaacaagatctgcagcctgctgagctgcggccagaaggtgctgatgcccaccgtgcccatcttccccaaggagttcaagagcaagaagatgctgctgagaagacagagcctgcagaccgagcagatcaagcagctggtgaacttctag

SEQ ID NO: 10192 - DNA, 1674 bp, Artificial Sequence
  Description of Artificial Sequence: Synthetic coding sequence
atggaccagagcagagtgctgctgtgggtgaaggccgagcccttcatcgtgggcgccctgcaggtgcccccccccagcaagttcagcctgcactacctgagaaagatcagcacctacgtgcagatcagagccaccgagggcgcctaccccagactgtactggagcacctggagacacatcgcctgcggcaagctgcagctggccaaggacctggcctggctgtacttcgagatcttcgacagcctgagcatgaagacccccgaggagagactggagtggagcgaggtgctgagcaactgcatgagcgaggaggaggtggagaagcagagaaaccagctgagcgtggacaccctgcagttcctgctgttcctgtacatccagcagctgaacaaggtgagcctgagaaccagcctgatcggcgaggagtggcccagccccagaaacaagagccagagccccgacctgaccgagaagagcaactgccacaacaagaactggaacgactacagccaccaggccttcgtgtacgaccacctgagcgacctgctggagctgctgctggaccccaagcagctgaccgccagcttccacagcacccacagcagcctggtgagcagagaggccgtggtggccctgagcttcctgatcgagggcaccatcagcagagccagaaagatctaccccctgcacgagctggccctgtggcagcccctgcacgccgacagcggcttcagcaagatcagcaagaccttcagcttctacaagctggagacctggctgagaagctgcctgaccggcaaccccttcggcaccagcgcctgcctgaagagcggcaagaagctggcctgggcccaccaggtggagggcaccaccaagagagccaagatcgcctgcaacacccacgtggcccccagaatgcacagactggtggtgatgagccaggtgtacaagcagaccctggccaagagcagcgacaccctggccggcgcccacgtgaagatccacagatgcaacgagagcttcatctacctgctgagccccctgagaagcgtgaccatcgagaagtgcagaaacagcatcttcgtgctgggccccgtgggcaccaccctgcacctgcacagctgcgacaacgtgaaggtgatcgccgtgtgccacagactgagcatcagcagcaccaccggctgcatcttccacgtgctgacccccaccagacccctgatcctgagcggcaaccagaccgtgaccttcgcccccttccacacccactaccccatgctggaggaccacatggccagaaccggcctggccaccgtgcccaactactgggacaaccccatggtggtgtgcagagagaacagcgacaccagagtgttccagctgctgcccccctgcgagttctacgtgttcatcatccccttcgagatggagggcgacaccaccgagatccccggcggcctgcccagcgtgtaccagaaggccctgggccagagagagcagaagatccagatctggcagaagaccgtgaaggaggcccacctgaccaaggaccagagaaagcagttccaggtgctggtggagaacaagttctacgagtggctgatcaacaccggccacagacagcagctggacagcctggtgccccccgccgccggcagcaagcaggccgccggctag

SEQ ID NO: 10193 - DNA, 648 bp, Artificial Sequence
  Description of Artificial Sequence: Synthetic coding sequence
atggtgttcagaagattcgtggaggtgggcagagtggcctacgtgagcttcggcccccacgccggcaagctggtggccatcgtggacgtgatcgaccagaacagagccctggtggacggcccctgcacccaggtgagaagacaggccatgcccttcaagtgcatgcagctgaccgacttcatcctgaagttcccccacagcgcccaccagaagtacgtgagacaggcctggcagaaggccgacatcaacaccaagtgggccgccaccagatgggccaagaagatcgaggccagagagagaaaggccaagatgaccgacttcgacagattcaaggtgatgaaggccaagaagatgagaaacagaatcatcaagaacgaggtgaagaagctgcagaaggccgccctgctgaaggccagccccaagaaggcccccggcaccaagggcaccgccgccgccgccgccgccgccgccgccgccaaggtgcccgccaagaagatcaccgccgccagcaagaaggcccccgcccagaaggtgcccgcccagaaggccaccggccagaaggccgcccccgcccccaaggcccagaagggccagaaggcccccgcccagaaggcccccgcccccaaggccagcggcaagaaggcctag

SEQ ID NO: 10194 - DNA, 888 bp, Artificial Sequence
  Description of Artificial Sequence: Synthetic coding sequence
atggagctgatccaggacaccagcagaccccccctggagtacgtgaagggcgtgcccctgatcaagtacttcgccgaggccctgggccccctgcagagcttccaggccagacccgacgacctgctgatcaacacctaccccaagagcggcaccacctgggtgagccagatcctggacatgatctaccagggcggcgacctggagaagtgcaacagagcccccatctacgtgagagtgcccttcctggaggtgaacgaccccggcgagcccagcggcctggagaccctgaaggacacccccccccccagactgatcaagagccacctgcccctggccctgctgccccagaccctgctggaccagaaggtgaaggtggtgtacgtggccagaaaccccaaggacgtggccgtgagctactaccacttccacagaatggagaaggcccaccccgagcccggcacctgggacagcttcctggagaagttcatggccggcgaggtgagctacggcagctggtaccagcacgtgcaggagtggtgggagctgagcagaacccaccccgtgctgtacctgttctacgaggacatgaaggagaaccccaagagagagatccagaagatcctggagttcgtgggcagaagcctgcccgaggagaccatggacttcatggtgcagcacaccagcttcaaggagatgaagaagaaccccatgaccaactacaccaccgtgccccaggagctgatggaccacagcatcagccccttcatgagaaagggcatggccggcgactggaagaccaccttcaccgtggcccagaacgagagattcgacgccgactacgccgagaagatggccggctgcagcctgagcttcagaagcgagctgtag

SEQ ID NO: 10195 - DNA, 1368 bp, Artificial Sequence
  Description of Artificial Sequence: Synthetic coding sequence
atgagcagcctgggcgccagcttcgtgcagatcaagttcgacgacctgcagttcttcgagaactgcggcggcggcagcttcggcagcgtgtacagagccaagtggatcagccaggacaaggaggtggccgtgaagaagctgctgaagatcgagaaggaggccgagatcctgagcgtgctgagccacagaaacatcatccagttctacggcgtgatcctggagccccccaactacggcatcgtgaccgagtacgccagcctgggcagcctgtacgactacatcaacagcaacagaagcgaggagatggacatggaccacatcatgacctgggccaccgacgtggccaagggcatgcactacctgcacatggaggcccccgtgaaggtgatccacagagacctgaagagcagaaacgtggtgatcgccgccgacggcgtgctgaagatctgcgacttcggcgccagcagattccacaaccacaccacccacatgagcctggtgggcaccttcccctggatggcccccgaggtgatccagagcctgcccgtgagcgagacctgcgacacctacagctacggcgtggtgctgtgggagatgctgaccagagaggtgcccttcaagggcctggagggcctgcaggtggcctggctggtggtggagaagaacgagagactgaccatccccagcagctgccccagaagcttcgccgagctgctgcaccagtgctgggaggccgacgccaagaagagacccagcttcaagcagatcatcagcatcctggagagcatgagcaacgacaccagcctgcccgacaagtgcaacagcttcctgcacaacaaggccgagtggagatgcgagatcgaggccaccctggagagactgaagaagctggagagagacctgagcttcaaggagcaggagctgaaggagagagagagaagactgaagatgtgggagcagaagctgaccgagcagagcaacacccccctgctgctgcccctggccgccagaatgagcgaggagagctacttcgagagcaagaccgaggagagcaacagcgccgagatgagctgccagatcaccgccaccagcaacggcgagggccacggcatgaaccccagcctgcaggccatgatgctgatgggcttcggcgacatcttcagcatgaacaaggccggcgccgtgatgcacagcggcatgcagatcaacatgcaggccaagcagaacagcagcaagaccaccagcaagagaagaggcaagaaggtgaacatggccctgggcttcagcgacttcgacctgagcgagggcgacgacgacgacgacgacgacggcgaggaggaggacaacgacatggacaacagcgagtag

SEQ ID NO: 10196 - DNA, 423 bp, Artificial Sequence
  Description of Artificial Sequence: Synthetic coding sequence
atgagattcagattctgcggcgacctggactgccccgactgggtgctggccgagatcagcaccctggccaagatgagcagcgtgaagctgagactgctgtgcagccaggtgctgaaggagctgctgggccagggcatcgactacgagaagatcctgaagctgaccgccgacgccaagttcgagagcggcgacgtgaaggccaccgtggccgtgctgagcttcatcctgagcagcgccgccaagcacagcgtggacggcgagagcctgagcagcgagctgcagcagctgggcctgcccaaggagcacgccgccagcctgtgcagatgctacgaggagaagcagagccccctgcagaagcacctgagagtgtgcagcctgagaaagctgaagcaggcccagaccctgatgagcagcctgggctag

SEQ ID NO: 10197 - DNA, 573 bp, Artificial Sequence
  Description of Artificial Sequence: Synthetic coding sequence
atgaccgccagcgccagcagcttcagcagcagccagggcgtgcagcagcccagcatctacagcttcagccagatcaccagaagcctgttcctgagcaacggcgtggccgccaacgacaagctgctgctgagcagcaacagaatcaccgccatcgtgaacgccagcgtggaggtggtgaacgtgttcttcgagggcatccagtacatcaaggtgcccgtgaccgacgccagagacagcagactgtacgacttcttcgaccccatcgccgacctgatccacaccatcgacatgagacagggcagaaccctgctgcactgcatggccggcgtgagcagaagcgccagcctgtgcctggcctacctgatgaagtaccacagcatgagcctgctggacgcccacacctggaccaagagcagaagacccatcatcagacccaacaacggcttctgggagcagctgatcaactacgagttcaagctgttcaacaacaacaccgtgagaatgatcaacagccccgtgggcaacatccccgacatctacgagaaggacctgagaatgatgatcagcatgtag

SEQ ID NO: 10198 - DNA, 3576 bp, Artificial Sequence
  Description of Artificial Sequence: Synthetic coding sequence
atgctgagaaagctgaccatcgagcagatcaacgactggttcaccatcggcaagaccgtgaccaacgtggagctgctgggcgccccccccgccttccccgccggcgccgccagagaggaggtgcagagacaggacgtggcccccggcgccggccccgccgcccaggcccccgccctggcccaggcccccgccagacccgccgccgccttcgagagaagcctgagccagagaagcagcgaggtggagtacatcaacaagtacagacagctggaggcccaggagctggacgtgtgcagaagcgtgcagcccaccagcggccccggccccagacccagcctggccaagctgagcagcgtgacctgcatccccggcaccacctacaagtaccccgacctgcccatcagcagatacaaggaggaggtggtgagcctgatcgagagcaacagcgtggtgatcatccacggcgccaccggcagcggcaagagcacccagctgccccagtacatcctggaccactacgtgcagagaagcgcctactgcagcatcgtggtgacccagcccagaaagatcggcgccagcagcatcgccagatggatcagcaaggagagagcctggaccctgggcggcgtggtgggctaccaggtgggcctggagaagatcgccaccgaggacaccagactgatctacatgaccaccggcgtgctgctgcagaagatcgtgagcgccaagagcctgatggagttcacccacatcatcatcgacgaggtgcacgagagaaccgaggagatggacttcctgctgctggtggtgagaaagctgctgagaaccaacagcagattcgtgaaggtggtgctgatgagcgccaccatcagctgcaaggagttcgccgactacttcgccgtgcccgtgcagaacaagatgaaccccgcctacatcttcgaggtggagggcaagccccacagcgtggaggagtactacctgaacgacctggagcacatccaccacagcaagctgagcccccacctgctggaggagcccgtgatcaccaaggacatctacgaggtggccgtgagcctgatccagatgttcgacgacctggacatgaaggagagcggcaacaaggcctggagcggcgcccagttcgtgctggagagaagcagcgtgctggtgttcctgcccggcctgggcgagatcaactacatgcacgagctgctgaccagcctggtgcacaagagactgcaggtgtaccccctgcacagcagcgtggccctggaggagcagaacaacgtgttcctgagccccgtgcccggctacagaaagatcatcctgagcaccaacatcgccgagagcagcgtgaccgtgcccgacgtgaagtacgtgatcgacttctgcctgaccagaaccctggtgtgcgacgaggacaccaactaccagagcctgagactgagctgggccagcaagaccagctgcaaccagagaaagggcagagccggcagagtgagcagaggctactgctacagactggtgcacaaggacttctgggacaacagcatccccgaccacgtggtgcccgagatgctgagatgccccctgggcagcaccatcctgaaggtgaagctgctggacatgggcgagcccagagccctgctggccaccgccctgagcccccccggcctgagcgacatcgagagaaccatcctgctgctgaaggaggtgggcgccctggccgtgagcggccagagagaggacgagaacccccacgacggcgagctgaccttcctgggcagagtgctggcccagctgcccgtgaaccagcagctgggcaagctgatcgtgctgggccacgtgttcggctgcctggacgagtgcctgatcatcgccgccgccctgagcctgaagaacttcttcgccatgcccttcagacagcacctggacggctacagaaacaaggtgaacttcagcggcagcagcaagagcgactgcatcgccctggtggaggccttcaagacctggaaggcctgcagacagaccggcgagctgagataccccaaggacgagctgaactggggcagactgaactacatccagatcaagagaatcagagaggtggccgagctgtacgaggagctgaagaccagaatcagccagttcaacatgcacgtggacagcagaagacccgtgatggaccaggagtacatctacaagcagagattcatcctgcaggtggtgctggccggcgccttctaccccaactacttcaccttcggccagcccgacgaggagatggccgtgagagagctggccggcaaggaccccaagaccaccgtggtgctgaagcacatccccccctacggcttcctgtactacaagcagctgcagagcctgttcagacagtgcggccaggtgaagagcatcgtgttcgacggcgccaaggccttcgtggagttcagcagaaaccccaccgagagattcaagaccctgcccgccgtgtacatggccatcaagatgagccagctgaaggtgagcctggagctgagcgtgcacagcgccgaggagatcgagggcaaggtgcagggcatgaacgtgagcaagctgagaaacaccagagtgaacgtggacttccagaagcagaccgtggaccccatgcaggtgagcttcaacaccagcgacagaagccagaccgtgaccgacctgctgctgaccatcgacgtgaccgaggtggtggaggtgggccacttctggggctacagaatcgacgagaacaacagcgagatcctgaagaagctgaccgccgagatcaaccagctgaccctggtgcccctgcccacccacccccaccccgacctggtgtgcctggcccccttcgccgacttcgacaagcagagatacttcagagcccaggtgctgtacgtgagcggcaacagcgccgaggtgttcttcgtggactacggcaacaagagccacgtggacctgcacctgctgatggagatcccctgccagttcctggagctgcccttccaggccctggagttcaagatctgcaagatgagacccagcgccaagagcctggtgtgcggcaagcactggagcgacggcgccagccagtggttcgccagcctggtgagcggctgcaccctgctggtgaaggtgttcagcgtggtgcacagcgtgctgcacgtggacgtgtaccagtacagcggcgtgcaggacgccatcaacatcagagacgtgctgatccagcagggctacgccgagctgaccgaggagagctacgagagcaaggtgaacatcctgagagccgccatcaacaagctggtgtgcgacggccccaacggctgcaagtgcctgggccccgagagagtggcccagctgcaggacatcgccagacagaagctgctgggcctgttctgccagagcaagcccagagagaagatcgtgcccaagtggcacgagaagccctacgagtggaaccaggtggaccccaagctggtgatggagcaggccgacagagagagcagcagaggcaagaacaccttcctgtaccagctgcacaagctggtggtgctgggcacctag

SEQ ID NO: 10199 - DNA, 906 bp, Artificial Sequence
  Description of Artificial Sequence: Synthetic coding sequence
atgaccagacacggcaagaactgcaccgccggcgccgtgtacacctaccacgagaagaagaaggacaccgccgccagcggctacggcacccagaacatcagactgagcagagacgccgtgaaggacttcgactgctgctgcctgagcctgcagccctgccacgaccccgtggtgacccccgacggctacctgtacgagagagaggccatcctggagtacatcctgcaccagaagaaggagatcgccagacagatgaaggcctacgagaagcagagaggcaccagaagagaggagcagaaggagctgcagagagccgccagccaggaccacgtgagaggcttcctggagaaggagagcgccatcgtgagcagacccctgaaccccttcaccgccaaggccctgagcggcaccagccccgacgacgtgcagcccggccccagcgtgggcccccccagcaaggacaaggacaaggtgctgcccagcttctggatccccagcctgacccccgaggccaaggccaccaagctggagaagcccagcagaaccgtgacctgccccatgagcggcaagcccctgagaatgagcgacctgacccccgtgcacttcacccccctggacagcagcgtggacagagtgggcctgatcaccagaagcgagagatacgtgtgcgccgtgaccagagacagcctgagcaacgccaccccctgcgccgtgctgagacccagcggcgccgtggtgaccctggagtgcgtggagaagctgatcagaaaggacatggtggaccccgtgaccggcgacaagctgaccgacagagacatcatcgtgctgcagagaggcggcaccggcttcgccggcagcggcgtgaagctgcaggccgagaagagcagacccgtgatgcaggcctag

SEQ ID NO: 10200 - DNA, 1509 bp, Artificial Sequence
  Description of Artificial Sequence: Synthetic coding sequence
atgcagagctgcgagagcagcggcgacagcgccgacgaccccctgagcagaggcctgagaagaagaggccagcccagagtggtggtgatcggcgccggcctggccggcctggccgccgccaaggccctgctggagcagggcttcaccgacgtgaccgtgctggaggccagcagccacatcggcggcagagtgcagagcgtgaagctgggccacgccaccttcgagctgggcgccacctggatccacggcagccacggcaaccccatctaccacctggccgaggccaacggcctgctggaggagaccaccgacggcgagagaagcgtgggcagaatcagcctgtacagcaagaacggcgtggcctgctacctgaccaaccacggcagaagaatccccaaggacgtggtggaggagttcagcgacctgtacaacgaggtgtacaacctgacccaggagttcttcagacacgacaagcccgtgaacgccgagagccagaacagcgtgggcgtgttcaccagagaggaggtgagaaacagaatcagaaacgaccccgacgaccccgaggccaccaagagactgaagctggccatgatccagcagtacctgaaggtggagagctgcgagagcagcagccacagcatggacgaggtgagcctgagcgccttcggcgagtggaccgagatccccggcgcccaccacatcatccccagcggcttcatgagagtggtggagctgctggccgagggcatccccgcccacgtgatccagctgggcaagcccgtgagatgcatccactgggaccaggccagcgccagacccagaggccccgagatcgagcccagaggcgtgctgaagagacagtacaccagcttcttcagacccggcctgcccaccgagaaggtggccgccatccacagactgggcatcggcaccaccgacaagatcttcctggagttcgaggagcccttctggggccccgagtgcaacagcctgcagttcgtgtgggaggacgaggccgagagccacaccctgacctacccccccgagctgtggtacagaaagatctgcggcttcgacgtgctgtacccccccgagagatacggccacgtgctgagcggctggatctgcggcgaggaggccctggtgatggagaagtgcgacgacgaggccgtggccgagatctgcaccgagatgctgagacagttcaccggcaaccccaacatccccaagcccagaagaatcctgagaagcgcctggggcagcaacccctacttcagaggcagctacagctacacccaggtgggcagcagcggcgccgacgtggagaagctggccaagcccctgccctacaccgagagcagcaagaccgcccccatgcaggtgctgttcagcggcgaggccacccacagaaagtactacagcaccacccacggcgccctgctgagcggccagagagaggccgccagactgatcgagatgtacagagacctgttccagcagggcacctag

SEQ ID NO: 10201 - DNA, 579 bp, Artificial Sequence
  Description of Artificial Sequence: Synthetic coding sequence
atgggcaccttcgacctgtggaccgactacctgggcctggcccacctggtgagagccctgagcggcaaggagggccccgagaccagactgagcccccagcccgagcccgagcccatgctggagcccgtgagcgccctggagcccatgcccgcccccgagagcgtgcccgtgcccggccccaaggaccagaagagaagcctggagagcagccccgcccccgagagactgtgcagcttctgcaagcacaacggcgagagcagagccatctaccagagccacgtgctgaaggacgaggccggcagagtgctgtgccccatcctgagagactacgtgtgcccccagtgcggcgccaccagagagagagcccacaccagaagattctgccccctgaccggccagggctacaccagcgtgtacagccacaccaccagaaacagcgccggcaagaagctggtgagacccgacaaggccaagacccaggacaccggccacagaagaggcggcggcggcggcgccggcttcagaggcgccggcaagagcgagcccagccccagctgcagccccagcatgagcacctag

SEQ ID NO: 10202 - DNA, 2568 bp, Artificial Sequence
  Description of Artificial Sequence: Synthetic coding sequence
atggccgtggaggacagcaccctgcaggtggtggtgagagtgagaccccccacccccagagagctggacagccagagaagacccgtggtgcaggtggtggacgagagagtgctggtgttcaaccccgaggagcccgacggcggcttccccggcctgaagtggggcggcacccacgacggccccaagaagaagggcaaggacctgaccttcgtgttcgacagagtgttcggcgaggccgccacccagcaggacgtgttccagcacaccacccacagcgtgctggacagcttcctgcagggctacaactgcagcgtgttcgcctacggcgccaccggcgccggcaagacccacaccatgctgggcagagagggcgaccccggcatcatgtacctgaccaccgtggagctgtacagaagactggaggccagacagcaggagaagcacttcgaggtgctgatcagctaccaggaggtgtacaacgagcagatccacgacctgctggagcccaagggccccctggccatcagagaggaccccgacaagggcgtggtggtgcagggcctgagcttccaccagcccgccagcgccgagcagctgctggagatcctgaccagaggcaacagaaacagaacccagcaccccaccgacgccaacgccaccagcagcagaagccacgccatcttccagatcttcgtgaagcagcaggacagagtgcccggcctgacccaggccgtgcaggtggccaagatgagcctgatcgacctggccggcagcgagagagccagcagcacccacgccaagggcgagagactgagagagggcgccaacatcaacagaagcctgctggccctgatcaacgtgctgaacgccctggccgacgccaagggcagaaagacccacgtgccctacagagacagcaagctgaccagactgctgaaggacagcctgggcggcaactgcagaaccgtgatgatcgccgccatcagccccagcagcctgacctacgaggacacctacaacaccctgaagtacgccgacagagccaaggagatcagactgagcctgaagagcaacgtgaccagcctggactgccacatcagccagtacgccaccatctgccagcagctgcaggccgaggtggccgccctgagaaagaagctgcaggtgtacgagggcggcggccagccccccccccaggacctgcccggcagccccaagagcggccccccccccgagcacctgcccagcagccccctgcccccccacccccccagccagccctgcacccccgagctgcccgccggccccagagccctgcaggaggagagcctgggcatggaggcccaggtggagagagccatggagggcaacagcagcgaccaggagcagagccccgaggacgaggacgagggccccgccgaggaggtgcccacccagatgcccgagcagaaccccacccacgccctgcccgagagccccagactgaccctgcagcccaagcccgtggtgggccacttcagcgccagagagctggacggcgacagaagcaagcagctggccctgaaggtgctgtgcgtggcccagagacagtacagcctgctgcaggccgccaacctgctgacccccgacatgatcaccgagttcgagaccctgcagcagctggtgcaggaggagaagatcgagcccggcgccgaggccctgagaaccagcggcctggccagaggcgcccccctggcccaggagctgtgcagcgagagcaagccccccggctacaccggccccgtgaccagaaccatggccagaagactgagcggccccctgcacaccctgggcatcccccccggccccaactgcacccccgcccagggcagcagatggcccatggagaagaagagaagaagacccagcgccctggaggccgacagccccatggcccccaagagaggcaccaagagacagagacagagcttcctgccctgcctgagaagaggcagcctgcccgacacccagcccagccagggccccagcacccccaagggcgagagagccagcagcccctgccacagccccagagtgtgccccgccaccgtgatcaagagcagagtgcccctgggccccagcgccatgcagaactgcagcacccccctggccctgcccaccagagacctgaacgccaccttcgacctgagcgaggagccccccagcaagcccagcttccacgagtgcatcggctgggacaagatcccccaggagctgagcagactggaccagcccttcatccccagagcccccgtgcccctgttcaccatgaagggccccaagcccaccagcagcctgcccggcaccagcgcctgcaagaagaagagagtggccagcagcagcgtgagccacggcagaagcagaatcgccagactgcccagcagcaccctgaagagacccgccggccccctggtgctgcccgagctgcccctgagccccctgtgccccagcaacagaagaaacggcaaggacctgatcagagtgggcagagccctgagcgccggcaacggcgtgaccaaggtgagctag

SEQ ID NO: 10203 - DNA, 444 bp, Artificial Sequence
  Description of Artificial Sequence: Synthetic coding sequence
atgtggaagttccccggcggcctgagcgagcccgaggaggacatcggcgacaccgccgtgagagaggtgttcgaggagaccggcatcaagagcgagttcagaagcgtgctgagcatcagacagcagcacaccaaccccggcgccttcggcaagagcgacatgtacatcatctgcagactgaagccctacagcttcaccatcaacttctgccaggaggagtgcctgagatgcgagtggatggacctgaacgacctggccaagaccgagaacaccacccccatcaccagcagagtggccagactgctgctgtacggctacagagagggcttcgacaagatcgacctgaccgtggaggagctgcccgccgtgtacaccggcctgttctacaagctgtaccacaaggagctgcccgagaactacaagaccatgaagggcatcgactag

SEQ ID NO: 10204 - DNA, 3327 bp, Artificial Sequence
  Description of Artificial Sequence: Synthetic coding sequence
atggccctgagacccggcgccggcagcggcggcggcggcgccgccggcgccggcgccggcagcgccggcggcggcggcttcatgttccccgtggccggcggcatcagacccccccaggccggcctgatgcccatgcagcagcagggcttccccatggtgagcgtgatgcagcccaacatgcagggcatcatgggcatgaactacagcagccagatgagccagggccccatcgccatgcaggccggcatccccatgggccccatgcccgccgccggcatgccctacctgggccaggcccccttcctgggcatgagaccccccggcccccagtacacccccgacatgcagaagcagttcgccgaggagcagcagaagagattcgagcagcagcagaagctgctggaggaggagagaaagagaagacagttcgaggagcagaagcagaagctgagactgctgagcagcgtgaagcccaagaccggcgagaagagcagagacgacgccctggaggccatcaagggcaacctggacggcttcagcagagacgccaagatgcaccccacccccgccagccaccccaagaagcccggcgtgggcgtgttccccagccaggaccccgcccagcccagaatgcccccctggatctacaacgagagcctggtgcccgacgcctacaagaagatcctggagaccaccatgacccccaccggcatcgacaccgccaagctgtaccccatcctgatgagcagcggcctgcccagagagaccctgggccagatctgggccctggccaacagaaccacccccggcaagctgaccaaggaggagctgtacaccgtgctggccatgatcgccgtgacccaggtggtgaagcccgaggaggacgacttccaggacttccaggacgccagcaagagcggcagcctggacgacagcttcagcgacttccaggagctgcccgccagcagcaagaccagcaacagccagcacggcaacagcgcccccagcctgctgatgcccctgcccggcaccaaggccctgcccagcatggacaagtacgccgtgttcaagggcatcgccgccgacaagagcagcgagaacaccgtgccccccggcgaccccggcgacaagtacagcgccttcagagagctggagcagaccgccgagaacaagcccctgggcgagagcttcgccgagttcagaagcgccggcaccgacgacggcttcaccgacttcaagaccgccgacagcgtgagccccctggagccccccaccaaggacaagaccttcccccccagcttccccagcggcaccatccagcagaagcagcagacccaggtgaagaaccccctgaacctggccgacctggacatgttcagcagcgtgaactgcagcagcgagaagcccctgagcttcagcgccgtgttcagcaccagcaagagcgtgagcaccccccagagcaccggcagcgccgccaccatgaccgccctggccgccaccaagaccagcagcctggccgacgacttcggcgagttcagcctgttcggcgagtacagcggcctggcccccgtgggcgagcaggacgacttcgccgacttcatggccttcagcaacagcagcatcagcagcgagcagaagcccgacgacaagtacgacgccctgaaggaggaggccagccccgtgcccctgaccagcaacgtgggcagcaccgtgaagggcggccagaacagcaccgccgccagcaccaagtacgacgtgttcagacagctgagcctggagggcagcggcctgggcgtggaggacctgaaggacaacacccccagcggcaagagcgacgacgacttcgccgacttccacagcagcaagttcagcagcatcaacagcgacaagagcctgggcgagaaggccgtggccttcagacacaccaaggaggacagcgccagcgtgaagagcctggacctgcccagcatcggcggcagcagcgtgggcaaggaggacagcgaggacgccctgagcgtgcagttcgacatgaagctggccgacgtgggcggcgacctgaagcacgtgatgagcgacagcagcctggacctgcccaccgtgagcggccagcacccccccgccgccgccggcagcggcagccccagcgccaccagcatcctgcagaagaaggagaccagcttcggcagcagcgagaacatcaccatgaccagcctgagcaaggtgaccaccttcgtgagcgaggacgccctgcccgagaccaccttccccgccctggccagcttcaaggacaccatcccccagaccagcgagcagaaggagtacgagaacagagactacaaggacttcaccaagcaggacctgcccaccgccgagagaagccaggaggccacctgccccagccccgccagcagcggcgccagccaggagacccccaacgagtgcagcgacgacttcggcgagttccagagcgagaagcccaagatcagcaagttcgacttcctggtggccaccagccagagcaagatgaagagcagcgaggagatgatcaagagcgagctggccaccttcgacctgagcgtgcagggcagccacaagagaagcctgagcctgggcgacaaggagatcagcagaagcagccccagccccgccctggagcagcccttcagagacagaagcaacaccctgaacgagaagcccgccctgcccgtgatcagagacaagtacaaggacctgaccggcgaggtggaggagaacgagagatacgcctacgagtggcagagatgcctgggcagcgccctgaacgtgatcaagaaggccaacgacaccctgaacggcatcagcagcagcagcgtgtgcaccgaggtgatccagagcgcccagggcatggagtacctgctgggcgtggtggaggtgtacagagtgaccaagagagtggagctgggcatcaaggccaccgccgtgtgcagcgagaagctgcagcagctgctgaaggacatcgacaaggtgtggaacaacctgatcggcttcatgagcctggccaccctgacccccgacgagaacagcctggacttcagcagctgcatgctgagacccggcatcaagaacgcccaggagctggcctgcggcgtgtgcctgctgaacgtggacagcagaagcagaaaggaggagaagcccgccgaggagcaccccaagaaggccttcaacagcgagaccgacagcttcaagctggcctacggcggccaccagtaccacgccagctgcgccaacttctggatcaactgcgtggagcccaagccccccggcctggtgctgcccgacctgctgtag

SEQ ID NO: 10205 - DNA, 1257 bp, Artificial Sequence
  Description of Artificial Sequence: Synthetic coding sequence
atggagacccacatcagctgcctgttccccgagctgctggccatgatcttcggctacctggacgtgagagacaagggcagagccgcccaggtgtgcaccgcctggagagacgccgcctaccacaagagcgtgtggagaggcgtggaggccaagctgcacctgagaagagccaaccccagcctgttccccagcctgcaggccagaggcatcagaagagtgcagatcctgagcctgagaagaagcctgagctacgtgatccagggcatggccaacatcgagagcctgaacctgagcggctgctacaacctgaccgacaacggcctgggccacgccttcgtgcaggagatcggcagcctgagagccctgaacctgagcctgtgcaagcagatcaccgacagcagcctgggcagaatcgcccagtacctgaagggcctggaggtgctggagctgggcggctgcagcaacatcaccaacaccggcctgctgctgatcgcctggggcctgcagagactgaagagcctgaacctgagaagctgcagacacctgagcgacgtgggcatcggccacctggccggcatgaccagaagcgccgccgagggctgcctgggcctggagcagctgaccctgcaggactgccagaagctgaccgacctgagcctgaagcacatcagcagaggcctgaccggcctgagactgctgaacctgagcttctgcggcggcatcagcgacgccggcctgctgcacctgagccacatgggcagcctgagaagcctgaacctgagaagctgcgacaacatcagcgacaccggcatcatgcacctggccatgggcagcctgagactgagcggcctggacgtgagcttctgcgacaaggtgggcgaccagagcctggcctacatcgcccagggcctggacggcctgaagagcctgagcctgtgcagctgccacatcagcgacgacggcatcaacagaatggtgagacagatgcacggcctgagaaccctgaacatcggccagtgcgtgagaatcaccgacaagggcctggagctgatcgccgagcacctgagccagctgaccggcatcgacctgtacggctgcaccagaatcaccaagagaggcctggagagaatcacccagctgccctgcctgaaggtgctgaacctgggcctgtggcagatgaccgacagcgagaaggaggccagaggcgacttcagccccctgttcaccgtgagaaccagaggcagcagcagaagatag

SEQ ID NO: 10206 - DNA, 1371 bp, Artificial Sequence
  Description of Artificial Sequence: Synthetic coding sequence
atggccgccgccctgaagtgcctgctgaccctgggcagatggtgccccggcctgggcgtggccccccaggccagagccctggccgccctggtgcccggcgtgacccaggtggacaacaagagcggcttcctgcagaagagaccccacagacagcaccccggcatcctgaagctgccccacgtgagactgccccaggccctggccaacggcgcccagctgctgctgctgggcagcgccggccccaccatggagaaccaggtgcagaccctgaccagctacctgtggagcagacacctgcccgtggagcccgaggagctgcagagaagagccagacacctggagaagaagttcctggagaaccccgacctgagccagaccgaggagaagctgagaggcgccgtgctgcacgccctgagaaagaccacctaccactggcaggagctgagctacaccgagggcctgagcctggtgtacatggccgccagactggacggcggcttcgccgccgtgagcagagccttccacgagatcagagccagaaaccccgccttccagccccagaccctgatggacttcggcagcggcaccggcagcgtgacctgggccgcccacagcatctggggccagagcctgagagagtacatgtgcgtggacagaagcgccgccatgctggtgctggccgagaagctgctgaagggcggcagcgagagcggcgagccctacatccccggcgtgttcttcagacagttcctgcccgtgagccccaaggtgcagttcgacgtggtggtgagcgccttcagcctgagcgagctgcccagcaaggccgacagaaccgaggtggtgcagaccctgtggagaaagaccggccacttcctggtgctggtggagaacggcaccaaggccggccacagcctgctgatggacgccagagacctggtgctgaagggcaaggagaagagccccctggaccccagacccggcttcgtgttcgccccctgcccccacgagctgccctgcccccagctgaccaacctggcctgcagcttcagccaggcctaccaccccatccccttcagctggaacaagaagcccaaggaggagaagttcagcatggtgatcctggccagaggcagccccgaggaggcccacagatggcccagaatcacccagcccgtgctgaagagacccagacacgtgcactgccacctgtgctgccccgacggccacatgcagcacgccgtgctgaccgccagaagacacggcagagacctgtacagatgcgccagagtgagcagctggggcgacctgctgcccgtgctgacccccagcgccttcccccccagcaccgcccaggaccccagcgagagctag

SEQ ID NO: 10207 - DNA, 756 bp, Artificial Sequence
  Description of Artificial Sequence: Synthetic coding sequence
atggacatgaagagaagaatccacctggagctgagaaacagaacccccgccgccgtgagagagctggtgctggacaactgcaagagcaacgacggcaagatcgagggcctgaccgccgagttcgtgaacctggagttcctgagcctgatcaacgtgggcctgatcagcgtgagcaacctgcccaagctgcccaagctgaagaagctggagctgagcgagaacagaatcttcggcggcctggacatgctggccgagaagctgcccaacctgacccacctgaacctgagcggcaacaagctgaaggacatcagcaccctggagcccctgaagaagctggagtgcctgaagagcctggacctgttcaactgcgaggtgaccaacctgaacgactacagagagagcgtgttcaagctgctgccccagctgacctacctggacggctacgacagagaggaccaggaggcccccgacagcgacgccgaggtggacggcgtggacgaggaggaggaggacgaggagggcgaggacgaggaggacgaggacgacgaggacggcgaggaggaggagttcgacgaggaggacgacgaggacgaggacgtggagggcgacgaggacgacgacgaggtgagcgaggaggaggaggagttcggcctggacgaggaggacgaggacgaggacgaggacgaggaggaggaggagggcggcaagggcgagaagagaaagagagagaccgacgacgagggcgaggacgactag

SEQ ID NO: 10208 - DNA, 510 bp, Artificial Sequence
  Description of Artificial Sequence: Synthetic coding sequence
atgagcgccccccccgccctgcagatcagagaggccaacgcccacctggccgccgtgcacagaagagccgccgagctggaggccagactggacgccgccgagagaaccgtgcacgcccaggccgagagactggccctgcacgaccagcagctgagagccgccctggacgagctgggcagagccaaggacagagagatcgccaccctgcaggagcagctgatgaccagcgaggccaccgtgcacagcctgcaggccaccgtgcaccagagagacgagctgatcagacagctgcagcccagagccgagctgctgcaggacatctgcagaagaagaccccccctggccggcctgctggacgccctggccgaggccgagagactgggccccctgcccgccagcgaccccggccaccccccccccggcggccccggcccccccctggacaacagcaccggcgaggaggccgacagagaccacctgcagcccgccgtgttcggcaccaccgtgtag

SEQ ID NO: 10209 - DNA, 2079 bp, Artificial Sequence
  Description of Artificial Sequence: Synthetic coding sequence
atgaagatcttctgcagcagagccaaccccaccaccggcagcgtggagtggctggaggaggacgagcactacgactaccaccaggagatcgccagaagcagctacgccgacatgctgcacgacaaggacagaaacgtgaagtactaccagggcatcagagccgccgtgagcagagtgaaggacagaggccagaaggccctggtgctggacatcggcaccggcaccggcctgctgagcatgatggccgtgaccgccggcgccgacttctgctacgccatcgaggtgttcaagcccatggccgacgccgccgtgaagatcgtggagaagaacggcttcagcgacaagatcaaggtgatcaacaagcacagcaccgaggtgaccgtgggccccgagggcgacatgccctgcagagccaacatcctggtgaccgagctgttcgacaccgagctgatcggcgagggcgccctgcccagctacgagcacgcccacagacacctggtggaggagaactgcgaggccgtgccccacagagccaccgtgtacgcccagctggtggagagcggcagaatgtggagctggaacaagctgttccccatccacgtgcagaccagcctgggcgagcaggtgatcgtgccccccgtggacgtggagagctgccccggcgcccccagcgtgtgcgacatccagctgaaccaggtgagccccgccgacttcaccgtgctgagcgacgtgctgcccatgttcagcatcgacttcagcaagcaggtgagcagcagcgccgcctgccacagcagaagattcgagcccctgaccagcggcagagcccaggtggtgctgagctggtgggacatcgagatggaccccgagggcaagatcaagtgcaccatggcccccttctgggcccacagcgaccccgaggagatgcagtggagagaccactggatgcagtgcgtgtacttcctgccccaggaggagcccgtggtgcagggcagcgccctgtacctggtggcccaccacgacgactactgcgtgtggtacagcctgcagagaaccagccccgagaagaacgagagagtgagacagatgagacccgtgtgcgactgccaggcccacctgctgtggaacagacccagattcggcgagatcaacgaccaggacagaaccgacagatacgtgcaggccctgagaaccgtgctgaagcccgacagcgtgtgcctgtgcgtgagcgacggcagcctgctgagcgtgctggcccaccacctgggcgtggagcaggtgttcaccgtggagagcagcgccgccagccacaagctgctgagaaagatcttcaaggccaaccacctggaggacaagatcaacatcatcgagaagagacccgagctgctgaccaacgaggacctgcagggcagaaaggtgagcctgctgctgggcgagcccttcttcaccaccagcctgctgccctggcacaacctgtacttctggtacgtgagaaccgccgtggaccagcacctgggccccggcgccatggtgatgccccaggccgccagcctgcacgccgtggtggtggagttcagagacctgtggagaatcagaagcccctgcggcgactgcgagggcttcgacgtgcacatcatggacgacatgatcaagagagccctggacttcagagagagcagagaggccgagccccaccccctgtgggagtacccctgcagaagcctgagcgagccctggcagatcctgaccttcgacttccagcagcccgtgcccctgcagcccctgtgcgccgagggcaccgtggagctgagaagacccggccagagccacgccgccgtgctgtggatggagtaccacctgacccccgagtgcaccctgagcaccggcctgctggagcccgccgaccccgagggcggctgctgctggaacccccactgcaagcaggccgtgtacttcttcagccccgcccccgaccccagagccctgctgggcggccccagaaccgtgagctacgccgtggagttccaccccgacaccggcgacatcatcatggagttcagacacgccgacacccccgactag

SEQ ID NO: 10210 - DNA, 468 bp, Artificial Sequence
  Description of Artificial Sequence: Synthetic coding sequence
atgaccgtggagggccccccccccaaggacaccggcatcgccagagtgcccctggccggcgccgccggcggccccggcatcggcagagccgccggcagaggcatccccgccggcgtgcccatgccccaggcccccgccggcctggccggccccgtgagaggcgtgggcggccccagccagcaggtgatgaccccccagggcagaggcaccgtggccgccgccgccgccgccgccaccgccagcatcgccggcgcccccacccagtacccccccggcagaggcggcccccccccccccatgggcagaggcgcccccccccccggcatgatgggccccccccccggcatgagaccccccatgggcccccccatgggcatcccccccggcagaggcacccccatgggcatgcccccccccggcatgagaccccccccccccggcatgagaggcaagtgcctgcagtggtag

SEQ ID NO: 10211 - DNA, 402 bp, Artificial Sequence
  Description of Artificial Sequence: Synthetic coding sequence
atgaccagaggcaaccagagagagctggccagacagaagaacatgaagaagcagagcgacagcgtgaagggcaagagaagagacgacggcctgagcgccgccgccagaaagcagagcgcccccagcagcctgccccccggcaccagaagaagctgcagcagaagcagaaagagacagaccagaagaagaagaaaccccagcagcttcgtggccagctgccccaccctgctgcccttcgcctgcgtgcccggcgccagccccaccaccctggccttcccccccgtggtgctgaccggccccagcaccgacggcatccccttcgccctgagcctgcagagagtgcccttcgtgctgcccagcccccaggtggccagcctgcccctgggccacagcagaggctag

SEQ ID NO: 10212 - DNA, 1809 bp, Artificial Sequence
  Description of Artificial Sequence: Synthetic coding sequence
atggccgagttcagagtgagagtgagcaccggcgaggccttcggcgccggcacctgggacaaggtgagcgtgagcatcgtgggcaccagaggcgagagcccccccctgcccctggacaacctgggcaaggagttcaccgccggcgccgaggaggacttccaggtgaccctgcccgaggacgtgggcagagtgctgctgctgagagtgcacaaggccccccccgtgctgcccctgctgggccccctggcccccgacgcctggttctgcagatggttccagctgaccccccccagaggcggccacctgctgttcccctgctaccagtggctggagggcgccggcaccctggtgctgcaggagggcaccgccaaggtgagctgggccgaccaccaccccgtgctgcagcagcagagacaggaggagctgcaggccagacaggagatgtaccagtggaaggcctacaaccccggctggccccactgcctggacgagaagaccgtggaggacctggagctgaacatcaagtacagcaccgccaagaacgccaacttctacctgcaggccggcagcgccttcgccgagatgaagatcaagggcctgctggacagaaagggcctgtggagaagcctgaacgagatgaagagaatcttcaacttcagaagaacccccgccgccgagcacgccttcgagcactggcaggaggacgccttcttcgccagccagttcctgaacggcctgaaccccgtgctgatcagaagatgccactacctgcccaagaacttccccgtgaccgacgccatggtggccagcgtgctgggccccggcaccagcctgcaggccgagctggagaagggcagcctgttcctggtggaccacggcatcctgagcggcatccagaccaacgtgatcaacggcaagccccagttcagcgccgcccccatgaccctgctgtaccagagccccggctgcggccccctgctgcccctggccatccagctgagccagacccccggccccaacagccccatcttcctgcccaccgacgacaagtgggactggctgctggccaagacctgggtgagaaacgccgagttcagcttccacgaggccctgacccacctgctgcacagccacctgctgcccgaggtgttcaccctggccaccctgagacagctgccccactgccaccccctgttcaagagcaccggcatcggcatcgagggcttcagcgagctgatccagagaaacatgaagcagctgaactacagcctgctgtgcctgcccgaggacatcagaaccagaggcgtggaggacatccccggctactactacagagacgacggcatgcagatctggggcatccccagcagcctggagaccagagaggccctggtgcagtacgtgaccatggtgatcttcacctgcagcgccaagcacgccgccgtgagcgccggccagttcgacagctgcgcctggatgcccaacctgccccccagcatgcagctgcccccccccaccagcaagggcctggccacctgcgagggcttcatcgccaccctgccccccgtgaacgccacctgcgacgtgatcctggccctgtggctgctgagcaaggagcccggcgaccagagacccctgggcacctaccccgacgagcacttcaccgaggaggcccccagaagaagcatcgccaccttccagagcagactggcccagatcagcagaggcatccaggagagaaaccagggcctggtgctgccctacacctacctggacccccccctgatcgagaacagcgtgagcatctag

SEQ ID NO: 10213 - DNA, 3123 bp, Artificial Sequence
  Description of Artificial Sequence: Synthetic coding sequence
atggtgagcagcgcccagatgggcttcaacctgcaggccctgctggagcagctgagccaggacgagctgagcaagttcaagtacctgatcaccaccttcagcctggcccacgagctgcagaagatcccccacaaggaggtggacaaggccgacggcaagcagctggtggagatcctgaccacccactgcgacagctactgggtggagatggccagcctgcaggtgttcgagaagatgcacagaatggacctgagcgagagagccaaggacgaggtgagagaggccgccctgaagagcttcaacaagagaaagcccctgagcctgggcatcaccagaaaggagagaccccccctggacgtggacgagatgctggagagattcaagaccgaggcccaggacaaggacaacagatgcagatacatcctgaagaccaagttcagagagatgtggaagagctggcccggcgacagcaaggaggtgcaggtgatggccgagagatacaagatgctgatccccttcagcaaccccagagtgctgcccggccccttcagctacaccgtggtgctgtacggccccgccggcctgggcaagaccaccctggcccagaagctgatgctggactgggccgaggacaacctgatccacaagttcaagtacgccttctacctgagctgcagagagctgagcagactgggcccctgcagcttcgccgagctggtgttcagagactggcccgagctgcaggacgacatcccccacatcctggcccaggccagaaagatcctgttcgtgatcgacggcttcgacgagctgggcgccgcccccggcgccctgatcgaggacatctgcggcgactgggagaagaagaagcccgtgcccgtgctgctgggcagcctgctgaacagagtgatgctgcccaaggccgccctgctggtgaccaccagacccagagccctgagagacctgagaatcctggccgaggagcccatctacatcagagtggagggcttcctggaggaggacagaagagcctacttcctgagacacttcggcgacgaggaccaggccatgagagccttcgagctgatgagaagcaacgccgccctgttccagctgggcagcgcccccgccgtgtgctggatcgtgtgcaccaccctgaagctgcagatggagaagggcgaggaccccgtgcccacctgcctgaccagaaccggcctgttcctgagattcctgtgcagcagattcccccagggcgcccagctgagaggcgccctgagaaccctgagcctgctggccgcccagggcctgtgggcccagaccagcgtgctgcacagagaggacctggagagactgggcgtgcaggagagcgacctgagactgttcctggacggcgacatcctgagacaggacagagtgagcaagggctgctacagcttcatccacctgagcttccagcagttcctgaccgccctgttctacaccctggagaaggaggaggaggaggacagagacggccacacctgggacatcggcgacgtgcagaagctgctgagcggcgtggagagactgagaaaccccgacctgatccaggccggctactacagcttcggcctggccaacgagaagagagccaaggagctggaggccaccttcggctgcagaatgagccccgacatcaagcaggagctgctgagatgcgacatcagctgcaagggcggccacagcaccgtgaccgacctgcaggagctgctgggctgcctgtacgagagccaggaggaggagctggtgaaggaggtgatggcccagttcaaggagatcagcctgcacctgaacgccgtggacgtggtgcccagcagcttctgcgtgaagcactgcagaaacctgcagaagatgagcctgcaggtgatcaaggagaacctgcccgagaacgtgaccgccagcgagagcgacgccgaggtggagagaagccaggacgaccagcacatgctgcccttctggaccgacctgtgcagcatcttcggcagcaacaaggacctgatgggcctggccatcaacgacagcttcctgagcgccagcctggtgagaatcctgtgcgagcagatcgccagcgacacctgccacctgcagagagtggtgttcaagaacatcagccccgccgacgcccacagaaacctgtgcctggccctgagaggccacaagaccgtgacctacctgaccctgcagggcaacgaccaggacgacatgttccccgccctgtgcgaggtgctgagacaccccgagtgcaacctgagatacctgggcctggtgagctgcagcgccaccacccagcagtgggccgacctgagcctggccctggaggtgaaccagagcctgacctgcgtgaacctgagcgacaacgagctgctggacgagggcgccaagctgctgtacaccaccctgagacaccccaagtgcttcctgcagagactgagcctggagaactgccacctgaccgaggccaactgcaaggacctggccgccgtgctggtggtgagcagagagctgacccacctgtgcctggccaagaaccccatcggcaacaccggcgtgaagttcctgtgcgagggcctgagataccccgagtgcaagctgcagaccctggtgctgtggaactgcgacatcaccagcgacggctgctgcgacctgaccaagctgctgcaggagaagagcagcctgctgtgcctggacctgggcctgaaccacatcggcgtgaagggcatgaagttcctgtgcgaggccctgagaaagcccctgtgcaacctgagatgcctgtggctgtggggctgcagcatcccccccttcagctgcgaggacctgtgcagcgccctgagctgcaaccagagcctggtgaccctggacctgggccagaaccccctgggcagcagcggcgtgaagatgctgttcgagaccctgacctgcagcagcggcaccctgagaaccctgagactgaagatcgacgacttcaacgacgagctgaacaagctgctggaggagatcgaggagaagaacccccagctgatcatcgacaccgagaagcaccacccctgggccgagagacccagcagccacgacttcatgatctag

SEQ ID NO: 10214 - DNA, 3864 bp, Artificial Sequence
  Description of Artificial Sequence: Synthetic coding sequence
atggtgcccggcgaggagaaccagctggtgcccaaggaggcccccctggaccacaccagcgacaagagcctgctggacgccaacttcgagcccggcaagaagaacttcctgcacctgaccgacaaggacggcgagcagccccagatcctgctggaggacagcagcgccggcgaggacagcgtgcacgacagattcatcggccccctgcccagagagggcagcggcggcagcaccagcgactacgtgagccagagctacagctacagcagcatcctgaacaagagcgagaccggctacgtgggcctggtgaaccaggccatgacctgctacctgaacagcctgctgcagaccctgttcatgacccccgagttcagaaacgccctgtacaagtgggagttcgaggagagcgaggaggaccccgtgaccagcatcccctaccagctgcagagactgttcgtgctgctgcagaccagcaagaagagagccatcgagaccaccgacgtgaccagaagcttcggctgggacagcagcgaggcctggcagcagcacgacgtgcaggagctgtgcagagtgatgttcgacgccctggagcagaagtggaagcagaccgagcaggccgacctgatcaacgagctgtaccagggcaagctgaaggactacgtgagatgcctggagtgcggctacgagggctggagaatcgacacctacctggacatccccctggtgatcagaccctacggcagcagccaggccttcgccagcgtggaggaggccctgcacgccttcatccagcccgagatcctggacggccccaaccagtacttctgcgagagatgcaagaagaagtgcgacgccagaaagggcctgagattcctgcacttcccctacctgctgaccctgcagctgaagagattcgacttcgactacaccaccatgcacagaatcaagctgaacgacagaatgaccttccccgaggagctggacatgagcaccttcatcgacgtggaggacgagaagagcccccagaccgagagctgcaccgacagcggcgccgagaacgagggcagctgccacagcgaccagatgagcaacgacttcagcaacgacgacggcgtggacgagggcatctgcctggagaccaacagcggcaccgagaagatcagcaagagcggcctggagaagaacagcctgatctacgagctgttcagcgtgatggtgcacagcggcagcgccgccggcggccactactacgcctgcatcaagagcttcagcgacgagcagtggtacagcttcaacgaccagcacgtgagcagaatcacccaggaggacatcaagaagacccacggcggcagcagcggcagcagaggctactacagcagcgccttcgccagcagcaccaacgcctacatgctgatctacagactgaaggaccccgccagaaacgccaagttcctggaggtggacgagtaccccgagcacatcaagaacctggtgcagaaggagagagagctggaggagcaggagaagagacagagagagatcgagagaaacacctgcaagatcaagctgttctgcctgcaccccaccaagcaggtgatgatggagaacaagctggaggtgcacaaggacaagaccctgaaggaggccgtggagatggcctacaagatgatggacctggaggaggtgatccccctggactgctgcagactggtgaagtacgacgagttccacgactacctggagagaagctacgagggcgaggaggacacccccatgggcctgctgctgggcggcgtgaagagcacctacatgttcgacctgctgctggagaccagaaagcccgaccaggtgttccagagctacaagcccggcgaggtgatggtgaaggtgcacgtggtggacctgaaggccgagagcgtggccgcccccatcaccgtgagagcctacctgaaccagaccgtgaccgagttcaagcagctgatcagcaaggccatccacctgcccgccgagaccatgagaatcgtgctggagagatgctacaacgacctgagactgctgagcgtgagcagcaagaccctgaaggccgagggcttcttcagaagcaacaaggtgttcgtggagagcagcgagaccctggactaccagatggccttcgccgacagccacctgtggaagctgctggacagacacgccaacaccatcagactgttcgtgctgctgcccgagcagagccccgtgagctacagcaagagaaccgcctaccagaaggccggcggcgacagcggcaacgtggacgacgactgcgagagagtgaagggccccgtgggcagcctgaagagcgtggaggccatcctggaggagagcaccgagaagctgaagagcctgagcctgcagcagcagcaggacggcgacaacggcgacagcagcaagagcaccgagaccagcgacttcgagaacatcgagagccccctgaacgagagagacagcagcgccagcgtggacaacagagagctggagcagcacatccagaccagcgaccccgagaacttccagagcgaggagagaagcgacagcgacgtgaacaacgacagaagcaccagcagcgtggacagcgacatcctgagcagcagccacagcagcgacaccctgtgcaacgccgacaacgcccagatccccctggccaacggcctggacagccacagcatcaccagcagcagaagaaccaaggccaacgagggcaagaaggagacctgggacaccgccgaggaggacagcggcaccgacagcgagtacgacgagagcggcaagagcagaggcgagatgcagtacatgtacttcaaggccgagccctacgccgccgacgagggcagcggcgagggccacaagtggctgatggtgcacgtggacaagagaatcaccctggccgccttcaagcagcacctggagcccttcgtgggcgtgctgagcagccacttcaaggtgttcagagtgtacgccagcaaccaggagttcgagagcgtgagactgaacgagaccctgagcagcttcagcgacgacaacaagatcaccatcagactgggcagagccctgaagaagggcgagtacagagtgaaggtgtaccagctgctggtgaacgagcaggagccctgcaagttcctgctggacgccgtgttcgccaagggcatgaccgtgagacagagcaaggaggagctgatcccccagctgagagagcagtgcggcctggagctgagcatcgacagattcagactgagaaagaagacctggaagaaccccggcaccgtgttcctggactaccacatctacgaggaggacatcaacatcagcagcaactgggaggtgttcctggaggtgctggacggcgtggagaagatgaagagcatgagccagctggccgtgctgagcagaagatggaagcccagcgagatgaagctggaccccttccaggaggtggtgctggagagcagcagcgtggacgagctgagagagaagctgagcgagatcagcggcatccccctggacgacatcgagttcgccaagggcagaggcaccttcccctgcgacatcagcgtgctggacatccaccaggacctggactggaaccccaaggtgagcaccctgaacgtgtggcccctgtacatctgcgacgacggcgccgtgatcttctacagagacaagaccgaggagctgatggagctgaccgacgagcagagaaacgagctgatgaagaaggagagcagcagactgcagaagaccggccacagagtgacctacagccccagaaaggagaaggccctgaagatctacctggacggcgcccccaacaaggacctgacccaggactag

SEQ ID NO: 10215 - DNA, 420 bp, Artificial Sequence
  Description of Artificial Sequence: Synthetic coding sequence
atgccctggagagccggcaacggcgtgggcctggaggcccaggccggcacccaggaggccggccccgaggagtactgccaggaggagctgggcgccgaggaggagatggccgccagagccgcctggcccgtgctgagaagcgtgaacagcagagagctgagcagaatcatcatctgcaaccacagccccagaatcgtgctgcccgtgtggctgaactactacggcaagctgctgccctacctgaccctgctgcccggcagagacttcagaatccacaacttcagaagccacccctggctgttcagagacgccagaacccacgacaagctgctggtgaaccagaccgagctgttcgtgcccagcagcaacgtgaacggccagcccgtgttcgccaacatcaccctgcagtgcatcccctag

SEQ ID NO: 10216 - DNA, 582 bp, Artificial Sequence
  Description of Artificial Sequence: Synthetic coding sequence
atggagggctgcgtgagcaacctgatggtgtgcaacctggcctacagcggcaagctggaggagctgaaggagagcatcctggccgacaagagcctggccaccagaaccgaccaggccggctggagccccctgcacatcgccgccagcgccggcagagacgagatcgtgaaggccctgctgggcaagggcgcccaggtgaacgccgtgaaccagaacggctgcacccccctgcactacgccgccagcaagaacagacacgagatcgccgtgatgctgctggagggcggcgccaaccccgacgccaaggaccactacgaggccaccgccatgcacagagccgccgccaagggcaacctgaagatgatccacatcctgctgtactacaaggccagcaccaacatccaggacaccgagggcaacacccccctgcacctggcctgcgacgaggagagagtggaggaggccaagctgctggtgagccagggcgccagcatctacatcgagaacaaggaggagaagacccccctgcaggtggccaagggcggcctgggcctgatcctgaagagaatggtggagggctag

SEQ ID NO: 10217 - DNA, 612 bp, Artificial Sequence
  Description of Artificial Sequence: Synthetic coding sequence
atgagcgagaacgccgcccccggcctgatcagcgagctgaagctggccgtgccctggggccacatcgccgccaaggcctggggcagcctgcagggcccccccgtgctgtgcctgcacggctggctggacaacgccagcagcttcgacagactgatccccctgctgccccaggacttctactacgtggccatggacttcggcggccacggcctgagcagccactacagccccggcgtgccctactacctgcagaccttcgtgagcgagatcagaagagtggtggccgccctgaagtggaacagattcagcatcctgggccacagcttcggcggcgtggtgggcggcatgttcttctgcaccttccccgagatggtggacaagctgatcctgctggacacccccctgttcctgctggagagcgacgagatggagaacctgctgacctacaagagaagagccatcgagcacgtgctgcaggtggaggccagccaggagcccagccacgtgttcagcctgaagcagctgctgcagagacagagaaccgccctgaccagcagcgccggcagctgcgtgagaatccccagcggcagctgcagacccatgagctgctag

SEQ ID NO: 10218 - DNA, 765 bp, Artificial Sequence
  Description of Artificial Sequence: Synthetic coding sequence
atgcccgccggcagcatgagcaccaccggctaccccggcgtgtgcagcaccaccagctacagaacccactgctacatccccgtgaccagcagcgtgaccctgagcagcagcgacctgagccccaccttcggccactgcctgcccagcagctaccagggcaacctgtggctgctggactactgccaggagagctacggcgaggcccccacctgcaagagccccagctgcgagcccaagacctgcagcaccaccggctgcgaccccagcaacagcagcgtgccctgcaacagccccagcgccggccaggtgttcagcgtgtgcgagaccaccaacgtgagccccagccccagctgcagccccagcacccagaccaacggctacgtgtgcaactgccacatccccaccagaaacgccagcaaggcctgccagaccctgagaaacggcagcaactgcttcggccagctgaactgcctgagcaagagcttccagaccctgaaccactgcagactgagcaccctgggctacaagagctaccagaacccctgcttcatccccagctacgtgagccccctgtgctacatcagcaacagctgccagccccagagctacctggtgagaaactaccactacagcagctacagacccaccagctgcagacccctgagctacctgagcagaagcttcagaagcctgagctacatccccagcaccttcccccccctgagatacctgtgcagcggcagcagacccctgaagtgctactag

SEQ ID NO: 10219 - DNA, 1338 bp, Artificial Sequence
  Description of Artificial Sequence: Synthetic coding sequence
atgagagagatcgtgcacctgcaggccggccagtgcggcaaccagatcggcgccaagttctgggaggtgatcagcgacgagcacggcatcgaccccaccggcacctaccacggcgacagcgacctgcagctggagagaatcaacgtgtactacaacgaggccaccggcggcaagtacgtgcccagagccgtgctggtggacctggagcccggcaccatggacagcgtgagaagcggccccttcggccagatcttcagacccgacaacttcgtgttcggccagagcggcgccggcaacaactgggccaagggccactacaccgagggcgccgagctggtggacagcgtgctggacgtggtgagaaaggaggccgagagctgcgactgcctgcagggcttccagctgacccacagcctgggcggcggcaccggcagcggcatgggcaccctgctgatcagcaagatcagagaggagtaccccgacagaatcatgaacaccttcagcgtggtgcccagccccaaggtgagcgacaccgtggtggagccctacaacgccaccctgagcgtgcaccagctggtggagaacaccgacgagacctactgcatcgacaacgaggccctgtacgacatctgcttcagaaccctgaagctgaccacccccacctacggcgacctgaaccacctggtgagcgccaccatgagcggcgtgaccacctgcctgagattccccggccagctgaacgccgacctgagaaagctggccgtgaacatggtgcccttccccagactgcacttcttcatgcccggcttcgcccccctgaccagcagaggcagccagcagtacagagccctgaccgtgcccgagctgacccagcagatgttcgacgccaagaacatgatggccgcctgcgaccccagacacggcagatacctgaccgtggccgccgtgttcagaggcagaatgagcatgaaggaggtggacgagcagatgctgaacgtgcagaacaagaacagcagctacttcgtggagtggatccccaacaacgtgaagaccgccgtgtgcgacatcccccccagaggcctgaagatgagcgccaccttcatcggcaacagcaccgccatccaggagctgttcaagagaatcagcgagcagttcaccgccatgttcagaagaaaggccttcctgcactggtacaccggcgagggcatggacgagatggagttcaccgaggccgagagcaacatgaacgacctggtgagcgagtaccagcagtaccaggacgccaccgccgaggaggagggcgagttcgaggaggaggccgaggaggaggtggcctag

SEQ ID NO: 10220 - DNA, 750 bp, Artificial Sequence
  Description of Artificial Sequence: Synthetic coding sequence
atggccgagagaggcgagctggacctgaccggcgccaagcagaacaccggcgtgtggctggtgaaggtgcccaagtacctgagccagcagtgggccaaggccagcggcagaggcgaggtgggcaagctgagaatcgccaagacccagggcagaaccgaggtgagcttcaccctgaacgaggacctggccaacatccacgacatcggcggcaagcccgccagcgtgagcgcccccagagagcaccccttcgtgctgcagagcgtgggcggccagaccctgaccgtgttcaccgagagcagcagcgacaagctgagcctggagggcatcgtggtgcagagagccgagtgcagacccgccgccagcgagaactacatgagactgaagagactgcagatcgaggagagcagcaagcccgtgagactgagccagcagctggacaaggtggtgaccaccaactacaagcccgtggccaaccaccagtacaacatcgagtacgagagaaagaagaaggaggacggcaagagagccagagccgacaagcagcacgtgctggacatgctgttcagcgccttcgagaagcaccagtactacaacctgaaggacctggtggacatcaccaagcagcccgtggtgtacctgaaggagatcctgaaggagatcggcgtgcagaacgtgaagggcatccacaagaacacctgggagctgaagcccgagtacagacactaccagggcgaggagaagagcgactag

SEQ ID NO: 10221 - DNA, 2511 bp, Artificial Sequence
  Description of Artificial Sequence: Synthetic coding sequence
atgtggagcctgggctgcgtgatcgccgagctgttcctgggctggcccctgtaccccggcgccagcgagtacgaccagatcagatacatcagccagacccagggcctgcccgccgagtacctgctgagcgccggcaccaagaccaccagattcttcaacagagaccccaacctgggctaccccctgtggagactgaagacccccgaggagcacgagctggagaccggcatcaagagcaaggaggccagaaagtacatcttcaactgcctggacgacatggcccaggtgaacatgagcaccgacctggagggcaccgacatgctggccgagaaggccgacagaagagagtacatcgacctgctgaagaagatgctgaccatcgacgccgacaagagaatcacccccctgaagaccctgaaccaccagttcgtgaccatgacccacctgctggacttcccccacagcaaccacgtgaagagctgcttccagaacatggagatctgcaagagaagagtgcacatgtacgacaccgtgagccagatcaagagccccttcaccacccacgtggcccccaacaccagcaccaacctgaccatgagcttcagcaaccagctgaacaccgtgcacaaccaggccagcgtgctggccagcagcagcaccgccgccgccgccaccctgagcctggccaacagcgacgtgagcctgctgaactaccagagcgccctgtaccccagcagcgccgcccccgtgcccggcgtggcccagcagggcgtgagcctgcagcccggcaccacccagatctgcacccagaccgaccccttccagcagaccttcatcgtgtgcccccccgccttccagaccggcctgcaggccaccaccaagcacagcggcttccccgtgagaatggacaacgccgtgcccatcgtgccccaggcccccgccgcccagcccctgcagatccagagcggcgtgctgacccagggcagctgcacccccctgatggtggccaccctgcacccccaggtggccaccatcaccccccagtacgccgtgcccttcaccctgagctgcgccgccggcagacccgccctggtggagcagaccgccgccgtgctgcaggcctggcccggcggcacccagcagatcctgctgcccagcacctggcagcagctgcccggcgtggccctgcacaacagcgtgcagcccaccgccatgatccccgaggccatgggcagcggccagcagctggccgactggagaaacgcccacagccacggcaaccagtacagcaccatcatgcagcagcccagcctgctgaccaaccacgtgaccctggccaccgcccagcccctgaacgtgggcgtggcccacgtggtgagacagcagcagagcagcagcctgcccagcaagaagaacaagcagagcgcccccgtgagcagcaagagcagcctggacgtgctgcccagccaggtgtacagcctggtgggcagcagccccctgagaaccaccagcagctacaacagcctggtgcccgtgcaggaccagcaccagcccatcatcatccccgacacccccagcccccccgtgagcgtgatcaccatcagaagcgacaccgacgaggaggaggacaacaagtacaagcccagcagcagcggcctgaagcccagaagcaacgtgatcagctacgtgaccgtgaacgacagccccgacagcgacagcagcctgagcagcccctacagcaccgacaccctgagcgccctgagaggcaacagcggcagcgtgctggagggccccggcagagtggtggccgacggcaccggcaccagaaccatcatcgtgccccccctgaagacccagctgggcgactgcaccgtggccacccaggccagcggcctgctgagcaacaagaccaagcccgtggccagcgtgagcggccagagcagcggctgctgcatcacccccaccggctacagagcccagagaggcggcaccagcgccgcccagcccctgaacctgagccagaaccagcagagcagcgccgcccccaccagccaggagagaagcagcaaccccgcccccagaagacagcaggccttcgtggcccccctgagccaggccccctacaccttccagcacggcagccccctgcacagcaccggccacccccacctggcccccgcccccgcccacctgcccagccaggcccacctgtacacctacgccgcccccaccagcgccgccgccctgggcagcaccagcagcatcgcccacctgttcagcccccagggcagcagcagacacgccgccgcctacaccacccaccccagcaccctggtgcaccaggtgcccgtgagcgtgggccccagcctgctgaccagcgccagcgtggcccccgcccagtaccagcaccagttcgccacccagagctacatcggcagcagcagaggcagcaccatctacaccggctaccccctgagccccaccaagatcagccagtacagctacctgtag

SEQ ID NO: 10222 - DNA, 2352 bp, Artificial Sequence
  Description of Artificial Sequence: Synthetic coding sequence
atgagccaggtgaagagcagctacagctacgacgcccccagcgacttcatcaacttcagcagcctggacgacgagggcgacacccagaacatcgacagctggttcgaggagaaggccaacctggagaacaagctgctgggcaagaacggcaccggcggcctgttccagggcaagacccccctgagaaaggccaacctgcagcaggccatcgtgacccccctgaagcccgtggacaacacctactacaaggaggccgagaaggagaacctggtggagcagagcatccccagcaacgcctgcagcagcctggaggtggaggccgccatcagcagaaagacccccgcccagccccagagaagaagcctgagactgagcgcccagaaggacctggagcagaaggagaagcaccacgtgaagatgaaggccaagagatgcgccacccccgtgatcatcgacgagatcctgcccagcaagaagatgaaggtgagcaacaacaagaagaagcccgaggaggagggcagcgcccaccaggacaccgccgagaagaacgccagcagccccgagaaggccaagggcagacacaccgtgccctgcatgccccccgccaagcagaagttcctgaagagcaccgaggagcaggagctggagaagagcatgaagatgcagcaggaggtggtggagatgagaaagaagaacgaggagttcaagaagctggccctggccggcatcggccagcccgtgaagaagagcgtgagccaggtgaccaagagcgtggacttccacttcagaaccgacgagagaatcaagcagcaccccaagaaccaggaggagtacaaggaggtgaacttcaccagcgagctgagaaagcaccccagcagccccgccagagtgaccaagggctgcaccatcgtgaagcccttcaacctgagccagggcaagaagagaaccttcgacgagaccgtgagcacctacgtgcccctggcccagcaggtggaggacttccacaagagaacccccaacagataccacctgagaagcaagaaggacgacatcaagaccggcagctgcagcgtgacccaggccggcgtgcagtggagagaccacggcagcctgcagtgccccacccccggcctgaagcagagcagctgcctgagcctgcccaacctgctgcccagcaagagcagcgtgaccaagatctgcagagacccccagacccccgtgctgcagaccaagcacagagccagagccgtgacctgcaagagcaccgccgagctggaggccgaggagctggagaagctgcagcagtacaagttcaaggccagagagctggaccccagaatcctggagggcggccccatcctgcccaagaagccccccgtgaagccccccaccgagcccatcggcttcgacctggagatcgagaagagaatccaggagagagagagcaagaagaagaccgaggacgagcacttcgagttccacagcagaccctgccccaccaagatcctggaggacgtggtgggcgtgcccgagaagaaggtgctgcccatcaccgtgcccaagagccccgccttcgccctgaagaacagaatcagaatgcccaccaaggaggacgaggaggaggacgagcccgtggtgatcaaggcccagcccgtgccccactacggcgtgcccttcaagccccagatccccgaggccagaaccgtggagatctgccccttcagcttcgacagcagagacaaggagagacagctgcagaaggagaagaagatcaaggagctgcagaagggcgaggtgcccaagttcaaggccctgcccctgccccacttcgacaccatcaacctgcccgagaagaaggtgaagaacgtgacccagatcgagcccttctgcctggagaccgacagaagaggcgccctgaaggcccagacctggaagcaccagctggaggaggagctgagacagcagaaggaggccgcctgcttcaaggccagacccaacaccgtgatcagccaggagcccttcgtgcccaagaaggagaagaagagcgtggccgagggcctgagcggcagcctggtgcaggagcccttccagctggccaccgagaagagagccaaggagagacaggagctggagaagagaatggccgaggtggaggcccagaaggcccagcagctggaggaggccagactgcaggaggaggagcagaagaaggaggagctggccagactgagaagagagctggtgcacaaggccaaccccatcagaaagtaccagggcctggagatcaagagcagcgaccagcccctgaccgtgcccgtgagccccaagttcagcaccagattccactgctag

SEQ ID NO: 10223 - DNA, 2061 bp, Artificial Sequence
  Description of Artificial Sequence: Synthetic coding sequence
atgggcagctacctgagcgtgcccgcctacttcaccagcagagacctgttcagatgcagcgagtgccaggacagcctgaccaactggtactacgagaaggacggcaagctgtactgccccaaggactactggggcaagttcggcgagttctgccacggctgcagcctgctgatgaccggccccttcatggtggccggcgagttcaagtaccaccccgagtgcttcgcctgcatgagctgcaaggtgatcatcgaggacggcgacgcctacgccctggtgcagcacgccaccctgtactgcggcaagtgccacaacgaggtggtgctggcccccatgttcgagagactgagcaccgagagcgtgcaggagcagctgccctacagcgtgaccctgatcagcatgcccgccaccaccgagggcagaagaggcttcagcgtgagcgtggagagcgcctgcagcaactacgccaccaccgtgcaggtgaaggaggtgaacagaatgcacatcagccccaacaacagaaacgccatccaccccggcgacagaatcctggagatcaacggcacccccgtgagaaccctgagagtggaggaggtggaggacgccatcagccagaccagccagaccctgcagctgctgatcgagcacgaccccgtgagccagagactggaccagctgagactggaggccagactggccccccacatgcagaacgccggccacccccacgccctgagcaccctggacaccaaggagaacctggagggcaccctgagaagaagaagcctgagaagaagcaacagcatcagcaagagccccggccccagcagccccaaggagcccctgctgttcagcagagacatcagcagaagcgagagcctgagatgcagcagcagctacagccagcagatcttcagaccctgcgacctgatccacggcgaggtgctgggcaagggcttcttcggccaggccatcaaggtgacccacaaggccaccggcaaggtgatggtgatgaaggagctgatcagatgcgacgaggagacccagaagaccttcctgaccgaggtgaaggtgatgagaagcctggaccaccccaacgtgctgaagttcatcggcgtgctgtacaaggacaagaagctgaacctgctgaccgagtacatcgagggcggcaccctgaaggacttcctgagaagcatggaccccttcccctggcagcagaaggtgagattcgccaagggcatcgccagcggcatggcctacctgcacagcatgtgcatcatccacagagacctgaacagccacaactgcctgatcaagctggacaagaccgtggtggtggccgacttcggcctgagcagactgatcgtggaggagagaaagagagcccccatggagaaggccaccaccaagaagagaaccctgagaaagaacgacagaaagaagagatacaccgtggtgggcaacccctactggatggcccccgagatgctgaacggcaagagctacgacgagaccgtggacatcttcagcttcggcatcgtgctgtgcgagatcatcggccaggtgtacgccgaccccgactgcctgcccagaaccctggacttcggcctgaacgtgaagctgttctgggagaagttcgtgcccaccgactgcccccccgccttcttccccctggccgccatctgctgcagactggagcccgagagcagagccccccccggcgccgccggcgagggccccggctgcgccgacgacgagggccccgtgagaagacagggcaaggtgaccatcaagtacgaccccaaggagctgagaaagcacctgaacctggaggagtggatcctggagcagctgaccagactgtacgactgccaggaggaggagatcagcgagctggagatcgacgtggacgagctgctggacatggagagcgacgacgcctgggccagcagagtgaaggagctgctggtggactgctacaagcccaccgaggccttcatcagcggcctgctggacaagatcagagccatgcagaagctgagcaccccccagaagaagtag

SEQ ID NO: 10224 - DNA, 840 bp, Artificial Sequence
  Description of Artificial Sequence: Synthetic coding sequence
atgagagccctgaccgtgcagagagtgaagttcgccatggacctgcccctgctgaagagagccggccaggacctggccgagaagaccaagaacttcgtgagcagaagcctggtgatcggcgaggtgctgagcatggccgacatggccaccggcgtgaagtgcggcatcatctactggctgttcggcggcgccatcagaaacctgggcagccccgagcacgtgaccaagtggttccagcccctgcaggagcagaagtacaccggcatgttcgccatgaccgagagaggccacggcagcaacgccagaggcatccagaccgaggccaccttcgacctgagcgcccaggagttcgtgatcgacaccccctgcgagaacgccgagaagatgtacatcggcaacgccatgtacggcaactacgccgccgtgttcgcccagctgatcatcgacggcagaagccagggcccccactgcttcatcgtgcccgtgagagacgagaacggcagcctgtaccccggcgtgaccgccatcgacatgatgtacaaggagggcctgcacggcgtggacaacggcatcctgatcttcgacaaggtgagaatccccagagagaacctgctggacaagttcggcagcgtggcccccgacggccagtaccacagccccatcagaaacaagagcgccagattcaacgccatgctggccgccctgacccccagcagactggccgtggccttccaggccatgggcgccatgaagctgggcctgaccatcgccatcagatacagccacagaagcagaatcatcagccagaactgctgcagcgcccccgccggcctgtactag

SEQ ID NO: 10225 - DNA, 597 bp, Artificial Sequence
  Description of Artificial Sequence: Synthetic coding sequence
atgaccctgagatgcctggagcccagcggcaacggcggcgagggcaccagaagccagtggggcaccgccggcagcgccgaggagcccagcccccaggccgccagactggccaaggccctgagagagctgggccagaccggctggtactggggcagcatgaccgtgaacgaggccaaggagaagctgaaggaggcccccgagggcaccttcctgatcagagacagcagccacagcgactacctgctgaccatcagcgtgaagaccagcgccggccccaccaacctgagaatcgagtaccaggacggcaagttcagactggacagcatcatctgcgtgaagagcaagctgaagcagttcgacagcgtggtgcacctgatcgactactacgtgcagatgtgcaaggacaagagaaccggccccgaggcccccagaaacggcaccgtgcacctgtacctgaccaagcccctgtacaccagcgcccccagcctgcagcacctgtgcagactgaccatcaacaagtgcaccggcgccatctggggcctgcccctgcccaccagactgaaggactacctggaggagtacaagttccaggtgtag

SEQ ID NO: 10226 - DNA, 570 bp, Artificial Sequence
  Description of Artificial Sequence: Synthetic coding sequence
atggaggccgacggcgacggcgaggagctggccagactgagaagcgtgttcgccgcctgcgacgccaacagaagcggcagactggagagagaggagttcagagccctgtgcaccgagctgagagtgagacccgccgacgccgaggccgtgttccagagactggacgccgacagagacggcgccatcaccttccaggagttcgccagaggcttcctgggcagcctgagaggcggcagaagaagagactggggccccctggaccccgcccccgccgtgagcgaggccggccccgagacccacgacagcgaggaggacgagggcgacgaggacgccgccgccgccctggccaccagctgcggccccgccagccccggcagagcctggcaggacttccaggccagactgggcgacgaggccaagttcatccccagattcggctacaccatcagcaagcccgccttcgtgttcgtgagacacctgatcaccctgtgcgccctgagctgggccaagaaggagggcagagagaccctgtggaccatcgaggagggcggcgccaagatggccgagtag

SEQ ID NO: 10227 - DNA, 300 bp, Artificial Sequence
  Description of Artificial Sequence: Synthetic coding sequence
gccctggacgtggccgtgaagaccttcccccccgagagacacgtggccgtgaagtgcttcggcaagaagaaggagaagaagaacaacgccaacagccccgccagcgtgagcaaccccaccgtgaccaagcacgccttcggcatggaggaggagctgcagagagagggcagcatcgagaccctgagcaacagcagcggcagcaccagcggcagcatccccagaaacttcgacggctacagaagccccctgcccaccaacgagagccagcccctgagcctgttccccaccggcttcccctag

SEQ ID NO: 10228 - DNA, 1170 bp, Artificial Sequence
  Description of Artificial Sequence: Synthetic coding sequence
atggagagaaaggacttcgagacctggctggacaacatcagcgtgaccttcctgagcctgaccgacctgcagaagaacgagaccctggaccacctgatcagcctgagcggcgccgtgcagctgagacacctgagcaacaacctggagaccctgctgaagagagacttcctgaagctgctgcccctggagctgagcttctacctgctgaagtggctggacccccagaccctgctgacctgctgcctggtgagcaagcagtggaacaaggtgatcagcgcctgcaccgaggtgtggcagaccgcctgcaagaacctgggctggcagatcgacgacagcgtgcaggacgccctgcactggaagaaggtgtacctgaaggccatcctgagaatgaagcagctggaggaccacgaggccttcgagaccagcagcctgatcggccacagcgccagagtgtacgccctgtactacaaggacggcctgctgtgcaccgtgttcagcgtggactacaacgacgagctggacatcctggtgagcggcagcgccgacttcaccgtgaaggtgtgggccctgagcgccggcacctgcctgaacaccctgaccggccacaccgagtgggtgaccaaggtggtgctgcagaagtgcaaggtgaagagcctgctgcacagccccggcgactacatcctgctgagcgccgacaagtacgagatcaagatctggcccatcggcagagagatcaactgcaagtgcctgaagaccctgagcgtgagcgaggacagaagcatctgcctgcagcccagactgcacttcgacggcaagtacatcgtgtgcagcagcgccctgggcctgtaccagtgggacttcgccagctacgacatcctgagagtgatcaagacccccgagatcgccaacctggccctgctgggcttcggcgacatcttcgccctgctgttcgacaacagatacctgtacatcatggacctgagaaccgagagcctgatcagcagatggcccctgcccgagtacagaaagagcaagagaggcagcagcttcctggccggcgaggccagctggctgaacggcctggacggccacaacgacaccggcctggtgttcgccaccagcatgcccgaccacagcatccacctggtgctgtggaaggagcacggctag

SEQ ID NO: 10229 - DNA, 2439 bp, Artificial Sequence
  Description of Artificial Sequence: Synthetic coding sequence
atgaagaagcagttcaacagaatgagacagctggccaaccagaccgtgggcagagccgagaagaccgaggtgctgagcgaggacctgctgcaggtggagaagagactggagctggtgaagcaggtgagccacagcacccacaagaagctgaccgcctgcctgcagggccagcagggcgccgaggccgacaagagaagcaagaagctgcccctgaccaccctggcccagtgcctgatggagggcagcgccatcctgggcgacgacaccctgctgggcaagatgctgaagctgtgcggcgagaccgaggacaagctggcccaggagctgatccacttcgagctgcaggtggagagagacgtgatcgagcccctgttcctgctggccgaggtggagatccccaacatccagaagcagagaaagcacctggccaagctggtgctggacatggacagcagcagaaccagatggcagcagaccagcaagagcagcggcctgagcagcagcctgcagcccgccggcgccaaggccgacgccctgagagaggagatggaggaggccgccaacagagtggagatctgcagagaccagctgagcgccgacatgtacagcttcgtggccaaggagatcgactacgccaactacttccagaccctgatcgaggtgcaggccgagtaccacagaaagagcctgaccctgctgcaggccgtgctgccccagatcaaggcccagcaggaggcctgggtggagaagcccagcttcggcaagcccctggaggagcacctgaccatcagcggcagagagatcgccttccccatcgaggcctgcgtgaccatgctgctggagtgcggcatgcaggaggagggcctgttcagagtggcccccagcgccagcaagctgaagaagctgaaggccgccctggactgctgcgtggtggacgtgcaggagtacagcgccgacccccacgccatcgccggcgccctgaagagctacctgagagagctgcccgagcccctgatgaccttcgagctgtacgacgagtggatccaggccagcaacgtgcaggagcaggacaagaagctgcaggccctgtggaacgcctgcgagaagctgcccaaggccaaccacaacaacatcagatacctgatcaagttcctgagcaagctgagcgagtaccaggacgtgaacaagatgacccccagcaacatggccatcgtgctgggccccaacctgctgtggccccaggccgagggcaacatcaccgagatgatgaccaccgtgagcctgcagatcgtgggcatcatcgagcccatcatccagcacgccgactggttcttccccggcgagatcgagttcaacatcaccggcaactacggcagccccgtgcacgtgaaccacaacgccaactacagcagcatgcccagccccgacatggaccccgccgacagaagacagcccgagcaggccagaagacccctgagcgtggccaccgacaacatgatgctggagttctacaagaaggacggcatgggcgtgagagtgatggacaccaactgggtggccagaagaggcagcagcgccggcagaaaggtgagctgcgccccccccagcatgcagccccccgccccccccgccgagctggccgcccccctgcccagccccctgcccgagcagcccctggacagccccgccgcccccgccctgagccccagcggcctgggcctgcagcccggccccgagagaaccagcaccaccaagagcaaggagctgagccccggcagcgcccagaagggcagccccggcagcagccagggcaccgcctgcgccggcacccagcccggcgcccagcccggcgcccagcccggcgccagccccagccccagccagccccccgccgaccagagcccccacaccctgagaaaggtgagcaagaagctggcccccatcccccccaaggtgcccttcggccagcccggcgccatggccgaccagagcgccggccagcccagccccgtgagcctgagccccaccccccccagcacccccagcccctacggcctgagctacccccagggctacagcctggccagcggccagctgagccccgccgccgccccccccctggccagccccagcgtgttcaccagcaccctgagcaagagcagacccacccccaagcccagacagagacccaccctgccccccccccagccccccaccgtgaacctgagcgccagcagcccccagagcaccgaggcccccatgctggacggcatgagccccggcgagagcatgagcaccgacctggtgcacttcgacatccccagcatccacatcgagctgggcagcaccctgagactgagccccctggagcacatgagaagacacagcgtgaccgacaagagagacagcgaggaggagagcgagagcaccgccctgtag

SEQ ID NO: 10230 - DNA, 1119 bp, Artificial Sequence
  Description of Artificial Sequence: Synthetic coding sequence
atgagcaagagcgagagccccaaggagcccgagcagctgagaaagctgttcatcggcggcctgagcttcgagaccaccgacgagagcctgagaagccacttcgagcagtggggcaccctgaccgactgcgtggtgatgagagaccccaacaccaagagaagcagaggcttcggcttcgtgacctacgccaccgtggaggaggtggacgccgccatgaacgccagaccccacaaggtggacggcagagtggtggagcccaagagagccgtgagcagagaggacagccagagacccggcgcccacctgaccgtgaagaagatcttcgtgggcggcatcaaggaggacaccgaggagcaccacctgagagactacttcgagcagtacggcaagatcgaggtgatcgagatcatgaccgacagaggcagcggcaagaagagaggcttcgccttcgtgaccttcgacgaccacgacagcgtggacaagatcgtgatccagaagtaccacaccgtgaacggccacaactgcgaggtgagaaaggccctgagcaagcaggagatggccagcgccagcagcagccagagaggcagaagcggcagcggcaacttcggcggcggcagaggcggcggcttcggcggcaacgacaacttcggcagaggcggcaacttcagcggcagaggcggcttcggcggcagcagaggcggcggcggctacggcggcagcggcgacggctacaacggcttcggcaacgacggcggctacggcggcggcggccccggctacagcggcggcagcagaggctacggcagcggcggccagggctacggcaaccagggcagcggctacggcggcagcggcagctacgacagctacaacaacggcggcggcggcggcttcggcggcggcagcggcagcaacttcggcggcggcggcagctacaacgacttcggcaactacaacaaccagagcagcaacttcggccccatgaagggcggcaacttcggcggcagaagcagcggcccctacggcggcggcggccagtacttcgccaagcccagaaaccagggcggctacggcggcagcagcagcagcagcagctacggcagcggcagaagattctag

SEQ ID NO: 10231 - DNA, 1491 bp, Artificial Sequence
  Description of Artificial Sequence: Synthetic coding sequence
atgaagctgggcaagaagcccatgtacaagcccgtggacccctacagcagaatgcagagcacctacaactacaacatgagaggcggcgcctacccccccagatacttctaccccttccccgtgccccccctgctgtaccaggtggagctgagcgtgggcggccagcagttcaacggcaagggcaagaccagacaggccgccaagcacgacgccgccgccaaggccctgagaatcctgcagaacgagcccctgcccgagagactggaggtgaacggcagagagagcgaggaggagaacctgaacaagagcgagatcagccaggtgttcgagatcgccctgaagagaaacctgcccgtgaacttcgaggtggccagagagagcggccccccccacatgaagaacttcgtgaccaaggtgagcgtgggcgagttcgtgggcgagggcgagggcaagagcaagaagatcagcaagaagaacgccgccatcgccgtgctggaggagctgaagaagctgccccccctgcccgccgtggagagagtgaagcccagaatcaagaagaagaccaagcccatcgtgaagccccagaccagccccgagtacggccagggcatcaaccccatcagcagactggcccagatccagcaggccaagaaggagaaggagcccgagtacaccctgctgaccgagagaggcctgcccagaagaagagagttcgtgatgcaggtgaaggtgggcaaccacaccgccgagggcaccggcaccaacaagaaggtggccaagagaaacgccgccgagaacatgctggagatcctgggcttcaaggtgccccaggcccagcccaccaagcccgccctgaagagcgaggagaagacccccatcaagaagcccggcgacggcagaaaggtgaccttcttcgagcccggcagcggcgacgagaacggcaccagcaacaaggaggacgagttcagaatgccctacctgagccaccagcagctgcccgccggcatcctgcccatggtgcccgaggtggcccaggccgtgggcgtgagccagggccaccacaccaaggacttcaccagagccgcccccaaccccgccaaggccaccgtgaccgccatgatcgccagagagctgctgtacggcggcaccagccccaccgccgagaccatcctgaagaacaacatcagcagcggccacgtgccccacggccccctgaccagacccagcgagcagctggactacctgagcagagtgcagggcttccaggtggagtacaaggacttccccaagaacaacaagaacgagttcgtgagcctgatcaactgcagcagccagccccccctgatcagccacggcatcggcaaggacgtggagagctgccacgacatggccgccctgaacatcctgaagctgctgagcgagctggaccagcagagcaccgagatgcccagaaccggcaacggccccatgagcgtgtgcggcagatgctag

SEQ ID NO: 10232 - DNA, 5835 bp, Artificial Sequence
  Description of Artificial Sequence: Synthetic coding sequence
atgagcaacttctacgaggagagaaccaccatgatcgccgccagagacctgcaggagttcgtgcccttcggcagagaccactgcaagcaccaccccaacgccctgaacctgcagctgagacagctgcagcccgccagcgagctgtggagcagcgacggcgccgccggcctggtgggcagcctgcaggaggtgaccatccacgagaagcagaaggagagctggcagctgagaaagggcgtgagcgagatcggcgaggacgtggactacgacgaggagctgtacgtggccggcaacatggtgatctggagcaagggcagcaagagccaggccctggccgtgtacaaggccttcaccgtggacagccccgtgcagcaggccctgtggtgcgacttcatcatcagccaggacaagagcgagaaggcctacagcagcaacgaggtggagaagtgcatctgcatcctgcagagcagctgcatcaacatgcacagcatcgagggcaaggactacatcgccagcctgcccttccaggtggccaacgtgtggcccaccaagtacggcctgctgttcgagagaagcgccagcagccacgaggtgccccccggcagccccagagagcccctgcccaccatgttcagcatgctgcaccccctggacgagatcacccccctggtgtgcaagagcggcagcctgttcggcagcagcagagtgcagtacgtggtggaccacgccatgaagatcgtgttcctgaacaccgaccccagcatcgtgatgacctacgacgccgtgcagaacgtgcacagcgtgtggaccctgagaagagtgaagagcgaggaggagaacgtggtgctgaagttcagcgagcagggcggcaccccccagaacgtggccaccagcagcagcctgaccgcccacctgagaagcctgagcaagggcgacagccccgtgaccagccccttccagaactacagcagcatccacagccagagcagaagcaccagcagccccagcctgcacagcagaagccccagcatcagcaacatggccgccctgagcagagcccacagccccgccctgggcgtgcacagcttcagcggcgtgcagagattcaacatcagcagccacaaccagagccccaagagacacagcatcagccacagccccaacagcaacagcaacggcagcttcctggcccccgagaccgagcccatcgtgcccgagctgtgcatcgaccacctgtggaccgagaccatcaccaacatcagagagaagaacagccaggccagcaaggtgttcatcaccagcgacctgtgcggccagaagttcctgtgcttcctggtggagagccagctgcagctgagatgcgtgaagttccaggagagcaacgacaagacccagctgatcttcggcagcgtgaccaacatccccgccaaggacgccgcccccgtggagaagatcgacaccatgctggtgctggagggcagcggcaacctggtgctgtacaccggcgtggtgagagtgggcaaggtgttcatccccggcctgcccgcccccagcctgaccatgagcaacaccatgcccagacccagcacccccctggacggcgtgagcacccccaagcccctgagcaagctgctgggcagcctggacgaggtggtgctgctgagccccgtgcccgagctgagagacagcagcaagctgcacgacagcctgtacaacgaggactgcaccttccagcagctgggcacctacatccacagcatcagagaccccgtgcacaacagagtgaccctggagctgagcaacggcagcatggtgagaatcaccatccccgagatcgccaccagcgagctggtgcagacctgcctgcaggccatcaagttcatcctgcccaaggagatcgccgtgcagatgctggtgaagtggtacaacgtgcacagcgcccccggcggccccagctaccacagcgagtggaacctgttcgtgacctgcctgatgaacatgatgggctacaacaccgacagactggcctggaccagaaacttcgacttcgagggcagcctgagccccgtgatcgcccccaagaaggccagacccagcgagaccggcagcgacgacgactgggagtacctgctgaacagcgactaccaccagaacgtggagagccacctgctgaacagaagcctgtgcctgagccccagcgaggccagccagatgaaggacgaggacttcagccagaacctgagcctggacagcagcaccctgctgttcacccacatccccgccatcttcttcgtgctgcacctggtgtacgaggagctgaagctgaacaccctgatgggcgagggcatctgcagcctggtggagctgctggtgcagctggccagagacctgaagctgggcccctacgtggaccactactacagagactaccccaccctggtgagaaccaccggccaggtgtgcaccatcgaccccggccagaccggcttcatgcaccaccccagcttcttcaccagcgagccccccagcatctaccagtgggtgagcagctgcctgaagggcgagggcatgcccccctacccctacctgcccggcatctgcgagagaagcagactggtggtgctgagcatcgccctgtacatcctgggcgacgagagcctggtgagcgacgagagcagccagtacctgaccagaatcaccatcgccccccagaagctgcaggtggagcaggaggagaacagattcagcttcagacacagcaccagcgtgagcagcctggccgagagactggtggtgtggatgaccaacgtgggcttcaccctgagagacctggagaccctgcccttcggcatcgccctgcccatcagagacgccatctaccactgcagagagcagcccgccagcgactggcccgaggccgtgtgcctgctgatcggcagacaggacctgagcaagcaggcctgcgagggcaacctgcccaagggcaagagcgtgctgagcagcgacgtgcccagcggcaccgagaccgaggaggaggacgacggcatgaacgacatgaaccacgaggtgatgagcctgatctggagcgaggacctgagagtgcaggacgtgagaagactgctgcagagcgcccaccccgtgagagtgaacgtggtgcagtaccccgagctgagcgaccacgagttcatcgaggagaaggagaacagactgctgcagctgtgccagagaaccatggccctgcccgtgggcagaggcatgttcaccctgttcagctaccaccccgtgcccaccgagcccctgcccatccccaagctgaacctgaccggcagagccccccccagaaacaccaccgtggacctgaacagcggcaacatcgacgtgccccccaacatgaccagctgggccagcttccacaacggcgtggccgccggcctgaagatcgcccccgccagccagatcgacagcgcctggatcgtgtacaacaagcccaagcacgccgagctggccaacgagtacgccggcttcctgatggccctgggcctgaacggccacctgaccaagctggccaccctgaacatccacgactacctgaccaagggccacgagatgaccagcatcggcctgctgctgggcgtgagcgccgccaagctgggcaccatggacatgagcatcaccagactgctgagcatccacatccccgccctgctgccccccaccagcaccgagctggacgtgccccacaacgtgcaggtggccgccgtggtgggcatcggcctggtgtaccagggcaccgcccacagacacaccgccgaggtgctgctggccgagatcggcagaccccccggccccgagatggagtactgcaccgacagagagagctacagcctggccgccggcctggccctgggcatggtgtgcctgggccacggcagcaacctgatcggcatgagcgacctgaacgtgcccgagcagctgtaccagtacatggtgggcggccacagaagattccagaccggcatgcacagagagaagcacaagagccccagctaccagatcaaggagggcgacaccatcaacgtggacgtgacctgccccggcgccaccctggccctggccatgatctacctgaagaccaacaacagaagcatcgccgactggctgagagcccccgacaccatgtacctgctggacttcgtgaagcccgagttcctgctgctgagaaccctggccagatgcctgatcctgtgggacgacatcctgcccaacagcaagtgggtggacagcaacgtgccccagatcatcagagagaacagcatcagcctgagcgagatcgagctgccctgcagcgaggacctgaacctggagaccctgagccaggcccacgtgtacatcatcgccggcgcctgcctgagcctgggcttcagattcgccggcagcgagaacctgagcgccttcaactgcctgcacaagttcgccaaggacttcatgacctacctgagcgcccccaacgccagcgtgaccggcccccacaacctggagacctgcctgagcgtggtgctgctgagcctggccatggtgatggccggcagcggcaacctgaaggtgctgcagctgtgcagattcctgcacatgaagaccggcggcgagatgaactacggcttccacctggcccaccacatggccctgggcctgctgttcctgggcggcggcagatacagcctgagcaccagcaacagcagcatcgccgccctgctgtgcgccctgtacccccacttccccgcccacagcaccgacaacagataccacctgcaggccctgagacacctgtacgtgctggccgccgagcccagactgctggtgcccgtggacgtggacaccaacaccccctgctacgccctgctggaggtgacctacaagggcacccagtggtacgagcagaccaaggaggagctgatggcccccaccctgctgcccgagctgcacctgctgaagcagatcaaggtgaagggccccagatactgggagctgctgatcgacctgagcaagggcacccagcacctgaagagcatcctgagcaaggacggcgtgctgtacgtgaagctgagagccggccagctgagctacaaggaggaccccatgggctggcagagcctgctggcccagaccgtggccaacagaaacagcgaggccagagccttcaagcccgagaccatcagcgccttcaccagcgaccccgccctgctgagcttcgccgagtacttctgcaagcccaccgtgaacatgggccagaagcaggagatcctggacctgttcagcagcgtgctgtacgagtgcgtgacccaggagacccccgagatgctgcccgcctacatcgccatggaccaggccatcagaagactgggcagaagagagatgagcgagaccagcgagctgtggcagatcaagctggtgctggagttcttcagcagcagaagccaccaggagagactgcagaaccaccccaagagaggcctgttcatgaacagcgagttcctgcccgtggtgaagtgcaccatcgacaacaccctggaccagtggctgcaggtgggcggcgacatgtgcgtgcacgcctacctgagcggccagcccctggaggagagccagctgagcatgctggcctgcttcctggtgtaccacagcgtgcccgccccccagcacctgccccccatcggcctggagggcagcaccagcttcgccgagctgctgttcaagttcaagcagctgaagatgcccgtgagagccctgctgagactggcccccctgctgctgggcaacccccagcccatggtgatgtag

SEQ ID NO: 10233 - DNA, 1263 bp, Artificial Sequence; identical to SEQ ID NO: 9866
  Description of Artificial Sequence: Synthetic coding sequence

SEQ ID NO: 10234 - DNA, 1257 bp, Artificial Sequence
  Description of Artificial Sequence: Synthetic coding sequence
atgagagagtgcatcagcatccacgtgggccaggccggcgtgcagatcggcaacgcctgctgggagctgtactgcctggagcacggcatccagcccgacggccagatgcccagcgacaagaccatcggcggcggcgacgacagcttcaacaccttcttcagcgagaccggcgccggcaagcacgtgcccagagccgtgttcgtggacctggagcccaccgtggtggacgaggtgagaaccggcacctacagacagctgttccaccccgagcagctgatcaccggcaaggaggacgccgccaacaactacgccagaggccactacaccatcggcaaggagatcgtggacctggtgctggacagaatcagaaagctggccgacctgtgcaccggcctgcagggcttcctgatcttccacagcttcggcggcggcaccggcagcggcttcgccagcctgctgatggagagactgagcgtggactacggcaagaagagcaagctggagttcgccatctaccccgccccccaggtgagcaccgccgtggtggagccctacaacagcatcctgaccacccacaccaccctggagcacagcgactgcgccttcatggtggacaacgaggccatctacgacatctgcagaagaaacctggacatcgagagacccacctacaccaacctgaacagactgatcggccagatcgtgagcagcatcaccgccagcctgagattcgacggcgccctgaacgtggacctgaccgagttccagaccaacctggtgccctaccccagaatccacttccccctggccacctacgcccccgtgatcagcgccgagaaggcctaccacgagcagctgagcgtggccgagatcaccaacgcctgcttcgagcccgccaaccagatggtgaagtgcgaccccagacacggcaagtacatggcctgctgcatgctgtacagaggcgacgtggtgcccaaggacgtgaacgccgccatcgccaccatcaagaccaagagaaccatccagttcgtggactggtgccccaccggcttcaaggtgggcatcaactaccagccccccaccgtggtgcccggcggcgacctggccaaggtgcagagagccgtgtgcatgctgagcaacaccaccgccatcgccgaggcctgggccagactggacctggccgccctggagaaggactacgaggaggtgggcgtggacagcgtggaggccgaggccgaggagggcgaggagtactag

SEQ ID NO: 10235 - DNA, 417 bp, Artificial Sequence
  Description of Artificial Sequence: Synthetic coding sequence
atgcagctgccccccttcgacatgtggaaggactacttcaacctgagccaggtggtgtgggccctgatcgccagcagaggccagagactggagacccaggagatcgaggagcccagccccggcccccccctgggccaggaccagggcctgggcgcccccggcgccaacggcggcctgggcaccctgtgcaacttctgcaagcacaacggcgagagcagacacgtgtacagcagccaccagctgaagacccccgacggcgtggtggtgtgccccatcctgagacactacgtgtgccccgtgtgcggcgccaccggcgaccaggcccacaccctgaagtactgccccctgaacggcggccagcagagcctgtacagaagaagcggcagaaacagcgccggcagaagagtgaagagatag

SEQ ID NO: 10236 - DNA, 375 bp, Artificial Sequence
  Description of Artificial Sequence: Synthetic coding sequence
atgagagccagcccctgcatcagccagcccgccgccagctggcaccccagacccagcgccctgagacccaccgccggcagcggccccgacaccagaacccccggcaccgtggaggacggcagcgccccctgccccgccttcagaagccccgccgtgagcccctgcggcgaggagccctgctgcttccagatcagccccgccgaggagaccctggagctgggcagactggtgagccccggcaactgcgacaccctgagccccagagccgccggcttctacgcctgccacgtgagaagcctgatcccctgcagaagcaccaagggcagatggcccctgaccgccagcgccgccggcctgagcagcttcagcggctag

SEQ ID NO: 10237 - DNA, 363 bp, Artificial Sequence
  Description of Artificial Sequence: Synthetic coding sequence
atggccgagcccagcagcgccagaagacccgtgcccctgatcgagagcgagctgtacttcctgatcgccagatacctgagcgccggcccctgcagaagagccgcccaggtgctggtgcaggagctggagcagtaccagctgctgcccaagagactggactgggagggcaacgagcacaacagaagctacgaggagctggtgctgagcaacaagcacgtggcccccgaccacctgctgcagatctgccagagaatcggccccatgctggacaaggagatcccccccagcatcagcagagtgaccagcctgctgggcgccggcagacagagcctgctgagaaccgccaagggcaccctgatctag

SEQ ID NO: 10238 - DNA, 2607 bp, Artificial Sequence
  Description of Artificial Sequence: Synthetic coding sequence
atgatccccaagagcctggtgcaggccgccgagacccagagaggcctgtgcgagcccggcggcaagggcagagagggcagaagcggcggcaagggcgagaccagacccagaggcgtgggcacccaggagggcaagggcaccatccccggcagccccagagagaagagaggcgagagaggcgagggcgaccccgccctgctgcccgccgaggacctgtggagactgcccggcagcaaggacagactgagaagcagcctgctgcccccccccggcccccccagcagcgacagcggccccggcccccccagcagccacagcggcaagaccgcccagggccccagaaccctgaactgggccagaaagcagagcgccagaaccagcagcaacctgtgcgcctggagcctggccatggccaccaagatggccgagatccccagcagcccctacgagcccggccagagaggcatgaaggacacccagagaggcgacgccccccagagaggcagccccgagcccagaatcctgcagctggccagagtgggcaacgtgtacctgaaggaggagagcagcagaagcggcagactggaggccaagaagtggatccccaccaagttcctggagaacctgagcgtgccccacgtggacctgggcggcaaccagctgtggagcggcggcatggaggccctgaccacccagctgggccccggcagagagggcagcagcagccccaacagcaagcaggagctgcagccctacagcggcagcagcgccctgaagcccaaccaggtgggcgagaccagcctgtacggcgtgcccatcgtgagcctggtgatcgacggccaggagagactgtgcctggcccagatcagcaacaccctgctgaagaactacagctacaacgagatccacaacagaagagtggccctgggcatcacctgcgtgcagtgcacccccgtgcagctggagatcctgagaagagccggcgccatgcccatcagcagcagaagatgcggcatgatcaccaagagagaggccgagagactgtgcaagagcttcctgggcgagcacaagccccccaagctgcccgagaacttcgccttcgacgtggtgcacgagtgcgcctggggcagcagaggcagcttcatccccgccagatacaacagcagcagagccaagtgcatcaagtgcggctactgcagcatgtacttcagccccaacaagttcatcttccacagccacagaacccccgacgccaagtacacccagcccgacgccgccaacttcaacagctggagaagacacctgaagctgagcgacaagagcgccaccgacgagctgagccacgcctgggaggacagaggcctgggcctggccaccggcgccagcggccccgccggccccggcggccccggcggcggcgccggcgtgagaagctaccccgtgatccccgtgcccagcaagggcttcggcctgctgcagaagctgcccccccccctgttcccccacccctacggcttccccaccgccttcggcctgtgccccaagaaggacgaccccgtgctgggcgccggcgagcccaagggcggcagctacgtgagcgccttcagacccgtggtgaaggacaccgagagcatcgccaagctgtacggcagcgccagagaggcctacggcgccggccccgccagaggccccggccccggcgccggcagcggcggctacgtgagccccgacttcctgagcgagggcagcagcagctacaacagcgccagccccgacgtggacaccgccgacgagcccgaggtggacgtggagagcaacagattccccgacgacgaggacgcccaggaggagaccgagcccagcgcccccagcgccggcggcggccccgacgccggcagacccgccttcggcgacctggccgccgaggacctggtgagaagacccgagagaagcccccccagcggcggcggcggctacgagctgagagagccctgcggccccctgggcggccccgcccccgccaaggtgttcgcccccgagagagacgagcacgtgaagagcgccgccgtggccctgggccccgccgccagctacgtgtgcacccccgaggcccacgagcccgacaaggaggacaaccacagccccgccgacgacctggagaccagaaagagctaccccgaccagagaagcatcagccagcccagccccgccaacaccgacagaggcgaggacggcctgaccctggacgtgaccggcacccacctggtggagaaggacatcgagaacctggccagagaggagctgcagaagctgctgctggagcagatggagctgagaaagaagctggagagagagttccagagcctgaaggacaacttccaggaccagatgaagagagagctggcctacagagaggagatggtgcagcagctgcagatcgtgagagacaccctgtgcaacgagctggaccaggagagaaaggccagatacgccatccagcagaagctgaaggaggcccacgacgccctgcaccacttcagctgcaagatgctgacccccagacactgcaccggcaactgcagcttcaagccccccctgctgccctag

SEQ ID NO: 10239 - DNA, 3585 bp, Artificial Sequence
  Description of Artificial Sequence: Synthetic coding sequence
atgcacgacctgccccccgacagcggcgccagaagaggcggcagaggcctggccgaccacagcttccccgccggcgccagagcccccggccagccccccagcagaggcgccgcctacagaagagcctgccccagagacggcgagagaggcggcggcggcagacccagacagcaggtgagcccccccagaagcccccagagagagcccagaggcggccagctgagaacccccagaatgagacccagctgcagcagaagcctggagagcctgagagtgggcgccaagcccccccccttccagagatggcccagcgacagctggatcagatgcggcgcccacagagactgggacgagcccccccccagaggcggcagaatggacggctggagcggcgacagagccagagccgccgcccccaccggcctgcagccccccggctgcaaggaccacggctgcagcagcggcagccccttcagagaccccgccggcagcagcgtgatcagaagcggcaagggcgacagacaggagggccccagcttcctgagaccccccgccgtgaccgtgaagaagctgcagaagtggatgtacaagggcagactgctgagcctgggcatgaagggcagagccagaggcaccgcccccaaggtgaccggcacccaggccgccagccccaacgtgggcgccctgaaggtgagagagaacagagtgctgagcgtgccccccgaccagagaatcaccctgaccgacctgttcgagaacgcctacggcagcagcatgaagggcagagagctggaggagctgaaggacaacatcgagttcagaggccacaagcccctgaacagcatcaccgtgagcaagaagagaaactggctgtaccagagcaccctgagacccctgaacctggaggaggagaacaagaagtgccaggacagaagccacctgagcatcagccccgtgagcctgcccaagcaccagctgagccagagcttcctgaagagcagcaaggagtactgcacctacgtggtgtgcaacgccaccaacagcagcctgagcaagaactgcgccctggacttcaacgaggagaacgacgccgacgacgagggcgagatctggtacaaccccatccccgaggacgacgacctgggcatcagcagcgccctgagcttcggcgaggccgacagcgccgtgctgaagctgcccgccgtgaacctgagcatgctgagcggcagcgacctgatgaaggccgagagacacaccgaggacagcctgtgcagcagcgagcacgccggcgacatccagaccaccagaagcaacggcatgaaccccatccaccccgcccacagcaccgagttcgtgcagcagtacaagcagaagctgggccacaagacccaggagggcatcatggtggaggacagccccatgctgaagagccccttcgccggcagcggcatcctggccgccaccaacagcaccgagctgggcatcatggagcccagcagccccaaccccagccccgtgaagaagggcagcagcatcaactggagcctgcccgacaagatcaagagccccagaaccgtgagaaagctgagcatgaagatgaagaagctgcccgagttcagcagaaagctgagcgtgaagggcaccctgaactacatcaacagccccgacaacacccccagcctgagcaagtacaactgcagagaggtgcaccacaccgacatcctgcccagcggcaacaccaccaccgccgccaagagaaacgtgatcagcagataccacctggacaccagcgtgagcagccagcagagctaccagaagaagaacagcatgagcagcaagtacagctgcaagggcggctacctgagcgacggcgacagccccgagctgaccaccaaggccagcaagcacggcagcgagaacaagttcggcaagggcaaggagatcatcagcaacagctgcagcaagaacgagatcgacatcgacgccttcagacactacagcttcagcgaccagcccaagtgcagccagtacatcagcggcctgatgagcgtgcacttctacggcgccgaggacctgaagccccccagaatcgacagcaaggacgtgttctgcgccatccaggtggacagcgtgaacaaggccagaaccgccctgctgacctgcagaaccaccttcctggacatggaccacaccttcaacatcgagatcgagaacgcccagcacctgaagctggtggtgttcagctgggagcccacccccagaaagaacagagtgtgctgccacggcaccgtggtgctgcccaccctgttcagagtgaccaagacccaccagctggccgtgaagctggagcccagaggcctgatctacgtgaaggtgaccctgatggagcagtgggagaacagcctgcacggcctggacatcaaccaggagcccatcatcttcggcgtggacatccagaaggtggtggagaaggagaacatcggcctgatggtgcccctgctgatccagaagtgcatcatggagatcgagaagagaggctgccaggtggtgggcctgtacagactgtgcggcagcgccgccgtgaagaaggagctgagagaggccttcgagagagacagcaaggccgtgggcctgtgcgagaaccagtaccccgacatcaacgtgatcaccggcgtgctgaaggactacctgagagagctgcccagccccctgatcaccaagcagctgtacgaggccgtgctggacgccatggccaagagccccctgaagatgagcagcaacggctgcgagaacgaccccggcgacagcaagtacaccgtggacctgctggactgcctgcccgagatcgagaaggccaccctgaagatgctgctggaccacctgaagctggtggccagctaccacgaggtgaacaagatgacctgccagaacctggccgtgtgcttcggccccgtgctgctgagccagagacaggagcccagcacccacaacaacagagtgttcaccgacagcgaggagctggccagcgccctggacttcaagaagcacatcgaggtgctgcactacctgctgcagctgtggcccgtgcagagactgaccgtgaagaagagcaccgacaacctgttccccgagcagaagagcagcctgaactacctgagacagaagaaggagagaccccacatgctgaacctgagcggcaccgacagcagcggcgtgctgagacccagacagaacagactggacagccccctgagcaacagatacgccggcgactggagcagctgcggcgagaactacttcctgaacaccaaggagaacctgaacgacgtggactacgacgacgtgcccagcgaggacagaaagatcggcgagaactacagcaagatggacggccccgaggtgatgatcgagcagcccatccccatgagcaaggagtgcaccttccagacctacctgaccatgcagaccgtggagagcaccgtggacagaaagaacaacctgaaggacctgcaggagagcatcgacaccctgatcggcaacctggagagagagctgaacaagaacaagctgaacatgagcttctag

SEQ ID NO: 10240 - DNA, 1353 bp, Artificial Sequence
  Description of Artificial Sequence: Synthetic coding sequence
atggaccccggcaacgagaacagcgccaccgaggccgccgccatcatcgacctggaccccgacttcgagccccagagcagacccagaagctgcacctggcccctgcccagacccgagatcgccaaccagcccagcgagccccccgaggtggagcccgacctgggcgagaaggccatcgagagcgcccccgagaagagactgaccctggcccagatctacgagtggatggtgagaaccgtgccctacttcaaggacaagggcgacagcaacagcagcgccggctggaagaacagcatcagacacaacctgagcctgcacagcaagttcatcaaggtgcacaacgaggccaccggcaagagcagctggtggatgctgaaccccgagggcggcaagagcggcaaggcccccagaagaagagccgccagcatggacagcagcagcaagctgctgagaggcagaagcaaggcccccaagaagaagcccagcgtgctgcccgccccccccgagggcgccacccccaccagccccgtgggccacttcgccaagtggagcggcagcccctgcagcagaaacagagaggaggccgacatgtggaccaccttcagacccagaagcagcagcaacgccagcagcgtgagcaccagactgagccccctgagacccgagagcgaggtgctggccgaggagatccccgccagcgtgagcagctacgccggcggcgtgccccccaccctgaacgagggcctggagctgctggacggcctgaacctgaccagcagccacagcctgctgagcagaagcggcctgagcggcttcagcctgcagcaccccggcgtgaccggccccctgcacacctacagcagcagcctgttcagccccgccgagggccccctgagcgccggcgagggctgcttcagcagcagccaggccctggaggccctgctgaccagcgacaccccccccccccccgccgacgtgctgatgacccaggtggaccccatcctgagccaggcccccaccctgctgctgctgggcggcctgcccagcagcagcaagctggccaccggcgtgggcctgtgccccaagcccctggaggcccccggccccagcagcctggtgcccaccctgagcatgatcgcccccccccccgtgatggccagcgcccccatccccaaggccctgggcacccccgtgctgaccccccccaccgaggccgccagccaggacagaatgccccaggacctggacctggacatgtacatggagaacctggagtgcgacatggacaacatcatcagcgacctgatggacgagggcgagggcctggacttcaacttcgagcccgacccctag

SEQ ID NO: 10241 - DNA, 1125 bp, Artificial Sequence
  Description of Artificial Sequence: Synthetic coding sequence
atggccggctacctgagcgagagcgacttcgtgatggtggaggagggcttcagcaccagagacctgctgaaggagctgaccctgggcgccagccaggccaccaccgacgaggtggccgccttcttcgtggccgacctgggcgccatcgtgagaaagcacttctgcttcctgaagtgcctgcccagagtgagacccttctacgccgtgaagtgcaacagcagccccggcgtgctgaaggtgctggcccagctgggcctgggcttcagctgcgccaacaaggccgagatggagctggtgcagcacatcggcatccccgccagcaagatcatctgcgccaacccctgcaagcagatcgcccagatcaagtacgccgccaagcacggcatccagctgctgagcttcgacaacgagatggagctggccaaggtggtgaagagccaccccagcgccaagttcgtgcagcagagaggcaccgcctgcctgatcagaatggtgctgtgcatcgccaccgacgacagccacagcctgagctgcctgagcctgaagttcggcgtgagcctgaagagctgcagacacctgctggagaacgccaagaagcaccacgtggaggtggtgggcgtgagcttccacatcggcagcggctgccccgacccccaggcctacgcccagagcatcgccgacgccagactggtgttcgagatgggcaccgagctgggccacaagatgcacgtgctggacctgggcggcggcttccccggcaccgagggcgccaaggtgagattcgaggagatcgccagcgtgatcaacagcgccctggacctgtacttccccgagggctgcggcgtggacatcttcgccgagctgggcagatactacgtgaccagcgccttcaccgtggccgtgagcatcatcgccaagaaggaggtgctgctggaccagcccggcagagaggaggagaacggcagcaccagcaagaccatcgtgtaccacctggacgagggcgtgtacggcatcttcaacagcgtgctgttcgacaacatctgccccacccccatcctgcagaagagcaagaaccacagcccctgctacatgagcctggagagcatccacttcatcgccgtgtag

SEQ ID NO: 10242 - DNA, 1629 bp, Artificial Sequence
  Description of Artificial Sequence: Synthetic coding sequence
atggacagaagcaagagaaacagcatcgccggcttcccccccagagtggagagactggaggagttcgagggcggcggcggcggcgagggcaacgtgagccaggtgggcagagtgtggcccagcagctacagagccctgatcagcgccttcagcagactgaccagactggacgacttcacctgcgagaagatcggcagcggcttcttcagcgaggtgttcaaggtgagacacagagccagcggccaggtgatggccctgaagatgaacaccctgagcagcaacagagccaacatgctgaaggaggtgcagctgatgaacagactgagccaccccaacatcctgagattcatgggcgtgtgcgtgcaccagggccagctgcacgccctgaccgagtacatcaacagcggcaacctggagcagctgctggacagcaacctgcacctgccctggaccgtgagagtgaagctggcctacgacatcgccgtgggcctgagctacctgcacttcaagggcatcttccacagagacctgaccagcaagaactgcctgatcaagagagacgagaacggctacagcgccgtggtggccgacttcggcctggccgagaagatccccgacgtgagcatgggcagcgagaagctggccgtggtgggcagccccttctggatggcccccgaggtgctgagagacgagccctacaacgagaaggccgacgtgttcagctacggcatcatcctgtgcgagatcatcgccagaatccaggccgaccccgactacctgcccagaaccgagatggaccccaagctgagacccagcttcgtggagatcggcaagaccctggaggagatcctgagcagactgcaggaggaggagcaggagagagacagaaagctgcagcccaccgccagaggcctgctggagaaggcccccggcgtgaagagactgagcagcctggacgacaagatcccccacaagagcccctgccccagaagaaccatctggctgagcagaagccagagcgacatcttcagcagaaagccccccagaaccgtgagcgtgctggacccctactacagacccagagacggcgccgccagaacccccaaggtgaaccccttcagcgccagacaggacctgatgggcggcaagatcaagttcttcgacctgcccagcaagagcgtgatcagcctggtgttcgacctggacgcccccggccccggcaccatgcccctggccgactggcaggagcccctggccccccccatcagaagatggagaagcctgcccggcagccccgagttcctgcaccaggaggcctgccccttcgtgggcagagaggagagcctgagcgacggccccccccccagactgagcagcctgaagtacagagtgaaggagatcccccccttcagagccagcgccctgcccgccgcccaggcccacgaggccatggactgcagcatcctgcaggaggagaacggcttcggcagcagaccccagggcaccagcccctgccccgccggcgccagcgaggagatggaggtggaggagagacccgccggcagcacccccgccaccttcagcaccagcggcatcggcctgcagacccagggcaagcaggacggctag

SEQ ID NO: 10243 - DNA, 786 bp, Artificial Sequence
  Description of Artificial Sequence: Synthetic coding sequence
atgggcagcagaaagaaggagatcgccctgcaggtgaacatcagcacccaggagctgtgggaggagatgctgagcagcaagggcctgaccgtggtggacgtgtaccagggctggtgcggcccctgcaagcccgtggtgagcctgttccagaagatgagaatcgaggtgggcctggacctgctgcacttcgccctgatcaaggacgaggccctgagcgacgaggacgagtgcgtgagccacggcaagaacaacggcgaggacgaggacatggtgagcagcgagagaacctgcaccctggccatcatcaagcccgacgccgtggcccacggcaagaccgacgagatcatcatgaagatccaggaggccggcttcgagatcctgaccaacgaggagagaaccatgaccgaggccgaggtgagactgttctaccagcacaaggccggcgaggaggccttcgagaagctggtgcaccacatgtgcagcggccccagccacctgctgatcctgaccagaaccgagggcttcgaggacgtggtgaccacctggagaaccgtgatgggccccagagaccccaacgtggccagaagagagcagcccgagagcctgagagcccagtacggcaccgagatgcccttcaacgccgtgcacggcagcagagacagagaggacgccgacagagagctggccctgctgttccccagcctgaagttcagcgacaaggacaccgaggccccccagggcgagagcagcacccagcccagactgaagatcaccgacctggactag

SEQ ID NO: 10244 - DNA, 1767 bp, Artificial Sequence
  Description of Artificial Sequence: Synthetic coding sequence
atggaggccgccgacgccagcagaagcaacggcagcagccccgaggccagagacgccagaagccccagcggccccagcggcagcctggagaacggcaccaaggccgacggcaaggacgccaagaccaccaacggccacggcggcgaggccgccgagggcaagagcctgggcagcgccctgaagcccggcgagggcagaagcgccctgttcgccggcaacgagtggagaagacccatcatccagttcgtggagagcggcgacgacaagaacagcaactacttcagcatggacagcatggagggcaagagaagcccctacgccggcctgcagctgggcgccgccaagaagccccccgtgaccttcgccgagaagggcgagctgagaaagagcatcttcagcgagagcagaaagcccaccgtgagcatcatggagcccggcgagaccagaagaaacagctaccccagagccgacaccggcctgttcagcagaagcaagagcggcagcgaggaggtgctgtgcgacagctgcatcggcaacaagcagaaggccgtgaagagctgcctggtgtgccaggccagcttctgcgagctgcacctgaagccccacctggagggcgccgccttcagagaccaccagctgctggagcccatcagagacttcgaggccagaaagtgccccgtgcacggcaagaccatggagctgttctgccagaccgaccagacctgcatctgctacctgtgcatgttccaggagcacaagaaccacagcaccgtgaccgtggaggaggccaaggccgagaaggagaccgagctgagcctgcagaaggagcagctgcagctgaagatcatcgagatcgaggacgaggccgagaagtggcagaaggagaaggacagaatcaagagcttcaccaccaacgagaaggccatcctggagcagaacttcagagacctggtgagagacctggagaagcagaaggaggaggtgagagccgccctggagcagagagagcaggacgccgtggaccaggtgaaggtgatcatggacgccctggacgagagagccaaggtgctgcacgaggacaagcagaccagagagcagctgcacagcatcagcgacagcgtgctgttcctgcaggagttcggcgccctgatgagcaactacagcctgcccccccccctgcccacctaccacgtgctgctggagggcgagggcctgggccagagcctgggcaacttcaaggacgacctgctgaacgtgtgcatgagacacgtggagaagatgtgcaaggccgacctgagcagaaacttcatcgagagaaaccacatggagaacggcggcgaccacagatacgtgaacaactacaccaacagcttcggcggcgagtggagcgcccccgacaccatgaagagatacagcatgtacctgacccccaagggcggcgtgagaaccagctaccagcccagcagccccggcagattcaccaaggagaccacccagaagaacttcaacaacctgtacggcaccaagggcaactacaccagcagagtgtgggagtacagcagcagcatccagaacagcgacaacgacctgcccgtggtgcagggcagcagcagcttcagcctgaagggctaccccagcctgatgagaagccagagccccaaggcccagccccagacctggaagagcggcaagcagaccatgctgagccactacagacccttctacgtgaacaagggcaacggcatcggcagcaacgaggccccctag

SEQ ID NO: 10245 - DNA, 3567 bp, Artificial Sequence
  Description of Artificial Sequence: Synthetic coding sequence
atgaagaagaagcagaccgtgcagggcaccttcagcaagctgttcggcaagaagcacaccaccacccccagcaccagcctgtacgccaccaaccccccctggatcttcacccaggaggcccccgaggagggcaccggcggcttcgacggcatctactacggcgacaacagattcaacaccgtgagcgagagcggcaccgccaccctgaaggccagacccagagtgagacccctgctgaccttcctgcccctgaacgcccaggagaaccacggcctggccgtgcccacccccagcgtgcccgacgacttcgccgacaaggaggtgaccggcaccagcagcctggtgaacggcaacctgagactgtacagcagcgtgggcgacctgagacccggccagtacggccaggacctgctgatccccccccccccccccggccccgcccccggccccccccaggacatcagcgagccccccggcggcagccccctgcccagcccccccagcaccgcccccccccccccccccctgctgctggagcccccccccccccccagcatggcccccccccccccccccgtgctggaggccctgagccccccccacaccctgagcagccccagcatccccaccccccccgacttcatcccccccgccccccccctggccttcctggcccccccccccccccccgtgcccgcccccgccccccccgcccccgccagcccccacaccgtgggcaccagactgttcccccccggcggcgtgaccaagtggaagagcgacgtggccctgaacggcagacaggccgaggccaccagagccagcccccccagaagccccgccgagcccaagggcagcgccctgggccccaaccccgagccccacctgaccttccccagaagcttcaaggtgcccccccccacccccgtgagaaccagcagcatccccgtgcaggaggcccaggaggcccccagaaaggaggagggcgccaccaagaaggcccccagcagactgcccctgccccccagcttccacatcagacccgccagccaggtgtaccccgacagagcccccgagcccgactgccccggcgagctgaaggccaccgcccccgccagccccagactgggccagagccagagccaggccgacgagagagccggcacccccccccccgccccccccctgcccccccccgccccccccctgcccccccccgccccccccctgccccccgccgccccccccctgccctgcgcccagaaggccgcccacccccccgccggcttcaccaagacccccaagagcagcagccccgccctgaagcccaagcccaacccccccagccccgagaacaccgccagcagcgcccccgtggactggagagaccccagccagatggagaagctgagaaacgagctggccgcctacctgtgcggcagcagaagagaggacagattcctgagccacagacccggccccaccgtggccccccagagcaaggagggcaagaagggccccagactgcccgagaaggagaccctgctgagcctgcccgccaaggacaccccccccggcgtgcccgagaagagcctgggcggcagcagcctgaccgagaccgaggccgcccccagcctgaccctgcccagcgtggactacatcccccaggacagccccacccccagcgtgagacagatcagaaacgagctggaggccagactgagcagcgccgccgagaaggaggccaagcccagcatcggcagcctgccccccaagcccagactggagggcggcagaatctgcgagaacggcgccgacgacgacaagctgagcaagcccgtggccaagaacctgcccccccagagcaccaccctgctgcccaccaccagcctgcagcccaaggccatgctgggccccgccatcccccccaaggccacccccgagcccgccatcccccccaaggccaccctgtggcccgccaccccccccaaggccaccctgggccccgccacccccctgaaggccaccagcggccccaccacccccctgaaggccaccagcggccccgccatcgccagcaccgccaccaccctgcccaccaccaccagccagctgatggccgagaaggacagcggccccgccggccagcccgagaagcccgccagccaggaggtgagcacccccagccaggccagaggcgagggcagccccagcgaggccaccagactgcccacccagggcgccagaagcagcgccgccttcccccccaagaccagccccggcggcggcgaggtgccctgcctgtacaagccccactgccaccagagcagcctgagcagagaggtggccgtggtgatgcccaccctggccagaggcggcgccgccggccccggcgagcccgtggaggtgaaggagccccccggcctgcccgccaagccccccgccagcgcccagcccaccgacgagctgctgagacaccccgtgaccggcgaggtggtggagagaggcagccccatggccctgctgctggccgccagacagagagcccagaagggcagaagcgtgggcgccgccctgggcagaagcagcctgcccggcagcctgagagaccacagccaccaggccgaggccagcagcgacagcatcttccacagccagggcacccccaacagcttcaccgtggtgcccaagctgcccaaggaggccgagaaggacagccccctgaccaccgagatccccaacaagtggggccccagactgggcagagacgccgagggcaccgagctgagcagaagacacaactggaccaagcccgagccccaggcccccgtggcctgggagagagtggcccccagcaacctgccccagggccaccccctgcccaagagcttcagcagcccccccagccccagcaacaagagagaggaggaggaggaggagttcaacttcgaggtgatcccccccccccccgagttcagcaacgaccccgagccccccgcccccgccctgcagtacctgggcagacagagcagcccccccagaaacaactacagcgacctgagacagctgcccaacgccggccccggcgccccccccgccctgggcttcagcagattccccgccggcgccagatacgccggcgccggcggcctggagagattcagcggcggcggcagaagcctgatcaagaagagactgtacgtgggcgagccccacagaggccccggcctgccccacggcggcaccggcagaagcctgagcagccccaactgcttcggcccccagcccggcggccccgagatgagaagagtgaacagcgccggcagagccccccccggcggcctgcacgcccccagactgagcctggagggcgccgccagaggcgccgccgaggccaagcacaaggcccccggcagcgccgactacggcttcgcccccgccgccggcagaagcccctacaccaccaccagatacggcagccccatcaacaccttcaccgtgagacccggcaccagacaccccatcagctacgtgtgcagcggcgcccacagaaaggccaccagctag

SEQ ID NO: 10246 - DNA, 2598 bp, Artificial Sequence
  Description of Artificial Sequence: Synthetic coding sequence
atggccgtggccagagtggacgccgccctgccccccggcgagggcagcgtggtgaactggagcggccagggcctgcagaagctgggccccaacctgccctgcgaggccgacatccacaccctgatcctggacaagaaccagatcatcaagctggagaacctggagaagtgcaagagactgatccagctgagcgtggccaacaacagactggtgagaatgatgggcgtggccaagctgaccctgctgagagtgctgaacctgccccacaacagcatcggctgcgtggagggcctgaaggagctggtgcacctggagtggctgaacctggccggcaacaacctgaaggccatggagcagatcaacagctgcaccgccctgcagcacctggacctgagcgacaacaacatcagccagatcggcgacctgagcaagctggtgagcctgaagaccctgctgctgcacggcaacatcatcaccagcctgagaatggcccccgcctacctgcccagaagcctggccatcctgagcctggccgagaacgagatcagagacctgaacgagatcagcttcctggccagcctgaccgagctggagcagctgagcatcatgaacaacccctgcgtgatggccacccccagcatccccggcttcgactacagaccctacatcgtgagctggtgcctgaacctgagagtgctggacggctacgtgatcagccagaaggagagcctgaaggccgagtggctgtacagccagggcaagggcagagcctacagacccggccagcacatccagctggtgcagtacctggccaccgtgtgccccctgaccagcaccctgggcctgcagaccgccgaggacgccaagctggagaagatcctgagcaagcagagattccaccagagacagctgatgaaccagagccagaacgaggagctgagccccctggtgcccgtggagaccagagccagcctgatccccgagcacagcagccccgtgcaggactgccagatcagccaggagagcgagcccgtgatccaggtgaacagctgggtgggcatcaacagcaacgacgaccagctgttcgccgtgaagaacaacttccccgccagcgtgcacaccaccagatacagcagaaacgacctgcacctggaggacatccagaccgacgaggacaagctgaactgcagcctgctgagcagcgagagcaccttcatgcccgtggccagcggcctgagccccctgagccccaccgtggagctgagactgcagggcatcaacctgggcctggaggacgacggcgtggccgacgagagcgtgaagggcctggagagccaggtgctggacaaggaggaggagcagcccctgtgggccgccaacgagaacagcgtgcagatgatgagaagcgagatcaacaccgaggtgaacgagaaggccggcctgctgccctgccccgagcccaccatcatcagcgccatcctgaaggacgacaaccacagcctgaccttcttccccgagagcaccgagcagaagcagagcgacatcaagaagcccgagaacacccagcccgagaacaaggagaccatcagccaggccaccagcgagaagctgcccatgatcctgacccagagaagcgtggccctgggccaggacaaggtggccctgcagaagctgaacgacgccgccaccaagctgcaggcctgctggagaggcttctacgccagaaactacaacccccaggccaaggacgtgagatacgagatcagactgagaagaatgcaggagcacatcgtgtgcctgaccgacgagatcagaagactgagaaaggagagagacgaggagagaatcaagaagttcgtgcaggaggaggccttcagattcctgtggaaccaggtgagaagcctgcaggtgtggcagcagaccgtggaccagagactgagcagctggcacaccgacgtgccccccatcagcagcaccctggtgcccagcaagcaccccctgttcacccagagccaggagagcagctgcgaccagaacgccgactggttcatcgccagcgacgtggccccccaggagaagagcctgcccgagttccccgacagcggcttccacagcagcctgaccgagcaggtgcacagcctgcagcacagcctggacttcgagaagagcagcaccgagggcagcgagagcagcatcatgggcaacagcatcgacaccgtgagatacggcaaggagagcgacctgggcgacgtgagcgaggagcacggcgagtggaacaaggagagcagcaacaacgagcaggacaacagcctgctggagcagtacctgaccagcgtgcagcagctggaggacgccgacgagagaaccaacttcgacaccgagaccagagacagcaagctgcacatcgcctgcttccccgtgcagctggacaccctgagcgacggcgccagcgtggacgagagccacggcatcagcccccccctgcagggcgagatcagccagacccaggagaacagcaagctgaacgccgaggtgcagggccagcagcccgagtgcgacagcaccttccagctgctgcacgtgggcgtgaccgtgtag

SEQ ID NO: 10247 - DNA, 1275 bp, Artificial Sequence
  Description of Artificial Sequence: Synthetic coding sequence
atgagcgtgggctgccccgagcccgagccccccagaagcctgacctgctgcggccccggcaccgcccccggccccggcgccggcgtgcccctgctgaccgaggacatgcaggccctgaccctgagaaccctggccgccagcgacgtgaccaagcactacgagctggtgagagagctgggcaagggcacctacggcaaggtggacctggtggtgtacaagggcaccggcaccaagatggccctgaagttcgtgaacaagagcaagaccaagctgaagaacttcctgagagaggtgagcatcaccaacagcctgagcagcagccccttcatcatcaaggtgttcgacgtggtgttcgagaccgaggactgctacgtgttcgcccaggagtacgcccccgccggcgacctgttcgacatcatccccccccaggtgggcctgcccgaggacaccgtgaagagatgcgtgcagcagctgggcctggccctggacttcatgcacggcagacagctggtgcacagagacatcaagcccgagaacgtgctgctgttcgacagagagtgcagaagagtgaagctggccgacttcggcatgaccagaagagtgggctgcagagtgaagagagtgagcggcaccatcccctacaccgcccccgaggtgtgccaggccggcagagccgacggcctggccgtggacaccggcgtggacgtgtgggccttcggcgtgctgatcttctgcgtgctgaccggcaacttcccctgggaggccgccagcggcgccgacgccttcttcgaggagttcgtgagatggcagagaggcagactgcccggcctgcccagccagtggagaagattcaccgagcccgccctgagaatgttccagagactgctggccctggagcccgagagaagaggccccgccaaggaggtgttcagattcctgaagcacgagctgaccagcgagctgagaagaagacccagccacagagccagaaagccccccggcgacagaccccccgccgccggccccctgagactggaggcccccggccccctgaagagaaccgtgctgaccgagagcggcagcggcagcagacccgccccccccgccgtgggcagcgtgcccctgcccgtgcccgtgcccgtgcccgtgcccgtgcccgtgcccgtgcccgagcccggcctggccccccagggcccccccggcagaaccgacggcagagccgacaagagcaagggccaggtggtgctggccaccgccatcgagatctgcgtgtag

SEQ ID NO: 10248 - DNA, 1632 bp, Artificial Sequence
  Description of Artificial Sequence: Synthetic coding sequence
atggccaccagaagactgggcgtgggcgagaccctgggcgccctgaacgccgccctgggccccggcggccccgtgtggatcaaggagaccagaaccagacacctgagaagcagagacttcctggccccccacagagccctgcaggccagattcgacgacggccaggtgcccgagcacctgctgcacgccctggcctgcctgcagggccccggcgtggcccccgtgctgagatgcgcccccacccccgccggcctgagcctgcagctgcagagaagcgccgtgttcgagagagtgctgagcgccgtggccgcctacgccacccccgccagccccgccagcctgggccagagagtgctgctgcactgccccgccctgagaagcagcccctgcgccctgagactgagccagctgagaaccgtgctggtggccgaccacctggccagagccctgagagcccacggcgtgtgcgtgagactggtgcccgccgtgagagacccccacatgctgaccttcctgcagcagctgagagtggactggcccgccgccagcgagagagccagcagccacaccctgagaagccacgccctggaggagctgaccagcgccaacgacggcagaaccctgagccccggcatcctgggcagactgtgcctgaaggagctggtggaggagcagggcagaaccgccggctacgaccccaacctggacaactgcctggtgaccgaggacctgctgagcgtgctggccgagctgcaggaggccctgtggcactggcccgaggacagccaccccggcctggccggcgccagcgacaccggcaccggcggctgcctggtggtgcacgtggtgagctgcgaggaggagttccagcagcagaagctggacctgctgtggcagaagctggtggacaaggcccccctgagacagaagcacctgatctgcggccccgtgaaggtggccggcgcccccggcaccctgatgaccgcccccgagtactacgagttcagacacacccaggtgtgcaaggccagcgccctgaagcacggcggcgacctggcccaggaccccgcctggaccgagatcttcggcgtgctgagcgtggccaccatcaagttcgagatgctgagcaccgccccccagagccagctgttcctggccctggccgacagcagcatcagcaccaagggcaccaagagcggcaccttcgtgatgtacaactgcgccagactggccaccctgttcgagagctacaagtgcagcatggagcagggcctgtaccccaccttcccccccgtgagcagcctggacttcagcctgctgcacgacgagggcgagtggctgctgctgttcaacagcatcctgcccttccccgacctgctgagcagaaccgccgtgctggactgcaccgcccccggcctgcacatcgccgtgagaaccgagatgatctgcaagttcctggtgcagctgagcatggacttcagcagctactacaacagagtgcacatcctgggcgagcccagaccccacctgttcggccagatgttcgtgagactgcagctgctgagagccgtgagagaggtgctgcacaccggcctggccatgctgggcctgccccccctgagccacatctag

SEQ ID NO: 10249 - DNA, 1353 bp, Artificial Sequence
  Description of Artificial Sequence: Synthetic coding sequence
atgggcaagagcttcgccaacttcatgtgcaagaaggacttccaccccgccagcaagagcaacatcaagaaggtgtggatggccgagcagaagatcagctacgacaagaagaagcaggaggagctgatgcagcagtacctgaaggagcaggagagctacgacaacagactgctgatgggcgacgagagagtgaagaacggcctgaacttcatgtacgaggccccccccggcgccaagaaggagaacaaggagaaggaggagaccgagggcgagaccgagtacaagttcgagtggcagaagggcgcccccagagagaagtacgccaaggacgacatgaacatcagagaccagcccttcggcatccaggtgagaaacgtgagatgcatcaagtgccacaagtggggccacgtgaacaccgacagagagtgccccctgttcggcctgagcggcatcaacgccagcagcgtgcccaccgacggcagcggccccagcatgcaccccagcgagctgatcgccgagatgagaaacagcggcttcgccctgaagagaaacgtgctgggcagaaacctgaccgccaacgaccccagccaggagtacgtggccagcgagggcgaggaggaccccgaggtggagttcctgaagagcctgaccaccaagcagaagcagaagctgctgagaaagctggacagactggagaagaagaagaagaagaaggacagaaagaagaagaagttccagaagagcagaagcaagcacaagaagcacaagagcagcagcagcagcagcagcagcagcagcagcagcagcagcaccgagaccagcgagagcagcagcgagagcgagagcaacaacaaggagaagaagatccagagaaagaagagaaagaagaacaagtgcagcggccacaacaacagcgacagcgaggagaaggacaagagcaagaagagaaagctgcacgaggagctgagcagcagccaccacaacagagagaaggccaaggagaagcccagattcctgaagcacgagagcagcagagaggacagcaagtggagccacagcgacagcgacaagaagagcagaacccacaagcacagccccgagaagagaggcagcgagagaaaggagggcagcagcagaagccacggcagagaggagagaagcagaagaagcagaagcagaagccccggcagctacaagcagagagagaccagaaagagagcccagagaaaccccggcgaggagcagagcagaagaaacgacagcagaagccacggcaccgacctgtacagaggcgagaagatgtacagagagcaccccggcggcacccacaccaaggtgacccagagagagtag

SEQ ID NO: 10250 - DNA, 1152 bp, Artificial Sequence
  Description of Artificial Sequence: Synthetic coding sequence
atgagccccgaggtggccctgaacagaatcagccccatgctgagccccttcatcagcagcgtggtgagaaacggcaaggtgggcctggacgccaccaactgcctgagaatcaccgacctgaagagcggctgcaccagcctgacccccggccccaactgcgacagattcaagctgcacatcccctacgccggcgagaccctgaagtgggacatcatcttcaacgcccagtaccccgagctgccccccgacttcatcttcggcgaggacgccgagttcctgcccgaccccagcgccctgcagaacctggccagctggaaccccagcaaccccgagtgcctgctgctggtggtgaaggagctggtgcagcagtaccaccagttccagtgcagcagactgagagagagcagcagactgatgttcgagtaccagaccctgctggaggagccccagtacggcgagaacatggagatctacgccggcaagaagaacaactggaccggcgagttcagcgccagattcctgctgaagctgcccgtggacttcagcaacatccccacctacctgctgaaggacgtgaacgaggaccccggcgaggacgtggccctgctgagcgtgagcttcgaggacaccgaggccacccaggtgtaccccaagctgtacctgagccccagaatcgagcacgccctgggcggcagcagcgccctgcacatccccgccttccccggcggcggctgcctgatcgactacgtgccccaggtgtgccacctgctgaccaacaaggtgcagtacgtgatccagggctaccacaagagaagagagtacatcgccgccttcctgagccacttcggcaccggcgtggtggagtacgacgccgagggcttcaccaagctgaccctgctgctgatgtggaaggacttctgcttcctggtgcacatcgacctgcccctgttcttccccagagaccagcccaccctgaccttccagagcgtgtaccacttcaccaacagcggccagctgtacagccaggcccagaagaactacccctacagccccagatgggacggcaacgagatggccaagagagccaaggcctacttcaagaccttcgtgccccagttccaggaggccgccttcgccaacggcaagctgtag

SEQ ID NO: 10251 - DNA, 675 bp, Artificial Sequence
  Description of Artificial Sequence: Synthetic coding sequence
atgcccaacagatgcggcatcatccacgtgagaggccccatgccccccaacagaatcagccacggcgaggtgctggagtggcagaagaccttcgaggagaagctgacccccctgctgagcgtgagagagagcctgagcgaggaggaggcccagaagatgggcagaaaggaccccgagcaggaggtggagaagttcgtgaccagcaacacccaggagctgggcaaggacaagtggctgtgccccctgagcggcaagaagttcaagggccccgagttcgtgagaaagcacatcttcaacaagcacgccgagaagatcgaggaggtgaagaaggaggtggccttcttcaacaacttcctgaccgacgccaagagacccgccctgcccgagatcaagcccgcccagccccccggccccgcccagatcctgccccccggcctgacccccggcctgccctacccccaccagaccccccagggcctgatgccctacggccagcccagaccccccatcggcctgtggagctggtgctgccccccctgcagcccccaggaggccctgcacacccccatgcccagaatggtgctggtggagggcaccatgatgcccagcgaggccagagaggtgatcctgggcaacctggccaccggctggttcgtggagacccagggcccctag

SEQ ID NO: 10252 - DNA, 4806 bp, Artificial Sequence
  Description of Artificial Sequence: Synthetic coding sequence
atggaggccggcagcgtggtgagagccatcttcgacttctgccccagcgtgagcgaggagctgcccctgttcgtgggcgacatcatcgaggtgctggccgtggtggacgagttctggctgctgggcaagaaggaggacgtgaccggccagttccccagcagcttcgtggagatcgtgaccatccccagcctgaaggagggcgagagactgttcgtgtgcatctgcgagttcaccagccaggagctggacaacctgcccctgcacagaggcgacctggtgatcctggacggcatccccaccgccggctggctgcagggcagaagctgctggggcgccagaggcttcttccccagcagctgcgtgagagagctgtgcctgagcagccagagcagacagtggcacagccagagcgccctgttccagatccccgagtacagcatgggccaggccagagccctgatgggcctgagcgcccagctggacgaggagctggacttcagagagggcgacgtgatcaccatcatcggcgtgcccgagcccggctggttcgagggcgagctggagggcagaagaggcatcttccccgagggcttcgtggagctgctgggccccctgagaaccgtggacgagagcgtgagcagcggcaaccaggacgactgcatcgtgaacggcgaggtggacacccccgtgggcgaggaggagatcggccccgacgaggacgaggaggagcccggcacctacggcgtggccctgtacagattccaggccctggagcccaacgagctggacttcgaggtgggcgacaagatcagaatcctggccaccctggaggacggctggctggagggcagcctgaagggcagaaccggcatcttcccctacagattcgtgaagctgtgccccgacaccagagtggaggagaccatggccctgccccaggagggcagcctggccagaatccccgagaccagcctggactgcctggagaacaccctgggcgtggaggagcagagacacgagaccagcgaccacgaggccgaggagcccgactgcatcatcagcgaggcccccaccagccccctgggccacctgaccagcgagtacgacaccgacagaaacagctaccaggacgaggacaccgccggcggcccccccagaagccccggcgtggagtgggagatgcccctggccaccgacagccccaccagcgaccccaccgaggtggtgaacggcatcagcagccagccccaggtgcccttccaccccaacctgcagaagagccagtactacagcaccgtgggcggcagccacccccacagcgagcagtaccccgacctgctgcccctggaggccagaaccagagactacgccagcctgccccccaagagaatgtacagccagctgaagaccctgcagaagcccgtgctgcccctgtacagaggcagcagcgtgagcgccagcagagtggtgaagcccagacagagcagcccccagctgcacaacctggccagctacaccaagaagcaccacaccagcagcgtgtacagcatcagcgagagactggagatgaagcccggcccccaggcccagggcctggtgatggaggccgccacccacagccagggcgacggcagcaccgacctggacagcaagctgacccagcagctgatcgagttcgagaagagcctggccggccccggcaccgagcccgacaagatcctgagacacttcagcatcatggacttcaacagcgagaaggacatcgtgagaggcagcagcaagctgatcaccgagcaggagctgcccgagagaagaaaggccctgagaccccccccccccagaccctgcacccccgtgagcaccagcccccacctgctggtggaccagaacctgaagcccgccccccccctggtggtgagacccagcagacccgcccccctgccccccagcgcccagcagagaaccaacgccgtgagccccaagctgctgagcagacacagacccacctgcgagaccctggagaaggagggccccggccacatgggcagaagcctggaccagaccagcccctgccccctggtgctggtgagaatcgaggagatggagagagacctggacatgtacagcagagcccaggaggagctgaacctgatgctggaggagaagcaggacgagagcagcagagccgagaccctggaggacctgaagttctgcgagagcaacatcgagagcctgaacatggagctgcagcagctgagagagatgaccctgctgagcagccagagcagcagcctggtggcccccagcggcagcgtgagcgccgagaaccccgagcagagaatgctggagaagagagccaaggtgatcgaggagctgctgcagaccgagagagactacatcagagacctggagatgtgcatcgagagaatcatggtgcccatgcagcaggcccaggtgcccaacatcgacttcgagggcctgttcggcaacatgcagatggtgatcaaggtgagcaagcagctgctggccgccctggagatcagcgacgccgtgggccccgtgttcctgggccacagagacgagctggagggcacctacaagatctactgccagaaccacgacgaggccatcgccctgctggagatctacgagaaggacgagaagatccagaagcacctgcaggacagcctggccgacctgaagagcctgtacaacgagtggggctgcaccaactacatcaacctgggcagcttcctgatcaagcccgtgcagagagtgatgagataccccctgctgctgatggagctgctgaacagcacccccgagagccaccccgacaaggtgcccctgaccaacgccgtgctggccgtgaaggagatcaacgtgaacatcaacgagtacaagagaagaaaggacctgggcaagaacagcatcatcgccgagaaggagtacgcccacgccgaggagagcgccttcctgacctacagcctggtgctgaagtacagaaagggcgacgaggacagcctgatggagaagatcagcaagctgaacatccacagcatcatcaagaagagcaacagagtgagcagccacctgaagcacctgaccggcttcgccccccagatcaaggacgaggtgttcgaggagaccgagaagaacttcagaatgcaggagagactgatcaagagcttcatcagagacctgagcctgtacctgcagcacatcagagagagcgcctgcgtgaaggtggtggccgccgtgagcatgtgggacgtgtgcatggagagaggccacagagacctggagcagttcgagagagtgcacagatacatcagcgaccagctgttcaccaacttcaaggagagaaccgagagactggtgatcagccccctgaaccagctgctgagcatgttcaccggcccccacaagctggtgcagaagagattcgacaagctgctggacttctacaactgcaccgagagagccgagaagctgaaggacaagaagaccctggaggagctgcagagcgccagaaacaactacgaggccctgaacgcccagctgctggacgagctgcccaagttccaccagtacgcccagggcctgttcaccaactgcgtgcacggctacgccgaggcccactgcgacttcgtgcaccaggccctggagcagctgaagcccctgctgagcctgctgaaggtggccggcagagagggcaacctgatcgccatcttccacgaggagcacagcagagtgctgcagcagctgcaggtgttcaccttcttccccgagagcctgcccgccaccaagaagcccttcgagagaaagaccatcgacagacagagcgccagaaagcccctgctgggcctgcccagctacatgctgcagagcgaggagctgagagccagcctgctggccagatacccccccgagaagctgttccaggccgagagaaacttcaacgccgcccaggacctggacgtgagcctgctggagggcgacctggtgggcgtgatcaagaagaaggaccccatgggcagccagaacagatggctgatcgacaacggcgtgaccaagggcttcgtgtacagcagcttcctgaagccctacaaccccagaagaagccacagcgacgccagcgtgggcagccacagcagcaccgagagcgagcacggcagcagcagccccagattccccagacagaacagcggcagcaccctgaccttcaaccccagcagcatggccgtgagcttcaccagcggcagctgccagaagcagccccaggacgccagccccccccccaaggagtgcgaccagggcaccctgagcgccagcctgaaccccagcaacagcgagagcagccccagcagatgccccagcgaccccgacagcaccagccagcccagaagcggcgacagcgccgacgtggccagagacgtgaagcagcccaccgccacccccagaagctacagaaacttcagacaccccgagatcgtgggctacagcgtgcccggcagaaacggccagagccaggacctggtgaagggctgcgccagaaccgcccaggcccccgaggacagaagcaccgagcccgacggcagcgaggccgagggcaaccaggtgtacttcgccgtgtacaccttcaaggccagaaaccccaacgagctgagcgtgagcgccaaccagaagctgaagatcctggagttcaaggacgtgaccggcaacaccgagtggtggctggccgaggtgaacggcaagaagggctacgtgcccagcaactacatcagaaagaccgagtacacctag

SEQ ID NO: 10253 - DNA, 1596 bp, Artificial Sequence
  Description of Artificial Sequence: Synthetic coding sequence
atgaagtgccactacgaggccctgggcgtgagaagagacgccagcgaggaggagctgaagaaggcctacagaaagctggccctgaagtggcaccccgacaagaacctggacaacgccgccgaggccgccgagcagttcaagctgatccaggccgcctacgacgtgctgagcgacccccaggagagagcctggtacgacaaccacagagaggccctgctgaagggcggcttcgacggcgagtaccaggacgacagcctggacctgctgagatacttcaccgtgacctgctacagcggctacggcgacgacgagaagggcttctacaccgtgtacagaaacgtgttcgagatgatcgccaaggaggagctggagagcgtgctggaggaggaggtggacgacttccccaccttcggcgacagccagagcgactacgacaccgtggtgcaccccttctacgcctactggcagagcttctgcacccagaagaacttcgcctggaaggaggagtacgacaccagacaggccagcaacagatgggagaagagagccatggagaaggagaacaagaagatcagagacaaggccagaaaggagaagaacgagctggtgagacagctggtggccttcatcagaaagagagacaagagagtgcaggcccacagaaagctggtggaggagcagaacgccgagaaggccagaaaggccgaggagatgagaagacagcagaagctgaagcaggccaagctggtggagcagtacagagagcagagctggatgaccatggccaacctggagaaggagctgcaggagatggaggccagatacgagaaggagttcggcgacggcagcgacgagaacgagatggaggagcacgagctgaaggacgaggaggacggcaaggacagcgacgaggccgaggacgccgagctgtacgacgacctgtactgccccgcctgcgacaagagcttcaagaccgagaaggccatgaagaaccacgagaagagcaagaagcacagagagatggtggccctgctgaagcagcagctggaggaggaggaggagaacttcagcagaccccagatcgacgagaaccccctggacgacaacagcgaggaggagatggaggacgcccccaagcagaagctgagcaagaagcagaagaagaagaagcagaagcccgcccagaactacgacgacaacttcaacgtgaacggccccggcgagggcgtgaaggtggaccccgaggacaccaacctgaaccaggacagcgccaaggagctggaggacagcccccaggagaacgtgagcgtgaccgagatcatcaagccctgcgacgaccccaagagcgaggccaagagcgtgcccaagcccaagggcaagaagaccaaggacatgaagaagcccgtgagagtgcccgccgagccccagaccatgagcgtgctgatcagctgcaccacctgccacagcgagttccccagcagaaacaagctgttcgaccacctgaaggccaccggccacgccagagcccccagcagcagcagcctgaacagcgccaccagcagccagagcaagaaggagaagagaaagaacagatag

SEQ ID NO: 10254 - DNA, 1353 bp, Artificial Sequence
  Description of Artificial Sequence: Synthetic coding sequence
atggtggtgcaggccgccgtggcccccaacagaagccagagactgctgctgaagatcccctacggcagcctgagaagaagaagcgtggagagaatgaccgagggcagaagatgccaggtgcacctgctggacgacagaaagctggagctgctggtgcagcccaagctgctggccaaggagctgctggacctggtggccagccacttcaacctgaaggagaaggagtacttcggcatcgccttcaccgacgagaccggccacctgaactggctgcagctggacagaagagtgctggagcacgacttccccaagaagagcggccccgtggtgctgtacttctgcgtgagattctacatcgagagcatcagctacctgaaggacaacgccaccatcgagctgttcttcctgaacgccaagagctgcatctacaaggagctgatcgacgtggacagcgaggtggtgttcgagctggccagctacatcctgcaggaggccaagggcgacttcagcagcaacgaggtggtgagaagcgacctgaagaagctgcccgccctgcccacccaggccctgaaggagcaccccagcctggcctactgcgaggacagagtgatcgagcactacaagaagctgaacggccagaccagaggccaggccatcgtgaactacatgagcatcgtggagagcctgcccacctacggcgtgcactactacgccgtgaaggacaagcagggcatcccctggtggctgggcctgagctacaagggcatcttccagtacgactaccacgacaaggtgaagcccagaaagatcttccagtggagacagctggagaacctgtacttcagagagaagaagttcagcgtggaggtgcacgaccccagaagagccagcgtgaccagaagaaccttcggccacagcggcatcgccgtgcacacctggtacgcctgccccgccctgatcaagagcatctgggccatggccatcagccagcaccagttctacctggacagaaagcagagcaagagcaagatccacgccgccagaagcctgagcgagatcgccatcgacctgaccgagaccggcaccctgaagaccagcaagctggccaacatgggcagcaagggcaagatcatcagcggcagcagcggcagcctgctgagcagcggcagacagagacccgccggcggcaccccccccgagcacggctgggaccccagaggcgaccccggcagatggggcgagctgcagctgggcagactgcagggcaagctgctgcagagctggctgtgcttccccgaccagggctgggaccccaacgccaacctgagaaagctgctgcccggcatcaagtag

SEQ ID NO: 10255 - DNA, 1020 bp, Artificial Sequence
  Description of Artificial Sequence: Synthetic coding sequence
atggagggcgagcccccccccgtggaggagagaagaagactgcaggaggagctgaacgagttcgtggagagcggctgcagaaccctggaggaggtgaccgccagcctgggctgggacctggacagcctggaccccggcgaggaggaggccgccgaggacgaggtggtgatctgcccctacgacagcaaccaccacatgcccaagagcagcctggccaagcacatggccagctgcagactgagaaagatgggctacaccaaggaggaggaggacgagatgtacaaccccgagttcttctacgagaacgtgaagatccccagcatcaccctgaacaaggacagccagttccagatcatcaagcaggccagaaccgccgtgggcaaggacagcgactgctacaaccagagaatctacagcagcctgcccgtggaggtgcccctgaaccacaagagattcgtgtgcgacctgacccaggccgacagactggccctgtacgacttcgtggtggaggagaccaagaagaagagaagcgacagccagatcatcgagaacgacagcgacctgttcgtggacctggccgccaagatcaaccaggacaacagcagaaagagccccaagagctacctggagatcctggccgaggtgagagactacaagagaagaagacagagctacagagccaagaacgtgcacatcaccaagaagagctacaccgaggtgatcagagacgtgatcaacgtgcacatggaggagctgagcaaccactggcaggaggagcaggagaaggccgaggacgacgccgagaagaacgaggagagaagaagcgccagcgtggacagcagacagagcggcggcagctacctggacgccgagtgcagcagacacagaagagacagaagcagaagcccccacaagagaaagagaaacaaggacaaggacaagaactgcgagagcagaagaagaaaggagagagacggcgagagacaccacagccacaagagaagaaagcagaagatctag

SEQ ID NO: 10256 - DNA, 6810 bp, Artificial Sequence
  Description of Artificial Sequence: Synthetic coding sequence
atggccgagcccagcagcgccagaagacccgtgcccctgatcgagagcgagctgtacttcctgatcgccagatacctgagcgccggcccctgcagaagagccgcccaggtgctggtgcaggagctggagcagtaccagctgctgcccaagagactggactgggagggcaacgagcacaacagaagctacgaggagctggtgctgagcaacaagcacgtggcccccgaccacctgctgcagatctgccagagaatcggccccatgctggacaaggagatcccccccagcatcagcagagtgaccagcctgctgggcgccggcagacagagcctgctgagaaccgccaaggactgcagacacaccgtgtggaagggcagcgccttcgccgccctgcacagaggcagaccccccgagatgcccgtgaactacggcagcccccccaacctggtggagatccacagaggcaagcagctgaccggctgcagcaccttcagcaccgccttccccggcaccatgtaccagcacatcaagatgcacagaagaatcctgggccacctgagcgccgtgtactgcgtggccttcgacagaaccggccacagaatcttcaccggcagcgacgactgcctggtgaagatctggagcacccacaacggcagactgctgagcaccctgagaggccacagcgccgagatcagcgacatggccgtgaactacgagaacaccatgatcgccgccggcagctgcgacaagatcatcagagtgtggtgcctgagaacctgcgcccccgtggccgtgctgcagggccacaccggcagcatcaccagcctgcagttcagccccatggccaagggcagccagagatacatggtgagcaccggcgccgacggcaccgtgtgcttctggcagtgggacctggagagcctgaagttcagccccagacccctgaagttcaccgagaagcccagacccggcgtgcagatgctgtgcagcagcttcagcgtgggcggcatgttcctggccaccggcagcaccgaccacgtgatcagaatgtacttcctgggcttcgaggcccccgagaagatcgccgagctggagagccacaccgacaaggtggacagcatccagttctgcaacaacggcgacagattcctgagcggcagcagagacggcaccgccagaatctggagattcgagcagctggagtggagaagcatcctgctggacatggccaccagaatcagcggcgacctgagcagcgaggaggagagattcatgaagcccaaggtgaccatgatcgcctggaaccagaacgacagcatcgtggtgaccgccgtgaacgaccacgtgctgaaggtgtggaacagctacaccggccagctgctgcacaacctgatgggccacgccgacgaggtgttcgtgctggagacccaccccttcgacagcagaatcatgctgagcgccggccacgacggcagcatcttcatctgggacatcaccaagggcaccaagatgaagcactacttcaacatgatcgagggccagggccacggcgccgtgttcgactgcaagttcagccaggacggccagcacttcgcctgcaccgacagccacggccacctgctgatcttcggcttcggctgcagcaagccctacgagaagatccccgaccagatgttcttccacaccgactacagacccctgatcagagacagcaacaactacgtgctggacgagcagacccagcaggccccccacctgatgcccccccccttcctggtggacgtggacggcaacccccaccccaccaagtaccagagactggtgcccggcagagagaacagcgccgacgagcacctgatcccccagctgggctacgtggccaccagcgacggcgaggtgatcgagcagatcatcagcctgcagaccaacgacaacgacgagagaagccccgagagcagcatcctggacggcatgatcagacagctgcagcagcagcaggaccagagaatgggcgccgaccaggacaccatccccagaggcctgagcaacggcgaggagacccccagaagaggcttcagaagactgagcctggacatccagagcccccccaacatcggcctgagaagaagcggccaggtggagggcgtgagacagatgcaccagaacgcccccagaagccagatcgccaccgagagagacctgcaggcctggaagagaagagtggtggtgcccgaggtgcccctgggcatcttcagaaagctggaggacttcagactggagaagggcgaggaggagagaaacctgtacatcatcggcagaaagagaaagaccctgcagctgagccacaagagcgacagcgtggtgctggtgagccagagcagacagagaacctgcagaagaaagtaccccaactacggcagaagaaacagaagctggagagagctgagcagcggcaacgagagcagcagcagcgtgagacacgagaccagctgcgaccagagcgagggcagcggcagcagcgaggaggacgagtggagaagcgacagaaagagcgagagctacagcgagagcagcagcgacagcagcagcagatacagcgactggaccgccgacgccggcatcaacctgcagccccccctgagaaccagctgcagaagaagaatcaccagattctgcagcagcagcgaggacgagatcagcaccgagaacctgagcccccccaagagaagaagaaagagaaagaaggagaacaagcccaagaaggagaacctgagaagaatgacccccgccgagctggccaacatggagcacctgtacgagttccacccccccgtgtggatcaccgacaccaccctgagaaagagccccttcgtgccccagatgggcgacgaggtgatctacttcagacagggccacgaggcctacatcgaggccgtgagaagaaacaacatctacgagctgaaccccaacaaggagccctggagaaagatggacctgagagaccaggagctggtgaagatcgtgggcatcagatacgaggtgggcccccccaccctgtgctgcctgaagctggccttcatcgaccccgccaccggcaagctgatggacaagagcttcagcatcagataccacgacatgcccgacgtgatcgacttcctggtgctgagacagttctacgacgaggccagacagagaaactggcagagctgcgacagattcagaagcatcatcgacgacgcctggtggttcggcaccgtgctgagccaggagccctaccagccccagtaccccgacagccacttccagtgctacatcgtgagatgggacaacaccgagatcgagaagctgagcccctgggacatggagcccatccccgacaacgtggacccccccgaggagctgggcgccagcatcagcgtgaccaccgacgagctggagaagctgctgtacaagccccaggccggcgagtggggccagaagagcagagacgaggagtgcgacagaatcatcagcggcatcgaccagctgctgaacctggacatcgccgccgccttcgccggccccgtggacctgtgcacctaccccaagtactgcaccgtggtggcctaccccaccgacctgtacaccatcagaatgagactggtgaacagattctacagaagactgagcgccctggtgtgggaggtgagatacatcgagcacaacgccagaaccttcaacgagcccgagagcgtgatcgccagaagcgccaagaagatcaccgaccagctgctgaagttcatcaagaaccagcactgcaccaacatcagcgagctgagcaacaccagcgagaacgacgagcagaacgccgaggacctggacgacagcgacctgcccaagaccagcagcggcagaagaagagtgcacgacggcaagaagagcatcagagccaccaactacgtggagagcaactggaagaagcagtgcaaggagctggtgaacctgatcttccagtgcgaggacagcgagcccttcagacagcccgtggacctggtggagtaccccgactacagagacatcatcgacacccccatggacttcggcaccgtgagagagaccctggacgccggcaactacgacagccccctggagttctgcaaggacatcagactgatcttcagcaacgccaaggcctacacccccaacaagagaagcaagatctacagcatgaccctgagactgagcgccctgttcgaggagaagatgaagaagatcagcagcgacttcaagatcggccagaagttcaacgagaagctgagaagaagccagagattcaagcagagacagaactgcaagggcgacagccagcccaacaagagcatcagaaacctgaagcccaagagactgaagagccagaccaagatcatccccgagctggtgggcagccccacccagagcaccagcagcagaaccgcctacctgggcacccacaagaccagcgccggcatcagcagcggcgtgaccagcggcgacagcagcgacagcgccgagagcagcgagagaagaaagagaaacagacccatcaccaacggcagcaccctgagcgagagcgaggtggaggacagcctggccaccagcctgagcagcagcgccagcagcagcagcgaggagagcaaggagagcagcagagccagagagagcagcagcagaagcggcctgagcagaagcagcaacctgagagtgaccagaaccagagccgcccagagaaagaccggccccgtgagcctggccaacggctgcggcagaaaggccaccagaaagagagtgtacctgagcgacagcgacaacaacagcctggagaccggcgagatcctgaaggccagagccggcaacaacagaaaggtgctgagaaagtgcgccgccgtggccgccaacaagatcaagctgatgagcgacgtggaggagaacagcagcagcgagagcgtgtgcagcggcagaaagctgccccacagaaacgccagcgccgtggccagaaagaagctgctgcacaacagcgaggacgagcagagcctgaagagcgagatcgaggaggaggagctgaaggacgagaaccagctgctgcccgtgagcagcagccacaccgcccagagcaacgtggacgagagcgagaacagagacagcgagagcgagagcgacctgagagtggccagaaagaactggcacgccaacggctacaagagccacacccccgcccccagcaagaccaagttcctgaagatcgagagcagcgaggaggacagcaagagccacgacagcgaccacgcctgcaacagaaccgccggccccagcaccagcgtgcagaagctgaaggccgagagcatcagcgaggaggccgacagcgagcccggcagaagcggcggcagaaagtacaacaccttccacaagaacgccagcttcttcaagaagaccaagatcctgagcgacagcgaggacagcgagagcgaggagcaggacagagaggacggcaagtgccacaagatggagatgaaccccatcagcggcaacctgaactgcgaccccatcgccatgagccagtgcagcagcgaccacggctgcgagaccgacctggacagcgacgacgacaagatcgagaagcccaacaacttcatgaaggacagcgccagccaggacaacggcctgagcagaaagatcagcagaaagagagtgtgcagcagcgacagcgacagcagcctgcaggtggtgaagaagagcagcaaggccagaaccggcctgctgagaatcaccagaagatgcgccgccaccgccgccaacaagatcaagctgatgagcgacgtggaggacgtgagcctggagaacgtgcacaccagaagcaagaacggcagaaagaagcccctgcacctggcctgcaccaccgccaagaagaagctgagcgactgcgagggcagcgtgcactgcgaggtgcccagcgagcagtacgcctgcgagggcaagccccccgaccccgacagcgagggcagcaccaaggtgctgagccaggccctgaacggcgacagcgacagcgaggacatgctgaacagcgagcacaagcacagacacaccaacatccacaagatcgacgcccccagcaagagaaagagcagcagcgtgaccagcagcggcgaggacagcaagagccacatccccggcagcgagaccgacagaaccttcagcagcgagagcaccctggcccagaaggccaccgccgagaacaacttcgaggtggagctgaactacggcctgagaagatggaacggcagaagactgagaacctacggcaaggcccccttcagcaagaccaaggtgatccacgacagccaggagaccgccgagaaggaggtgaagagaaagagaagccaccccgagctggagaacgtgaagatcagcgagaccaccggcaacagcaagttcagacccgacaccagcagcaagagcagcgacctgggcagcgtgaccgagagcgacatcgactgcaccgacaacaccaagaccaagagaagaaagaccaagggcaaggccaaggtggtgagaaagggcaagaccttcaccgccaacatcagcaagaccgtgagaagacagagacagagcaagagacccagactgagcgtggacgacaacgactgggaggacctggactacgccaagagcaagagagtgctgagaagaagcaagatcaagaccagaaaccagggcagaagaaccgtgagataccacgacggcgacgacgacagaagcctggagaacgtgctggacttcaacggctgcaccctgtag

SEQ ID NO: 10257 - DNA, 492 bp, Artificial Sequence
  Description of Artificial Sequence: Synthetic coding sequence
atgaccgcccccagctgcgccttccccgtgcagttcagacagcccagcgtgagcggcctgagccagatcaccaagagcctgtacatcagcaacggcgtggccgccaacaacaagctgatgctgagcagcaaccagatcaccatggtgatcaacgtgagcgtggaggtggtgaacaccctgtacgaggacatccagtacatgcaggtgcccgtggccgacagccccaacagcagactgtgcgacttcttcgaccccatcgccgaccacatccacagcgtggagatgaagcagggcagaaccctgctgcactgcgccgccggcgtgagcagaagcgccgccctgtgcctggcctacctgatgaagtaccacgccatgagcctgctggacgcccacacctggaccaagagctgcagacccatcatcagacccaacagcggcttctgggagcagctgatccactacgagttccagctgttcggcaagaacacctag

SEQ ID NO: 10258 - DNA, 756 bp, Artificial Sequence
  Description of Artificial Sequence: Synthetic coding sequence
atgatcagcaccaccagcaaggagaccaagaaggacaccaagctgtactgcatctgcaagaccccctacgacgagagcaagttctacatcggctgcgacctgtgcaccaactggtaccacggcgagtgcgtgggcatcaccgagaaggaggccaagaagatggacgtgtacatctgcaacgactgcaagagagcccaggagggcagcagcgaggagctgtactgcatctgcagaaccccctacgacgagagccagttctacatcggctgcgacagatgccagaactggtaccacggcagatgcgtgggcatcctgcagagcgaggccgagctgatcgacgagtacgtgtgcccccagtgccagagcaccgaggacgccatgaccgtgctgacccccctgaccgagaaggactacgagggcctgaagagagtgctgagaagcctgcaggcccacaagatggcctggcccttcctggagcccgtggaccccaacgacgcccccgactactacggcgtgatcaaggagcccatggacctggccaccatggaggagagagtgcagagaagatactacgagaagctgaccgagttcgtggccgacatgaccaagatcttcgacaactgcagatactacaaccccagcgacagccccttctaccagtgcgccgaggtgctggagagcttcttcgtgcagaagctgaagggcttcaaggccagcagaagccacaacaacaagctgcagagcaccgccagctag

SEQ ID NO: 10259 - DNA, 501 bp, Artificial Sequence
  Description of Artificial Sequence: Synthetic coding sequence
atgtacagcctgaaccaggagatcaaggccttcagcagaaacaacctgagaaagcagtgcaccagagtgaccaccctgaccggcaagaagatcatcgagacctggaaggacgccagaatccacgtggtggaggaggtggagcccagcagcggcggcggctgcggctacgtgcaggacctgagcagcgacctgcaggtgggcgtgatcaagccctggctgctgctgggcagccaggacgccgcccacgacctggacaccctgaagaagaacaaggacggcgtggtgctggtgcactgcaacgccggcgtgagcagagccgccgccatcgtgatcggcttcctgatgaacagcgagcagaccagcttcaccagcgccttcagcctggtgaagaacgccagacccagcatctgccccaacagcggcttcatggagcagctgagaacctaccaggagggcaaggagagcaacaagtgcgacagaatccaggagaacagcagctag

SEQ ID NO: 10260 - DNA, 963 bp, Artificial Sequence
  Description of Artificial Sequence: Synthetic coding sequence
atgagcaagagcgccagccccaaggagcccgagcagctgagaaagctgttcatcggcggcctgagcttcgagaccaccgacgagagcctgagaagccacttcgagcagtggggcaccctgaccgactgcgtggtgatgagagaccccaacaccaagagaagcagaggcttcggcttcgtgacctacgccaccgtggaggaggtggacgccgccatgaacaccaccccccacaaggtggacggcagagtggtggagcccaagagagccgtgagcagagaggacagccagagacccggcgcccacctgaccgtgaagaagatcttcgtgggcggcatcaaggaggacaccgaggagcaccacctgagagactacttcgagcagtacggcaagatcgaggtgatcgagatcatgaccgacagaggcagcggcaagaagagaggcttcgccttcgtgaccttcgacgaccacgacagcgtggacaagatcgtgatccagaagtaccacaccgtgaagggccacaactgcgaggtgagaaaggccctgcccaagcaggagatggccagcgccagcagcagccagagaggcagaagaggcagcggcaacttcggcggcggcagaggcgacggcttcggcggcaacgacaacttcggcagaggcggcaacttcagcggcagaggcggcttcggcggcagctgcggcggcggcggctacggcggcagcggcgacggctacaacggcttcggcaacgacggcagcaacttcggcggcggcggcagctacaacgacttcggcaactacaacaaccagagcagcaacttcggccccatgaagggcggcaacttcggcggcagaagcagcggcccctacggcggcggcggccagtacttcgccaagccccagaaccagggcggctacggcgtgagcagcagcagcagcagctacggcagcggcagaagattctag

SEQ ID NO: 10261 - DNA, 357 bp, Artificial Sequence
  Description of Artificial Sequence: Synthetic coding sequence
atgagcctgctgaacaagcccaagagcgagatgacccccgaggagctgcagaagagagaggaggaggagttcaacaccggccccctgagcgtgctgacccagagcgtgaagaacaacacccaggtgctgatcaactgcagaaacaacaagaagctgctgggcagagtgaaggccttcgacagacactgcaacatggtgctggagaacgtgaaggagatgtggaccgaggtgcccaagagcggcaagggcaagaagaagagcaagcccgtgaacaaggacagatacatcagcaagatgttcctgagaggcgacagcgtgatcgtggtgctgagaaaccccctgatcgccggcaagtag

SEQ ID NO: 10262 - DNA, 1179 bp, Artificial Sequence
  Description of Artificial Sequence: Synthetic coding sequence
atgaaggacaccctgggccaggcccagcagagagtggccgagctggagcccctgaaggagcagctgagaggcgcccaggagctggccgccagcagccagcagaaggccaccctgctgggcgaggagctggccagcgccgccgccgccagagacagaaccatcgccgagctgcacagaagcagactggaggtggccgaggtgaacggcagactggccgagctgggcctgcacctgaaggaggagaagtgccagtggagcaaggagagagccggcctgctgcagagcgtggaggccgagaaggacaagatcctgaagctgagcgccgagatcctgagactggagaaggccgtgcaggaggagagaacccagaaccaggtgttcaagaccgagctggccagagagaaggacagcagcctggtgcagctgagcgagagcaagagagagctgaccgagctgagaagcgccctgagagtgctgcagaaggagaaggagcagctgcaggaggagaagcaggagctgctggagtacatgagaaagctggaggccagactggagaaggtggccgacgagaagtggaacgaggacgccaccaccgaggacgaggaggccgccgtgggcctgagctgccccgccgccctgaccgacagcgaggacgagagccccgaggacatgagactgcccccctacggcctgtgcgagagaggcgaccccggcagcagccccgccggccccagagaggccagccccctggtggtgatcagccagcccgcccccatcagcccccacctgagcggccccgccgaggacagcagcagcgacagcgaggccgaggacgagaagagcgtgctgatggccgccgtgcagagcggcggcgaggaggccaacctgctgctgcccgagctgggcagcgccttctacgacatggccagcaccatcttctgcagagcccagatcgccctgctgcccctgagccccgccagcacccccagccccaccaccagcggcttcaccgtgggcaccctgagcgagaccagcaccggcggccccgccacccccacctggaaggagtgccccatctgcaaggagagattccccgccgagagcgacaaggacgccctggaggaccacatggacggccacttcttcttcagcacccaggaccccttcaccttcgagtag

SEQ ID NO: 10263 - DNA, 600 bp, Artificial Sequence
  Description of Artificial Sequence: Synthetic coding sequence
atgacccccctggccccctgggaccccaagtacgaggccaaggccggccccagacccgtgtggggcgccaactgcagcagcggcgccagcttcagcggcagaaccctgtgccaccccagcttctggcccctgtacgaggccgccagcggcagaggcctgagacccgtggcccccgccaccggccactggaacggccagcaggccccccccgacgccggcttccccgtggtgtgctgcgaggacgtgttcctgagcgaccccctgctgcccagaggccagagagtgcccctgtacctgagcaaggccccccagcagatgatgggcagcctgaagctgctgccccccccccccatcatgagcgccagagtgctgcccagacccagccccagcagaggccccagcaccgcctggctgagcggccccgagctgatcgccctgaccggcctgctgcagatgagccagggcgagcccagacccagcagcagcgccgtgggcccccccgaccacaccagcgacccccccagcccctgcggcagccccagcagcagccagggcgccgacctgagcctgccccagacccccgacacccactgcccctag

SEQ ID NO: 10264 - DNA, 1155 bp, Artificial Sequence
  Description of Artificial Sequence: Synthetic coding sequence
atggagggcctgggcagaagctgcctgtggctgagaagagagctgagcccccccagacccagactgctgctgctggactgcagaagcagagagctgtacgagagcgccagaatcggcggcgccctgagcgtggccctgcccgccctgctgctgagaagactgagaagaggcagcctgagcgtgagagccctgctgcccggcccccccctgcagccccccccccccgcccccgtgctgctgtacgaccagggcggcggcagaagaagaagaggcgaggccgaggccgaggccgaggagtgggaggccgagagcgtgctgggcaccctgctgcagaagctgagagaggagggctacctggcctactacctgcagggcggcttcagcagattccaggccgagtgcccccacctgtgcgagaccagcctggccggcagagccggcagcagcatggcccccgtgcccggccccgtgcccgtggtgggcctgggcagcctgtgcctgggcagcgactgcagcgacgccgagagcgaggccgacagagacagcatgagctgcggcctggacagcgagggcgccacccccccccccgtgggcctgagagccagcttccccgtgcagatcctgcccaacctgtacctgggcagcgccagagacagcgccaacctggagagcctggccaagctgggcatcagatacatcctgaacgtgacccccaacctgcccaacttcttcgagaagaacggcgacttccactacaagcagatccccatcagcgaccactggagccagaacctgagcagattcttccccgaggccatcgagttcatcgacgaggccctgagccagaactgcggcgtgctggtgcactgcctggccggcgtgagcagaagcgtgaccgtgaccgtggcctacctgatgcagaagctgcacctgagcctgaacgacgcctacgacctggtgaagagaaagaagagcaacatcagccccaacttcaacttcatgggccagctgctggacttcgagagaagcctgagactggaggagagacacagccaggagcagggcagcggcggccaggccagcgccgccagcaacccccccagcttcttcaccacccccaccagcgacggcgccttcgagctggcccccacctag

SEQ ID NO: 10265 - DNA, 2208 bp, Artificial Sequence
  Description of Artificial Sequence: Synthetic coding sequence
atggccgagcccctgctgagaaagaccttcagcagactgagaggcagagagaagctgcccagaaagaagagcgacgccaaggagagaggccaccccgcccagagacccgagcccagcccccccgagcccgagccccaggcccccgagggcagccaggccggcgccgagggccccagcagccccgaggccagcagaagccccgccagaggcgcctacctgcagagcctggagcccagcagcagaagatgggtgctgggcggcgccaagcccgccgaggacaccagcctgggccccggcgtgcccggcaccggcgagcccgccggcgagatctggtacaaccccatccccgaggaggaccccagaccccccgcccccgagccccccggcccccagcccggcagcgccgagagcgagggcctggccccccagggcgccgcccccgccagcccccccaccaaggccagcagaaccaagagccccggccccgccagaagactgagcatcaagatgaagaagctgcccgagctgagaagaagactgagcctgagaggccccagagccggcagagagagagagagagccgcccccgccggcagcgtgatcagcagataccacctggacagcagcgtgggcggccccggccccgccgccggccccggcggcaccagaagccccagagccggctacctgagcgacggcgacagccccgagagacccgccggcccccccagccccaccagcttcagaccctacgaggtgggccccgccgccagagccccccccgccgccctgtggggcagactgagcctgcacctgtacggcctgggcggcctgagacccgcccccggcgccacccccagagacctgtgctgcctgctgcaggtggacggcgaggccagagccagaaccggccccctgagaggcggccccgacttcctgagactggaccacaccttccacctggagctggaggccgccagactgctgagagccctggtgctggcctgggaccccggcgtgagaagacacagaccctgcgcccagggcaccgtgctgctgcccaccgtgttcagaggctgccaggcccagcagctggccgtgagactggagccccagggcctgctgtacgccaagctgaccctgagcgagcagcaggaggcccccgccaccgccgagcccagagtgttcggcctgcccctgcccctgctggtggagagagagagaccccccggccaggtgcccctgatcatccagaagtgcgtgggccagatcgagagaagaggcctgagagtggtgggcctgtacagactgtgcggcagcgccgccgtgaagaaggagctgagagacgccttcgagagagacagcgccgccgtgtgcctgagcgaggacctgtaccccgacatcaacgtgatcaccggcatcctgaaggactacctgagagagctgcccacccccctgatcacccagcccctgtacaaggtggtgctggaggccatggccagagacccccccaacagagtgccccccaccaccgagggcaccagaggcctgctgagctgcctgcccgacgtggagagagccaccctgaccctgctgctggaccacctgagactggtgagcagcttccacgcctacaacagaatgaccccccagaacctggccgtgtgcttcggccccgtgctgctgcccgccagacaggcccccaccagacccagagccagaagcagcggccccggcctggccagcgccgtggacttcaagcaccacatcgaggtgctgcactacctgctgcagagctggcccgaccccagactgcccagacagagccccgacgtggccccctacctgagacccaagagacagccccccctgcacctgcccctggccgaccccgaggtggtgaccagacccagaggcagaggcggccccgagagcccccccagcaacagatacgccggcgactggagcgtgtgcggcagagacttcctgccctgcggcagagacttcctgagcggccccgactacgaccacgtgaccggcagcgacagcgaggacgaggacgaggaggtgggcgagcccagagtgaccggcgacttcgaggacgacttcgacgcccccttcaacccccacctgaacctgaaggacttcgacgccctgatcctggacctggagagagagctgagcaagcagatcaacgtgtgcctgtag

SEQ ID NO: 10266 - DNA, 660 bp, Artificial Sequence
  Description of Artificial Sequence: Synthetic coding sequence
atgcccagaggcagaaagagcagaagaagaagaaacgccagagccgccgaggagaacagaaacaacagaaagatccaggccagcgaggccagcgagacccccatggccgccagcgtggtggccagcacccccgaggacgacctgagcggccccgaggaggaccccagcacccccgaggaggccagcaccacccccgaggaggccagcagcaccgcccaggcccagaagcccagcgtgcccagaagcaacttccagggcaccaagaagagcctgctgatgagcatcctggccctgatcttcatcatgggcaacagcgccaaggaggccctggtgtggaaggtgctgggcaagctgggcatgcagcccggcagacagcacagcatcttcggcgaccccaagaagatcgtgaccgaggagttcgtgagaagaggctacctgatctacaagcccgtgcccagaagcagccccgtggagtacgagttcttctggggccccagagcccacgtggagagcagcaagctgaaggtgatgcacttcgtggccagagtgagaaacagatgcagcaaggactggccctgcaactacgactgggacagcgacgacgacgccgaggtggaggccatcctgaacagcggcgccagaggctacagcgccccctag

SEQ ID NO: 10267 - DNA, 702 bp, Artificial Sequence
  Description of Artificial Sequence: Synthetic coding sequence
atgaacctgaacttcaccagccccctgcaccccgccagcagccagagacccaccagcttcttcatcgaggacatcctgctgcacaagcccaagcccctgagagaggtggcccccgaccacttcgccagcagcctggccagcagagtgcccctgctggactacggctaccccctgatgcccacccccaccctgctggccccccacgcccaccaccccctgcacaagggcgaccaccaccacccctacttcctgaccaccagcggcatgcccgtgcccgccctgttcccccacccccagcacgccgagctgcccggcaagcactgcagaagaagaaaggccagaaccgtgttcagcgacagccagctgagcggcctggagaagagattcgagatccagagatacctgagcacccccgagagagtggagctggccaccgccctgagcctgagcgagacccaggtgaagacctggttccagaacagaagaatgaagcacaagaagcagctgagaaagagccaggacgagcccaaggcccccgacggccccgagagccccgagggcagccccagaggcagcgaggccgccaccgccgccgaggccagactgagcctgcccgccggccccttcgtgctgaccgagcccgaggacgaggtggacatcggcgacgagggcgagctgggcagcggcccccacgtgctgtag

SEQ ID NO: 10268 - DNA, 873 bp, Artificial Sequence
  Description of Artificial Sequence: Synthetic coding sequence
atggagctgcccgccgtgggcgagcacgtgttcgccgtggagagcatcgagaagaagagaatcagaaagggcagagtggagtacctggtgaagtggagaggctggagccccaagtacaacacctgggagcccgaggagaacatcctggaccccagactgctgatcgccttccagaacagagagagacaggagcagctgatgggctacagaaagagaggccccaagcccaagcccctggtggtgcaggtgcccaccttcgccagaagaagcaacgtgctgaccggcctgcaggacagcagcaccgacaacagagccaagctggacctgggcgcccagggcaagggccagggccaccagtacgagctgaacagcaagaagcaccaccaccacgccgtgggcctgaacctgagccacgtgagaaagagatgcctgagcgagacccacggcgagagagagccctgcaagaagagactgaccgccagaagcatcagcacccccacctgcctgggcggcagccccgccgccgagagacccgccgacctgccccccgccgccgccctgccccagcccgaggtgatcctgctggacagcgacctggacgagcccatcgacctgagatgcgtgaagaccagaagcgaggccggcgagccccccagcagcctgcaggtgaagcccgagacccccgccagcgccgccgtggccgtggccgccgccgccgcccccaccaccaccgccgagaagccccccgccgaggcccaggacgagcccgccgagagcctgagcgagttcaagcccttcttcggcaacatcatcatcaccgacgtgaccgccaactgcctgaccgtgaccttcaaggagtacgtgaccgtgtag

SEQ ID NO: 10269 - DNA, 744 bp, Artificial Sequence
  Description of Artificial Sequence: Synthetic coding sequence
atgaccgaggacagccagagaaacttcagaagcgtgtactacgagaaggtgggcttcagaggcgtggaggagaagaagagcctggagatcctgctgaaggacgacagactggacaccgagaagctgtgcaccttcagccagagattccccctgcccagcatgtacagagccctggtgtggaaggtgctgctgggcatcctgcccccccaccacgagagccacgccaaggtgatgatgtacagaaaggagcagtacctggacgtgctgcacgccctgaaggtggtgagattcgtgagcgacgccaccccccaggccgaggtgtacctgagaatgtaccagctggagagcggcaagctgcccagaagccccagcttccccctgcccaaggccttcgagcagtacctgaacctggaggacggcagactgctgacccacctgagaatgtgcagcgccgcccccaagctgccctacgacctgtggttcaagagatgcttcgccggctgcctgcccgagagcagcctgcagagagtgtgggacaaggtggtgagcggcagctgcaagatcctggtgttcgtggccgtggagatcctgctgaccttcaagatcaaggtgatggccctgaacagcgccgagaagatcaccaagttcctggagaacatcccccaggacagcagcgacgccatcgtgagcaaggccatcgacctgtggcacaagcactgcggcacccccgtgcacagcagctag

SEQ ID NO: 10270 - DNA, 546 bp, Artificial Sequence
  Description of Artificial Sequence: Synthetic coding sequence
atggtgagcagctgctgcggcagcgtgagcagcgagcagagctgcggcctggagaactgctgcagacccagctgctgccagaccacctgctgcagaaccacctgctgcagacccagctgctgcaagccccagtgctgccagagcgtgtgctaccagcccacctgctgccaccccagctgctgcatcagcagctgctgcagaccctactgctgcgagagcagctgctgcagaccctgctgctgccagaccacctgctgcagaaccacctgctgcagaaccacctgctgctgccccagctgctgcgtgagcagctgctgcagaccccagtgctgccagagcgtgtgctgccagcccacctgctgcagacccagctgctgcatcagcagctgctgccaccccagctgctgcgagagcagctgctgcagaccctgctgctgcgtgagacccgtgtgcggcagagtgagctgccacaccacctgctacagacccacctgcgtgatcagcacctgccccagacccctgtgctgcgccagcagctgctgctag

SEQ ID NO: 10271 - DNA, 1086 bp, Artificial Sequence
  Description of Artificial Sequence: Synthetic coding sequence
atggccctgaacgtggcccccgtgagagacaccaagtggctgaccctggaggtgtgcagacagttccagagaggcacctgcagcagaagcgacgaggagtgcaagttcgcccacccccccaagagctgccaggtggagaacggcagagtgatcgcctgcttcgacagcctgaagggcagatgcagcagagagaactgcaagtacctgcacccccccacccacctgaagacccagctggagatcaacggcagaaacaacctgatccagcagaagaccgccgccgccatgctggcccagcagatgcagttcatgttccccggcacccccctgcaccccgtgcccaccttccccgtgggccccgccatcggcaccaacaccgccatcagcttcgccccctacctggcccccgtgacccccggcgtgggcctggtgcccaccgagatcctgcccaccacccccgtgatcgtgcccggcagcccccccgtgaccgtgcccggcagcaccgccacccagaagctgctgagaaccgacaagctggaggtgtgcagagagttccagagaggcaactgcgccagaggcgagaccgactgcagattcgcccaccccgccgacagcaccatgatcgacaccagcgacaacaccgtgaccgtgtgcatggactacatcaagggcagatgcatgagagagaagtgcaagtacttccacccccccgcccacctgcaggccaagatcaaggccgcccagcaccaggccaaccaggccgccgtggccgcccaggccgccgccgccgccgccaccgtgatggccttcccccccggcgccctgcaccccctgcccaagagacaggccctggagaagagcaacggcaccagcgccgtgttcaaccccagcgtgctgcactaccagcaggccctgaccagcgcccagctgcagcagcacgccgccttcatccccaccgacaacagcgagatcatcagcagaaacggcatggagtgccaggagagcgccctgagaatcaccaagcactgctactgcacctactaccccgtgagcagcagcatcgagctgccccagaccgcctgctag

SEQ ID NO: 10272 - DNA, 1017 bp, Artificial Sequence
  Description of Artificial Sequence: Synthetic coding sequence
atgctgaagaacaagggccacagcagcaagaaggacaacctggccgtgaacgccgtggccctgcaggaccacatcctgcacgacctgcagctgagaaacctgagcgtggccgaccacagcaagacccaggtgcagaagaaggagaacaagagcctgaagagagacaccaaggccatcatcgacaccggcctgaagaagaccacccagtgccccaagctggaggacagcgagaaggagtacgtgctggaccccaagcccccccccctgaccctggcccagaagctgggcctgatcggccccccccccccccccctgagcagcgacgagtgggagaaggtgaagcagagaagcctgctgcagggcgacagcgtgcagccctgccccatctgcaaggaggagttcgagctgagaccccaggtgttcagcatcagaggcaagaaccagtaccagaccagagtgatccacgacggcgccagactgttcagaatcaagtgcgtgaccagaatccaggcctactggagaggctgcgtggtgagaaagtggtacagaaacctgagaaagaccgtgccccccaccgacgccaagctgagaaagaagttcttcgagaagaagttcaccgagatcagccacagaatcctgtgcagctacaacaccaacatcgaggagctgttcgccgagatcgaccagtgcctggccatcaacagaagcgtgctgcagcagctggaggagaagtgcggccacgagatcaccgaggaggagtgggagaagatccaggtgcaggccctgagaagagagacccacgagtgcagcatctgcctggcccccctgagcgccgccggcggccagagagtgggcgccggcagaagaagcagagagatggccctgctgagctgcagccacgtgttccaccacgcctgcctgctggccctggaggagttcagcgtgggcgacagaccccccttccacgcctgccccctgtgcagaagctgctaccagaagaagatcctggagtgctag

SEQ ID NO: 10273 - DNA, 1098 bp, Artificial Sequence
  Description of Artificial Sequence: Synthetic coding sequence
atggccgccgccgccgccggcaccgccaccagccagagattcttccagagcttcagcgacgccctgatcgacgaggacccccaggccgccctggaggagctgaccaaggccctggagcagaagcccgacgacgcccagtactactgccagagagcctactgccacatcctgctgggcaactactgcgtggccgtggccgacgccaagaagagcctggagctgaaccccaacaacagcaccgccatgctgagaaagggcatctgcgagtaccacgagaagaactacgccgccgccctggagaccttcaccgagggccagaagctggacatcgagaccggcttccacagagtgggccaggccggcctgcagctgctgaccagcagcgacccccccgccctggacagccagagcgccggcatcaccggcgccgacgccaacttcagcgtgtggatcaagagatgccaggaggcccagaacggcagcgagagcgaggtgtggacccaccagagcaagatcaagtacgactggtaccagaccgagagccaggtggtgatcaccctgatgatcaagaacgtgcagaagaacgacgtgaacgtggagttcagcgagaaggagctgagcgccctggtgaagctgcccagcggcgaggactacaacctgaagctggagctgctgcaccccatcatccccgagcagagcaccttcaaggtgctgagcaccaagatcgagatcaagctgaagaagcccgaggccgtgagatgggagaagctggagggccagggcgacgtgcccacccccaagcagttcgtggccgacgtgaagaacctgtaccccagcagcagcccctacaccagaaactgggacaagctggtgggcgagatcaaggaggaggagaagaacgagaagctggagggcgacgccgccctgaacagactgttccagcagatctacagcgacggcagcgacgaggtgaagagagccatgaacaagagcttcatggagagcggcggcaccgtgctgagcaccaactggagcgacgtgggcaagagaaaggtggagatcaacccccccgacgacatggagtggaagaagtactag

SEQ ID NO: 10274 - DNA, 1389 bp, Artificial Sequence
  Description of Artificial Sequence: Synthetic coding sequence
atggacaaggacagccagggcctgctggacagcagcctgatggccagcggcaccgccagcagaagcgaggacgaggagagcctggccggccagaagagagccagcagccaggccctgggcaccatccccaagagaagaagcagcagcagattcatcaagagaaagaagttcgacgacgagctggtggagagcagcctggccaagagcagcaccagagccaagggcgccagcggcgtggagcccggcagatgcagcggcagcgagcccagcagcagcgagaagaagaaggtgagcaaggcccccagcacccccgtgccccccagccccgcccccgcccccggcctgaccaagagagtgaagaagagcaagcagcccctgcaggtgaccaaggacctgggcagatggaagcccgccgacgacctgctgctgatcaacgccgtgctgcagaccaacgacctgaccagcgtgcacctgggcgtgaagttcagctgcagattcaccctgagagaggtgcaggagagatggtacgccctgctgtacgaccccgtgatcagcaagctggcctgccaggccatgagacagctgcaccccgaggccatcgccgccatccagagcaaggccctgttcagcaaggccgaggagcagctgctgagcaaggtgggcagcaccagccagcccaccctggagaccttccaggacctgctgcacagacaccccgacgccttctacctggccagaaccgccaaggccctgcaggcccactggcagctgatgaagcagtactacctgctggaggaccagaccgtgcagcccctgcccaagggcgaccaggtgctgaacttcagcgacgccgaggacctgatcgacgacagcaagctgaaggacatgagagacgaggtgctggagcacgagctgatggtggccgacagaagacagaagagagagatcagacagctggagcaggagctgcacaagtggcaggtgctggtggacagcatcaccggcatgagcagccccgacttcgacaaccagaccctggccgtgctgagaggcagaatggtgagatacctgatgagaagcagagagatcaccctgggcagagccaccaaggacaaccagatcgacgtggacctgagcctggagggccccgcctggaagatcagcagaaagcagggcgtgatcaagctgaagaacaacggcgacttcttcatcgccaacgagggcagaagacccatctacatcgacggcagacccgtgctgtgcggcagcaagtggagactgagcaacaacagcgtggtggagatcgccagcctgagattcgtgttcctgatcaaccaggacctgatcgccctgatcagagccgaggccgccaagatcaccccccagtag

SEQ ID NO: 10275 - DNA, 963 bp, Artificial Sequence
  Description of Artificial Sequence: Synthetic coding sequence
atgagcgtgggcttcatcggcgccggccagctggcctacgccctggccagaggcttcaccgccgccggcatcctgagcgcccacaagatcatcgccagcagccccgagatgaacctgcccaccgtgagcgccctgagaaagatgggcgtgaacctgaccagaagcaacaaggagaccgtgaagcacagcgacgtgctgttcctggccgtgaagccccacatcatccccttcatcctggacgagatcggcgccgacgtgcaggccagacacatcgtggtgagctgcgccgccggcgtgaccatcagcagcgtggagaagaagctgatggccttccagcccgcccccaaggtgatcagatgcatgaccaacacccccgtggtggtgcaggagggcgccaccgtgtacgccaccggcacccacgccctggtggaggacggccagctgctggagcagctgatgagcagcgtgggcttctgcaccgaggtggaggaggacctgatcgacgccgtgaccggcctgagcggcagcggccccgcctacgccttcatggccctggacgccctggccgacggcggcgtgaagatgggcctgcccagaagactggccatccagctgggcgcccaggccctgctgggcgccgccaagatgctgctggacagcgagcagcacccctgccagctgaaggacaacgtgtgcagccccggcggcgccaccatccacgccctgcacttcctggagagcggcggcttcagaagcctgctgatcaacgccgtggaggccagctgcatcagaaccagagagctgcagagcatggccgaccaggagaagatcagccccgccgccctgaagaagaccctgctggacagagtgaagctggagagccccaccgtgagcaccctgacccccagcagccccggcaagctgctgaccagaagcctggccctgggcggcaagaaggactag

SEQ ID NO: 10276 - DNA, 2370 bp, Artificial Sequence
  Description of Artificial Sequence: Synthetic coding sequence
atggaggacggccccagcaacaacgccagctgcttcagaagactgaccgagtgcttcctgagccccagcctgaccgacgagaaggtgaaggcctacctgagcctgcacccccaggtgctggacgagttcgtgagcgagagcgtgagcgccgagaccgtggagaagtggctgaagagaaagaacaacaagagcgaggacgagagcgcccccaaggaggtgagcagataccaggacaccaacatgcagggcgtggtgtacgagctgaacagctacatcgagcagagactggacaccggcggcgacaaccagctgctgctgtacgagctgagcagcatcatcaagatcgccaccaaggccgacggcttcgccctgtacttcctgggcgagtgcaacaacagcctgtgcatcttcaccccccccggcatcaaggagggcaagcccagactgatccccgccggccccatcacccagggcaccaccgtgagcgcctacgtggccaagagcagaaagaccctgctggtggaggacatcctgggcgacgagagattccccagaggcaccggcctggagagcggcaccagaatccagagcgtgctgtgcctgcccatcgtgaccgccatcggcgacctgatcggcatcctggagctgtacagacactggggcaaggaggccttctgcctgagccaccaggaggtggccaccgccaacctggcctgggccagcgtggccatccaccaggtgcaggtgtgcagaggcctggccaagcagaccgagctgaacgacttcctgctggacgtgagcaagacctacttcgacaacatcgtggccatcgacagcctgctggagcacatcatgatctacgccaagaacctggtgaacgccgacagatgcgccctgttccaggtggaccacaagaacaaggagctgtacagcgacctgttcgacatcggcgaggagaaggagggcaagcccgtgttcaagaagaccaaggagatcagattcagcatcgagaagggcatcgccggccaggtggccagaaccggcgaggtgctgaacatccccgacgcctacgccgaccccagattcaacagagaggtggacctgtacaccggctacaccaccagaaacatcctgtgcatgcccatcgtgagcagaggcagcgtgatcggcgtggtgcagatggtgaacaagatcagcggcagcgccttcagcaagaccgacgagaacaacttcaagatgttcgccgtgttctgcgccctggccctgcactgcgccaacatgtaccacagaatcagacacagcgagtgcatctacagagtgaccatggagaagctgagctaccacagcatctgcaccagcgaggagtggcagggcctgatgcagttcaccctgcccgtgagactgtgcaaggagatcgagctgttccacttcgacatcggccccttcgagaacatgtggcccggcatcttcgtgtacatggtgcacagaagctgcggcaccagctgcttcgagctggagaagctgtgcagattcatcatgagcgtgaagaagaactacagaagagtgccctaccacaactggaagcacgccgtgaccgtggcccactgcatgtacgccatcctgcagaacaaccacaccctgttcaccgacctggagagaaagggcctgctgatcgcctgcctgtgccacgacctggaccacagaggcttcagcaacagctacctgcagaagttcgaccaccccctggccgccctgtacagcaccagcaccatggagcagcaccacttcagccagaccgtgagcatcctgcagctggagggccacaacatcttcagcaccctgagcagcagcgagtacgagcaggtgctggagatcatcagaaaggccatcatcgccaccgacctggccctgtacttcggcaacagaaagcagctggaggagatgtaccagaccggcagcctgaacctgaacaaccagagccacagagacagagtgatcggcctgatgatgaccgcctgcgacctgtgcagcgtgaccaagctgtggcccgtgaccaagctgaccgccaacgacatctacgccgagttctgggccgagggcgacgagatgaagaagctgggcatccagcccatccccatgatggacagagacaagaaggacgaggtgccccagggccagctgggcttctacaacgccgtggccatcccctgctacaccaccctgacccagatcctgccccccaccgagcccctgctgaaggcctgcagagacaacctgagccagtgggagaaggtgatcagaggcgaggagaccgccacctggatcagcagccccagcgtggcccagaaggccgccgccagcgaggactag

SEQ ID NO: 10277 - DNA, 645 bp, Artificial Sequence
  Description of Artificial Sequence: Synthetic coding sequence
atggacgacagcgagaccggcttcaacctgaaggtggtgctggtgagcttcaagcagtgcctggacgagaaggaggaggtgctgctggacccctacatcgccagctggaagggcctggtgagattcctgaacagcctgggcaccatcttcagcttcatcagcaaggacgtggtgagcaagctgagaatcatggagagactgagaggcggcccccagagcgagcactacagaagcctgcaggccatggtggcccacgagctgagcaacagactggtggacctggagagaagaagccaccaccccgagagcggctgcagaaccgtgctgagactgcacagagccctgcactggctgcagctgttcctggagggcctgagaaccagccccgaggacgccagaaccagcgccctgtgcgccgacagctacaacgccagcctggccgcctaccacccctgggtggtgagaagagccgtgaccgtggccttctgcaccctgcccaccagagaggtgttcctggaggccatgaacgtgggcccccccgagcaggccgtgcagatgctgggcgaggccctgcccttcatccagagagtgtacaacgtgagccagaagctgtacgccgagcacagcctgctggacctgccctag

SEQ ID NO: 10278 - DNA, 4293 bp, Artificial Sequence
  Description of Artificial Sequence: Synthetic coding sequence
atgaccagcgccgccgagatcaagaagccccccgtggcccccaagcccaagttcgtggtggccaacaacaagcccgcccccccccccatcgcccccaagcccgacatcgtgatcagcagcgtgccccagagcaccaagaagatgaagcccgccatcgcccccaagcccaaggtgctgaagaccagccccgtgagagagatcggccagagccccagcagaaagatcatgctgaacctggagggccacaagcaggagctggccgagagcaccgacaacttcaactgcaagtacgagggcaaccagagcaacgactacatcagccccatgtgcagctgcagcagcgagtgcatccacaagctgggccacagagagaacctgtgcgtgaagcagctggtgctggagcccctggagatgaacgagaacctggagaacagcaagatcgacgagaccctgaccatcaagaccagaagcaagtgcgacctgtacggcgagaaggccaagaaccagggcggcgtggtgctgaaggccagcgtgctggaggaggagctgaaggacgccctgatccaccagatgccccccttcatcagcgcccagaagcacagacccaccgacagccccgagatgaacggcggctgcaacagcaacggccagttcagaatcgagttcgccgacctgagccccagccccagcagcttcgagaaggtgcccgaccaccacagctgccacctgcagctgcccagcgacgagtgcgagcacttcgagacctgccaggacgacagcgagaagagcaacaactgcttccagagcagcgagctggaggccctggagaacggcaagagaagcaccctgatcagcagcgacggcgtgagcaagaagagcgaggtgaaggacctgggccccctggagatccacctggtgccctacacccccaagttccccacccccaagcccagaaagaccagaaccgccagactgctgagacagaagtgcgtggacacccccagcgagagcaccgaggagcccggcaacagcgacagcagcagcagctgcctgaccgagaacagcctgaagatcaacaagatcagcgtgctgcaccagaacgtgctgtgcaagcaggagcaggtggacaagatgaagctgggcaacaagagcgagctgaacatggagagcaacagcgacgcccaggacctggtgaacagccagaaggccatgtgcaacgagaccaccagcttcgagaagatggcccccagcttcgacaaggacagcaacctgagcagcgacagcaccaccgtggacggcagcagcatgagcctggccgtggacgagggcaccggcttcatcagatgcaccgtgagcatgagcctgcccaagcagctgaagctgacctgcaacgagcacctgcagagcggcagaaacctgggcgtgagcgccccccagatgcagaaggagagcgtgatcaaggaggagaacagcctgagaatcgtgcccaagaagccccagagacacagcctgcccgccaccggcgtgctgaagaaggccgccagcgaggagctgctggagaagagcagctaccccagcagcgaggagaagagcagcgagaagagcctggagagaaaccacctgcagcacctgtgcgcccagaacagaggcgtgagcagcagcttcgacatgcccaagagagccagcgagaagcccgtgtggaagctgccccaccccatcctgcccttcagcggcaaccccgagttcctgaagagcgtgaccgtgagcagcaacagcgagcccagcaccgccctgaccaagcccagagccaagagcctgagcgccatggacgtggagaagtgcaccaagccctgcaaggacagcaccaagaagaacagcttcaagaagctgctgagcatgaagctgagcatctgcttcatgaagagcgacttccagaagttctggagcaagagcagccagctgggcgacaccaccaccggccacctgagcagcggcgagcagaagggcatcgagagcgactggcagggcctgctggtgggcgaggagaagagaagcaagcccatcaaggcctacagcaccgagaactacagcctggagagccagaagaagagaaagaagagcagaggccagaccagcgccgccaacggcctgagagccgagagcctggacgaccagatgctgagcagagagagcagcagccaggccccctacaagagcgtgaccagcctgtgcgcccccgagtacgagaacatcagacactacgaggagatccccgagtacgagaacctgcccttcatcatggccatcagaaagacccaggagctggagtggcagaacagcagcagcatggaggacgccgacgccaacgtgtacgaggtggaggagccctacgaggcccccgacggccagctgcagctgggccccagacaccagcacagcagcagcggcgccagccaggaggagcagaacgacctgggcctgggcgacctgcccagcgacgaggaggagatcatcaacagcagcgacgaggacgacgtgagcagcgagagcagcaagggcgagcccgaccccctggaggacaagcaggacgaggacaacggcatgaagagcaaggtgcaccacatcgccaaggagatcatgagcagcgagaaggtgttcgtggacgtgctgaagctgctgcacatcgacttcagagacgccgtggcccacgccagcagacagctgggcaagcccgtgatcgaggacagaatcctgaaccagatcctgtactacctgccccagctgtacgagctgaacagagacctgctgaaggagctggaggagagaatgctgcactggaccgagcagcagagaatcgccgacatcttcgtgaagaagggcccctacctgaagatgtacagcacctacatcaaggagttcgacaagaacatcgccctgctggacgagcagtgcaagaagaaccccggcttcgccgccgtggtgagagagttcgagatgagccccagatgcgccaacctggccctgaagcactacctgctgaagcccgtgcagagaatcccccagtacagactgctgctgaccgactacctgaagaacctgatcgaggacgccggcgactacagagacacccaggacgccctggccgtggtgatcgaggtggccaaccacgccaacgacaccatgaagcagggcgacaacttccagaagctgatgcagatccagtacagcctgaacggccaccacgagatcgtgcagcccggcagagtgttcctgaaggagggcatcctgatgaagctgagcagaaaggtgatgcagcccagaatgttcttcctgttcaacgacgccctgctgtacaccacccccgtgcagagcggcatgtacaagctgaacaacatgctgagcctggccggcatgaaggtgagaaagcccacccaggaggcctaccagaacgagctgaagatcgagagcgtggagagaagcttcatcctgagcgccagcagcgccaccgagagagacgagtggctggaggccatcagcagagccatcgaggagtacgccaagaagagaatcaccttctgccccagcagaagcctggacgaggccgacagcgagaacaaggaggaggtgagccccctgggcagcaaggcccccatctggatccccgacaccagagccaccatgtgcatgatctgcaccagcgagttcaccctgacctggagaagacaccactgcagagcctgcggcaagatcgtgtgccaggcctgcagcagcaacaagtacggcctggactacctgaagaaccagcccgccagagtgtgcgagcactgcttccaggagctgcagaagctggaccaccagcacagccccagaatcggcagccccggcaaccacaagagccccagcagcgccctgagcagcgtgctgcacagcatccccagcggcagaaagcagaagaagatccccgccgccctgaaggaggtgagcgccaacaccgaggacagcagcatgagcggctacctgtacagaagcaagggcaacaagaagccctggaagcacttctggttcgtgatcaagaacaaggtgctgtacacctacgccgccagcgaggacgtggccgccctggagagccagcccctgctgggcttcaccgtgatccaggtgaaggacgagaacagcgagagcaaggtgttccagctgctgcacaagaacatgctgttctacgtgttcaaggccgaggacgcccacagcgcccagaagtggatcgaggccttccaggagggcaccatcctgtag

SEQ ID NO: 10279 - DNA, 1641 bp, Artificial Sequence
  Description of Artificial Sequence: Synthetic coding sequence
atgggcgcctacctgagccagcccaacaccgtgaagtgcagcggcgacggcgtgggcgcccccagactgcccctgccctacggcttcagcgccatgcagggctggagagtgagcatggaggacgcccacaactgcatccccgagctggacagcgagaccgccatgttcagcgtgtacgacggccacggcggcgaggaggtggccctgtactgcgccaagtacctgcccgacatcatcaaggaccagaaggcctacaaggagggcaagctgcagaaggccctggaggacgccttcctggccatcgacgccaagctgaccaccgaggaggtgatcaaggagctggcccagatcgccggcagacccaccgaggacgaggacgagaaggagaaggtggccgacgaggacgacgtggacaacgaggaggccgccctgctgcacgaggaggccaccatgaccatcgaggagctgctgaccagatacggccagaactgccacaagggccccccccacagcaagagcggcggcggcaccggcgaggagcccggcagccagggcctgaacggcgaggccggccccgaggacagcaccagagagacccccagccaggagaacggccccaccgccaaggcctacaccggcttcagcagcaacagcgagagaggcaccgaggccggccaggtgggcgagcccggcatccccaccggcgaggccggccccagctgcagcagcgccagcgacaagctgcccagagtggccaagagcaagttcttcgaggacagcgaggacgagagcgacgaggccgaggaggaggaggaggacagcgaggagtgcagcgaggaggaggacggctacagcagcgaggaggccgagaacgaggaggacgaggacgacaccgaggaggccgaggaggacgacgaggaggaggaggaggagatgatggtgcccggcatggagggcaaggaggagcccggcagcgacagcggcaccaccgccgtggtggccctgatcagaggcaagcagctgatcgtggccaacgccggcgacagcagatgcgtggtgagcgaggccggcaaggccctggacatgagctacgaccacaagcccgaggacgaggtggagctggccagaatcaagaacgccggcggcaaggtgaccatggacggcagagtgaacggcggcctgaacctgagcagagccatcggcgaccacttctacaagagaaacaagaacctgccccccgaggagcagatgatcagcgccctgcccgacatcaaggtgctgaccctgaccgacgaccacgagttcatggtgatcgcctgcgacggcatctggaacgtgatgagcagccaggaggtggtggacttcatccagagcaagatcagccagagagacgagaacggcgagctgagactgctgagcagcatcgtggaggagctgctggaccagtgcctggcccccgacaccagcggcgacggcaccggctgcgacaacatgacctgcatcatcatctgcttcaagcccagaaacaccgccgagctgcagcccgagagcggcaagagaaagctggaggaggtgctgagcaccgagggcgccgaggagaacggcaacagcgacaagaagaagaaggccaagagagactag

SEQ ID NO: 10280 - DNA, 273 bp, Artificial Sequence
  Description of Artificial Sequence: Synthetic coding sequence
atgagcaccgccatgaacttcggcaccaagagcttccagcccagaccccccgacaagggcagcttccccctggaccacctgggcgagtgcaagagcttcaaggagaagttcatgaagtgcctgcacaacaacaacttcgagaacgccctgtgcagaaaggagagcaaggagtacctggagtgcagaatggagagaaagctgatgctgcaggagcccctggagaagctgggcttcggcgacctgaccagcggcaagagcgaggccaagaagtag

SEQ ID NO: 10281 - DNA, 726 bp, Artificial Sequence
  Description of Artificial Sequence: Synthetic coding sequence
atgaacagcggcagacccgagaccatggagaacctgcccgccctgtacaccatcttccagggcgaggtggccatggtgaccgactacggcgccttcatcaagatccccggctgcagaaagcagggcctggtgcacagaacccacatgagcagctgcagagtggacaagcccagcgagatcgtggacgtgggcgacaaggtgtgggtgaagctgatcggcagagagatgaagaacgacagaatcaaggtgagcctgagcatgaaggtggtgaaccagggcaccggcaaggacctggaccccaacaacgtgatcatcgagcaggaggagagaagaagaagaagcttccaggactacaccggccagaagatcaccctggaggccgtgctgaacaccacctgcaagaagtgcggctgcaagggccacttcgccaaggactgcttcatgcagcccggcggcaccaagtacagcctgatccccgacgaggaggaggagaaggaggaggccaagagcgccgagttcgagaagcccgaccccaccagaaaccccagcagaaagagaaagaaggagaagaagaagaagaagcacagagacagaaagagcagcgacagcgacagcagcgacagcgagagcgacaccggcaagagagccagacacaccagcaaggacagcaaggccgccaagaagaagaagaagaagaagaagcacaagaagaagcacaaggagtag

SEQ ID NO: 10282 - DNA, 1758 bp, Artificial Sequence
  Description of Artificial Sequence: Synthetic coding sequence
atggccgccgccgccgccgccgtgggccccggcgccggcggcgccggcagcgccgtgcccggcggcgccggcccctgcgccaccgtgagcgtgttccccggcgccagactgctgaccatcggcgacgccaacggcgagatccagagacacgccgagcagcaggccctgagactggaggtgagagccggccccgacagcgccggcatcgccctgtacagccacgaggacgtgtgcgtgttcaagtgcagcgtgagcagagagaccgagtgcagcagagtgggcaagcagagcttcatcatcaccctgggctgcaacagcgtgctgatccagttcgccacccccaacgacttctgcagcttctacaacatcctgaagacctgcagaggccacaccctggagagaagcgtgttcagcgagagaaccgaggagagcagcgccgtgcagtacttccagttctacggctacctgagccagcagcagaacatgatgcaggactacgtgagaaccggcacctaccagagagccatcctgcagaaccacaccgacttcaaggacaagatcgtgctggacgtgggctgcggcagcggcatcctgagcttcttcgccgcccaggccggcgccagaaagatctacgccgtggaggccagcaccatggcccagcacgccgaggtgctggtgaagagcaacaacctgaccgacagaatcgtggtgatccccggcaaggtggaggaggtgagcctgcccgagcaggtggacatcatcatcagcgagcccatgggctacatgctgttcaacgagagaatgctggagagctacctgcacgccaagaagtacctgaagcccagcggcaacatgttccccaccatcggcgacgtgcacctggcccccttcaccgacgagcagctgtacatggagcagttcaccaaggccaacttctggtaccagcccagcttccacggcgtggacctgagcgccctgagaggcgccgccgtggacgagtacttcagacagcccgtggtggacaccttcgacatcagaatcctgatggccaagagcgtgaagtacaccgtgaacttcctggaggccaaggagggcgacctgcacagaatcgagatccccttcaagttccacatgctgcacagcggcctggtgcacggcctggccttctggttcgacgtggccttcatcggcagcatcatgaccgtgtggctgagcaccgcccccaccgagcccctgacccactggtaccaggtgagatgcctgttccagagccccctgttcgccaaggccggcgacaccctgagcggcacctgcctgctgatcgccaacaagagacagagctacgacatcagcatcgtggcccaggtggaccagaccggcagcaagagcagcaacctgctggacctgaagaaccccttcttcagatacaccggcaccacccccagccccccccccggcagccactacaccagccccagcgagaacatgtggaacaccggcagcacctacaacctgagcagcggcatggccgtggccggcatgcccaccgcctacgacctgagcagcgtgatcgccagcggcagcagcgtgggccacaacaacctgatccccctgggcagcagcggcgcccagggcagcggcggcggcagcaccagcgcccactacgccgtgaacagccagttcaccatgggcggccccgccatcagcatggccagccccatgagcatccccaccaacaccatgcactacggcagctag

SEQ ID NO: 10283 - DNA, 771 bp, Artificial Sequence
  Description of Artificial Sequence: Synthetic coding sequence
atggccagcggcagacccgaggagctgtgggaggccgtggtgggcgccgccgagagattcagagccagaaccggcaccgagctggtgctgctgaccgccgcccccccccccccccccagacccggcccctgcgcctacgccgcccacggcagaggcgccctggccgaggccgccagaagatgcctgcacgacatcgccctggcccacagagccgccaccgccgccagaccccccgcccccccccccgccccccagccccccagccccacccccagcccccccagacccaccctggccagagaggacaacgaggaggacgaggacgagcccaccgagaccgagaccagcggcgagcagctgggcatcagcgacaacggcggcctgttcgtgatggacgaggacgccaccctgcaggacctgccccccttctgcgagagcgaccccgagagcaccgacgacggcagcctgagcgaggagacccccgccggcccccccacctgcagcgtgccccccgccagcgccctgcccacccagcagtacgccaagagcctgcccgtgagcgtgcccgtgtggggcttcaaggagaagagaaccgaggccagaagcagcgacgaggagaacggcccccccagcagccccgacctggacagaatcgccgccagcatgagagccctggtgctgagagaggccgaggacacccaggtgttcggcgacctgcccagacccagactgaacaccagcgacttccagaagctgaagagaaagtactag

SEQ ID NO: 10284 - DNA, 4293 bp, Artificial Sequence
  Description of Artificial Sequence: Synthetic coding sequence
atgtgcctggagagcaacctgagcagctgcaagcacctgccctgctgcggcaagctgcacttccagagctgccacggcaacgtgcacaagctgcaccagttccccagcctgcagggctgcaccagcgccggctacttcccctgcagcgacttcaccagcggcgcccccggccacctggaggagcacatcagccagagcgagctgaccccccacctgtgcaccaacagcctgcacctgaacgtggtgccccccgtgtgcctgaagggcagcctgtactgcgaggactgcctgaacaagcccgccagaaacagcatcatcgacgccgccaaggtgtggcccaacatccccccccccaacacccagcccgcccccctggccgtgcccctgtgcaacggctgcggcaccaagggcaccggcaaggagaccaccctgctgctggccaccagcctgggcaaggccgccagcaagttcggcagccccgaggtggccgtggccggccaggtgctggagaacctgccccccatcggcgtgttctgggacatcgagaactgcagcgtgcccagcggcagaagcgccaccgccgtggtgcagagaatcagagagaagttcttcaagggccacagagaggccgagttcatctgcgtgtgcgacatcagcaaggagaacaaggaggtgatccaggagctgaacaactgccaggtgaccgtggcccacatcaacgccaccgccaagaacgccgccgacgacaagctgagacagagcctgagaagattcgccaacacccacaccgcccccgccaccgtggtgctggtgagcaccgacgtgaacttcgccctggagctgagcgacctgagacacagacacggcttccacatcatcctggtgcacaagaaccaggccagcgaggccctgctgcaccacgccaacgagctgatcagattcgaggagttcatcagcgacctgccccccagactgcccctgaagatgccccagtgccacaccctgctgtacgtgtacaacctgcccgccaacaaggacggcaagagcgtgagcaacagactgagaagactgagcgacaactgcggcggcaaggtgctgagcatcaccggctgcagcgccatcctgagattcatcaaccaggacagcgccgagagagcccagaagagaatggagaacgaggacgtgttcgagaagaaggacaaggaggagaccgtgttccaggtgagctaccccagcgccttcagcaagctggtggccagcagacaggtgagccccctgctggccagccagagctggagcagcagagccagccccctggccttcaacatcgccaacagcagcagcgaggccgactgccccgaccccttcgccaacggcgccgacgtgcaggtgagcaacatcgactacagactgagcagaaaggagctgcagcagctgctgcaggaggccttcgccagacacggcaaggtgaagagcgtggagctgagcccccacaccgactaccagctgaaggccgtggtgcagatggagaacctgcaggacgccatcggcgccgtgaacagcctgcacagatacaagatcggcagcaagaagatcctggtgagcctggccaccggcgccgccagcaagagcctgagcctgctgagattcggccacaagctgaacgtgagcgacctgtacaagctgaccgacaccgtggccatcagagagcagggcaacggcagactggtgtgcctgctgcccagcagccaggccagacagagccccctgggcagcagccagagccacgacggcagcagcaccaactgcagccccatcatcttcgaggagctggagtaccacgagcccgtgtgcagacagcactgcagcaacaaggacttcagcttccccgactgctacatcgccgagttcggcgacctggaggtggtgcaggagaaccagggcggcgtgcccctggagcacttcatcacctgcgtgcccggcgtgaacatcgccaccgcccagaacggcatcaaggtggtgaagtggatccacaacaagccccccccccccaacaccgacccctggctgctgagaagcaagagccccgtgggcaacccccagctgatccagttcagcagagaggtgatcgacctgctgaagagccagcccagctgcgtgatccccatcagccacttcatccccagctaccaccaccacttcgccaagcagtgcagagtgagcgactacggctacagcaagctgatcgagctgctggaggccgtgccccacgtgctgcagatcctgggcatgggcagcaagagactgctgaccctgacccacagagcccaggtgaagagattcacccaggacctgctgaagctgctgaagagccaggccagcaagcaggtgatcgtgagagagttcagccaggcctaccactggtgcttcagcaaggactgggacgtgaccgagtacggcgtgtgcgagctgatcgacatcgtgagcgagatccccgacaccaccatctgcctgagccagcaggacaacgagatggtgatctgcatccccaagagagagagaacccaggacgagatcgagagaaccaagcagttcagcaaggacgtggtggacctgctgagacaccagccccacttcagaatgcccttcaacaagttcatccccagctaccaccaccacttcggcagacagtgcaagctggcctactacggcttcaccaagctgctggagctgttcgaggccatccccgacaccctgcaggtgctggagtgcggcgaggagaagatcctgaccctgaccgaggtggagagattcaaggccctggccgcccagttcgtgaagctgctgagaagccagaaggacaactgcctgatgatgaccgacctgctgaccgagtacgccaagaccttcggctacaccttcagactgcaggactacgacgtgagcagcatcagcgccctgacccagaagctgtgccacgtggtgaaggtggccgacatcgagagcggcagacagatccagctgatcaacagaaagagcctgagaagcctgaccgcccagctgctggtgctgctgatgagctgggagggcaccacccacctgagcgtggaggagctgaagagacactacgagagcacccacaacacccccctgaacccctgcgagtacggcttcatgaccctgaccgagctgctgaagagcctgccctacctggtggagaccgccgccgccttcgacctgcagatcgagctgaagttcgccggcggctacagcctgctgctggaggagatcctggagtacatccccccccccttcctgagccccctgcccagcttcctgccccccccccccttcttcttcttcgtgttcttcgtgatcttcatcttcttcatcttcgtgttcgtgcagttcgtggtgttcgtgttcttcatcgtggtgttcgtgttcttcatcgtggtgttcgtgttcaccaacgacaagatggaggagtgcgtgaagctgaccagcctgtacctgttcgccaagaacgtgagaagcctgctgcacacctaccactaccagcagatcttcctgcacgagttcagcatggcctacaccaagtacgtgggcgagaccctgcagcccaagacctacggccacagcagcgtggaggagctgctgggcgccatcccccaggtggtggtgcagttcctgcagaagaacggcaaggagctgagctgcgagaactacctgaacctgtacgccaaggccggcagactgagcagcctgagcctgagccccgccaaccacgagaaccagcccagcgagggcgagagaatcctggaggtgcccgagagccacaccgccagcgagctgaagctgggcgccgacggcagcggccccagccacaccgagcaggagctgctgagactgaccgacgacagccccgtggacctgctgtgcgcccccgtgcccagctgcctgcccagcccccagctgagacccgaccccgtgatcctgcagagcgccgacctgatccagttcgaggagagaccccaggagcccagcgagatcatgatcctgaaccaggaggagaagatggagatccccatccccggcaagagcaagaccctgaccagcgacagcagcagcagctgcatcagcgccgccgtgcccgtgcccccctgccccagcagcgagaccagcgagagcctgctgagcaaggaccccgtggagagccccgccaagaagcagcccaagaacagagtgaagctggccgccaacttcagcctggcccccatcaccaagctgtag

SEQ ID NO: 10285 - DNA, 2346 bp, Artificial Sequence
  Description of Artificial Sequence: Synthetic coding sequence
atgggccagctgagagactggttccccaacacccaggacctggccggcaacgaccaggagaacatcagacacgccgacagaaacaacagcgacgacaaccacctggccagcgaggacaccagcgccaagcagagcggcaagcccggcatctacgaggacagagaccccctgagagtgagcatcagcagagagcagagcttcttcggcagccccctggcccacgaccccttcagctgcctgcagctggtgggccaggagaacgtgtgcggcgacgactacgacgaggccgtgaagctgaaggagagcgtggtggagaaccacgccgtgctgagctacgccgtggaggaggagcacgcctacctgggccccaccgtgaagcccgacgacaaggccaagaccctgagctacgagcccctgagcagcgccaccgtgagcaccggcagcctgctgagctacgagaacaccgacctgagcctgaccgaccccgagagcttcagcgagcacatggacgacagcaagcaggagagcaccaccagcaaggaggaggagaccaacatcatcagcagcatcgtgcccagcacccaggacatctaccagagacagaacagcagcgacgtgcacaagagcctgctgcccgccgtggacgagaccacctgcggccacacccacttccagcagatgatcgacaagtacatcaacgaggccaacctgatccccgagaagaccgacctgcaggagctggagcacatcttccccaacctgcaccaccagctgttcaagcccctggagccccaccccgacttcgacctgagcagcagcagcagcggcatcagccccgacaacagagacttctaccagagaagcgacagcagcagcgagagccactgcgccaccggcctgagcaagagcaccgtgtacttcaccgccctgagaagaaccagcatgcacagcagcctgaacaccagccccaaccagcagcccgacaccaacctggcccacgtgggcgcccacagcttcgccaccgagaacatcatcggcggcagcgagcagtgcttcgagcagctgcagcccgagtacagcagccaggaggagagccagcacgccgacctgcccagcatcttcagcatcgaggccagagacagcagccagggcatgaagaaccagaactaccccagcgaggagcacaccgagatcctgcagaacaagaagaagatcgtgcacttccagctgagcatcggcaacctgagcagcgtgtacagcagcagcgacgaggccaacgtgttcgaccagctgaacgtgcagcacagcaccccctgcggcagcaacagcagcgagtgcagcaccaagcaccagctggagagcagaaaggagagcatgggcttcgaggagctgagcaagagaggcgtggtgaccatgctgcagagccagggcctgatcgaggacaacaagaacgagacctgcagagtgctggacatcaacccccaggtggaggagaccgacagcagactgtgcgtgagaaccgtggagatgggcaccagcatccaggccccctacagcctgaccacccagaacgagaagtacttcgagaacagcgccgagaccgacatccccaagatcaccaagaagctgagccagctgggcgagagcgagctgttcgccagcagcggcagcttcagcctgcagagcagcatccccgtgtgggagaccgagaccggccacggcatcatggaggagcccgagctgaccctgatcagcaccaccgacaccagcatcgccgagatggacttcgccaacctgaccctggaggagaagagcgagaacgaggccaagtgcttcttccaggtgagcgagttcctgcccctggtgagcgccaccgaggccagcgactaccccgccgtgagcgagctgagcatcgagaagcccagaaccgccagcaccgagacccccagaagactgacccccgtgcccggcagcctgcaggaggccttcatcaagagaaagaagagcttcatggagagaagccaccagagacagaaggagatcagaaacaagatccacgtgagcgagaacagccagatcaagaccgtgaaggagaagcccagcatcagcagcagcgtgagcagactgaagggcgtgaacaaggtgagagccagcttccccgaggacagaaagaccacccaggccctgagacaccagagaggcctgagactgtacaaccagctggccgaggtgaagcagcagaaggaggagaagaccaagcaggaggcctacgcccagaacagagccagagccaaggagttccacaagaagaccctggagaagctgagagccaagaacacctgctag

SEQ ID NO: 10286 - DNA, 513 bp, Artificial Sequence
  Description of Artificial Sequence: Synthetic coding sequence
atgggcaagagatacttctgcgactactgcgacagaagcttccaggacaacctgcacaacagaaagaagcacctgaacggcctgcagcacctgaaggccaagaaggtgtggtacgacatgttcagagacgccgccgccatcctgctggacgagcagaacaagagaccctgcagaaagttcctgctgaccggccagtgcgacttcggcagcaactgcagattcagccacatgagcgagagagacctgcaggagctgagcatccaggtggaggaggagagaagagccagagagtggctgctggacgcccccgagctgcccgagggccacctggaggactggctggagaagagagccaagagactgagcagcgcccccagcagcagagccgagcccatcagaaccaccgtgttccagtaccccgtgggctggccccccgtgcaggagctgccccccagcctgagagcccccccccccggcggctggcccctgcagcccagagtgcagtggggctag

SEQ ID NO: 10287 - DNA, 1542 bp, Artificial Sequence
  Description of Artificial Sequence: Synthetic coding sequence
atggccagcgtgctgagcagaagactgggcaagagaagcctgctgggcgccagagtgctgggccccagcgccagcgagggccccagcgccgccccccccagcgagcccctgctggagggcgccgccccccagcccttcaccaccagcgacgacaccccctgccaggagcagcccaaggaggtgctgaaggcccccagcaccagcggcctgcagcaggtggccttccagcccggccagaaggtgtacgtgtggtacggcggccaggagtgcaccggcctggtggagcagcacagctggatggagggccaggtgaccgtgtggctgctggagcagaagctgcaggtgtgctgcagagtggaggaggtgtggctggccgagctgcagggcccctgcccccaggccccccccctggagcccggcgcccaggccctggcctacagacccgtgagcagaaacatcgacgtgcccaagagaaagagcgacgccgtggagatggacgagatgatggccgccatggtgctgaccagcctgagctgcagccccgtggtgcagagcccccccggcaccgaggccaacttcagcgccagcagagccgcctgcgacccctggaaggagagcggcgacatcagcgacagcggcagcagcaccaccagcggccactggagcggcagcagcggcgtgagcacccccagccccccccacccccaggccagccccaagtacctgggcgacgccttcggcagcccccagaccgaccacggcttcgagaccgaccccgaccccttcctgctggacgagcccgcccccagaaagagaaagaacagcgtgaaggtgatgtacaagtgcctgtggcccaactgcggcaaggtgctgagaagcatcgtgggcatcaagagacacgtgaaggccctgcacctgggcgacaccgtggacagcgaccagttcaagagagaggaggacttctactacaccgaggtgcagctgaaggaggagagcgccgccgccgccgccgccgccgccgccggcacccccgtgcccggcacccccaccagcgagcccgcccccacccccagcatgaccggcctgcccctgagcgccctgcccccccccctgcacaaggcccagagcagcggccccgagcaccccggccccgagagcagcctgcccagcggcgccctgagcaagagcgcccccggcagcttctggcacatccaggccgaccacgcctaccaggccctgcccagcttccagatccccgtgagcccccacatctacaccagcgtgagctgggccgccgcccccagcgccgcctgcagcctgagccccgtgagaagcagaagcctgagcttcagcgagccccagcagcccgcccccgccatgaagagccacctgatcgtgaccagcccccccagagcccagagcggcgccagaaaggccagaggcgaggccaagaagtgcagaaaggtgtacggcatcgagcacagagaccagtggtgcaccgcctgcagatggaagaaggcctgccagagattcctggactag

SEQ ID NO: 10288 - DNA, 555 bp, Artificial Sequence
  Description of Artificial Sequence: Synthetic coding sequence
atgggcaacggcatgaacaagatcctgcccggcctgtacatcggcaacttcaaggacgccagagacgccgagcagctgagcaagaacaaggtgacccacatcctgagcgtgcacgacagcgccagacccatgctggagggcgtgaagtacctgtgcatccccgccgccgacagccccagccagaacctgaccagacacttcaaggagagcatcaagttcatccacgagtgcagactgagaggcgagagctgcctggtgcactgcctggccggcgtgagcagaagcgtgaccctggtgatcgcctacatcatgaccgtgaccgacttcggctgggaggacgccctgcacaccgtgagagccggcagaagctgcgccaaccccaacgtgggcttccagagacagctgcaggagttcgagaagcacgaggtgcaccagtacagacagtggctgaaggaggagtacggcgagagccccctgcaggacgccgaggaggccaagaacatcctggccgcccccggcatcctgaagttctgggccttcctgagaagactgtag

SEQ ID NO: 10289 - DNA, 642 bp, Artificial Sequence
  Description of Artificial Sequence: Synthetic coding sequence
atgctgcagctgagagacagcgtggacagcgccggcaccagccccaccgccgtgctggccgccggcgaggaggtgggcgccggcggcggccccggcggcggcagacccggcgccggcacccccctgagacagaccctgtggcccctgagcatccacgaccccaccagaagagccagagtgaaggagtacttcgtgttcagacccggcagcatcgagcaggccgtggaggagatcagagtggtggtgagacccgtggaggacggcgagatccagggcgtgtggctgctgaccgagagagagggcttcggcatcagaatccagtgggacaagcagagcagacccagcttcatcaacagatggaacccctggagcaccaacgtgccctacgccaccttcaccgagcaccccatggccggcgccgacgagaagaccgccagcctgtgccagctggagagcttcaaggccctgctgatccaggccgtgaagaaggcccagaaggagagccccctgcccggccaggccaacggcgtgctgatcctggagagacccctgctgatcgagacctacgtgggcctgatgagcttcatcaacaacgaggccaagctgggctacagcatgaccagaggcaagatcggcttctag

SEQ ID NO: 10290 - DNA, 888 bp, Artificial Sequence; identical to SEQ ID NO: 10194
  Description of Artificial Sequence: Synthetic coding sequence

SEQ ID NO: 10291 - DNA, 3867 bp, Artificial Sequence
  Description of Artificial Sequence: Synthetic coding sequence
atgcccagaaagggcacccagcccagcaccgccagaagaagagaggagggcccccccccccccagccccgacggcgccagcagcgacgccgagcccgagccccccagcggcagaaccgagagccccgccaccgccgccgagaccgccagcgaggagctggacaacagaagcctggaggagatcctgaacagcatcccccccccccccccccccgccatgaccaacgaggccggcgcccccagactgatgatcacccacatcgtgaaccagaacttcaagagctacgccggcgagaagatcctgggccccttccacaagagattcagctgcatcatcggccccaacggcagcggcaagagcaacgtgatcgacagcatgctgttcgtgttcggctacagagcccagaagatcagaagcaagaagctgagcgtgctgatccacaacagcgacgagcacaaggacatccagagctgcaccgtggaggtgcacttccagaagatcatcgacaaggagggcgacgactacgaggtgatccccaacagcaacttctacgtgagcagaaccgcctgcagagacaacaccagcgtgtaccacatcagcggcaagaagaagaccttcaaggacgtgggcaacctgctgagaagccacggcatcgacctggaccacaacagattcctgatcctgcagggcgaggtggagcagatcgccatgatgaagcccaagggccagaccgagcacgacgagggcatgctggagtacctggaggacatcatcggctgcggcagactgaacgagcccatcaaggtgctgtgcagaagagtggagatcctgaacgagcacagaggcgagaagctgaacagagtgaagatggtggagaaggagaaggacgccctggagggcgagaagaacatcgccatcgagttcctgaccctggagaacgagatcttcagaaagaagaaccacgtgtgccagtactacatctacgagctgcagaagagaatcgccgagatggagacccagaaggagaagatccacgaggacaccaaggagatcaacgagaagagcaacatcctgagcaacgagatgaaggccaagaacaaggacgtgaaggacaccgagaagaagctgaacaagatcaccaagttcatcgaggagaacaaggagaagttcacccagctggacctggaggacgtgcaggtgagagagaagctgaagcacgccaccagcaaggccaagaagctggagaagcagctgcagaaggacaaggagaaggtggaggagttcaagagcatccccgccaagagcaacaacatcatcaacgagaccaccaccagaaacaacgccctggagaaggagaaggagaaggaggagaagaagctgaaggaggtgatggacagcctgaagcaggagacccagggcctgcagaaggagaaggagagcagagagaaggagctgatgggcttcagcaagagcgtgaacgaggccagaagcaagatggacgtggcccagagcgagctggacatctacctgagcagacacaacaccgccgtgagccagctgaccaaggccaaggaggccctgatcgccgccagcgagaccctgaaggagagaaaggccgccatcagagacatcgagggcaagctgccccagaccgagcaggagctgaaggagaaggagaaggagctgcagaagctgacccaggaggagaccaacttcaagagcctggtgcacgacctgttccagaaggtggaggaggccaagagcagcctggccatgaacagaagcagaggcaaggtgctggacgccatcatccaggagaagaagagcggcagaatccccggcatctacggcagactgggcgacctgggcgccatcgacgagaagtacgacgtggccatcagcagctgctgccacgccctggactacatcgtggtggacagcatcgacatcgcccaggagtgcgtgaacttcctgaagagacagaacatcggcgtggccaccttcatcggcctggacaagatggccgtgtgggccaagaagatgaccgagatccagacccccgagaacacccccagactgttcgacctggtgaaggtgaaggacgagaagatcagacaggccttctacttcgccctgagagacaccctggtggccgacaacctggaccaggccaccagagtggcctaccagaaggacagaagatggagagtggtgaccctgcagggccagatcatcgagcagagcggcaccatgaccggcggcggcagcaaggtgatgaagggcagaatgggcagcagcctggtgatcgagatcagcgaggaggaggtgaacaagatggagagccagctgcagaacgacagcaagaaggccatgcagatccaggagcagaaggtgcagctggaggagagagtggtgaagctgagacacagcgagagagagatgagaaacaccctggagaagttcaccgccagcatccagagactgatcgagcaggaggagtacctgaacgtgcaggtgaaggagctggaggccaacgtgctggccaccgcccccgacaagaagaagcagaagctgctggaggagaacgtgagcgccttcaagaccgagtacgacgccgtggccgagaaggccggcaaggtggaggccgaggtgaagagactgcacaacaccatcgtggagatcaacaaccacaagctgaaggcccagcaggacaagctggacaagatcaacaagcagctggacgagtgcgccagcgccatcaccaaggcccaggtggccatcaagaccgccgacagaaacctgcagaaggcccaggacagcgtgctgagaaccgagaaggagatcaaggacaccgagaaggaggtggacgacctgaccgccgagctgaagagcctggaggacaaggccgccgaggtggtgaagaacaccaacgccgccgaggagagcctgcccgagatccagaaggagcacagaaacctgctgcaggagctgaaggtgatccaggagaacgagcacgccctgcagaaggacgccctgagcatcaagctgaagctggagcagatcgacggccacatcgccgagcacaacagcaagatcaagtactggcacaaggagatcagcaagatcagcctgcaccccatcgaggacaaccccatcgaggagatcagcgtgctgagccccgaggacctggaggccatcaagaaccccgacagcatcaccaaccagatcgccctgctggaggccagatgccacgagatgaagcccaacctgggcgccatcgccgagtacaagaagaaggaggagctgtacctgcagagagtggccgagctggacaagatcacctacgagagagacagcttcagacaggcctacgaggacctgagaaagcagagactgaacgagttcatggccggcttctacatcatcaccaacaagctgaaggagaactaccagatgctgaccctgggcggcgacgccgagctggagctggtggacagcctggaccccttcagcgagggcatcatgttcagcgtgagaccccccaagaagagctggaagaagatcttcaacctgagcggcggcgagaagaccctgagcagcctggccctggtgttcgccctgcaccactacaagcccacccccctgtacttcatggacgagatcgacgccgccctggacttcaagaacgtgagcatcgtggccttctacatctacgagcagaccaagaacgcccagttcatcatcatcagcctgagaaacaacatgttcgagatcagcgacagactgatcggcatctacaagacctacaacatcaccaagagcgtggccgtgaaccccaaggagatcgccagcaagggcctgtgctag

SEQ ID NO: 10292 - DNA, 2856 bp, Artificial Sequence
  Description of Artificial Sequence: Synthetic coding sequence
atgctgggcagcatggccagaaagaagcccagaaacaccagcagactgcccctggccctgaaccccctgaagagcaaggacgtgctggccgtgctggccgagagaaacgaggccatcgtgcccgtgggcgcctgggtggagcccgccagccccggcagcagcgagatccccgcctacaccagcgcctacctgatcgaggaggagctgaaggagcagctgagaaagaagcaggaggccctgaagcacttccagaagcaggtgaagtacagagtgaaccagcagatcagactgagaaagaagcagcagctgcagaagagctacgagagagcccagaaggagggcagcatcgccatgcagagcagcgccacccacctgaccagcaagagaaccagcgtgttccccaacaacctgaacgtggccatcggcagcagcagactgccccccagcctgatgcccggcgacggcatcgaggacgaggagaaccagaacgagctgttccagcagcaggcccaggccctgagcgagaccatgaagcaggccagacacagactggccagcttcaagaccgtgatcaagaagaagggcagcgtgttccccgacgacggcagaaagagcttcctgaccagagaggaggtgctgagcagaaagcccgccagcaccggcatcaacaccggcatcagaggcgagctgcccatcaaggtgcaccagggcctgctggccgccgtgccctaccagaactacatggagaaccaggagctggactacgaggagcccgactacgaggagagcagcagcctggtgaccgacgagaagggcaaggaggacctgttcggcagaggccagcaggaccagcaggccatccacagcgaggacaagaacaagcccttcagcagagtgcagaaggtgaagttcaagaaccccctgttcgtgctgatggaggaggaggagcagaagcagctgcacttcgagggcctgcaggacatcctgcccgaggcccaggactacttcctggaggcccagggcgacctgctggagacccagggcgacctgaccggcatccagagcgtgaagcccgacacccaggccgtggagatgaaggtgcaggtgaccgagcccgagggccaggccatcgagcccgagggccagcccatcaagaccgagacccagggcatcatgctgaaggcccagagcatcgagctggaggagggcagcatcgtgctgaagacccaggacttcctgcccaccaaccaggccctgctgaccaagaaccaggacgtgctgctgaaggaccactgcgtgctgcccaaggaccagagcatcctgctgaagtaccaggaccaggacttcctgcccagagaccagcacgtgctgcacaaggaccaggacatcctgcccaagtaccaggaccagaacttcctgcccaaggaccagaacttcctgagcagagaccagcacgtgctgcccaaggaccaggacatcctgcccaagtaccaggaccagaacttcctgcccaaggaccagaacttcctgagcagagaccagcacgtgctgcccaaggaccagaacatcctgcccaagtaccagggccaggacttcctgcccaaggaccaggacttcctgagcagagaccagcacgtgctgcccaaggactggaacatcctgcccaagtgccaggaccaggacttcctgcccagagaccagggcgtgctgcccaaggaccagaacatcctgcccatctgccaggaccaggacttcctgcccagagaccagggctacctgcccaaggaccagaacatcctgcccatctgccaggacagagacttcctgcccagagacctgcacgtgctgagcaacgaccagaacatcctgcccaagtgccaggaccaggacttcctgcccaagtaccagaaggtgcacttcaaggagccctacagcgacatgaccgacgagaagggcagagaggacttcagcctggccgactaccagtgcctgccccccaagagccaggaccaggacgacatcaagaaccagcagcccgccagcttcatgagagaggagagagtgagagaggagctgcccctggactaccaccagtacgtggtgcccaagatccaggaccaggacagccccagagagcagaacaagcacatcaagctgcccagcagcttcgagaagtgggagatcgccagaggcaacacccccggcgtgcccctggcctacgacagataccagagcggcctgagcaccgagttccaggcccccctggccttccagagcgacgtggacaaggaggaggacaagaaggagagacagaagcagtacctgagacacagaagactgttcatggacatcgagagagagcaggtgaaggagcagcagagacagaaggagcagaagaagaagatcgagaagatcaagaagaagagagagcaggagtgctacgccgccgagcagagaatcctgagaatgaacttccacgaggacccctacagcggcgagaagctgagcgagatcctggcccagctgcagctgcaggagatcaagggcaccagagagaagcagcagagagagaaggagtacctgagatacgtggaggccctgagagcccagatccaggagaagatgcagctgtacaacatcaccctgccccccctgtgctgctgcggccccgacttctgggacgcccaccccgacacctgcgccaacaactgcatcttctacaagaaccacagagcctacaccagagccctgcacagcttcatcaacagctgcgacgtgcccggcggcaacagcaccctgagagtggccatccacaacttcgccagcgcccacagaagaaccctgaagaacctgtag

SEQ ID NO: 10293 - DNA, 1248 bp, Artificial Sequence
  Description of Artificial Sequence: Synthetic coding sequence
atgagccccgaggtggccctgaacagaatcagccccatgctgagccccttcatcagcagcgtggtgagaaacggcaaggtgggcctggacgccaccaactgcctgagaatcaccgacctgaagagcggctgcaccagcctgacccccggccccaactgcgacagattcaagctgcacatcccctacgccggcgagaccctgaagtgggacatcatcttcaacgcccagtaccccgagctgccccccgacttcatcttcggcgaggacgccgagttcctgcccgaccccagcgccctgcagaacctggccagctggaaccccagcaaccccgagtgcctgctgctggtggtgaaggagctggtgcagcagtaccaccagttccagtgcagcagactgagagagagcagcagactgatgttcgagtaccagaccctgctggaggagccccagtacggcgagaacatggagatctacgccggcaagaagaacaactggaccggcgagttcagcgccagattcctgctgaagctgcccgtggacttcagcaacatccccacctacctgctgaaggacgtgaacgaggaccccggcgaggacgtggccctgctgagcgtgagcttcgaggacaccgaggccacccaggtgtaccccaagctgtacctgagccccagaatcgagcacgccctgggcggcagcagcgccctgcacatccccgccttccccggcggcggctgcctgatcgactacgtgccccaggtgtgccacctgctgaccaacaaggtgcagtacgtgatccagggctaccacaagagaagagagtacatcgccgccttcctgagccacttcggcaccggcgtggtggagtacgacgccgagggcttcaccaagctgaccctgctgctgatgtggaaggacttctgcttcctggtgcacatcgacctgcccctgttcttccccagagaccagcccaccctgaccttccagagcgtgtaccacttcaccaacagcggccagctgtacagccaggcccagaagaactacccctacagccccagatgggacggcaacgagatggccaagagagccaagggctgccagggcagcagagacgcctgcagcccctgggagcaggtgctggccttcgccgtggccaagaccggctgcaagctgctgcagccccagagaaactggcccagcagcagaggccccccctggagagccagcgagggcgagagaaccgcccagtag

SEQ ID NO: 10294 - DNA, 903 bp, Artificial Sequence
  Description of Artificial Sequence: Synthetic coding sequence
atgctgagcgccgtggccagaggctaccagggctggttccacccctgcgccagactgagcgtgagaatgagcagcaccggcatcgacagaaagggcgtgctggccaacagagtggccgtggtgaccggcagcaccagcggcatcggcttcgccatcgccagaagactggccagagacggcgcccacgtggtgatcagcagcagaaagcagcagaacgtggacagagccatggccaagctgcagggcgagggcctgagcgtggccggcatcgtgtgccacgtgggcaaggccgaggacagagagcagctggtggccaaggccctggagcactgcggcggcgtggacttcctggtgtgcagcgccggcgtgaaccccctggtgggcagcaccctgggcaccagcgagcagatctgggacaagatcctgagcgtgaacgtgaagagccccgccctgctgctgagccagctgctgccctacatggagaacagaagaggcgccgtgatcctggtgagcagcatcgccgcctacaaccccgtggtggccctgggcgtgtacaacgtgagcaagaccgccctgctgggcctgaccagaaccctggccctggagctggcccccaaggacatcagagtgaactgcgtggtgcccggcatcatcaagaccgacttcagcaaggtggtgagaatcggcttcatgggcatgagcctgagcggcagaaccagcagaaacatcatcagctgcagaggcctgggcagccagagaaccgtgcaggagagctgccccagctgcgccctgcagatgcccgccaccagcaccggcagaaccctgagatggcaggccacccccctgggcagcgagagaagcggcggcggctgcgtggccgtggtgcccggccccggcgcctag

SEQ ID NO: 10295 - DNA, 1014 bp, Artificial Sequence
  Description of Artificial Sequence: Synthetic coding sequence
atgagattcgacaccctgtgggagaacaagctgatgcagagcagagccgtggacggcttccacagcgaggagcagcagctgctgctgcaggtgcagcagcagcaccagccccagcagcagcagcaccaccaccaccaccaccaccagcaggcccagccccagcagaccgtgccccagcaggcccagacccagcaggtgctgatccccgccagccagcaggccaccgccccccaggtgatcgtgcccgacagcaagctgatccagcacatgaacgccagcaacatgagcgccgccgccaccgccgccaccctggccctgcccgccggcgtgacccccgtgcagcagatcctgaccaacagcggccagctgctgcaggtggtgagagccgccaacggcgcccagtacatcttccagccccagcagagcgtggtgctgcagcagcaggtgatcccccagatgcagcccggcggcgtgcaggcccccgtgatccagcaggtgctggcccccctgcccggcggcatcagcccccagaccggcgtgatcatccagccccagcagatcctgttcaccggcaacaagacccaggtgatccccaccaccgtggccgcccccacccccgcccaggcccagatcaccgccaccggccagcagcagccccaggcccagcccgcccagacccaggcccccctggtgctgcaggtggacggcaccggcgacaccagcagcgaggaggacgaggacgaggaggaggactacgacgacgacgaggaggaggacaaggagaaggacggcgccgaggacggccaggtggaggaggagcccctgaacagcgaggacgacgtgagcgacgaggagggccaggagctgttcgacaccgagaacgtggtggtgtgccagtacgacaagatccacagaagcaagaacaagtggaagttccacctgaaggacggcatcatgaacctgaacggcagagactacatcttcagcaaggccatcggcgacgccgagtggtag

SEQ ID NO: 10296 - DNA, 282 bp, Artificial Sequence
  Description of Artificial Sequence: Synthetic coding sequence
atggcccagagcggcggcgaggccagacccggccccaagaccgccgtgcagatcagagtggccatccaggaggccgaggacgtggacgagctggaggacgaggaggagggcgccgagaccagaggcgccggcgaccccgccagatacctgagccccggctggggcagcgccagcgaggaggagcccagcagaggccacagaaacagaagcagcgtgaacagcagaaccatgctggccagcttcatcgtgagcagcgcccccagcaccgcccccagcacctag

SEQ ID NO: 10297 - DNA, 255 bp, Artificial Sequence
  Description of Artificial Sequence: Synthetic coding sequence
atgaaggtgaagatcaagtgctggaacggcgtggccacctggctgtgggtggccaacgacgagaactgcggcatctgcagaatggccttcaacggctgctgccccgactgcaaggtgcccggcgacgactgccccctggtgtggggccagtgcagccactgcttccacatgcactgcatcctgaagtggctgcacgcccagcaggtgcagcagcactgccccatgtgcagacaggagtggaagttcaaggagtag

SEQ ID NO: 10298 - DNA, 612 bp, Artificial Sequence; identical to SEQ ID NO: 9820
  Description of Artificial Sequence: Synthetic coding sequence

SEQ ID NO: 10299 - DNA, 1794 bp, Artificial Sequence
  Description of Artificial Sequence: Synthetic coding sequence
atgcccagcccccagctgctggtgctgttcggcagccagaccggcaccgcccaggacgtgagcgagagactgggcagagaggccagaagaagaagactgggctgcagagtgcaggccctggacagctaccccgtggtgaacctgatcaacgagcccctggtgatcttcgtgtgcgccaccaccggccagggcgacccccccgacaacatgaagaacttctggagattcatcttcagaaagaacctgcccagcaccgccctgtgccagatggacttcgccgtgctgggcctgggcgacagcagctacgccaagttcaacttcgtggccaagaagctgcacagaagactgctgcagctgggcggcagcgccctgctgcccgtgtgcctgggcgacgaccagcacgagctgggccccgacgccgccgtggacccctggctgagagacctgtgggacagagtgctgggcctgtacccccccccccccggcctgaccgagatcccccccggcgtgcccctgcccagcaagttcaccctgctgttcctgcaggaggcccccagcaccggcagcgagggccagagagtggcccaccccggcagccaggagccccccagcgagagcaagcccttcctggcccccatgatcagcaaccagagagtgaccggccccagccacttccaggacgtgagactgatcgagttcgacatcctgggcagcggcatcagcttcgccgccggcgacgtggtgctgatccagcccagcaacagcgccgcccacgtgcagagattctgccaggtgctgggcctggaccccgaccagctgttcatgctgcagcccagagagcccgacgtgagcagccccaccagactgccccagccctgcagcatgagacacctggtgagccactacctggacatcgccagcgtgcccagaagaagcttcttcgagctgctggcctgcctgagcctgcacgagctggagagagagaagctgctggagttcagcagcgcccagggccaggaggagctgttcgagtactgcaacagacccagaagaaccatcctggaggtgctgtgcgacttcccccacaccgccgccgccatcccccccgactacctgctggacctgatccccgtgatcagacccagagccttcagcatcgccagcagcctgctgacccaccccagcagactgcagatcctggtggccgtggtgcagttccagaccagactgaaggagcccagaagaggcctgtgcagcagctggctggccagcctggaccccggccagggccccgtgagagtgcccctgtgggtgagacccggcagcctggccttccccgagacccccgacacccccgtgatcatggtgggccccggcaccggcgtggcccccttcagagccgccatccaggagagagtggcccagggccagaccggcaacttcctgttcttcggctgcagatggagagaccaggacttctactgggaggccgagtggcaggagctggagaagagagactgcctgaccctgatccccgccttcagcagagagcaggagcagaaggtgtacgtgcagcacagactgagagagctgggcagcctggtgtgggagctgctggacagacagggcgcctacttctacctggccggcaacgccaagagcatgcccgccgacgtgagcgaggccctgatgagcatcttccaggaggagggcggcctgtgcagccccgacgccgccgcctacctggccagactgcagcagaccagaagattccagaccgagacctgggcctag

SEQ ID NO: 10300 - DNA, 1860 bp, Artificial Sequence
  Description of Artificial Sequence: Synthetic coding sequence
atggacgaccagcaggccctgaacagcatcatgcaggacctggccgtgctgcacaaggccagcagacccgccctgagcctgcaggagaccagaaaggccaagagcagcagccccaagaagcagaacgacgtgagagtgaagttcgagcacagaggcgagaagagaatcctgcagttccccagacccgtgaagctggaggacctgagaagcaaggccaagatcgccttcggccagagcatggacctgcactacaccaacaacgagctggtgatccccctgaccacccaggacgacctggacaaggccgtggagctgctggacagaagcatccacatgaagagcctgaagatcctgctggtgatcaacggcagcacccaggccaccaacctggagcccctgcccagcctggaggacctggacaacaccgtgttcggcgccgagagaaagaagagactgagcatcatcggccccaccagcagagacagaagcagccccccccccggctacatccccgacgagctgcaccaggtggccagaaacggcagcttcaccagcatcaacagcgagggcgagttcatccccgagagcatggaccagatgctggaccccctgagcctgagcagccccgagaacagcggcagcggcagctgccccagcctggacagccccctggacggcgagagctaccccaagagcagaatgcccagagcccagagctaccccgacaaccaccaggagttcagcgactacgacaaccccatcttcgagaagttcggcaagggcggcacctaccccagaagataccacgtgagctaccaccaccaggagtacaacgacggcagaaagaccttccccagagccagaagaacccagggcaccagcctgagaagccccgtgagcttcagccccaccgaccacagcctgagcaccagcagcggcagcagcatcttcacccccgagtacgacgacagcagaatcagaagaagaggcagcgacatcgacaaccccaccctgaccgtgatggacatcagcccccccagcagaagccccagagcccccaccaactggagactgggcaagctgctgggccagggcgccttcggcagagtgtacctgtgctacgacgtggacaccggcagagagctggccgtgaagcaggtgcagttcgaccccgacagccccgagaccagcaaggaggtgaacgccctggagtgcgagatccagctgctgaagaacctgctgcacgagagaatcgtgcagtactacggctgcctgagagacccccaggagaagaccctgagcatcttcatggagtacatgcccggcggcagcatcaaggaccagctgaaggcctacggcgccctgaccgagaacgtgaccagaaagtacaccagacagatcctggagggcgtgcactacctgcacagcaacatgatcgtgcacagagacatcaagggcgccaacatcctgagagacagcaccggcaacgtgaagctgggcgacttcggcgccagcaagagactgcagaccatctgcctgagcggcaccggcatgaagagcgtgaccggcaccccctactggatgagccccgaggtgatcagcggcgagggctacggcagaaaggccgacatctggagcgtggcctgcaccgtggtggagatgctgaccgagaagcccccctgggccgagttcgaggccatggccgccatcttcaagatcgccacccagcccaccaaccccaagctgcccccccacgtgagcgactacaccagagacttcctgaagagaatcttcgtggaggccaagctgagacccagcgccgacgagctgctgagacacatgttcgtgcactaccactag

SEQ ID NO: 10301 - DNA, 828 bp, Artificial Sequence
  Description of Artificial Sequence: Synthetic coding sequence
atgagcaccatcggcagcttcgagggcttccaggccgtgagcctgaagcaggagggcgacgaccagcccagcgagaccgaccacctgagcatggaggaggaggaccccatgcccagacagatcagcagacagagcagcgtgaccgagagcaccctgtaccccaacccctaccaccagccctacatcagcagaaagtacttcgccaccagacccggcgccatcgagaccgccatggaggacctgaagggccacgtggccgagaccagcggcgagaccatccagggcttctggctgctgaccaagatcgaccactggaacaacgagaaggagagaatcctgctggtgaccgacaagaccctgctgatctgcaagtacgacttcatcatgctgagctgcgtgcagctgcagagaatccccctgagcgccgtgtacagaatctgcctgggcaagttcaccttccccggcatgagcctggacaagagacagggcgagggcctgagaatctactggggcagccccgaggagcagagcctgctgagcagatggaacccctggagcaccgaggtgccctacgccaccttcaccgagcaccccatgaagtacaccagcgagaagttcctggagatctgcaagctgagcggcttcatgagcaagctggtgcccgccatccagaacgcccacaagaacagcaccggcagcggcagaggcaagaagctgatggtgctgaccgagcccatcctgatcgagacctacaccggcctgatgagcttcatcggcaacagaaacaagctgggctacagcctggccagaggcagcatcggcttctag

SEQ ID NO: 10302 - DNA, 1629 bp, Artificial Sequence
  Description of Artificial Sequence: Synthetic coding sequence
atggccgccgccgccggcgccgccgccgcccccggcagcagagagccccaggacagacccgagtgcggcgccggccaccccggccccagatactacagacaccccgagagatggctgctgagacccgaggccttcctgggccccctgagaaccagagcccccagcgccgaggacagccagagagagagacccgccgccagaagcggccccgccatgagcagaagagtggtgagacagagcaagttcagacacgtgttcggccaggccgccaaggccgaccaggcctacgaggacatcagagtgagcaaggtgacctgggacagcagcttctgcgccgtgaaccccaagttcctggccatcatcgtggaggccggcggcggcggcgccttcatcgtgctgcccctggccaagaccggcagagtggacaagaactaccccctggtgaccggccacaccgcccccgtgctggacatcgactggtgcccccacaacgacaacgtgatcgccagcgccagcgacgacaccaccatcatggtgtggcagatccccgactacacccccatgagaaacatcaccgagcccatcatcaccctggagggccacagcaagagagtgggcatcctgagctggcaccccaccgccagaaacgtgctgctgagcgccggcggcgacaacgtgatcatcatctggaacgtgggcaccggcgaggtgctgctgagcctggacgacatgcaccccgacgtgatccacagcgtgtgctggaacagcaacggcagcctgctggccaccacctgcaaggacaagaccctgagaatcatcgaccccagaaagggccaggtggtggccgagagattcgccgcccacgagggcatgagacccatgagagccgtgttcaccagacagggccacatcttcaccaccggcttcaccagaatgagccagagagagctgggcctgtgggaccccaacaacttcgaggagcccgtggccctgcaggagatggacaccagcaacggcgtgctgctgcccttctacgaccccgacagcagcatcgtgtacctgtgcggcaagggcgacagcagcatcagatacttcgagatcaccgacgagccccccttcgtgcactacctgaacaccttcagcagcaaggagccccagagaggcatgggcttcatgcccaagagaggcctggacgtgagcaagtgcgagatcgccagattctacaagctgcacgagagaaagtgcgagcccatcatcatgaccgtgcccagaaagagcgacctgttccaggacgacctgtaccccgacacccccggccccgagcccgccctggaggccgacgagtggctgagcggccaggacgccgagcccgtgctgatcagcctgagagacggctacgtgccccccaagcacagagagctgagagtgaccaagagaaacatcctggacgtgagaccccccagcggccccagaagaagccagagcgccagcgacgcccccctgagccagcacaccctggagaccctgctggaggagatcaaggccctgagagagagagtgcaggcccaggagcagagaatcaccgccctggagaacatgctgtgcgagctggtggacggcaccgactag

SEQ ID NO: 10303 - DNA, 2550 bp, Artificial Sequence
  Description of Artificial Sequence: Synthetic coding sequence
atgagcgacaccagaagaagagtgaaggtgtacaccctgaacgaggacagacagtgggacgacagaggcaccggccacgtgagcagcacctacgtggaggagctgaagggcatgagcctgctggtgagagccgagagcgacggcagcctgctgctggagagcaagatcaaccccaacaccgcctaccagaagcagcaggacaccctgatcgtgtggagcgaggccgagaactacgacctggccctgagcttccaggagaaggccggctgcgacgagatctgggagaagatctgccaggtgcagggcaaggaccccagcgtggaggtgacccaggacctgatcgacgagagcgaggaggagagattcgaggagatgcccgagaccagccacctgatcgacctgcccacctgcgagctgaacaagctggaggagatcgccgacctggtgaccagcgtgctgagcagccccatcagaagagagaagctggccctggccctggagaacgagggctacatcaagaagctgctgcagctgttccaggcctgcgagaacctggagaacaccgagggcctgcaccacctgtacgagatcatcagaggcatcctgttcctgaacaaggccaccctgttcgaggtgatgttcagcgacgagtgcatcatggacgtggtgggctgcctggagtacgaccccgccctggcccagcccaagagacacagagagttcctgaccaagaccgccaagttcaaggaggtgatccccatcaccgacagcgagctgagacagaagatccaccagacctacagagtgcagtacatccaggacatcatcctgcccacccccagcgtgttcgaggagaacttcctgagcaccctgaccagcttcatcttcttcaacaaggtggagatcgtgagcatgctgcaggaggacgagaagttcctgagcgaggtgttcgcccagctgaccgacgaggccaccgacgacgacaagagaagagagctggtgaacttcttcaaggagttctgcgccttcagccagaccctgcagccccagaacagagacgccttcttcaagaccctggccaagctgggcatcctgcccgccctggagatcgtgatgggcatggacgacctgcaggtgagaagcgccgccaccgacatcttcagctacctggtggagttcagccccagcatggtgagagagttcgtgatgcaggaggcccagcagagcgacgacgacatcctgctgatcaacgtggtgatcgagcagatgatctgcgacaccgaccccgagctgggcggcgccgtgcagctgatgggcctgctgagaaccctgatcgaccccgagaacatgctggccaccaccaacaagaccgagaagagcgagttcctgaacttcttctacaaccactgcatgcacgtgctgaccgcccccctgctgaccaacaccagcgaggacaagtgcgagaaggacttcttcctgaagcactacagatacagctggagcttcatctgcacccccagccacagccacagccacagcacccccagcagcagcatcagccaggacaacatcgtgggcagcaacaagaacaacaccatctgccccgacaactaccagaccgcccagctgctggccctgatcctggagctgctgaccttctgcgtggagcaccacacctaccacatcaagaactacatcatgaacaaggacctgctgagaagagtgctggtgctgatgaacagcaagcacaccttcctggccctgtgcgccctgagattcatgagaagaatcatcggcctgaaggacgagttctacaacagatacatcaccaagggcaacctgttcgagcccgtgatcaacgccctgctggacaacggcaccagatacaacctgctgaacagcgccgtgatcgagctgttcgagttcatcagagtggaggacatcaagagcctgaccgcccacatcgtggagaacttctacaaggccctggagagcatcgagtacgtgcagaccttcaagggcctgaagaccaagtacgagcaggagaaggacagacagaaccagaagctgaacagcgtgcccagcatcctgagaagcaacagattcagaagagacgccaaggccctggaggaggacgaggagatgtggttcaacgaggacgaggaggaggagggcaaggccgtggtggcccccgtggagaagcccaagcccgaggacgacttccccgacaactacgagaagttcatggagaccaagaaggccaaggagagcgaggacaaggagaacctgcccaagagaaccagccccggcggcttcaagttcaccttcagccacagcgccagcgccgccaacggcaccaacagcaagagcgtggtggcccagatcccccccgccaccagcaacggcagcagcagcaagaccaccaacctgcccaccagcgtgaccgccaccaagggcagcctggtgggcctggtggactaccccgacgacgaggaggaggacgaggaggaggagagcagccccagaaagagacccagactgggcagctag

SEQ ID NO: 10304 - DNA, 669 bp, Artificial Sequence
  Description of Artificial Sequence: Synthetic coding sequence
atgggcgacatccccgccgtgggcctgagcagctggaaggccagccccggcaaggtgaccgaggccgtgaaggaggccatcgacgccggctacagacacttcgactgcgcctacttctaccacaacgagagagaggtgggcgccggcatcagatgcaagatcaaggagggcgccgtgagaagagaggacctgttcatcgccaccaagctgtggtgcacctgccacaagaagagcctggtggagaccgcctgcagaaagagcctgaaggccctgaagctgaactacctggacctgtacctgatccactggcccatgggcttcaagcccccccaccccgagtggatcatgagctgcagcgagctgagcttctgcctgagccaccccagagtgcaggacctgcccctggacgagagcaacatggtgatccccagcgacaccgacttcctggacacctgggagatcctgatcagattccagatccagagaaacgtgatcgtgatccccggcagcatcacccccagccacatcaaggagaacatccaggtgttcgacttcgagctgacccagcacgacatggacaacatcctgagcctgaacagaaacctgagactggccatgttccccatcaccaagaaccacaaggactaccccttccacatcgagtactag

SEQ ID NO: 10305 - DNA, 1080 bp, Artificial Sequence
  Description of Artificial Sequence: Synthetic coding sequence
atgcccaaccccagcagcaccagcagcccctaccccctgcccgaggagatcagaaacctgctggccgacgtggagaccttcgtggccgacatcctgaagggcgagaacctgagcaagaaggccaaggagaagagagagagcctgatcaagaagatcaaggacgtgaagagcatctacctgcaggagttccaggacaagggcgacgccgaggacggcgaggagtacgacgaccccttcgccggcccccccgacaccatcagcctggccagcgagagatacgacaaggacgacgaggcccccagcgacggcgcccagttcccccccatcgccgcccaggacctgcccttcgtgctgaaggccggctacctggagaagagaagaaaggaccacagcttcctgggcttcgagtggcagaagagatggtgcgccctgagcaagaccgtgttctactactacggcagcgacaaggacaagcagcagaagggcgagttcgccatcgacggctacagcgtgagaatgaacaacaccctgagaaaggacggcaagaaggactgctgcttcgagatcagcgcccccgacaagagaatctaccagttcaccgccgccagccccaaggacgccgaggagtgggtgcagcagctgaagttcgtgctgcaggacatggagagcgacatcatccccgaggactacgacgagagaggcgagctgtacgacgacgtggaccaccccctgcccatcagcaaccccctgaccagcagccagcccatcgacgacgagatctacgaggagctgcccgaggaggaggaggacagcgcccccgtgaaggtggaggagcagagaaagatgagccaggacagcgtgcaccacaccagcggcgacaagagcaccgactacgccaacttctaccagggcctgtgggactgcaccggcgccttcagcgacgagctgagcttcaagagaggcgacgtgatctacatcctgagcaaggagtacaacagatacggctggtgggtgggcgagatgaagggcgccatcggcctggtgcccaaggcctacatcatggagatgtacgacatctag

SEQ ID NO: 10306 - DNA, 1227 bp, Artificial Sequence
  Description of Artificial Sequence: Synthetic coding sequence
atgaagtgcgagcactgcaccagaaaggagtgcagcaagaagaccaagaccgacgaccaggagaacgtgagcgccgacgcccccagccccgcccaggagaacggcgagaagtgcgacaccagcaagcacaaggtgctggtggtgagcgtgtgcccccagagcctgccctacttcgccgccaagttcaacctgagcgtgaccgacgccagcagaagactgtgcggcttcctgaagagcctgggcgtgcactacgtgttcgacaccaccatcgccgccgacttcagcatcctggagagccagaaggagttcgtgagaagatacagacagcacagcgaggaggagagaaccctgcccatgctgaccagcgcctgccccggctgggtgagatacgccgagagagtgctgggcagacccatcaccgcccacctgtgcaccgccaagagcccccagcaggtgatgggcagcctggtgaaggactacttcgccagacagcagaacctgagccccgagaagatcttccacgtgatcgtggccccctgctacgacaagaagctggaggccctgcaggagagcctgccccccgccctgcacggcagcagaggcgccgactgcgtgctgaccagcggcgagatcgcccagatcatggagcagggcgacctgagcgtgagagacgccgccgtggacaccctgttcggcgacctgaaggaggacaaggtgaccagacacgacggcgccagcagcgacggccacctggcccacatcttcagacacgccgccaaggagctgttcaacgaggacgtggaggaggtgacctacagagccctgagaaacaaggacttccaggaggtgaccctggagaagaacggcgaggtggtgctgagattcgccgccgcctacggcttcagaaacatccagaacatgatcctgaagctgaagaagggcaagttccccttccacttcgtggaggtgctggcctgcgccggcggctgcctgaacggcagaggccaggcccagacccccgacggccacgccgacaaggccctgctgagacagatggagggcatctacgccgacatccccgtgagaagacccgagagcagcgcccacgtgcaggagctgtaccaggagtggctggagggcatcaacagccccaaggccagagaggtgctgcacaccacctaccagagccaggagagaggcacccacagcctggacatcaagtggtag

SEQ ID NO: 10307 - DNA, 1104 bp, Artificial Sequence
  Description of Artificial Sequence: Synthetic coding sequence
atggccctgaacgtggcccccgtgagagacaccaagtggctgaccctggaggtgtgcagacagttccagagaggcacctgcagcagaagcgacgaggagtgcaagttcgcccacccccccaagagctgccaggtggagaacggcagagtgatcgcctgcttcgacagcctgaagggcagatgcagcagagagaactgcaagtacctgcacccccccacccacctgaagacccagctggagatcaacggcagaaacaacctgatccagcagaagaccgccgccgccatgctggcccagcagatgcagttcatgttccccggcacccccctgcaccccgtgcccaccttccccgtgggccccgccatcggcaccaacaccgccatcagcttcgccccctacctggcccccgtgacccccggcgtgggcctggtgcccaccgagatcctgcccaccacccccgtgatcgtgcccggcagcccccccgtgaccgtgcccggcagcaccgccacccagaagctgctgagaaccgacaagctggaggtgtgcagagagttccagagaggcaactgcgccagaggcgagaccgactgcagattcgcccaccccgccgacagcaccatgatcgacaccagcgacaacaccgtgaccgtgtgcatggactacatcaagggcagatgcatgagagagaagtgcaagtacttccacccccccgcccacctgcaggccaagatcaaggccgcccagcaccaggccaaccaggccgccgtggccgcccaggccgccgccgccgccgccaccgtgatggccttcccccccggcgccctgcaccccctgcccaagagacaggccctggagaagagcaacggcaccagcgccgtgttcaaccccagcgtgctgcactaccagcaggccctgaccagcgcccagctgcagcagcacgccgccttcatccccaccggcagcgtgctgtgcatgacccccgccaccagcatcgtgcccatgatgcacagcgccaccagcgccaccgtgagcgccgccaccacccccgccaccagcgtgcccttcgccgccaccgccaccgccaaccagatcatcctgaagtag

SEQ ID NO: 10308 - DNA, 3909 bp, Artificial Sequence
  Description of Artificial Sequence: Synthetic coding sequence
atggccctgagacccggcgccggcagcggcggcggcggcgccgccggcgccggcgccggcagcgccggcggcggcggcttcatgttccccgtggccggcggcatcagacccccccaggccggcctgatgcccatgcagcagcagggcttccccatggtgagcgtgatgcagcccaacatgcagggcatcatgggcatgaactacagcagccagatgagccagggccccatcgccatgcaggccggcatccccatgggccccatgcccgccgccggcatgccctacctgggccaggcccccttcctgggcatgagaccccccggcccccagtacacccccgacatgcagaagcagttcgccgaggagcagcagaagagattcgagcagcagcagaagctgctggaggaggagagaaagagaagacagttcgaggagcagaagcagaagctgagactgctgagcagcgtgaagcccaagaccggcgagaagagcagagacgacgccctggaggccatcaagggcaacctggacggcttcagcagagacgccaagatgcaccccacccccgccagccaccccaagaagcccggccccagcctggaggagaagttcctggtgagctgcgacatcagcaccagcggccaggagcagatcaagctgaacaccagcgaggtgggccacaaggccctgggccccggcagcagcaagaagtaccccagcctgatggccagcaacggcgtggccgtggacggctgcgtgagcggcaccaccaccgccgaggccgagaacaccagcgaccagaacctgagcatcgaggagagcggcgtgggcgtgttccccagccaggaccccgcccagcccagaatgcccccctggatctacaacgagagcctggtgcccgacgcctacaagaagatcctggagaccaccatgacccccaccggcatcgacaccgccaagctgtaccccatcctgatgagcagcggcctgcccagagagaccctgggccagatctgggccctggccaacagaaccacccccggcaagctgaccaaggaggagctgtacaccgtgctggccatgatcgccgtgacccagagaggcgtgcccgccatgagccccgacgccctgaaccagttccccgccgcccccatccccaccctgagcggcttcagcatgaccctgcccacccccgtgagccagcccaccgtgatccccagcggccccgccggcagcatgcccctgagcctgggccagcccgtgatgggcatcaacctggtgggccccgtgggcggcgccgccgcccaggccagcagcggcttcatccccacctaccccgccaaccaggtggtgaagcccgaggaggacgacttccaggacttccaggacgccagcaagagcggcagcctggacgacagcttcagcgacttccaggagctgcccgccagcagcaagaccagcaacagccagcacggcaacagcgcccccagcctgctgatgcccctgcccggcaccaaggccctgcccagcatggacaagtacgccgtgttcaagggcatcgccgccgacaagagcagcgagaacaccgtgccccccggcgaccccggcgacaagtacagcgccttcagagagctggagcagaccgccgagaacaagcccctgggcgagagcttcgccgagttcagaagcgccggcaccgacgacggcttcaccgacttcaagaccgccgacagcgtgagccccctggagccccccaccaaggacaagaccttcccccccagcttccccagcggcaccatccagcagaagcagcagacccaggtgaagaaccccctgaacctggccgacctggacatgttcagcagcgtgaactgcagcagcgagaagcccctgagcttcagcgccgtgttcagcaccagcaagagcgtgagcaccccccagagcaccggcagcgccgccaccatgaccgccctggccgccaccaagaccagcagcctggccgacgacttcggcgagttcagcctgttcggcgagtacagcggcctggcccccgtgggcgagcaggacgacttcgccgacttcatggccttcagcaacagcagcatcagcagcgagcagaagcccgacgacaagtacgacgccctgaaggaggaggccagccccgtgcccctgaccagcaacgtgggcagcaccgtgaagggcggccagaacagcaccgccgccagcaccaagtacgacgtgttcagacagctgagcctggagggcagcggcctgggcgtggaggacctgaaggacaacacccccagcggcaagagcgacgacgacttcgccgacttccacagcagcaagttcagcagcatcaacagcgacaagagcctgggcgagaaggccgtggccttcagacacaccaaggaggacagcgccagcgtgaagagcctggacctgcccagcatcggcggcagcagcgtgggcaaggaggacagcgaggacgccctgagcgtgcagttcgacatgaagctggccgacgtgggcggcgacctgaagcacgtgatgagcgacagcagcctggacctgcccaccgtgagcggccagcacccccccgccgccgacatcgaggacctgaagtacgccgccttcggcagctacagcagcaacttcgccgtgagcaccctgaccagctacgactggagcgacagagacgacgccacccagggcagaaagctgagccccttcgtgctgagcgccggcagcggcagccccagcgccaccagcatcctgcagaagaaggagaccagcttcggcagcagcgagaacatcaccatgaccagcctgagcaaggtgaccaccttcgtgagcgaggacgccctgcccgagaccaccttccccgccctggccagcttcaaggacaccatcccccagaccagcgagcagaaggagtacgagaacagagactacaaggacttcaccaagcaggacctgcccaccgccgagagaagccaggaggccacctgccccagccccgccagcagcggcgccagccaggagacccccaacgagtgcagcgacgacttcggcgagttccagagcgagaagcccaagatcagcaagttcgacttcctggtggccaccagccagagcaagatgaagagcagcgaggagatgatcaagagcgagctggccaccttcgacctgagcgtgcagggcagccacaagagaagcctgagcctgggcgacaaggagatcagcagaagcagccccagccccgccctggagcagcccttcagagacagaagcaacaccctgaacgagaagcccgccctgcccgtgatcagagacaagtacaaggacctgaccggcgaggtggaggagaacgagagatacgcctacgagtggcagagatgcctgggcagcgccctgaacgtgatcaagaaggccaacgacaccctgaacggcatcagcagcagcagcgtgtgcaccgaggtgatccagagcgcccagggcatggagtacctgctgggcgtggtggaggtgtacagagtgaccaagagagtggagctgggcatcaaggccaccgccgtgtgcagcgagaagctgcagcagctgctgaaggacatcgacaaggtgtggaacaacctgatcggcttcatgagcctggccaccctgacccccgacgagaacagcctggacttcagcagctgcatgctgagacccggcatcaagaacgcccaggagctggcctgcggcgtgtgcctgctgaacgtggacagcagaagcagagccttcaacagcgagaccgacagcttcaagctggcctacggcggccaccagtaccacgccagctgcgccaacttctggatcaactgcgtggagcccaagccccccggcctggtgctgcccgacctgctgtag

SEQ ID NO: 10309 - DNA, 1011 bp, Artificial Sequence
  Description of Artificial Sequence: Synthetic coding sequence
atggagagcgtgctgagcaagtacgaggaccagatcaccatcttcaccgactacctggaggagtaccccgacaccgacgagctggtgtggatcctgggcaagcagcacctgctgaagaccgagaagagcaagctgctgagcgacatcagcgccagactgtggttcacctacagaagaaagttcagccccatcggcggcaccggccccagcagcgacgccggctggggctgcatgctgagatgcggccagatgatgctggcccaggccctgatctgcagacacctgggcagagactggagctgggagaagcagaaggagcagcccaaggagtaccagagaatcctgcagtgcttcctggacagaaaggactgctgctacagcatccaccagatggcccagatgggcgtgggcgagggcaagagcatcggcgagtggttcggccccaacaccgtggcccaggtgctgaagaagctggccctgttcgacgagtggaacagcctggccgtgtacgtgagcatggacaacaccgtggtgatcgaggacatcaagaagatgtgcagagtgctgcccctgagcgccgacaccgccggcgacagaccccccgacagcctgaccgccagcaaccagagcgacgagctgatcttcctggacccccacaccacccagaccttcgtggacaccgaggagaacggcaccgtgaacgaccagaccttccactgcctgcagagcccccagagaatgaacatcctgaacctggaccccagcgtggccctgggcttcttctgcaaggaggagaaggacttcgacaactggtgcagcctggtgcagaaggagatcctgaaggagaacctgagaatgttcgagctggtgcagaagcaccccagccactggccccccttcgtgccccccgccaagcccgaggtgaccaccaccggcgccgagttcatcgacagcaccgagcagctggaggagttcgacctggaggaggacttcgagatcctgagcgtgtag

SEQ ID NO: 10310 - DNA, 3018 bp, Artificial Sequence
  Description of Artificial Sequence: Synthetic coding sequence
atgctgagaaccgccggcagagacggcctgtgcagactgagcacctacctggaggagctggaggccgtggagctgaagaagttcaagctgtacctgggcaccgccaccgagctgggcgagggcaagatcccctggggcagcatggagaaggccggccccctggagatggcccagctgctgatcacccacttcggccccgaggaggcctggagactggccctgagcaccttcgagagaatcaacagaaaggacctgtgggagagaggccagagagaggacctggtgagagacaccccccccggcggccccagcagcctgggcaaccagagcacctgcctgctggaggtgagcctggtgacccccagaaaggacccccaggagacctacagagactacgtgagaagaaagttcagactgatggaggacagaaacgccagactgggcgagtgcgtgaacctgagccacagatacaccagactgctgctggtgaaggagcacagcaaccccatgcaggtgcagcagcagctgctggacaccggcagaggccacgccagaaccgtgggccaccaggccagccccatcaagatcgagaccctgttcgagcccgacgaggagagacccgagccccccagaaccgtggtgatgcagggcgccgccggcatcggcaagagcatgctggcccacaaggtgatgctggactgggccgacggcaagctgttccagggcagattcgactacctgttctacatcaactgcagagagatgaaccagagcgccaccgagtgcagcatgcaggacctgatcttcagctgctggcccgagcccagcgcccccctgcaggagctgatcagagtgcccgagagactgctgttcatcatcgacggcttcgacgagctgaagcccagcttccacgacccccagggcccctggtgcctgtgctgggaggagaagagacccaccgagctgctgctgaacagcctgatcagaaagaagctgctgcccgagctgagcctgctgatcaccaccagacccaccgccctggagaagctgcacagactgctggagcaccccagacacgtggagatcctgggcttcagcgaggccgagagaaaggagtacttctacaagtacttccacaacgccgagcaggccggccaggtgttcaactacgtgagagacaacgagcccctgttcaccatgtgcttcgtgcccctggtgtgctgggtggtgtgcacctgcctgcagcagcagctggagggcggcggcctgctgagacagaccagcagaaccaccaccgccgtgtacatgctgtacctgctgagcctgatgcagcccaagcccggcgcccccagactgcagcccccccccaaccagagaggcctgtgcagcctggccgccgacggcctgtggaaccagaagatcctgttcgaggagcaggacctgagaaagcacggcctggacggcgaggacgtgagcgccttcctgaacatgaacatcttccagaaggacatcaactgcgagagatactacagcttcatccacctgagcttccaggagttcttcgccgccatgtactacatcctggacgagggcgagggcggcgccggccccgaccaggacgtgaccagactgctgaccgagtacgccttcagcgagagaagcttcctggccctgaccagcagattcctgttcggcctgctgaacgaggagaccagaagccacctggagaagagcctgtgctggaaggtgagcccccacatcaagatggacctgctgcagtggatccagagcaaggcccagagcgacggcagcaccctgcagcagggcagcctggagttcttcagctgcctgtacgagatccaggaggaggagttcatccagcaggccctgagccacttccaggtgatcgtggtgagcaacatcgccagcaagatggagcacatggtgagcagcttctgcctgaagagatgcagaagcgcccaggtgctgcacctgtacggcgccacctacagcgccgacggcgaggacagagccagatgcagcgccggcgcccacaccctgctggtgcagctgagacccgagagaaccgtgctgctggacgcctacagcgagcacctggccgccgccctgtgcaccaaccccaacctgatcgagctgagcctgtacagaaacgccctgggcagcagaggcgtgaagctgctgtgccagggcctgagacaccccaactgcaagctgcagaacctgagactgaagagatgcagaatcagcagcagcgcctgcgaggacctgagcgccgccctgatcgccaacaagaacctgaccagaatggacctgagcggcaacggcgtgggcttccccggcatgatgctgctgtgcgagggcctgagacacccccagtgcagactgcagatgatccagctgagaaagtgccagctggagagcggcgcctgccaggagatggccagcgtgctgggcaccaacccccacctggtggagctggacctgaccggcaacgccctggaggacctgggcctgagactgctgtgccagggcctgagacaccccgtgtgcagactgagaaccctgtggctgaagatctgcagactgaccgccgccgcctgcgacgagctggccagcaccctgagcgtgaaccagagcctgagagagctggacctgagcctgaacgagctgggcgacctgggcgtgctgctgctgtgcgagggcctgagacaccccacctgcaagctgcagaccctgagactgggcatctgcagactgggcagcgccgcctgcgagggcctgagcgtggtgctgcaggccaaccacaacctgagagagctggacctgagcttcaacgacctgggcgactggggcctgtggctgctggccgagggcctgcagcaccccgcctgcagactgcagaagctgtggctgttcggcatggacctgaacaagatgacccacagcagactggccgccctgagagtgaccaagccctacctggacatcggctgctag

SEQ ID NO: 10311 - DNA, 618 bp, Artificial Sequence
  Description of Artificial Sequence: Synthetic coding sequence
atggtgagcagctgctgcggcagcgtgtgcagcgaccagggctgcggcctggagacctgctgcagacccagctgctgccagaccacctgctgcagaaccacctgctgcagacccagctgctgcgtgagcagctgctgcagaccccagtgctgccagagcgtgtgctgccagcccacctgctgcagacccagctgctgccccagctgctgccagaccacctgctgcagaaccacctgctgcagacccagctgctgcgtgagcagctgctgcagaccccagtgctgccagagcgtgtgctgccagcccacctgctgcagacccagctgcagcatcagcagctgctgcagacccagctgctgcgtgagcagatgctgcagaagccagtgctgccagagcgtgtgctgccagcccacctgctgcagacccagctgctgcatcagcagctgctgcagacccagctgctgcgagagcagctgctgcagaccctgctgctgcagaccctgctgctgcctgagacccgtgtgcggcagagtgagctgccacaccacctgctacagacccacctgcgtgatcagcacctgccccagacccctgtgctgcgccagcagctgctgctag

SEQ ID NO: 10312 - DNA, 573 bp, Artificial Sequence
  Description of Artificial Sequence: Synthetic coding sequence
atgcagagctgcgagagcagcggcgacagcgccgacgaccccctgagcagaggcctgagaagaagaggccagcccagagtggtggtgatcggcgccggcctggccggcctggccgccgccaaggccctgctggagcagggcttcaccgacgtgaccgtgctggaggccagcagccacatcggcggcagagtgcagagcgtgaagctgggccacgccaccttcgagctgggcgccacctggatccacggcagccacggcaaccccatctaccacctggccgaggccaacggcctgctggaggagaccaccgacggcgagagaagcgtgggcagaatcagcctgtacagcaagaacggcgtggcctgctacctgaccaaccacggcagaagaatccccaaggacgtggtggaggagttcagcgacctgtacaacgagcccatgcaggtgctgttcagcggcgaggccacccacagaaagtactacagcaccacccacggcgccctgctgagcggccagagagaggccgccagactgatcgagatgtacagagacctgttccagcagggcacctag

SEQ ID NO: 10313 - DNA, 3945 bp, Artificial Sequence
  Description of Artificial Sequence: Synthetic coding sequence
atggccctgagacccggcgccggcagcggcggcggcggcgccgccggcgccggcgccggcagcgccggcggcggcggcttcatgttccccgtggccggcggcatcagacccccccaggccggcctgatgcccatgcagcagcagggcttccccatggtgagcgtgatgcagcccaacatgcagggcatcatgggcatgaactacagcagccagatgagccagggccccatcgccatgcaggccggcatccccatgggccccatgcccgccgccggcatgccctacctgggccaggcccccttcctgggcatgagaccccccggcccccagtacacccccgacatgcagaagcagttcgccgaggagcagcagaagagattcgagcagcagcagaagctgctggaggaggagagaaagagaagacagttcgaggagcagaagcagaagctgagactgctgagcagcgtgaagcccaagaccggcgagaagagcagagacgacgccctggaggccatcaagggcaacctggacggcttcagcagagacgccaagatgcaccccacccccgccagccaccccaagaagcccggccccagcctggaggagaagttcctggtgagctgcgacatcagcaccagcggccaggagcagatcaagctgaacaccagcgaggtgggccacaaggccctgggccccggcagcagcaagaagtaccccagcctgatggccagcaacggcgtggccgtggacggctgcgtgagcggcaccaccaccgccgaggccgagaacaccagcgaccagaacctgagcatcgaggagagcggcgtgggcgtgttccccagccaggaccccgcccagcccagaatgcccccctggatctacaacgagagcctggtgcccgacgcctacaagaagatcctggagaccaccatgacccccaccggcatcgacaccgccaagctgtaccccatcctgatgagcagcggcctgcccagagagaccctgggccagatctgggccctggccaacagaaccacccccggcaagctgaccaaggaggagctgtacaccgtgctggccatgatcgccgtgacccagagaggcgtgcccgccatgagccccgacgccctgaaccagttccccgccgcccccatccccaccctgagcggcttcagcatgaccctgcccacccccgtgagccagcccaccgtgatccccagcggccccgccggcagcatgcccctgagcctgggccagcccgtgatgggcatcaacctggtgggccccgtgggcggcgccgccgcccaggccagcagcggcttcatccccacctaccccgccaaccaggtggtgaagcccgaggaggacgacttccaggacttccaggacgccagcaagagcggcagcctggacgacagcttcagcgacttccaggagctgcccgccagcagcaagaccagcaacagccagcacggcaacagcgcccccagcctgctgatgcccctgcccggcaccaaggccctgcccagcatggacaagtacgccgtgttcaagggcatcgccgccgacaagagcagcgagaacaccgtgccccccggcgaccccggcgacaagtacagcgccttcagagagctggagcagaccgccgagaacaagcccctgggcgagagcttcgccgagttcagaagcgccggcaccgacgacggcttcaccgacttcaagaccgccgacagcgtgagccccctggagccccccaccaaggacaagaccttcccccccagcttccccagcggcaccatccagcagaagcagcagacccaggtgaagaaccccctgaacctggccgacctggacatgttcagcagcgtgaactgcagcagcgagaagcccctgagcttcagcgccgtgttcagcaccagcaagagcgtgagcaccccccagagcaccggcagcgccgccaccatgaccgccctggccgccaccaagaccagcagcctggccgacgacttcggcgagttcagcctgttcggcgagtacagcggcctggcccccgtgggcgagcaggacgacttcgccgacttcatggccttcagcaacagcagcatcagcagcgagcagaagcccgacgacaagtacgacgccctgaaggaggaggccagccccgtgcccctgaccagcaacgtgggcagcaccgtgaagggcggccagaacagcaccgccgccagcaccaagtacgacgtgttcagacagctgagcctggagggcagcggcctgggcgtggaggacctgaaggacaacacccccagcggcaagagcgacgacgacttcgccgacttccacagcagcaagttcagcagcatcaacagcgacaagagcctgggcgagaaggccgtggccttcagacacaccaaggaggacagcgccagcgtgaagagcctggacctgcccagcatcggcggcagcagcgtgggcaaggaggacagcgaggacgccctgagcgtgcagttcgacatgaagctggccgacgtgggcggcgacctgaagcacgtgatgagcgacagcagcctggacctgcccaccgtgagcggccagcacccccccgccgccgacatcgaggacctgaagtacgccgccttcggcagctacagcagcaacttcgccgtgagcaccctgaccagctacgactggagcgacagagacgacgccacccagggcagaaagctgagccccttcgtgctgagcgccggcagcggcagccccagcgccaccagcatcctgcagaagaaggagaccagcttcggcagcagcgagaacatcaccatgaccagcctgagcaaggtgaccaccttcgtgagcgaggacgccctgcccgagaccaccttccccgccctggccagcttcaaggacaccatcccccagaccagcgagcagaaggagtacgagaacagagactacaaggacttcaccaagcaggacctgcccaccgccgagagaagccaggaggccacctgccccagccccgccagcagcggcgccagccaggagacccccaacgagtgcagcgacgacttcggcgagttccagagcgagaagcccaagatcagcaagttcgacttcctggtggccaccagccagagcaagatgaagagcagcgaggagatgatcaagagcgagctggccaccttcgacctgagcgtgcagggcagccacaagagaagcctgagcctgggcgacaaggagatcagcagaagcagccccagccccgccctggagcagcccttcagagacagaagcaacaccctgaacgagaagcccgccctgcccgtgatcagagacaagtacaaggacctgaccggcgaggtggaggagaacgagagatacgcctacgagtggcagagatgcctgggcagcgccctgaacgtgatcaagaaggccaacgacaccctgaacggcatcagcagcagcagcgtgtgcaccgaggtgatccagagcgcccagggcatggagtacctgctgggcgtggtggaggtgtacagagtgaccaagagagtggagctgggcatcaaggccaccgccgtgtgcagcgagaagctgcagcagctgctgaaggacatcgacaaggtgtggaacaacctgatcggcttcatgagcctggccaccctgacccccgacgagaacagcctggacttcagcagctgcatgctgagacccggcatcaagaacgcccaggagctggcctgcggcgtgtgcctgctgaacgtggacagcagaagcagaaaggaggagaagcccgccgaggagcaccccaagaaggccttcaacagcgagaccgacagcttcaagctggcctacggcggccaccagtaccacgccagctgcgccaacttctggatcaactgcgtggagcccaagccccccggcctggtgctgcccgacctgctgtag

SEQ ID NO: 10314 - DNA, 531 bp, Artificial Sequence
  Description of Artificial Sequence: Synthetic coding sequence
atgagcgacgacgacagcagagccagcaccagcagcagcagcagcagcagcagcaaccagcagaccgagaaggagaccaacacccccaagaagaaggagagcaaggtgagcatgagcaagaacagcaagctgctgagcaccagcgccaagagcgccggccccaagggcgacaacatctacgagtggagaagcaccatcctgggcccccccggcagcgtgtacgagggcggcgtgttcttcctggacatcaccttcacccccgagtaccccttcaagccccccaaggtgaccttcagaaccagaatctaccactgcaacatcaacagccagggcgtgatctgcctggacatcctgaaggacaactggagccccgccctgaccatcagcaaggtgctgctgagcatctgcagcctgctgaccgactgcaaccccgccgaccccctggtgggcagcatcgccacccagtacatgaccaacagagccgagcacgacagaatggccagacagtggaccaagagatacgccacctag

SEQ ID NO: 10315 - DNA, 7029 bp, Artificial Sequence
  Description of Artificial Sequence: Synthetic coding sequence
atggacggcgtgagcagcgaggccaacgaggagaacgacaacatcgagagacccgtgagaagaagacacagcagcatcctgaagccccccagaagccccctgcaggacctgagaggcggcaacgagagagtgcaggagagcaacgccctgagaaacaagaagaacagcagaagagtgagcttcgccgacaccatcaaggtgttccagaccgagagccacatgaagatcgtgagaaagagcgagatggagggctgcagcgccatggtgcccagccagctgcagctgctgccccccggcttcaagagattcagctgcctgagcctgcccgagaccgagaccggcgagaacctgctgctgatccagaacaagaagctggaggacaactactgcgagatcaccggcatgaacaccctgctgagcgcccccatccacacccagatgcagcagaaggagttcagcatcatcgagcacaccagagagagaaagcacgccaacgaccagaccgtgatcttcagcgacgagaaccagatggacctgaccagcagccacaccgtgatgatcaccaagggcctgctggacaaccccatcagcgagaagagcaccaagatcgacaccaccagcttcctggccaacctgaagctgcacaccgaggacagcagaatgaagaaggaggtgaacttcagcgtggaccagaacaccagcagcgagaacaagatcgacttcaacgacttcatcaagagactgaagaccggcaagtgcagcgccttccccgacgtgcccgacaaggagaacttcgagatccccatctacagcaaggagcccaacagcgccagcagcacccaccagatgcacgtgagcctgaaggaggacgagaacaacagcaacatcaccagactgttcagagagaaggacgacggcatgaacttcacccagtgccacaccgccaacatccagaccctgatccccaccagcagcgagaccaacagcagagagagcaagggcaacgacatcaccatctacggcaacgacttcatggacctgaccttcaaccacaccctgcagatcctgcccgccaccggcaacttcagcgagatcgagaaccagacccagaacgccatggacgtgaccaccggctacggcaccaaggccagcggcaacaagaccgtgttcaagagcaagcagaacaccgccttccaggacctgagcatcaacagcgccgacaagatccacatcaccagaagccacatcatgggcgccgagacccacatcgtgagccagacctgcaaccaggacgccagaatcctggccatgacccccgagagcatctacagcaaccccagcatccagggctgcaagaccgtgttctacagcagctgcaacgacgccatggagatgaccaagtgcctgagcaacatgagagaggagaagaacctgctgaagcacgacagcaactacgccaagatgtactgcaaccccgacgccatgagcagcctgaccgagaagaccatctacagcggcgaggagaacatggacatcaccaagagccacaccgtggccatcgacaaccagatcttcaagcaggaccagagcaacgtgcagatcgccgccgcccccacccccgagaaggagatgatgctgcagaacctgatgaccaccagcgaggacggcaagatgaacgtgaactgcaacagcgtgccccacgtgagcaaggagagaatccagcagagcctgagcaaccccctgagcatcagcctgaccgacagaaagaccgagctgctgagcggcgagaacatggacctgaccgagagccacaccagcaacctgggcagccaggtgcccctggccgcctacaacctggcccccgagagcaccagcgagagccacagccagagcaagagcagcagcgacgagtgcgaggagatcaccaagagcagaaacgagcccttccagagaagcgacatcatcgccaagaacagcctgaccgacacctggaacaaggacaaggactgggtgctgaagatcctgccctacctggacaaggacagcccccagagcgccgactgcaaccaggagatcgccaccagccacaacatcgtgtactgcggcggcgtgctggacaagcagatcaccaacagaaacaccgtgagctgggagcagagcctgttcagcaccaccaagcccctgttcagcagcggccagttcagcatgaagaaccacgacaccgccatcagcagccacaccgtgaagagcgtgctgggccagaacagcaagctggccgagcccctgagaaagagcctgagcaaccccacccccgactactgccacgacaagatgatcatctgcagcgaggaggagcagaacatggacctgaccaagagccacaccgtggtgatcggcttcggccccagcgagctgcaggagctgggcaagaccaacctggagcacaccaccggccagctgaccaccatgaacagacagatcgccgtgaaggtggagaagtgcggcaagagccccatcgagaagagcggcgtgctgaagagcaactgcatcatggacgtgctggaggacgagagcgtgcagaagcccaagttccccaaggagaagcagaacgtgaagatctggggcagaaagagcgtgggcggccccaagatcgacaagaccatcgtgttcagcgaggacgacaagaacgacatggacatcaccaagagctacaccatcgagatcaaccacagacccctgctggagaagagagactgccacctggtgcccctggccggcaccagcgagaccatcctgtacacctgcagacaggacgacatggagatcaccagaagccacaccaccgccctggagtgcaagaccgtgagccccgacgagatcaccaccagacccatggacaagaccgtggtgttcgtggacaaccacgtggagctggagatgaccgagagccacaccgtgttcatcgactaccaggagaaggagagaaccgacagacccaacttcgagctgagccagagaaagagcctgggcacccccaccgtgatctgcacccccaccgaggagagcgtgttcttccccggcaacggcgagagcgacagactggtggccaacgacagccagctgacccccctggaggagtggagcaacaacagaggccccgtggaggtggccgacaacatggagctgagcaagagcgccacctgcaagaacatcaaggacgtgcagagccccggcttcctgaacgagcccctgagcagcaagagccagagaagaaagagcctgaagctgaagaacgacaagaccatcgtgttcagcgagaaccacaagaacgacatggacatcacccagagctgcatggtggagatcgacaacgagagcgccctggaggacaaggaggacttccacctggccggcgccagcaagaccatcctgtacagctgcggccaggacgacatggagatcaccagaagccacaccaccgccctggagtgcaagaccctgctgcccaacgagatcgccatcagacccatggacaagaccgtgctgttcaccgacaactacagcgacctggaggtgaccgacagccacaccgtgttcatcgactgccaggccaccgagaagatcctggaggagaaccccaagttcggcatcggcaagggcaagaacctgggcgtgagcttccccaaggacaacagctgcgtgcaggagatcgccgagaagcaggccctggccgtgggcaacaagatcgtgctgcacaccgagcagaagcagcagctgttcgccgccaccaacagaaccaccaacgagatcatcaagttccacagcgccgccatggacgagaaggtgatcggcaaggtggtggaccaggcctgcaccctggagaaggcccaggtggagagctgccagctgaacaacagagacagaagaaacgtggacttcaccagcagccacgccaccgccgtgtgcggcagcagcgacaactacagctgcctgcccaacgtgatcagctgcaccgacaacctggagggcagcgccatgctgctgtgcgacaaggacgaggagaaggccaactactgccccgtgcagaacgacctggcctacgccaacgacttcgccagcgagtactacctggagagcgagggccagcccctgagcgccccctgccccctgctggagaaggaggaggtgatccagaccagcaccaagggccagctggactgcgtgatcaccctgcacaaggaccaggacctgatcaaggaccccagaaacctgctggccaaccagaccctggtgtacagccaggacctgggcgagatgaccaagctgaacagcaagagagtgagcttcaagctgcccaaggaccagatgaaggtgtacgtggacgacatctacgtgatcccccagccccacttcagcaccgaccagccccccctgcccaagaagggccagagcagcatcaacaaggaggaggtgatcctgagcaaggccggcaacaagagcctgaacatcatcgagaacagcagcgcccccatctgcgagaacaagcccaagatcctgaacagcgaggagtggttcgccgccgcctgcaagaaggagctgaaggagaacatccagaccaccaactacaacaccgccctggacttccacagcaacagcgacgtgaccaagcaggtgatccagacccacgtgaacgccggcgaggcccccgaccccgtgatcaccagcaacgtgccctgcttccacagcatcaagcccaacctgaacaacctgaacggcaagaccggcgagttcctggccttccagaccgtgcacctgccccccctgcccgagcagctgctggagctgggcaacaaggcccacaacgacatgcacatcgtgcaggccaccgagatccacaacatcaacatcatcagcagcaacgccaaggacagcagagacgaggagaacaagaagagccacaacggcgccgagaccaccagcctgccccccaagaccgtgttcaaggacaaggtgagaagatgcagcctgggcatcttcctgcccagactgcccaacaagagaaactgcagcgtgaccggcatcgacgacctggagcagatccccgccgacaccaccgacatcaaccacctggagacccagcccgtgagcagcaaggacagcggcatcggcagcgtggccggcaagctgaacctgagccccagccagtacatcaacgaggagaacctgcccgtgtaccccgacgagatcaacagcagcgacagcatcaacatcgagaccgaggagaaggccctgatcgagacctaccagaaggagatcagcccctacgagaacaagatgggcaagacctgcaacagccagaagagaacctgggtgcaggaggaggaggacatccacaaggagaagaagatcagaaagaacgagatcaagttcagcgacaccacccaggacagagagatcttcgaccaccacaccgaggaggacatcgacaagagcgccaacagcgtgctgatcaagaacctgagcagaacccccagcagctgcagcagcagcctggacagcatcaaggccgacggcaccagcctggacttcagcacctacagaagcagccagatggagagccagttcctgagagacaccatctgcgaggagagcctgagagagaagctgcaggacggcagaatcaccatcagagagttcttcatcctgctgcaggtgcacatcctgatccagaagcccagacagagcaacctgcccggcaacttcaccgtgaacaccccccccacccccgaggacctgatgctgagccagtacgtgtacagacccaagatccagatctacagagaggactgcgaggccagaagacagaagatcgaggagctgaagctgagcgccagcaaccaggacaagctgctggtggacatcaacaagaacctgtgggagaagatgagacactgcagcgacaaggagctgaaggccttcggcatctacctgaacaagatcaagagctgcttcaccaagatgaccaaggtgttcacccaccagggcaaggtggccctgtacggcaagctggtgcagagcgcccagaacgagagagagaagctgcagatcaagatcgacgagatggacaagatcctgaagaagatcgacaactgcctgaccgagatggagaccgagaccaagaacctggaggacgaggagaagaacaaccccgtggaggagtgggacagcgagatgagagccgccgagaaggagctggagcagctgaagaccgaggaggaggagctgcagagaaacctgctggagctggaggtgcagaaggagcagaccctggcccagatcgacttcatgcagaagcagagaaacagaaccgaggagctgctggaccagctgagcctgagcgagtgggacgtggtggagtggagcgacgaccaggccgtgttcaccttcgtgtacgacaccatccagctgaccatcaccttcgaggagagcgtggtgggcttccccttcctggacaagagatacagaaagatcgtggacgtgaacttccagagcctgctggacgaggaccaggccccccccagcagcctgctggtgcacaagctgatcttccagtacgtggaggagaaggagagctggaagaagacctgcaccacccagcaccagctgcccaagatgctggaggagttcagcctggtggtgcaccactgcagactgctgggcgaggagatcgagtacctgaagagatggggccccaactacaacctgatgaacatcgacatcaacaacaacgagctgagactgctgttcagcagcagcgccgccttcgccaagttcgagatcaccctgttcctgagcgcctactaccccagcgtgcccctgcccagcaccatccagaaccacgtgggcaacaccagccaggacgacatcgccaccatcctgagcaaggtgcccctggagaacaactacctgaagaacgtggtgaagcagatctaccaggacctgttccaggactgccacttctaccactag

SEQ ID NO: 10316 - DNA, 1638 bp, Artificial Sequence
  Description of Artificial Sequence: Synthetic coding sequence
atgagcagctgcgtgagcagccagcccagcagcaacagagccgccccccaggacgagctgggcggcagaggcagcagcagcagcgagagccagaagccctgcgaggccctgagaggcctgagcagcctgagcatccacctgggcatggagagcttcatcgtggtgaccgagtgcgagcccggctgcgccgtggacctgggcctggccagagacagacccctggaggccgacggccaggaggtgcccctggacaccagcggcagccaggccagaccccacctgagcggcagaaagctgagcctgcaggagagaagccagggcggcctggccgccggcggcagcctggacatgaacggcagatgcatctgccccagcctgccctacagccccgtgagcagcccccagagcagccccagactgcccagaagacccaccgtggagagccaccacgtgagcatcaccggcatgcaggactgcgtgcagctgaaccagtacaccctgaaggacgagatcggcaagggcagctacggcgtggtgaagctggcctacaacgagaacgacaacacctactacgccatgaaggtgctgagcaagaagaagctgatcagacaggccggcttccccagaagacccccccccagaggcaccagacccgcccccggcggctgcatccagcccagaggccccatcgagcaggtgtaccaggagatcgccatcctgaagaagctggaccaccccaacgtggtgaagctggtggaggtgctggacgaccccaacgaggaccacctgtacatggtgttcgagctggtgaaccagggccccgtgatggaggtgcccaccctgaagcccctgagcgaggaccaggccagattctacttccaggacctgatcaagggcatcgagtacctgcactaccagaagatcatccacagagacatcaagcccagcaacctgctggtgggcgaggacggccacatcaagatcgccgacttcggcgtgagcaacgagttcaagggcagcgacgccctgctgagcaacaccgtgggcacccccgccttcatggcccccgagagcctgagcgagaccagaaagatcttcagcggcaaggccctggacgtgtgggccatgggcgtgaccctgtactgcttcgtgttcggccagtgccccttcatggacgagagaatcatgtgcctgcacagcaagatcaagagccaggccctggagttccccgaccagcccgacatcgccgaggacctgaaggacctgatcaccagaatgctggacaagaaccccgagagcagaatcgtggtgcccgagatcaagatcctggtgaagaccatgatcagaaagagaagcttcggcaaccccttcgagggcagcagaagagaggagagaagcctgagcgcccccggcaacctgctgaccaagaagcccaccagagagtgcgagagcctgagcgagctgaaggaggccagacagagaagacagccccccggccacagacccgcccccagaggcggcggcggcagcgccctggtgagaggcagcccctgcgtggagagctgctgggcccccgcccccggcagccccgccagaatgcaccccctgagacccgaggaggccatggagcccgagtag

SEQ ID NO: 10317 - DNA, 333 bp, Artificial Sequence
  Description of Artificial Sequence: Synthetic coding sequence
atgcccaagagaagctgccccttcgccgacgtggcccccctgcagctgaaggtgagagtgagccagagagagctgagcagaggcgtgtgcgccgagagatacagccaggaggtgttcgaccccagcggcgtggccagcatcgcctgcagcagctgcgtgagagccgtggacggcaaggccgtgtgcggccagtgcgagagagccctgtgcggccagtgcgtgagaacctgctggggctgcggcagcgtggcctgcaccctgtgcggcctggtggactgcagcgacatgtacgagaaggtgctgtgcaccagctgcgccatgttcgagacctag

SEQ ID NO: 10318 - DNA, 2253 bp, Artificial Sequence
  Description of Artificial Sequence: Synthetic coding sequence
atggaggacctgttcgagaccttccaggacgagatgggcttcagcaacatggaggacgacggccccgaggaggaggagagagtggccgagccccaggccaacttcaacaccccccaggccctgagattcgaggagctgctggccaacctgctgaacgagcagcaccagatcgccaaggagctgttcgagcagctgaagatgaagaagcccagcgccaagcagcagaaggaggtggagaaggtgaagccccagtgcaaggaggtgcaccagaccctgatcctggaccccgcccagagaaagagactgcagcagcagatgcagcagcacgtgcagctgctgacccagatccacctgctggccacctgcaaccccaacctgaaccccgaggccagcagcaccagaatctgcctgaaggagctgggcaccttcgcccagagcagcatcgccctgcaccaccagtacaaccccaagttccagaccctgttccagccctgcaacctgatgggcgccatgcagctgatcgaggacttcagcacccacgtgagcatcgactgcagcccccacaagaccgtgaagaagaccgccaacgagttcccctgcctgcccaagcaggtggcctggatcctggccaccagcaaggtgttcatgtaccccgagctgctgcccgtgtgcagcctgaaggccaagaacccccaggacaagatcctgttcaccaaggccgaggacaacctgctggccctgggcctgaagcacttcgagggcaccgagttcctgaaccccctgatcagcaagtacctgctgacctgcaagaccgccagacagctgaccgtgagaatcaagaacctgaacatgaacagagcccccgacaacatcatcaagttctacaagaagaccaagcagctgcccgtgctgggcaagtgctgcgaggagatccagccccaccagtggaagccccccatcgagagagaggagcacagactgcccttctggctgaaggccagcctgcccagcatccaggaggagctgagacacatggccgacggcgccagagaggtgggcaacatgaccggcaccaccgagatcaacagcgaccagggcctggagaaggacaacagcgagctgggcagcgagaccagataccccctgctgctgcccaagggcgtggtgctgaagctgaagcccgtggccgacagattccccaagaaggcctggagacagaagagaagcagcgtgctgaagcccctgctgatccagcccagccccagcctgcagcccagcttcaaccccggcaagacccccgcccagagcacccacagcgaggccccccccagcaagatggtgctgagaatcccccaccccatccagcccgccaccgtgctgcagaccgtgcccggcgtgccccccctgggcgtgagcggcggcgagagcttcgagagccccgccgccctgcccgccatgccccccgaggccagaaccagcttccccctgagcgagagccagaccctgctgagcagcgcccccgtgcccaaggtgatgatgcccagccccgccagcagcatgttcagaaagccctacgtgagaagaagacccagcaagagaagaggcgccagagccttcagatgcatcaagcccgcccccgtgatccaccccgccagcgtgatcttcaccgtgcccgccaccaccgtgaagatcgtgagcctgggcggcggctgcaacatgatccagcccgtgaacgccgccgtggcccagagcccccagaccatccccatcgccaccctgctggtgaaccccaccagcttcccctgccccctgaaccagcccctggtggccagcagcgtgagccccctgatcgtgagcggcaacagcgtgaacctgcccatccccagcacccccgaggacaaggcccacatgaacgtggacatcgcctgcgccgtggccgacggcgagaacgccttccagggcctggagcccaagctggagccccaggagctgagccccctgagcgccaccgtgttccccaaggtggagcacagccccggccccccccccgtggacaagcagtgccaggagggcctgagcgagaacagcgcctacagatggaccgtggtgaagaccgaggagggcagacaggccctggagcccctgccccagggcatccaggagagcctgaacaacagcagccccggcgacctggaggaggtggtgaagatggagcccgaggacgccaccgaggagatcagcggcttcctgtag

SEQ ID NO: 10319 - DNA, 2604 bp, Artificial Sequence
  Description of Artificial Sequence: Synthetic coding sequence
atgcaggccgaggccgccgactggttcagcagcatgcccttccagaagcacgtgtactaccccctggccagcggccccgagggccccgacgtggccgtggccgccgccgccgccggcgccgccagcatggcctgcgccccccccagcgccgccagcggccccctgcccttcttccagttcagacccagactggagagcgtggactggagaagactgagcgccatcgacgtggacaaggtggccggcgccgtggacgtgctgaccctgcaggagaacatcatgaacatcaccttctgcaagctggaggacgagaagtgcccccactgccagagcggcgtggaccccgtgctgctgaagctgatcagactggcccagttcaccatcgagtacctgctgcacagccaggagttcctgaccagccagctgcacaccctggaggagagactgagactgagccactgcgacggcgagcagagcaagaagctgctgaccaagcaggccggcgagatcaagaccctgaaggaggagtgcaagagaagaaagaagatgatcagcacccagcagctgatgatcgaggccaaggccaactactaccagtgccacttctgcgacaaggccttcatgaaccaggccttcctgcagagccacatccagagaagacacaccgaggagaacagccacttcgagtaccagaagaacgcccagatcgagaagctgagaagcgagatcgtggtgctgaaggaggagctgcagctgaccagaagcgagctggaggccgcccaccacgccagcgccgtgagattcagcaaggagtacgagatgcagaagaccaaggaggaggacttcctgaagctgttcgacagatggaaggaggaggagaaggagaagctggtggacgagatggagaaggtgaaggagatgttcatgaaggagttcaaggagctgaccagcaagaacagcgccctggagtaccagctgagcgagatccagaagagcaacatgcagatcaagagcaacatcggcaccctgaaggacgcccacgagttcaaggaggacagaagcccctacccccaggacttccacaacgtgatgcagctgctggacagccaggagagcaagtggaccgccagagtgcaggccatccaccaggagcacaagaaggagaagggcagactgctgagccacatcgagaagctgagaaccagcatgatcgacgacctgaacgccagcaacgtgttctacaagaagagaatcgaggagctgggccagagactgcaggagcagaacgagctgatcatcacccagagacagcagatcaaggacttcacctgcaaccccctgaacagcatcagcgagcccaagggcaaccccctggcctggcaggccttcgagagccagcccgccgcccccgccgtgcccatgaacgcccccgccctgcacaccctggagaccaagagcagcctgcccatggtgcacgagcaggccttcagcagccacatcctggagcccatcgaggagctgagcgaggaggagaagggcagagagaacgagcagaagctgaacaacaacaagatgcacctgagaaaggccctgaagagcaacagcagcctgaccaagggcctgagaaccatggtggagcagaacctgatggagaagctggagaccctgggcatcaacgccgacatcagaggcatcagcagcgaccagctgcacagagtgctgaagagcgtggagagcgagagacacaagcaggagagagagatccccaacttccaccagatcagagagttcctggagcaccaggtgagctgcaagatcgaggagaaggccctgctgagcagcgaccagtgcagcgtgagccagatggacaccctgagcaccggcgaggtgcccaagatgatccagctgcccagcaagaacagacagctgatcagacagaaggccgtgagcaccgacagaaccagcgtgcccaagatcaagaagaacgtgatggaggaccccttccccagaaagagcagcaccatcaccaccccccccttcagcagcgaggaggagcaggaggacgacgacctgatcagagcctacgccagccccggccccctgcccgtgccccccccccagaacaagggcagcttcggcaagaacaccgtgaagagcgacgccgacggcaccgagggcagcgagatcgaggacaccgacgacagccccaagcccgccggcgtggccgtgaagacccccaccgagaaggtggagaagatgttcccccacagaaagaacgtgaacaagcccgtgggcggcaccaacgtgcccgagatgttcatcaagaaggaggagctgcaggagctgaagtgcgccgacgtggaggacgaggactgggacatcagcagcctggaggaggagatcagcctgggcaagaagagcggcaaggagcagaaggagcccccccccgccaagaacgagccccacttcgcccacgtgctgaacgcctggggcgccttcaaccccaagggccccaagggcgagggcctgcaggagaacgagagcagcaccctgaagagcagcctggtgaccgtgaccgactggagcgacaccagcgacgtgtag

SEQ ID NO: 10320 - DNA, 1860 bp, Artificial Sequence
  Description of Artificial Sequence: Synthetic coding sequence
atgagcggcctggtgctgggccagagagacgagcccgccggccacagactgagccaggaggagatcctgggcagcaccagactggtgagccagggcctggaggccctgagaagcgagcaccaggccgtgctgcagagcctgagccagaccatcgagtgcctgcagcagggcggccacgaggagggcctggtgcacgagaaggccagacagctgagaagaagcatggagaacatcgagctgggcctgagcgaggcccaggtgatgctggccctggccagccacctgagcaccgtggagagcgagaagcagaagctgagagcccaggtgagaagactgtgccaggagaaccagtggctgagagacgagctggccggcacccagcagagactgcagagaagcgagcaggccgtggcccagctggaggaggagaagaagcacctggagttcctgggccagctgagacagtacgacgaggacggccacaccagcgaggagaaggagggcgacgccaccaaggacagcctggacgacctgttccccaacgaggaggaggaggaccccagcaacggcctgagcagaggccagggcgccaccgccgcccagcagggcggctacgagatccccgccagactgagaaccctgcacaacctggtgatccagtacgccgcccagggcagatacgaggtggccgtgcccctgtgcaagcaggccctggaggacctggagagaaccagcggcagaggccaccccgacgtggccaccatgctgaacatcctggccctggtgtacagagaccagaacaagtacaaggaggccgcccacctgctgaacgacgccctgagcatcagagagagcaccctgggccccgaccaccccgccgtggccgccaccctgaacaacctggccgtgctgtacggcaagagaggcaagtacaaggaggccgagcccctgtgccagagagccctggagatcagagagaaggtgctgggcaccaaccaccccgacgtggccaagcagctgaacaacctggccctgctgtgccagaaccagggcaagtacgaggccgtggagagatactaccagagagccctggccatctacgagggccagctgggccccgacaaccccaacgtggccagaaccaagaacaacctggccagctgctacctgaagcagggcaagtacgccgaggccgagaccctgtacaaggagatcctgaccagagcccacgtgcaggagttcggcagcgtggacgacgaccacaagcccatctggatgcacgccgaggagagagaggagatgagcaagagcagacaccacgagggcggcaccccctacgccgagtacggcggctggtacaaggcctgcaaggtgagcagccccaccgtgaacaccaccctgagaaacctgggcgccctgtacagaagacagggcaagctggaggccgccgagaccctggaggagtgcgccctgagaagcagaagacagggcaccgaccccatcagccagaccaaggtggccgagctgctgggcgagagcgacggcagaagaaccagccaggagggccccggcgacagcgtgaagttcgagggcggcgaggacgccagcgtggccgtggagtggagcggcgacggcagcggcaccctgcagagaagcggcagcctgggcaagatcagagacgtgctgagaagaagcagcgagctgctggtgagaaagctgcagggcaccgagcccagacccagcagcagcaacatgaagagagccgccagcctgaactacctgaaccagcccagcgccgcccccctgcaggtgagcagaggcctgagcgccagcaccatggacctgagcagcagcagctag

SEQ ID NO: 10321 - DNA, 1137 bp, Artificial Sequence
  Description of Artificial Sequence: Synthetic coding sequence
atgaaggagcagctgcccgacctgcacagccacttcagcgacctgaacctggaggcccacatgtacgccagccagtggttcctgaccctgttcaccgccaagttccccctgtgcatggtgttccacatcatcgacctgctgctgtgcgagggcctgaacatcatcttccacgtggccctggccctgctgaagaccagcaaggaggacctgctgcaggccgacttcgagggcgccctgaagttcttcagagtgcagctgcccaagagatacagagccgaggagaacgccagaagactgatggagcaggcctgcaacatcaaggtgcccaccaagaagctgaagaagtacgagaaggagtaccagaccatgagagagagccagctgcagcaggaggaccccatggacagatacaagagagagaacagaagactgcaggaggccagcatgagactggagcaggagaacgacgacctggcccacgagctggtgaccagcaagatcgccctgagaaacgacctggaccaggccgaggacaaggccgacgtgctgaacaaggagctgctgctgaccaagcagagactggtggagaccgaggaggagaagagaaagcaggaggaggagaccgcccagctgaaggaggtgttcagaaagcagctggagaaggccgagtacgagatcaagaagaccaccgccatcatcgccgagtacaagcagatctgcagccagctgagcaccagactggagaagcagcaggccgccagcaaggaggagctggaggtggtgaagggcaagatgatggcctgcaagcactgcagcgacatcttcagcaaggagggcgccctgaagctggccgccaccggcagagaggaccagggcatcgagaccgacgacgagaaggacagcctgaagaagcagctgagagagatggagctggagctggcccagaccaagctgcagctggtggaggccaagtgcaagatccaggagctggagcaccagagaggcgccctgatgaacgagatccaggccgccaagaacagctggttcagcaagaccctgaacagcatcaagaccgccaccggcacccagcccctgcagcccgcccccgtgacccagccccccaaggagagcacctag

SEQ ID NO: 10322 - DNA, 2631 bp, Artificial Sequence
  Description of Artificial Sequence: Synthetic coding sequence
atgggcgacagcgacgacgagtacgacagaagaagaagagacaagttcagaagagagagaagcgactacgacagaagcagagagagagacgagagaagaagaggcgacgactggaacgacagagagtgggacagaggcagagagagaagaagcagaggcgagtacagagactacgacagaaacagaagagagagattcagcccccccagacacgagctgagccccccccagaagagaatgagaagagactgggacgagcacagcagcgacccctaccacagcggctacgagatgccctacgccggcggcggcggcggccccacctacggccccccccagccctggggccaccccgacgtgcacatcatgcagcaccacgtgctgcccatccaggccagactgggcagcatcgccgagatcgacctgggcgtgcccccccccgtgatgaagaccttcaaggagttcctgctgagcctggacgacagcgtggacgagaccgaggccgtgaagagatacaacgactacaagctggacttcagaagacagcagatgcaggacttcttcctggcccacaaggacgaggagtggttcagaagcaagtaccaccccgacgaggtgggcaagagaagacaggaggccagaggcgccctgcagaacagactgagagtgttcctgagcctgatggagaccggctggttcgacaacctgctgctggacatcgacaaggccgacgccatcgtgaagatgctggacgccgccgtgatcaagatggagggcggcaccgagaacgacctgagaatcctggagcaggaggaggaggaggagcaggccggcaagcccggcgagcccagcaagaaggaggagggcagagccggcgccggcctgggcgacggcgagagaaagaccaacgacaaggacgagaagaaggaggacggcaagcaggccgagaacgacagcagcaacgacgacaagaccaagaagagcgagggcgacggcgacaaggaggagaagaaggaggacagcgagaaggaggccaagaagagcagcaagaagagaaacagaaagcacagcggcgacgacagcttcgacgagggcagcgtgagcgagagcgagagcgagagcgagagcggccaggccgaggaggagaaggaggaggccgaggaggccctgaaggagaaggagaagcccaaggaggaggagtgggagaagcccaaggacgccgccggcctggagtgcaagcccagacccctgcacaagacctgcagcctgttcatgagaaacatcgcccccaacatcagcagagccgagatcatcagcctgtgcaagagataccccggcttcatgagagtggccctgagcgagccccagcccgagagaagattcttcagaagaggctgggtgaccttcgacagaagcgtgaacatcaaggagatctgctggaacctgcagaacatcagactgagagagtgcgagctgagccccggcgtgaacagagacctgaccagaagagtgagaaacatcaacggcatcacccagcacaagcagatcgtgagaaacgacatcaagctggccgccaagctgatccacaccctggacgacagaacccagctgtgggccagcgagcccggcaccccccccctgcccaccagcctgcccagccagaaccccatcctgaagaacatcaccgactacctgatcgaggaggtgagcgccgaggaggaggagctgctgggcagcagcggcggcgccccccccgaggagccccccaaggagggcaaccccgccgagatcaacgtggagagagacgagaagctgatcaaggtgctggacaagctgctgctgtacctgagaatcgtgcacagcctggactactacaacacctgcgagtaccccaacgaggacgagatgcccaacagatgcggcatcatccacgtgagaggccccatgccccccaacagaatcagccacggcgaggtgctggagtggcagaagaccttcgaggagaagctgacccccctgctgagcgtgagagagagcctgagcgaggaggaggcccagaagatgggcagaaaggaccccgagcaggaggtggagaagttcgtgaccagcaacacccaggagctgggcaaggacaagtggctgtgccccctgagcggcaagaagttcaagggccccgagttcgtgagaaagcacatcttcaacaagcacgccgagaagatcgaggaggtgaagaaggaggtggccttcttcaacaacttcctgaccgacgccaagagacccgccctgcccgagatcaagcccgcccagccccccggccccgcccagatcctgccccccggcctgacccccggcctgccctacccccaccagaccccccagggcctgatgccctacggccagcccagaccccccatcctgggctacggcgccggcgccgtgagacccgccgtgcccaccggcggccccccctacccccacgccccctacggcgccggcagaggcaactacgacgccttcagaggccagggcggctaccccggcaagcccagaaacagaatggtgagaggcgaccccagagccatcgtggagtacagagacctggacgcccccgacgacgtggacttcttctag

SEQ ID NO: 10323 - DNA, 1491 bp, Artificial Sequence; identical to SEQ ID NO: 10231
  Description of Artificial Sequence: Synthetic coding sequence

SEQ ID NO: 10324 - DNA, 318 bp, Artificial Sequence
  Description of Artificial Sequence: Synthetic coding sequence
atggccctgagataccccatggccgtgggcctgaacaagggccacaaggtgaccaagaacgtgagcaagcccagacacagcagaagaagaggcagactgaccaagcacaccaagttcgtgagagacatgatcagagaggtgtgcggcttcgccccctacgagagaagagccatggagctgctgaaggtgagcaaggacaagagagccctgaagttcatcaagaagagagtgggcacccacatcagagccaagagaaagagagaggagctgagcaacgtgctggccgccatgagaaaggccgccgccaagaaggactag

SEQ ID NO: 10325 - DNA, 3720 bp, Artificial Sequence
  Description of Artificial Sequence: Synthetic coding sequence
atggccaacgacagccccgccaagagcctggtggacatcgacctgagcagcctgagagaccccgccggcatcttcgagctggtggaggtggtgggcaacggcacctacggccaggtgtacaagggcagacacgtgaagaccggccagctggccgccatcaaggtgatggacgtgaccgaggacgaggaggaggagatcaagctggagatcaacatgctgaagaagtacagccaccacagaaacatcgccacctactacggcgccttcatcaagaagagcccccccggccacgacgaccagctgtggctggtgatggagttctgcggcgccggcagcatcaccgacctggtgaagaacaccaagggcaacaccctgaaggaggactggatcgcctacatcagcagagagatcctgagaggcctggcccacctgcacatccaccacgtgatccacagagacatcaagggccagaacgtgctgctgaccgagaacgccgaggtgaagctggtggacttcggcgtgagcgcccagctggacagaaccgtgggcagaagaaacaccttcatcggcaccccctactggatggcccccgaggtgatcgcctgcgacgagaaccccgacgccacctacgactacagaagcgacctgtggagctgcggcatcaccgccatcgagatggccgagggcgccccccccctgtgcgacatgcaccccatgagagccctgttcctgatccccagaaaccccccccccagactgaagagcaagaagtggagcaagaagttcttcagcttcatcgagggctgcctggtgaagaactacatgcagagacccagcaccgagcagctgctgaagcaccccttcatcagagaccagcccaacgagagacaggtgagaatccagctgaaggaccacatcgacagaaccagaaagaagagaggcgagaaggacgagaccgagtacgagtacagcggcagcgaggaggaggaggaggaggtgcccgagcaggagggcgagcccagcagcatcgtgaacgtgcccggcgagagcaccctgagaagagacttcctgagactgcagcaggagaacaaggagagaagcgaggccctgagaagacagcagctgctgcaggagcagcagctgagagagcaggaggagtacaagagacagctgctggccgagagacagaagagaatcgagcagcagaaggagcagagaagaagactggaggagcagcagagaagagagagagaggccagaagacagcaggagagagagcagagaagaagagagcaggaggagaagagaagactggaggagctggagagaagaagaaaggaggaggaggagagaagaagagccgaggaggagaagagaagagtggagagagagcaggagtacatcagaagacagctggaggaggagcagagacacctggaggtgctgcagcagcagctgctgcaggagcaggccatgctgctggagtgcagatggagagagatggaggagcacagacaggccgagagactgcagagacagctgcagcaggagcaggcctacctgctgagcctgcagcacgaccacagaagaccccacccccagcacagccagcagcccccccccccccagcaggagagaagcaagcccagcttccacgcccccgagcccaaggcccactacgagcccgccgacagagccagagaggtggaggacagattcagaaagaccaaccacagcagccccgaggcccagagcaagcagaccggcagagtgctggagccccccgtgcccagcagaagcgagagcttcagcaacggcaacagcgagagcgtgcaccccgccctgcagagacccgccgagccccaggtgcccgtgagaaccaccagcagaagccccgtgctgagcagaagagacagccccctgcagggcagcggccagcagaacagccaggccggccagagaaacagcaccagcatcgagcccagactgctgtgggagagagtggagaagctggtgcccagacccggcagcggcagcagcagcggcagcagcaacagcggcagccagcccggcagccaccccggcagccagagcggcagcggcgagagattcagagtgagaagcagcagcaagagcgagggcagccccagccagagactggagaacgccgtgaagaagcccgaggacaagaaggaggtgttcagacccctgaagcccgccgacctgaccgccctggccaaggagctgagagccgtggaggacgtgagacccccccacaaggtgaccgactacagcagcagcagcgaggagagcggcaccaccgacgaggaggacgacgacgtggagcaggagggcgccgacgagagcaccagcggccccgaggacaccagagccgccagcagcctgaacctgagcaacggcgagaccgagagcgtgaagaccatgatcgtgcacgacgacgtggagagcgagcccgccatgacccccagcaaggagggcaccctgatcgtgagacagacccagagcgccagcagcaccctgcagaagcacaagagcagcagcagcttcacccccttcatcgaccccagactgctgcagatcagccccagcagcggcaccaccgtgaccagcgtggtgggcttcagctgcgacggcatgagacccgaggccatcagacaggaccccaccagaaagggcagcgtggtgaacgtgaaccccaccaacaccagaccccagagcgacacccccgagatcagaaagtacaagaagagattcaacagcgagatcctgtgcgccgccctgtggggcgtgaacctgctggtgggcaccgagagcggcctgatgctgctggacagaagcggccagggcaaggtgtaccccctgatcaacagaagaagattccagcagatggacgtgctggagggcctgaacgtgctggtgaccatcagcggcaagaaggacaagctgagagtgtactacctgagctggctgagaaacaagatcctgcacaacgaccccgaggtggagaagaagcagggctggaccaccgtgggcgacctggagggctgcgtgcactacaaggtggtgaagtacgagagaatcaagttcctggtgatcgccctgaagagcagcgtggaggtgtacgcctgggcccccaagccctaccacaagttcatggccttcaagagcttcggcgagctggtgcacaagcccctgctggtggacctgaccgtggaggagggccagagactgaaggtgatctacggcagctgcgccggcttccacgccgtggacgtggacagcggcagcgtgtacgacatctacctgcccacccacatccagtgcagcatcaagccccacgccatcatcatcctgcccaacaccgacggcatggagctgctggtgtgctacgaggacgagggcgtgtacgtgaacacctacggcagaatcaccaaggacgtggtgctgcagtggggcgagatgcccaccagcgtggcctacatcagaagcaaccagaccatgggctggggcgagaaggccatcgagatcagaagcgtggagaccggccacctggacggcgtgttcatgcacaagagagcccagagactgaagttcctgtgcgagagaaacgacaaggtgttcttcgccagcgtgagaagcggcggcagcagccaggtgtacttcatgaccctgggcagaaccagcctgctgagctggtag

SEQ ID NO: 10326 - DNA, 2847 bp, Artificial Sequence
  Description of Artificial Sequence: Synthetic coding sequence
atgtacggcagcgccagaagcgtgggcaaggtggagcccagcagccagagccccggcagaagccccagactgcccagaagccccagactgggccacagaagaaccaacagcaccggcggcagcagcggcagcagcgtgggcggcggcagcggcaagaccctgagcatggagaacatccagagcctgaacgccgcctacgccaccagcggccccatgtacctgagcgaccacgagaacgtgggcagcgagacccccaagagcaccatgaccctgggcagaagcggcggcagactgccctacggcgtgagaatgaccgccatgggcagcagccccaacatcgccagcagcggcgtggccagcgacaccatcgccttcggcgagcaccacctgccccccgtgagcatggccagcaccgtgccccacagcctgagacaggccagagacaacaccatcatggacctgcagacccagctgaaggaggtgctgagagagaacgacctgctgagaaaggacgtggaggtgaaggagagcaagctgagcagcagcatgaacagcatcaagaccttctggagccccgagctgaagaaggagagagccctgagaaaggacgaggccagcaagatcaccatctggaaggagcagtacagagtggtgcaggaggagaaccagcacatgcagatgaccatccaggccctgcaggacgagctgagaatccagagagacctgaaccagctgttccagcaggacagcagcagcagaaccggcgagccctgcgtggccgagctgaccgaggagaacttccagagactgcacgccgagcacgagagacaggccaaggagctgttcctgctgagaaagaccctggaggagatggagctgagaatcgagacccagaagcagaccctgaacgccagagacgagagcatcaagaagctgctggagatgctgcagagcaagggcctgagcgccaaggccaccgaggaggaccacgagagaaccagaagactggccgaggccgagatgcacgtgcaccacctggagagcctgctggagcagaaggagaaggagaacagcatgctgagagaggagatgcacagaagattcgagaacgcccccgacagcgccaagaccaaggccctgcagaccgtgatcgagatgaaggacagcaagatcagcagcatggagagaggcctgagagacctggaggaggagatccagatgctgaagagcaacggcgccctgagcaccgaggagagagaggaggagatgaagcagatggaggtgtacagaagccacagcaagttcatgaagaacaagatcggccaggtgaagcaggagctgagcagaaaggacaccgagctgctggccctgcagaccaagctggagaccctgaccaaccagttcagcgacagcaagcagcacatcgaggtgctgaaggagagcctgaccgccaaggagcagagagccgccatcctgcagaccgaggtggacgccctgagactgagactggaggagaaggagaccatgctgaacaagaagaccaagcagatccaggacatggccgaggagaagggcacccaggccggcgagatccacgacctgaaggacatgctggacgtgaaggagagaaaggtgaacgtgctgcagaagaagatcgagaacctgcaggagcagctgagagacaaggagaagcagatgagcagcctgaaggagagagtgaagagcctgcaggccgacaccaccaacaccgacaccgccctgaccaccctggaggaggccctggccgagaaggagagaaccatcgagagactgaaggagcagagagacagagacgagagagagaagcaggaggagatcgacaactacaagaaggacctgaaggacctgaaggagaaggtgagcctgctgcagggcgacctgagcgagaaggaggccagcctgctggacctgaaggagcacgccagcagcctggccagcagcggcctgaagaaggacagcagactgaagaccctggagatcgccctggagcagaagaaggaggagtgcctgaagatggagagccagctgaagaaggcccacgaggccgccctggaggccagagccagccccgagatgagcgacagaatccagcacctggagagagagatcaccagatacaaggacgagagcagcaaggcccaggccgaggtggacagactgctggagatcctgaaggaggtggagaacgagaagaacgacaaggacaagaagatcgccgagctggagagcctgaccagcagacaggtgaaggaccagaacaagaaggtggccaacctgaagcacaaggagcaggtggagaagaagaagagcgcccagatgctggaggaggccagaagaagagaggacaacctgaacgacagcagccagcagctgcaggtggaggagctgctgatggccatggagaaggtgaagcaggagctggagagcatgaaggccaagctgagcagcacccagcagagcctggccgagaaggagacccacctgaccaacctgagagccgagagaagaaagcacctggaggaggtgctggagatgaagcaggaggccctgctggccgccatcagcgagaaggacgccaacatcgccctgctggagctgagcagcagcaagaagaagacccaggaggaggtggccgccctgaagagagagaaggacagactggtgcagcagctgaagcagcagacccagaacagaatgaagctgatggccgacaactacgaggacgaccacttcaagagcagccacagcaaccagaccaaccacaagcccagccccgaccaggacgaggaggagggcatctgggcctag

SEQ ID NO: 10327 - DNA, 2733 bp, Artificial Sequence
  Description of Artificial Sequence: Synthetic coding sequence
atggccgccaccgtggagggccccgagctggaggccgccgccgccgccggcgacgccagcgaggacagcgacgccggcagcagagccctgcccttcctgggcggcaacagactgagcctggacctgtaccccggcggctgccagcagctgctgcacctgtgcgtgcagcagcccctgcagctgctgcaggtggagttcctgagactgagcacccacgaggacccccagctgctggaggccaccctggcccagctgccccagagcctgagctgcctgagaagcctggtgctgaagggcggccagagaagagacaccctgggcgcctgcctgagaggcgccctgaccaacctgcccgccggcctgagcggcctggcccacctggcccacctggacctgagcttcaacagcctggagaccctgcccgcctgcgtgctgcagatgagaggcctgggcgccctgctgctgagccacaactgcctgagcgagctgcccgaggccctgggcgccctgcccgccctgaccttcctgaccgtgacccacaacagactgcagaccctgccccccgccctgggcgccctgagcaccctgcagagactggacctgagccagaacctgctggacaccctgccccccgagatcggcggcctgggcagcctgctggagctgaacctggccagcaacagactgcagagcctgcccgccagcctggccggcctgagaagcctgagactgctggtgctgcacagcaacctgctggccagcgtgcccgccgacctggccagactgcccctgctgaccagactggacctgagagacaaccagctgagagacctgccccccgagctgctggacgcccccttcgtgagactgcagggcaaccccctgggcgaggccagccccgacgcccccagcagccccgtggccgccctgatccccgagatgcccagactgttcctgaccagcgacctggacagcttccccgtgaccccccagggctgcagcgtgaccctggcctgcggcgtgagactgcagttccccgccggcgccaccgccacccccatcaccatcagatacagactgctgctgcccgagcccggcctggtgcccctgggcccccacgacgccctgctgagccacgtgctggagctgcagccccacggcgtggccttccagcaggacgtgggcctgtggctgctgttcacccccccccaggccagaagatgcagagaggtggtggtgagaaccagaaacgacaacagctggggcgacctggagacctacctggaggaggaggccccccagagactgtgggcccactgccaggtgccccacttcagctggttcctggtggtgagcagacccgtgagcaacgcctgcctggtgccccccgagggcaccctgctgtgcagcagcggccaccccggcgtgaaggtgatcttcccccccggcgccaccgaggagcccagaagagtgagcatgcaggtggtgagaatggccggcagagagctgcaggccctgctgggcgagcccgaggccgccgtgagccccctgctgtgcctgagccagagcggcccccccagcttcctgcagcccgtgaccgtgcagctgcccctgcccagcggcatcaccggcctgagcctggacagaagcagactgcacctgctgtactgggccccccccgccgccacctgggacgacatcaccgcccaggtggtgctggagctgacccacctgtacgccagattccaggtgacccacttcagctggtactggctgtggtacaccaccaagaactgcgtgggcggcctggccagaaaggcctgggagagactgagactgcacagagtgaacctgatcgccctgcagagaagaagagaccccgagcaggtgctgctgcagtgcctgcccagaaacaaggtggacgccaccctgagaagactgctggagagatacagaggccccgagcccagcgacaccgtggagatgttcgagggcgaggagttcttcgccgccttcgagagaggcatcgacgtggacgccgacagacccgactgcgtggagggcagaatctgcttcgtgttctacagccacctgaagaacgtgaaggaggtgtacgtgaccaccaccctggacagagaggcccaggccgtgagaggccaggtgagcttctacagaggcgccgtgcccgtgagagtgcccgaggaggccgaggccgccagacagagaaagggcgccgacgccctgtggatggccaccctgcccatcaagctgcccagactgagaggcagcgagggccccagaagaggcgccggcctgagcctggcccccctgaacctgggcgacgccgagaccggcttcctgacccagagcaacctgctgagcgtggccggcagactgggcctggactggcccgccgtggccctgcacctgggcgtgagctacagagaggtgcagagaatcagacacgagttcagagacgacctggacgagcagatcagacacatgctgttcagctgggccgagagacaggccggccagcccggcgccgtgggcctgctggtgcaggccctggagcagagcgacagacaggacgtggccgaggaggtgagagccgtgctggagctgggcagaagaaagtaccaggacagcatcagaagaatgggcctggcccccaaggaccccgccctgcccggcagcagcgccccccagccccccgagcccgcccaggcctag

SEQ ID NO: 10328 - DNA, 2961 bp, Artificial Sequence
  Description of Artificial Sequence: Synthetic coding sequence
atgagccagtggacccccgagtacaacgagctgtacaccctgaaggtggacatgaagagcgagatccccagcgacgcccccaagacccaggagagcctgaagggcatcctgctgcaccccgagcccatcggcgccgccaagagcttccccgccggcgtggagatgatcaacagcaaggtgggcaacgagttcagccacctgtgcgacgacagccagaagcaggagaaggagatgaacggcaaccagcaggagcaggagaagagcctggtggtgagaaagaagagaaagagccagcaggccggccccagctacgtgcagaactgcgtgaaggagaaccagggcatcctgggcctgagacagcacctgggcacccccagcgacgaggacaacgacagcagcttcagcgactgcctgagcagccccagcagcagcctgcacttcggcgacagcgacaccgtgaccagcgacgaggacaaggaggtgagcgtgagacacagccagaccatcctgaacgccaagagcagaagccacagcgccagaagccacaagtggcccagaaccgagaccgagagcgtgagcggcctgctgatgaagagaccctgcctgcacggcagcagcctgagaagactgccctgcagaaagagattcgtgaagaacaacagcagccagagaacccagaagcagaaggagagaatcctgatgcagagaaagaagagagaggtgctggccagaagaaagtacgccctgctgcccagcagcagcagcagcagcgagaacgacctgagcagcgagagcagcagcagcagcagcaccgagggcgaggaggacctgttcgtgagcgccagcgagaaccaccagaacaaccccgccgtgcccagcggcagcatcgacgaggacgtggtggtgatcgaggccagcagcaccccccaggtgaccgccaacgaggagatcaacgtgaccagcaccgacagcgaggtggagatcgtgaccgtgggcgagagctacagaagcagaagcaccctgggccacagcagaagccactggagccagggcagcagcagccacgccagcagaccccaggagcccagaaacagaagcagaatcagcaccgtgatccagcccctgagacagaacgccgccgaggtggtggacctgaccgtggacgaggacgagcccaccgtggtgcccaccaccagcgccagaatggagagccaggccaccagcgccagcatcaacaacagcaaccccagcaccagcgagcaggccagcgacaccgccagcgccgtgaccagcagccagcccagcaccgtgagcgagaccagcgccaccctgaccagcaacagcaccaccggcaccagcatcggcgacgacagcagaagaaccaccagcagcgccgtgaccgagaccggcccccccgccatgcccagactgcccagctgctgcccccagcacagcccctgcggcggcagcagccagaaccaccacgccctgggccacccccacaccagctgcttccagcagcacggccaccacttccagcaccaccaccaccaccaccacaccccccaccccgccgtgcccgtgagccccagcttcagcgaccccgcctgccccgtggagagacccccccaggtgcaggccccctgcggcgccaacagcagcagcggcaccagctaccacgagcagcaggccctgcccgtggacctgagcaacagcggcatcagaagccacggcagcggcagcttccacggcgccagcgccttcgacccctgctgccccgtgagcagcagcagagccgccatcttcggccaccaggccgccgccgccgcccccagccagcccctgagcagcatcgacggctacggcagcagcatggtggcccagccccagccccagccccccccccagcccagcctgagcagctgcagacactacatgccccccccctacgccagcctgaccagacccctgcaccaccaggccagcgcctgcccccacagccacggcaacccccccccccagacccagccccccccccaggtggactacgtgatcccccaccccgtgcacgccttccacagccagatcagcagccacgccaccagccaccccgtggccccccccccccccacccacctggccagcaccgccgcccccatcccccagcacctgccccccacccaccagcccatcagccaccacatccccgccaccgccccccccgcccagagactgcacccccacgaggtgatgcagagaatggaggtgcagagaagaagaatgatgcagcaccccaccagagcccacgagagaccccccccccacccccacagaatgcaccccaactacggccacggccaccacatccacgtgccccagaccatgagcagccaccccagacaggcccccgagagaagcgcctgggagctgggcatcgaggccggcgtgaccgccgccacctacacccccggcgccctgcacccccacctggcccactaccacgccccccccagactgcaccacctgcagctgggcgccctgcccctgatggtgcccgacatggccggctacccccacatcagatacatcagcagcggcctggacggcaccagcttcagaggccccttcagaggcaacttcgaggagctgatccacctggaggagagactgggcaacgtgaacagaggcgccagccagggcaccatcgagagatgcacctacccccacaagtacaagaagagaaagctgcactgcaagcaggacggcgaggagggcaccgaggaggacaccgaggagaagtgcaccatctgcctgagcatcctggaggagggcgaggacgtgagaagactgccctgcatgcacctgttccaccaggtgtgcgtggaccagtggctgatcaccaacaagaagtgccccatctgcagagtggacatcgaggcccagctgcccagcgagagctag

SEQ ID NO: 10329 - DNA, 372 bp, Artificial Sequence
  Description of Artificial Sequence: Synthetic coding sequence
atggccaagatcaaggccagagacctgagaggcaagaagaaggaggagctgctgaagcagctggacgacctgaaggtggagctgagccagctgagagtggccaaggtgaccggcggcgccgccagcaagctgagcaagatcagagtggtgagaaagagcatcgccagagtgctgaccgtgatcaaccagacccagaaggagaacctgagaaagttctacaagggcaagaagtacaagcccctggacctgagacccaagaagaccagagccatgagaagaagactgaacaagcacgaggagaacctgaagaccaagaagcagcagagaaaggagagactgtaccccctgagaaagtacgccgtgaaggcctag

SEQ ID NO: 10330 - DNA, 1635 bp, Artificial Sequence
  Description of Artificial Sequence: Synthetic coding sequence
atgaagatcttctgcagcagagccaaccccaccaccggcagcgtggagtggctggaggaggacgagcactacgactaccaccaggagatcgccagaagcagctacgccgacatgctgcacgacaaggacagaaacgtgaagtactaccagggcatcagagccgccgtgagcagagtgaaggacagaggccagaaggccctggtgctggacatcggcaccggcaccggcctgctgagcatgatggccgtgaccgccggcgccgacttctgctacgccatcgaggagaactgcgaggccgtgccccacagagccaccgtgtacgcccagctggtggagagcggcagaatgtggagctggaacaagctgttccccatccacgtgcagaccagcctgggcgagcaggtgatcgtgccccccgtggacgtggagagctgccccggcgcccccagcgtgtgcgacatccagctgaaccaggtgagccccgccgacttcaccgtgctgagcgacgtgctgcccatgttcagcatcgacttcagcaagcaggtgagcagcagcgccgcctgccacagcagaagattcgagcccctgaccagcggcagagcccaggtggtgctgagctggtgggacatcgagatggaccccgagggcaagatcaagtgcaccatggcccccttctgggcccacagcgaccccgaggagatgcagtggagagaccactggatgcagtgcgtgtacttcctgccccaggaggagcccgtggtgcagggcagcgccctgtacctggtggcccaccacgacgactactgcgtgtggtacagcctgcagagaaccagccccgagaagaacgagagagtgagacagatgagacccgtgtgcgactgccaggcccacctgctgtggaacagacccagattcggcgagatcaacgaccaggacagaaccgacagatacgtgcaggccctgagaaccgtgagcctgctgctgggcgagcccttcttcaccaccagcctgctgccctggcacaacctgtacttctggtacgtgagaaccgccgtggaccagcacctgggccccggcgccatggtgatgccccaggccgccagcctgcacgccgtggtggtggagttcagagacctgtggagaatcagaagcccctgcggcgactgcgagggcttcgacgtgcacatcatggacgacatgatcaagagagccctggacttcagagagagcagagaggccgagccccaccccctgtgggagtacccctgcagaagcctgagcgagccctggcagatcctgaccttcgacttccagcagcccgtgcccctgcagcccctgtgcgccgagggcaccgtggagctgagaagacccggccagagccacgccgccgtgctgtggatggagtaccacctgacccccgagtgcaccctgagcaccggcctgctggagcccgccgaccccgagggcggctgctgctggaacccccactgcaagcaggccgtgtacttcttcagccccgcccccgaccccagagccctgctgggcggccccagaaccgtgagctacgccgtggagttccaccccgacaccggcgacatcatcatggagttcagacacgccgacacccccgactag

SEQ ID NO: 10331 - DNA, 1131 bp, Artificial Sequence
  Description of Artificial Sequence: Synthetic coding sequence
atgcccctgcaggtgagcgactacagctggcagcagaccaagaccgccgtgttcctgagcctgcccctgaagggcgtgtgcgtgagagacaccgacgtgttctgcaccgagaactacctgaaggtgaacttcccccccttcctgttcgaggccttcctgtacgcccccatcgacgacgagagcagcaaggccaagatcggcaacgacaccatcgtgttcaccctgtacaagaaggaggccgccatgtgggagaccctgagcgtgaccggcgtggacaaggagatgatgcagagaatcagagagaagagcatcctgcaggcccaggagagagccaaggaggccaccgaggccaaggccgccgccaagagagaggaccagaagtacgccctgagcgtgatgatgaagatcgaggaggaggagagaaagaagatcgaggacatgaaggagaacgagagaatcaaggccaccaaggccctggaggcctggaaggagtaccagagaaaggccgaggagcagaagaagatccagagagaggagaagctgtgccagaaggagaagcagatcaaggaggagagaaagaagatcaagtacaagagcctgaccagaaacctggccagcagaaacctggcccccaagggcagaaacagcgagaacatcttcaccgagaagctgaaggaggacagcatccccgcccccagaagcgtgggcagcatcaagatcaacttcacccccagagtgttccccaccgccctgagagagagccaggtggccgaggaggaggagtggctgcacaagcaggccgaggccagaagagccatgaacaccgacatcgccgagctgtgcgacctgaaggaggaggagaagaaccccgagtggctgaaggacaagggcaacaagctgttcgccaccgagaactacctggccgccatcaacgcctacaacctggccatcagactgaacaacaagatgcccctgctgtacctgaacagagccgcctgccacctgaagctgaagaacctgcacaaggccatcgaggacagcagcaaggcctacagaatcatgaagagacacctgagactgatccaccccaccaagctgtacaagctgatgctgagaagattcggcatgtag

SEQ ID NO: 10332 - DNA, 4221 bp, Artificial Sequence
  Description of Artificial Sequence: Synthetic coding sequence
atgtggagcctgaccgccagcgagggcgagagcaccaccgcccacttcttcctgggcgccggcgacgagggcctgggcaccagaggcatcggcatgagacccgaggagagcgacagcgagctgctggaggacgaggaggacgaggtgccccccgagccccagatcatcgtgggcatctgcgccatgaccaagaagagcaagagcaagcccatgacccagatcctggagagactgtgcagattcgactacctgaccgtggtgatcctgggcgaggacgtgatcctgaacgagcccgtggagaactggcccagctgccactgcctgatcagcttccacagcaagggcttccccctggacaaggccgtggcctacagcaagctgagaaaccccttcctgatcaacgacctggccatgcagtactacatccaggacagaagagaggtgtacagaatcctgcaggaggagggcatcgacctgcccagatacgccgtgctgaacagagaccccgccagacccgaggagtgcaacctgatcgagggcgaggaccaggtggaggtgaacggcgccgtgttccccaagcccttcgtggagaagcccgtgagcgccgaggaccacaacgtgtacatctactaccccagcagcgccggcggcggcagccagagactgttcagaaagatcggcagcagaagcagcgtgtacagccccgagagcagcgtgagaaagaccggcagctacatctacgaggagttcatgcccaccgacggcaccgacgtgaaggtgtacaccgtgggccccgactacgcccacgccgaggccagaaagagccccgccctggacggcaaggtggagagagacagcgagggcaaggagatcagataccccgtgatgctgaccgccatggagaagctggtggccagaaaggtgtgcgtggccttcaagcagaccgtgtgcggcttcgacctgctgagagccaacggccacagcttcgtgtgcgacgtgaacggcttcagcttcgtgaagaacagcatgaagtactacgacgactgcgccaagatcctgggcaacaccatcatgagagagctggccccccagttccagatcccctggagcatccccaccgaggccgaggacatccccatcgtgcccaccaccagcggcaccatgatggagctgagatgcgtgatcgccatcatcagacacggcgacagaacccccaagcagaagatgaagatggaggtgaagcaccccagattcttcgccctgttcgagaagcacggcggctacaagaccggcaagctgaagctgaagagacccgagcagctgcaggaggtgctggacatcaccagactgctgctggccgagctggagaaggagcccggcggcgagatcgaggagaagaccggcaagctggagcagctgaagagcgtgctggagatgtacggccacttcagcggcatcaacagaaaggtgcagctgacctactacccccacggcgtgaaggccagcaacgagggccaggacccccagagagagaccctggcccccagcctgctgctggtgctgaagtggggcggcgagctgacccccgccggcagagtgcaggccgaggagctgggcagagccttcagatgcatgtaccccggcggccagggcgactacgccggcttccccggctgcggcctgctgagactgcacagcaccttcagacacgacctgaagatctacgccagcgacgagggcagagtgcagatgaccgccgccgccttcgccaagggcctgctggccctggagggcgagctgacccccatcctggtgcagatggtgaagagcgccaacatgaacggcctgctggacagcgacggcgacagcctgagcagctgccagcacagagtgaaggccagactgcaccacatcctgcagcaggacgcccccttcggccccgaggactacgaccagctggcccccaccagaagcaccagcctgctgaacagcatgaccatcatccagaaccccgtgaaggtgtgcgaccaggtgttcgccctgatcgagaacctgacccaccagatcagagagagaatgcaggaccccagaagcgtggacctgcagctgtaccacagcgagaccctggagctgatgctgcagagatggagcaagctggagagagacttcagacagaagagcggcagatacgacatcagcaagatccccgacatctacgactgcgtgaagtacgacgtgcagcacaacggcagcctgggcctgcagggcaccgccgagctgctgagactgagcaaggccctggccgacgtggtgatcccccaggagtacggcatcagcagagaggagaagctggagatcgccgtgggcttctgcctgcccctgctgagaaagatcctgctggacctgcagagaacccacgaggacgagagcgtgaacaagctgcaccccctgtacagcagaggcgtgctgagccccggcagacacgtgagaaccagactgtacttcaccagcgagagccacgtgcacagcctgctgagcgtgttcagatacggcggcctgctggacgagacccaggacgcccagtggcagagagccctggactacctgagcgccatcagcgagctgaactacatgacccagatcgtgatcatgctgtacgaggacaacacccaggaccccctgagcgaggagagattccacgtggagctgcacttcagccccggcgtgaagggcgtggaggaggagggcagcgcccccgccggctgcggcttcagacccgccagcagcgagaacgaggagatgaagaccaaccagggcagcatggagaacctgtgccccggcaaggccagcgacgagcccgacagagccctgcagaccagcccccagccccccgagggccccggcctgcccagaagaagccccctgatcagaaacagaaaggccggcagcatggaggtgctgagcgagaccagcagcagcagacccggcggctacagactgttcagcagcagcagaccccccaccgagatgaagcagagcggcctgggcttcgagggctgcagcatggtgcccaccatctaccccctggagaccctgcacaacgccctgagcctgagacaggtgagcgagttcctgagcagagtgtgccagagacacaccgacgcccaggcccaggccagcgccgccctgttcgacagcatgcacagcagccaggccagcgacaaccccttcagcccccccagaaccctgcacagcccccccctgcagctgcagcagagaagcgagaagcccccctggctggagaccagattctgccacgtgggccaggccggcctggagctgctgaccagcagcgacctgcccgccagcgccagccagagcgccggcatcaccggcgtgagccacagaacccagcccgacagcagcggccccagcagcaccgtgagcagcgccggccccagcagccccaccaccgtggacggcaacagccagttcggcttcagcgaccagcccagcctgaacagccacgtggccgaggagcaccagggcctgggcctgctgcaggagacccccggcagcggcgcccaggagctgagcatcgagggcgagcaggagctgttcgagcccaaccagagcccccaggtgccccccatggagaccagccagccctacgaggaggtgagccagccctgccaggaggtgcccgacatcagccagccctgccaggacatcagcgaggccctgagccagccctgccagaaggtgcccgacatcagccagcagtgccaggagaaccacgacaacggcaaccacacctgccaggaggtgccccacatcagccagccctgccagaagagcagccagctgtgccagaaggtgagcgaggaggtgtgccagctgtgcctggagaacagcgaggaggtgagccagccctgccagggcgtgagcgtggaggtgggcaagctggtgcacaagttccacgtgggcgtgggcagcctggtgcaggagaccctggtggaggtgggcagccccgccgaggagatccccgaggaggtgatccagccctaccaggagttcagcgtggaggtgggcagactggcccaggagaccagcgccatcaacctgctgagccagggcatccccgagatcgacaagcccagccaggagttccccgaggagatcgacctgcaggcccaggaggtgcccgaggagatcaactag

SEQ ID NO: 10333 - DNA, 1338 bp, Artificial Sequence
  Description of Artificial Sequence: Synthetic coding sequence
atggtgctggagggcaaccccgaggtgggcagccccagaaccagcgacctgcagcacagaggcaacaagggcagctgcgtgctgagcagccccggcgaggacgcccagcccggcgaggagcccatcaagtacggcgagctgatcgtgctgggctacaacggctgcctggccagcggcgacaagggcagaagaagaagcagactggccctgagcagaagaagccacgccaacggcgtgaagcccgacgtgatgcaccacatcagcacccccctggtgagcaaggccctgagcaacagaggccagcacagcatcagctacaccctgagcagaagccacagcgtgatcgtggagtacacccacgacagcgacaccgacatgttccagatcggcagaagcaccgagaacatgatcgacttcgtggtgaccgacaccagccccggcggcggcgccgccgagggccccagcgcccagagcaccatcagcagatacgcctgcagaatcctgtgcgacagaagacccccctacaccgccagaatctacgccgccggcttcgacgccagcagcaacatcttcctgggcgagagagccgccaagtggagaacccccgacggcctgatggacggcctgaccaccaacggcgtgctggtgatgcaccccgccggcggcttcagcgaggacagcgcccccggcgtgtggagagagatcagcgtgtgcggcaacgtgtacaccctgagagacagcagaagcgcccagcagagaggcaagctggtggagaacgagagcaacgtgctgcaggacggcagcctgatcgacctgtgcggcgccaccctgctgtggagaacccccgccggcctgctgagagcccccaccctgaagcagctggaggcccagagacaggaggccaacgccgccagaccccagtgccccgtgggcctgagcaccctggccttccccagccccgccagaggcagaaccgcccccgacaagcagcagccctgggtgtacgtgagatgcggccacgtgcacggctaccacggctggggctgcagaagagagagaggcccccaggagagagagtgccccctgtgcagactggtgggcccctacgtgcccctgtggctgggccaggaggccggcctgtgcctggaccccggcccccccagccacgccttcgccccctgcggccacgtgtgcagcgagaagaccgccagatactgggcccagacccccctgccccacggcacccacgccttccacgccgcctgccccttctgcggcgcctggctgaccggcgagcacggctgcgtgagactgatcttccagggccccctggactag

SEQ ID NO: 10334 - DNA, 1950 bp, Artificial Sequence
  Description of Artificial Sequence: Synthetic coding sequence
atgggcaccgccctggtgtaccacgaggacatgaccgccaccagactgctgtgggacgaccccgagtgcgagatcgagagacccgagagactgaccgccgccctggacagactgagacagagaggcctggagcagagatgcctgagactgagcgccagagaggccagcgaggaggagctgggcctggtgcacagccccgagtacgtgagcctggtgagagagacccaggtgctgggcaaggaggagctgcaggccctgagcggccagttcgacgccatctacttccaccccagcaccttccactgcgccagactggccgccggcgccggcctgcagctggtggacgccgtgctgaccggcgccgtgcagaacggcctggccctggtgagaccccccggccaccacggccagagagccgccgccaacggcttctgcgtgttcaacaacgtggccatcgccgccgcccacgccaagcagaagcacggcctgcacagaatcctggtggtggactgggacgtgcaccacggccagggcatccagtacctgttcgaggacgaccccagcgtgctgtacttcagctggcacagatacgagcacggcagattctggcccttcctgagagagagcgacgccgacgccgtgggcagaggccagggcctgggcttcaccgtgaacctgccctggaaccaggtgggcatgggcaacgccgactacgtggccgccttcctgcacctgctgctgcccctggccttcgagggccagatgcaggccacccccgagtgcttcgcccacctgacccagctgctgcaggtgctggccggcggcagagtgtgcgccgtgctggagggcggctaccacctggagagcctggccgagagcgtgtgcatgaccgtgcagaccctgctgggcgaccccgccccccccctgagcggccccatggccccctgccagagcgccctggagagcatccagagcgccagagccgcccaggccccccactggaagagcctgcagcagcaggacgtgaccgccgtgcccatgagccccagcagccacagccccgagggcagacccccccccctgctgcccggcggccccgtgtgcaaggccgccgccagcgcccccagcagcctgctggaccagccctgcctgtgccccgcccccagcgtgagaaccgccgtggccctgaccacccccgacatcaccctggtgctgccccccgacgtgatccagcaggaggccagcgccctgagagaggagaccgaggcctgggccagaccccacgagagcctggccagagaggaggccctgaccgccctgggcaagctgctgtacctgctggacggcatgctggacggccaggtgaacagcggcatcgccgccacccccgccagcgccgccgccgccaccctggacgtggccgtgagaagaggcctgagccacggcgcccagagactgctgtgcgtggccctgggccagctggacagaccccccgacctggcccacgacggcagaagcctgtggctgaacatcagaggcaaggaggccgccgccctgagcatgttccacgtgagcacccccctgcccgtgatgaccggcggcttcctgagctgcatcctgggcctggtgctgcccctggcctacggcttccagcccgacctggtgctggtggccctgggccccggccacggcctgcagggcccccacgccgccctgctggccgccatgctgagaggcctggccggcggcagagtgctggccctgctggaggagaacagcaccccccagctggccggcatcctggccagagtgctgaacggcgaggccccccccagcctgggccccagcagcgtggccagccccgaggacgtgcaggccctgatgtacctgagaggccagctggagccccagtggaagatgctgcagtgccacccccacctggtggcctag

SEQ ID NO: 10335 - DNA, 795 bp, Artificial Sequence
  Description of Artificial Sequence: Synthetic coding sequence
atggccggcgagcagaagcccagcagcaacctgctggagcagttcatcctgctggccaagggcaccagcggcagcgccctgaccgccctgatcagccaggtgctggaggcccccggcgtgtacgtgttcggcgagctgctggagctggccaacgtgcaggagctggccgagggcgccaacgccgcctacctgcagctgctgaacctgttcgcctacggcacctaccccgactacatcgccaacaaggagagcctgcccgagctgagcaccgcccagcagaacaagctgaagcacctgaccatcgtgagcctggccagcagaatgaagtgcatcccctacagcgtgctgctgaaggacctggagatgagaaacctgagagagctggaggacctgatcatcgaggccgtgtacaccgacatcatccagggcaagctggaccagagaaaccagctgctggaggtggacttctgcatcggcagagacatcagaaagaaggacatcaacaacatcgtgaagaccctgcacgagtggtgcgacggctgcgaggccgtgctgctgggcatcgagcagcaggtgctgagagccaaccagtacaaggagaaccacaacagaacccagcagcaggtggaggccgaggtgaccaacatcaagaagaccctgaaggccaccgccagcagcagcgcccaggagatggagcagcagctggccgagagagagtgccccccccacgccgagcagagacagcccaccaagaagatgagcaaggtgaagggcctggtgagcagcagacactag

SEQ ID NO: 10336 - DNA, 726 bp, Artificial Sequence
  Description of Artificial Sequence: Synthetic coding sequence
atgagcgccagcctgaactacaagagcttcagcaaggagcagcagaccatggacaacctggagaagcagctgatctgccccatctgcctggagatgttcaccaagcccgtggtgatcctgccctgccagcacaacctgtgcagaaagtgcgccagcgacatcttccaggccagcaacccctacctgcccaccagaggcggcaccaccatggccagcggcggcagattcagatgccccagctgcagacacgaggtggtgctggacagacacggcgtgtacggcctgcagagaaacctgctggtggagaacatcatcgacatctacaagcaggagagcaccagacccgagaagaagagcgaccagcccatgtgcgaggagcacgaggaggagagaatcaacatctactgcctgaactgcgaggtgcccacctgcagcctgtgcaaggtgttcggcgcccacaaggactgccaggtggcccccctgacccacgtgttccagagacagaagagcgagctgagcgacggcatcgccatcctggtgggcagcaacgacagagtgcagggcgtgatcagccagctggaggacacctgcaagaccatcgagatcggcttcgaggccccccccctgcagggccaggccgccgcccccgccagcggcagcggcgccgacagcgagcccgccagacacatcttcagcttcagctggctgaacagcctgaacgagtag

SEQ ID NO: 10337 - DNA, 3501 bp, Artificial Sequence
  Description of Artificial Sequence: Synthetic coding sequence
atggccaacgacagccccgccaagagcctggtggacatcgacctgagcagcctgagagaccccgccggcatcttcgagctggtggaggtggtgggcaacggcacctacggccaggtgtacaagggcagacacgtgaagaccggccagctggccgccatcaaggtgatggacgtgaccgaggacgaggaggaggagatcaagctggagatcaacatgctgaagaagtacagccaccacagaaacatcgccacctactacggcgccttcatcaagaagagcccccccggccacgacgaccagctgtggctggtgatggagttctgcggcgccggcagcatcaccgacctggtgaagaacaccaagggcaacaccctgaaggaggactggatcgcctacatcagcagagagatcctgagaggcctggcccacctgcacatccaccacgtgatccacagagacatcaagggccagaacgtgctgctgaccgagaacgccgaggtgaagctggtggacttcggcgtgagcgcccagctggacagaaccgtgggcagaagaaacaccttcatcggcaccccctactggatggcccccgaggtgatcgcctgcgacgagaaccccgacgccacctacgactacagaagcgacctgtggagctgcggcatcaccgccatcgagatggccgagggcgccccccccctgtgcgacatgcaccccatgagagccctgttcctgatccccagaaaccccccccccagactgaagagcaagaagtggagcaagaagttcttcagcttcatcgagggctgcctggtgaagaactacatgcagagacccagcaccgagcagctgctgaagcaccccttcatcagagaccagcccaacgagagacaggtgagaatccagctgaaggaccacatcgacagaaccagaaagaagagaggcgagaaggacgagaccgagtacgagtacagcggcagcgaggaggaggaggaggaggtgcccgagcaggagggcgagcccagcagcatcgtgaacgtgcccggcgagagcaccctgagaagagacttcctgagactgcagcaggagaacaaggagagaagcgaggccctgagaagacagcagctgctgcaggagcagcagctgagagagcaggaggagtacaagagacagctgctggccgagagacagaagagaatcgagcagcagaaggagcagagaagaagactggaggagcagcagagaagagagagagaggccagaagacagcaggagagagagcagagaagaagagagcaggaggagaagagaagactggaggagctggagagaagaagaaaggaggaggaggagagaagaagagccgaggaggagaagagaagagtggagagagagcaggagtacatcagaagacagctggaggaggagcagagacacctggaggtgctgcagcagcagctgctgcaggagcaggccatgctgctgcacgaccacagaagaccccacccccagcacagccagcagcccccccccccccagcaggagagaagcaagcccagcttccacgcccccgagcccaaggcccactacgagcccgccgacagagccagagaggtgcccgtgagaaccaccagcagaagccccgtgctgagcagaagagacagccccctgcagggcagcggccagcagaacagccaggccggccagagaaacagcaccagcagcatcgagcccagactgctgtgggagagagtggagaagctggtgcccagacccggcagcggcagcagcagcggcagcagcaacagcggcagccagcccggcagccaccccggcagccagagcggcagcggcgagagattcagagtgagaagcagcagcaagagcgagggcagccccagccagagactggagaacgccgtgaagaagcccgaggacaagaaggaggtgttcagacccctgaagcccgccgtgagaatcgacctgaccgccctggccaaggagctgagagccgtggaggacgtgagacccccccacaaggtgaccgactacagcagcagcagcgaggagagcggcaccaccgacgaggaggacgacgacgtggagcaggagggcgccgacgagagcaccagcggccccgaggacaccagagccgccagcagcctgaacctgagcaacggcgagaccgagagcgtgaagaccatgatcgtgcacgacgacgtggagagcgagcccgccatgacccccagcaaggagggcaccctgatcgtgagacagacccagagcgccagcagcaccctgcagaagcacaagagcagcagcagcttcacccccttcatcgaccccagactgctgcagatcagccccagcagcggcaccaccgtgaccagcgtggtgggcttcagctgcgacggcatgagacccgaggccatcagacaggaccccaccagaaagggcagcgtggtgaacgtgaaccccaccaacaccagaccccagagcgacacccccgagatcagaaagtacaagaagagattcaacagcgagatcctgtgcgccgccctgtggggcgtgaacctgctggtgggcaccgagagcggcctgatgctgctggacagaagcggccagggcaaggtgtaccccctgatcaacagaagaagattccagcagatggacgtgctggagggcctgaacgtgctggtgaccatcagcggcaagaaggacaagctgagagtgtactacctgagctggctgagaaacaagatcctgcacaacgaccccgaggtggagaagaagcagggctggaccaccgtgggcgacctggagggctgcgtgcactacaaggtggtgaagtacgagagaatcaagttcctggtgatcgccctgaagagcagcgtggaggtgtacgcctgggcccccaagccctaccacaagttcatggccttcaagagcttcggcgagctggtgcacaagcccctgctggtggacctgaccgtggaggagggccagagactgaaggtgatctacggcagctgcgccggcttccacgccgtggacgtggacagcggcagcgtgtacgacatctacctgcccacccacgtgagaaagaacccccacagcatgatccagtgcagcatcaagccccacgccatcatcatcctgcccaacaccgacggcatggagctgctggtgtgctacgaggacgagggcgtgtacgtgaacacctacggcagaatcaccaaggacgtggtgctgcagtggggcgagatgcccaccagcgtggcctacatcagaagcaaccagaccatgggctggggcgagaaggccatcgagatcagaagcgtggagaccggccacctggacggcgtgttcatgcacaagagagcccagagactgaagttcctgtgcgagagaaacgacaaggtgttcttcgccagcgtgagaagcggcggcagcagccaggtgtacttcatgaccctgggcagaaccagcctgctgagctggtag

SEQ ID NO: 10338 - DNA, 2466 bp, Artificial Sequence
  Description of Artificial Sequence: Synthetic coding sequence
atggtggcccccgtgctggagaccagccacgtgttctgctgccccaacagagtgagaggcgtgctgaactggagcagcggccccagaggcctgctggccttcggcaccagctgcagcgtggtgctgtacgaccccctgaagagagtggtggtgaccaacctgaacggccacaccgccagagtgaactgcatccagtggatctgcaagcaggacggcagccccagcaccgagctggtgagcggcggcagcgacaaccaggtgatccactgggagatcgaggacaaccagctgctgaaggccgtgcacctgcagggccacgagggccccgtgtacgccgtgcacgccgtgtaccagagaagaaccagcgaccccgccctgtgcaccctgatcgtgagcgccgccgccgacagcgccgtgagactgtggagcaagaagggccccgaggtgacctggaagaccggccaggtggagagaggcagagcctggaagccccccgccagcctggccctgtgcagcagaagctgcgacagcatggtgagctgctacgccagcatcctgtgcaaggccctgtggaaggagaagctgcacaccttctggcaccacaacagaatcagcttcctgcccagcgccttcagacccatccccatcctggcctgcggcaacgacgactgcagaatccacatcttcgcccagcagaacgaccagttccagaaggtgctgagcctgtgcggccacgaggactggatcagaggcgtggagtgggccgccttcggcagagacctgttcctggccagctgcagccaggactgcctgatcagaatctggaagctgtacatcaagagcaccagcctggagacccaggacgacgacaacatcagactgaaggagaacaccttcaccatcgagaacgagagcgtgaagatcgccttcgccgtgaccctggagaccgtgctggccggccacgagaactgggtgaacgccgtgcactggcagcccgtgttctacaaggacggcgtgctgcagcagcccgtgagactgctgagcgccagcatggacaagaccatgatcctgtgggcccccgacgaggagagcggcgtgtggctggagcagagagagtggacccccgagatcgtgatcagcggccacttcgacggcgtgcaggacctggtgtgggaccccgagggcgagttcatcatcaccgtgggcaccgaccagaccaccagactgttcgccccctggaagagaaaggaccagagccaggtgacctggcacgagatcgccagaccccagatccacggctacgacctgaagtgcctggccatgatcaacagattccagttcgtgagcggcgccgacgagaaggtgctgagagtgttcagcgcccccagaaacttcgtggagaacttctgcgccatcaccggccagagcctgaaccacgtgctgtgcaaccaggacagcgacctgcccgagggcgccaccgtgcccgccctgggcctgagcaacaaggccgtgttccagggcgacatcgccagccagcccagcgacgaggaggagctgctgaccagcaccggcttcgagtaccagcaggtggccttccagcccagcatcctgaccgagccccccaccgaggaccacctgctgcagaacaccctgtggcccgaggtgcagaagctgtacggccacggctacgagatcttctgcgtgacctgcaacagcagcaagaccctgctggccagcgcctgcaaggccgccaagaaggagcacgccgccatcatcctgtggaacaccaccagctggaagcaggtgcagaacctggtgttccacagcctgaccgtgacccagatggccttcagccccaacgagaagttcctgctggccgtgagcagagacagaacctggagcctgtggaagaagcaggacaccatcagccccgagttcgagcccgtgttcagcctgttcgccttcaccaacaagatcaccagcgtgcacagcagaatcatctggagctgcgactggagccccgacagcaagtacttcttcaccggcagcagagacaagaaggtggtggtgtggggcgagtgcgacagcaccgacgactgcatcgagcacaacatcggcccctgcagcagcgtgctggacgtgggcggcgccgtgaccgccgtgagcgtgtgccccgtgctgcaccccagccagagatacgtggtggccgtgggcctggagtgcggcaagatctgcctgtacacctggaagaagaccgaccaggtgcccgagatcaacgactggacccactgcgtggagaccagccagagccagagccacaccctggccatcagaaagctgtgctggaagaactgcagcggcaagaccgagcagaaggaggccgagggcgccgagtggctgcacttcgccagctgcggcgaggaccacaccgtgaagatccacagagtgaacaagtgcgccctgtag

SEQ ID NO: 10339 - DNA, 969 bp, Artificial Sequence
  Description of Artificial Sequence: Synthetic coding sequence
atggtgagcgtgatcaacaccgtggacaccagccacgaggacatgatccacgacgcccagatggactactacggcaccagactggccacctgcagcagcgacagaagcgtgaagatcttcgacgtgagaaacggcggccagatcctgatcgccgacctgagaggccacgagggccccgtgtggcaggtggcctgggcccaccccatgtacggcaacatcctggccagctgcagctacgacagaaaggtgatcatctggagagaggagaacggcacctgggagaagagccacgagcacgccggccacgacagcagcgtgaacagcgtgtgctgggccccccacgactacggcctgatcctggcctgcggcagcagcgacggcgccatcagcctgctgacctacaccggcgagggccagtgggaggtgaagaagatcaacaacgcccacaccatcggctgcaacgccgtgagctgggcccccgccgtggtgcccggcagcctgatcgaccaccccagcggccagaagcccaactacatcaagagattcgccagcggcggctgcgacaacctgatcaagctgtggaaggaggaggaggacggccagtggaaggaggagcagaagctggaggcccacagcgactgggtgagagacgtggcctgggcccccagcatcggcctgcccaccagcaccatcgccagctgcagccaggacggcagagtgttcatctggacctgcgacgacgccagcagcaacacctggagccccaagctgctgcacaagttcaacgacgtggtgtggcacgtgagctggagcatcaccgccaacatcctggccgtgagcggcggcgacaacaaggtgaccctgtggaaggagagcgtggacggccagtgggtgtgcatcagcgacgtgaacaagggccagggcagcgtgagcgccagcgtgaccgagggccagcagaacgagcagtag

SEQ ID NO: 10340 - DNA, 1347 bp, Artificial Sequence
  Description of Artificial Sequence: Synthetic coding sequence
atgagcagcagaaagctgagcggccccaagggcagaagactgagcatccacgtggtgacctggaacgtggccagcgccgccccccccctggacctgagcgacctgctgcagctgaacaacagaaacctgaacctggacatctacgtgatcggcctgcaggagctgaacagcggcatcatcagcctgctgagcgacgccgccttcaacgacagctggagcagcttcctgatggacgtgctgagccccctgagcttcatcaaggtgagccacgtgagaatgcagggcatcctgctgctggtgttcgccaagtaccagcacctgccctacatccagatcctgagcaccaagagcacccccaccggcctgttcggctactggggcaacaagggcggcgtgaacatctgcctgaagctgtacggctactacgtgagcatcatcaactgccacctgcccccccacatcagcaacaactaccagagactggagcacttcgacagaatcctggagatgcagaactgcgagggcagagacatccccaacatcctggaccacgacctgatcatctggttcggcgacatgaacttcagaatcgaggacttcggcctgcacttcgtgagagagagcatcaagaacagatgctacggcggcctgtgggagaaggaccagctgagcatcgccaagaagcacgaccccctgctgagagagttccaggagggcagactgctgttcccccccacctacaagttcgacagaaacagcaacgactacgacaccagcgagaagaagagaaagcccgcctggaccgacagaatcctgtggagactgaagagacagccctgcgccggccccgacacccccatcccccccgccagccacttcagcctgagcctgagaggctacagcagccacatgacctacggcatcagcgaccacaagcccgtgagcggcaccttcgacctggagctgaagcccctggtgagcgcccccctgatcgtgctgatgcccgaggacctgtggaccgtggagaacgacatgatggtgagctacagcagcaccagcgacttccccagcagcccctgggactggatcggcctgtacaaggtgggcctgagagacgtgaacgactacgtgagctacgcctgggtgggcgacagcaaggtgagctgcagcgacaacctgaaccaggtgtacatcgacatcagcaacatccccaccaccgaggacgagttcctgctgtgctactacagcaacagcctgagaagcgtggtgggcatcagcagacccttccagatcccccccggcagcctgagagaggaccccctgggcgaggcccagccccagatctag

SEQ ID NO: 10341 - DNA, 1641 bp, Artificial Sequence; identical to SEQ ID NO: 10279
  Description of Artificial Sequence: Synthetic coding sequence

SEQ ID NO: 10342 - DNA, 3840 bp, Artificial Sequence
  Description of Artificial Sequence: Synthetic coding sequence
atgctgcaggccctgcagctgagaaccggcttcttctgcttcagagtgctggtggccctgagcccctgcgccctgcacgacagcggcagactgaccaccggcagcttcaacgtggtgagagacgaggaggaggagatcaagctggagatcaacatgctgaagaagtacagccaccacagaaacatcgccacctactacggcgccttcatcaagaagagcccccccggccacgacgaccagctgtggctggtgatggagttctgcggcgccggcagcatcaccgacctggtgaagaacaccaagggcaacaccctgaaggaggactggatcgcctacatcagcagagagatcctgagaggcctggcccacctgcacatccaccacgtgatccacagagacatcaagggccagaacgtgctgctgaccgagaacgccgaggtgaagctggtggacttcggcgtgagcgcccagctggacagaaccgtgggcagaagaaacaccttcatcggcaccccctactggatggcccccgaggtgatcgcctgcgacgagaaccccgacgccacctacgactacagaagcgacctgtggagctgcggcatcaccgccatcgagatggccgagggcgccccccccctgtgcgacatgcaccccatgagagccctgttcctgatccccagaaaccccccccccagactgaagagcaagaagtggagcaagaagttcttcagcttcatcgagggctgcctggtgaagaactacatgcagagacccagcaccgagcagctgctgaagcaccccttcatcagagaccagcccaacgagagacaggtgagaatccagctgaaggaccacatcgacagaaccagaaagaagagaggcgagaaggacgagaccgagtacgagtacagcggcagcgaggaggaggaggaggaggtgcccgagcaggagggcgagcccagcagcatcgtgaacgtgcccggcgagagcaccctgagaagagacttcctgagactgcagcaggagaacaaggagagaagcgaggccctgagaagacagcagctgctgcaggagcagcagctgagagagcaggaggagtacaagagacagctgctggccgagagacagaagagaatcgagcagcagaaggagcagagaagaagactggaggagcagcagagaagagagagagaggccagaagacagcaggagagagagcagagaagaagagagcaggaggagaagagaagactggaggagctggagagaagaagaaaggaggaggaggagagaagaagagccgaggaggagaagagaagagtggagagagagcaggagtacatcagaagacagctggaggaggagcagagacacctggaggtgctgcagcagcagctgctgcaggagcaggccatgctgctgcacgaccacagaagaccccacccccagcacagccagcagcccccccccccccagcaggagagaagcaagcccagcttccacgcccccgagcccaaggcccactacgagcccgccgacagagccagagaggtgcagtggagccacctggccagcctgaagaacaacgtgagccccgtgagcagaagccacagcttcagcgaccccagccccaagttcgcccaccaccacctgagaagccaggacccctgcccccccagcagaagcgaggtgctgagccagagcagcgacagcaagagcgaggcccccgaccccacccagaaggcctggagcagaagcgacagcgacgaggtgccccccagagtgcccgtgagaaccaccagcagaagccccgtgctgagcagaagagacagccccctgcagggcagcggccagcagaacagccaggccggccagagaaacagcaccagcagcatcgagcccagactgctgtgggagagagtggagaagctggtgcccagacccggcagcggcagcagcagcggcagcagcaacagcggcagccagcccggcagccaccccggcagccagagcggcagcggcgagagattcagagtgagaagcagcagcaagagcgagggcagccccagccagagactggagaacgccgtgaagaagcccgaggacaagaaggaggtgttcagacccctgaagcccgccgtgagaatcgacctgaccgccctggccaaggagctgagagccgtggaggacgtgagacccccccacaaggtgaccgactacagcagcagcagcgaggagagcggcaccaccgacgaggaggacgacgacgtggagcaggagggcgccgacgagagcaccagcggccccgaggacaccagagccgccagcagcctgaacctgagcaacggcgagaccgagagcgtgaagaccatgatcgtgcacgacgacgtggagagcgagcccgccatgacccccagcaaggagggcaccctgatcgtgagacagagcaccgtggaccagaagagagccagccaccacgagagcaacggcttcgccggcagaatccacctgctgcccgacctgctgcagcagagccacagcagcagcaccagcagcaccagcagcagccccagcagcagccagcccacccccaccatgagcccccagaccccccaggacaagctgaccgccaacgagacccagagcgccagcagcaccctgcagaagcacaagagcagcagcagcttcacccccttcatcgaccccagactgctgcagatcagccccagcagcggcaccaccgtgaccagcgtggtgggcttcagctgcgacggcatgagacccgaggccatcagacaggaccccaccagaaagggcagcgtggtgaacgtgaaccccaccaacaccagaccccagagcgacacccccgagatcagaaagtacaagaagagattcaacagcgagatcctgtgcgccgccctgtggggcgtgaacctgctggtgggcaccgagagcggcctgatgctgctggacagaagcggccagggcaaggtgtaccccctgatcaacagaagaagattccagcagatggacgtgctggagggcctgaacgtgctggtgaccatcagcggcaagaaggacaagctgagagtgtactacctgagctggctgagaaacaagatcctgcacaacgaccccgaggtggagaagaagcagggctggaccaccgtgggcgacctggagggctgcgtgcactacaaggtggtgaagtacgagagaatcaagttcctggtgatcgccctgaagagcagcgtggaggtgtacgcctgggcccccaagccctaccacaagttcatggccttcaagagcttcggcgagctggtgcacaagcccctgctggtggacctgaccgtggaggagggccagagactgaaggtgatctacggcagctgcgccggcttccacgccgtggacgtggacagcggcagcgtgtacgacatctacctgcccacccacatccagtgcagcatcaagccccacgccatcatcatcctgcccaacaccgacggcatggagctgctggtgtgctacgaggacgagggcgtgtacgtgaacacctacggcagaatcaccaaggacgtggtgctgcagtggggcgagatgcccaccagcgtggcctacatcagaagcaaccagaccatgggctggggcgagaaggccatcgagatcagaagcgtggagaccggccacctggacggcgtgttcatgcacaagagagcccagagactgaagttcctgtgcgagagaaacgacaaggtgttcttcgccagcgtgagaagcggcggcagcagccaggtgtacttcatgaccctgggcagaaccagcctgctgagctggtag

SEQ ID NO: 10343 - DNA, 1989 bp, Artificial Sequence
  Description of Artificial Sequence: Synthetic coding sequence
atggccagctgccccgacagcgacaacagctgggtgctggccggcagcgagagcctgcccgtggagaccctgggccccgccagcagaatggaccccgagagcgagagagccctgcaggccccccacagccccagcaagaccgacggcaaggagctggccggcaccatggacggcgagggcaccctgttccagaccgagagcccccagagcggcagcatcctgaccgaggagaccgaggtgaagggcaccctggagggcgacgtgtgcggcgtggagccccccggccccggcgacaccgtggtgcagggcgacctgcaggagaccaccgtggtgaccggcctgggccccgacacccaggacctggagggccagagccccccccagagcctgcccagcacccccaaggccgcctggatcagagaggagggcagatgcagcagcagcgacgacgacaccgacgtggacatggagggcctgagaagaagaagaggcagagaggccggccccccccagcccatggtgcccctggccgtggagaaccaggccggcggcgagggcgccggcggcgagctgggcatcagcctgaacatgtgcctgctgggcgccctggtgctgctgggcctgggcgtgctgctgttcagcggcggcctgagcgagagcgagaccggccccatggaggaggtggagagacaggtgctgcccgaccccgaggtgctggaggccgtgggcgacagacaggacggcctgagagagcagctgcaggcccccgtgccccccgacagcgtgcccagcctgcagaacatgggcctgctgctggacaagctggccaaggagaaccaggacatcagactgctgcaggcccagctgcaggcccagaaggaggagctgcagagcctgatgcaccagcccaagggcctggaggaggagaacgcccagctgagaggcgccctgcagcagggcgaggccttccagagagccctggagagcgagctgcagcagctgagagccagactgcagggcctggaggccgactgcgtgagaggccccgacggcgtgtgcctgagcggcggcagaggcccccagggcgacaaggccatcagagagcagggccccagagagcaggagcccgagctgagcttcctgaagcagaaggagcagctggaggccgaggcccaggccctgagacaggagctggagagacagagaagactgctgggcagcgtgcagcaggacctggagagaagcctgcaggacgccagcagaggcgaccccgcccacgccggcctggccgagctgggccacagactggcccagaagctgcagggcctggagaactggggccaggaccccggcgtgagcgccaacgccagcaaggcctggcaccagaagagccacttccagaacagcagagagtggagcggcaaggagaagtggtgggacggccagagagacagaaaggccgagcactggaagcacaagaaggaggagagcggcagagagagaaagaagaactggggcggccaggaggacagagagcccgccggcagatggaaggagggcagacccagagtggaggagagcggcagcaagaaggagggcaagagacagggccccaaggagccccccagaaagagcggcagcttccacagcagcggcgagaagcagaagcagcccagatggagagagggcaccaaggagctgcccctgagccccgccttcttcggcgaggacggcatcttcagacacgacagactgagattcagagacttcgtggacgccctggaggacagcctggaggaggtggccgtgcagcagaccggcgacgacgacgaggtggacgacttcgaggacttcatcttcagccacttcttcggcgacaaggccctgaagaagagaagcggcaagaaggacaagcacagccagagccccagagccgccggccccagagagggccacagccacagccaccaccaccaccacagaggctag

SEQ ID NO: 10344 - DNA, 2403 bp, Artificial Sequence
  Description of Artificial Sequence: Synthetic coding sequence
atggtggcccccgtgctggagaccagccacgtgttctgctgccccaacagagtgagaggcgtgctgaactggagcagcggccccagaggcctgctggccttcggcaccagctgcagcgtggtgctgtacgaccccctgaagagagtggtggtgaccaacctgaacggccacaccgccagagtgaactgcatccagtggatctgcaagcaggacggcagccccagcaccgagctggtgagcggcggcagcgacaaccaggtgatccactgggagatcgaggacaaccagctgctgaaggccgtgcacctgcagggccacgagggccccgtgtacgccgtgcacgccgtgtaccagagaagaaccagcgaccccgccctgtgcaccctgatcgtgagcgccgccgccgacagcgccgtgagactgtggagcaagaagggccccgaggtgcccatcctggcctgcggcaacgacgactgcagaatccacatcttcgcccagcagaacgaccagttccagaaggtgctgagcctgtgcggccacgaggactggatcagaggcgtggagtgggccgccttcggcagagacctgttcctggccagctgcagccaggactgcctgatcagaatctggaagctgtacatcaagagcaccagcctggagacccaggacgacgacaacatcagactgaaggagaacaccttcaccatcgagaacgagagcgtgaagatcgccttcgccgtgaccctggagaccgtgctggccggccacgagaactgggtgaacgccgtgcactggcagcccgtgttctacaaggacggcgtgctgcagcagcccgtgagactgctgagcgccagcatggacaagaccatgatcctgtgggcccccgacgaggagagcggcgtgtggctggagcaggtgagagtgggcgaggtgggcggcaacaccctgggcttctacgactgccagttcaacgaggacggcagcatgatcatcgcccacgccttccacggcgccctgcacctgtggaagcagaacaccgtgaaccccagagagtggacccccgagatcgtgatcagcggccacttcgacggcgtgcaggacctggtgtgggaccccgagggcgagttcatcatcaccgtgggcaccgaccagaccaccagactgttcgccccctggaagagaaaggaccagagccaggtgacctggcacgagatcgccagaccccagatccacggctacgacctgaagtgcctggccatgatcaacagattccagttcgtgagcggcgccgacgagaaggtgctgagagtgttcagcgcccccagaaacttcgtggagaacttctgcgccatcaccggccagagcctgaaccacgtgctgtgcaaccaggacagcgacctgcccgagggcgccaccgtgcccgccctgggcctgagcaacaaggccgtgttccagggcgacatcgccagccagcccagcgacgaggaggagctgctgaccagcaccggcttcgagtaccagcaggtggccttccagcccagcatcctgaccgagccccccaccgaggaccacctgctgcagaacaccctgtggcccgaggtgcagaagctgtacggccacggctacgagatcttctgcgtgacctgcaacagcagcaagaccctgctggccagcgcctgcaaggccgccaagaaggagcacgccgccatcatcctgtggaacaccaccagctggaagcaggtgcagaacctggtgttccacagcctgaccgtgacccagatggccttcagccccaacgagaagttcctgctggccgtgagcagagacagaacctggagcctgtggaagaagcaggacaccatcagccccgagttcgagcccgtgttcagcctgttcgccttcaccaacaagatcaccagcgtgcacagcagaatcatctggagctgcgactggagccccgacagcaagtacttcttcaccggcagcagagacaagaaggtggtggtgtggggcgagtgcgacagcaccgacgactgcatcgagcacaacatcggcccctgcagcagcgtgctggacgtgggcggcgccgtgaccgccgtgagcgtgtgccccgtgctgcaccccagccagagatacgtggtggccgtgggcctggagtgcggcaagatctgcctgtacacctggaagaagaccgaccaggtgcccgagatcaacgactggacccactgcgtggagaccagccagagccagagccacaccctggccatcagaaagctgtgctggaagaactgcagcggcaagaccgagcagaaggaggccgagggcgccgagtggctgcacttcgccagctgcggcgaggaccacaccgtgaagatccacagagtgaacaagtgcgccctgtag

SEQ ID NO: 10345 - DNA, 561 bp, Artificial Sequence
  Description of Artificial Sequence: Synthetic coding sequence
atggccggcgagaacttcgccacccccttccacggccacgtgggcagaggcgccttcagcgacgtgtacgagcccgccgaggacaccttcctgctgctgaacgccctggaggccgccgccgccgagctggccggcgtggagatctgcctggaggtgggcagcggcagcggcgtggtgagcgccttcctggccagcatgatcggcccccaggccctgtacatgtgcaccgacatcaaccccgaggccgccgcctgcaccctggagaccgccagatgcaacaaggtgcacatccagcccgtgatcaccgacctggtgggcagccacggcatcgaggccgcctgggccggcggcaagaacggcagagaggtgatggacagattcttccccctggtgcccgacctgctgagccccaagggcctgttctacctggtgaccatcaaggagaacaaccccgaggagatcctgaagatcatgaagaccaagggcctgcagggcaccaccgccctgagcagacaggccggccaggagaccctgagcgtgctgaagttcaccaagagctag

SEQ ID NO: 10346 - DNA, 2352 bp, Artificial Sequence
  Description of Artificial Sequence: Synthetic coding sequence
atggccaagtacaacaccggcggcaaccccaccgaggacgtgagcgtgaacagcagacccttcagagtgaccggccccaacagcagcagcggcatccaggccagaaagaacctgttcaacaaccagggcaacgccagcccccccgccggccccagcaacgtgcccaagttcggcagccccaagccccccgtggccgtgaagcccagcagcgaggagaagcccgacaaggagcccaagccccccttcctgaagcccaccggcgccggccagagattcggcacccccgccagcctgaccaccagagaccccgaggccaaggtgggcttcctgaagcccgtgggccccaagcccatcaacctgcccaaggaggacagcaagcccaccttcccctggccccccggcaacaagcccagcctgcacagcgtgaaccaggaccacgacctgaagcccctgggccccaagagcggccccaccccccccaccagcgagaacgagcagaagcaggccttccccaagctgaccggcgtgaagggcaagttcatgagcgccagccaggacctggagcccaagcccctgttccccaagcccgccttcggccagaagccccccctgagcaccgagaacagccacgaggacgagagccccatgaagaacgtgagcagcagcaagggcagccccgcccccctgggcgtgagaagcaagagcggccccctgaagcccgccagagaggacagcgagaacaaggaccacgccggcgagatcagcagcctgcccttccccggcgtggtgctgaagcccgccgccagcagaggcggccccggcctgagcaagaacggcgaggagaagaaggaggacagaaagatcgacgccgccaagaacaccttccagagcaagatcaaccaggaggagctggccagcggcaccccccccgccagattccccaaggcccccagcaagctgaccgtgggcggcccctggggccagagccaggagaaggagaagggcgacaagaacagcgccacccccaagcagaagcccctgccccccctgttcaccctgggcccccccccccccaagcccaacagaccccccaacgtggacctgaccaagttccacaagaccagcagcggcaacagcaccagcaagggccagaccagctacagcaccaccagcctgcccccccccccccccagccaccccgccagccagccccccctgcccgccagccaccccagccagccccccgtgcccagcctgccccccagaaacatcaagccccccttcgacctgaagagccccgtgaacgaggacaaccaggacggcgtgacccacagcgacggcgccggcaacctggacgaggagcaggacagcgagggcgagacctacgaggacatcgaggccagcaaggagagagagaagaagagagagaaggaggagaagaagagactggagctggagaagaaggagcagaaggagaaggagaagaaggagcaggagatcaagaagaagttcaagctgaccggccccatccaggtgatccacctggccaaggcctgctgcgacgtgaagggcggcaagaacgagctgagcttcaagcagggcgagcagatcgagatcatcagaatcaccgacaaccccgagggcaagtggctgggcagaaccgccagaggcagctacggctacatcaagaccaccgccgtggagatcgactacgacagcctgaagctgaagaaggacagcctgggcgcccccagcagacccatcgaggacgaccaggaggtgtacgacgacgtggccgagcaggacgacatcagcagccacagccagagcggcagcggcggcatcttcccccccccccccgacgacgacatctacgacggcatcgaggaggaggacgccgacgacggcttccccgccccccccaagcagctggacatgggcgacgaggtgtacgacgacgtggacaccagcgacttccccgtgagcagcgccgagatgagccagggcaccaacgtgggcaaggccaagaccgaggagaaggacctgaagaagctgaagaagcaggagaaggaggagaaggacttcagaaagaagttcaagtacgacggcgagatcagagtgctgtacagcaccaaggtgaccaccagcatcaccagcaagaagtggggcaccagagacctgcaggtgaagcccggcgagagcctggaggtgatccagaccaccgacgacaccaaggtgctgtgcagaaacgaggagggcaagtacggctacgtgctgagaagctacctggccgacaacgacggcgagatctacgacgacatcgccgacggctgcatctacgacaacgactag

SEQ ID NO: 10347 - DNA, 1722 bp, Artificial Sequence
  Description of Artificial Sequence: Synthetic coding sequence
atgatccccccccaggaggccagcgccagaagaagagagatcgaggacaagctgaagcaggaggaggagaccctgagcttcatcagagacagcctggagaagagcgaccagctgaccaagaacatggtgagcatcctgagcagcttcgagagcagactgatgaagctggagaacagcatcatccccgtgcacaagcagaccgagaacctgcagagactgcaggagaacgtggagaagaccctgagctgcctggaccacgtgatcagctactaccacgtgatcagcggcgacgacgacctggaggcccaggaggacgtgaccctggagcacctgcccgagagcgtgctgcaggacgtgatcagaatcagcagatggctggtggagtacggcagaaaccaggacttcatgaacgtgtactaccagatcagaagcagccagctggacagaagcatcaagggcctgaaggagcacttccacaagagcagcagcagcagcggcgtgccctacagccccgccatccccaacaagagaaaggacacccccaccaagaagcccgtgaagagacccggcagagacgacatgctggacgtggagaccgacgcctacatccactgcgtgagcgccttcgtgaagctggcccagagcgagtaccagctgctggccgacatcatccccgagcaccaccagaagaagaccttcgacagcctgatccaggacgccctggacggcctgatgctggagggcgagaacatcgtgagcgccgccagaaaggccatcgtgagacacgacttcagcaccgtgctgaccgtgttccccatcctgagacacctgaagcagaccaagcccgagttcgaccaggtgctgcagggcaccgccgccagcaccaagaacaagctgcccggcctgatcaccagcatggagaccatcggcgccaaggccctggaggacttcgccgacaacatcaagaacgaccccgacaaggagtacaacatgcccaaggacggcaccgtgcacgagctgaccagcaacgccatcctgttcctgcagcagctgctggacttccaggagaccgccggcgccatgctggccagccaggagaccagcagcagcgccaccagctacagcagcgagttcagcaagagactgctgagcacctacatctgcaaggtgctgggcaacctgcagctgaacctgctgagcaagagcaaggtgtacgaggaccccgccctgagcgccatcttcctgcacaacaactacaactacatcctgaagagcctggagaagagcgagctgatccagctggtggccgtgacccagaagaccgccgagagaagctacagagagcacatcgagcagcagatccagacctaccagagaagctggctgaaggtgaccgactacatcgccgagaagaacctgcccgtgttccagcccggcgtgaagctgagagacaaggagagacagatcatcaaggagagattcaagggcttcaacgacggcctggaggagctgtgcaagatccagaaggcctgggccatccccgacaccgagcagagagacagaatcagacaggcccagaagaccatcgtgaaggagacctacggcgccttcctgcagaagttcggcagcgtgcccttcaccaagaaccccgagaagtacatcaagtacggcgtggagcaggtgggcgacatgatcgacagactgttcgacaccagcgcctag

SEQ ID NO: 10348 - DNA, 2475 bp, Artificial Sequence
  Description of Artificial Sequence: Synthetic coding sequence
atgatgcagaacgtgcacctggcccccgagaccgacgaggacgacctgtacagcggctacaacgactacaaccccatctacgacatcgaggagctggagaacgacgccgccttccagcaggccgtgagaaccagccacggcagaagaccccccatcaccgccaagatcagcagcaccgccgtgaccagacccatcgccaccggctacggcagcaagaccagcctggccagcagcatcggcagacccatgaccggcgccatccaggacggcgtgaccagacccatgaccgccgtgagagccgccggcttcaccaaggccgccctgagaggcagcgccttcgaccccctgagccagagcagaggccccgccagccccctggaggccaagaagaaggacagccccgaggagaagatcaagcagctggagaaggaggtgaacgagctggtggaggagagctgcatcgccaacagctgcggcgacctgaagctggccctggagaaggccaaggacgccggcagaaaggagagagtgctggtgagacagagagagcaggtgaccacccccgagaacatcaacctggacctgacctacagcgtgctgttcaacctggccagccagtacagcgtgaacgagatgtacgccgaggccctgaacacctaccaggtgatcgtgaagaacaagatgttcagcaacgccggcatcctgaagatgaacatgggcaacatctacctgaagcagagaaactacagcaaggccatcaagttctacagaatggccctggaccaggtgcccagcgtgaacaagcagatgagaatcaagatcatgcagaacatcggcgtgaccttcatccaggccggccagtacagcgacgccatcaacagctacgagcacatcatgagcatggcccccaacctgaaggccggctacaacctgaccatctgctacttcgccatcggcgacagagagaagatgaagaaggccttccagaagctgatcaccgtgcccctggagatcgacgaggacaagtacatcagccccagcgacgacccccacaccaacctggtgaccgaggccatcaagaacgaccacctgagacagatggagagagagagaaaggccatggccgagaagtacatcatgaccagcgccaagctgatcgcccccgtgatcgagaccagcttcgccgccggctacgactggtgcgtggaggtggtgaaggccagccagtacgtggagctggccaacgacctggagatcaacaaggccgtgacctacctgagacagaaggactacaaccaggccgtggagatcctgaaggtgctggagaagaaggacagcagagtgaagagcgccgccgccaccaacctgagcgccctgtactacatgggcaaggacttcgcccaggccagcagctacgccgacatcgccgtgaacagcgacagatacaaccccgccgccctgaccaacaagggcaacaccgtgttcgccaacggcgactacgagaaggccgccgagttctacaaggaggccctgagaaacgacagcagctgcaccgaggccctgtacaacatcggcctgacctacgagaagctgaacagactggacgaggccctggactgcttcctgaagctgcacgccatcctgagaaacagcgccgaggtgctgtaccagatcgccaacatctacgagctgatggagaaccccagccaggccatcgagtggctgatgcaggtggtgagcgtgatccccaccgacccccaggtgctgagcaagctgggcgagctgtacgacagagagggcgacaagagccaggccttccagtactactacgagagctacagatacttcccctgcaacatcgaggtgatcgagtggctgggcgcctactacatcgacacccagttctgggagaaggccatccagtacttcgagagagccagcctgatccagcccacccaggtgaagtggcagctgatggtggccagctgcttcagaagaagcggcaactaccagaaggccctggacacctacaaggacacccacagaaagttccccgagaacgtggagtgcctgagattcctggtgagactgtgcaccgacctgggcctgaaggacgcccaggagtacgccagaaagctgaagagactggagaagatgaaggagatcagagagcagagaatcaagagcggcagagacggcagcggcggcagcagaggcaagagagagggcagcgccagcggcgacagcggccagaactacagcgccagcagcaagggcgagagactgagcgccagactgagagccctgcccggcaccaacgagccctacgagagcagcagcaacaaggagatcgacgccagctacgtggaccccctgggcccccagatcgagagacccaagaccgccgccaagaagagaatcgacgaggacgacttcgccgacgaggagctgggcgacgacctgctgcccgagtag

SEQ ID NO: 10349 - DNA, 2850 bp, Artificial Sequence
  Description of Artificial Sequence: Synthetic coding sequence
atgctgagaaccgccggcagagacggcctgtgcagactgagcacctacctggaggagctggaggccgtggagctgaagaagttcaagctgtacctgggcaccgccaccgagctgggcgagggcaagatcccctggggcagcatggagaaggccggccccctggagatggcccagctgctgatcacccacttcggccccgaggaggcctggagactggccctgagcaccttcgagagaatcaacagaaaggacctgtgggagagaggccagagagaggacctggtgagagacaccccccccggcggccccagcagcctgggcaaccagagcacctgcctgctggaggtgagcctggtgacccccagaaaggacccccaggagacctacagagactacgtgagaagaaagttcagactgatggaggacagaaacgccagactgggcgagtgcgtgaacctgagccacagatacaccagactgctgctggtgaaggagcacagcaaccccatgcaggtgcagcagcagctgctggacaccggcagaggccacgccagaaccgtgggccaccaggccagccccatcaagatcgagaccctgttcgagcccgacgaggagagacccgagccccccagaaccgtggtgatgcagggcgccgccggcatcggcaagagcatgctggcccacaaggtgatgctggactgggccgacggcaagctgttccagggcagattcgactacctgttctacatcaactgcagagagatgaaccagagcgccaccgagtgcagcatgcaggacctgatcttcagctgctggcccgagcccagcgcccccctgcaggagctgatcagagtgcccgagagactgctgttcatcatcgacggcttcgacgagctgaagcccagcttccacgacccccagggcccctggtgcctgtgctgggaggagaagagacccaccgagctgctgctgaacagcctgatcagaaagaagctgctgcccgagctgagcctgctgatcaccaccagacccaccgccctggagaagctgcacagactgctggagcaccccagacacgtggagatcctgggcttcagcgaggccgagagaaaggagtacttctacaagtacttccacaacgccgagcaggccggccaggtgttcaactacgtgagagacaacgagcccctgttcaccatgtgcttcgtgcccctggtgtgctgggtggtgtgcacctgcctgcagcagcagctggagggcggcggcctgctgagacagaccagcagaaccaccaccgccgtgtacatgctgtacctgctgagcctgatgcagcccaagcccggcgcccccagactgcagcccccccccaaccagagaggcctgtgcagcctggccgccgacggcctgtggaaccagaagatcctgttcgaggagcaggacctgagaaagcacggcctggacggcgaggacgtgagcgccttcctgaacatgaacatcttccagaaggacatcaactgcgagagatactacagcttcatccacctgagcttccaggagttcttcgccgccatgtactacatcctggacgagggcgagggcggcgccggccccgaccaggacgtgaccagactgctgaccgagtacgccttcagcgagagaagcttcctggccctgaccagcagattcctgttcggcctgctgaacgaggagaccagaagccacctggagaagagcctgtgctggaaggtgagcccccacatcaagatggacctgctgcagtggatccagagcaaggcccagagcgacggcagcaccctgcagcagggcagcctggagttcttcagctgcctgtacgagatccaggaggaggagttcatccagcaggccctgagccacttccaggtgatcgtggtgagcaacatcgccagcaagatggagcacatggtgagcagcttctgcctgaagagatgcagaagcgcccaggtgctgcacctgtacggcgccacctacagcgccgacggcgaggacagagccagatgcagcgccggcgcccacaccctgctggtgcagctgcccgagagaaccgtgctgctggacgcctacagcgagcacctggccgccgccctgtgcaccaaccccaacctgatcgagctgagcctgtacagaaacgccctgggcagcagaggcgtgaagctgctgtgccagggcctgagacaccccaactgcaagctgcagaacctgagactgaagagatgcagaatcagcagcagcgcctgcgaggacctgagcgccgccctgatcgccaacaagaacctgaccagaatggacctgagcggcaacggcgtgggcttccccggcatgatgctgctgtgcgagggcctgagacacccccagtgcagactgcagatgatccagctgagaaagtgccagctggagagcggcgcctgccaggagatggccagcgtgctgggcaccaacccccacctggtggagctggacctgaccggcaacgccctggaggacctgggcctgagactgctgtgccagggcctgagacaccccgtgtgcagactgagaaccctgtggctgcagctggacagctgcggcctgaccgccaaggcctgcgagaacctgtacttcaccctgggcatcaaccagaccctgaccgacctgtacctgaccaacaacgccctgggcgacaccggcgtgagactgctgtgcaagagactgagccaccccggctgcaagctgagagtgctgtggctgttcggcatggacctgaacaagatgacccacagcagactggccgccctgagagtgaccaagccctacctggacatcggctgctag

SEQ ID NO: 10350 - DNA, 5796 bp, Artificial Sequence
  Description of Artificial Sequence: Synthetic coding sequence
atggccgccagaagcgcccccagctgccacctgagactggagtgggtgtacggctacagaggccaccagtgcagaaacaacctgtactacaccgccgccaaggagatcgtgtacttcgtggccggcgtgggcgtggtgtacagccccagagagcacagacagaagttctacagaggccacagcgacgacatcatcagcctggccctgcaccccgagagagtgctggtggccaccggccaggtgggcaaggagccctacatctgcatctgggacagctacaccgtgcagaccatcagcgtgctgaaggacgtgcacacccacggcatcgcctgcctggccttcgacctggacggccagagactggtgagcgtgggcctggacagcaagaacgccgtgtgcgtgtgggactggaagagaggcaagatgctgagcatggcccccggccacaccgacagaatcttcgacatcagctgggacctgtaccagcccaacaagctggtgagctgcggcgtgaagcacatcaagttctggagcctgtgcggcaacgccctgacccccaagagaggcgtgttcggcaagaccggcgacctgcagaccatcctgtgcctggcctgcgccagagacgagctgacctacagcggcgccctgaacggcgacatctacgtgtggaagggcatcaacctgatcagaaccatccagggcgcccacgccgccggcatcttcagcatgaacgcctgcgaggagggcttcgccaccggcggcagagacggctgcatcagactgtgggacctgaccttcaagcccatcaccgtgatcgacctgagagagaccgaccagggctacaagggcctgagcgtgagaagcgtgtgctggagaggcgaccacatcctggtgggcacccaggacagcgagatcttcgagatcgtggtgcaggagagaaacaagcccttcctgatcatgcagggccactgcgagggcgagctgtgggccctggccgtgcaccccaccaagcccctggccgtgaccggcagcgacgacagaagcgtgagaatctggagcctggtggaccacgccctgatcgccagatgcaacatggaggagcccatcagatgcgccgccgtgaacgccgacggcatccacctggccctgggcatgaaggacggcagcttcaccgtgctgagagtgagagacatgaccgaggtggtgcacatcaaggacagaaaggaggccatccacgagctgaagtacagccccgacggcacctacctggccgtgggctgcaacgacagcagcgtggacatctacggcgtggcccagagatacaagaaggtgggcgagtgcctgggcagcctgagcttcatcacccacctggactggagcagcgacagcagatacctgcagaccaacgacggcaacggcaagagactgttctacagaatgcccggcggcaaggaggtgaccagcaccgaggagatcaagggcgtgcactgggccagctggacctgcgtgagcggcctggaggtgaacggcatctggcccaagtacagcgacatcaacgacatcaacagcgtggacggcaactacatcggccaggtgctggtgaccgccgacgactacggcatcatcaagctgttcagatacccctgcctgagaaagggcgccaagttcagaaagtacatcggccacagcgcccacgtgaccaacgtgagatggagccacgactaccagtgggtgatcagcatcggcggcgccgaccacagcgtgttccagtggaagttcatccccgagagaaagctgaaggacgccgtgcacatcgccccccaggagagcctggccgacagccacagcgacgagagcgacagcgacctgagcgacgtgcccgagctggacagcgagatcgagcaggagacccagctgacctacagaagacaggtgtacaaggaggacctgccccagctgaaggagcagtgcaaggagaagcagaagagcgccaccagcaagagaagagagagagcccccggcaacagcatcagactgcacttcgtgcacggctacagaggctacgactgcagaagcaacctgttctacacccagatcggcgagatcgtgtaccacgtggccgccgtgggcgtgatctacaacagacagcagaacacccagagattctacctgggccacgacgacgacatcctgtgcctgaccatccaccccctgaaggactacgtggccaccggccaggtgggcagagaccccagcatccacatctgggacaccgagaccatcaagcccctgagcatcctgaagggccaccaccagtacggcgtgagcgccgtggacttcagcgccgacggcaagagactggccagcgtgggcatcgacgacagccacaccgtggtgctgtgggactggaagaagggcgagaagctgagcatcgccagaggcagcaaggacaagatcttcgtggtgaagatgaacccctacgtgcccgacaagctgatcaccgccggcatcaagcacatgaagttctggagaaaggccggcgacgtgtgcatctggagagacatcttcctggtgaagaccgtgaaggcccacgacggccccgtgttcagcatgcacgccctggagaagggcttcgtgaccggcggcaaggacggcatcgtggccctgtgggacgacagcttcgagagatgcctgaagacctacgccatcaagagagccgccctggcccccggcagcaagggcctgctgctggaggacaaccccagcatcagagccatcagcctgggccacggccacatcctggtgggcaccaagaacggcgagatcctggaggtggacaagagcggccccatcaccctgctggtgcagggccacatggagggcgaggtgtggggcctggccacccacccctacctgcccatctgcgccaccgtgagcgacgacaagaccctgagaatctgggacctgagccccagccactgcatgctggccgtgagaaagctgaagaagggcggcagatgctgctgcttcagccccgacggcaaggccctggccgtgggcctgaacgacggcagcttcctgatggccaacgccgacaccctggaggacctggtgagcttccaccacagaaaggacatgatcagcgacatcagattcagccccggcagcggcaagtacctggccgtggccagccacgacagcttcatcgacatctacaacgtgatgagcagcaagagagtgggcatctgcaagggcgccaccagctacatcacccacatcgactgggacatcagaggcaagctgctgcaggtgaacaccggcgccaaggagcagctgttcttcgaggcccccagaggcaagaagcagaccatccccagcgtggaggtggagaagatcgcctgggccagctggaccagcgtgctgggcctgtgctgcgagggcatctggcccgtgatcggcgaggtgaccgacgtgaccgccagctgcctgaccagcgacaagatggtgctggccaccggcgacgacctgggcttcgtgaagctgttcagataccccaccaagggcaagttcggcaagttcaagagatacgtggcccacagcacccacgtgaccaacgtgagatggacctacgacgacagcatgctggtgaccctgggcggcaccgacatgagcctgatggtgtggaccaacgagatggagggctacagagagaagagaccctgcgacagcgaggagagcgacatcgacagcgaggaggacggcggctacgacagcgacgtgaccagagagaacgagatcagctacaccatcagagccctgagcaccaacatcagacccatgctgggcatcaagccccacctgcagcagaaggagcccagcatcgacgagagaccccccgtgagcagagcccccccccagcccgagaagctgcagaccaacaacgtgggcaagaagaagagacccatcgaggacctggtgctggagctgatcttcggctacagaggcagagactgcagaaacaacgtgcactacctgaacgacggcgacgacatcatctaccacaccgccagcgtgggcatcctgcacaacgtggccaccggcagccagagcttctaccaggagcacaacgacgacatcctgtgcctgaccgtgaaccagcaccccaagttcatcaacatcgtggccaccggccaggtggtgctgagctgcagcctgctgaccaccgcccccagcatccacatctgggacgccatgaacaagcagaccctgagcatcctgagatgctaccacagcaagggcgtgtgcagcgtgagcttcagcgccaccggcaagctgctgctgagcgtgggcctggaccccgagcacaccatcaccatctggagatggcaggagggcgccaagatcgccagcagagccggccacaaccagagaatcttcgtggccgagttcagacccgacagcgacacccagttcgtgagcgtgggcgtgaagcacgtgaagttctggaccctggccggcagagccctgctgagcaagaagggcctgctgagcaccctggaggacgccagaatgcagaccatgctggccatcgccttcggcgccaacaacctgaccttcaccggcaccatcagcggcgacgtgtgcgtgtggaaggaccacatcctgtgcagaatcgtggccagagcccacaacggccccgtgttcgccatgtacaccaccctgagagacggcctgatcgtgaccggcggcaaggagagacccagcaaggagggcggcgccgtgaagctgtgggaccaggagctgagaagatgcagagccttcagactggagaccggccaggccaccgactgcgtgagaagcgtgtgcagaggcaagggcaagatcctggtgggcaccagaaacgccgagatcatcgaggtgggcgagaagaacgccgcctgcaacatcctggtgaacggccacgtggacggccccatctggggcctggccacccaccccagcagagacttcttcctgagcgccgccgaggacggcaccgtgagactgtgggacatcgccgacaagaagatgctgaacaaggtgaacctgggccacgccgccagaaccgtgtgctacagccccgagggcgacatggtggccatcggcatgaagaacggcgagttcatcatcctgctggtgagcagcctgaagatctggggcaagaagagagacagaagatgcgccatccacgacatcagattcagccccgacagcagatacctggccgtgggcagcagcgagaacagcgtggacttctacgacctgaccctgggccccaccctgaacagaatcagctactgcaaggacatccccagcttcgtgatccagatggacttcagcgccgacagcagctacctgcaggtgagcagcggctgctacaagagacacgtgtacgaggtgcccagcggcaagcacctgatggaccacgccgccatcgacagaatcacctgggccacctggaccagcatcctgggcgacgaggtgctgggcatctggagcagacacgccgagaaggccgacgtgaactgcgcctgcgtgagccacagcggcatcagcctggtgaccggcgacgacttcggcatggtgaagctgttcgacttcccctgccccgagaagttcgccaagcacaagagattcctgggccacagcccccacgtgaccaacatcagattcaccagcggcgacagacacgtggtgagcgccggcggcgacgactgcagcctgttcgtgtggaagtgcgtgcacaccccccactag

SEQ ID NO: 10351 - DNA, 429 bp, Artificial Sequence
  Description of Artificial Sequence: Synthetic coding sequence
atgagcatcagcagcgacgaggtgaacttcctggtgtacagatacctgcaggagagcggcttcagccacagcgccttcaccttcggcatcgagagccacatcagccagagcaacatcaacggcgccctggtgccccccgccgccctgatcagcatcatccagaagggcctgcagtacgtggaggccgaggtgagcatcaacgaggacggcaccctgttcgacggcagacccatcgagagcctgagcctgatcgacgccgtgatgcccgacgtggtgcagaccagacagcaggcctacagagacaagctggcccagcagcaggccgccgccgccgccgccgccgccgccgccgccagccagcagggcagcgccaagaacggcgagaacaccgccaacggcgaggagaacggcgcccacaccatcgcctag

SEQ ID NO: 10352 - DNA, 1704 bp, Artificial Sequence
  Description of Artificial Sequence: Synthetic coding sequence
atggagttcttcaccatgccccccagaacctggttcatgagacagctgcagagaatgtggttcctgagacccagcatggccatcatggtgttcagaatgatcgaggagagacccacccacgccatcaccgtgagagtgagctacctggagatctacaacgagagcctgttcgacctgctgagcaccctgccctacgtgggccccagcgtgacccccatgaccatcgtggagaacccccagggcgtgttcatcaagggcctgagcgtgcacctgaccagccaggaggaggacgccttcagcctgctgttcgagggcgagaccaacagaatcatcgccagccacaccatgaacaagaacagcagcagaagccactgcatcttcaccatctacctggaggcccacagcagaaccctgagcgaggagaagtacatcaccagcaagatcaacctggtggacctggccggcagcgagagactgggcaagagcggcagcgagggccaggtgctgaaggaggccacctacatcaacaagagcctgagcttcctggagcaggccatcatcgccctgggcgaccagaagagagaccacatccccttcagacagtgcaagctgacccacgccctgaaggacagcctgggcggcaactgcaacatggtgctggtgaccaacatctacggcgaggccgcccagctggaggagaccctgagcagcctgagattcgccagcagaatgaagctggtgaccaccgagcccgccatcaacgagaagtacgacgccgagagaatggtgaagaacctggagaaggagctggccctgctgaagcaggagctggccatccacgacagcctgaccaacagaaccttcgtgacctacgaccccatggacgagatccagatcgccgagatcaacagccaggtgagaagatacctggagggcaccctggacgagatcgacatcatcagcctgagacagatcaaggaggtgttcaaccagttcagagtggtgctgagccagcaggagcaggaggtggagagcaccctgagaagaaagtacaccctgatcgacagaaacgacttcgccgccatcagcgccatccagaaggccggcctggtggacgtggacggccacctggtgggcgagcccgagggccagaacttcggcctgggcgtggcccccttcagcaccaagcccggcaagaaggccaagagcaagaagaccttcaaggagcccctgagacccgacaccccccccagcaagcccgtggccttcgaggagttcaagaacgagcagggcagcgagatcaacagaatcttcaaggagaacaagagcatcctgaacgagagaagaaagagagccagcgagaccacccagcacatcaacgccatcaagagagagatcgacgtgaccaaggaggccctgaacttccagaagagcctgagagagaagcagggcaagtacgagaacaagggcctgatgatcatcgacgaggaggagttcctgctgatcctgaagctgaaggacctgaagaagcagtacagaagcgagtaccaggacctgagagacctgagagccgagatccagtactgccagcacctggtggaccagtgcagacacagactgctgatgggcgccaccgtgggcaagaacctgaccagcggcaccatgagccccctgagcagcctgagaacctgcagatggcactag

SEQ ID NO: 10353 - DNA, 1428 bp, Artificial Sequence
  Description of Artificial Sequence: Synthetic coding sequence
atggccgagggcagcgtgatgttcagcgacgtgagcatcgacttcagccaggaggagtgggactgcctggaccccgtgcagagagacctgtacagagacgtgatgctggagaactacggcaacctggtgagcatgggcctgtacacccccaagccccaggtgatcagcctgctggagcagggcaaggagccctggatggtgggcagagagctgaccagaggcctgtgcagcgacctggagagcatgtgcgagaccaagctgctgagcctgaagaaggaggtgtacgagatcgagctgtgccagagagagatcatgggcctgaccaagcacggcctggagtacagcagcttcggcgacgtgctggagtacagaagccacctggccaagcagctgggctaccccaacggccacttcagccaggagatcttcacccccgagtacatgcccaccttcatccagcagaccttcctgaccctgcaccagatcatcaacaacgaggacagaccctacgagtgcaagaagtgcggcaaggccttcagccagaacagccagttcatccagcaccagagaatccacatcggcgagaagagctacgagtgcaaggagtgcggcaagttcttcagctgcggcagccacgtgaccagacacctgaagatccacaccggcgagaagcccttcgagtgcaaggagtgcggcaaggccttcagctgcagcagctacctgagccagcaccagagaatccacaccggcaagaagccctacgagtgcaaggagtgcggcaaggccttcagctactgcagcaacctgatcgaccaccagagaatccacaccggcgagaagccctacgagtgcaaggtgtgcggcaaggccttcaccaagagcagccagctgttccagcacgccagaatccacaccggcgagaagccctacgagtgcaaggagtgcggcaaggccttcacccagagcagcaagctggtgcagcaccagagaatccacaccggcgagaagccctacgagtgcaaggagtgcggcaaggccttcagcagcggcagcgccctgaccaaccaccagagaatccacaccggcgagaagccctacgactgcaaggagtgcggcaaggccttcacccagagcagccagctgagacagcaccagagaatccacgccggcgagaagcccttcgagtgcctggagtgcggcaaggccttcacccagaacagccagctgttccagcaccagagaatccacaccgacgagaagccctacgagtgcaacgagtgcggcaaggccttcaacaagtgcagcaacctgaccagacacctgagaatccacaccggcgagaagccctacaactgcaaggagtgcggcaaggccttcagcagcggcagcgacctgatcagacaccagggcatccacaccaacaagtag

SEQ ID NO: 10354 - DNA, 462 bp, Artificial Sequence; identical to SEQ ID NO: 9388
  Description of Artificial Sequence: Synthetic coding sequence

SEQ ID NO: 10355 - DNA, 2616 bp, Artificial Sequence
  Description of Artificial Sequence: Synthetic coding sequence
atgggcgagggcggcctgccccccgccttccagctgctgctgagagcctgcgaccagggcgacaccgagaccgccagaagactgctggagcccggcgccgccgagcccgccgagagaggcgccgagcccgaggccggcgccgagcccgccggcgccgaggtggccggccccggcgccgccgccgccggcgccgtgggcgcccccgtgcccgtggactgcagcgacgaggccggcaacaccgccctgcagttcgccgccgccggcggccacgagcccctggtgagattcctgctgagaagaggcgccagcgtgaacagcagaaaccactacggctggagcgccctgatgcaggccgccagattcggccacgtgagcgtggcccacctgctgctggaccacggcgccgacgtgaacgcccagaacagactgggcgccagcgtgctgaccgtggccagcagaggcggccacctgggcgtggtgaagctgctgctggaggccggcgccttcgtggaccaccaccaccccagcggcgagcagctgggcctgggcggcagcagagacgagcccctggacatcaccgccctgatggccgccatccagcacggccacgaggccgtggtgagactgctgatggagtggggcgccgaccccaaccacgccgccagaaccgtgggctggagccccctgatgctggccgccctgaccggcagactgggcgtggcccagcagctggtggagaagggcgccaaccccgaccacctgagcgtgctggagaagaccgccttcgaggtggccctggactgcaagcacagagacctggtggactacctggaccccctgaccaccgtgagacccaagaccgacgaggagaagagaagacccgacatcttccacgccctgaagatgggcaacttccagctggtgaaggagatcgccgacgaggaccccagccacgtgaacctggtgaacggcgacggcgccacccccctgatgctggccgccgtgaccggccagctggccctggtgcagctgctggtggagagacacgccgacgtggacaagcaggacagcgtgcacggctggaccgccctgatgcaggccacctaccacggcaacaaggagatcgtgaagtacctgctgaaccagggcgccgacgtgaccctgagagccaagaacggctacaccgccttcgacctggtgatgctgctgaacgaccccgacaccgagctggtgagactgctggccagcgtgtgcatgcaggtgaacaaggacaagggcagacccagccaccagccccccctgccccacagcaaggtgagacagccctggagcatccccgtgctgcccgacgacaagggcggcctgaagagctggtggaacagaatgagcaacagattcagaaagctgaagctgatgcagaccctgcccagaggcctgagcagcaaccagcccctgcccttcagcgacgagcccgagcccgccctggacagcaccatgagagccgccccccaggacaagaccagcagaagcgccctgcccgacgccgcccccgtgaccaaggacaacggccccggcagcaccagaggcgagaaggaggacaccctgctgaccaccatgctgagaaacggcgcccccctgaccagactgcccagcgacaagctgaaggccgtgatcccccccttcctgccccccagcagcttcgagctgtggagcagcgacagaagcagaaccagacacaacggcaaggccgaccccatgaagaccgccctgccccagagagccagcagaggccaccccgtgggcggcggcggcaccgacaccacccccgtgagacccgtgaagttccccagcctgcccagaagccccgccagcagcgccaacagcggcaacttcaaccacagcccccacagcagcggcggcagcagcggcgtgggcgtgagcagacacggcggcgagctgctgaacagaagcggcggcagcatcgacaacgtgctgagccagatcgccgcccagagaaagaaggccgccggcctgctggagcagaagcccagccacagaagcagccccgtgggccccgcccccggcagcagccccagcgagctgcccgccagccccgccggcggcagcgcccccgtgggcaagaagctggagaccagcaagagaccccccagcggcaccagcaccaccagcaagagcaccagccccaccctgacccccagccccagccccaagggccacaccgccgagagcagcgtgagcagcagcagcagccacagacagagcaagagcagcggcggcagcagcagcggcaccatcaccgacgaggacgagctgaccggcatcctgaagaagctgagcctggagaagtaccagcccatcttcgaggagcaggaggtggacatggaggccttcctgaccctgaccgacggcgacctgaaggagctgggcatcaagaccgacggcagcagacagcagatcctggccgccatcagcgagctgaacgccggcaagggcagagagagacagatcctgcaggagaccatccacaacttccacagcagcttcgagagcagcgccagcaacaccagagcccccggcaacagcccctgcgcctag

SEQ ID NO: 10356 - DNA, 1359 bp, Artificial Sequence
  Description of Artificial Sequence: Synthetic coding sequence
atgagcgccagcctgaactacaagagcttcagcaaggagcagcagaccatggacaacctggagaagcagctgatctgccccatctgcctggagatgttcaccaagcccgtggtgatcctgccctgccagcacaacctgtgcagaaagtgcgccagcgacatcttccaggccagcaacccctacctgcccaccagaggcggcaccaccatggccagcggcggcagattcagatgccccagctgcagacacgaggtggtgctggacagacacggcgtgtacggcctgcagagaaacctgctggtggagaacatcatcgacatctacaagcaggagagcaccagacccgagaagaagagcgaccagcccatgtgcgaggagcacgaggaggagagaatcaacatctactgcctgaactgcgaggtgcccacctgcagcctgtgcaaggtgttcggcgcccacaaggactgccaggtggcccccctgacccacgtgttccagagacagaagagcgagctgagcgacggcatcgccatcctggtgggcagcaacgacagagtgcagggcgtgatcagccagctggaggacacctgcaagaccatcgaggagtgctgcagaaagcagaagcaggagctgtgcgagaagttcgactacctgtacggcatcctggaggagagaaagaacgagatgacccaggtgatcaccagaacccaggaggagaagctggagcacgtgagagccctgatcaagaagtacagcgaccacctggagaacgtgagcaagctggtggagagcggcatccagttcatggacgagcccgagatggccgtgttcctgcagaacgccaagaccctgctgaagaagatcagcgaggccagcaaggccttccagatggagaagatcgagcacggctacgagaacatgaaccacttcaccgtgaacctgaacagagaggagaagatcatcagagagatcgacttctacagagaggacgaggacgaggaggaggaggagggcggcgagggcgagaaggagggcgagggcgaggtgggcggcgaggccgtggaggtggaggaggtggagaacgtgcagaccgagttccccggcgaggacgagaaccccgagaaggccagcgagctgagccaggtggagctgcaggccgcccccggcgccctgcccgtgagcagccccgagcccccccccgccctgccccccgccgccgacgcccccgtgacccagatcggcttcgaggccccccccctgcagggccaggccgccgcccccgccagcggcagcggcgccgacagcgagcccgccagacacatcttcagcttcagctggctgaacagcctgaacgagtag

SEQ ID NO: 10357 - DNA, 492 bp, Artificial Sequence
  Description of Artificial Sequence: Synthetic coding sequence
atgcccagcatcaagctgcagagcagcgacggcgagatcttcgaggtggacgtggagatcgccaagcagagcgtgaccatcaagaccatgctggaggacctgggcatggacgacgagggcgacgacgaccccgtgcccctgcccaacgtgaacgccgccatcctgaagaaggtgatccagtggtgcacccaccacaaggacgacccccccccccccgaggacgacgagaacaaggagaagagaaccgacgacatccccgtgtgggaccaggagttcctgaaggtggaccagggcaccctgttcgagctgatcctggccgccaactacctggacatcaagggcctgctggacgtgacctgcaagaccgtggccaacatgatcaagggcaagacccccgaggagatcagaaagaccttcaacatcaagaacgacttcaccgaggaggaggaggcccaggtgagaaaggagaaccagtggtgcgaggagaagtag

SEQ ID NO: 10358 - DNA, 1200 bp, Artificial Sequence
  Description of Artificial Sequence: Synthetic coding sequence
atggccgcccccagccccagcggcggcggcggcagcggcggcggcagcggcagcggcacccccggccccgtgggcagccccgcccccggccaccccgccgtgagcagcatgcagggcaagagaaaggccctgaagctgaacttcgccaacccccccttcaagagcaccgccagattcaccctgaaccccaaccccaccggcgtgcagaacccccacatcgagagactgagaacccacagcatcgagagcagcggcaagctgaagatcagccccgagcagcactgggacttcaccgccgaggacctgaaggacctgggcgagatcggcagaggcgcctacggcagcgtgaacaagatggtgcacaagcccagcggccagatcatggccgtgaagagaatcagaagcaccgtggacgagaaggagcagaagcagctgctgatggacctggacgtggtgatgagaagcagcgactgcccctacatcgtgcagttctacggcgccctgttcagagagggcgactgctggatctgcatggagctgatgagcaccagcttcgacaagttctacaagtacgtgtacagcgtgctggacgacgtgatccccgaggagatcctgggcaagatcaccctggccaccgtgaaggccctgaaccacctgaaggagaacctgaagatcatccacagagacatcaagcccagcaacatcctgctggacagaagcggcaacatcaagctgtgcgacttcggcatcagcggccagctggtggacagcatcgccaagaccagagacgccggctgcagaccctacatggcccccgagagaatcgaccccagcgccagcagacagggctacgacgtgagaagcgacgtgtggagcctgggcatcaccctgtacgagctggccaccggcagattcccctaccccaagtggaacagcgtgttcgaccagctgacccaggtggtgaagggcgaccccccccagctgagcaacagcgaggagagagagttcagccccagcttcatcaacttcgtgaacctgtgcctgaccaaggacgagagcaagagacccaagtacaaggagctgctgaagcaccccttcatcctgatgtacgaggagagagccgtggaggtggcctgctacgtgtgcaagatcctggaccagatgcccgccacccccagcagccccatgtacgtggactag

SEQ ID NO: 10359 - DNA, 1122 bp, Artificial Sequence
  Description of Artificial Sequence: Synthetic coding sequence
atggcccaggagagccccaagaacagcgccgccgagatccccgtgaccagcaacggcgaggtggacgacagcagagagcacagcttcaacagagacctgaagcacagcctgcccagcggcctgggcctgagcgagacccagatcaccagccacggcttcgacaacaccaaggagggcgtgatcgaggccggcgccttccagggcagccccgccccccccctgcccagcgtgatgagccccagcagagtggccgccagcagactggcccagcagggcagcgacctgatcgtgcccgccggcggccagagaacccagaccaagagcggccccgtgatcctggccgacgagatcaagaaccccgccatggagaagctggagctggtgagaaagtggagcctgaacacctacaagtgcaccagacagatcatcagcgagaagctgggcagaggcagcagaaccgtggacctggagctggaggcccagatcgacatcctgagagacaacaagaagaagtacgagaacatcctgaagctggcccagaccctgagcacccagctgttccagatggtgcacacccagagacagctgggcgacgccttcgccgacctgagcctgaagagcctggagctgcacgaggagttcggctacaacgccgacacccagaagctgctggccaagaacggcgagaccctgctgggcgccatcaacttcttcatcgccagcgtgaacaccctggtgaacaagaccatcgaggacaccctgatgaccgtgaagcagtacgagagcgccagaatcgagtacgacgcctacagaaccgacctggaggagctgaacctgggccccagagacgccaacaccctgcccaagatcgagcagagccagcacctgttccaggcccacaaggagaagtacgacaagatgagaaacgacgtgagcgtgaagctgaagttcctggaggagaacaaggtgaaggtgctgcacaaccagctggtgctgttccacaacgccatcgccgcctacttcgccggcaaccagaagcagctggagcagaccctgaagcagttccacatcaagctgaagacccccggcgtggacgcccccagctggctggaggagcagtag

SEQ ID NO: 10360 - DNA, 654 bp, Artificial Sequence
  Description of Artificial Sequence: Synthetic coding sequence
atgtacagcctgaaccaggagatcaaggccttcagcagaaacaacctgagaaagcagtgcaccagagtgaccaccctgaccggcaagaagatcatcgagacctggaaggacgccagaatccacgtggtggaggaggtggagcccagcagcggcggcggctgcggctacgtgcaggacctgagcagcgacctgcaggtgggcgtgatcaagccctggctgctgctgggcagccaggacgccgcccacgacctggacaccctgaagaagaacaaggtgacccacatcctgaacgtggcctacggcgtggagaacgccttcctgagcgacttcacctacaagagcatcagcatcctggacctgcccgagaccaacatcctgagctacttccccgagtgcttcgagttcatcgaggaggccaagagaaaggacggcgtggtgctggtgcactgcaacgccggcgtgagcagagccgccgccatcgtgatcggcttcctgatgaacagcgagcagaccagcttcaccagcgccttcagcctggtgaagaacgccagacccagcatctgccccaacagcggcttcatggagcagctgagaacctaccaggagggcaaggagagcaacaagtgcgacagaatccaggagaacagcagctag

SEQ ID NO: 10361 - DNA, 2679 bp, Artificial Sequence
  Description of Artificial Sequence: Synthetic coding sequence
atgctgagaaccgccggcagagacggcctgtgcagactgagcacctacctggaggagctggaggccgtggagctgaagaagttcaagctgtacctgggcaccgccaccgagctgggcgagggcaagatcccctggggcagcatggagaaggccggccccctggagatggcccagctgctgatcacccacttcggccccgaggaggcctggagactggccctgagcaccttcgagagaatcaacagaaaggacctgtgggagagaggccagagagaggacctggtgagagacaccccccccggcggccccagcagcctgggcaaccagagcacctgcctgctggaggtgagcctggtgacccccagaaaggacccccaggagacctacagagactacgtgagaagaaagttcagactgatggaggacagaaacgccagactgggcgagtgcgtgaacctgagccacagatacaccagactgctgctggtgaaggagcacagcaaccccatgcaggtgcagcagcagctgctggacaccggcagaggccacgccagaaccgtgggccaccaggccagccccatcaagatcgagaccctgttcgagcccgacgaggagagacccgagccccccagaaccgtggtgatgcagggcgccgccggcatcggcaagagcatgctggcccacaaggtgatgctggactgggccgacggcaagctgttccagggcagattcgactacctgttctacatcaactgcagagagatgaaccagagcgccaccgagtgcagcatgcaggacctgatcttcagctgctggcccgagcccagcgcccccctgcaggagctgatcagagtgcccgagagactgctgttcatcatcgacggcttcgacgagctgaagcccagcttccacgacccccagggcccctggtgcctgtgctgggaggagaagagacccaccgagctgctgctgaacagcctgatcagaaagaagctgctgcccgagctgagcctgctgatcaccaccagacccaccgccctggagaagctgcacagactgctggagcaccccagacacgtggagatcctgggcttcagcgaggccgagagaaaggagtacttctacaagtacttccacaacgccgagcaggccggccaggtgttcaactacgtgagagacaacgagcccctgttcaccatgtgcttcgtgcccctggtgtgctgggtggtgtgcacctgcctgcagcagcagctggagggcggcggcctgctgagacagaccagcagaaccaccaccgccgtgtacatgctgtacctgctgagcctgatgcagcccaagcccggcgcccccagactgcagcccccccccaaccagagaggcctgtgcagcctggccgccgacggcctgtggaaccagaagatcctgttcgaggagcaggacctgagaaagcacggcctggacggcgaggacgtgagcgccttcctgaacatgaacatcttccagaaggacatcaactgcgagagatactacagcttcatccacctgagcttccaggagttcttcgccgccatgtactacatcctggacgagggcgagggcggcgccggccccgaccaggacgtgaccagactgctgaccgagtacgccttcagcgagagaagcttcctggccctgaccagcagattcctgttcggcctgctgaacgaggagaccagaagccacctggagaagagcctgtgctggaaggtgagcccccacatcaagatggacctgctgcagtggatccagagcaaggcccagagcgacggcagcaccctgcagcagggcagcctggagttcttcagctgcctgtacgagatccaggaggaggagttcatccagcaggccctgagccacttccaggtgatcgtggtgagcaacatcgccagcaagatggagcacatggtgagcagcttctgcctgaagagatgcagaagcgcccaggtgctgcacctgtacggcgccacctacagcgccgacggcgaggacagagccagatgcagcgccggcgcccacaccctgctggtgcagctgcccgagagaaccgtgctgctggacgcctacagcgagcacctggccgccgccctgtgcaccaaccccaacctgatcgagctgagcctgtacagaaacgccctgggcagcagaggcgtgaagctgctgtgccagggcctgagacaccccaactgcaagctgcagaacctgagactgaagagatgcagaatcagcagcagcgcctgcgaggacctgagcgccgccctgatcgccaacaagaacctgaccagaatggacctgagcggcaacggcgtgggcttccccggcatgatgctgctgtgcgagggcctgagacacccccagtgcagactgcagatgatccagctgagaaagtgccagctggagagcggcgcctgccaggagatggccagcgtgctgggcaccaacccccacctggtggagctggacctgaccggcaacgccctggaggacctgggcctgagactgctgtgccagggcctgagacaccccgtgtgcagactgagaaccctgtgctggatgctgttcggcatggacctgaacaagatgacccacagcagactggccgccctgagagtgaccaagccctacctggacatcggctgctag

SEQ ID NO: 10362 - DNA, 945 bp, Artificial Sequence
  Description of Artificial Sequence: Synthetic coding sequence
atgcagaccttcctgaagggcaagagagtgggctactggctgagcgagaagaagatcaagaagctgaacttccaggccttcgccgagctgtgcagaaagagaggcatggaggtggtgcagctgaacctgagcagacccatcgaggagcagggccccctggacgtgatcatccacaagctgaccgacgtgatcctggaggccgaccagaacgacagccagagcctggagctggtgcacagattccaggagtacatcgacgcccaccccgagaccatcgtgctggaccccctgcccgccatcagaaccctgctggacagaagcaagagctacgagctgatcagaaagatcgaggcctacatggaggacgacagaatctgcagcccccccttcatggagctgaccagcctgtgcggcgacgacaccatgagactgctggagaagaacggcctgaccttccccttcatctgcaagaccagagtggcccacggcaccaacagccacgagatggccatcgtgttcaaccaggagggcctgaacgccatccagcccccctgcgtggtgcagaacttcatcaaccacaacgccgtgctgtacaaggtgttcgtggtgggcgagagctacaccgtggtgcagagacccagcctgaagaacttcagcgccggcaccagcgacagagagagcatcttcttcaacagccacaacgtgagcaagcccgagagcagcagcgtgctgaccgagctggacaagatcgagggcgtgttcgagagacccagcgacgaggtgatcagagagctgagcagagccctgagacaggccctgggcgtgagcctgttcggcatcgacatcatcatcaacaaccagaccggccagcacgccgtgatcgacatcaacgccttccccggcgactgccaggtgtgcttcatcgagggctggaagaccgactag

SEQ ID NO: 10363 - DNA, 630 bp, Artificial Sequence
  Description of Artificial Sequence: Synthetic coding sequence
atgcccgtggccgtgatggccgagagcgccttcagcttcaagaagctgctggaccagtgcgagaaccaggagctggaggcccccggcggcatcgccaccccccccgtgtacggccagctgctggccctgtacctgctgcacaacgacatgaacaacgccagatacctgtggaagagaatcccccccgccatcaagagcgccaacagcgagctgggcggcatctggagcgtgggccagagaatctggcagagagacttccccggcatctacaccaccatcaacgcccaccagtggagcgagaccgtgcagcccatcatggaggccctgagagacgccaccagaagaagagccttcgccctggtgagccaggcctacaccagcatcatcgccgacgacttcgccgccttcgtgggcctgcccgtggaggaggccgtgaagggcatcctggagcagggctggcaggccgacagcaccaccagaatggtgctgcccagaaagcccgtggccggcgccctggacgtgagcttcaacaagttcatccccctgagcgagcccgcccccgtgccccccatccccaacgagcagcagctggccagactgaccgactacgtggccttcctggagaactag

SEQ ID NO: 10364 - DNA, 4935 bp, Artificial Sequence
  Description of Artificial Sequence: Synthetic coding sequence
atgttctggtgcggcacctgcttcgtgaccaacaacatgaagggcagcgaggtgagcctggagaagaagaagaagatcaagatgcccgtgaagagactgagagaggtggtgagccagaaccacggcgaccacctggtgctgctgaaggacgagctgccctgcgtgccccccgccctgagcgccaacaagagactgcccgtgggcaccggcaccagcctgaacggcaccagcagaggcagcagcgacctgaccagcgccagaaactgctaccagcccctgctggagaaccccatggtgagcgagagcgacttcagcaaggacgtggccgtgcaggtgctgcccctggacaagatcgaggagaacaacaagcagaaggccaacgacatcttcatcagccagtacaccatgggccagaaggacgccctgagaaccgtgctgaagcagaacgtgagcctgtgcctgaccggctggagcgaccacagcggcgtgatcaccacccactgcagcctgtacctgctgagactgatgagaagcagccacctgagcctgcccagcagctgggactacagagcccagagcatgcccgtgttcaaggaggtgaaggtgcacctgctggaggacgccggcatcgagaaggacgccgtgacccaggagaccagaatcagccccagcggcatcgacagcgccaccaccgtggccgccgccaccgccgccgccatcgccaccgccgcccccctgatcaaggtgcagagcgacctggaggccaaggtgaacagcgtgaccgagctgctgagcaagctgcaggagaccgacaagcacctgcagagagtgaccgagcagcagaccagcatccagagaaagcaggagaagctgcactgccacgaccacgagaagcagatgaacgtgttcatggagcagcacatcagacacctggagaagctgcagcagcagcagatcgacatccagacccacttcatcagcgccgccctgaagaccagcagcttccagcccgtgagcatgcccagcagcagagccgtggagaagtacagcgtgaagcccgagcaccccaacctgggcagctgcaaccccagcctgtacaacaccttcgccagcaagcaggcccccctgaaggaggtggaggacaccagcttcgacaagcagaagagccccctggagacccccgcccccagaagattcgcccccgtgcccgtgagcagagacgacgagctgagcaagagagagaacctgctggaggagaaggagaacatggaggtgagctgccacagaggcaacgtgagactgctggagcagatcctgaacaacaacgacagcctgaccagaaagagcgagagcagcaacaccaccagcctgaccagaagcaagatcggctggacccccgagaagaccaacagattccccagctgcgaggagctggagaccaccaaggtgaccatgcagaagagcgacgacgtgctgcacgacctgggccagaaggagaaggagaccaacagcatggtgcagcccaaggagagcctgagcatgctgaagctgcccgacctgccccagaacagcgtgaagctgcagaccaccaacaccaccagaagcgtgctgaaggacgccgagaagatcctgagaggcgtgcagaacaacaagaaggtgctggaggagaacctggaggccatcatcagagccaaggacggcgccgccatgtacagcctgatcaacgccctgagcaccaacagagagatgagcgagaagatcagaatcagaaagaccgtggacgagtggatcaagaccatcagcgccgagatccaggacgagctgagcagaaccgactacgagcagaagagattcgaccagaagaaccagagaaccaagaagggccagaacatgaccaaggacatcagaaccaacacccaggacaagaccgtgaacaagagcgtgatccccagaaagcacagccagaagcagatcgaggagcacttcagaaacctgcccatgagaggcatgcccgccagcagcctgcagaaggagagaaaggagggcctgctgaaggccaccaccgtgatccaggacgaggactacatgctgcaggtgtacggcaagcccgtgtaccagggccacagaagcaccctgaagaagggcccctacctgagattcaacagccccagccccaagagcagaccccagagacccaaggtgatcgagagagtgaagggcaccaaggtgaagagcatcagaacccagaccgacttctacgccaccaagcccaagaagatggacagcaagatgaagcacagcgtgcccgtgctgccccacggcgaccagcagtacctgttcagccccagcagagagatgcccaccttcagcggcaccctggagggccacctgatccccatggccatcctgctgggccagacccagagcaacagcgacaccatgccccccgccggcgtgatcgtgagcaagccccaccccgtgaccgtgaccaccagcatcccccccagcagcagaaaggtggagaccggcgtgaagaagcccaacatcgccatcgtggagatgaagagcgagaagaaggaccccccccagctgaccgtgcaggtgctgcccagcgtggacatcgacagcatcagcaacagcagcgccgacgtgctgagccccctgagcagccccaaggaggccagcctgccccccgtgcagacctggatcaagacccccgagatcatgaaggtggacgaggaggaggtgaagttccccggcaccaacttcgacgagatcatcgacgtgatccaggaggaggagaagtgcgacgagatccccgacagcgagcccatcctggagttcaacagaagcgtgaaggccgacagcaccaagtacaacggcccccccttcccccccgtggccagcaccttccagcccaccgccgacatcctggacaaggtgatcgagagaaaggagaccctggagaacagcctgatccagtgggtggagcaggagatcatgagcagaatcatcagcggcctgttccccgtgcagcagcagatcgcccccagcatcagcgtgagcgtgagcgagaccagcgagcccctgaccagcgacatcgtggagggcaccagcagcggcgccctgcagctgttcgtggacgccggcgtgcccgtgaacagcaacgtgatcaagcacttcgtgaacgaggccctggccgagaccatcgccgtgatgctgggcgacagagaggccaagaagcagggccccgtggccaccggcgtgagcggcgacgccagcaccaacgagacctacctgcccgccagagtgtgcacccccctgcccaccccccagcccacccccccctgcagccccagcagccccgccaaggagtgcgtgctggtgaagacccccgacagcagcccctgcgacagcgaccacgacatggccttccccgtgaaggagatctgcgccgagaagggcgacgacatgcccgccatcatgctggtgaacacccccaccgtgacccccaccaccacccccccccccgccgccgccgtgttcacccccaccctgagcgacatcagcatcgacaagctgaaggtgagcagccccgagctgcccaagccctggggcgacggcgacctgcccctggaggaggagaaccccaacagcccccaggaggagctgcaccccagagccatcgtgatgagcgtggccaaggacgaggagcccgagagcatggacttccccgcccagccccccccccccgagcccgtgcccttcatgcccttccccgccggcaccaaggcccccagccccagccagatgcccggcagcgacagcagcaccctggagagcaccctgagcgtgaccgtgaccgagaccgagaccctggacaagcccatcagcgagggcgagatcctgttcagctgcggccagaagctggcccccaagatcctggaggacatcggcctgtacctgaccaacctgaacgacagcctgagcagcaccctgcacgacgccgtggagatggaggacgacccccccagcgagggccaggtgatcagaatgagccacaagaagttccacgccgacgccatcctgagcttcgccaagcagaaccaggagagcgccgtgagccagcaggccgtgtaccacagcgaggacctggagaacagcgtgggcgagctgagcgagggccagagaccccagctgaccgccgccgccgagaacatcctgatgggccacagcctgtacatgcagccccccgtgaccaacacccagagcctggaccagcagtgcgaccccaagcccctgagcagacagttcgacaccgtgagcggcagcatctacgaggacagctgcgccagccacggccccatgagcctgggcgagctggagctggagcccaacagcaagctggtgctgcccaccaccctgctgaccgcccaggagaacgacgtgaacctgcccgtggccgccgaggacttcagccagtaccagctgaagcagaaccaggacgtgaagcaggtggagcacaagcccagccagagctacctgagagtgagaaacaagagcgacatcgcccccagccagcagcaggtgagccccggcgacatggacagaacccagatcgagctgaacccctacctgacctgcgtgttcagcggcctgggcgtgcacgtgaagaaggtgagctgcatcggcaagctgggcctgtggagattcgtgatccagatcatcagcagccccagatgggagagcagcgccaccctgagattcaccgacgccccctgccaggacgtgagcgacgccgccgtgagcgagcccagaggcctgctgagcgtgagcgagagccagcacaacgccggcggccacggcgtgttcggcggcagatacctgctgaacggcaagagacagcccgcccagtgcctgtgccactggttctag

SEQ ID NO: 10365 - DNA, 3138 bp, Artificial Sequence
  Description of Artificial Sequence: Synthetic coding sequence
atgctgaccgtgcaggtgaagaccagcagcgccatcgagctgcccgacagcctggccttcctgtggatcatccccatgtggtactgcgagggcaaggagctggagaacagccccgacatccacatcgtgcaggccggcaacctgcacagcctgaccatcgccgaggccttcgaggaggacaccggcagatacagctgcttcgccagcaacatctacggcaccgacagcaccagcgccgagatctacatcgagggcgtgagcagcagcgacagcgagggcgaccccaacaaggaggagatgaacagaatccagaagcccaacgaggtgagcagcccccccaccaccagcgccgtgatcccccccgccgtgccccaggcccagcacctggtggcccagcccagagtggccaccatccagcagtgccagagccccaccaactacctgcagggcctggacggcaagcccatcatcgccgcccccgtgttcaccaagatgctgcagaacctgagcgccagcgagggccagctggtggtgttcgagtgcagagtgaagggcgcccccagccccaaggtggagtggtacagagagggcaccctgatcgaggacagccccgacttcagaatcctgcagaagaagcccagaagcatggccgagcccgaggagatctgcaccctggtgatcgccgaggtgttcgccgaggacagcggctgcttcacctgcaccgccagcaacaagtacggcaccgtgagcagcatcgcccagctgcacgtgagaggcaacgaggacctgagcaacaacggcagcctgcacagcgccaacagcaccaccaacctggccgccatcgagccccagcccagccccccccacagcgagccccccagcgtggagcagccccccaagcccaagctggagggcgtgctggtgaaccacaacgagcccagaagcagcagcagaatcggcctgagagtgcacttcaacctgcccgaggacgacaagggcagcgaggccagcagcgaggccggcgtggtgaccaccagacagaccagacccgacagcttccaggagagattcaacggccaggccaccaagacccccgagcccagcagccccgtgaaggagcccccccccgtgctggccaagcccaagctggacagcacccagctgcagcagctgcacaaccaggtgctgctggagcagcaccagctgcagaaccccccccccagcagccccaaggagttccccttcagcatgaccgtgctgaacagcaacgccccccccgccgtgaccaccagcagcaagcaggtgaaggcccccagcagccagaccttcagcctggccagacccaagtacttcttccccagcaccaacaccaccgccgccaccgtggcccccagcagcagccccgtgttcaccctgagcagcaccccccagaccatccagagaaccgtgagcaaggagagcctgctggtgagccaccccagcgtgcagaccaagagccccggcggcctgagcatccagaacgagcccctgccccccggccccaccgagcccacccccccccccttcaccttcagcatccccagcggcaaccagttccagcccagatgcgtgagccccatccccgtgagccccaccagcagaatccagaaccccgtggccttcctgagcagcgtgctgcccagcctgcccgccatcccccccaccaacgccatgggcctgcccagaagcgcccccagcatgcccagccagggcctggccaagaagaacaccaagagcccccagcccgtgaacgacgacaacatcagagagaccaagaacgccgtgatcagagacctgggcaagaagatcaccttcagcgacgtgagacccaaccagcaggagtacaagatcagcagcttcgagcagagactgatgaacgagatcgagttcagactggagagaacccccgtggacgagagcgacgacgagatccagcacgacgagatccccaccggcaagtgcatcgcccccatcttcgacaagagactgaagcacttcagagtgaccgagggcagccccgtgaccttcacctgcaagatcgtgggcatccccgtgcccaaggtgtactggttcaaggacggcaagcagatcagcaagagaaacgagcactgcaagatgagaagagagggcgacggcacctgcagcctgcacatcgagagcaccaccagcgacgacgacggcaactacaccatcatggccgccaacccccagggcagaatcagctgcagcggccacctgatggtgcagagcctgcccatcagaagcagactgaccagcgccggccagagccacagaggcagaagcagagtgcaggagagagacaaggagcccctgcaggagagattcttcagaccccacttcctgcaggcccccggcgacatggtggcccacgagggcagactgtgcagactggactgcaaggtgagcggcctgcccccccccgagctgacctggctgctgaacggccagcccgtgctgcccgacgccagccacaagatgctggtgagagagaccggcgtgcacagcctgctgatcgaccccctgacccagagagacgccggcacctacaagtgcatcgccaccaacaagaccggccagaacagcttcagcctggagctgagcgtggtggccaaggaggtgaagaaggcccccgtgatcctggagaagctgcagaactgcggcgtgcccgagggccaccccgtgagactggagtgcagagtgatcggcatgcccccccccgtgttctactggaagaaggacaacgagaccatcccctgcaccagagagagaatcagcatgcaccaggacaccaccggctacgcctgcctgctgatccagcccgccaagaagagcgacgccggctggtacaccctgagcgccaagaacgaggccggcatcgtgagctgcaccgccagactggacatctacgcccagtggcaccaccagatccccccccccatgagcgtgagacccagcggcagcagatacggcagcctgaccagcaagggcctggacatcttcagcgccttcagcagcatggagagcaccatggtgtacagctgcagcagcagaagcgtggtggagagcgacgagctgtag

SEQ ID NO: 10366 - DNA, 951 bp, Artificial Sequence
  Description of Artificial Sequence: Synthetic coding sequence
atgacccccagcgagggcgccagagccggcaccggcagagagctggagatgctggacagcctgctggccctgggcggcctggtgctgctgagagacagcgtggagtgggagggcagaagcctgctgaaggccctggtgaagaagagcgccctgtgcggcgagcaggtgcacatcctgggctgcgaggtgagcgaggaggagttcagagagggcttcgacagcgacatcaacaacagactggtgtaccacgacttcttcagagaccccctgaactggagcaagaccgaggaggccttccccggcggccccctgggcgccctgagagccatgtgcaagagaaccgaccccgtgcccgtgaccatcgccctggacagcctgagctggctgctgctgagactgccctgcaccaccctgtgccaggtgctgcacgccgtgagccaccaggacagctgccccggcgacagcagcagcgtgggcaaggtgagcgtgctgggcctgctgcacgaggagctgcacggccccggccccgtgggcgccctgagcagcctggcccagaccgaggtgaccctgggcggcaccatgggccaggccagcgcccacatcctgtgcagaagacccagacagagacccaccgaccagacccagtggttcagcatcctgcccgacttcagcctggacctgcaggagggccccagcgtggagagccagccctacagcgacccccacatcccccccgtggaccccaccacccacctgaccttcaacctgcacctgagcaagaaggagagagaggccagagacagcctgatcctgcccttccagttcagcagcgagaagcagcaggccctgctgagacccagacccggccaggccaccagccacatcttctacgagcccgacgcctacgacgacctggaccaggaggaccccgacgacgacctggacatctag

SEQ ID NO: 10367 - DNA, 1473 bp, Artificial Sequence; identical to SEQ ID NO: 9885
  Description of Artificial Sequence: Synthetic coding sequence

SEQ ID NO: 10368 - DNA, 1428 bp, Artificial Sequence
  Description of Artificial Sequence: Synthetic coding sequence
atggaggccctgctggagggcatccagaacagaggccacggcggcggcttcctgaccagctgcgaggccgagctgcaggagctgatgaagcagatcgacatcatggtggcccacaagaagagcgagtgggagggcagaacccacgccctggagacctgcctgaagatcagagagcaggagctgaagagcctgagaagccagctggacgtgacccacaaggaggtgggcatgctgcaccagcaggtggaggagcacgagaagatcaagcaggagatgaccatggagtacaagcaggagctgaagaagctgcacgaggagctgtgcatcctgaagagaagctacgagaagctgcagaagaagcagatgagagagttcagaggcaacaccaagaaccacagagaggacagaagcgagatcgagagactgaccgccaagatcgaggagttcagacagaagagcctggactgggagaagcagagactgatctaccagcagcaggtgagcagcctggaggcccagagaaaggccctggccgagcagagcgagatcatccaggcccagctggtgaacagaaagcagaagctggagagcgtggagctgagcagccagagcgagatccagcacctgagcagcaagctggagagagccaacgacaccatctgcgccaacgagctggagatcgagagactgaccatgagagtgaacgacctggtgggcaccagcatgaccgtgctgcaggagcagcagcagaaggaggagaagctgagagagagcgagaagctgctggaggccctgcaggaggagaagagagagctgaaggccgccctgcagagccaggagaacctgatccacgaggccagaatccagaaggagaagctgcaggagaaggtgaaggccaccaacacccagcacgccgtggaggccatcagcctggagagcgtgagcgccacctgcaagcagctgagccaggagctgatggagaagtacgaggagctgaagagaatggaggcccacaacaacgagtacaaggccgagatcaagaagctgaaggagcagatcctgcagggcgagcagagctacagcagcgccctggagggcatgaagatggagatcagccacctgacccaggagctgcaccagagagacatcaccatcgccagcaccaagggcagcagcagcgacatggagaagagactgagagccgagatgcagaaggccgaggacaaggccgtggagcacaaggagatcctggaccagctggagagcctgaagctggagaacagacacctgagcgagatggtgatgaagctggagctgggcctgcacgagagatggggcttcaccatgctgagcagcctggtgctgaacttcggcatccaggccatcagacagccccagagacccaaggtgctggagctgcaggtgtag

SEQ ID NO: 10369 - DNA, 2340 bp, Artificial Sequence
  Description of Artificial Sequence: Synthetic coding sequence
atgagaatcgaggagagaaagagccagcacctgaccggcctgaccgacgagaaggtgaaggcctacctgagcctgcacccccaggtgctggacgagttcgtgagcgagagcgtgagcgccgagaccgtggagaagtggctgaagagaaagaacaacaagagcgaggacgagagcgcccccaaggaggtgagcagataccaggacaccaacatgcagggcgtggtgtacgagctgaacagctacatcgagcagagactggacaccggcggcgacaaccagctgctgctgtacgagctgagcagcatcatcaagatcgccaccaaggccgacggcttcgccctgtacttcctgggcgagtgcaacaacagcctgtgcatcttcaccccccccggcatcaaggagggcaagcccagactgatccccgccggccccatcacccagggcaccaccgtgagcgcctacgtggccaagagcagaaagaccctgctggtggaggacatcctgggcgacgagagattccccagaggcaccggcctggagagcggcaccagaatccagagcgtgctgtgcctgcccatcgtgaccgccatcggcgacctgatcggcatcctggagctgtacagacactggggcaaggaggccttctgcctgagccaccaggaggtggccaccgccaacctggcctgggccagcgtggccatccaccaggtgcaggtgtgcagaggcctggccaagcagaccgagctgaacgacttcctgctggacgtgagcaagacctacttcgacaacatcgtggccatcgacagcctgctggagcacatcatgatctacgccaagaacctggtgaacgccgacagatgcgccctgttccaggtggaccacaagaacaaggagctgtacagcgacctgttcgacatcggcgaggagaaggagggcaagcccgtgttcaagaagaccaaggagatcagattcagcatcgagaagggcatcgccggccaggtggccagaaccggcgaggtgctgaacatccccgacgcctacgccgaccccagattcaacagagaggtggacctgtacaccggctacaccaccagaaacatcctgtgcatgcccatcgtgagcagaggcagcgtgatcggcgtggtgcagatggtgaacaagatcagcggcagcgccttcagcaagaccgacgagaacaacttcaagatgttcgccgtgttctgcgccctggccctgcactgcgccaacatgtaccacagaatcagacacagcgagtgcatctacagagtgaccatggagaagctgagctaccacagcatctgcaccagcgaggagtggcagggcctgatgcagttcaccctgcccgtgagactgtgcaaggagatcgagctgttccacttcgacatcggccccttcgagaacatgtggcccggcatcttcgtgtacatggtgcacagaagctgcggcaccagctgcttcgagctggagaagctgtgcagattcatcatgagcgtgaagaagaactacagaagagtgccctaccacaactggaagcacgccgtgaccgtggcccactgcatgtacgccatcctgcagaacaaccacaccctgttcaccgacctggagagaaagggcctgctgatcgcctgcctgtgccacgacctggaccacagaggcttcagcaacagctacctgcagaagttcgaccaccccctggccgccctgtacagcaccagcaccatggagcagcaccacttcagccagaccgtgagcatcctgcagctggagggccacaacatcttcagcaccctgagcagcagcgagtacgagcaggtgctggagatcatcagaaaggccatcatcgccaccgacctggccctgtacttcggcaacagaaagcagctggaggagatgtaccagaccggcagcctgaacctgaacaaccagagccacagagacagagtgatcggcctgatgatgaccgcctgcgacctgtgcagcgtgaccaagctgtggcccgtgaccaagctgaccgccaacgacatctacgccgagttctgggccgagggcgacgagatgaagaagctgggcatccagcccatccccatgatggacagagacaagaaggacgaggtgccccagggccagctgggcttctacaacgccgtggccatcccctgctacaccaccctgacccagatcctgccccccaccgagcccctgctgaaggcctgcagagacaacctgagccagtgggagaaggtgatcagaggcgaggagaccgccacctggatcagcagccccagcgtggcccagaaggccgccgccagcgaggactag

SEQ ID NO: 10370 - DNA, 2112 bp, Artificial Sequence
  Description of Artificial Sequence: Synthetic coding sequence
atggccgccgccaccggcgaccccggcctgagcaagctgcagttcgcccccttcagcagcgccctggacgtgggcttctggcacgagctgacccagaagaagctgaacgagtacagactggacgaggcccccaaggacatcaagggctactactacaacggcgacagcgccggcctgcccgccagactgaccctggagttcagcgccttcgacatgagcgcccccacccccgccagatgctgccccgccatcggcaccctgtacaacaccaacaccctggagagcttcaagaccgccgacaagaagctgctgctggagcaggccgccaacgagatctgggagagcatcaagagcggcaccgccctggagaaccccgtgctgctgaacaagttcctgctgctgaccttcgccgacctgaagaagtaccacttctactactggttctgctaccccgccctgtgcctgcccgagagcctgcccctgatccagggccccgtgggcctggaccagagattcagcctgaagcagatcgaggccctggagtgcgcctacgacaacctgtgccagaccgagggcgtgaccgccctgccctacttcctgatcaagtacgacgagaacatggtgctggtgagcctgctgaagcactacagcgacttcttccagggccagagaaccaagatcaccatcggcgtgtacgacccctgcaacctggcccagtaccccggctggcccctgagaaacttcctggtgctggccgcccacagatggagcagcagcttccagagcgtggaggtggtgtgcttcagagacagaaccatgcagggcgccagagacgtggcccacagcatcatcttcgaggtgaagctgcccgagatggccttcagccccgactgccccaaggccgtgggctgggagaagaaccagaagggcggcatgggccccagaatggtgaacctgagcgagtgcatggaccccaagagactggccgagagcagcgtggacctgaacctgaagctgatgtgctggagactggtgcccaccctggacctggacaaggtggtgagcgtgaagtgcctgctgctgggcgccggcaccctgggctgcaacgtggccagaaccctgatgggctggggcgtgagacacatcaccttcgtggacaacgccaagatcagctacagcaaccccgtgagacagcccctgtacgagttcgaggactgcctgggcggcggcaagcccaaggccctggccgccgccgacagactgcagaagatcttccccggcgtgaacgccagaggcttcaacatgagcatccccatgcccggccaccccgtgaacttcagcagcgtgaccctggagcaggccagaagagacgtggagcagctggagcagctgatcgagagccacgacgtggtgttcctgctgatggacaccagagagagcagatggctgcccgccgtgatcgccgccagcaagagaaagctggtgatcaacgccgccctgggcttcgacaccttcgtggtgatgagacacggcctgaagaagcccaagcagcagggcgccggcgacctgtgccccaaccaccccgtggccagcgccgacctgctgggcagcagcctgttcgccaacatccccggctacaagctgggctgctacttctgcaacgacgtggtggcccccggcgacagcaccagagacagaaccctggaccagcagtgcaccgtgagcagacccggcctggccgtgatcgccggcgccctggccgtggagctgatggtgagcgtgctgcagcaccccgagggcggctacgccatcgccagcagcagcgacgacagaatgaacgagccccccaccagcctgggcctggtgccccaccagatcagaggcttcctgagcagattcgacaacgtgctgcccgtgagcctggccttcgacaagtgcaccgcctgcagcagcaaggtgctggaccagtacgagagagagggcttcaacttcctggccaaggtgttcaacagcagccacagcttcctggaggacctgaccggcctgaccctgctgcaccaggagacccaggccgccgagatctgggacatgagcgacgacgagaccatctag

SEQ ID NO: 10371 - DNA, 3246 bp, Artificial Sequence
  Description of Artificial Sequence: Synthetic coding sequence
atggagagcgccggcctggagcagctgctgagagagctgctgctgcccgacaccgagagaatcagaagagccaccgagcagctgcagatcgtgctgagagcccccgccgccctgcccgccctgtgcgacctgctggccagcgccgccgacccccagatcagacagttcgccgccgtgctgaccagaagaagactgaacaccagatggagaagactggccgccgagcagagagagagcctgaagagcctgatcctgaccgccctgcagagagagaccgagcactgcgtgagcctgagcctggcccagctgagcgccaccatcttcagaaaggagggcctggaggcctggccccagctgctgcagctgctgcagcacagcacccacagcccccacagccccgagagagagatgggcctgctgctgctgagcgtggtggtgaccagcagacccgaggccttccagccccaccacagagagctgctgagactgctgaacgagaccctgggcgaggtgggcagccccggcctgctgttctacagcctgagaaccctgaccaccatggccccctacctgagcaccgaggacgtgcccctggccagaatgctggtgcccaagctgatcatggccatgcagaccctgatccccatcgacgaggccaaggcctgcgaggccctggaggccctggacgagctgctggagagcgaggtgcccgtgatcaccccctacctgagcgaggtgctgaccttctgcctggaggtggccagaaacgtggccctgggcaacgccatcagaatcagaatcctgtgctgcctgaccttcctggtgaaggtgaagagcaaggccctgctgaagaacagactgctgccccccctgctgcacaccctgttccccatcgtggccgccgagcccccccccggccagctggaccccgaggaccaggacagcgaggaggaggagctggagatcgagctgatgggcgagacccccaagcacttcgccgtgcaggtggtggacatgctggccctgcacctgccccccgagaagctgtgcccccagctgatgcccatgctggaggaggccctgagaagcgagagcccctaccagagaaaggccggcctgctggtgctggccgtgctgagcgacggcgccggcgaccacatcagacagagactgctgccccccctgctgcagatcgtgtgcaagggcctggaggaccccagccaggtggtgagaaacgccgccctgttcgccctgggccagttcagcgagaacctgcagccccacatcagcagctacagcagagaggtgatgcccctgctgctggcctacctgaagagcgtgcccctgggccacacccaccacctggccaaggcctgctacgccctggagaacttcgtggagaacctgggccccaaggtgcagccctacctgcccgagctgatggagtgcatgctgcagctgctgagaaaccccagcagccccagagccaaggagctggccgtgagcgccctgggcgccatcgccaccgccgcccaggccagcctgctgccctacttccccgccatcatggagcacctgagagagttcctgctgaccggcagagaggacctgcagcccgtgcagatccagagcctggagaccctgggcgtgctggccagagccgtgggcgagcccatgagacccctggccgaggagtgctgccagctgggcctgggcctgtgcgaccaggtggacgaccccgacctgagaagatgcacctacagcctgttcgccgccctgagcggcctgatgggcgagggcctggccccccacctggagcagatcaccaccctgatgctgctgagcctgagaagcaccgagggcatcgtgccccagtacgacggcagcagcagcttcctgctgttcgacgacgagagcgacggcgaggaggaggaggagctgatggacgaggacgtggaggaggaggacgacagcgagatcagcggctacagcgtggagaacgccttcttcgacgagaaggaggacacctgcgccgccgtgggcgagatcagcgtgaacaccagcgtggccttcctgccctacatggagagcgtgttcgaggaggtgttcaagctgctggagtgcccccacctgaacgtgagaaaggccgcccacgaggccctgggccagttctgctgcgccctgcacaaggcctgccagagctgccccagcgagcccaacaccgccgccctgcaggccgccctggccagagtggtgcccagctacatgcaggccgtgaacagagagagagagagacaggtggtgatggccgtgctggaggccctgaccggcgtgctgagaagctgcggcaccctgaccctgaagccccccggcagactggccgagctgtgcggcgtgctgaaggccgtgctgcagagaaagaccgcctgccaggacaccgacgaggaggaggaggaggaggacgacgaccaggccgagtacgacgccatgctgctggagcacgccggcgaggccatccccgccctggccgccgccgccggcggcgacagcttcgcccccttcttcgccggcttcctgcccctgctggtgtgcaagaccaagcagggctgcaccgtggccgagaagagcttcgccgtgggcaccctggccgagaccatccagggcctgggcgccgccagcgcccagttcgtgagcagactgctgcccgtgctgctgagcaccgcccaggaggccgaccccgaggtgagaagcaacgccatcttcggcatgggcgtgctggccgagcacggcggccaccccgcccaggagcacttccccaagctgctgggcctgctgttccccctgctggccagagagagacacgacagagtgagagacaacatctgcggcgccctggccagactgctgatggccagccccaccagaaagcccgagccccaggtgctggccgccctgctgcacgccctgcccctgaaggaggacctggaggagtgggtgaccatcggcagactgttcagcttcctgtaccagagcagccccgaccaggtgatcgacgtggcccccgagctgctgagaatctgcagcctgatcctggccgacaacaagatcccccccgacaccaaggccgccctgctgctgctgctgaccttcctggccaagcagcacaccgacagcttccaggccgccctgggcagcctgcccgtggacaaggcccaggagctgcaggccgtgctgggcctgagctag

SEQ ID NO: 10372 - DNA, 7224 bp, Artificial Sequence
  Description of Artificial Sequence: Synthetic coding sequence
atggtgggcgagagacacgccggcgacctgatggtgcccctgggccccagactgcaggcctaccccgaggagctgatcagacagagacccggccacgacggccaccccgagtacctgatcagatggagcgtgctgaagtgcggcgaggtgggcaaggtgggcgtggaggagggcaaggccgagcacatcctgatgtggctgagcgcccccgaggtgtacgccaactgccccggcctgctgggcgagagagccctgagcaagggcctgcagcacgagcccgccggcgtgagcggcagcttccccagagaccccggcggcctggacgaggtggccatgggcgagatggaggccgacgtgcaggccctggtgagaagagccgccagacagctggccgagagcggcacccccagcctgaccgccgccgtgctgcacaccatccacgtgctgagcgcctacgccagcatcggccccctgaccggcgtgttcagagagaccggcgccctggacctgctgatgcacatgctgtgcaaccccgagccccagatcagaagaagcgccggcaagatgctgcaggccctggccgcccacgacgccggcagcagagcccacgtgctgctgagcctgagccagcaggacggcatcgagcagcacatggacttcgacagcagatacaccctgctggagctgttcgccgagaccaccagcagcgaggagcactgcatggccttcgagggcatccacctgccccagatccccggcaagctgctgttcagcctggtgaagagatacctgtgcgtgaccagcctgctggaccagctgaacagcagccccgagctgggcgccggcgaccagagcagcccctgcgccaccagagagaagagcagaggccagagagagctggagttcagcatggccgtgggcaacctgatcagcgagctggtgagaagcatgggctgggccagaaacctgagcgagcagggcatgagcccccccagacccaccagaagcatcttccagccctacatcagcggccccagcctgctgctgcccaccatcgtgaccacccccagaagacagggctgggtgttcagacagagaagcgagttcagcagcagaagcggctacggcgagtacgtgcagcagaccctgcagcccggcatgagagtgagaatgctggacgactacgaggagatcagcgccggcgacgagggcgagttcagacagagcaacaacggcatcccccccgtgcagaccctgggcgagaaggccctgggcgagatcagcgtgagcgtggagatggccgagagcctgctgcaggtgctgagcagcagattcgagggcagcaccctgaacgacctgctgaacagccagatctacaccaagtacggcctgctgagcaacgagcccagcagcagcagcaccagcagaaaccacagctgcacccccgaccccgaggaggagagcaagagcgaggccagcttcagcgaggaggagaccgagagcctgaaggccaaggccgaggcccccaagaccgaggccgagcccaccaagaccagaaccgagacccccatggcccagagcgacagccagctgttcaaccagctgctggtgaccgagggcatgaccctgcccaccgagatgaaggaggccgccagcgagatggccagagccctgagaggccccggccccagaagcagcctggaccagcacgtggccgccgtggtggccaccgtgcagatcagcagcctggacaccaacctgcagctgagcggcctgagcgccctgagccaggccgtggaggaggtgaccgagagagaccaccccctggtgagacccgacagaagcctgagagagaagctggtgaagatgctggtggagctgctgaccaaccaggtgggcgagaagatggtggtggtgcaggccctgagactgctgtacctgctgatgaccaagcacgagtggagacccctgttcgccagagagggcggcatctacgccgtgctggtgtgcatgcaggagtacaagaccagcgtgctggtgcagcaggccggcctggccgccctgaagatgctggccgtggccagcagcagcgagatccccaccttcgtgaccggcagagacagcatccacagcctgttcgacgcccagatgaccagagagatcttcgccagcatcgacagcgccaccagacccggcagcgagagcctgctgctgaccgtgcccgccgccgtgatcctgatgctgaacaccgagggctgcagcagcgccgccagaaacggcctgctgctgctgaacctgctgctgtgcaaccaccacaccctgggcgaccagatcatcacccaggagctgagagacaccctgttcagacacagcggcatcgcccccagaaccgagcccatgcccaccaccagaaccatcctgatgatgctgctgaacagatacagcgagccccccggcagccccgagagagccgccctggagacccccatcatccagggccaggacggcagccccgagctgctgatcagaagcctggtgggcggccccagcgccgagctgctgctggacctggagagagtgctgtgcagagagggcagccccggcggcgccgtgagacccctgctgaagagactgcagcaggagacccagcccttcctgctgctgctgagaaccctggacgcccccggccccaacaagaccctgctgctgagcgtgctgagagtgatcaccagactgctggacttccccgaggccatggtgctgccctggcacgaggtgctggagccctgcctgaactgcctgagcggccccagcagcgacagcgagatcgtgcaggagctgacctgcttcctgcacagactggccagcatgcacaaggactacgccgtggtgctgtgctgcctgggcgccaaggagatcctgagcaaggtgctggacaagcacagcgcccagctgctgctgggctgcgagctgagagacctggtgaccgagtgcgagaagtacgcccagctgtacagcaacctgaccagcagcatcctggccggctgcatccagatggtgctgggccagatcgaggaccacagaagaacccaccagcccatcaacatccccttcttcgacgtgttcctgagacacctgtgccagggcagcagcgtggaggtgaaggaggacaagtgctgggagaaggtggaggtgagcagcaacccccacagagccagcaagctgaccgaccacaaccccaagacctactgggagagcaacggcagcaccggcagccactacatcaccctgcacatgcacagaggcgtgctggtgagacagctgaccctgctggtggccagcgaggacagcagctacatgcccgccagagtggtggtgttcggcggcgacagcaccagctgcatcggcaccgagctgaacaccgtgaacgtgatgcccagcgccagcagagtgatcctgctggagaacctgaacagattctggcccatcatccagatcagaatcaagagatgccagcagggcggcatcgacaccagagtgagaggcgtggaggtgctgggccccaagcccaccttctggcccctgttcagagagcagctgtgcagaagaacctgcctgttctacaccatcagagcccaggcctggagcagagacatcgccgaggaccacagaagactgctgcagctgtgccccagactgaacagagtgctgagacacgagcagaacttcgccgacagattcctgcccgacgacgaggccgcccaggccctgggcaagacctgctgggaggccctggtgagccccctggtgcagaacatcaccagccccgacgccgagggcgtgagcgccctgggctggctgctggaccagtacctggagcagagagagaccagcagaaaccccctgagcagagccgccagcttcgccagcagagtgagaagactgtgccacctgctggtgcacgtggagcccccccccggccccagccccgagcccagcaccagacccttcagcaagaacagcaagggcagagacagaagccccgcccccagccccgtgctgcccagcagcagcctgagaaacatcacccagtgctggctgagcgtggtgcaggagcaggtgagcagattcctggccgccgcctggagagcccccgacttcgtgcccagatactgcaagctgtacgagcacctgcagagagccggcagcgagctgttcggccccagagccgccttcatgctggccctgagaagcggcttcagcggcgccctgctgcagcagagcttcctgaccgccgcccacatgagcgagcagttcgccagatacatcgaccagcagatccagggcggcctgatcggcggcgcccccggcgtggagatgctgggccagctgcagagacacctggagcccatcatggtgctgagcggcctggagctggccaccaccttcgagcacttctaccagcactacatggccgacagactgctgagcttcggcagcagctggctggagggcgccgtgctggagcagatcggcctgtgcttccccaacagactgccccagctgatgctgcagagcctgagcaccagcgaggagctgcagagacagttccacctgttccagctgcagagactggacaagctgttcctggagcaggaggacgaggaggagaagagactggaggaggaggaggaggaggaggaggaggaggaggccgagaaggagctgttcatcgaggaccccagccccgccatcagcatcctggtgctgagccccagatgctggcccgtgagccccctgtgctacctgtaccaccccagaaagtgcctgcccaccgagttctgcgacgccctggacagattcagcagcttctacagccagagccagaaccaccccgtgctggacatgggcccccacagaagactgcagtggacctggctgggcagagccgagctgcagttcggcaagcagatcctgcacgtgagcaccgtgcagatgtggctgctgctgaagttcaaccagaccgaggaggtgagcgtggagaccctgctgaaggacagcgacctgagccccgagctgctgctgcaggccctggtgcccctgaccagcggcaacggccccctgaccctgcacgagggccaggacttcccccacggcggcgtgctgagactgcacgagcccggcccccagagaagcggcgaggccctgtggctgatccccccccaggcctacctgaacgtggagaaggacgagggcagaaccctggagcagaagagaaacctgctgagctgcctgctggtgagaatcctgaaggcccacggcgagaagggcctgcacatcgaccagctggtgtgcctggtgctggaggcctggcagaagggccccaacccccccggcaccctgggccacaccgtggccggcggcgtggcctgcaccagcaccgacgtgctgagctgcatcctgcacctgctgggccagggctacgtgaagagaagagacgacagaccccagatcctgatgtacgccgcccccgagcccatgggcccctgcagaggccaggccgacgtgcccttctgcggcagccagagcgagaccagcaagcccagccccgaggccgtggccaccctggccagcctgcagctgcccgccggcagaaccatgagcccccaggaggtggagggcctgatgaagcagaccgtgagacaggtgcaggagaccctgaacctggagcccgacgtggcccagcacctgctggcccacagccactggggcgccgagcagctgctgcagagctacagcgaggaccccgagcccctgctgctggccgccggcctgtgcgtgcaccaggcccaggccgtgcccgtgagacccgaccactgccccgtgtgcgtgagccccctgggctgcgacgacgacctgcccagcctgtgctgcatgcactactgctgcaagagctgctggaacgagtacctgaccaccagaatcgagcagaacctggtgctgaactgcacctgccccatcgccgactgccccgcccagcccaccggcgccttcatcagagccatcgtgagcagccccgaggtgatcagcaagtacgagaaggccctgctgagaggctacgtggagagctgcagcaacctgacctggtgcaccaacccccagggctgcgacagaatcctgtgcagacagggcctgggctgcggcaccacctgcagcaagtgcggctgggccagctgcttcaactgcagcttccccgaggcccactaccccgccagctgcggccacatgagccagtgggtggacgacggcggctactacgacggcatgagcgtggaggcccagagcaagcacctggccaagctgatcagcaagagatgccccagctgccaggcccccatcgagaagaacgagggctgcctgcacatgacctgcgccaagtgcaaccacggcttctgctggagatgcctgaagagctggaagcccaaccacaaggactactacaactgcagcgccatggtgagcaaggccgccagacaggagaagagattccaggactacaacgagagatgcaccttccaccaccaggccagagagttcgccgtgaacctgagaaacagagtgagcgccatccacgaggtgcccccccccagaagcttcaccttcctgaacgacgcctgccagggcctggagcaggccagaaaggtgctggcctacgcctgcgtgtacagcttctacagccaggacgccgagtacatggacgtggtggagcagcagaccgagaacctggagctgcacaccaacgccctgcagatcctgctggaggagaccctgctgagatgcagagacctggccagcagcctgagactgctgagagccgactgcctgagcaccggcatggagctgctgagaagaatccaggagagactgctggccatcctgcagcacagcgcccaggacttcagagtgggcctgcagagccccagcgtggaggcctgggaggccaagggccccaacatgcccggcagccagccccaggccagcagcggccccgaggccgaggaggaggaggaggacgacgaggacgacgtgcccgagtggcagcaggacgagttcgacgaggagctggacaacgacagcttcagctacgacgagagcgagaacctggaccaggagaccttcttcttcggcgacgaggaggaggacgaggacgaggcctacgactag

SEQ ID NO: 10373 - DNA, 672 bp, Artificial Sequence
  Description of Artificial Sequence: Synthetic coding sequence
atggaggacgtgaagctggagttccccagcctgccccagtgcaaggaggacgccgaggagtggacctaccccatgagaagagagatgcaggagatcctgcccggcctgttcctgggcccctacagcagcgccatgaagagcaagctgcccgtgctgcagaagcacggcatcacccacatcatctgcatcagacagaacatcgaggccaacttcatcaagcccaacttccagcagctgttcagatacctggtgctggacatcgccgacaaccccgtggagaacatcatcagattcttccccatgaccaaggagttcatcgacggcagcctgcagatgggcggcaaggtgctggtgcacggcaacgccggcatcagcagaagcgccgccttcgtgatcgcctacatcatggagaccttcggcatgaagtacagagacgccttcgcctacgtgcaggagagaagattctgcatcaaccccaacgccggcttcgtgcaccagctgcaggagtacgaggccatctacctggccaagctgaccatccagatgatgagccccctgcagatcgagagaagcctgagcgtgcacagcggcaccaccggcagcctgaagagaacccacgaggaggaggacgacttcggcaccatgcaggtggccaccgcccagaacggctag

SEQ ID NO: 10374 - DNA, 1689 bp, Artificial Sequence
  Description of Artificial Sequence: Synthetic coding sequence
atggacgacaagggcgaccccagcaacgaggaggcccccaaggccatcaagcccaccagcaaggagttcagaaagacctggggcttcagaagaaccaccatcgccaagagagagggcgccggcgacgccgaggccgaccccctggagcccccccccccccagcagcagctgggcctgagcctgagaagaagcggcagacagcccaagagaaccgagagagtggagcagttcctgaccatcgccagaagaagaggcagaagaagcatgcccgtgagcctggaggacagcggcgagcccaccagctgccccgccaccgacgccgagaccgccagcgagggcagcgtggagagcgccagcgagaccagaagcggcccccagagcgccagcaccgccgtgaaggagagacccgccagcagcgagaaggtgaagggcggcgacgaccacgacgacaccagcgacagcgacagcgacggcctgaccctgaaggagctgcagaacagactgagaagaaagagagagcaggagcccaccgagagacccctgaagggcatccagagcagactgagaaagaagagaagagaggagggccccgccgagaccgtgggcagcgaggccagcgacaccgtggagggcgtgctgcccagcaagcaggagcccgagaacgaccagggcgtggtgagccaggccggcaaggacgacagagagagcaagctggagggcaaggccgcccaggacatcaaggacgaggagcccggcgacctgggcagacccaagcccgagtgcgagggctacgaccccaacgccctgtactgcatctgcagacagccccacaacaacagattcatgatctgctgcgacagatgcgaggagtggttccacggcgactgcgtgggcatcagcgaggccagaggcagactgctggagagaaacggcgaggactacatctgccccaactgcaccatcctgcaggtgcaggacgagacccacagcgagaccgccgaccagcaggaggccaagtggagacccggcgacgccgacggcaccgactgcaccagcatcggcaccatcgagcagaagagcagcgaggaccagggcatcaagggcagaatcgagaaggccgccaaccccagcggcaagaagaagctgaagatcttccagcccgtgatcgaggcccccggcgccagcaagtgcatcggccccggctgctgccacgtggcccagcccgacagcgtgtactgcagcaacgactgcatcctgaagcacgccgccgccaccatgaagttcctgagcagcggcaaggagcagaagcccaagcccaaggagaagatgaagatgaagcccgagaagcccagcctgcccaagtgcggcgcccaggccggcatcaagatcagcagcgtgcacaagagacccgcccccgagaagaaggagaccaccgtgaagaaggccgtggtggtgcccgccagaagcgaggccctgggcaaggaggccgcctgcgagagcagcacccccagctgggccagcgaccacaactacaacgccgtgaagcccgagaagaccgccgcccccagccccagcctgctgtacaagtgcatgtaccacctgggcgtgggcctgctggaccccagcagaagcttctggatcgccatcccctgggcctgccccggcctgggcgtggccgccctgtgctag

SEQ ID NO: 10375 - DNA, 360 bp, Artificial Sequence
  Description of Artificial Sequence: Synthetic coding sequence
atgatcctgcagcagcccctgcagagaggcccccagggcggcgcccagagactgcccagagccgccctgggcgtgacctggggcctggacgccagagagcccctgagaaagcagttcctgagcgaggagaacatggccacccacttcagccagctgagcctgcacaacgaccacccctactgcagcccccccatgaccttcagccccgccctgccccccctgagaagcccctgcagcgagctgctgctgtggagataccccggcagcctgatccccgaggccctgagactgctgagactgggcgacacccccagccccccctaccccgccacccccgccggcgacatcatggagctgtag

SEQ ID NO: 10376 - DNA, 1794 bp, Artificial Sequence
  Description of Artificial Sequence: Synthetic coding sequence
atggtgcccgaggagagaagagtgggcctgagcagcgacgagaccagcagcgacagcctgaagagctggcacagcatctgcgtgctggacagcaaggagcagcccctggcctgccagcagaagcagagacagttcgtgaagcccgtgaccgagagcgagcagcccaccgtgctggagctgctgctggccgagctgagaaccctgttcagcgccgtgctgcaggacagcagccccgccgcctggagatacctgcacgccgtgctgggcctgctgcccccctacagagagctgctggtgggccacctggacctgctgcccttcctggagcagctgtactgctgggccccctgggtgcagacccacctgcacctggacctgctgggcgccatcgtgcaggccttcccccccgacagcagcctgctggacagcgccagccacgccgactgctgcccccagaagagaagactgcaccacagacccccctgccccgcctgccccttcgtgcaggcccagtggagcagacagcaggtgaaggaggagctggccacctggctgagacccctgaccctgcccgagctgcagagatgcctgggcatcgtgggcgcccaggtggccctggaggaggccgtgtggctggacggcctgagcctgctgcccctggccctggccgccgacatccccgtgagatacgagagcagcgacaccgacaacgccgaggtggagcccgtgggcagaaaggagaccagaagccagctggactacgaggtgcccagagagaaggccttccagaagagcagcaccggcttcagccccgagaccagcttcctggacagccaggtgatgaccgccctgaagatggagagatacctgaagaagatccacttcctgtacctgaacgtggcccccagcagatacttcagaccctacagcctgatggtggtgccccccgacaaggtgaaccccgagcactacatcttcagccccttcggcatcctgcacgtgcaccccgtggagggcagcgagaccatgaccctgggcacctggcaccaccactgcgtgctgtggcagcagctgcagttcatccccttcttcaagtactgcctgctgagaaagagcttcacctgctggaagaagaacgtgagactgcagggcctgcacagactgcagaagttcctggagaaccacctgctgctggccgtgccccacttcggcgccggcctgctgcacatcagcagactgctgcaggagctgcacagcgtgagctggctgccccaggagctggacagatgctacgagctgctggacctgcagaccgccctggccgaggagaagcacaaggccctgagactgctgcacagatgcctgaacctgtgcaccagcatcctgagactggtgcacgaggacacctaccacatgcagcagtgcctgcaggagagagtgcagaactgcgacagaatcagaaccggccagggcagcatctacctgcagagagtgcagcacaagcagctggagcagaagctgaagcaggccgaggcctggtggctgcagctgggcaagttcgccagactggtggactacatgatctgccagagcctgatcagcgtgctggaggagcagatcaccagcttcgtggccaacatcctgcaggcccccagacagaagcccttcctgagcagccagctggtgttcgacgaccacggccagctgagccacgtgccctgcgtggagaacatgatccagaccctgaccggcggcctgcagagcgtgaagaccagcgccctgcaggtgttctag

SEQ ID NO: 10377 - DNA, 591 bp, Artificial Sequence
  Description of Artificial Sequence: Synthetic coding sequence
atggaggacctgttcgagaccttccaggacgagatgggcttcagcaacatggaggacgacggccccgaggaggaggagagagtggccgagccccaggccaacttcaacaccccccaggccctgagattcgaggagctgctggccaacctgctgaacgagcagcaccagatcgccaaggagctgttcgagcagctgaagatgaagaagcccagcgccaagcagcagaaggaggtggagaaggtgaagccccagtgcaaggaggtgcaccagaccctgatcctggaccccgcccagagaaagagactgcagcagcagatgcagcagcacgtgcagctgctgacccagatccacctgctggccacctgcaaccccaacctgaaccccgaggccagcagcaccagaatctgcctgaaggagctgggcaccttcgcccagagcagcatcgccctgcaccaccagtacaaccccaagttccagaccctgttccagccctgcaacctgatgggcgccatgcagctgatcgaggacttcagcacccacgtgagcatcgactgcagcccccacaagaccgtgaagaagaccgtgtgctag

SEQ ID NO: 10378 - DNA, 888 bp, Artificial Sequence; identical to SEQ ID NO: 10194
  Description of Artificial Sequence: Synthetic coding sequence

SEQ ID NO: 10379 - DNA, 915 bp, Artificial Sequence
  Description of Artificial Sequence: Synthetic coding sequence
atgaagagagcccaccccgagtacagcagcagcgacagcgagctggacgagaccatcgaggtggagaaggagagcgccgacgagaacggcaacctgagcagcgccctgggcagcatgagccccaccaccagcagccagatcctggccagaaagagaagaagaggcatcatcgagaagagaagaagagacagaatcaacaacagcctgagcgagctgagaagactggtgcccagcgccttcgagaagcagggcagcgccaagctggagaaggccgagatcctgcagatgaccgtggaccacctgaagatgctgcacaccgccggcggcaagggctacttcgacgcccacgccctggccatggactacagaagcctgggcttcagagagtgcctggccgaggtggccagatacctgagcatcatcgagggcctggacgccagcgaccccctgagagtgagactggtgagccacctgaacaactacgccagccagagagaggccgccagcggcgcccacgccggcctgggccacatcccctggggcaccgtgttcggccaccacccccacatcgcccaccccctgctgctgccccagaacggccacggcaacgccggcaccaccgccagccccaccgagccccaccaccagggcagactgggcagcgcccaccccgaggcccccgccctgagagccccccccagcggcagcctgggccccgtgctgcccgtggtgaccagcgccagcaagctgagcccccccctgctgagcagcgtggccagcctgagcgccttccccttcagcttcggcagcttccacctgctgagccccaacgccctgagccccagcgcccccacccaggccgccaacctgggcaagccctacagaccctggggcaccgagatcggcgccttctag

SEQ ID NO: 10380 - DNA, 2529 bp, Artificial Sequence
  Description of Artificial Sequence: Synthetic coding sequence
atgtgcggcagcgagagaatcctgcaggccggcaacatcctggagatcagagtgggccaggccggcgccagaagagtggccaccatgaccagccccgtgctggtggacatcagagaggaggtgacctgccccatctgcctggagctgctgaccgagcccctgagcatcgactgcggccacagcttctgccaggcctgcatcacccccaacggcagagagagcgtgatcggccaggagggcgagagaagctgccccgtgtgccagaccagctaccagcccggcaacctgagacccaacagacacctggccaacatcgtgagaagactgagagaggtggtgctgggccccggcaagcagctgaaggccgtgctgtgcgccgaccacggcgagaagctgcagctgttctgccaggaggacggcaaggtgatctgctggctgtgcgagagaagccaggagcacagaggccaccacaccttcctggtggaggaggtggcccaggagtaccaggagaagttccaggagagcctgaagaagctgaagaacgaggagcaggaggccgagaagctgaccgccttcatcagagagaagaagaccagctggaagaaccagatggagcccgagagatgcagaatccagaccgagttcaaccagctgagaaacatcctggacagagtggagcagagagagctgaagaagctggagcaggaggagaagaagggcctgagaatcatcgaggaggccgagaacgacctggtgcaccagacccagagcctgagagagctgatcagcgacctggagagaagatgccagggcagcaccatggagctgctgcaggacgtgagcgacgtgaccgagagaagcgagttctggaccctgagaaagcccgaggccctgcccaccaagctgagaagcatgttcagagcccccgacctgaagagaatgctgagagtgtgcagagagctgaccgacgtgcagagctactgggccatccagggcagcctgaccagaagagagagaagagccagcggcgtgagaaccagaagaagccagggcagcagcgccatggccagcaagatcctgctgaacgtgcaggaggaggtgacctgccccatctgcctggagctgctgaccgagcccctgagcctggactgcggccacagcctgtgcagagcctgcatcaccgtgagcaacaaggaggccgtgaccagcatgggcggcaagagcagctgccccgtgtgcggcatcagctacagcttcgagcacctgcaggccaaccagcacctggccaacatcgtggagagactgaaggaggtgaagctgagccccgacaacggcaagaagagagacctgtgcgaccaccacggcgagaagctgctgctgttctgcaaggaggacagaaaggtgatctgctggctgtgcgagagaagccaggagcacagaggccaccacaccgtgctgaccgaggaggtgttcaaggagtgccaggagaagctgcaggccgtgctgaagagactgaagaaggaggaggaggaggccgagaagctggaggccgacatcagagaggagaagaccagctggaagtaccaggtgcagaccgagagacagagaatccagaccgagttcgaccagctgagaagcatcctgaacaacgaggagcagagagagctgcagagactggaggaggaggagaagaagaccctggacaagttcgccgaggccgaggacgagctggtgcagcagaagcagctggtgagagagctgatcagcgacgtggagtgcagaagccagtggagcaccatggagctgctgcaggacatgagcggcatcatgaagtggagcgagatctggagactgaagaagcccaagatggtgagcaagaagctgaagaccgtgttccacgcccccgacctgagcagaatgctgcagatgttcagagagctgaccgccgtgagatgctactgggtggacgtgaccctgaacagcgtgaacctgaacctgaacctggtgctgagcgaggaccagagacaggtgatcagcgtgcccatctggcccttccagtgctacaactacggcgtgctgggcagccagtacttcagcagcggcaagcactactgggaggtggacgtgagcaagaagaccgcctggatcctgggcgtgtactgcagaacctacagcagacacatgaagtacgtggtgagaagatgcgccaacagacagaacctgtacaccaagtacagacccctgttcggctactgggtgatcggcctgcagaacaagtgcaagtacggcgtgttcgaggagagcctgagcagcgaccccgaggtgctgaccctgagcatggccgtgcccccctgcagagtgggcgtgttcctggactacgaggccggcatcgtgagcttcttcaacgtgaccagccacggcagcctgatctacaagttcagcaagtgctgcttcagccagcccgtgtacccctacttcaacccctggaactgccccgcccccatgaccctgtgcccccccagcagctag

SEQ ID NO: 10381 - DNA, 1497 bp, Artificial Sequence
  Description of Artificial Sequence: Synthetic coding sequence
atgaacggcgccctggaccacagcgaccagcccgaccccgacgccatcaagatgttcgtgggccagatccccagaagctggagcgagaaggagctgaaggagctgttcgagccctacggcgccgtgtaccagatcaacgtgctgagagacagaagccagaaccccccccagagcaagggctgctgcttcgtgaccttctacaccagaaaggccgccctggaggcccagaacgccctgcacaacatcaagaccctgcccggcatgcaccaccccatccagatgaagcccgccgacagcgagaagagcaacgccgtggaggacagaaagctgttcatcggcatggtgagcaagaagtgcaacgagaacgacatcagagtgatgttcagccccttcggccagatcgaggagtgcagaatcctgagaggccccgacggcctgagcagaggctgcgccttcgtgaccttcagcaccagagccatggcccagaacgccatcaaggccatgcaccagagccagaccatggagggctgcagcagccccatcgtggtgaagttcgccgacacccagaaggacaaggagcagagaagactgcagcagcagctggcccagcagatgcagcagctgaacaccgccacctggggcaacctgaccggcctgggcggcctgaccccccagtacctggccctgctgcagcaggccaccagcagcagcaacctgggcgccttcagcggcatccagcagatggccggcatgaacgccctgcagctgcagaacctggccaccctggccgccgccgccgccgccgcccagaccagcgccaccagcaccaacgccaaccccctgagcaccaccagcagcgccctgggcgccctgaccagccccgtggccgccagcacccccaacagcaccgccggcgccgccatgaacagcctgaccagcctgggcaccctgcagggcctggccggcgccaccgtgggcctgaacaacatcaacgccctggccgcccccagaagcaagagactgctgctgcccaaggacaacaacggcatggccgccctgaacggcggcctgggcgccaccggcctgaccaacggcaccgccggcaccatggacgccctgacccaggcctacagcggcatccagcagtacgccgccgccgccctgcccaccctgtacagccagagcctgctgcagcagcagagcgccgccggcagccagaaggagggccccgagggcgccaacctgttcatctaccacctgccccaggagttcggcgaccaggacatcctgcagatgttcatgcccttcggcaacgtgatcagcgccaaggtgttcatcgacaagcagaccaacctgagcaagtgcttcggcttcgtgagctacgacaaccccgtgagcgcccaggccgccatccaggccatgaacggcttccagatcggcatgaagagactgaaggtgcagctgaagagaagcaagaacgacagcaagccctactag

SEQ ID NO: 10382 - DNA, 2580 bp, Artificial Sequence
  Description of Artificial Sequence: Synthetic coding sequence
atgctggaggtgctggaggagatctggagcgtgagagccagaagagcccacagaccctgccccggccccagcctggccgacgacaccgacgccaacagcaacggcagcagcggcaacgagagcaacggccacgagagcagaggcgccagccagagaagcagccacagcagcagcagcggcaacggcaaggacagcgccctgctggagaccaccgagagcagcaagagcaccaacagccagagccccagcccccccagcagcagcatcgcctacagcctgctgagcgccagcagcgagcaggacaaccccagcaccagcggctgcagcagcgagcagagcgccagagccagaacccagaaggagctgatgaccgccctgagagagctgaagctgagactgccccccgagagaagaggcaagggcagaagcggcaccctggccaccctgcagtacgccctggcctgcgtgaagcaggtgcaggccaaccaggagtactaccagcagtggagcctggaggagggcgagccctgcagcatggacatgagcacctacaccctggaggagctggagcacatcaccagcgagtacaccctgcagaaccaggacaccttcagcgtggccgtgagcttcctgaccggcagaatcgtgtacatcagcgagcaggccgccgtgctgctgagatgcaagagagacgtgttcagaggcaccagattcagcgagctgctggccccccaggacgtgggcgtgttctacggcagcaccgcccccagcagactgcccacctggggcaccggcgccagcgccggcagcggcctgagagacttcacccaggagaagagcgtgttctgcagaatcagaggcggccccgacagagaccccggccccagataccagcccttcagactgaccccctacgtgaccaagatcagagtgagcgacggcgcccccgcccagccctgctgcctgctgatcgccgagagaatccacagcggctacgaggcccccagaatcccccccgacaagagaatcttcaccaccagacacacccccagctgcctgttccaggacgtggacgagagagccgcccccctgctgggctacctgccccaggacctgctgggcgcccccgtgctgctgttcctgcaccccgaggacagacccctgatgctggccatccacaagaagatcctgcagctggccggccagcccttcgaccacagccccatcagattctgcgccagaaacggcgagtacgtgaccatggacaccagctgggccggcttcgtgcacccctggagcagaaaggtggccttcgtgctgggcagacacaaggtgagaaccgcccccctgaacgaggacgtgttcaccccccccgcccccagccccgcccccagcctggacaccgacatccaggagctgagcgagcagatccacagactgctgctgcagcccgtgcacagccccagccccaccggcctgtgcggcgtgggcgccgtgaccagccccggccccctgcacagccccggcagcagcagcgacagcaacggcggcgacgccgagggccccggcccccccgcccccgtgaccttccagcagatctgcaaggacgtgcacctggtgaagcaccagggccagcagctgttcatcgagagcagagccagaccccagagcagacccagactgcccgccaccggcaccttcaaggccaaggccctgccctgccagagccccgaccccgagctggaggccggcagcgcccccgtgcaggcccccctggccctggtgcccgaggaggccgagagaaaggaggccagcagctgcagctaccagcagatcaactgcctggacagcatcctgagatacctggagagctgcaacctgcccagcaccaccaagagaaagtgcgccagcagcagcagctacaccaccagcagcgccagcgacgacgacagacagagaaccggccccgtgagcgtgggcaccaagaaggacccccccagcgccgccctgagcggcgagggcgccacccccagaaaggagcccgtggtgggcggcaccctgagccccctggccctggccaacaaggccgagagcgtggtgagcgtgaccagccagtgcagcttcagcagcaccatcgtgcacgtgggcgacaagaagccccccgagagcgacatcatcatgatggaggacctgcccggcctggcccccggccccgcccccagccccgcccccagccccaccgtggcccccgaccccgcccccgacgcctacagacccgtgggcctgaccaaggccgtgctgagcctgcacacccagaaggaggagcaggccttcctgagcagattcagagacctgggcagactgagaggcctggacagcagcagcaccgcccccagcgccctgggcgagagaggcagccacctgggcccccccggcgcctgccccctgcccagcctgggcctggactgctggggcgtgggcctgaagggcggcgtgagcgcccccggcacccaggccggcgtggccagcaccaccagaccctgcctgggcaccggccccagcctggccagcccccactag

SEQ ID NO: 10383 - DNA, 1266 bp, Artificial Sequence
  Description of Artificial Sequence: Synthetic coding sequence
atggccagcagcagcgtgccccccgccaccgtgagcgccgccaccgccggccccggccccggcttcggcttcgccagcaagaccaagaagaagcacttcgtgcagcagaaggtgaaggtgttcagagccgccgaccccctggtgggcgtgttcctgtggggcgtggcccacagcatcaacgagctgagccaggtgcccccccccgtgatgctgctgcccgacgacttcaaggccagcagcaagatcaaggtgaacaaccacctgttccacagagagaacctgcccagccacttcaagttcaaggagtactgcccccaggtgttcagaaacctgagagacagattcggcatcgacgaccaggactacctggtgagcctgaccagaaacccccccagcgagagcgagggcagcgacggcagattcctgatcagctacgacagaaccctggtgatcaaggaggtgagcagcgaggacatcgccgacatgcacagcaacctgagcaactaccaccagtacatcgtgaagtgccacggcaacaccctgctgccccagttcctgggcatgtacagagtgagcgtggacaacgaggacagctacatgctggtgatgagaaacatgttcagccacagactgcccgtgcacagaaagtacgacctgaagggcagcctggtgagcagagaggccagcgacaaggagaaggtgaaggagctgcccaccctgaaggacatggacttcctgaacaagaaccagaaggtgtacatcggcgaggaggagaagaagatcttcctggagaagctgaagagagacgtggagttcctggtgcagctgaagatcatggactacagcctgctgctgggcatccacgacatcatcagaggcagcgagcccgaggaggaggcccccgtgagagaggacgagagcgaggtggacggcgactgcagcctgaccggcccccccgccctggtgggcagctacggcaccagccccgagggcatcggcggctacatccacagccacagacccctgggccccggcgagttcgagagcttcatcgacgtgtacgccatcagaagcgccgagggcgccccccagaaggaggtgtacttcatgggcctgatcgacatcctgacccagtacgacgccaagaagaaggccgcccacgccgccaagaccgtgaagcacggcgccggcgccgagatcagcaccgtgcaccccgagcagtacgccaagagattcctggacttcatcaccaacatcttcgcctag

SEQ ID NO: 10384 - DNA, 2031 bp, Artificial Sequence
  Description of Artificial Sequence: Synthetic coding sequence
atggccgccgccaccggcgaccccggcctgagcaagctgcagttcgcccccttcagcagcgccctggacgtgggcttctggcacgagctgacccagaagaagctgaacgagtacagactggacgaggcccccaaggacatcaagggctactactacaacggcgacagcgccggcctgcccgccagactgaccctggagttcagcgccttcgacatgagcgcccccacccccgccagatgctgccccgccatcggcaccctgtacaacaccaacaccctggagagcttcaagaccgccgacaagaagctgctgctggagcaggccgccaacgagatctgggagagcatcaagagcggcaccgccctggagaaccccgtgctgctgaacaagttcctgctgctgaccttcgccgacctgaagaagtaccacttctactactggttctgctaccccgccctgtgcctgcccgagagcctgcccctgatccagggccccgtgggcctggaccagagattcagcctgaagcagatcgaggccctggagtgcgcctacgacaacctgtgccagaccgagggcgtgaccgccctgccctacttcctgatcaagtacgacgagaacatggtgctggtgagcctgctgaagcactacagcgacttcttccagggccagagaaccaagatcaccatcggcgtgtacgacccctgcaacctggcccagtaccccggctggcccctgagaaacttcctggtgctggccgcccacagatggagcagcagcttccagagcgtggaggtggtgtgcttcagagacagaaccatgcagggcgccagagacgtggcccacagcatcatcttcgaggtgaagctgcccgagatggccttcagccccgactgccccaaggccgtgggctgggagaagaaccagaagggcggcatgggccccagaatggtgaacctgagcgagtgcatggaccccaagagactggccgagagcagcgtggacctgaacctgaagctgatgtgctggagactggtgcccaccctggacctggacaaggtggtgagcgtgaagtgcctgctgctgggcgccggcaccctgggctgcaacgtggccagaaccctgatgggctggggcgtgagacacatcaccttcgtggacaacgccaagatcagctacagcaaccccgtgagacagcccctgtacgagttcgaggactgcctgggcggcggcaagcccaaggccctggccgccgccgacagactgcagaagatcttccccggcgtgaacgccagaggcttcaacatgagcatccccatgcccggccaccccgtgaacttcagcagcgtgaccctggagcaggccagaagagacgtggagcagctggagcagctgatcgagagccacgacgtggtgttcctgctgatggacaccagagagagcagatggctgcccgccgtgatcgccgccagcaagagaaagctggtgatcaacgccgccctgggcttcgacaccttcgtggtgatgagacacggcctgaagaagcccaagcagcagggcgccggcgacctgtgccccaaccaccccgtggccagcgccgacctgctgggcagcagcctgttcgccaacatccccggctacaagctgggctgctacttctgcaacgacgtggtggcccccggcgacagcaccagagacagaaccctggaccagcagtgcaccgtgagcagacccggcctggccgtgatcgccggcgccctggccgtggagctgatggtgagcgtgctgcagcaccccgagggcggctacgccatcgccagcagcagcgacgacagaatgaacgagccccccaccagcctgggcctggtgccccaccaggtgctggaccagtacgagagagagggcttcaacttcctggccaaggtgttcaacagcagccacagcttcctggaggacctgaccggcctgaccctgctgcaccaggagacccaggccgccgagatctgggacatgagcgacgacgagaccatctag

SEQ ID NO: 10385 - DNA, 1329 bp, Artificial Sequence
  Description of Artificial Sequence: Synthetic coding sequence
atggccagcgacggcgccagcgccctgcccggccccgacatgagcatgaagcccagcgccgcccccagccccagccccgccctgcccttcctgccccccaccagcgacccccccgaccacccccccagagagccccccccccagcccatcatgcccagcgtgttcagccccgacaaccccctgatgctgagcgccttccccagcagcctgctggtgaccggcgacggcggcccctgcctgagcggcgccggcgccggcaaggtgatcgtgaaggtgaagaccgagggcggcagcgccgagcccagccagacccagaacttcatcctgacccagaccgccctgaacagcaccgcccccggcaccccctgcggcggcctggagggccccgccccccccttcgtgaccgccagcaacgtgaagaccatcctgcccagcaaggccgtgggcgtgagccaggagggcccccccggcctgcccccccagccccccccccccgtggcccagctggtgcccatcgtgcccctggagaaggcctggcccggcccccacggcaccaccggcgagggcggccccgtggccaccctgagcaagcccagcctgggcgacagaagcaagatcagcaaggacgtgtacgagaacttcagacagtggcagagatacaaggccctggccagaagacacctgagccagagccccgacaccgaggccgtgaaggagtacgtggacatcatggagtggctggtgggcacccacctggccaccggcgagagcgacggcaagcaggaggaggagggccagcagcaggaggaggagggcatgtaccccgaccccggcctgctgagctacatcaacgagctgtgcagccagaaggtgttcgtgagcaaggtggaggccgtgatccacccccagttcctggccgacctgctgagccccgagaagcagagagaccccctggccctgatcgaggagctggagcaggaggagggcctgaccctggcccagctggtgcagaagagactgatggccctggaggaggaggaggacgccgaggccccccccagcttcagcggcgcccagctggacagcagccccagcggcagcgtggaggacgaggacggcgacggcagactgagacccagccccggcctgcagggcgccggcggcgccgcctgcctgggcaaggtgagcagcagcggcaagagagccagagaggtgcacggcggccaggagcaggccctggacagccccagaggcatgcacagagacggcaacaccctgcccagccccagcagctgggacctgcccaccaacggcgagagccagtgctag

SEQ ID NO: 10386 - DNA, 666 bp, Artificial Sequence
  Description of Artificial Sequence: Synthetic coding sequence
atgcaggtgcaggacgacggcgtgaacctgatccccttcgccaagtgcagcagagtggtgagcagaagccccccccccagactgcccagccagagcctgagacccatgccccagagatacggcgacgtgttctggaagaacctgaaccagagacccacccccacctggctggaggagcagcacatcccccccatgctgctgcccccccccgagatgctgtggagaagaaagaagagaagaccctgcctggagggcatgcagcagcagggcctgggcggcgtgcccgccagagtgagagccgtgacctaccacctggaggacctgagaagaagacagagcatcatcaacgagctgaagaaggcccagtggggcagcagcggcgccgccagcgagcccgtggtgctgggcgaggagggctgcggcttccccagcaccaacgagtaccccgacctggaggaggagagagccacctacccccaggaggaggacagattcctgacccccggcagagcccagctgctgtggagcccctggagccccctggaccaggaggaggcctgcgccagcagacagctgcacagcctggccagcttcagcaccgtgaccgccagaagaaaccccctgcacaacccctggggcatggagctggccgccagcgaggagtag

SEQ ID NO: 10387 - DNA, 480 bp, Artificial Sequence
  Description of Artificial Sequence: Synthetic coding sequence
atgcagagagtgggcaacaccttcagcaacgagagcagagtggccagcagatgccccagcgtgggcctggccgagagaaacagagtggccaccatgcccgtgagactgctgagagacagccccgccgcccaggaggacaacgaccacgccagagacggcttccagatgaagctggacgcccacggcttcgcccccgaggagctggtggtgcaggtggacggccagtggctgatggtgaccggccagcagcagctggacgtgagagaccccgagagagtgagctacagaatgagccagaaggtgcacagaaagatgctgcccagcaacctgagccccaccgccatgacctgctgcctgacccccagcggccagctgtgggtgagaggccagtgcgtggccctggccctgcccgaggcccagaccggccccagccccagactgggcagcctgggcagcaaggccagcaacctgaccagatag

SEQ ID NO: 10388 - DNA, 1782 bp, Artificial Sequence
  Description of Artificial Sequence: Synthetic coding sequence
atggagaagctgagcgccctgcaggagcagaagggcgagctgagaaagagactgagctacaccacccacaagctggagaagctggagaccgagttcgacagcaccagacactacctggagatcgagctgagaagagcccaggaggagctggagaaggtgaccgagaagctgagaagaatccagagcaactacatggccctgcagagaatcaaccaggagctggaggacaagctgtacagaatgggccagcactacgaggaggagaagagagccctgagccacgagatcgtggccctgaacagccacctgctggaggccaaggtgaccatcgacaagctgagcgaggacaacgagctgtacagaaaggactgcaacctggccgcccagctgctgcagtgcagccagacctacggcagagtgcacaaggtgagcgagctgcccagcgacttccaggagagagtgagcctgcacatggagaagcacggctgcagcctgcccagccccctgtgccaccccgcctacgccgacagcgtgcccacctgcgtgatcgccaaggtgctggagaagcccgaccccgccagcctgagcagcagactgagcgacgccagcgccagagacctggccttctgcgacggcgtggagaagcccggccccagacccccctacaagggcgacatctactgcagcgacaccgccctgtactgccccgaggagagaagaagagacagaagacccagcgtggacgcccccgtgaccgacgtgggcttcctgagagcccagaacagcaccgacagcgccgccgaggaggaggaggaggccgaggccgccgccttccccgccggcttccagcacgaggccttccccagctacgccggcagcctgcccaccagcagcagctacagcagcttcagcgccaccagcgaggagaaggagcacgcccaggccagcaccctgaccgccagccagcaggccatctacctgaacagcagagacgagctgttcgacagaaagccccccgccaccacctacgagggcagccccagattcgccaaggccaccgccgccgtggccgcccccctggaggccgaggtggcccccggcttcggcagaaccatgagcccctaccccgccgagaccttcagattccccgccagccccggcccccagcaggccctgatgccccccaacctgtggagcctgagagccaagcccggcaccgccagactgcccggcgaggacatgagaggccagtggagacccctgagcgtggaggacatcggcgcctacagctaccccgtgagcgccgccggcagagccagcccctgcagcttcagcgagagatactacggcggcgccggcggcagccccggcaagaaggccgacggcagagccagccccctgtacgccagctacaaggccgacagcttcagcgagggcgacgacctgagccagggccacctggccgagccctgcttcctgagagccggcggcgacctgagcctgagccccggcagaagcgccgaccccctgcccggctacgcccccagcgagggcggcgacggcgacagactgggcgtgcagctgtgcggcaccgccagcagccccgagcccgagcagggcagcagagacagcctggagcccagcagcatggaggccagccccgagatgcaccccgccgccagactgagcccccagcaggccttccccagaaccggcggcagcggcctgagcagaaaggacagcctgaccaaggcccagctgtacggcaccctgctgaactag

SEQ ID NO: 10389 - DNA, 2610 bp, Artificial Sequence
  Description of Artificial Sequence: Synthetic coding sequence
atgggcaacagagagatggaggagctgatccccctggtgaacagactgcaggacgccttcagcgccctgggccagagctgcctgctggagctgccccagatcgccgtggtgggcggccagagcgccggcaagagcagcgtgctggagaacttcgtgggcagagacttcctgcccagaggcagcggcatcgtgaccagaagacccctggtgctgcagctggtgaccagcaaggccgagtacgccgagttcctgcactgcaagggcaagaagttcaccgacttcgacgaggtgagactggagatcgaggccgagaccgacagagtgaccggcatgaacaagggcatcagcagcatccccatcaacctgagagtgtacagcccccacgtgctgaacctgaccctgatcgacctgcccggcatcaccaaggtgcccgtgggcgaccagccccccgacatcgagtaccagatcagagagatgatcatgcagttcatcaccagagagaactgcctgatcctggccgtgacccccgccaacaccgacctggccaacagcgacgccctgaagctggccaaggaggtggacccccagggcctgagaaccatcggcgtgatcaccaagctggacctgatggacgagggcaccgacgccagagacgtgctggagaacaagctgctgcccctgagaagaggctacgtgggcgtggtgaacagaagccagaaggacatcgacggcaagaaggacatcaaggccgccatgctggccgagagaaagttcttcctgagccaccccgcctacagacacatcgccgacagaatgggcaccccccacctgcagaaggtgctgaaccagcagctgaccaaccacatcagagacaccctgcccaacttcagaaacaagctgcagggccagctgctgagcatcgagcacgaggtggaggcctacaagaacttcaagcccgaggaccccaccagaaagaccaaggccctgctgcagatggtgcagcagttcgccgtggacttcgagaagagaatcgagggcagcggcgaccaggtggacaccctggagctgagcggcggcgccaagatcaacagaatcttccacgagagattccccttcgagatcgtgaagatggagttcaacgagaaggagctgagaagagagatcagctacgccatcaagaacatccacggcatcagaaccggcctgttcacccccgacatggccttcgaggccatcgtgaagaagcagatcgtgaagctgaagggccccagcctgaagagcgtggacctggtgatccaggagctgatcaacaccgtgaagaagtgcaccaagaagctggccaacttccccagactgtgcgaggagaccgagagaatcgtggccaaccacatcagagagagagagggcaagaccaaggaccaggtgctgctgctgatcgacatccaggtgagctacatcaacaccaaccacgaggacttcatcggcttcgccaacgcccagcagagaagcagccaggtgcacaagaagaccaccgtgggcaaccagggcaccaacctgccccccagcagacagatcgtgatcagaaagggctggctgaccatcagcaacatcggcatcatgaagggcggcagcaagggctactggttcgtgctgaccgccgagagcctgagctggtacaaggacgacgaggagaaggagaagaagtacatgctgcccctggacaacctgaaggtgagagacgtggagaagagcttcatgagcagcaagcacatcttcgccctgttcaacaccgagcagagaaacgtgtacaaggactacagattcctggagctggcctgcgacagccaggaggacgtggacagctggaaggccagcctgctgagagccggcgtgtaccccgacaagagcgtggccgagaacgacgagaacggccaggccgagaacttcagcatggacccccagctggagagacaggtggagaccatcagaaacctggtggacagctacatgagcatcatcaacaagtgcatcagagacctgatccccaagaccatcatgcacctgatgatcaacaacgtgaaggacttcatcaacagcgagctgctggcccagctgtacagcagcgaggaccagaacaccctgatggaggagagcgccgagcaggcccagagaagagacgagatgctgagaatgtaccaggccctgaaggaggccctgggcatcatcggcgacatcagcaccgccaccgtgagcacccccgcccccccccccgtggacgacagctggatccagcacagcagaagaagccccccccccagccccaccacccagagaagacccaccctgagcgcccccctggccagacccaccagcggcagaggccccgcccccgccatccccagccccggcccccacagcggcgccccccccgtgcccttcagacccggccccctgccccccttccccagcagcagcgacagcttcggcgcccccccccaggtgcccagcagacccaccagagccccccccagcgtgcccagcagaagacccccccccagccccaccagacccaccatcatcagacccctggagagcagcctgctggactag

SEQ ID NO: 10390 - DNA, 1896 bp, Artificial Sequence
  Description of Artificial Sequence: Synthetic coding sequence
atgaacagcagcgacgaggagaagcagctgcagctgatcaccagcctgaaggagcaggccatcggcgagtacgaggacctgagagccgagaaccagaagaccaaggagaagtgcgacaagatcagacaggagagagacgaggccgtgaagaagctggaggagttccagaagatcagccacatggtgatcgaggaggtgaacttcatgcagaaccacctggagatcgagaagacctgcagagagagcgccgaggccctggccaccaagctgaacaaggagaacaagaccctgaagagaatcagcatgctgtacatggccaagctgggccccgacgtgatcaccgaggagatcaacatcgacgacgaggacagcaccaccgacaccgacggcgccgccgagacctgcgtgagcgtgcagtgccagaagcagatcaaggagctgagagaccagatcgtgagcgtgcaggaggagaagaagatcctggccatcgagctggagaacctgaagagcaagctggtggaggtgatcgaggaggtgaacaaggtgaagcaggagaagaccgtgctgaacagcgaggtgctggagcagagaaaggtgctggagaagtgcaacagagtgagcatgctggccgtggaggagtacgaggagatgcaggtgaacctggagctggagaaggacctgagaaagaaggccgagagcttcgcccaggagatgttcatcgagcagaacaagctgaagagacagagccacctgctgctgcagagcagcatccccgaccagcagctgctgaaggccctggacgagaacgccaagctgacccagcagctggaggaggagagaatccagcaccagcagaaggtgaaggagctggaggagcagctggagaacgagaccctgcacaaggagatccacaacctgaagcagcagctggagctgctggaggaggacaagaaggagctggagctgaagtaccagaacagcgaggagaaggccagaaacctgaagcacagcgtggacgagctgcagaagagagtgaaccagagcgagaacagcgtgcccccccccccccccccccccccccccctgcccccccccccccccaaccccatcagaagcctgatgagcatgatcagaaagagaagccaccccagcggcagcggcgccaagaaggagaaggccacccagcccgagaccaccgaggaggtgaccgacctgaagagacaggccgtggaggagatgatggacagaatcaagaagggcgtgcacctgagacccgtgaaccagaccgccagacccaagaccaagcccgagagcagcaagggctgcgagagcgccgtggacgagctgaagggcatcctgggcaccctgaacaagagcaccagcagcagaagcctgaagagcctggaccccgagaacagcgagaccgagctggagagaatcctgagaagaagaaaggtgaccgccgaggccgacagcagcagccccaccggcatcctggccaccagcgagagcaagagcatgcccgtgctgggcagcgtgagcagcgtgaccaagaccgccctgaacaagaagaccctggaggccgagttcaacagccccagcccccccacccccgagcccggcgagggccccagaaagctggagggctgcaccagcagcaaggtgaccttccagccccccagcagcatcggctgcagaaagaagtacatcgacggcgagaagcaggccgagcccgtggtggtgctggaccccgtgagcacccacgagccccagaccaaggaccaggtggccgagaaggaccccacccagcacaaggaggacgagggcgagatccagcccgagaacaaggaggacagcatcgagaacgtgagagagaccgacagcagcaactgctag

SEQ ID NO: 10391 - DNA, 1701 bp, Artificial Sequence
  Description of Artificial Sequence: Synthetic coding sequence
atggacctgcacagagccgccttcaagatggagaacagcagctacctgcccaaccccctggccagccccgccctgatggtgctggccagcaccgccgaggccagcagagacgccagcatcccctgccagcagcccagacccttcggcgtgcccgtgagcgtggacaaggacgtgcacatccccttcaccaacggcagctacaccttcgccagcatgtaccacagacagggcggcgtgcccggcaccttcgccaacagagacttcccccccagcctgctgcacctgcacccccagttcgccccccccaacctggactgcacccccatcagcatgctgaaccacagcggcgtgggcgccttcagacccttcgccagcaccgaggacagagagagctaccagagcgccttcacccccgccaagagactgaagaactgccacgacaccgagagcccccacctgagattcagcgacgccgacggcaaggagtacgacttcggcacccagctgcccagcagcagccccggcagcctgaaggtggacgacaccggcaagaagatcttcgccgtgagcggcctgatcagcgacagagaggccagcagcagccccgaggacagaaacgacagatgcaagaagaaggccgccgccctgttcgacagccaggcccccatctgccccatctgccaggtgctgctgagacccagcgagctgcaggagcacatggagcaggagctggagcagctggcccagctgcccagcagcaagaacagcctgctgaaggacgccatggcccccggcacccccaagagcctgctgctgagcgccagcatcaagagagagggcgagagccccaccgccagcccccacagcagcgccaccgacgacctgcaccacagcgacagataccagaccttcctgagagtgagagccaacagacagaccagactgaacgccagaatcggcaagatgaagagaagaaagcaggacgagggccagagagagggcagctgcatggccgaggacgacgccgtggacatcgagcacgagaacaacaacagattcgaggagtacgagtggtgcggccagaagagaatcagagccaccaccctgctggagggcggcttcagaggcagcggcttcatcatgtgcagcggcaaggagaaccccgacagcgacgccgacctggacgtggacggcgacgacaccctggagtacggcaagccccagtacaccgaggccgacgtgatcccctgcaccggcgaggagcccggcgaggccaaggagagagaggccctgagaggcgccgtgctgaacggcggcccccccagcaccagaatcacccccgagttcagcaagtgggccagcgacgagatgcccagcaccagcaacggcgagagcagcaagcaggaggccatgcagaagacctgcaagaacagcgacatcgagaagatcaccgaggacagcgccgtgaccaccttcgaggccctgaaggccagagtgagagagctggagagacagctgagcagaggcgacagatacaagtgcctgatctgcatggacagctacagcatgcccctgaccagcatccagtgctggcacgtgcactgcgaggagtgctggctgagaaccctgggcgccaagaagctgtgcccccagtgcaacaccatcaccgcccccggcgacctgagaagaatctacctgtag

SEQ ID NO: 10392 - DNA, 1071 bp, Artificial Sequence
  Description of Artificial Sequence: Synthetic coding sequence
atgctgagcgccatcaccaacgtggtgcagaacaccggcaagagcgtgctgaccggcggcctggacgccctggagttcatcggcaagaagaccatgaacgtgctggccgagagcgaccccggcttcaagagaaccaagaccctgatggagagaaccgtgagcctgagccagatgctgagagaggccaaggagaaggagaagcagagactggcccagcagctgaccatggagagaaccgcccactacggcatgctgttcgacgagtaccagggcctgagccacctggaggccctggagatcctgagcaacgagagcgagagcaaggtgcagagcttcctggccagcctggacggcgagaagctggagctgctgaagaacgacctgatcagcatcaaggacatcttcgccgccaaggagctggagaacgaggagaaccaggaggagcagggcctggaggagaagggcgaggagttcgccagaatgctgaccgagctgctgttcgagctgcacgtggccgccacccccgacaagctgaacaaggccatgaagagagcccacgactgggtggaggaggaccagaccgtggtgagcgtggacgtggccaaggtgagcgaggaggagaccaagaaggaggagaaggaggagaagagccaggacccccaggaggacaagaaggaggagaagaagaccaagaccatcgaggaggtgtacatgagcagcatcgagagcctggccgaggtgaccgccagatgcatcgagcagctgcacaaggtggccgagctgatcctgcacggccaggaggaggagaagcccgcccaggaccaggccaaggtgctgatcaagctgaccaccgccatgtgcaacgaggtggccagcctgagcaagaagttcaccaacagcctgaccaccgtgggcagcaacaagaaggccgaggtgctgaaccccatgatcagcagcgtgctgctggagggctgcaacagcaccacctacatccaggacgccttccagctgctgctgcccgtgctgcaggtgagccacatccagaccagctgcctgaaggcccagccctag

SEQ ID NO: 10393 - DNA, 519 bp, Artificial Sequence
  Description of Artificial Sequence: Synthetic coding sequence
atgagctacaactgctgcagcggcaacttcagcagcagaagctgcggcggctacctgcactaccccgccagcagctgcggcttcagctaccccagcaaccaggtgtacagcaccgacctgtgcagccccagcacctgccagctgggcagcagcctgtacagaggctgccagcagacctgctgggagcccaccagctgccagaccagctacgtggagagcagcccctgccagaccagctgctacagacccagaaccagcctgctgtgcagcccctgccagaccacctacagcggcagcctgggcttcggcagcagcagctgcagaagcctgggctacggcagcagaagctgctacagcgtgggctgcggcagcagcggcttcagaagcctgggctacggcggctgcggcttccccagcctgggctacggcgtgggcttctgcagacccacctacctggccagcagaagctgccagagcagctgctacagacccacctgcggcagcggcttctactactag

SEQ ID NO: 10394 - DNA, 2253 bp, Artificial Sequence; identical to SEQ ID NO: 10318
  Description of Artificial Sequence: Synthetic coding sequence

SEQ ID NO: 10395 - DNA, 888 bp, Artificial Sequence; identical to SEQ ID NO: 10194
  Description of Artificial Sequence: Synthetic coding sequence

SEQ ID NO: 10396 - DNA, 1476 bp, Artificial Sequence
  Description of Artificial Sequence: Synthetic coding sequence
atggacaccaagggctgcaccaccaccaacagccccagcaccccctgccagaactgcagcagaatcaccaacgtgagcaccatcagcagcaacaacggctgccaccccggcggcctgaccgtgaacaactgccagcccgccggccacgtgctgagaatcccctgggaccagggctgccagcccacccccagattctgcagaaagcccatctacctgatgaacaacttcaacgccagattcagcctggacgactgcagctggtacggcgagggcatcaacagcaacgagaaggagaccatgcagatcctgaacgagagactggccaactacctgcagaaggtgagaatgctggagagagagaacgccgagctggagagcaagatccaggaggagagcaacaaggagctgcccgtgctgtgccccgactacctgagctactacaccaccatcgaggagctgcagcagaagatcctgtgcaccaaggccgagaacagcagactggtgagccagatcgacaacaccaagctgaccgccgacgacctgagagccaagtacgaggccgaggtgagcctgagacagctggtggagagcgacgccaacggcctgaagcagatcctgaacgtgctgaccctgggcaaggccgacctggaggcccaggtgcagagcctgaaggaggagctgctgtgcctgaagaacaaccacaaggaggagatcaacagcctgcagtgccagctgggcgagagactggacatcgaggtgaccgccgcccccagcgccgacctgaaccaggtgctgcaggagatgagatgccagtacgagcccatcatggagaccaacagaaaggacgtggagcagtggttcaacacccagatcgaggagctgaaccagcaggtggtgaccagcagccagcagcagcagtgctgccagaaggagatcatcgagctgagaagaagcgtgaacaccctggaggtggagctgcaggcccagcacagaatgagagacagccaggagtgcatcctgaccgagaccgaggccagatacaccgccctgctgacccagatccagagcctgatcgacaacctggaggcccagctggccgagatcagatgcgccctggagagacagaaccaggagtacgagatcctgctggacgtgaagagcagactggagtgcgagatcaccacctacagaagcctgctggagagcagcgacggcaagagaccctgctaccccagagccaccaagtgcgagcccagcccctggaccagctgcaagagcggcgccatcgagagcaccgcccccgcctgcaccagcagcagcccctgcagcctgaaggagcactgcagcgcctgcggccccctgagcagaatcctggtgaagatctgcaccatcaccaaggagatcaaggacggcaaggtgatcagcagctacgagcacgtgcagccctgcttcatcatcagacccgccaaggtgtag

SEQ ID NO: 10397 - DNA, 1287 bp, Artificial Sequence
  Description of Artificial Sequence: Synthetic coding sequence
atgaagagaggcggcagagacagcgacagaaacagcagcgaggagggcaccgccgagaagagcaagaagctgagaaccaccaacgagcacagccagacctgcgactggggcaacctgctgcaggacatcatcctgcaggtgttcaagtacctgcccctgctggacagagcccacgccagccaggtgtgcagaaactggaaccaggtgttccacatgcccgacctgtggagatgcttcgagttcgagctgaaccagcccgccaccagctacctgaaggccacccaccccgagctgatcaagcagatcatcaagagacacagcaaccacctgcagtacgtgagcttcaaggtggacagcagcaaggagagcgccgaggccgcctgcgacatcctgagccagctggtgaactgcagcctgaagaccctgggcctgatcagcaccgccagacccagcttcatggacctgcccaagagccacttcatcagcgccctgaccgtggtgttcgtgaacagcaagagcctgagcagcctgaagatcgacgacacccccgtggacgaccccagcctgaaggtgctggtggccaacaacagcgacaccctgaagctgctgaagatgagcagctgcccccacgtgagccccgccggcatcctgtgcgtggccgaccagtgccacggcctgagagagctggccctgaactaccacctgctgagcgacgagctgctgctggccctgagcagcgagaagcacgtgagactggagcacctgagaatcgacgtggtgagcgagaaccccggccagacccacttccacaccatccagaagagcagctgggacgccttcatcagacacagccccaaggtgaacctggtgatgtacttcttcctgtacgaggaggagttcgaccccttcttcagatacgagatccccgccacccacctgtacttcggcagaagcgtgagcaaggacgtgctgggcagagtgggcatgacctgccccagactggtggagctggtggtgtgcgccaacggcctgagacccctggacgaggagctgatcagaatcgccgagagatgcaagaacctgagcgccatcggcctgggcgagtgcgaggtgagctgcagcgccttcgtggagttcgtgaagatgtgcggcggcagactgagccagctgagcatcatggaggaggtgctgatccccgaccagaagtacagcctggagcagatccactgggaggtgagcaagcacctgggcagagtgtggttccccgacatgatgcccacctggtag

SEQ ID NO: 10398 - DNA, 3603 bp, Artificial Sequence
  Description of Artificial Sequence: Synthetic coding sequence
atgaacaccgacagcggcggctgcgccagaaagagagccgccatgagcgtgaccctgaccagcgtgaagagagtgcagagcagccccaacctgctggccgccggcagagacagccagagccccgacagcgcctggagaagctacaacgacggcaaccaggagaccctgaacggcgacgccacctacagcagcctggccgccaagggcttcagaagcgtgagacccaacctgcaggacaagagaagccccacccagagccagatcaccgtgaacggcaacagcggcggcgccgtgagccccatgagctactaccagagacccttcagccccagcgcctacagcctgcccgccagcctgaacagcagcatcgtgatgcagcacggcaccagcctggacagcaccgacacctacccccagcacgcccagagcctggacggcaccaccagcagcagcatccccctgtacagaagcagcgaggaggagaagagagtgaccgtgatcaaggccccccactaccccggcatcggccccgtggacgagagcggcatccccaccgccatcagaaccaccgtggacagacccaaggactggtacaagaccatgttcaagcagatccacatggtgcacaagcccgacgacgacaccgacatgtacaacaccccctacacctacaacgccggcctgtacaaccccccctacagcgcccagagccaccccgccgccaagacccagacctacagacccctgagcaagagccacagcgacaacagccccaacgccttcaaggacgccagcagccccgtgccccccccccacgtgcccccccccgtgccccccctgagacccagagacagaagcagcaccgagaagcacgactgggacccccccgacagaaaggtggacaccagaaagttcagaagcgagcccagaagcatcttcgagtacgagcccggcaagagcagcatcctgcagcacgagagacccgccagcctgtaccagagcagcatcgacagaagcctggagagacccatgagcagcgccagcatggccagcgacttcagaaagagaagaaagagcgagcccgccgtgggcccccccagaggcctgggcgaccagagcgccagcagaaccagccccggcagagtggacctgcccggcagcagcaccaccctgaccaagagcttcaccagcagcagccccagcagccccagcagagccaagggcggcgacgacagcaagatctgccccagcctgtgcagctacagcggcctgaacggcaaccccagcagcgagctggactactgcagcacctacagacagcacctggacgtgcccagagacagccccagagccatcagcttcaagaacggctggcagatggccagacagaacgccgagatctggagcagcaccgaggagaccgtgagccccaagatcaagagcagaagctgcgacgacctgctgaacgacgactgcgacagcttccccgaccccaaggtgaagagcgagagcatgggcagcctgctgtgcgaggaggacagcaaggagagctgccccatggcctggggcagcccctacgtgcccgaggtgagaagcaacggcagaagcagaatcagacacagaagcgccagaaacgcccccggcttcctgaagatgtacaagaagatgcacagaatcaacagaaaggacctgatgaacagcgaggtgatctgcagcgtgaagagcagaatcctgcagtacgagagcgagcagcagcacaaggacctgctgagagcctggagccagtgcagcaccgaggaggtgcccagagacatggtgcccaccagaatcagcgagttcgagaagctgatccagaagagcaagagcatgcccaacctgggcgacgacatgctgagccccgtgaccctggagcccccccagaacggcctgtgccccaagagaagattcagcatcgagtacctgctggaggaggagaaccagagcggcccccccgccagaggcagaagaggctgccagagcaacgccctggtgcccatccacatcgaggtgaccagcgacgagcagcccagagcccacgtggagttcagcgacagcgaccaggacggcgtggtgagcgaccacagcgactacatccacctggagggcagcagcttctgcagcgagagcgacttcgaccacttcagcttcaccagcagcgagagcttctacggcagcagccaccaccaccaccaccaccaccaccaccaccacagacacctgatcagcagctgcaagggcagatgccccgccagctacaccagattcaccaccatgctgaagcacgagagagccagacacgagaacaccgaggagcccagaagacaggagatggaccccggcctgagcaagctggccttcctggtgagccccgtgcccttcagaagaaagaagaacagcgcccccaagaagcagaccgagaaggccaagtgcaaggccagcgtgttcgaggccctggacagcgccctgaaggacatctgcgaccagatcaaggccgagaagaagagaggcagcctgcccgacaacagcatcctgcacagactgatcagcgagctgctgcccgacgtgcccgagagaaacagcagcctgagagccctgagaagaagccccctgcaccagcccctgcaccccctgccccccgacggcgccatccactgccccccctaccagaacgactgcggcagaatgcccagaagcgccagcttccaggacgtggacaccgccaacagcagctgccaccaccaggacagaggcggcgccctgcaggacagagagagccccagaagctacagcagcaccctgaccgacatgggcagaagcgcccccagagagagaagaggcacccccgagaaggagaagctgcccgccaaggccgtgtacgacttcaaggcccagaccagcaaggagctgagcttcaagaagggcgacaccgtgtacatcctgagaaagatcgaccagaactggtacgagggcgagcaccacggcagagtgggcatcttccccatcagctacgtggagaagctgaccccccccgagaaggcccagcccgccagaccccccccccccgcccagcccggcgagatcggcgaggccatcgccaagtacaacttcaacgccgacaccaacgtggagctgagcctgagaaagggcgacagagtgatcctgctgaagagagtggaccagaactggtacgagggcaagatccccggcaccaacagacagggcatcttccccgtgagctacgtggaggtggtgaagaagaacaccaagggcgccgaggactaccccgacccccccatcccccacagctacagcagcgacagaatccacagcctgagcagcaacaagccccagagacccgtgttcacccacgagaacatccagggcggcggcgagcccttccaggccctgtacaactacacccccagaaacgaggacgagctggagctgagagagagcgacgtgatcgacgtgatggagaagtgcgacgacggctggttcgtgggcaccagcagaagaaccaagttcttcggcaccttccccggcaactacgtgaagagactgtag

SEQ ID NO: 10399 - DNA, 1470 bp, Artificial Sequence
  Description of Artificial Sequence: Synthetic coding sequence
atggaggacagcgccagcgccagcctgagcagcgccgccgccaccggcaccagcaccagcacccccgccgcccccaccgccagaaagcagctggacaaggagcaggtgagaaaggccgtggacgccctgctgacccactgcaagagcagaaagaacaactacggcctgctgctgaacgagaacgagagcctgttcctgatggtggtgctgtggaagatccccagcaaggagctgagagtgagactgaccctgccccacagcatcagaagcgacagcgaggacatctgcctgttcaccaaggacgagcccaacagcacccccgagaagaccgagcagttctacagaaagctgctgaacaagcacggcatcaagaccgtgagccagatcatcagcctgcagaccctgaagaaggagtacaagagctacgaggccaagctgagactgctgagcagcttcgacttcttcctgaccgacgccagaatcagaagactgctgcccagcctgatcggcagacacttctaccagagaaagaaggtgcccgtgagcgtgaacctgctgagcaagaacctgagcagagagatcaacgactgcatcggcggcaccgtgctgaacatcagcaagagcggcagctgcagcgccatcagaatcggccacgtgggcatgcagatcgagcacatcatcgagaacatcgtggccgtgaccaagggcctgagcgagaagctgcccgagtgggagagcgtgaagctgctgttcgtgaagaccgagaagagcgccgccctgcccatcttcagcagcttcgtgagcaactgggacgaggccaccaagagaagcctgctgaacaagaagaagaaggaggccagaagaaagagaagagagagaaacttcgagaagcagaaggagagaaagaagaagagacagcaggccagaaagaccgccagcgtgctgagcaaggacgacgtggcccccgagagcggcgacaccaccgtgaagaagcccgagagcaagaaggagcagacccccgagcacggcaagaagaagagaggcagaggcaaggcccaggtgaaggccaccaacgagagcgaggacgagatcccccagctggtgcccatcggcaagaagacccccgccaacgagaaggtggagatccagaagcacgccaccggcaagaagagccccgccaagagccccaaccccagcacccccagaggcaagaagagaaaggccctgcccgccagcgagacccccaaggccgccgagagcgagacccccggcaagagccccgagaagaagcccaagatcaaggaggaggccgtgaaggagaagagccccagcctgggcaagaaggacgccagacagacccccaagaagcccgaggccaagttcttcaccacccccagcaagagcgtgagaaaggccagccacacccccaagaagtggcccaagaagcccaaggtgccccagagcacctag

SEQ ID NO: 10400 - DNA, 3171 bp, Artificial Sequence
  Description of Artificial Sequence: Synthetic coding sequence
atggccggcgccctgagaagaggcagagccctgggcagcagacccagcggccccaccgtgagcagcagaagaagcccccagtgccccgtggcccaggagggcctgggcgccagaagcagacccagagtggcccccagaagcctggccagatgcggccccagcagcagactgatgggctggaagcccagcgaggccagaggccagagccagagcttccaggccagcggcctgcagcccagaagcctgaaggccgccagaagagccaccggcagacccgacagaagcagagccgccccccccaacatggaccccgacccccaggccggcgtgcaggtgggcatgagagtggtgagaggcgtggactggaagtggggccagcaggacggcggcgagggcggcgtgggcaccgtggtggagctgggcagacacggcagccccagcacccccgacagaaccgtggtggtgcagtgggaccagggcaccagaaccaactacagagccggctaccagggcgcccacgacctgctgctgtacgacaacgcccagatcggcgtgagacaccccaacatcatctgcgactgctgcaagaagcacggcctgagaggcatgagatggaagtgcagagtgtgcctggactacgacctgtgcacccagtgctacatgcacaacaagcacgagctggcccacgccttcgacagatacgagaccgcccacagcagacccgtgaccctgagccccagacagggcctgcccagaatccccctgagaggcatcttccagggcgccaaggtggtgagaggccccgactgggagtggggcagccaggacggcggcgagggcaagcccggcagagtggtggacatcagaggctgggacgtggagaccggcagaagcgtggccagcgtgacctgggccgacggcaccaccaacgtgtacagagtgggccacaagggcaaggtggacctgaagtgcgtgggcgaggccgccggcggcttctactacaaggaccacctgcccagactgggcaagcccgccgagctgcagagaagagtgagcgccgacagccagcccttccagcacggcgacaaggtgaagtgcctgctggacaccgacgtgctgagagagatgcaggagggccacggcggctggaaccccagaatggccgagttcatcggccagaccggcaccgtgcacagaatcaccgacagaggcgacgtgagagtgcagttcaaccacgagaccagatggaccttccaccccggcgccctgaccaagcaccacagcttctgggtgggcgacgtggtgagagtgatcggcgacctggacaccgtgaagagactgcaggccggccacggcgagtggaccgacgacatggcccccgccctgggcagagtgggcaaggtggtgaaggtgttcggcgacggcaacctgagagtggccgtggccggccagagatggaccttcagccccagctgcctggtggcctacagacccgaggaggacgccaacctggacgtggccgagagagccagagagaacaagagcagcctgagcgtggccctggacaagctgagagcccagaagagcgaccccgagcaccccggcagactggtggtggaggtggccctgggcaacgccgccagagccctggacctgctgagaagaagacccgagcaggtggacaccaagaaccagggcagaaccgccctgcaggtggccgcctacctgggccaggtggagctgatcagactgctgctgcaggccagagccggcgtggacctgcccgacgacgagggcaacaccgccctgcactacgccgccctgggcaaccagcccgaggccaccagagtgctgctgagcgccggctgcagagccgacgccatcaacagcacccagagcaccgccctgcacgtggccgtgcagagaggcttcctggaggtggtgagagccctgtgcgagagaggctgcgacgtgaacctgcccgacgcccacagcgacacccccctgcacagcgccatcagcgccggcaccggcgccagcggcatcgtggaggtgctgaccgaggtgcccaacatcgacgtgaccgccaccaacagccagggcttcaccctgctgcaccacgccagcctgaagggccacgccctggccgtgagaaagatcctggccagagccagacagctggtggacgccaagaaggaggacggcttcaccgccctgcacctggccgccctgaacaaccacagagaggtggcccagatcctgatcagagagggcagatgcgacgtgaacgtgagaaacagaaagctgcagagccccctgcacctggccgtgcagcaggcccacgtgggcctggtgcccctgctggtggacgccggctgcagcgtgaacgccgaggacgaggagggcgacaccgccctgcacgtggccctgcagagacaccagctgctgcccctggtggccgacggcgccggcggcgaccccggccccctgcagctgctgagcagactgcaggccagcggcctgcccggcagcgccgagctgaccgtgggcgccgccgtggcctgcttcctggccctggagggcgccgacgtgagctacaccaaccacagaggcagaagccccctggacctggccgccgagggcagagtgctgaaggccctgcagggctgcgcccagagattcagagagagacaggccggcggcggcgccgcccccggccccagacagaccctgggcacccccaacaccgtgaccaacctgcacgtgggcgccgcccccggccccgaggccgccgagtgcctggtgtgcagcgagctggccctgctggtgctgttcagcccctgccagcacagaaccgtgtgcgaggagtgcgccagaagaatgaagaagtgcatcagatgccaggtggtggtgagcaagaagctgagacccgacggcagcgaggtggccagcgccgcccccgcccccggcccccccagacagctggtggaggagctgcagagcagatacagacagatggaggagagaatcacctgccccatctgcatcgacagccacatcagactggtgttccagtgcggccacggcgcctgcgccccctgcggcagcgccctgagcgcctgccccatctgcagacagcccatcagagacagaatccagatcttcgtgtag

SEQ ID NO: 10401 - DNA, 858 bp, Artificial Sequence
  Description of Artificial Sequence: Synthetic coding sequence
atgagcgaggccggcgaggagcagcccatggagaccaccggcgccaccgagaacggccacgaggccgtgcccgagggcgagagccccgccggcgccggcaccggcgccgccgccggcgccggcggcgccaccgccgccccccccagcggcaaccagaacggcgccgagggcgaccagatcaacgccagcaagaacgaggaggacgccggcaagatgttcgtgggcggcctgagctgggacaccagcaagaaggacctgaaggactacttcaccaagttcggcgaggtggtggactgcaccatcaagatggaccccaacaccggcagaagcagaggcttcggcttcatcctgttcaaggacgccgccagcgtggagaaggtgctggaccagaaggagcacagactggacggcagagtgatcgaccccaagaaggccatggccatgaagaaggaccccgtgaagaagatcttcgtgggcggcctgaaccccgaggccaccgaggagaagatcagagagtacttcggcgagttcggcgagatcgaggccatcgagctgcccatggaccccaagctgaacaagagaagaggcttcgtgttcatcaccttcaaggaggaggagcccgtgaagaaggtgctggagaagaagttccacaccgtgagcggcagcaagtgcgagatcaaggtggcccagcccaaggaggtgtaccagcagcagcagtacggcagcggcggcagaggcaacagaaacagaggcaacagaggcagcggcggcggcggcggcggcggcggccagggcagcaccaactacggcaagagccagagaagaggcggccaccagaacaactacaagccctactag

SEQ ID NO: 10402 - DNA, 1212 bp, Artificial Sequence; identical to SEQ ID NO: 9962
  Description of Artificial Sequence: Synthetic coding sequence

SEQ ID NO: 10403 - DNA, 1347 bp, Artificial Sequence
  Description of Artificial Sequence: Synthetic coding sequence
atggccaccgacagctgggccctggccgtggacgagcaggaggccgccgccgagagcctgagcaacctgcacctgaaggaggagaagatcaagcccgacaccaacggcgccgtggtgaagaccaacgccaacgccgagaagaccgacgaggaggagaaggaggacagagccgcccagagcctgctgaacaagctgatcagaagcaacctggtggacaacaccaaccaggtggaggtgctgcagagagaccccaacagccccctgtacagcgtgaagagcttcgaggagctgagactgccccagaacctgatcgcccagagccagagcggcaccggcaagaccgccgccttcgtgctggccatgctgagccaggtggagcccgccaacaagtacccccagtgcctgtgcctgagccccacctacgagctggccctgcagaccggcaaggtgatcgagcagatgggcaagttctaccccgagctgaagctggcctacgccgtgagaggcaacaagctggagagaggccagaagatcagcgagcagatcgtgatcggcacccccggcaccgtgctggactggtgcagcaagctgaagttcatcgaccccaagaagatcaaggtgttcgtgctggacgaggccgacgtgatgatcgccacccagggccaccaggaccagagcatcagaatccagagaatgctgcccagaaactgccagatgctgctgttcagcgccaccttcgaggacagcgtgtggaagttcgcccagaaggtggtgcccgaccccaacgtgatcaagctgaagagagaggaggagaccctggacaccatcaagcagtactacgtgctgtgcagcagcagagacgagaagttccaggccctgtgcaacctgtacggcgccatcaccatcgcccaggccatgatcttctgccacaccagaaagaccgccagctggctggccgccgagctgagcaaggagggccaccaggtggccctgctgagcggcgagatgatggtggagcagagagccgccgtgatcgagagattcagagagggcaaggagaaggtgctggtgaccaccaacgtgtgcgccagaggcatcgacgtggagcaggtgagcgtggtgatcaacttcgacctgcccgtggacaaggacggcaaccccgacaacgagacctacctgcacagaatcggcagaaccggcagattcggcaagagaggcctggccgtgaacatggtggacagcaagcacagcatgaacatcctgaacagaatccaggagcacttcaacaagaagatcgagagactggacaccgacgacctggacgagatcgagaagatcgccaactag

SEQ ID NO: 10404 - DNA, 1248 bp, Artificial Sequence; identical to SEQ ID NO: 10184
  Description of Artificial Sequence: Synthetic coding sequence

SEQ ID NO: 10405 - DNA, 1026 bp, Artificial Sequence
  Description of Artificial Sequence: Synthetic coding sequence
atggcccaggagagccccaagaacagcgccgccgagatccccgtgaccagcaacggcgaggtggacgacagcagagagcacagcttcaacagagacctgaagcacagcctgcccagcggcctgggcctgagcgagacccagatcaccagccacggcttcgacaacaccaaggagggcgtgatcgaggccggcgccttccagggcggccagagaacccagaccaagagcggccccgtgatcctggccgacgagatcaagaaccccgccatggagaagctggagctggtgagaaagtggagcctgaacacctacaagtgcaccagacagatcatcagcgagaagctgggcagaggcagcagaaccgtggacctggagctggaggcccagatcgacatcctgagagacaacaagaagaagtacgagaacatcctgaagctggcccagaccctgagcacccagctgttccagatggtgcacacccagagacagctgggcgacgccttcgccgacctgagcctgaagagcctggagctgcacgaggagttcggctacaacgccgacacccagaagctgctggccaagaacggcgagaccctgctgggcgccatcaacttcttcatcgccagcgtgaacaccctggtgaacaagaccatcgaggacaccctgatgaccgtgaagcagtacgagagcgccagaatcgagtacgacgcctacagaaccgacctggaggagctgaacctgggccccagagacgccaacaccctgcccaagatcgagcagagccagcacctgttccaggcccacaaggagaagtacgacaagatgagaaacgacgtgagcgtgaagctgaagttcctggaggagaacaaggtgaaggtgctgcacaaccagctggtgctgttccacaacgccatcgccgcctacttcgccggcaaccagaagcagctggagcagaccctgaagcagttccacatcaagctgaagacccccggcgtggacgcccccagctggctggaggagcagtag

SEQ ID NO: 10406 - DNA, 1572 bp, Artificial Sequence
  Description of Artificial Sequence: Synthetic coding sequence
atggccaacgtgggcctgcagttccaggccagcgccggcgacagcgacccccagagcagacccctgctgctgctgggccagctgcaccacctgcacagagtgccctggagccacgtgagaggcaagctgcagcccagagtgaccgaggagctgtggcaggccgccctgagcaccctgaaccccaaccccaccgacagctgccccctgtacctgaactacgccaccgtggccgccctgccctgcagagtgagcagacacaacagccccagcgccgcccacttcatcaccagactggtgagaacctgcctgccccccggcgcccacagatgcatcgtgatggtgtgcgagcagcccgaggtgttcgccagcgcctgcgccctggccagagccttccccctgttcacccacagaagcggcgccagcagaagactggagaagaagaccgtgaccgtggagttcttcctggtgggccaggacaacggccccgtggaggtgagcaccctgcagtgcctggccaacgccaccgacggcgtgagactggccgccagaatcgtggacaccccctgcaacgagatgaacaccgacaccttcctggaggagatcaacaaggtgggcaaggagctgggcatcatccccaccatcatcagagacgaggagctgaagaccagaggcttcggcggcatctacggcgtgggcaaggccgccctgcacccccccgccctggccgtgctgagccacacccccgacggcgccacccagaccatcgcctgggtgggcaagggcatcgtgtacgacaccggcggcctgagcatcaagggcaagaccaccatgcccggcatgaagagagactgcggcggcgccgccgccgtgctgggcgccttcagagccgccatcaagcagggcttcaaggacaacctgcacgccgtgttctgcctggccgagaacagcgtgggccccaacgccaccagacccgacgacatccacctgctgtacagcggcaagaccgtggagatcaacaacaccgacgccgagggcagactggtgctggccgacggcgtgagctacgcctgcaaggacctgggcgccgacatcatcctggacatggccaccctgaccggcgcccagggcatcgccaccggcaagtaccacgccgccgtgctgaccaacagcgccgagtgggaggccgcctgcgtgaaggccggcagaaagtgcggcgacctggtgcaccccctggtgtactgccccgagctgcacttcagcgagttcaccagcgccgtggccgacatgaagaacagcgtggccgacagagacaacagccccagcagctgcgccggcctgttcatcgccagccacatcggcttcgactggcccggcgtgtgggtgcacctggacatcgccgcccccgtgcacgccggcgagagagccaccggcttcggcgtggccctgctgctggccctgttcggcagagccagcgaggaccccctgctgaacctggtgagccccctgggctgcgaggtggacgtggaggagggcgacctgggcagagacagcaagagaagaagactggtgtag

SEQ ID NO: 10407 - DNA, 1371 bp, Artificial Sequence
  Description of Artificial Sequence: Synthetic coding sequence
atggccgacggcggcagcgagagagccgacggcagaatcgtgaagatggaggtggactacagcgccaccgtggaccagagactgcccgagtgcgccaagctggccaaggagggcagactgcaggaggtgatcgagaccctgctgagcctggagaagcagaccagaaccgccagcgacatggtgagcaccagcagaatcctggtggccgtggtgaagatgtgctacgaggccaaggagtgggacctgctgaacgagaacatcatgctgctgagcaagagaagaagccagctgaagcaggccgtggccaagatggtgcagcagtgctgcacctacgtggaggagatcaccgacctgcccatcaagctgagactgatcgacaccctgagaatggtgaccgagggcaagatctacgtggagatcgagagagccagactgaccaagaccctggccaccatcaaggagcagaacggcgacgtgaaggaggccgccagcatcctgcaggagctgcaggtggagacctacggcagcatggagaagaaggagagagtggagttcatcctggagcagatgagactgtgcctggccgtgaaggactacatcagaacccagatcatcagcaagaagatcaacaccaagttcttccaggaggagaacaccgagaagctgaagctgaagtactacaacctgatgatccagctggaccagcacgagggcagctacctgagcatctgcaagcactacagagccatctacgacaccccctgcatccaggccgagagcgagaagtggcagcaggccctgaagagcgtggtgctgtacgtgatcctggcccccttcgacaacgagcagagcgacctggtgcacagaatcagcggcgacaagaagctggaggagatccccaagtacaaggacctgctgaagctgttcaccaccatggagctgatgagatggagcaccctggtggaggactacggcatggagctgagaaagggcagcctggagagccccgccaccgacgtgttcggcagcaccgaggagggcgagaagagatggaaggacctgaagaacagagtggtggagcacaacatcagaatcatggccaagtactacaccagaatcaccatgaagagaatggcccagctgctggacctgagcgtggacgagagcgaggccttcctgagcaacctggtggtgaacaagaccatcttcgccaaggtggacagactggccggcatcatcaacttccagagacccaaggaccccaacaacctgctgaacgactggagccagaagctgaacagcctgatgagcctggtgaacaagaccacccacctgatcgccaaggaggagatgatccacaacctgcagtag

SEQ ID NO: 10408 - DNA, 1011 bp, Artificial Sequence
  Description of Artificial Sequence: Synthetic coding sequence
atgaagatcgacatccacagccacatcctgcccaaggagtggcccgacctgaagaagagattcggctacggcggctgggtgcagctgcagcaccacagcaagggcgaggccaagctgctgaaggacggcaaggtgttcagagtggtgagagagaactgctgggaccccgaggtgagaatcagagagatggaccagaagggcgtgaccgtgcaggccctgagcaccgtgcccgtgatgttcagctactgggccaagcccgaggacaccctgaacctgtgccagctgctgaacaacgacctggccagcaccgtggtgagctaccccagaagattcgtgggcctgggcaccctgcccatgcaggcccccgagctggccgtgaaggagatggagagatgcgtgaaggagctgggcttccccggcgtgcagatcggcacccacgtgaacgagtgggacctgaacgcccaggagctgttccccgtgtacgccgccgccgagagactgaagtgcagcctgttcgtgcacccctgggacatgcagatggacggcagaatggccaagtactggctgccctggctggtgggcatgcccgccgagaccaccatcgccatctgcagcatgatcatgggcggcgtgttcgagaagttccccaagctgaaggtgtgcttcgcccacggcggcggcgccttccccttcaccgtgggcagaatcagccacggcttcagcatgagacccgacctgtgcgcccaggacaaccccatgaaccccaagaagtacctgggcagcttctacaccgacgccctggtgcacgaccccctgagcctgaagctgctgaccgacgtgatcggcaaggacaaggtgatcctgggcaccgactaccccttccccctgggcgagctggagcccggcaagctgatcgagagcatggaggagttcgacgaggagaccaagaacaagctgaaggccggcaacgccctggccttcctgggcctggagagaaagcagttcgagtag

SEQ ID NO: 10409 - DNA, 1617 bp, Artificial Sequence
  Description of Artificial Sequence: Synthetic coding sequence
atggagctgagctaccagaccctgaagttcacccaccaggccagagaggcctgcgagatgagaaccgaggccagaagaaagaacctgctgatcctgatcagccactacctgacccaggagggctacatcgacaccgccaacgccctggagcaggagaccaagctgggcctgagaagattcgaggtgtgcgacaacatcgacctggagaccatcctgatggagtacgagagctactacttcgtgaagttccagaagtaccccaagatcgtgaagaagagcagcgacaccgccgagaacaacctgccccagagaagcagaggcaagaccagaagaatgatgaacgacagctgccagaacctgcccaagatcaaccagcagagacccagaagcaagaccaccgccggcaagaccggcgacaccaagagcctgaacaaggagcaccccaaccaggaggtggtggacaacaccagactggagagcgccaacttcggcctgcacatcagcagaatcagaaaggacagcggcgaggagaacgcccaccccagaagaggccagatcatcgacttccagggcctgctgaccgacgccatcaagggcgccaccagcgagctggccctgaacaccttcgaccacaaccccgaccccagcgagagactgctgaagcccctgagcgccttcatcggcatgaacagcgagatgagagagctggccgccgtggtgagcagagacatctacctgcacaaccccaacatcaagtggaacgacatcatcggcctggacgccgccaagcagctggtgaaggaggccgtggtgtaccccatcagatacccccagctgttcaccggcatcctgagcccctggaagggcctgctgctgtacggcccccccggcaccggcaagaccctgctggccaaggccgtggccaccgagtgcaagaccaccttcttcaacatcagcgccagcaccatcgtgagcaagtggagaggcgacagcgagaagctggtgagagtgctgttcgagctggccagataccacgcccccagcaccatcttcctggacgagctggagagcgtgatgagccagagaggcaccgccagcggcggcgagcacgagggcagcctgagaatgaagaccgagctgctggtgcagatggacggcctggccagaagcgaggacctggtgttcgtgctggccgccagcaacctgccctgggagctggactgcgccatgctgagaagactggagaagagaatcctggtggacctgcccagcagagaggccagacaggccatgatctaccactggctgccccccgtgagcaagagcagagccctggagctgcacaccgagctggagtacagcgtgctgagccaggagaccgagggctacagcggcagcgacatcaagctggtgtgcagagaggccgccatgagacccgtgagaaagatcttcgacgccctggagaaccaccagagcgagagcagcgacctgcccagaatccagctggacatcgtgaccaccgccgacttcctggacgtgctgacccacaccaagcccagcgccaagaacctggcccagagatacagcgactggcagagagagttcgagagcgtgtag

SEQ ID NO: 10410 - DNA, 507 bp, Artificial Sequence; identical to SEQ ID NO: 9834
  Description of Artificial Sequence: Synthetic coding sequence

SEQ ID NO: 10411 - DNA, 1764 bp, Artificial Sequence
  Description of Artificial Sequence: Synthetic coding sequence
atggccagcgaggacatcgccaagctggccgagaccctggccaagacccaggtggccggcggccagctgagcttcaagggcaagagcctgaagctgaacaccgccgaggacgccaaggacgtgatcaaggagatcgaggacttcgacagcctggaggccctgagactggagggcaacaccgtgggcgtggaggccgccagagtgatcgccaaggccctggagaagaagagcgagctgaagagatgccactggagcgacatgttcaccggcagactgagaaccgagatcccccccgccctgatcagcctgggcgagggcctgatcaccgccggcgcccagctggtggagctggacctgagcgacaacgccttcggccccgacggcgtgcagggcttcgaggccctgctgaagagcagcgcctgcttcaccctgcaggagctgaagctgaacaactgcggcatgggcatcggcggcggcaagatcctggccgccgccctgaccgagtgccacagaaagagcagcgcccagggcaagcccctggccctgaaggtgttcgtggccggcagaaacagactggagaacgacggcgccaccgccctggccgaggccttcagagtgatcggcaccctggaggaggtgcacatgccccagaacggcatcaaccaccccggcatcaccgccctggcccaggccttcgccgtgaaccccctgctgagagtgatcaacctgaacgacaacaccttcaccgagaagggcgccgtggccatggccgagaccctgaagaccctgagacaggtggaggtgatcaacttcggcgactgcctggtgagaagcaagggcgccgtggccatcgccgacgccatcagaggcggcctgcccaagctgaaggagctgaacctgagcttctgcgagatcaagagagacgccgccctggccgtggccgaggccatggccgacaaggccgagctggagaagctggacctgaacggcaacaccctgggcgaggagggctgcgagcagctgcaggaggtgctggagggcttcaacatggccaaggtgctggccagcctgagcgacgacgaggacgaggaggaggaggaggagggcgaggaggaggaggaggaggccgaggaggaggaggaggaggacgaggaggaggaggaggaggaggaggaggaggaggaggaggagccccagcagagaggccagggcgagaagagcgccacccccagcagaaagatcctggaccccaacaccggcgagcccgcccccgtgctgagcagccccccccccgccgacgtgagcaccttcctggccttccccagccccgagaagctgctgagactgggccccaagagcagcgtgctgatcgcccagcagaccgacaccagcgaccccgagaaggtggtgagcgccttcctgaaggtgagcagcgtgttcaaggacgaggccaccgtgagaatggccgtgcaggacgccgtggacgccctgatgcagaaggccttcaacagcagcagcttcaacagcaacaccttcctgaccagactgctggtgcacatgggcctgctgaagagcgaggacaaggtgaaggccatcgccaacctgtacggccccctgatggccctgaaccacatggtgcagcaggactacttccccaaggccctggcccccctgctgctggccttcgtgaccaagcccaacagcgccctggagagctgcagcttcgccagacacagcctgctgcagaccctgtacaaggtgtag

SEQ ID NO: 10412 - DNA, 2529 bp, Artificial Sequence
  Description of Artificial Sequence: Synthetic coding sequence
atggacatcagcaagggcctgcccggcatgcagggcggcctgcacatctggatcagcgagaacagaaagatggtgcccgtgcccgagggcgcctacggcaacttcttcgaggagcactgctacgtgatcctgcacgtgccccagagccccaaggccacccagggcgccagcagcgacctgcactactgggtgggcaagcaggccggcgccgaggcccagggcgccgccgaggccttccagcagagactgcaggacgagctgggcggccagaccgtgctgcacagagaggcccagggccacgagagcgactgcttctgcagctacttcagacccggcatcatctacagaaagggcggcctggccagcgacctgaagcacgtggagaccaacctgttcaacatccagagactgctgcacatcaagggcagaaagcacgtgagcgccaccgaggtggagctgagctggaacagcttcaacaagggcgacatcttcctgctggacctgggcaagatgatgatccagtggaacggccccaagaccagcatcagcgagaaggccagaggcctggccctgacctacagcctgagagacagagagagaggcggcggcagagcccagatcggcgtggtggacgacgaggccaaggcccccgacctgatgcagatcatggaggccgtgctgggcagaagagtgggcagcctgagagccgccacccccagcaaggacatcaaccagctgcagaaggccaacgtgagactgtaccacgtgtacgagaagggcaaggacctgctgcaggaggaggacttctacatcctggaccagggcggcttcaagatctacgtgtggcagggcagaatgagcagcctgcaggagagaaaggccgccttcagcagagccgtgggcttcatccaggccaagggctaccccacctacaccaacgtggaggtggtgaacgacggcgccgagagcgccgccttcaagcagctgttcagaacctggagcgagaagagaagaagaaaccagaagctgggcggcagagacaagagcatccacgtgaagctggacgtgggcaagctgcacacccagcccaagctggccgcccagctgagaatggtggacgacggcagcggcaaggtggaggtgtggtgcatccaggacctgcacagacagcccgtggaccccaagagacacggccagctgtgcgccggcaactgctacctggtgctgtacacctaccagagactgggcagagtgcagtacatcctgtacctgtggcagggccaccaggccaccgccgacgagatcgaggccctgaacagcaacgccgaggagctggacgtgatgtacggcggcgtgctggtgcaggagcacgtgaccatgggcagcgagcccccccacttcctggccatcttccagggccagctggtgatcttccaggagagagccggccaccacggcaagggccagagcgccagcaccaccagactgttccaggtgcagggcaccgacagccacaacaccagaaccatggaggtgcccgccagagccagcagcctgaacagcagcgacatcttcctgctggtgaccgccagcgtgtgctacctgtggttcggcaagggctgcaacggcgaccagagagagatggccagagtggtggtgaccgtgatcagcagaaagaacgaggagaccgtgctggagggccaggagcccccccacttctgggaggccctgggcggcagagccccctaccccagcaacaagagactgcccgaggaggtgcccagcttccagcccagactgttcgagtgcagcagccacatgggctgcctggtgctggccgaggtgggcttcttcagccaggaggacctggacaagtacgacatcatgctgctggacacctggcaggagatcttcctgtggctgggcgaggccgccagcgagtggaaggaggccgtggcctggggccaggagtacctgaagacccaccccgccggcagaagccccgccacccccatcgtgctggtgaagcagggccacgagccccccaccttcatcggctggttcttcacctgggacccctacaagtggaccagccaccccagccacaaggaggtggtggacggcagccccgccgccgccagcaccatcagcgagatcaccgccgaggtgaacaacctgagactgagcagatggcccggcaacggcagagccggcgccgtggccctgcaggccctgaagggcagccaggacagcagcgagaacgacctggtgagaagccccaagagcgccggcagcagaaccagcagcagcgtgagcagcaccagcgccaccatcaacggcggcctgagaagagagcagctgatgcaccaggccgtggaggacctgcccgagggcgtggaccccgccagaagagagttctacctgagcgacagcgacttccaggacatcttcggcaagagcaaggaggagttctacagcatggccacctggagacagagacaggagaagaagcagctgggcttcttctag

SEQ ID NO: 10413 - DNA, 1620 bp, Artificial Sequence
  Description of Artificial Sequence: Synthetic coding sequence
atggacgccatggccagccccggcaaggacaactacagaatgaagagctacaagaacaaggccctgaacccccaggagatgagaagaagaagagaggaggagggcatccagctgagaaagcagaagagagaggagcagctgttcaagagaagaaacgtgtacctgcccagaaacgacgagagcatgctggagagccccatccaggaccccgacatcagcagcaccgtgcccatccccgaggaggaggtggtgaccaccgacatggtgcagatgatcttcagcaacaacgccgaccagcagctgaccgccacccagaagttcagaaagctgctgagcaaggagcccaacccccccatcgaccaggtgatccagaagcccggcgtggtgcagagattcgtgaagttcctggagagaaacgagaactgcaccctgcagttcgaggccgcctgggccctgaccaacatcgccagcggcaccttcctgcacaccaaggtggtgatcgagaccggcgccgtgcccatcttcatcaagctgctgaacagcgagcacgaggacgtgcaggagcaggccgtgtgggccctgggcaacatcgccggcgacaacgccgagtgcagagacttcgtgctgaactgcgagatcctgccccccctgctggagctgctgaccaacagcaacagactgaccaccaccagaaacgccgtgtgggccctgagcaacctgtgcagaggcaagaaccccccccccaacttcagcaaggtgagcccctgcctgaacgtgctgagcagactgctgttcagcagcgaccccgacgtgctggccgacgtgtgctgggccctgagctacctgagcgacggccccaacgacaagatccaggccgtgatcgacagcggcgtgtgcagaagactggtggagctgctgatgcacaacgactacaaggtggtgagccccgccctgagagccgtgggcaacatcgtgaccggcgacgacatccagacccaggtgatcctgaactgcagcgccctgccctgcctgctgcacctgctgagcagccccaaggagagcatcagaaaggaggcctgctggaccgtgagcaacatcaccgccggcaacagagcccagatccaggccgtgatcgacgccaacatcttccccgtgctgatcgagatcctgcagaaggccgagttcagaaccagaaaggaggccgcctgggccatcaccaacgccaccagcggcggcacccccgagcagatcagatacctggtggccctgggctgcatcaagcccctgtgcgacctgctgaccgtgatggacagcaagatcgtgcaggtggccctgaacggcctggagaacatcctgagactgggcgagcaggagagcaagcagaacggcatcggcatcaacccctactgcgccctgatcgaggaggcctacggcctggacaagatcgagttcctgcagagccacgagaaccaggagatctaccagaaggccttcgacctgatcgagcactacttcggcgtggaggaggacgaccccagcatcgtgccccaggtggacgagaaccagcagcagttcatcttccagcagcaggaggcccccatggacggcttccagctgtag

SEQ ID NO: 10414 - DNA, 3735 bp, Artificial Sequence
  Description of Artificial Sequence: Synthetic coding sequence
atgctgatcaaggagtaccacatcctgctgcccatgagcctggacgagtaccaggtggcccagctgtacatgatccagaagaagagcagagaggagagcagcggcgagggcagcggcgtggagatcctggccaacagaccctacaccgacggccccggcggcagcggccagtacacccacaaggtgtaccacgtgggcagccacatccccggctggttcagagccctgctgcccaaggccgccctgcaggtggaggaggagagctggaacgcctacccctacaccagaaccagatacacctgccccttcgtggagaagttcagcatcgagatcgagacctactacctgcccgacggcggccagcagcccaacgtgttcaacctgagcggcgccgagagaagacagagaatcctggacaccatcgacatcgtgagagacgccgtggcccccggcgagtacaaggccgaggaggaccccagactgtaccacagcgtgaagaccggcagaggccccctgagcgacgactgggccagaaccgccgcccagaccggccccctgatgtgcgcctacaagctgtgcaaggtggagttcagatactggggcatgcaggccaagatcgagcagttcatccacgacgtgggcctgagaagagtgatgctgagagcccacagacaggcctggtgctggcaggacgagtggaccgagctgagcatggccgacatcagagccctggaggaggagaccgccagaatgctggcccagagaatggccaagtgcaacaccggcagcgagggcagcgaggcccagccccccggcaagcccagcaccgaggccagaagcgccgccagcaacaccggcacccccgacggccccgaggccccccccggccccgacgccagccccgacgccagcttcggcaagcagtggagcagcagcagcagaagcagctacagcagccagcacggcggcgccgtgagcccccagagcctgagcgagtggagaatgcagaacatcgccagagacagcgagaacagcagcgaggaggagttcttcgacgcccacgagggcttcagcgacagcgaggaggtgttccccaaggagatgaccaagtggaacagcaacgacttcatcgacgccttcgccagccccgtggaggccgagggcacccccgagcccggcgccgaggccgccaagggcatcgaggacggcgcccaggcccccagagacagcgagggcctggacggcgccggcgagctgggcgccgaggcctgcgccgtgcacgccctgttcctgatcctgcacagcggcaacatcctggacagcggccccggcgacgccaacagcaagcaggccgacgtgcagaccctgagcagcgccttcgaggccgtgaccagaatccacttccccgaggccctgggccacgtggccctgagactggtgccctgcccccccatctgcgccgccgcctacgccctggtgagcaacctgagcccctacagccacgacggcgacagcctgagcagaagccaggaccacatccccctggccgccctgcccctgctggccaccagcagcagcagataccagggcgccgtggccaccgtgatcgccagaaccaaccaggcctacagcgccttcctgagaagccccgagggcgccggcttctgcggccaggtggccctgatcggcgacggcgtgggcggcatcctgggcttcgacgccctgtgccacagcgccaacgccggcaccggcagcagaggcagcagcagaagaggcagcatgaacaacgagctgctgagccccgagttcggccccgtgagagaccccctggccgacggcgtggagggcctgggcagaggcagccccgagcccagcgccctgcccccccagagaatccccagcgacatggccagccccgagcccgagggcagccagaacagcctgcaggccgcccccgccaccaccagcagctgggagcccagaagagccagcaccgccttctgcccccccgccgccagcagcgaggcccccgacggccccagcagcaccgccagactggacttcaaggtgagcggcttcttcctgttcggcagccccctgggcctggtgctggccctgagaaagaccgtgatgcccgccctggaggccgcccagatgagacccgcctgcgagcagatctacaacctgttccacgccgccgacccctgcgccagcagactggagcccctgctggcccccaagttccaggccatcgcccccctgaccgtgcccagataccagaagttccccctgggcgacggcagcagcctgctgctggccgacaccctgcagacccacagcagcctgttcctggaggagctggagatgctggtgcccagcacccccaccagcaccagcggcgccttctggaagggcagcgagctggccaccgacccccccgcccagcccgccgcccccagcaccaccagcgaggtggtgaagatcctggagagatggtggggcaccaagagaatcgactacagcctgtactgccccgaggccctgaccgccttccccaccgtgaccctgccccacctgttccacgccagctactgggagagcgccgacgtggtggccttcatcctgagacaggtgatcgagaaggagagaccccagctggccgagtgcgaggagcccagcatctacagccccgccttccccagagagaagtggcagagaaagagaacccaggtgaagatcagaaacgtgaccagcaaccacagagccagcgacaccgtggtgtgcgagggcagaccccaggtgctgagcggcagattcatgtacggccccctggacgtggtgaccctgaccggcgagaaggtggacgtgtacatcatgacccagcccctgagcggcaagtggatccacttcggcaccgaggtgaccaacagcagcggcagactgaccttccccgtgccccccgagagagccctgggcatcggcgtgtaccccgtgagaatggtggtgagaggcgaccacacctacgccgagtgctgcctgaccgtggtggccagaggcaccgaggccgtggtgttcagcatcgacggcagcttcaccgccagcgtgagcatcatgggcagcgaccccaaggtgagagccggcgccgtggacgtggtgagacactggcaggacagcggctacctgatcgtgtacgtgaccggcagacccgacatgcagaagcacagagtggtggcctggctgagccagcacaacttcccccacggcgtggtgagcttctgcgacggcctgacccacgaccccctgagacagaaggccatgttcctgcagagcctggtgcaggaggtggagctgaacatcgtggccggctacggcagccccaaggacgtggccgtgtacgccgccctgggcctgagccccagccagacctacatcgtgggcagagccgtgagaaagctgcaggcccagtgccagttcctgagcgacggctacgtggcccacctgggccagctggaggccggcagccacagccacgccagcagcggcccccccagagccgccctgggcaagagcagctacggcgtggccgcccccgtggacttcctgagaaagcagagccagctgctgagaagcagaggccccagccaggccgagagagagggccccggcaccccccccaccaccctggccagaggcaaggccagaagcatcagcctgaagctggacagcgaggagtag

SEQ ID NO: 10415 - DNA, 882 bp, Artificial Sequence
  Description of Artificial Sequence: Synthetic coding sequence
atgaccgaggacagccagagaaacttcagaagcgtgtactacgagaaggtgggcttcagaggcgtggaggagaagaagagcctggagatcctgctgaaggacgacagactggacaccgagaagctgtgcaccttcagccagagattccccctgcccagcatgtacagagccctggtgtggaaggtgctgctgggcatcctgcccccccaccacgagagccacgccaaggtgatgatgtacagaaaggagcagtacctggacgtgctgcacgccctgaaggtggtgagattcgtgagcgacgccaccccccaggccgaggtgtacctgagaatgtaccagctggagagcggcaagctgcccagaagccccagcttccccctggagcccgacgacgaggtgttcctggccatcgccaaggccatggaggagatggtggaggacagcgtggactgctactggatcaccagaagattcgtgaaccagctgaacaccaagtacagagacagcctgccccagctgcccaaggccttcgagcagtacctgaacctggaggacggcagactgctgacccacctgagaatgtgcagcgccgcccccaagctgccctacgacctgtggttcaagagatgcttcgccggctgcctgcccgagagcagcctgcagagagtgtgggacaaggtggtgagcggcagctgcaagatcctggtgttcgtggccgtggagatcctgctgaccttcaagatcaaggtgatggccctgaacagcgccgagaagatcaccaagttcctggagaacatcccccaggacagcagcgacgccatcgtgagcaaggccatcgacctgtggcacaagcactgcggcacccccgtgcacagcagctag

SEQ ID NO: 10416 - DNA, 249 bp, Artificial Sequence
  Description of Artificial Sequence: Synthetic coding sequence
atgagcgagggcgagagccagaccgtgctgagcagcggcagcgaccccaaggtggagagcagcagcagcgcccccggcctgaccagcgtgagcccccccgtgaccagcaccaccagcgccgccagccccgaggaggaggaggagagcgaggacgagagcgagatcctggaggagagcccctgcggcagatggcagaagagaagagaggaggtgaaccagagaaacgtgcccggcatcgacagcgcctag

SEQ ID NO: 10417 - DNA, 5058 bp, Artificial Sequence
  Description of Artificial Sequence: Synthetic coding sequence
atgagcctgcccttctaccagagatgccaccagcactacgacctgagctacagaaacaaggacgtgagaagcaccgtgagccactaccagagagagaagaagagaagcgccgtgtacacccagggcagcaccgcctacagcagcagaagcagcgccgcccacagaagagagagcgaggccttcagaagagccagcgccagcagcagccagcagcaggccagccagcacgccctgagcagcgaggtgagcagaaaggccgccagcgcctacgactacggcagcagccacggcctgaccgacagcagcctgctgctggacgactacagcagcaagctgagccccaagcccaagagagccaagcacagcctgctgagcggcgaggagaaggagaacctgcccagcgactacatggtgcccatcttcagcggcagacagaagcacgtgagcggcatcaccgacaccgaggaggagagaatcaaggaggccgccgcctacatcgcccagagaaacctgctggccagcgaggagggcatcaccaccagcaagcagagcaccgccagcaagcagaccaccgccagcaagcagagcaccgccagcaagcagagcaccgccagcaagcagagcaccgccagcagacagagcaccgccagcagacagagcgtggtgagcaagcaggccaccagcgccctgcagcaggaggagaccagcgagaagaagagcagaaaggtggtgatcagagagaaggccgagagactgagcctgagaaagaccctggaggagaccgagacctaccacgccaagctgaacgaggaccacctgctgcacgcccccgagttcatcatcaagcccagaagccacaccgtgtgggagaaggagaacgtgaagctgcactgcagcatcgccggctggcccgagcccagagtgacctggtacaagaaccaggtgcccatcaacgtgcacgccaaccccggcaagtacatcatcgagagcagatacggcatgcacaccctggagatcaacggctgcgacttcgaggacaccgcccagtacagagccagcgccatgaacgtgaagggcgagctgagcgcctacgccagcgtggtggtgaagagatacaagggcgagttcgacgagaccagattccacgccggcgccagcaccatgcccctgagcttcggcgtgaccccctacggctacgccagcagattcgagatccacttcgacgacaagttcgacgtgagcttcggcagagagggcgagaccatgagcctgggctgcagagtggtgatcacccccgagatcaagcacttccagcccgagatccagtggtacagaaacggcgtgcccctgagccccagcaagtgggtgcagaccctgtggagcggcgagagagccaccctgaccttcagccacctgaacaaggaggacgagggcctgtacaccatcagagtgagaatgggcgagtactacgagcagtacagcgcctacgtgttcgtgagagacgccgacgccgagatcgagggcgcccccgccgcccccctggacgtgaagtgcctggaggccaacaaggactacatcatcatcagctggaagcagcccgccgtggacggcggcagccccatcctgggctacttcatcgacaagtgcgaggtgggcaccgacagctggagccagtgcaacgacacccccgtgaagttcgccagattccccgtgaccggcctgatcgagggcagaagctacatcttcagagtgagagccgtgaacaagatgggcatcggcttccccagcagagtgagcgagcccgtggccgccctggaccccgccgagaaggccagactgaagagcagacccagcgccccctggaccggccagatcatcgtgaccgaggaggagcccagcgagggcatcgtgcccggcccccccaccgacctgagcgtgaccgaggccaccagaagctacgtggtgctgagctggaagccccccggccagagaggccacgagggcatcatgtacttcgtggagaagtgcgaggccggcaccgagaactggcagagagtgaacaccgagctgcccgtgaagagccccagattcgccctgttcgacctggccgagggcaagagctactgcttcagagtgagatgcagcaacagcgccggcgtgggcgagcccagcgaggccaccgaggtgaccgtggtgggcgacaagctggacatccccaaggcccccggcaagatcatccccagcagaaacaccgacaccagcgtggtggtgagctgggaggagagcaaggacgccaaggagctggtgggctactacatcgaggccagcgtggccggcagcggcaagtgggagccctgcaacaacaaccccgtgaagggcagcagattcacctgccacggcctggtgaccggccagagctacatcttcagagtgagagccgtgaacgccgccggcctgagcgagtacagccaggacagcgaggccatcgaggtgaaggccgccatcggcggcggcgtgagccccgacgtgtgccccgccctgagcgacgagcccggcggcctgaccgccagcagaggcagagtgcacgaggccagcccccccaccttccagaaggacgccctgctgggcagcaagcccaacaagcccagcctgcccagcagcagccagaacctgggccagaccgaggtgagcaaggtgagcgagaccgtgcaggaggagctgaccccccccccccagaaggccgccccccagggcaagagcaagagcgaccccctgaagaagaagaccgacagagccccccccagccccccctgcgacatcacctgcctggagagcttcagagacagcatggtgctgggctggaagcagcccgacaagatcggcggcgccgagatcaccggctactacgtgaactacagagaggtgatcgacggcgtgcccggcaagtggagagaggccaacgtgaaggccgtgagcgaggaggcctacaagatcagcaacctgaaggagaacatggtgtaccagttccaggtggccgccatgaacatggccggcctgggcgcccccagcgccgtgagcgagtgcttcaagtgcgaggagtggaccatcgccgtgcccggccccccccacagcctgaagtgcagcgaggtgagaaaggacagcctggtgctgcagtggaagccccccgtgcacagcggcagaacccccgtgaccggctacttcgtggacctgaaggaggccaaggccaaggaggaccagtggagaggcctgaacgaggccgccatcaagaacgtgtacctgaaggtgagaggcctgaaggagggcgtgagctacgtgttcagagtgagagccatcaaccaggccggcgtgggcaagcccagcgacctggccggccccgtggtggccgagaccagacccggcaccaaggaggtggtggtgaacgtggacgacgacggcgtgatcagcctgaacttcgagtgcgacaagatgacccccaagagcgagttcagctggagcaaggactacgtgagcaccgaggacagccccagactggaggtggagagcaagggcaacaagaccaagatgaccttcaaggacctgggcatggacgacctgggcatctacagctgcgacgtgaccgacaccgacggcatcgccagcagctacctgatcgacgaggaggagctgaagagactgctggccctgagccacgagcacaagttccccaccgtgcccgtgaagagcgagctggccgtggagatcctggagaagggccaggtgagattctggatgcaggccgagaagctgagcggcaacgccaaggtgaactacatcttcaacgagaaggagatcttcgagggccccaagtacaagatgcacatcgacagaaacaccggcatcatcgagatgttcatggagaagctgcaggacgaggacgagggcacctacaccttccagctgcaggacggcaaggccaccaaccacagcaccgtggtgctggtgggcgacgtgttcaagaagctgcagaaggaggccgagttccagagacaggagtggatcagaaagcagggcccccacttcgtggagtacctgagctgggaggtgaccggcgagtgcaacgtgctgctgaagtgcaaggtggccaacatcaagaaggagacccacatcgtgtggtacaaggacgagagagagatcagcgtggacgagaagcacgacttcaaggacggcatctgcaccctgctgatcaccgagttcagcaagaaggacgccggcatctacgaggtgatcctgaaggacgacagaggcaaggacaagagcagactgaagctggtggacgaggccttcaaggagctgatgatggaggtgtgcaagaagatcgccctgagcgccaccgacctgaagatccagagcaccgccgagggcatccagctgtacagcttcgtgacctactacgtggaggacctgaaggtgaactggagccacaacggcagcgccatcagatacagcgacagagtgaagaccggcgtgaccggcgagcagatctggctgcagatcaacgagcccacccccaacgacaagggcaagtacgtgatggagctgttcgacggcaagaccggccaccagaagaccgtggacctgagcggccaggcctacgacgaggcctacgccgagttccagagactgaagcaggccgccatcgccgagaagaacagagccagagtgctgggcggcctgcccgacgtggtgaccatccaggagggcaaggccctgaacctgacctgcaacgtgtggggcgaccccccccccgaggtgagctggctgaagaacgagaaggccctggccagcgacgaccactgcaacctgaagttcgaggccggcagaaccgcctacttcaccatcaacggcgtgagcaccgccgacagcggcaagtacggcctggtggtgaagaacaagtacggcagcgagaccagcgacttcaccgtgagcgtgttcatccccgaggaggaggccagaatggccgccctggagagcctgaagggcggcaagaaggccaagtag

SEQ ID NO: 10418 - DNA, 5877 bp, Artificial Sequence
  Description of Artificial Sequence: Synthetic coding sequence
atggccgacagaaccgcccccagatgccagctgagactggagtgggtgtacggctacagaggccaccagtgcagaaacaacctgtactacaccgccggcaaggaggtggtgtacttcgtggccggcgtgggcgtggtgtacaacaccagagagcacagccagaagttcttcctgggccacaacgacgacatcatcagcctggccctgcaccccgacaagaccctggtggccaccggccaggtgggcaaggagccctacatctgcatctgggacagctacaacgtgcagaccgtgagcctgctgaaggacgtgcacacccacggcgtggcctgcctggccttcgacagcgacggccagagactggccagcgtgggcctggacgccaagaacaccgtgtgcatctgggactggagaaagggcaagctgctggccagcgccaccggccacagcgacagaatcttcgacatcagctgggacccctaccagcccaacagagtggtgagctgcggcgtgaagcacatcaagttctggaccctgtgcggcaacgccctgaccgccaagagaggcatcttcggcaagaccggcgacctgcagaccatcctgtgcctggcctgcgccaaggaggacatcacctacagcggcgccctgaacggcgacatctacgtgtggaagggcctgaacctggtgagaaccatccagggcgcccacagcgccggcatcttcagcatgtacgcctgcgaggagggcttcgccaccggcggcagagacggctgcatcagactgtgggacaccgacttcaagcccatcaccaagatcgacctgagagagaccgagcagggctacaagggcctgagcatcagaagcgtgtgctggaaggccgacagactgctggccggcacccaggacagcgagatcttcgaggtgatcgtgagagagagagacaagcccatgctgatcctgcagggccactgcgagggcgagctgtgggccctggccctgcaccccaagaagcccctggccgtgaccggcagcgacgacagaagcgtgagactgtggagcctggccgaccacgccctgatcgccagatgcaacatggaggaggccgtgagaagcgtggccttcagccccgacggcagccagctggccctgggcatgaaggacggcagcttcatcgtgctgagagtgagagacatgaccgaggtggtgcacatcaaggacagaaaggaggtgatccacgagatgaagttcagccccgacggcagctacctggccgtgggcagcaacgacggccccgtggacgtgtacgccgtggcccagagatacaagaagatcggcgagtgcagcaagagcctgagcttcatcacccacatcgactggagcctggacagcaagtacctgcagaccaacgacggcgccggcgagagactgttctacagaatgcccagcggcaagcccctgaccagcaaggaggagatcaagggcatcccctgggccagctggacctgcgtgaagggccccgaggtgagcggcatctggcccaagtacaccgaggtgaccgacatcaacagcgtggacgccaactacaacagcagcgtgctggtgagcggcgacgacttcggcctggtgaagctgttcaagttcccctgcctgaagagaggcgccaagttcagaaagtacgtgggccacagcgcccacgtgaccaacgtgagatggagccacgacttccagtgggtgctgagcaccggcggcgccgaccacagcgtgttccagtggagattcatccccgagggcgtgagcaacggcatgctggagaccgccccccaggagggcggcgccgacagctacagcgaggagagcgacagcgacctgagcgacgtgcccgagctggacagcgacatcgagcaggaggcccagatcaactacgacagacaggtgtacaaggaggacctgccccagctgaagcagcagagcaaggagaagaaccacgccgtgcccttcctgaagagagagaaggcccccgaggacagcctgaagctgcagttcatccacggctacagaggctacgactgcagaaacaacctgttctacacccaggccggcgaggtggtgtaccacatcgccgccgtggccgtggtgtacaacagacagcagcacagccagagactgtacctgggccacgacgacgacatcctgagcctgaccatccaccccgtgaaggactacgtggccaccggccaggtgggcagagacgccgccatccacgtgtgggacacccagaccctgaagtgcctgagcctgctgaagggccagcaccagagaggcgtgtgcgccctggacttcagcgccgacggcaagtgcctggtgagcgtgggcctggacgacttccacagcatcgtgttctgggactggaagaagggcgagaagatcgccaccaccagaggccacaaggacaagatcttcgtggtgaagtgcaacccccaccacgtggacaagctggtgaccgtgggcatcaagcacatcaagttctggcagcaggccggcggcggcttcaccagcaagagaggcaccttcggcagcgtgggcaagctggagaccatgatgtgcgtgagctacggcagaatggaggacctggtgttcagcggcgccgccaccggcgacatcttcatctggaaggacatcctgctgctgaagaccgtgaaggcccacgacggccccgtgttcgccatgtacgccctggacaagggcttcgtgaccggcggcaaggacggcatcgtggagctgtgggacgacatgttcgagagatgcctgaagacctacgccatcaagagaagcgccctgagcaccagcagcaagggcctgctgctggaggacaaccccagcatcagagccatcaccctgggccacggccacatcctggtgggcaccaagaacggcgagatcctggagatcgacaagagcggccccatgaccctgctggtgcagggccacatggagggcgaggtgtggggcctggccgcccaccccctgctgcccatctgcgccaccgtgagcgacgacaagaccctgagaatctgggagctgagcgcccagcacagaatgctggccgtgagaaagctgaagaagggcggcagatgctgcgccttcagccccgacggcaaggccctggccgtgggcctgaacgacggcagcttcctggtggtgaacgccgacaccgtggaggacatggtgagcttccaccacagaaaggagatgatcagcgacatcaagttcagcaaggacaccggcaagtacctggccgtggccagccacgacaacttcgtggacatctacaacgtgctgaccagcaagagagtgggcatctgcaagggcgccagcagctacatcacccacatcgactgggacagcagaggcaagctgctgcaggtgaacagcggcgccagagagcagctgttcttcgaggcccccagaggcaagagacacatcatcagacccagcgagatcgagaagatcgagtgggacacctggacctgcgtgctgggccccacctgcgagggcatctggcccgcccacagcgacatcaccgacgtgaacgccgccagcctgaccaaggactgcagcctgctggccaccggcgacgacttcggcttcgtgaagctgttcagctaccccgtgaagggccagcacgccagattcaagaagtacgtgggccacagcgcccacgtgaccaacgtgagatggctgcacaacgacagcgtgctgctgaccgtgggcggcgccgacaccgccctgatgatctggaccagagagttcgtgggcacccaggagagcaagctggtggacagcgaggagagcgacaccgacgtggaggaggacggcggctacgacagcgacgtggccagagagaaggccatcgactacaccaccaagatctacgccgtgagcatcagagagatggagggcaccaagccccaccagcagctgaaggaggtgagcgtggaggagagaccccccgtgagcagagccgccccccagcccgagaagctgcagaagaacaacatcaccaagaagaagaagctggtggaggagctggccctggaccacgtgttcggctacagaggcttcgactgcagaaacaacctgcactacctgaacgacggcgccgacatcatcttccacaccgccgccgccggcatcgtgcagaacctgagcaccggcagccagagcttctacctggagcacaccgacgacatcctgtgcctgaccgtgaaccagcaccccaagtacagaaacgtggtggccaccagccagatcggcaccacccccagcatccacatctgggacgccatgaccaagcacaccctgagcatgctgagatgcttccacagcaagggcgtgaactacatcaacttcagcgccaccggcaagctgctggtgagcgtgggcgtggaccccgagcacaccatcaccgtgtggagatggcaggagggcgccaaggtggccagcagaggcggccacctggagagaatcttcgtggtggagttcagacccgacagcgacacccagttcgtgagcgtgggcgtgaagcacatgaagttctggaccctggccggcagcgccctgctgtacaagaagggcgtgatcggcagcctgggcgccgccaagatgcagaccatgctgagcgtggccttcggcgccaacaacctgaccttcaccggcgccatcaacggcgacgtgtacgtgtggaaggaccacttcctgatcagactggtggccaaggcccacaccggccccgtgttcaccatgtacaccaccctgagagacggcctgatcgtgaccggcggcaaggagagacccaccaaggagggcggcgccgtgaagctgtgggaccaggagatgaagagatgcagagccttccagctggagaccggccagctggtggagtgcgtgagaagcgtgtgcagaggcaagggcaagatcctggtgggcaccaaggacggcgagatcatcgaggtgggcgagaagaacgccgccagcaacatcctgatcgacggccacatggagggcgagatctggggcctggccacccaccccagcaaggacctgttcatcagcgccagcaacgacggcaccgccagaatctgggacctggccgacaagaagctgctgaacaaggtgagcctgggccacgccgccagatgcgccgcctacagccccgacggcgagatggtggccatcggcatgaagaacggcgagttcgtgatcctgctggtgaacagcctgaaggtgtggggcaagaagagagacagaaagagcgccatccaggacatcagaatcagccccgacaacagattcctggccgtgggcagcagcgagcacaccgtggacttctacgacctgacccagggcaccaacctgaacagaatcggctactgcaaggacatccccagcttcgtgatccagatggacttcagcgccgacggcaagtacatccaggtgagcaccggcgcctacaagagacaggtgcacgaggtgcccctgggcaagcaggtgaccgaggccgtggtgatcgagaagatcacctgggccagctggaccagcgtgctgggcgacgaggtgatcggcatctggcccagaaacgccgacaaggccgacgtgaactgcgcctgcgtgacccacgccggcctgaacatcgtgaccggcgacgacttcggcctggtgaagctgttcgacttcccctgcaccgagaagttcgccaagcacaagagatacttcggccacagcgcccacgtgaccaacatcagattcagctacgacgacaagtacgtggtgagcaccggcggcgacgactgcagcgtgttcgtgtggagatgcctgtag

SEQ ID NO: 10419 - DNA, 630 bp, Artificial Sequence
  Description of Artificial Sequence: Synthetic coding sequence
atgaaccccagcatgaagcagaagcaggaggagatcaaggagaacatcaagaacagcagcgtgcccagaagaaccctgaagatgatccagcccagcgccagcggcagcctggtgggcagagagaacgagctgagcgccggcctgagcaagagaaagcacagaaacgaccacctgaccagcaccaccagcagccccggcgtgatcgtgcccgagagcagcgagaacaagaacctgggcggcgtgacccaggagagcttcgacctgatgatcaaggagaaccccagcagccagtactggaaggaggtggccgagaagagaagaaaggccctgtacgaggccctgaaggagaacgagaagctgcacaaggagatcgagcagaaggacaacgagatcgccagactgaagaaggagaacaaggagctggccgaggtggccgagcacgtgcagtacatggccgagctgatcgagagactgaacggcgagcccctggacaacttcgagagcctggacaaccaggagttcgacagcgaggaggagaccgtggaggacagcctggtggaggacagcgagatcggcacctgcgccgagggcaccgtgagcagcagcaccgacgccaagccctgcatctag

SEQ ID NO: 10420 - DNA, 1635 bp, Artificial Sequence
  Description of Artificial Sequence: Synthetic coding sequence
atgaacaccagcatcccctaccagcagaacccctacaaccccagaggcagcagcaacgtgatccagtgctacagatgcggcgacacctgcaagggcgaggtggtgagagtgcacaacaaccacttccacatcagatgcttcacctgccaggtgtgcggctgcggcctggcccagagcggcttcttcttcaagaaccaggagtacatctgcacccaggactaccagcagctgtacggcaccagatgcgacagctgcagagacttcatcaccggcgaggtgatcagcgccctgggcagaacctaccaccccaagtgcttcgtgtgcagcctgtgcagaaagcccttccccatcggcgacaaggtgaccttcagcggcaaggagtgcgtgtgccagacctgcagccagagcatggccagcagcaagcccatcaagatcagaggccccagccactgcgccggctgcaaggaggagatcaagcacggccagagcctgctggccctggacaagcagtggcacgtgagctgcttcaagtgccagacctgcagcgtgatcctgaccggcgagtacatcagcaaggacggcgtgccctactgcgagagcgactaccacgcccagttcggcatcaagtgcgagacctgcgacagatacatcagcggcagagtgctggaggccggcggcaagcactaccaccccacctgcgccagatgcgtgagatgccaccagatgttcaccgagggcgaggagatgtacctgaccggcagcgaggtgtggcaccccatctgcaagcaggccgccagagccgagaagaagctgaagcacagaagaaccagcgagaccagcatcagcccccccggcagcagcatcggcagccccaacagagtgatctgcgacatctacgagaacctggacctgagacagagaagagccagcagccccggctacatcgacagccccacctacagcagacagggcatgagccccaccttcagcagaagcccccaccactactacagaagcggcgacctgagcaccgccaccaagagcaagaccagcgaggacatcagccagaccagcaagtacagccccatctacagccccgacccctactacgccagcgagagcgagtactggacctaccacggcagccccaaggtgcccagagccagaagattcagcagcggcggcgaggaggacgacttcgacagaagcatgcacaagctgcagagcggcatcggcagactgatcctgaaggaggagatgaaggccagaagcagcagctacgccgacccctggaccccccccagaagcagcaccagcagcagagaggccctgcacaccgccggctacgagatgagcctgaacggcagccccagaagccactacctggccgacagcgaccccctgatcagcaagagcgccagcctgcccgcctacagaagaaacggcctgcacagaacccccagcgccgacctgttccactacgacagcatgaacgccgtgaactggggcatgagagagtacaagatctacccctacgagctgctgctggtgaccaccagaggcagaaacagactgcccaaggacgtggacagaaccagactggagggcaacttctggaagagcggctgcctgtag

SEQ ID NO: 10421 - DNA, 840 bp, Artificial Sequence
  Description of Artificial Sequence: Synthetic coding sequence
atgacccccagcgagggcgccagagccggcaccggcagagagctggagatgctggacagcctgctggccctgggcggcctggtgctgctgagagacagcgtggagtgggagggcagaagcctgctgaaggccctggtgaagaagagcgccctgtgcggcgagcaggtgcacatcctgggctgcgaggtgagcgaggaggagttcagagagggcttcgacagcgacatcaacaacagactggtgtaccacgacttcttcagagaccccctgaactggagcaagaccgaggaggccttccccggcggccccctgggcgccctgagagccatgtgcaagagaaccgaccccgtgcccgtgaccatcgccctggacagcctgagctggctgctgctgagactgccctgcaccaccctgtgccaggtgctgcacgccgtgagccaccaggacagctgccccggcgacagcagcagcgtgggcaaggtgagcgtgctgggcctgctgcacgaggagctgcacggccccggccccgtgggcgccctgagcagcctggcccagaccgaggtgaccctgggcggcaccatgggccaggccagcgcccacatcctgtgcagaagacccagacagagacccaccgaccagacccagtggttcagcatcctgcccgacttcagcctggacctgcaggagggccccagcgtggagagccagccctacagcgacccccacatcccccccgtgagcaagaacgccaaggccagaaccagaaagtgcagcctggtgagcggccacggcagagagaacaagagctgcagaggctggggctggggccagggcttctag

SEQ ID NO: 10422 - DNA, 405 bp, Artificial Sequence
  Description of Artificial Sequence: Synthetic coding sequence
atgagcgagaacgccgcccccggcctgtgcggcgagctgctgctgcagagaggcaccaccaaggtggccaccggcctggtgctgaacagagaccagagactggcctgggccgagaacagcatcgacttcatcagcagagagctgtgcgcccacagcatcagaaagctgcaggcccacgtgctgctgatcaaggccgtgcacggctacttcgacagcagacagaactacagcgagaaggagagcctgagcttcatgatcgacaccatgaagagcaccctgaaggagcagttccagttcgtggaggtgcccggcaaccactgcgtgcacatgagcgagccccagcacgtggccagcatcatcagcagcttcctgcagtgcacccacatgctgcccgcccagctgtag

SEQ ID NO: 10423 - DNA, 1350 bp, Artificial Sequence
  Description of Artificial Sequence: Synthetic coding sequence
atgatgctgggcaccgagggcggcgagggcttcgtggtgaaggtgagaggcctgccctggagctgcagcgccgacgaggtgcagagattcttcagcgactgcaagatccagaacggcgcccagggcatcagattcatctacaccagagagggcagacccagcggcgaggccttcgtggagctggagagcgaggacgaggtgaagctggccctgaagaaggacagagagaccatgggccacagatacgtggaggtgttcaagagcaacaacgtggagatggactgggtgctgaagcacaccggccccaacagccccgacaccgccaacgacggcttcgtgagactgagaggcctgcccttcggctgcagcaaggaggagatcgtgcagttcttcagcggcctggagatcgtgcccaacggcatcaccctgcccgtggacttccagggcagaagcaccggcgaggccttcgtgcagttcgccagccaggagatcgccgagaaggccctgaagaagcacaaggagagaatcggccacagatacatcgagatcttcaagagcagcagagccgaggtgagaacccactacgacccccccagaaagctgatggccatgcagagacccggcccctacgacagacccggcgccggcagaggctacaacagcatcggcagaggcgccggcttcgagagaatgagaagaggcgcctacggcggcggctacggcggctacgacgactacaacggctacaacgacggctacggcttcggcagcgacagattcggcagagacctgaactactgcttcagcggcatgagcgaccacagatacggcgacggcggcagcaccttccagagcaccaccggccactgcgtgcacatgagaggcctgccctacagagccaccgagaacgacatctacaacttcttcagccccctgaaccccgtgagagtgcacatcgagatcggccccgacggcagagtgaccggcgaggccgacgtggagttcgccacccacgaggacgccgtggccgccatgagcaaggacaaggccaacatgcagcacagatacgtggagctgttcctgaacagcaccgccggcgccagcggcggcgcctacgagcacagatacgtggagctgttcctgaacagcaccgccggcgccagcggcggcgcctacggcagccagatgatgggcggcatgggcctgagcaaccagagcagctacggcggccccgccagccagcagctgagcggcggctacggcggcggctacggcggccagagcagcatgagcggctacgaccaggtgctgcaggagaacagcagcgacttccagagcaacatcgcctag

SEQ ID NO: 10424 - DNA, 4077 bp, Artificial Sequence
  Description of Artificial Sequence: Synthetic coding sequence
atgggcaaccagctggccggcatcgcccccagccagatcctgagcgtggagagctacttcagcgacatccacgacttcgagtacgacaagagcctgggcagcaccagattcttcaaggtggccagagccaagcacagagagggcctggtggtggtgaaggtgttcgccatccaggaccccaccctgcccctgaccagctacaagcaggagctggaggagctgaagatcagactgaacagcgcccagaactgcctgcccttccagaaggccagcgagaaggccagcgagaaggccgccatgctgttcagacagtacgtgagagacaacctgtacgacagaatcagcaccagacccttcctgaacaacatcgagaagagatggatcgccttccagatcctgaccgccgtggaccaggcccacaagagcggcgtgagacacggcgacatcaagaccgagaacgtgatggtgaccagctggaactgggtgctgctgaccgacttcgccagcttcaagcccacctacctgcccgaggacaaccccgccgacttcaactacttcttcgacaccagcagaagaagaacctgctacatcgcccccgagagattcgtggacggcggcatgttcgccaccgagctggagtacatgagagaccccagcacccccctggtggacctgaacagcaaccagagaaccagaggcgagctgaagagagccatggacatcttcagcgccggctgcgtgatcgccgagctgttcaccgagggcgtgcccctgttcgacctgagccagctgctggcctacagaaacggccacttcttccccgagcaggtgctgaacaagatcgaggaccacagcatcagagagctggtgacccagatgatccacagagagcccgacaagagactggaggccgaggactacctgaagcagcagagaggcaacgccttccccgagatcttctacaccttcctgcagccctacatggcccagttcgccaaggagaccttcctgagcgccgacgagagaatcctggtgatcagaaaggacctgggcaacatcatccacaacctgtgcggccacgacctgcccgagaaggccgagggcgagcccaaggagaacggcctggtgatcctggtgagcgtgatcaccagctgcctgcagaccctgaagtactgcgacagcaagctggccgccctggagctgatcctgcacctggcccccagactgagcgtggagatcctgctggacagaatcaccccctacctgctgcacttcagcaacgacagcgtgcccagagtgagagccgaggccctgagaaccctgaccaaggtgctggccctggtgaaggaggtgcccagaaacgacatcaacatctaccccgagtacatcctgcccggcatcgcccacctggcccaggacgacgccaccatcgtgagactggcctacgccgagaacatcgccctgctggccgagaccgccctgagattcctggagctggtgcagctgaagaacctgaacatggagaacgaccccaacaacgaggagatcgacgaggtgacccaccccaacggcaactacgacaccgagctgcaggccctgcacgagatggtgcagcagaaggtggtgaccctgctgagcgaccccgagaacatcgtgaagcagaccctgatggagaacggcatcaccagactgtgcgtgttcttcggcagacagaaggccaacgacgtgctgctgagccacatgatcaccttcctgaacgacaagaacgactggcacctgagaggcgccttcttcgacagcatcgtgggcgtggccgcctacgtgggctggcagagcagcagcatcctgaagcccctgctgcagcagggcctgagcgacgccgaggagttcgtgatcgtgaaggccctgtacgccctgacctgcatgtgccagctgggcctgctgcagaagccccacgtgtacgagttcgccagcgacatcgcccccttcctgtgccaccccaacctgtggatcagatacggcgccgtgggcttcatcaccgtggtggccagacagatcagcaccgccgacgtgtactgcaagctgatgccctacctggacccctacatcacccagcccatcatccagatcgagagaaagctggtgctgctgagcgtgctgaaggagcccgtgagcagaagcatcttcgactacgccctgagaagcaaggacatcaccagcctgttcagacacctgcacatgagacagaagaagagaaacggcagcctgcccgactgccccccccccgaggaccccgccatcgcccagctgctgaagaagctgctgagccagggcatgaccgaggaggaggaggacaagctgctggccctgaaggacttcatgatgaagagcaacaaggccaaggccaacatcgtggaccagagccacctgcacgacagcagccagaagggcgtgatcgacctggccgccctgggcatcaccggcagacaggtggacctggtgaagaccaagcaggagcccgacgacaagagagccagaaagcacgtgaagcaggacagcaacgtgaacgaggagtggaagagcatgttcggcagcctggacccccccaacatgccccaggccctgcccaagggcagcgaccaggaggtgatccagaccggcaagccccccagaagcgagagcagcgccggcatctgcgtgcccctgagcaccagcagccaggtgcccgaggtgaccaccgtgcagaacaagaagcccgtgatccccgtgctgagcagcaccatcctgcccagcacctaccagatcagaatcaccacctgcaagaccgagctgcagcagctgatccagcagaagagagagcagtgcaacgccgagagaatcgccaagcagatgatggagaacgccgagtgggagagcaagccccccccccccggctggagacccaagggcctgctggtggcccacctgcacgagcacaagagcgccgtgaacagaatcagagtgagcgacgagcacagcctgttcgccacctgcagcaacgacggcaccgtgaagatctggaacagccagaagatggagggcaagaccaccaccaccagaagcatcctgacctacagcagaatcggcggcagagtgaagaccctgaccttctgccagggcagccactacctggccatcgccagcgacaacggcgccgtgcagctgctgggcatcgaggccagcaagctgcccaagagccccaagatccaccccctgcagagcagaatcctggaccagaaggaggacggctgcgtggtggacatgcaccacttcaacagcggcgcccagagcgtgctggcctacgccaccgtgaacggcagcctggtgggctgggacctgagaagcagcagcaacgcctggaccctgaagcacgacctgaagagcggcctgatcaccagcttcgccgtggacatccaccagtgctggctgtgcatcggcaccagcagcggcaccatggcctgctgggacatgagattccagctgcccatcagcagccactgccaccccagcagagccagaatcagaagactgagcatgcaccccctgtaccagagctgggtgatcgccgccgtgcagggcaacaacgaggtgagcatgtgggacatggagaccggcgacagaagattcaccctgtgggccagcagcgccccccccctgagcgagctgcagcccagcccccacagcgtgcacggcatctactgcagccccgccgacggcaaccccatcctgctgaccgccggcagcgacatgaagatcagattctgggacctggcctaccccgagagaagctacgtggtggccggcagcaccagcagccccagcgtgagctactacagaaagatcatcgagggcaccgaggtggtgcaggagatccagaacaagcagaaggtgggccccagcgacgacacccccagaagaggccccgagagcctgcccgtgggccaccacgacatcatcaccgacgtggccaccttccagaccacccagggcttcatcgtgaccgccagcagagacggcatcgtgaaggtgtggaagtag

SEQ ID NO: 10425 - DNA, 993 bp, Artificial Sequence
  Description of Artificial Sequence: Synthetic coding sequence
atgcccgtggtgaccaccgacgccgagagcgagaccggcatccccaagagcctgagcaacgagccccccagcgagaccatggaggagatcgagcacacctgcccccagcccagactgaccctgaccgcccccgcccccttcgccgacgagaccaactgccagtgccaggccccccacgagaagctgaccatcgcccaggccagactgggcacccccgccgacagacccgtgagagtgtacgccgacggcatcttcgacctgttccacagcggccacgccagagccctgatgcaggccaagaccctgttccccaacagctacctgctggtgggcgtgtgcagcgacgacctgacccacaagttcaagggcttcaccgtgatgaacgaggccgagagatacgaggccctgagacactgcagatacgtggacgaggtgatcagagacgccccctggaccctgacccccgagttcctggagaagcacaagatcgacttcgtggcccacgacgacatcccctacagcagcgccggcagcgacgacgtgtacaagcacatcaaggaggccggcatgttcgtgcccacccagagaaccgagggcatcagcaccagcgacatcatcaccagaatcgtgagagactacgacgtgtacgccagaagaaacctgcagagaggctacaccgccaaggagctgaacgtgagcttcatcaacgagaagagatacagattccagaaccaggtggacaagatgaaggagaaggtgaagaacgtggaggagagaagcaaggagttcgtgaacagagtggaggagaagagccacgacctgatccagaagtgggaggagaagagcagagagttcatcggcaacttcctggagctgttcggccccgacggcgcctggaagcagatgttccaggagagaagcagcagaatgctgcaggccctgagccccaagcagagccccctgaagagctgggccagatgcagagacttctag

SEQ ID NO: 10426 - DNA, 2025 bp, Artificial Sequence
  Description of Artificial Sequence: Synthetic coding sequence
atgcagaccagcagcagcagaagcgtgcacctgagcgagtggcagaagaactacttcgccatcaccagcggcatctgcaccggccccaaggccgacgcctacagagcccagatcctgagaatccagtacgcctgggccaacagcgagatcagccaggtgtgcgccaccaagctgttcaagaagtacgccgagaagtacagcgccatcatcgacagcgacaacgtggagagcggcctgaacaactacgccgagaacatcctgaccctggccggcagccagcagaccgacagcgacaagtggcagagcggcctgagcatcaacaacgtgttcaagatgagcagcgtgcagaagatgatgcaggccggcaagaagttcaaggacagcctgctggagcccgccctggccagcgtggtgatccacaaggaggccaccgtgttcgacctgcccaagttcagcgtgtgcggcagcagccaggagagcgacagcctgcccaacagcgcccacgacagagacagaacccaggacttccccgagagcaacagactgaagctgctgcagaacgcccagccccccatggtgaccaacaccgccagaacctgccccaccttcagcgcccccgtgggcgagagcgccaccgccaagttccacgtgacccccctgttcggcaacgtgaagaaggagaaccacagcagcgccaaggagaacatcggcctgaacgtgttcctgagcaaccagagctgcttccccgccgcctgcgagaacccccagagaaagagcttctacggcagcggcaccatcgacgccctgagcaaccccatcctgaacaaggcctgcagcaagaccgaggacaacggccccaaggaggacagcagcctgcccaccttcaagaccgccaaggagcagctgtgggtggaccagcagaagaagtaccaccagccccagagagccagcggcagcagctacggcggcgtgaagaagagcctgggcgccagcagaagcagaggcatcctgggcaagttcgtgccccccatccccaagcaggacggcggcgagcagaacggcggcatgcagtgcaagccctacggcgccggccccaccgagcccgcccaccccgtggacgagagactgaagaacctggagcccaagatgatcgagctgatcatgaacgagatcatggaccacggcccccccgtgaactgggaggacatcgccggcgtggagttcgccaaggccaccatcaaggagatcgtggtgtggcccatgctgagacccgacatcttcaccggcctgagaggcccccccaagggcatcctgctgttcggcccccccggcaccggcaagaccctgatcggcaagtgcatcgccagccagagcggcgccaccttcttcagcatcagcgccagcagcctgaccagcaagtgggtgggcgagggcgagaagatggtgagagccctgttcgccgtggccagatgccagcagcccgccgtgatcttcatcgacgagatcgacagcctgctgagccagagaggcgacggcgagcacgagagcagcagaagaatcaagaccgagttcctggtgcagctggacggcgccaccaccagcagcgaggacagaatcctggtggtgggcgccaccaacagaccccaggagatcgacgaggccgccagaagaagactggtgaagagactgtacatccccctgcccgaggccagcgccagaaagcagatcgtgatcaacctgatgagcaaggagcagtgctgcctgagcgaggaggagatcgagcagatcgtgcagcagagcgacgccttcagcggcgccgacatgacccagctgtgcagagaggccagcctgggccccatcagaagcctgcagaccgccgacatcgccaccatcacccccgaccaggtgagacccatcgcctacatcgacttcgagaacgccttcagaaccgtgagacccagcgtgagccccaaggacctggagctgtacgagaactggaacaagaccttcggctgcggcaagtag

SEQ ID NO: 10427 - DNA, 1143 bp, Artificial Sequence
  Description of Artificial Sequence: Synthetic coding sequence
atgctgagaagaaagcccagcaacgccagcgagaaggagcccacccagaagaagaagctgagcctgcagagaagcagcagcttcaaggacttcgccaagagcaagcccagcagccccgtggtgagcgagaaggagttcaacctggacgacaacatccccgaggacgacagcggcgtgcccacccccgaggacgccggcaagagcggcaagaagctgggcaagaagtggagagccgtgatcagcagaaccatgaacagaaagatgggcaagatgatggtgaaggccctgagcgaggagatggccgacaccctggaggagggcagcgccagccccaccagccccgactacagcctggacagccccggccccgagaagatggccctggccttcagcgagcaggaggagcacgagctgcccgtgctgagcagacaggccagcaccggcagcgagctgtgcagccccagccccggcagcggcagcttcggcgaggagccccccgccccccagtacaccggccccttctgcggcagagccagagtgcacaccgacttcacccccagcccctacgaccacgacagcctgaagctgcagaagggcgacgtgatccagatcatcgagaagccccccgtgggcacctggctgggcctgctgaacggcaaggtgggcagcttcaagttcatctacgtggacgtgctgcccgaggaggccgtgggccacgccagacccagcagaagacagagcaagggcaagagacccaagcccaagaccctgcacgagctgctggagagaatcggcctggaggagcacaccagcaccctgctgctgaacggctaccagaccctggaggacttcaaggagctgagagagacccacctgaacgagctgaacatcatggacccccagcacagagccaagctgctgaccgccgccgagctgctgctggactacgacaccggcagcgaggaggccgaggagggcgccgagagcagccaggagcccgtggcccacaccgtgagcgagcccaaggtggacatccccagagacagcggctgcttcgagggcagcgagagcggcagagacgacgccgagctggccggcaccgaggagcagctgcagggcctgagcctggccggcgccccctag

SEQ ID NO: 10428 - DNA, 1692 bp, Artificial Sequence
  Description of Artificial Sequence: Synthetic coding sequence
atgaaccccctgttcggccccaacctgttcctgctgcagcaggagcagcagggcctggccggccccctgggcgacagcctgggcggcgaccacttcgccggcggcggcgacctgccccccgcccccctgagccccgccggccccgccgcctacagcccccccggccccggccccgccccccccgccgccatggccctgagaaacgacctgggcagcaacatcaacgtgctgaagaccctgaacctgagattcagatgcttcctggccaaggtgcacgagctggagagaagaaacagactgctggagaagcagctgcagcaggccctggaggagggcaagcagggcagaagaggcctgggcagaagagaccaggccgtgcagaccggcttcgtgagccccatcagacccctgggcctgcagctgggcgccagacccgccgccgtgtgcagccccagcgccagagtgctgggcagccccgccagaagccccgccggccccctggcccccagcgccgccagcctgagcagcagcagcaccagcaccagcaccacctacagcagcagcgccagattcatgcccggcaccatctggagcttcagccacgccagaagactgggccccggcctggagcccaccctggtgcagggccccggcctgagctgggtgcaccccgacggcgtgggcgtgcagatcgacaccatcacccccgagatcagagccctgtacaacgtgctggccaaggtgaagagagagagagacgagtacaagagaagatgggaggaggagtacaccgtgagaatccagctgcaggacagagtgaacgagctgcaggaggaggcccaggaggccgacgcctgccaggaggagctggccctgaaggtggagcagctgaaggccgagctggtggtgttcaagggcctgatgagcaacaacctgagcgagctggacaccaagatccaggagaaggccatgaaggtggacatggacatctgcagaagaatcgacatcaccgccaagctgtgcgacgtggcccagcagagaaactgcgaggacatgatccagatgttccagaagaagctggtgcccagcatgggcggcagaaagagagagagaaaggccgccgtggaggaggacaccagcctgagcgagagcgagggccccagacagcccgacggcgacgaggaggagagcaccgccctgagcatcaacgaggagatgcagagaatgctgaaccagctgagagagtacgacttcgaggacgactgcgacagcctgacctgggaggagaccgaggagaccctgctgctgtgggaggacttcagcggctacgccatggccgccgccgaggcccagggcgagcagcaggaggacagcctggagaaggtgatcaaggacaccgagagcctgttcaagaccagagagaaggagtaccaggagaccatcgaccagatcgagctggagctggccaccgccaagaacgacatgaacagacacctgcacgagtacatggagatgtgcagcatgaagagaggcctggacgtgcagatggagacctgcagaagactgatcacccagagcggcgacagaaagagccccgccttcaccgccgtgcccctgagcgaccccccccccccccccagcgaggccgaggacagcgacagagacgtgagcagcgacagcagcatgagatag

SEQ ID NO: 10429 - DNA, 1893 bp, Artificial Sequence
  Description of Artificial Sequence: Synthetic coding sequence
atgctgttcctggccatcccccagagcatcgacgaggagaccgaggtgtggagcgaccacatcatcttccccagaatccccagaggccccgtgcagcagcccctggaggacagaatcttcacccccgccgtgagcgccgtgtacagcaccgtgacccaggtggccagacagcccggcacccccacccccagcccctacagcgcccacgagatcaacaagggccaccccaacctggccgccaccccccccggccacgccagcagccccggcctgagccagaccccctaccccagcggccagaacgccggccccaccaccctggtgtacccccagaccccccagaccatgaacagccagccccagaccagaagccccttcgccgccggccccagacccccccaccaccagttcttccagagaccccagatccagccccccagagccaccatccccaacagcagccccagcatcagacccggcgcccagacccccaccgccgtgtaccaggccaaccagcacatcatgatggtgaaccacctgcccatgccctaccccgtgccccagggcccccagtactgcatcccccagtacagacacagcggccccccctacgtgggccccccccagcagtaccccgtgcagccccccggccccggccccttctaccccggccccggccccggcgacttccccaacgcctacggcacccccttctaccccagccagcccgtgtaccagagcgcccccatcatcgtgcccacccagcagcagcccccccccgccaagagagagaagaagaccatcagaatcagagaccccaaccagggcggcaaggacatcaccgaggagatcatgagcggcggcggcagcagaaaccccaccccccccatcggcagacccaccagcacccccacccccccccagcagctgcccagccaggtgcccgagcacagccccgtggtgtacggcaccgtggagagcgcccacctggccgccagcacccccgtgaccgccgccagcgaccagaagcaggaggagaagcccaagcccgaccccgtgctgaagagccccagccccgtgctgagactggtgctgagcggcgagaagaaggagcaggagggccagaccagcgagaccaccgccatcgtgagcatcgccgagctgcccctgccccccagccccaccaccgtgagcagcgtggccagaagcaccatcgccgcccccaccagcagcgccctgagcagccagcccatcttcaccaccgccatcgacgacagatgcgagctgagcagccccagagaggacaccatccccatccccagcctgaccagctgcaccgagaccagcgaccccctgcccaccaacgagaacgacgacgacatctgcaagaagccctgcagcgtggcccccaacgacatccccctggtgagcagcaccaacctgatcaacgagatcaacggcgtgagcgagaagctgagcgccaccgagagcatcgtggagatcgtgaagcaggaggtgctgcccctgaccctggagctggagatcctggagaacccccccgaggagatgaagctggagtgcatccccgcccccatcacccccagcaccgtgcccagcttcccccccaccccccccaccccccccgccagccccccccacacccccgtgatcgtgcccgccgccgccaccaccgtgagcagccccagcgccgccatcaccgtgcagagagtgctggaggaggacgagagcatcagaacctgcctgagcgaggacgccaaggagatccagaacaagatcgaggtggaggccgacggccagaccgaggagatcctggacagccagaacctgaacagcagaagaagccccgtgcccgagaccagcaacgagtgctag

SEQ ID NO: 10430 - DNA, 414 bp, Artificial Sequence
  Description of Artificial Sequence: Synthetic coding sequence
atgatcctgcccaccaaggccatggccacccaggagctgaccgtgaagagaaagctgagcggcaacaccctgcaggtgcaggccagcagccccgtggccctgggcgtgagaatccccaccgtggccctgcacatgatggagctgttcgacaccaccgtggagcagctgtacagcatcttcaccgtgaaggagctgaccaacaagaagatcatcatgaagtggagatgcggcaactggcccgaggagcactacgccatggtggccctgaacttcgtgcccaccctgggccagaccgagctgcagctgaaggagttcctgagcatctgcaaggaggagaacatgaagttctgctggcagaagcagcacttcgaggagatcaagggcagcctgcagctgacccccctgaacggctag

SEQ ID NO: 10431 - DNA, 1248 bp, Artificial Sequence; identical to SEQ ID NO: 10184
  Description of Artificial Sequence: Synthetic coding sequence

SEQ ID NO: 10432 - DNA, 1464 bp, Artificial Sequence
  Description of Artificial Sequence: Synthetic coding sequence
atgagcagccccctggccagcctgagcaagaccagaaaggtgcccctgcccagcgagcccatgaaccccggcagaagaggcatcagaatctacggcgacgtgcccgccagccacgacagcgagctgatggccttcatgaccagaaagctgtgggacctggagcagcaggtgaaggcccagaccgacgagatcctgagcaaggaccagaagatcgccgccctggaggacctggtgcagaccctgagaccccaccccgccgaggccaccctgcagagacaggaggagctggagaccatgtgcgtgcagctgcagagacaggtgagagagatggagagattcctgagcgactacggcctgcagtgggtgggcgagcccatggaccaggaggacagcgagagcaagaccgtgagcgagcacggcgagagagactggatgaccgccaagaagttctggaagcccggcgacagcctggccccccccgaggtggacttcgacagactgctggccagcctgcaggacctgagcgagctggtggtggagggcgacacccaggtgacccccgtgcccggcggcgccagactgagaaccctggagcccatccccctgaagctgtacagaaacggcatcatgatgttcgacggccccttccagcccttctacgaccccagcacccagagatgcctgagagacatcctggacggcttcttccccagcgagctgcagagactgtaccccaacggcgtgcccttcaaggtgagcgacctgagaaaccaggtgtacctggaggacggcctggaccccttccccggcgagggcagagtggtgggcagacagctgatgcacaaggccctggacagagtggaggagcaccccggcagcagaatgaccgccgagaagttcctgaacagactgcccaagttcgtgatcagacagggcgaggtgatcgacatcagaggccccatcagagacaccctgcagaactgctgccccctgcccgccagaatccaggagatcgtggtggagacccccaccctggccgccgagagagagagaagccaggagagccccaacacccccgccccccccctgagcatgctgagaatcaagagcgagaacggcgagcaggccttcctgctgatgatgcagcccgacaacaccatcggcgacgtgagagccctgctggcccaggccagagtgatggacgccagcgccttcgagatcttcagcaccttcccccccaccctgtaccaggacgacaccctgaccctgcaggccgccggcctggtgcccaaggccgccctgctgctgagagccagaagagcccccaagagcagcctgaagttcagccccggcccctgccccggccccggccccggccccagccccggccccggccccggccccagccccggccccggccccggccccagcccctgccccggccccagccccagcccccagtag

SEQ ID NO: 10433 - DNA, 1467 bp, Artificial Sequence
  Description of Artificial Sequence: Synthetic coding sequence
atgagcgccttctgcctgggcctggtgggcagagccagcgcccccgccgagcccgacagcgcctgctgcatggagctgcccgccgccgccggcgacgccgtgagaagccccgccgccgccgccgccctgatcttccccggcggcagcggcgagctggagctggccctggaggaggagctggccctgctggccgccggcgagagacccagcgaccccggcgagcacccccaggccgagctgctgagcgtgatcagacagaaggagaaggacctggtgctggccgccagactgggcaaggccctgctggagagaaaccaggacatgagcagacagtacgagcagatgcacaaggagctgaccgacaagctggagcacctggagcaggagaagcacgagctgagaagaagattcgagaacagagagggcgagtgggagggcagagtgagcgagctggagagcgacgtgaagcagctgcaggacgagctggagagacagcagatccacctgagagaggccgacagagagaagagcagagccgtgcaggagctgagcgagcagaaccagagactgctggaccagctgagcagagccagcgaggtggagagacagctgagcatgcaggtgcacgccctgagagaggacttcagagagaagaacagcagcaccaaccagcacatcatcagactggagagcctgcaggccgagatcaagatgctgagcgacagaaagagagagctggagcacagactgagcgccaccctggaggagaacgacctgctgcagggcaccgtggaggagctgcaggacagagtgctgatcctggagagacagggccacgacaaggacctgcagctgcaccagagccagctggagctgcaggaggtgagactgagctgcagacagctgcaggtgaaggtggaggagctgaccgaggagagaagcctgcagagcagcgccgccaccagcaccagcctgctgagcgagatcgagcagagcatggaggccgaggagctggagcaggagagagagcagctgagactgcagctgtgggaggcctactgccaggtgagatacctgtgcagccacctgagaggcaacgacagcgccgacagcgccgtgagcaccgacagcagcatggacgagagcagcgagaccagcagcgccaaggacgtgcccgccggcagcctgagaaccgccctgaacgagctgaagagactgatccagagcatcgtggacggcatggagcccaccggcagcagaagactggacgacgacagcctggaggagcagatcagacagaccagcgaggacagcagagccctgagagagctgatggagggcgagagaggcagactgcccgaggccagcagatgctgcctgcccgcctgcagccagcccatccagagccccagcctgccccacgtgggcaaggcccagcagggctgcgccgccagaatgtacctgtag

SEQ ID NO: 10434 - DNA, 1428 bp, Artificial Sequence
  Description of Artificial Sequence: Synthetic coding sequence
atgaccagaggcaccggcggcaccgcccagagaggcagaagcggccccgacagccagggcctgctggacagcagcctgatggccagcggcaccgccagcagaagcgaggacgaggagagcctggccggccagaagagagccagcagccaggccctgggcaccatccccaagagaagaagcagcagcagattcatcaagagaaagaagttcgacgacgagctggtggagagcagcctggccaagagcagcaccagagccaagggcgccagcggcgtggagcccggcagatgcagcggcagcgagcccagcagcagcgagaagaagaaggtgagcaaggcccccagcacccccgtgccccccagccccgcccccgcccccggcctgaccaagagagtgaagaagagcaagcagcccctgcaggtgaccaaggacctgggcagatggaagcccgccgacgacctgctgctgatcaacgccgtgctgcagaccaacgacctgaccagcgtgcacctgggcgtgaagttcagctgcagattcaccctgagagaggtgcaggagagatggtacgccctgctgtacgaccccgtgatcagcaagctggcctgccaggccatgagacagctgcaccccgaggccatcgccgccatccagagcaaggccctgttcagcaaggccgaggagcagctgctgagcaaggtgggcagcaccagccagcccaccctggagaccttccaggacctgctgcacagacaccccgacgccttctacctggccagaaccgccaaggccctgcaggcccactggcagctgatgaagcagtactacctgctggaggaccagaccgtgcagcccctgcccaagggcgaccaggtgctgaacttcagcgacgccgaggacctgatcgacgacagcaagctgaaggacatgagagacgaggtgctggagcacgagctgatggtggccgacagaagacagaagagagagatcagacagctggagcaggagctgcacaagtggcaggtgctggtggacagcatcaccggcatgagcagccccgacttcgacaaccagaccctggccgtgctgagaggcagaatggtgagatacctgatgagaagcagagagatcaccctgggcagagccaccaaggacaaccagatcgacgtggacctgagcctggagggccccgcctggaagatcagcagaaagcagggcgtgatcaagctgaagaacaacggcgacttcttcatcgccaacgagggcagaagacccatctacatcgacggcagacccgtgctgtgcggcagcaagtggagactgagcaacaacagcgtggtggagatcgccagcctgagattcgtgttcctgatcaaccaggacctgatcgccctgatcagagccgaggccgccaagatcaccccccagtag

SEQ ID NO: 10435 - DNA, 1311 bp, Artificial Sequence
  Description of Artificial Sequence: Synthetic coding sequence
atggccgacggcggcagcgagagagccgacggcagaatcgtgaagatggaggtggactacagcgccaccgtggaccagagactgcccgagtgcgccaagctggccaaggccagcgacatggtgagcaccagcagaatcctggtggccgtggtgaagatgtgctacgaggccaaggagtgggacctgctgaacgagaacatcatgctgctgagcaagagaagaagccagctgaagcaggccgtggccaagatggtgcagcagtgctgcacctacgtggaggagatcaccgacctgcccatcaagctgagactgatcgacaccctgagaatggtgaccgagggcaagatctacgtggagatcgagagagccagactgaccaagaccctggccaccatcaaggagcagaacggcgacgtgaaggaggccgccagcatcctgcaggagctgcaggtggagacctacggcagcatggagaagaaggagagagtggagttcatcctggagcagatgagactgtgcctggccgtgaaggactacatcagaacccagatcatcagcaagaagatcaacaccaagttcttccaggaggagaacaccgagaagctgaagctgaagtactacaacctgatgatccagctggaccagcacgagggcagctacctgagcatctgcaagcactacagagccatctacgacaccccctgcatccaggccgagagcgagaagtggcagcaggccctgaagagcgtggtgctgtacgtgatcctggcccccttcgacaacgagcagagcgacctggtgcacagaatcagcggcgacaagaagctggaggagatccccaagtacaaggacctgctgaagctgttcaccaccatggagctgatgagatggagcaccctggtggaggactacggcatggagctgagaaagggcagcctggagagccccgccaccgacgtgttcggcagcaccgaggagggcgagaagagatggaaggacctgaagaacagagtggtggagcacaacatcagaatcatggccaagtactacaccagaatcaccatgaagagaatggcccagctgctggacctgagcgtggacgagagcgaggccttcctgagcaacctggtggtgaacaagaccatcttcgccaaggtggacagactggccggcatcatcaacttccagagacccaaggaccccaacaacctgctgaacgactggagccagaagctgaacagcctgatgagcctggtgaacaagaccacccacctgatcgccaaggaggagatgatccacaacctgcagtag

SEQ ID NO: 10436 - DNA, 1974 bp, Artificial Sequence
  Description of Artificial Sequence: Synthetic coding sequence
atggacgaccccgactgcgacagcacctgggaggaggacgaggaggacgccgaggacgccgaggacgaggactgcgaggacggcgaggccgccggcgccagagacgccgacgccggcgacgaggacgaggagagcgaggagcccagagccgccagacccagcagcttccagagcagaatgaccggcagcagaaactggagagccaccagagacatgtgcagatacagacacaactaccccgacctggtggagagagactgcaacggcgacacccccaacctgagcttctacagaaacgagatcagattcctgcccaacggctgcttcatcgaggacatcctgcagaactggaccgacaactacgacctgctggaggacaaccacagctacatccagtggctgttccccctgagagagcccggcgtgaactggcacgccaagcccctgaccctgagagaggtggaggtgttcaagagcagccaggagatccaggagagactggtgagagcctacgagctgatgctgggcttctacggcatcagactggaggacagaggcaccggcaccgtgggcagagcccagaactaccagaagagattccagaacctgaactggagaagccacaacaacctgagaatcaccagaatcctgaagagcctgggcgagctgggcctggagcacttccaggcccccctggtgagattcttcctggaggagaccctggtgagaagagagctgcccggcgtgagacagagcgccctggactacttcatgttcgccgtgagatgcagacaccagagaagacagctggtgcacttcgcctgggagcacttcagacccagatgcaagttcgtgtggggcccccaggacaagctgagaagattcaagcccagcagcctgccccaccccctggagggcagcagaaaggtggaggaggagggcagccccggcgaccccgaccacgaggccagcacccagggcagaacctgcggccccgagcacagcaagggcggcggcagagtggacgagggcccccagcccagaagcgtggagccccaggacgccggccccctggagagaagccagggcgacgaggccggcggccacggcgaggacagacccgagcccctgagccccaaggagagcaagaagagaaagctggagctgagcagaagagagcagccccccaccgagcccggcccccagagcgccagcgaggtggagaagatcgccctgaacctggagggctgcgccctgagccagggcagcctgagaaccggcacccaggaggtgggcggccaggaccccggcgaggccgtgcagccctgcagacagcccctgggcgccagagtggccgacaaggtgagaaagagaagaaaggtggacgagggcgccggcgacagcgccgccgtggccagcggcggcgcccagaccctggccctggccggcagccccgcccccagcggccaccccaaggccggccacagcgagaacggcgtggaggaggacaccgagggcagaaccggccccaaggagggcacccccggcagccccagcgagacccccggccccagccccgccggccccgccggcgacgagcccgccgagagccccagcgagacccccggccccagacccgccggccccgccggcgacgagcccgccgagagccccagcgagacccccggccccagccccgccggccccaccagagacgagcccgccgagagccccagcgagacccccggccccagacccgccggccccgccggcgacgagcccgccgagagccccagcgagacccccggccccagacccgccggccccgccggcgacgagcccgccgagagccccagcgagacccccggccccagccccgccggccccaccagagacgagcccgccaaggccggcgaggccgccgagctgcaggacgccgaggtggagagcagcgccaagagcggcaagccctag

SEQ ID NO: 10437 - DNA, 615 bp, Artificial Sequence; identical to SEQ ID NO: 9347
  Description of Artificial Sequence: Synthetic coding sequence

SEQ ID NO: 10438 - DNA, 3042 bp, Artificial Sequence
  Description of Artificial Sequence: Synthetic coding sequence
atgggctggaagcccagcgaggccagaggccagagccagagcttccaggccagcggcctgcagcccagaagcctgaaggccgccagaagagccaccggcagacccgacagaagcagagccgccagacccaccatggaccccagcgcccacagaagcagagccgccccccccaacatggaccccgacccccaggccggcgtgcaggtgggcatgagagtggtgagaggcgtggactggaagtggggccagcaggacggcggcgagggcggcgtgggcaccgtggtggagctgggcagacacggcagccccagcacccccgacagaaccgtggtggtgcagtgggaccagggcaccagaaccaactacagagccggctaccagggcgcccacgacctgctgctgtacgacaacgcccagatcggcgtgagacaccccaacatcatctgcgactgctgcaagaagcacggcctgagaggcatgagatggaagtgcagagtgtgcctggactacgacctgtgcacccagtgctacatgcacaacaagcacgagctggcccacgccttcgacagatacgagaccgcccacagcagacccgtgaccctgagccccagacagggcctgcccagaatccccctgagaggcatcttccagggcgccaaggtggtgagaggccccgactgggagtggggcagccaggacggcggcgagggcaagcccggcagagtggtggacatcagaggctgggacgtggagaccggcagaagcgtggccagcgtgacctgggccgacggcaccaccaacgtgtacagagtgggccacaagggcaaggtggacctgaagtgcgtgggcgaggccgccggcggcttctactacaaggaccacctgcccagactgggcaagcccgccgagctgcagagaagagtgagcgccgacagccagcccttccagcacggcgacaaggtgaagtgcctgctggacaccgacgtgctgagagagatgcaggagggccacggcggctggaaccccagaatggccgagttcatcggccagaccggcaccgtgcacagaatcaccgacagaggcgacgtgagagtgcagttcaaccacgagaccagatggaccttccaccccggcgccctgaccaagcaccacagcttctgggtgggcgacgtggtgagagtgatcggcgacctggacaccgtgaagagactgcaggccggccacggcgagtggaccgacgacatggcccccgccctgggcagagtgggcaaggtggtgaaggtgttcggcgacggcaacctgagagtggccgtggccggccagagatggaccttcagccccagctgcctggtggcctacagacccgaggaggacgccaacctggacgtggccgagagagccagagagaacaagagcagcctgagcgtggccctggacaagctgagagcccagaagagcgaccccgagcaccccggcagactggtggtggaggtggccctgggcaacgccgccagagccctggacctgctgagaagaagacccgagcaggtggacaccaagaaccagggcagaaccgccctgcaggtggccgcctacctgggccaggtggagctgatcagactgctgctgcaggccagagccggcgtggacctgcccgacgacgagggcaacaccgccctgcactacgccgccctgggcaaccagcccgaggccaccagagtgctgctgagcgccggctgcagagccgacgccatcaacagcacccagagcaccgccctgcacgtggccgtgcagagaggcttcctggaggtggtgagagccctgtgcgagagaggctgcgacgtgaacctgcccgacgcccacagcgacacccccctgcacagcgccatcagcgccggcaccggcgccagcggcatcgtggaggtgctgaccgaggtgcccaacatcgacgtgaccgccaccaacagccagggcttcaccctgctgcaccacgccagcctgaagggccacgccctggccgtgagaaagatcctggccagagccagacagctggtggacgccaagaaggaggacggcttcaccgccctgcacctggccgccctgaacaaccacagagaggtggcccagatcctgatcagagagggcagatgcgacgtgaacgtgagaaacagaaagctgcagagccccctgcacctggccgtgcagcaggcccacgtgggcctggtgcccctgctggtggacgccggctgcagcgtgaacgccgaggacgaggagggcgacaccgccctgcacgtggccctgcagagacaccagctgctgcccctggtggccgacggcgccggcggcgaccccggccccctgcagctgctgagcagactgcaggccagcggcctgcccggcagcgccgagctgaccgtgggcgccgccgtggcctgcttcctggccctggagggcgccgacgtgagctacaccaaccacagaggcagaagccccctggacctggccgccgagggcagagtgctgaaggccctgcagggctgcgcccagagattcagagagagacaggccggcggcggcgccgcccccggccccagacagaccctgggcacccccaacaccgtgaccaacctgcacgtgggcgccgcccccggccccgaggccgccgagtgcctggtgtgcagcgagctggccctgctggtgctgttcagcccctgccagcacagaaccgtgtgcgaggagtgcgccagaagaatgaagaagtgcatcagatgccaggtggtggtgagcaagaagctgagacccgacggcagcgaggtggccagcgccgcccccgcccccggcccccccagacagctggtggaggagctgcagagcagatacagacagatggaggagagaatcacctgccccatctgcatcgacagccacatcagactggtgttccagtgcggccacggcgcctgcgccccctgcggcagcgccctgagcgcctgccccatctgcagacagcccatcagagacagaatccagatcttcgtgtag

SEQ ID NO: 10439 - DNA, 2055 bp, Artificial Sequence
  Description of Artificial Sequence: Synthetic coding sequence
atgatccccccccaggaggccagcgccagaagaagagagatcgaggacaagctgaagcaggaggaggagaccctgagcttcatcagagacagcctggagaagagcgaccagctgaccaagaacatggtgagcatcctgagcagcttcgagagcagactgatgaagctggagaacagcatcatccccgtgcacaagcagaccgagaacctgcagagactgcaggagaacgtggagaagaccctgagctgcctggaccacgtgatcagctactaccacgtggccagcgacaccgagaagatcatcagagagggccccaccggcagactggaggagtacctgggcagcatggccaagatccagaaggccgtggagtacttccaggacaacagccccgacagccccgagctgaacaaggtgaagctgctgttcgagagaggcaaggaggccctggagagcgagttcagaagcctgatgaccagacacagcaaggtggtgagccccgtgctgatcctggacctgatcagcggcgacgacgacctggaggcccaggaggacgtgaccctggagcacctgcccgagagcgtgctgcaggacgtgatcagaatcagcagatggctggtggagtacggcagaaaccaggacttcatgaacgtgtactaccagatcagaagcagccagctggacagaagcatcaagggcctgaaggagcacttccacaagagcagcagcagcagcggcgtgccctacagccccgccatccccaacaagagaaaggacacccccaccaagaagcccgtgaagagacccggcaccatcagaaaggcccagaacctgctgaagcagtacagccagcacggcctggacggcaagaagggcggcagcaacctgatccccctggagggcagagacgacatgctggacgtggagaccgacgcctacatccactgcgtgagcgccttcgtgaagctggcccagagcgagtaccagctgctggccgacatcatccccgagcaccaccagaagaagaccttcgacagcctgatccaggacgccctggacggcctgatgctggagggcgagaacatcgtgagcgccgccagaaaggccatcgtgagacacgacttcagcaccgtgctgaccgtgttccccatcctgagacacctgaagcagaccaagcccgagttcgaccaggtgctgcagggcaccgccgccagcaccaagaacaagctgcccggcctgatcaccagcatggagaccatcggcgccaaggccctggaggacttcgccgacaacatcaagaacgaccccgacaaggagtacaacatgcccaaggacggcaccgtgcacgagctgaccagcaacgccatcctgttcctgcagcagctgctggacttccaggagaccgccggcgccatgctggccagccaggagaccagcagcagcgccaccagctacagcagcgagttcagcaagagactgctgagcacctacatctgcaaggtgctgggcaacctgcagctgaacctgctgagcaagagcaaggtgtacgaggaccccgccctgagcgccatcttcctgcacaacaactacaactacatcctgaagagcctggagaagagcgagctgatccagctggtggccgtgacccagaagaccgccgagagaagctacagagagcacatcgagcagcagatccagacctaccagagaagctggctgaaggtgaccgactacatcgccgagaagaacctgcccgtgttccagcccggcgtgaagctgagagacaaggagagacagatcatcaaggagagattcaagggcttcaacgacggcctggaggagctgtgcaagatccagaaggcctgggccatccccgacaccgagcagagagacagaatcagacaggcccagaagaccatcgtgaaggagacctacggcgccttcctgcagaagttcggcagcgtgcccttcaccaagaaccccgagaagtacatcaagtacggcgtggagcaggtgggcgacatgatcgacagactgttcgacaccagcgcctag

SEQ ID NO: 10440 - DNA, 3576 bp, Artificial Sequence
  Description of Artificial Sequence: Synthetic coding sequence
atgcccgtgcaggccgcccagtggaccgagttcctgagctgccccatctgctacaacgagttcgacgagaacgtgcacaagcccatcagcctgggctgcagccacaccgtgtgcaagacctgcctgaacaagctgcacagaaaggcctgccccttcgaccagaccgccatcaacaccgacatcgacgtgctgcccgtgaacttcgccctgctgcagctggtgggcgcccaggtgcccgaccaccagagcatcaagctgagcaacctgggcgagaacaagcactacgaggtggccaagaagtgcgtggaggacctggccctgtacctgaagcccctgagcggcggcaagggcgtggccagcctgaaccagagcgccctgagcagacccatgcagagaaagctggtgaccctggtgaactgccagctggtggaggaggagggcagagtgagagccatgagagccgccagaagcctgggcgagagaaccgtgaccgagctgatcctgcagcaccagaacccccagcagctgagcgccaacctgtgggccgccgtgagagccagaggctgccagttcctgggccccgccatgcaggaggaggccctgaagctggtgctgctggccctggaggacggcagcgccctgagcagaaaggtgctggtgctgttcgtggtgcagagactggagcccagattcccccaggccagcaagaccagcatcggccacgtggtgcagctgctgtacagagccagctgcttcaaggtgaccaagagagacgaggacagcagcctgatgcagctgaaggaggagttcagaagctacgaggccctgagaagagagcacgacgcccagatcgtgcacatcgccatggaggccggcctgagaatcagccccgagcagtggagcagcctgctgtacggcgacctggcccacaagagccacatgcagagcatcatcgacaagctgcagagccccgagagcttcgccaagagcgtgcaggagctgaccatcgtgctgcagagaaccggcgaccccgccaacctgaacagactgagaccccacctggagctgctggccaacatcgaccccaaccccgacgccgtgagccccacctgggagcagctggagaacgccatggtggccgtgaagaccgtggtgcacggcctggtggacttcatccagaactacagcagaaagggccacgagaccccccagccccagcccaacagcaagtacaagaccagcatgtgcagagacctgagacagcagggcggctgccccagaggcaccaactgcaccttcgcccacagccaggaggagctggagaagtacagactgagaaacaagaagatcaacgccaccgtgagaaccttccccctgctgaacaaggtgggcgtgaacaacaccgtgaccaccaccgccggcaacgtgatcagcgtgatcggcagcaccgagaccaccggcaagatcgtgcccagcaccaacggcatcagcaacgccgagaacagcgtgagccagctgatcagcagaagcaccgacagcaccctgagagccctggagaccgtgaagaaggtgggcaaggtgggcgccaacggccagaacgccgccggccccagcgccgacagcgtgaccgagaacaagatcggcagcccccccaagacccccgtgagcaacgtggccgccaccagcgccggccccagcaacgtgggcaccgagctgaacagcgtgccccagaagagcagccccttcctgaccagagtgcccgtgtaccccccccacagcgagaacatccagtacttccaggaccccagaacccagatccccttcgaggtgccccagtacccccagaccggctactacccccccccccccaccgtgcccgccggcgtggccccctgcgtgcccagattcgtgagaagcaacaacgtgcccgagagcagcctgccccccgccagcatgccctacgccgaccactacagcaccttcagccccagagacagaatgaacagcagcccctaccagcccccccccccccagccctacggccccgtgccccccgtgcccagcggcatgtacgcccccgtgtacgacagcagaagaatctggagaccccccatgtaccagagagacgacatcatcagaagcaacagcctgccccccatggacgtgatgcacagcagcgtgtaccagaccagcctgagagagagatacaacagcctggacggctactacagcgtggcctgccagccccccagcgagcccagaaccaccgtgcccctgcccagagagccctgcggccacctgaagaccagctgcgaggagcagatcagaagaaagcccgaccagtgggcccagtaccacacccagaaggcccccctggtgagcagcaccctgcccgtggccacccagagccccaccccccccagccccctgttcagcgtggacttcagagccgacttcagcgagagcgtgagcggcaccaagttcgaggaggaccacctgagccactacagcccctggagctgcggcaccatcggcagctgcatcaacgccatcgacagcgagcccaaggacgtgatcgccaacagcaacgccgtgctgatggacctggacagcggcgacgtgaagagaagagtgcacctgttcgagacccagagaagaaccaaggaggaggaccccatcatccccttcagcgacggccccatcatcagcaagtggggcgccatcagcagaagcagcagaaccggctaccacaccaccgaccccgtgcaggccaccgccagccagggcagcgccaccaagcccatcagcgtgagcgactacgtgccctacgtgaacgccgtggacagcagatggagcagctacggcaacgaggccaccagcagcgcccactacgtggagagagacagattcatcgtgaccgacctgagcggccacagaaagcacagcagcaccggcgacctgctgagcctggagctgcagcaggccaagagcaacagcctgctgctgcagagagaggccaacgccctggccatgcagcagaagtggaacagcctggacgagggcagacacctgaccctgaacctgctgagcaaggagatcgagctgagaaacggcgagctgcagagcgactacaccgaggacgccaccgacaccaagcccgacagagacatcgagctggagctgagcgccctggacaccgacgagcccgacggccagagcgagcccatcgaggagatcctggacatccagctgggcatcagcagccagaacgaccagctgctgaacggcatggccgtggagaacggccaccccgtgcagcagcaccagaaggagccccccaagcagaagaagcagagcctgggcgaggaccacgtgatcctggaggagcagaagaccatcctgcccgtgaccagctgcttcagccagcccctgcccgtgagcatcagcaacgccagctgcctgcccatcaccaccagcgtgagcgccggcaacctgatcctgaagacccacgtgatgagcgaggacaagaacgacttcctgaagcccgtggccaacggcaagatggtgaacagctag

SEQ ID NO: 10441 - DNA, 2100 bp, Artificial Sequence
  Description of Artificial Sequence: Synthetic coding sequence
atgtgcggcatcttcgcctacctgaactaccacgtgcccagaaccagaagagagatcctggagaccctgatcaagggcctgcagagactggagtacagaggctacgacagcgccggcgtgggcttcgacggcggcaacgacaaggactgggaggccaacgcctgcaagatccagctgatcaagaagaagggcaaggtgaaggccctggacgaggaggtgcacaagcagcaggacatggacctggacatcgagttcgacgtgcacctgggcatcgcccacaccagatgggccacccacggcgagcccagccccgtgaacagccacccccagagaagcgacaagaacaacgagttcatcgtgatccacaacggcatcatcaccaactacaaggacctgaagaagttcctggagagcaagggctacgacttcgagagcgagaccgacaccgagaccatcgccaagctggtgaagtacatgtacgacaacagagagagccaggacaccagcttcaccaccctggtggagagagtgatccagcagctggagggcgccttcgccctggtgttcaagagcgtgcacttccccggccaggccgtgggcaccagaagaggcagccccctgctgatcggcgtgagaagcgagcacaagctgagcaccgaccacatccccatcctgtacagaaccgccagaacccagatcggcagcaagttcaccagatggggcagccagggcgagagaggcaaggacaagaagggcagctgcaacctgagcagagtggacagcaccacctgcctgttccccgtggaggagaaggccgtggagtactacttcgccagcgacgccagcgccgtgatcgagcacaccaacagagtgatcttcctggaggacgacgacgtggccgccgtggtggacggcagactgagcatccacagaatcaagagaaccgccggcgaccaccccggcagagccgtgcagaccctgcagatggagctgcagcagatcatgaagggcaacttcagcagcttcatgcagaaggagatcttcgagcagcccgagagcgtggtgaacaccatgagaggcagagtgaacttcgacgactacaccgtgaacctgggcggcctgaaggaccacatcaaggagatccagagatgcagaagactgatcctgatcgcctgcggcaccagctaccacgccggcgtggccaccagacaggtgctggaggagctgaccgagctgcccgtgatggtggagctggccagcgacttcctggacagaaacacccccgtgttcagagacgacgtgtgcttcttcctgagccagagcggcgagaccgccgacaccctgatgggcctgagatactgcaaggagagaggcgccctgaccgtgggcatcaccaacaccgtgggcagcagcatcagcagagagaccgactgcggcgtgcacatcaacgccggccccgagatcggcgtggccagcaccaaggcctacaccagccagttcgtgagcctggtgatgttcgccctgatgatgtgcgacgacagaatcagcatgcaggagagaagaaaggagatcatgctgggcctgaagagactgcccgacctgatcaaggaggtgctgagcatggacgacgagatccagaagctggccaccgagctgtaccaccagaagagcgtgctgatcatgggcagaggctaccactacgccacctgcctggagggcgccctgaagatcaaggagatcacctacatgcacagcgagggcatcctggccggcgagctgaagcacggccccctggccctggtggacaagctgatgcccgtgatcatgatcatcatgagagaccacacctacgccaagtgccagaacgccctgcagcaggtggtggccagacagggcagacccgtggtgatctgcgacaaggaggacaccgagaccatcaagaacaccaagagaaccatcaaggtgccccacagcgtggactgcctgcagggcatcctgagcgtgatccccctgcagctgctggccttccacctggccgtgctgagaggctacgacgtggacttccccagaaacctggccaagagcgtgaccgtggagtag

SEQ ID NO: 10442 - DNA, 2067 bp, Artificial Sequence
  Description of Artificial Sequence: Synthetic coding sequence
atgagcgtgaacagcgagaagagcagcagcagcgagagacccgagccccagcagaaggcccccctggtgcccccccccccccccccccccccccccccccccccccccctgcccgaccccaccccccccgagcccgaggaggagatcctgggcagcgacgacgaggagcaggaggaccccgccgactactgcaagggcggctaccaccccgtgaagatcggcgacctgttcaacggcagataccacgtgatcagaaagctgggctggggccacttcagcaccgtgtggctgtgctgggacatgcagggcaagagattcgtggccatgaaggtggtgaagagcgcccagcactacaccgagaccgccctggacgagatcaagctgctgaagtgcgtgagagagagcgaccccagcgaccccaacaaggacatggtggtgcagctgatcgacgacttcaagatcagcggcatgaacggcatccacgtgtgcatggtgttcgaggtgctgggccaccacctgctgaagtggatcatcaagagcaactaccagggcctgcccgtgagatgcgtgaagagcatcatcagacaggtgctgcagggcctggactacctgcacagcaagtgcaagatcatccacaccgacatcaagcccgagaacatcctgatgtgcgtggacgacgcctacgtgagaagaatggccgccgaggccaccgagtggcagaaggccggcgcccccccccccagcggcagcgccgtgagcaccgccccccagcagaagcccatcggcaagatcagcaagaacaagaagaagaagctgaagaagaagcagaagagacaggccgagctgctggagaagagactgcaggagatcgaggagctggagagagaggccgagagaaagatcatcgaggagaacatcaccagcgccgcccccagcaacgaccaggacggcgagtactgccccgaggtgaagctgaagaccaccggcctggaggaggccgccgaggccgagaccgccaaggacaacggcgaggccgaggaccaggaggagaaggaggacgccgagaaggagaacatcgagaaggacgaggacgacgtggaccaggagctggccaacatcgaccccacctggatcgagagccccaagaccaacggccacatcgagaacggccccttcagcctggagcagcagctggacgacgaggacgacgacgaggaggactgccccaaccccgaggagtacaacctggacgagcccaacgccgagagcgactacacctacagcagcagctacgagcagttcaacggcgagctgcccaacggcagacacaagatccccgagagccagttccccgagttcagcaccagcctgttcagcggcagcctggagcccgtggcctgcggcagcgtgctgagcgagggcagccccctgaccgagcaggaggagagcagccccagccacgacagaagcagaaccgtgagcgccagcagcaccggcgacctgcccaaggccaagaccagagccgccgacctgctggtgaaccccctggaccccagaaacgccgacaagatcagagtgaagatcgccgacctgggcaacgcctgctgggtgcacaagcacttcaccgaggacatccagaccagacagtacagaagcatcgaggtgctgatcggcgccggctacagcacccccgccgacatctggagcaccgcctgcatggccttcgagctggccaccggcgactacctgttcgagccccacagcggcgaggactacagcagagacgaggaccacatcgcccacatcatcgagctgctgggcagcatccccagacacttcgccctgagcggcaagtacagcagagagttcttcaacagaagaggcgagctgagacacatcaccaagctgaagccctggagcctgttcgacgtgctggtggagaagtacggctggccccacgaggacgccgcccagttcaccgacttcctgatccccatgctggagatggtgcccgagaagagagccagcgccggcgagtgcctgagacacccctggctgaacagctag

SEQ ID NO: 10443 - DNA, 1308 bp, Artificial Sequence
  Description of Artificial Sequence: Synthetic coding sequence
atgagcggctaccagagaagacccggcgccacccccctgagcagagccagaagcctggccatccccgacgcccccgccttctacgagagaagaagctgcctgccccagctgaactgcgagagaccccacggcagagacctggacagccccttcttcggcatcagacccgccttcatgtgctacgtgcccagccccgtgctggccagcgtgggcgacaccgacttcggctacggcaagggcaagtgcagcaagcagagccccagcggcgcccacggcacccacttcggcgacgacagattcgaggacctggaggaggccaaccccttcagcttcagagagttcctgaagaccaagaacctgggcctgagcaaggaggaccccgccagcagaatctacgccaaggaggccagcagacacagcctgggcctggaccacaacagcccccccagccagaccggcggctacggcctggagtaccagcagcccttcttcgaggaccccaccggcgccggcgacctgctggacgaggaggaggacgaggacaccggctggagcggcgcctacctgcccagcgccatcgagcagacccaccccgagagagtgcccgccggcaccagcccctgcagcacctacctgagcttcttcagcacccccagcgagctggccggccccgagagcctgcccagctgggccctgagcgacaccgacagcagagtgagccccgccagccccgccggcagccccagcgccgacttcgccgtgcacggcgagagcctgggcgacagacacctgagaaccctgcagatcagctacgacgccctgaaggacgagaacagcaagctgagaagaaagctgaacgaggtgcagagcttcagcgaggcccagaccgagatggtgagaaccctggagagaaagctggaggccaagatgatcaaggaggagagcgactaccacgacctggagagcgtggtgcagcaggtggagcagaacctggagctgatgaccaagagagccgtgaaggccgagaaccacgtggtgaagctgaagcaggagatcagcctgctgcaggcccaggtgagcaacttccagagagagaacgaggccctgagatgcggccagggcgccagcctgaccgtggtgaagcagaacgccgacgtggccctgcagaacctgagagtggtgatgaacagcgcccaggccagcatcaagcagctggtgagcggcgccgagaccctgaacctggtggccgagatcctgaagagcatcgacagaatcagcgaggtgaaggacgaggaggaggacagctag

SEQ ID NO: 10444 - DNA, 591 bp, Artificial Sequence
  Description of Artificial Sequence: Synthetic coding sequence
atgaaggtgaagatcaagtgctggaacggcgtggccacctggctgtgggtggccaacgacgagaactgcggcatctgcagaatggccttcaacggctgctgccccgactgccccctgcacggcgagagcatcagcagatgcctgggctggtgcccccagcccgtgcccgtgctgggcggcagagcccacccccaggtgcccatcaacaccgccagccccacccccggccagcacaccggcagcctgatgagcagagaggagagcagcagaagccccgaccccaccccccccgccctggaccaggagaccagcagcctgctgagatgcaccagcccctggtgcctggaccacagctgcgacctgttcggcatcaccgaccaggtgagcgccgacggccccagagcctgcagacagggcgccagaagaagactgcccgccggcgtgggccccgtgctgcccctgctgccccacgccctgcacccccaggtggccgccagaaccgccggcgccgccgccctgccccacgtgccccccggcatggaggtgcagggcgtgagacccgacctggccctggccggcggcgccagctag

SEQ ID NO: 10445 - DNA, 5127 bp, Artificial Sequence
  Description of Artificial Sequence: Synthetic coding sequence
atggccgccatcggcagaggcagaagcctgaagaacctgagagtgagaggcagaaacgacagcggcgaggagaacgtgcccctggacctgaccagagagcccagcgacaacctgagagagatcctgcagaacgtggccagactgcagggcgtgagcaacatgagaaagctgggccacctgaacaacttcaccaagctgctgtgcgacatcggccacagcgaggagaagctgggcttccactacgaggacatcatcatctgcctgagactggccctgctgaacgaggccaaggaggtgagagccgccggcctgagagccctgagatacctgatccaggacagcagcatcctgcagaaggtgctgaagctgaaggtggactacctgatcgccagatgcatcgacatccagcagagcaacgaggtggagagaacccaggccctgagactggtgagaaagatgatcaccgtgaacgccagcctgttccccagcagcgtgaccaacagcctgatcgccgtgggcaacgacggcctgcaggagagagacagaatggtgagagcctgcatcgccatcatctgcgagctggccctgcagaaccccgaggtggtggccctgagaggcggcctgaacaccatcctgaagaacgtgatcgactgccagctgagcagaatcaacgaggccctgatcaccaccatcctgcacctgctgaaccaccccaagaccagacagtacgtgagagccgacgtggagctggagagaatcctggccccctacaccgacttccactacagacacagccccgacaccgccgagggccagctgaaggaggacagagaggccagattcctggccagcaagatgggcatcatcgccaccttcagaagctgggccggcatcatcaacctgtgcaagcccggcaacagcggcatccagagcctgatcggcgtgctgtgcatccccaacatggagatcagaagaggcctgctggaggtgctgtacgacatcttcagactgcccctgcccgtggtgaccgaggagttcatcgaggccctgctgagcgtggaccccggcagattccaggacagctggagactgagcgacggcttcgtggccgccgaggccaagaccatcctgccccacagagccagaagcagacccgacctgatggacaactacctggccctgatcctgagcgccttcatcagaaacggcctgctggagggcctggtggaggtgatcaccaacagcgacgaccacatcagcgtgagagccaccatcctgctgggcgagctgctgcacatggccaacaccatcctgccccacagccacagccaccacctgcactgcctgcccaccctgatgaacatggccgccagcttcgacatccccaaggagaagagactgagagccagcgccgccctgaactgcctgaagagattccacgagatgaagaagagaggccccaagccctacagcctgcacctggaccacatcatccagaaggccatcgccacccaccagaagagagaccagtacctgagagtgcagaaggacatcttcatcctgaaggacaccgaggaggccctgctgatcaacctgagagacagccaggtgctgcagcacaaggagaacctggagtggaactggaacctgatcggcaccatcctgaagtggcccaacgtgaacctgagaaactacaaggacgagcagctgcacagattcgtgagaagactgctgtacttctacaagcccagcagcaagctgtacgccaacctggacctggacttcgccaaggccaagcagctgaccgtggtgggctgccagttcaccgagttcctgctggagagcgaggaggacggccagggctacctggaggacctggtgaaggacatcgtgcagtggctgaacgccagcagcggcatgaagcccgagagaagcctgcagaacaacggcctgctgaccaccctgagccagcactacttcctgttcatcggcaccctgagctgccacccccacggcgtgaagatgctggagaagtgcagcgtgttccagtgcctgctgaacctgtgcagcctgaagaaccaggaccacctgctgaagctgaccgtgagcagcctggactacagcagagacggcctggccagagtgatcctgagcaagatcctgaccgccgccaccgacgcctgcagactgtacgccaccaagcacctgagagtgctgctgagagccaacgtggagttcttcaacaactggggcatcgagctgctggtgacccagctgcacgacaagaacaagaccatcagcagcgaggccctggacatcctggacgaggcctgcgaggacaaggccaacctgcacgccctgatccagatgaagcccgccctgagccacctgggcgacaagggcctgctgctgctgctgagattcctgagcatccccaagggcttcagctacctgaacgagagaggctacgtggccaagcagctggagaagtggcacagagagtacaacagcaagtacgtggacctgatcgaggagcagctgaacgaggccctgaccacctacagaaagcccgtggacggcgacaactacgtgagaagaagcaaccagagactgcagagaccccacgtgtacctgcccatccacctgtacggccagctggtgcaccacaagaccggctgccacctgctggaggtgcagaacatcatcaccgagctgtgcagaaacgtgagaacccccgacctggacaagtgggaggagatcaagaagctgaaggccagcctgtgggccctgggcaacatcggcagcagcaactggggcctgaacctgctgcaggaggagaacgtgatccccgacatcctgaagctggccaagcagtgcgaggtgctgagcatcagaggcacctgcgtgtacgtgctgggcctgatcgccaagaccaagcagggctgcgacatcctgaagtgccacaactgggacgccgtgagacacagcagaaagcacctgtggcccgtggtgcccgacgacgtggagcagctgtgcaacgagctgagcagcatccccagcaccctgagcctgaacagcgagagcaccagcagcagacacaacagcgagagcgagagcgtgcccagcagcatgttcatcctggaggacgacagattcggcagcagcagcaccagcaccttcttcctggacatcaacgaggacaccgagcccaccttctacgacagaagcggccccatcaaggacaagaacagcttccccttcttcgccagcagcaagctggtgaagaacagaatcctgaacagcctgaccctgcccaacaagaagcacagaagcagcagcgaccccaagggcggcaagctgagcagcgagagcaagaccagcaacagaagaatcagaaccctgaccgagcccagcgtggacttcaaccacagcgacgacttcacccccatcagcaccgtgcagaagaccctgcagctggagaccagcttcatgggcaacaagcacatcgaggacaccggcagcacccccagcatcggcgagaacgacctgaagttcaccaagaacttcggcaccgagaaccacagagagaacaccagcagagagagactggtggtggagagcagcaccagcagccacatgaagatcagaagccagagcttcaacaccgacaccaccaccagcggcatcagcagcatgagcagcagccccagcagagagaccgtgggcgtggacgccaccaccatggacaccgactgcggcagcatgagcaccgtggtgagcaccaagaccatcaagaccagccactacctgaccccccagagcaaccacctgagcctgagcaagagcaacagcgtgagcctggtgccccccggcagcagccacaccctgcccagaagagcccagagcctgaaggcccccagcatcgccaccatcaagagcctggccgactgcaacttcagctacaccagcagcagagacgccttcggctacgccaccctgaagagactgcagcagcagagaatgcaccccagcctgagccacagcgaggccctggccagccccgccaaggacgtgctgttcaccgacaccatcaccatgaaggccaacagcttcgagagcagactgacccccagcagattcatgaaggccctgagctacgccagcctggacaaggaggacctgctgagccccatcaaccagaacaccctgcagagaagcagcagcgtgagaagcatggtgagcagcgccacctacggcggcagcgacgactacatcggcctggccctgcccgtggacatcaacgacatcttccaggtgaaggacatcccctacttccagaccaagaacatccccccccacgacgacagaggcgccagagccttcgcccacgacgccggcggcctgcccagcggcaccggcggcctggtgaagaacagcttccacctgctgagacagcagatgagcctgaccgagatcatgaacagcatccacagcgacgccagcctgttcctggagagcaccgaggacaccggcctgcaggagcacaccgacgacaactgcctgtactgcgtgtgcatcgagatcctgggcttccagcccagcaaccagctgagcgccatctgcagccacagcgacttccaggacatcccctacagcgactggtgcgagcagaccatccacaaccccctggaggtggtgcccagcaagttcagcggcatcagcggctgcagcgacggcgtgagccaggagggcagcgccagcagcaccaagagcaccgagctgctgctgggcgtgaagaccatccccgacgacacccccatgtgcagaatcctgctgagaaaggaggtgctgagactggtgatcaacctgagcagcagcgtgagcaccaagtgccacgagaccggcctgctgaccatcaaggagaagtacccccagaccttcgacgacatctgcctgtacagcgaggtgagccacctgctgagccactgcaccttcagactgccctgcagaagattcatccaggagctgttccaggacgtgcagttcctgcagatgcacgaggaggccgaggccgtgctggccaccccccccaagcagcccatcgtggacaccagcgccgagagctag

SEQ ID NO: 10446 - DNA, 3867 bp, Artificial Sequence; identical to SEQ ID NO: 10291
  Description of Artificial Sequence: Synthetic coding sequence

SEQ ID NO: 10447 - DNA, 2829 bp, Artificial Sequence
  Description of Artificial Sequence: Synthetic coding sequence
atgaccggcagcaacagccacatcaccatcctgaccctgaaggtgctgccccacttcgagagcctgggcaagcaggagaagatccccaacaagatgagcgccttcagaaaccactgcccccacctggacagcgtgggcgagatcaccaaggaggacctgatccagaagagcctgggcacctgccaggactgcaaggtgcagggccccaacctgtgggcctgcctggagaacagatgcagctacgtgggctgcggcgagagccaggtggaccacagcaccatccacagccaggagaccaagcactacctgaccgtgaacctgaccaccctgagagtgtggtgctacgcctgcagcaaggaggtgttcctggacagaaagctgggcacccagcccagcctgccccacgtgagacagccccaccagatccaggagaacagcgtgcaggacttcaagatccccagcaacaccaccctgaagacccccctggtggccgtgttcgacgacctggacatcgaggccgacgaggaggacgagctgagagccagaggcctgaccggcctgaagaacatcggcaacacctgctacatgaacgccgccctgcaggccctgagcaactgcccccccctgacccagttcttcctggactgcggcggcctggccagaaccgacaagaagcccgccatctgcaagagctacctgaagctgatgaccgagctgtggcacaagagcagacccggcagcgtggtgcccaccaccctgttccagggcatcaagaccgtgaaccccaccttcagaggctacagccagcaggacgcccaggagttcctgagatgcctgatggacctgctgcacgaggagctgaaggagcaggtgatggaggtggaggaggacccccagaccatcaccaccgaggagaccatggaggaggacaagagccagagcgacgtggacttccagagctgcgagagctgcagcaacagcgacagagccgagaacgagaacggcagcagatgcttcagcgaggacaacaacgagaccaccatgctgatccaggacgacgagaacaacagcgagatgagcaaggactggcagaaggagaagatgtgcaacaagatcaacaaggtgaacagcgagggcgagttcgacaaggacagagacagcatcagcgagaccgtggacctgaacaaccaggagaccgtgaaggtgcagatccacagcagagccagcgagtacatcaccgacgtgcacagcaacgacctgagcaccccccagatcctgcccagcaacgagggcgtgaaccccagactgagcgccagcccccccaagagcggcaacctgtggcccggcctggcccccccccacaagaaggcccagagcgccagccccaagagaaagaagcagcacaagaagtacagaagcgtgatcagcgacatcttcgacggcaccatcatcagcagcgtgcagtgcctgacctgcgacagagtgagcgtgaccctggagaccttccaggacctgagcctgcccatccccggcaaggaggacctggccaagctgcacagcagcagccaccccaccagcatcgtgaaggccggcagctgcggcgaggcctacgccccccagggctggatcgccttcttcatggagtacgtgaagagattcgtggtgagctgcgtgcccagctggttctggggccccgtggtgaccctgcaggactgcctggccgccttcttcgccagagacgagctgaagggcgacaacatgtacagctgcgagaagtgcaagaagctgagaaacggcgtgaagttctgcaaggtgcagaacttccccgagatcctgtgcatccacctgaagagattcagacacgagctgatgttcagcaccaagatcagcacccacgtgagcttccccctggagggcctggacctgcagcccttcctggccaaggacagccccgcccagatcgtgacctacgacctgctgagcgtgatctgccaccacggcaccgccagcagcggccactacatcgcctactgcagaaacaacctgaacaacctgtggtacgagttcgacgaccagagcgtgaccgaggtgagcgagagcaccgtgcagaacgccgaggcctacgtgctgttctacagaaagagcagcgaggaggcccagaaggagagaagaagaatcagcaacctgctgaacatcatggagcccagcctgctgcagttctacatcagcagacagtggctgaacaagttcaagaccttcgccgagcccggccccatcagcaacaacgacttcctgtgcatccacggcggcgtgccccccagaaaggccggctacatcgaggacctggtgctgatgctgccccagaacatctgggacaacctgtacagcagatacggcggcggccccgccgtgaaccacctgtacatctgccacacctgccagatcgaggccgagaagatcgagaagagaagaaagaccgagctggagatcttcatcagactgaacagagccttccagaaggaggacagccccgccaccttctactgcatcagcatgcagtggttcagagagtgggagagcttcgtgaagggcaaggacggcgacccccccggccccatcgacaacaccaagatcgccgtgaccaagtgcggcaacgtgatgctgagacagggcgccgacagcggccagatcagcgaggagacctggaacttcctgcagagcatctacggcggcggccccgaggtgatcctgagaccccccgtggtgcacgtggaccccgacatcctgcaggccgaggagaagatcgaggtggagaccagaagcctgtag

SEQ ID NO: 10448 - DNA, 2106 bp, Artificial Sequence
  Description of Artificial Sequence: Synthetic coding sequence
atgatgaagagacagctgcacagaatgagacagctggcccagaccggcagcctgggcagaacccccgagaccgccgagttcctgggcgaggacctgctgcaggtggagcagagactggagcccgccaagagagccgcccacaacatccacaagagactgcaggcctgcctgcagggccagagcggcgccgacatggacaagagagtgaagaagctgcccctgatggccctgagcaccaccatggccgagagcttcaaggagctggaccccgacagcagcatgggcaaggccctggagatgagctgcgccatccagaaccagctggccagaatcctggccgagttcgagatgaccctggagagagacgtgctgcagcccctgagcagactgagcgaggaggagctgcccgccatcctgaagcacaagaagagcctgcagaagctggtgagcgactggaacaccctgaagagcagactgagccaggccaccaagaacagcggcagcagccagggcctgggcggcagccccggcagccacagccacaccaccatggccaacaaggtggagaccctgaaggaggaggaggaggagctgaagagaaaggtggagcagtgcagagacgagtacctggccgacctgtaccacttcgtgaccaaggaggacagctacgccaactacttcatcagactgctggagatccaggccgactaccacagaagaagcctgagcagcctggacaccgccctggccgagctgagagagaaccacggccaggccgaccacagccccagcatgaccgccacccacttccccagagtgtacggcgtgagcctggccacccacctgcaggagctgggcagagagatcgccctgcccatcgaggcctgcgtgatgatgctgctgagcgagggcatgaaggaggagggcctgttcagactggccgccggcgccagcgtgctgaagagactgaagcagaccatggccagcgacccccacagcctggaggagttctgcagcgacccccacgccgtggccggcgccctgaagagctacctgagagagctgcccgagcccctgatgaccttcgacctgtacgacgactggatgagagccgccagcctgaaggagcccggcgccagactgcaggccctgcaggaggtgtgcagcagactgccccccgagaacctgagcaacctgagatacctgatgaagttcctggccagactggccgaggagcaggaggtgaacaagatgacccccagcaacatcgccatcgtgctgggccccaacctgctgtggccccccgagaaggagggcgaccaggcccagctggacgccgccagcgtgagcagcatccaggtggtgggcgtggtggaggccctgatccagagcgccgacaccctgttccccggcgacatcaacttcaacgtgagcggcctgttcagcgccgtgaccctgcaggacaccgtgagcgacagactggccagcgaggagctgcccagcaccgccgtgcccacccccgccaccacccccgcccccgcccccgcccccgcccccgcccccgcccccgccctggccagcgccgccaccaaggagagaaccgagagcgaggtgccccccagacccgccagccccaaggtgaccagaagcccccccgagaccgccgcccccgtggaggacatggccagaagaaccaagagacccgcccccgccagacccaccatgccccccccccaggtgagcggcagcagaagcagcccccccgccccccccctgccccccggcagcggcagccccggcaccccccaggccctgcccagaagactggtgggcagcagcctgagagcccccaccgtgcccccccccctgccccccacccccccccagcccgccagaagacagagcagaagaagccccgccagccccagccccgccagccccggccccgccagccccagccccgtgagcctgagcaaccccgcccaggtggacctgggcgccgccaccgccgagggcggcgcccccgaggccatcagcggcgtgcccaccccccccgccatccccccccagcccagacccagaagcctggccagcgagaccaactag

SEQ ID NO: 10449 - DNA, 1818 bp, Artificial Sequence
  Description of Artificial Sequence: Synthetic coding sequence
atggaggtgagagccagcctgcagaagatcgtgagcaacggcgacgagcagctggagaaggccatggaggagatcctgagagacagcgagaagagacccagcagcctgctggtggactgccagagcagcagcgagatcagcgaccacagcttcggcgacatccccgccagccagaccaacaagcccagcctgcagctgatcctggaccccagcaacaccgagatcagcacccccagacccagcagccccggcggcctgcccgaggaggacagcgtgctgttcaacaagctgacctacctgggctgcatgaaggtgagcagccccagaaacgaggtggaggccctgagagccatggccaccatgaagagcagcagccagtaccccttccccgtgaccctgtacgtgcccaacgtgcccgagggcagcgtgagaatcatcgaccagagcagcaacgtggagatcgccagcttccccatctacaaggtgctgttctgcgccagaggccacgacggcaccaccgagagcaactgcttcgccttcaccgagagcagccacggcagcgaggagttccagatccacgtgttcagctgcgagatcaaggaggccgtgagcagaatcctgtacagcttctgcaccgccttcaagagaagcagcagacaggtgagcgacgtgaaggacagcgtgatccccacccccgacagcgacgtgttcaccttcagcgtgagcctggaggtgaaggaggacgacggcaagggcaacttcagccccgtgcccaaggacagagacaagttctacttcaagctgaagcagggcatcgagaagaaggtggtgatcaccgtgcagcagctgagcaacaaggagctggccatcgagagatgcttcggcatgctgctgagccccggcagaaacgtgaagaacagcgacatgcacctgctggacatggagagcatgggcaagagctacgacggcagagcctacgtgatcaccggcatgtggaaccccaacgcccccgtgttcctggccctgaacgaggagacccccaaggacaagcaggtgtacatgaccgtggccgtggacatggtggtgaccgaggtggtggagcccgtgagattcctgctggagaccgtggtgagagtgtaccccgccaacgagagattctggtacttcagcagaaagaccttcaccgagaccttcttcatgagactgaagcagagcgagggcaagggccacaccaacgccggcgacgccatctacgaggtggtgagcctgcagagagagagcgacaaggaggagcccgtgacccccaccagcggcggcggccccatgagcccccaggacgacgaggccgaggaggagagcgacaacgagctgagcagcggcaccggcgacgtgagcaaggactgccccgagaagatcctgtacagctggggcgagctgctgggcaagtggcacagcaacctgggcgccagacccaagggcctgagcaccctggtgaagagcggcgtgcccgaggccctgagagccgaggtgtggcagctgctggccggctgccacgacaaccaggccatgctggacagatacagaatcctgatcaccaagcagcagatgaagttcagcctgacccccagacagaccatccacctggtgaagtacgagggcagcatgaaggtgagcatgaccccctgcaaccagctgcagttcgacatcagactggacgtgctgatcacctacaccttctgcttcagcagcttccccgagcccgagctgtacaagtacgtgctgaagcaccagctgatcaagagactgaacgcctgctag

SEQ ID NO: 10450 - DNA, 3120 bp, Artificial Sequence
  Description of Artificial Sequence: Synthetic coding sequence
atggccgtgcagctggtgcccgacagcgccctgggcctgctgatgatgaccgagggcagaagatgccaggtgcacctgctggacgacagaaagctggagctgctggtgcagcccaagctgctggccaaggagctgctggacctggtggccagccacttcaacctgaaggagaaggagtacttcggcatcgccttcaccgacgagaccggccacctgaactggctgcagctggacagaagagtgctggagcacgacttccccaagaagagcggccccgtggtgctgtacttctgcgtgagattctacatcgagagcatcagctacctgaaggacaacgccaccatcgagctgttcttcctgaacgccaagagctgcatctacaaggagctgatcgacgtggacagcgaggtggtgttcgagctggccagctacatcctgcaggaggccaagggcgacttcagcagcaacgaggtggtgagaagcgacctgaagaagctgcccgccctgcccacccaggccctgaaggagcaccccagcctggcctactgcgaggacagagtgatcgagcactacaagaagctgaacggccagaccagaggccaggccatcgtgaactacatgagcatcgtggagagcctgcccacctacggcgtgcactactacgccgtgaaggacaagcagggcatcccctggtggctgggcctgagctacaagggcatcttccagtacgactaccacgacaaggtgaagcccagaaagatcttccagtggagacagctggagaacctgtacttcagagagaagaagttcagcgtggaggtgcacgaccccagaagagccagcgtgaccagaagaaccttcggccacagcggcatcgccgtgcacacctggtacgcctgccccgccctgatcaagagcatctgggccatggccatcagccagcaccagttctacctggacagaaagcagagcaagagcaagatccacgccgccagaagcctgagcgagatcgccatcgacctgaccgagaccggcaccctgaagaccagcaagctggccaacatgggcagcaagggcaagatcatcagcggcagcagcggcagcctgctgagcagcggcagccaggagagcgacagcagccagagcgccaagaaggacatgctggccgccctgaagagcagacaggaggccctggaggagaccctgagacagagactggaggagctgaagaagctgtgcctgagagaggccgagctgaccggcaagctgcccgtggagtaccccctggaccccggcgaggagccccccatcgtgagaagaagaatcggcaccgccttcaagctggacgagcagaagatcctgcccaagggcgaggaggccgagctggagagactggagagagagttcgccatccagagccagatcaccgaggccgccagaagactggccagcgaccccaacgtgagcaagaagctgaagaagcagagaaagaccagctacctgaacgccctgaagaagctgcaggagatcgagaacgccatcaacgagaacagaatcaagagcggcaagaagcccacccagagagccagcctgatcatcgacgacggcaacatcgccagcgaggacagcagcctgagcgacgccctggtgctggaggacgaggacagccaggtgaccagcaccatcagccccctgcacagcccccacaagggcctgccccccagaccccccagccacaacagacccccccccccccagagcctggagggcctgagacagatgcactaccacagaaacgactacgacaagagccccatcaagcccaagatgtggagcgagagcagcctggacgagccctacgagaaggtgaagaagagaagcagccacagccacagcagcagccacaagagattccccagcaccggcagctgcgccgaggccggcggcggcagcaacagcctgcagaacagccccatcagaggcctgccccactggaacagccagagcagcatgcccagcacccccgacctgagagtgagaagcccccactacgtgcacagcaccagaagcgtggacatcagccccaccagactgcacagcctggccctgcacttcagacacagaagcagcagcctggagagccagggcaagctgctgggcagcgagaacgacaccggcagccccgacttctacacccccagaaccagaagcagcaacggcagcgaccccatggacgactgcagcagctgcaccagccacagcagcagcgagcactactaccccgcccagatgaacgccaactacagcaccctggccgaggacagccccagcaaggccagacagagacagagacagagacagagagccgccggcgccctgggcagcgccagcagcggcagcatgcccaacctggccgccagaggcggcgccggcggcgccggcggcgccggcggcggcgtgtacctgcacagccagagccagcccagcagccagtacagaatcaaggagtaccccctgtacatcgagggcggcgccacccccgtggtggtgagaagcctggagagcgaccaggagggccactacagcgtgaaggcccagttcaagaccagcaacagctacaccgccggcggcctgttcaaggagagctggagaggcggcggcggcgacgagggcgacaccggcagactgacccccagcagaagccagatcctgagaacccccagcctgggcagagagggcgcccacgacaagggcgccggcagagccgccgtgagcgacgagctgagacagtggtaccagagaagcaccgccagccacaaggagcacagcagactgagccacaccagcagcaccagcagcgacagcggcagccagtacagcaccagcagccagagcaccttcgtggcccacagcagagtgaccagaatgccccagatgtgcaaggccaccagcgccgccctgccccagagccagagaagcagcacccccagcagcgagatcggcgccaccccccccagcagcccccaccacatcctgacctggcagaccggcgaggccaccgagaacagccccatcctggacggcagcgagagccccccccaccagagcaccgacgagtag

SEQ ID NO: 10451 - DNA, 3228 bp, Artificial Sequence
  Description of Artificial Sequence: Synthetic coding sequence
atggtggtggaggtggacagcatgcccgccgccagcagcgtgaagaagcccttcggcctgagaagcaagatgggcaagtggtgctgcagatgcttcccctgctgcagagagagcggcaagagcaacgtgggcaccagcggcgaccacgacgacagcgccatgaagaccctgagaagcaagatgggcaagtggtgcagacactgcttcccctgctgcagaggcagcggcaagagcaacgtgggcgccagcggcgaccacgacgacagcgccatgaagaccctgagaaacaagatgggcaagtggtgctgccactgcttcccctgctgcagaggcagcagcaagagcaaggtgggcgcctggggcgactacgacgacagcgccttcatggagcccagataccacgtgagaggcgaggacctggacaagctgcacagagccgcctggtggggcaaggtgcccagaaaggacctgatcgtgatgctgagagacaccgacgtgaacaagcaggacaagcagaagagaaccgccctgcacctggccagcgccaacggcaacagcgaggtggtgaagctgctgctggacagaagatgccagctgaacgtgctggacaacaagaagagaaccgccctgatcaaggccgtgcagtgccaggaggacgagtgcgccctgatgctgctggagcacggcaccgaccccaacatccccgacgagtacggcaacaccaccctgcactacgccatctacaacgaggacaagctgatggccaaggccctgctgctgtacggcgccgacatcgagagcaagaacaagcacggcctgacccccctgctgctgggcgtgcacgagcagaagcagcaggtggtgaagttcctgatcaagaagaaggccaacctgaacgccctggacagatacggcagaaccgccctgatcctggccgtgtgctgcggcagcgccagcatcgtgagcctgctgctggagcagaacatcgacgtgagcagccaggacctgagcggccagaccgccagagagtacgccgtgagcagccaccaccacgtgatctgccagctgctgagcgactacaaggagaagcagatgctgaagatcagcagcgagaacagcaaccccgagcaggacctgaagctgaccagcgaggaggagagccagagattcaagggcagcgagaacagccagcccgagaagatgagccaggagcccgagatcaacaaggacggcgacagagaggtggaggaggagatgaagaagcacgagagcaacaacgtgggcctgctggagaacctgaccaacggcgtgaccgccggcaacggcgacaacggcctgatcccccagagaaagagcagaacccccgagaaccagcagttccccgacaacgagagcgaggagtaccacagaatctgcgagctgctgagcgactacaaggagaagcagatgcccaagtacagcagcgagaacagcaaccccgagcaggacctgaagctgaccagcgaggaggagagccagagactgaagggcagcgagaacggccagcccgagaagagaagccaggagcccgagatcaacaaggacggcgacagagagctggagaacttcatggccatcgaggagatgaagaagcacagaagcacccacgtgggcttccccgagaacctgaccaacggcgccaccgccggcaacggcgacgacggcctgatcccccccagaaagagcagaacccccgagagccagcagttccccgacaccgagaacgaggagtaccacagcgacgagcagaacgacacccagaagcagttctgcgaggagcagaacaccggcatcctgcacgacgagatcctgatccacgaggagaagcagatcgaggtggtggagaagatgaacagcgagctgagcctgagctgcaagaaggagaaggacatcctgcacgagaacagcaccctgagagaggagatcgccatgctgagactggagctggacaccatgaagcaccagagccagctgagagagaagaagtacctggaggacatcgagagcgtgaagaagagaaacgacaacctgctgaaggccctgcagctgaacgagctgaccatggacgacgacaccgccgtgctggtgatcgacaacggcagcggcatgtgcaaggccggcttcgccggcgacgacgcccccagagccgtgttccccagcatcgtgggcagacccagacagcagggcatgatgggcggcatgcaccagaaggagagctacgtgggcaaggaggcccagagcaagagaggcatcctgaccctgaagtaccccatggagcacggcatcatcaccaactgggacgacatggagaagatctggcaccacaccttctacaacgagctgagagtggcccccgaggagcaccccgtgctgctgaccgaggccaccctgaaccccaaggccaacagagagaagatgacccagatcatgttcgagaccttcaacacccccgccatgtacgtggccatccaggccgtgctgagcctgtacaccagcggcagaaccaccggcatcgtgatggacagcggcgacggcgtgacccacaccgtgcccatctacgagggcaacgccctgccccacgccaccctgagactggacctggccggcagagagctgcccgactacctgatgaagatcctgaccgagcacggctacagattcaccaccatggccgagagagagatcgtgagagacatcaaggagaagctgtgctacgtggccctggacttcgagcaggagatggccaccgtggccagcagcagcagcctggagaagagctacgagctgcccgacggccaggtgatcaccatcggcaacgagagattcagatgccccgaggccctgttccagccctgcttcctgggcatggagagctgcggcatccacgagaccaccttcaacagcatcatgaagagcgacgtggacatcagaaaggacctgtacaccaacaccgtgctgagcggcggcaccaccatgtaccccggcatggcccacagaatgcagaaggagatcgccgccctggcccccagcatgatgaagatcagaatcatcgccccccccaagagaaagtacagcgtgtgggtgggcggcagcatcctggccagcctgagcaccttccagcagatgtggatcagcaagcaggagtacgacgagagcggccccagcatcgtgcacagaaagtgcctgtag

SEQ ID NO: 10452 - DNA, 1752 bp, Artificial Sequence
  Description of Artificial Sequence: Synthetic coding sequence
atgctgagcgagagcaaggagggcgaggagaaggaggaggtgaccatggacaccagcgagaacagacccgagaacgacgtgcccgagccccccatgcccatcgccgaccaggtgagcaacgacgacagacccgagggcagcgtggaggacgaggagaagaaggagagcagcctgcccaagagcttcaagagaaagatcagcgtggtgagcgccaccaagggcgtgcccgccggcaacagcgacaccgagggcggccagcccggcagaaagagaagatggggcgccagcaccgccaccacccagaagaagcccagcatcagcatcaccaccgagagcctgaagagcctgatccccgacatcaagcccctggccggccaggaggccgtggtggacctgcacgccgacgacagcagaatcagcgaggacgagaccgagagaaacggcgacgacggcacccacgacaagggcctgaagatctgcagaaccgtgacccaggtggtgcccgccgagggccaggagaacggccagagagaggaggaggaggaggagaaggagcccgaggccgagccccccgtgcccccccaggtgagcgtggaggtggccctgcccccccccgccgagcacgaggtgaagaaggtgaccctgggcgacaccctgaccagaagaagcatcagccagcagaagagcggcgtgagcatcaccatcgacgaccccgtgagaaccgcccaggtgcccagcccccccagaggcaagatcagcaacatcgtgcacatcagcaacctggtgagacccttcaccctgggccagctgaaggagctgctgggcagaaccggcaccctggtggaggaggccttctggatcgacaagatcaagagccactgcttcgtgacctacagcaccgtggaggaggccgtggccaccagaaccgccctgcacggcgtgaagtggccccagagcaaccccaagttcctgtgcgccgactacgccgagcaggacgagctggactaccacagaggcctgctggtggacagacccagcgagaccaagaccgaggagcagggcatccccagacccctgcacccccccccccccccccccgtgcagcccccccagcaccccagagccgagcagagagagcaggagagagccgtgagagagcagtgggccgagagagagagagagatggagagaagagagagaaccagaagcgagagagagtgggacagagacaaggtgagagagggccccagaagcagaagcagaagcagagacagaagaagaaaggagagagccaagagcaaggagaagaagagcgagaagaaggagaaggcccaggaggagccccccgccaagctgctggacgacctgttcagaaagaccaaggccgccccctgcatctactggctgcccctgaccgacagccagatcgtgcagaaggaggccgagagagccgagagagccaaggagagagagaagagaagaaaggagcaggaggaggaggagcagaaggagagagagaaggaggccgagagagagagaaacagacagctggagagagagaagagaagagagcacagcagagagagagacagagagagagagagagagagagagagagacagaggcgacagagacagagacagagagagagacagagagagaggcagagagagagacagaagagacaccaagagacacagcagaagcagaagcagaagcacccccgtgagagacagaggcggcagaagatag

SEQ ID NO: 10453 - DNA, 963 bp, Artificial Sequence; identical to SEQ ID NO: 10260
  Description of Artificial Sequence: Synthetic coding sequence

SEQ ID NO: 10454 - DNA, 3294 bp, Artificial Sequence
  Description of Artificial Sequence: Synthetic coding sequence
atggccgccgccgccgccgagcagcagcagttctacctgctgctgggcaacctgctgagccccgacaacgtggtgagaaagcaggccgaggagacctacgagaacatccccggccagagcaagatcaccttcctgctgcaggccatcagaaacaccaccgccgccgaggaggccagacagatggccgccgtgctgctgagaagactgctgagcagcgccttcgacgaggtgtaccccgccctgcccagcgacgtgcagaccgccatcaagagcgagctgctgatgatcatccagatggagacccagagcagcatgagaaagaaggtgtgcgacatcgccgccgagctggccagaaacctgatcgacgaggacggcaacaaccagtggcccgagggcctgaagttcctgttcgacagcgtgagcagccagaacgtgggcctgagagaggccgccctgcacatcttctggaacttccccggcatcttcggcaaccagcagcagcactacctggacgtgatcaagagaatgctggtgcagtgcatgcaggaccaggagcaccccagcatcagaaccctgagcgccagagccaccgccgccttcatcctggccaacgagcacaacgtggccctgttcaagcacttcgccgacctgctgcccggcttcctgcaggccgtgaacgacagctgctaccagaacgacgacagcgtgctgaagagcctggtggagatcgccgacaccgtgcccaagtacctgagaccccacctggaggccaccctgcagctgagcctgaagctgtgcggcgacaccagcctgaacaacatgcagagacagctggccctggaggtgatcgtgaccctgagcgagaccgccgccgccatgctgagaaagcacaccaacatcgtggcccagaccatcccccagatgctggccatgatggtggacctggaggaggacgaggactgggccaacgccgacgagctggaggacgacgacttcgacagcaacgccgtggccggcgagagcgccctggacagaatggcctgcggcctgggcggcaagctggtgctgcccatgatcaaggagcacatcatgcagatgctgcagaaccccgactggaagtacagacacgccggcctgatggccctgagcgccatcggcgagggctgccaccagcagatggagggcatcctgaacgagatcgtgaacttcgtgctgctgttcctgcaggacccccaccccagagtgagatacgccgcctgcaacgccgtgggccagatggccaccgacttcgcccccggcttccagaagaagttccacgagaaggtgatcgccgccctgctgcagaccatggaggaccagggcaaccagagagtgcaggcccacgccgccgccgccctgatcaacttcaccgaggactgccccaagagcctgctgatcccctacctggacaacctggtgaagcacctgcacagcatcatggtgctgaagctgcaggagctgatccagaagggcaccaagctggtgctggagcaggtggtgaccagcatcgccagcgtggccgacaccgccgaggagaagttcgtgccctactacgacctgttcatgcccagcctgaagcacatcgtggagaacgccgtgcagaaggagctgagactgctgagaggcaagaccatcgagtgcatcagcctgatcggcctggccgtgggcaaggagaagttcatgcaggacgccagcgacgtgatgcagctgctgctgaagacccagaccgacttcaacgacatggaggacgacgacccccagatcagctacatgatcagcgcctgggccagaatgtgcaagatcctgggcaaggagttccagcagtacctgcccgtggtgatgggccccctgatgaagaccgccagcatcaagcccgaggtggccctgctggacacccaggacatggagaacatgagcgacgacgacggctgggagttcgtgaacctgggcgaccagcagagcttcggcatcaagaccgccggcctggaggagaagagcaccgcctgccagatgctggtgtgctacgccaaggagctgaaggagggcttcgtggagtacaccgagcaggtggtgaagctgatggtgcccctgctgaagttctacttccacgacggcgtgagagtggccgccgccgagagcatgcccctgctgctggagtgcgccagagtgagaggccccgagtacctgacccagatgtggcacttcatgtgcgacgccctgatcaaggccatcggcaccgagcccgacagcgacgtgctgagcgagatcatgcacagcttcgccaagtgcatcgaggtgatgggcgacggctgcctgaacaacgagcacttcgaggagctgggcggcatcctgaaggccaagctggaggagcacttcaagaaccaggagctgagacaggtgaagagacaggacgaggactacgacgagcaggtggaggagagcctgcaggacgaggacgacaacgacgtgtacatcctgaccaaggtgagcgacatcctgcacagcatcttcagcagctacaaggagaaggtgctgccctggttcgagcagctgctgcccctgatcgtgaacctgatctgcccccacagaccctggcccgacagacagtggggcctgtgcatcttcgacgacgtgatcgagcactgcagccccgccagcttcaagtacgccgagtacttcctgagacccatgctgcagtacgtgtgcgacaacagccccgaggtgagacaggccgccgcctacggcctgggcgtgatggcccagtacggcggcgacaactacagacccttctgcaccgaggccctgcccctgctggtgagagtgatccagagcgccgacagcaagaccaaggagaacgtgaacgccaccgagaactgcatcagcgccgtgggcaagatcatgaagttcaagcccgactgcgtgaacgtggaggaggtgctgccccactggctgagctggctgcccctgcacgaggacaaggaggaggccgtgcagaccttcaactacctgtgcgacctgatcgagagcaaccaccccatcgtgctgggccccaacaacaccaacctgcccaagatcttcagcatcatcgccgagggcgagatgcacgaggccatcaagcacgaggacccctgcgccaagagactggccaacgtggtgagacaggtgcagaccagcggcggcctgtggaccgagtgcatcgcccagctgagccccgagcagcaggccgccatccaggagctgctgaacagcgcctag

SEQ ID NO: 10455 - DNA, 2715 bp, Artificial Sequence
  Description of Artificial Sequence: Synthetic coding sequence
atgttccccgccctggagacccacctgaagcagaccatccccgacccctacgaggacttcatgtacagacacctgcagtactacggctacttcaaggcccagagaggcagcctgcccaacagcgccacccaccagcacgtgagaaagaacaacccccagtgcctgctgaacggcagcctgggcgagaaggacgacctgatccccgacaccctgcagaaggagaagctgctgtggcccatcagcctgagcagcgccgtgcacagacagatcgaggccatcaacagagacttccacagctgcctgggctggatgcagtggagaggcctgagcagcctgcagccccccccccccagattcaaggacagccccgccagcgccttcagagtggccggcatcaccgacagccacatgctgagcctgccccacctgagaagcagacagctgctgtacgacgagctggacgaggtgaaccccagactgagagagccccaggagctgttcagcatcctgagcaccaagagacccctgcaggcccccagatggcccatcgagtgcgaggtgatcaaggagaacatccaccacatcgagtgggcccccccccagcccgagtacttctaccagcccaagggcaacgagaaggtgcccgagatcgtgggcgagaagaagggcaccgtggtgtaccagctggacagcgtgcccatcgagggcagctacttcaccagcagcagagtgggcggcaagagaggcatcgtgaaggagctggccgtgaccctgcagggccccgaggacaacaccctgctgttcgagagcagattcgagagcggcaacctgcagaaggccgtgagagtggacacctacgagtacgagctgaccctgagaaccgacctgtacaccaacaagcacacccagtggttctacttcagagtgcagaacaccagaaaggacgccacctacagattcaccatcgtgaacctgctgaagcccaagagcctgtacaccgtgggcatgaagcccctgctgtacagccagctggacgccaacaccagaaacatcggctggagaagagagggcaacgagatcaagtactacaagaacaacaccgacgacggccagcagcccttctactgcctgacctggaccatccagttcccctacgaccaggacacctgcttcttcgcccacttctacccctacacctacaccgacctgcagtgctacctgctgagcgtggccaacaaccccatccagagccagttctgcaagctgcagaccctgtgcagaagcctggccggcaacaccgtgtacctgctgaccatcaccaaccccagccagaccccccaggaggccgccgccaagaaggccgtggtgctgagcgccagagtgcaccccggcgagagcaacggcagctgggtgatgaagggcttcctggacttcatcctgagcaacagccccgacgcccagctgctgagagacatcttcgtgttcaaggtgctgcccatgctgaaccccgacggcgtgatcgtgggcaactacagatgcagcctggccggcagagacctgaacagacactacaagaccatcctgaaggagagcttcccctgcatctggtacaccagaaacatgatcaagagactgctggaggagagagaggtgctgctgtactgcgacttccacggccacagcagaaagaacaacatcttcctgtacggctgcaacaacaacaacagaaagtactggctgcacgagagagtgttccccctgatgctgtgcaagaacgcccccgacaagttcagcttccacagctgcaacttcaaggtgcagaagtgcaaggagggcaccggcagagtggtgatgtggagaatgggcatcctgaacagctacaccatggagagcaccttcggcggcagcaccctgggcaacaagagagacacccacttcaccatcgaggacctgaagagcctgggctaccacgtgtgcgacaccctgctggacttctgcgaccccgaccagatgaagttcacccagtgcctggccgagctgaaggagctgctgagacaggagatccacaagaagttccacgagctgggccaggacgtggacctggagggcagctggagcgacatcagcctgagcgacatcgagagcagaaacagcaccagcggcagcgacagcagcctgagcgacggcctgcccgtgcacctggccaacatcgccgacgagctgacccagaagaagaagatgttcaagaagaagaagaagaagagcctgcagaccagaaagcagagaaacgagcagtaccagaagaagaacctgatgcagaagctgaagctgaccgaggacaccagcgagaaggccggcttcgccagcaccctgcagaagcagcccaccttcttcaagaacagcgagaacagcagcttcctgcccatgaagaacgagaaccccagactgaacgagaccaacctgaacagaagagacaaggacacccccctggaccccagcatggccaccctgatcctgcccaagaacaagggcagaatgcagaacaagaagcccggcttcaccgtgagctgcagccccaagagaaccatcaacagcagccaggagcccgcccccggcatgaagcccaactggcccagaagcagataccccgccaccaagagaggctgcgccgccatggccgcctaccccagcctgcacatctacacctacccctag

SEQ ID NO: 10456 - DNA, 789 bp, Artificial Sequence
  Description of Artificial Sequence: Synthetic coding sequence
atggccctgagcctgggctggaaggcccacagaaaccactgcggcctgctgctgcaggccctgagaagcagcggcctgctgctgttcccctgcggccagtgcccctggagaggcgccggcagcttcctggaccccgagatcaaggccttcctggaggagaacaccgaggtgaccagcagcggcagcctgacccccgagatccagctgagactgctgacccccagatgcaagttctggtgggagagagccgacctgtggccccacagcgacccctactgggccatctactggcccggcggccaggccctgagcagatacctgctggacaaccccgacgtggtgagaggcaagagcgtgctggacctgggcagcggctgcggcgccaccgccatcgccgccaagatgagcggcgccagcagaatcctggccaacgacatcgaccccatcgccggcatggccatcaccctgaactgcgagctgaacagactgaaccccttccccatcctgatccagaacatcctgaacctggagcaggacaagtgggacctggtggtgctgggcgacatgttctacgacgaggacctggccgacagcctgcaccagtggctgaagaagtgcttctggacctacagaaccagagtgctgatcggcgaccccggcagaccccagttcagcggccacagcatccagcaccacctgcacaaggtggtggagtacagcctgctggagagcaccagacaggagaacagcggcctgaccaccagcaccgtgtggggcttccagccctag

SEQ ID NO: 10457 - DNA, 2619 bp, Artificial Sequence
  Description of Artificial Sequence: Synthetic coding sequence
atgaactaccccggcagaggcagccccagaagccccgagcacaacggcagaggcggcggcggcggcgcctgggagctgggcagcgacgccagacccgccttcggcggcggcgtgtgctgcttcgagcacctgcccggcggcgaccccgacgacggcgacgtgcccctggccctgctgagaggcgagcccggcctgcacctggcccccggcaccgacgaccacaaccaccacctggccctggacccctgcctgagcgacgagaactacgacttcagcagcgccgagagcggcagcagcctgagatactacagcgagggcgagagcggcggcggcggcagcagcctgagcctgcaccccccccagcagccccccctggtgcccaccaacagcggcggcggcggcgccaccggcggcagccccggcgagagaaagagaaccagactgggcggccccgccgccagacacagatacgaggtggtgaccgagctgggccccgaggaggtgagatggttctacaaggaggacaagaagacctggaagcccttcatcggctacgacagcctgagaatcgagctggccttcagaaccctgctgcagaccaccggcgccagaccccagggcggcgacagagacggcgaccacgtgtgcagccccaccggccccgccagcagcagcggcgaggacgacgacgaggacagagcctgcggcttctgccagagcaccaccggccacgagcccgagatggtggagctggtgaacatcgagcccgtgtgcgtgagaggcggcctgtacgaggtggacgtgacccagggcgagtgctaccccgtgtactggaaccaggccgacaagatccccgtgatgagaggccagtggttcatcgacggcacctggcagcccctggaggaggaggagagcaacctgatcgagcaggagcacctgaactgcttcagaggccagcagatgcaggagaacttcgacatcgaggtgagcaagagcatcgacggcaaggacgccgtgcacagcttcaagctgagcagaaaccacgtggactggcacagcgtggacgaggtgtacctgtacagcgacgccaccaccagcaagatcgccagaaccgtgacccagaagctgggcttcagcaaggccagcagcagcggcaccagactgcacagaggctacgtggaggaggccaccctggaggacaagcccagccagaccacccacatcgtgttcgtggtgcacggcatcggccagaagatggaccagggcagaatcatcaagaacaccgccatgatgagagaggccgccagaaagatcgaggagagacacttcagcaaccacgccacccacgtggagttcctgcccgtggagtggagaagcaagctgaccctggacggcgacaccgtggacagcatcacccccgacaaggtgagaggcctgagagacatgctgaacagcagcgccatggacatcatgtactacaccagccccctgtacagagacgagctggtgaagggcctgcagcaggagctgaacagactgtacagcctgttctgcagcagaaaccccgacttcgaggagaagggcggcaaggtgagcatcgtgagccacagcctgggctgcgtgatcacctacgacatcatgaccggctggaaccccgtgagactgtacgagcagctgctgcagaaggaggaggagctgcccgacgagagatggatgagctacgaggagagacacctgctggacgagctgtacatcaccaagagaagactgaaggagatcgaggagagactgcacggcctgaaggccagcagcatgacccagacccccgccctgaagttcaaggtggagaacttcttctgcatgggcagccccctggccgtgttcctggccctgagaggcatcagacccggcaacaccggcagccaggaccacatcctgcccagagagatctgcaacagactgctgaacatcttccaccccaccgaccccgtggcctacagactggagcccctgatcctgaagcactacagcaacatcagccccgtgcagatccactggtacaacaccagcaaccccctgccctacgagcacatgaagcccagcttcctgaaccccgccaaggagcccaccagcgtgagcgagaacgagggcatcagcaccatccccagccccgtgaccagccccgtgctgagcagaagacactacggcgagagcatcaccaacatcggcaaggccagcatcctgggcgccgccagcatcggcaagggcctgggcggcatgctgttcagcagattcggcagaagcagcaccacccagagcagcgagaccagcaaggacagcatggaggacgagaagaagcccgtggccagccccagcgccaccaccgtgggcacccagaccctgccccacagcagcagcggcttcctggacagcgccctggagctggaccacagaatcgacttcgagctgagagagggcctggtggagagcagatactggagcgccgtgaccagccacaccgcctactggagcagcctggacgtggccctgttcctgctgaccttcatgtacaagcacgagcacgacgacgacgccaagcccaacctggaccccatctag

SEQ ID NO: 10458 - DNA, 1461 bp, Artificial Sequence
  Description of Artificial Sequence: Synthetic coding sequence
atggtgagccacaccttccacatgagaaccgaggagagcgacgccagccaggagggcgacgacctgcccaagagcagcgccaacaccagccaccccaagcaggacgacagccccaagagcagcgaggagaccatccagcccaaggagggcgacatccccaaggcccccgaggagaccatccagagcaagaaggaggacctgcccaagagcagcgagaaggccatccagcccaaggagagcaacatccccaagagcagcgccaagcccatccagcccaagctgggcaacatccccaaggccagcgtgaagcccagccagcccaaggagggcgacatccccaaggcccccgaggagaccatccagagcaagaaggaggacctgcccaagagcagcgaggaggccatccagcccaaggagggcgacatccccaagagcagcgccaagcccatccagcccaagctgggcaacatcgccaagaccagcgtgaagcccagccagcccaaggagagcgacatccccaagagccccgaggagaccatccagcccaaggagggcgacatccccaagagcagcgccaagcccatccagcccaagctgggcaacatccccaaggccagcgtgaagcccagccagcccaaggagggcgacatcagcaagagccccgaggaggccatccagcccaaggagggcgacctgcccaagagcctggaggaggccatccagcccaaggagggcgacatccccaagagccccgaggaggccatccagcccaaggagggcgacatccccaagagcctggaggaggccatccagcccaaggagggcgacatccccaagagccccgaggagaccatccagcccaagaagggcgacatccccaagagccccgaggaggccatccagcccaaggagggcgacatccccaagagccccaagcaggccatccagcccaaggagggcgacatccccaagagcctggaggaggccatcccccccaaggagatcgacatccccaagagccccgaggagaccatccagcccaaggaggacgacagccccaagagcctggaggaggccacccccagcaaggagggcgacatcctgaagcccgaggaggagaccatggagttccccgagggcgacaaggtgaaggtgatcctgagcaaggaggacttcgaggccagcctgaaggaggccggcgagagactggtggccgtggacttcagcgccacctggtgcggcccctgcagaaccatcagacccttcttccacgccctgagcgtgaagcacgaggacgtggtgttcctggaggtggacgccgacaactgcgaggaggtggtgagagagtgcgccatcatgtgcgtgcccaccttccagttctacaagaaggaggagaaggtggacgagctgtgcggcgccctgaaggagaagctggaggccgtgatcgccgagctgaagtag

SEQ ID NO: 10459 - DNA, 1005 bp, Artificial Sequence
  Description of Artificial Sequence: Synthetic coding sequence
atggccgccagcggcagcggcatggcccagaagacctgggagctggccaacaacatgcaggaggcccagagcatcgacgagatctacaagtacgacaagaagcagcagcaggagatcctggccgccaagccctggaccaaggaccaccactacttcaagtactgcaagatcagcgccctggccctgctgaagatggtgatgcacgccagaagcggcggcaacctggaggtgatgggcctgatgctgggcaaggtggacggcgagaccatgatcatcatggacagcttcgccctgcccgtggagggcaccgagaccagagtgaacgcccaggccgccgcctacgagtacatggccgcctacatcgagaacgccaagcaggtgggcagactggagaacgccatcggctggtaccacagccaccccggctacggctgctggctgagcggcatcgacgtgagcacccagatgctgaaccagcagttccaggagcccttcgtggccgtggtgatcgaccccaccagaaccatcagcgccggcaaggtgaacctgggcgccttcagaacctaccccaagggctacaagccccccgacgagggccccagcgagtaccagaccatccccctgaacaagatcgaggacttcggcgtgcactgcaagcagtactacgccctggaggtgagctacttcaagagcagcctggacagaaagctgctggagctgctgtggaacaagtactgggtgaacaccctgagcagcagcagcctgctgaccaacgccgactacaccaccggccaggtgttcgacctgagcgagaagctggagcagagcgaggcccagctgggcagaggcagcttcatgctgggcctggagacccacgacagaaagagcgaggacaagctggccaaggccaccagagacagctgcaagaccaccatcgaggccatccacggcctgatgagccaggtgatcaaggacaagctgttcaaccagatcaacatcagctag

SEQ ID NO: 10460 - DNA, 1350 bp, Artificial Sequence
  Description of Artificial Sequence: Synthetic coding sequence
atggtgatggagaagcccagccccctgctggtgggcagagagttcgtgagacagtactacaccctgctgaacaaggcccccgagtacctgcacagattctacggcagaaacagcagctacgtgcacggcggcgtggacgccagcggcaagccccaggaggccgtgtacggccagaacgacatccaccacaaggtgctgagcctgaacttcagcgagtgccacaccaagatcagacacgtggacgcccacgccaccctgagcgacggcgtggtggtgcaggtgatgggcctgctgagcaacagcggccagcccgagagaaagttcatgcagaccttcgtgctggcccccgagggcagcgtgcccaacaagttctacgtgcacaacgacatgttcagatacgaggacgaggtgttcggcgacagcgagcccgagctggacgaggagagcgaggacgaggtggaggaggagcaggaggagagacagcccagccccgagcccgtgcaggagaacgccaacagcggctactacgaggcccaccccgtgaccaacggcatcgaggagcccctggaggagagcagccacgagcccgagcccgagcccgagagcgagaccaagaccgaggagctgaagccccaggtggaggagaagaacctggaggagctggaggagaagagcaccacccccccccccgccgagcccgtgagcctgccccaggagccccccaagcccagagtggaggccaagcccgaggtgcagagccagccccccagagtgagagagcagagacccagagagagacccggcttcccccccagaggccccagacccggcagaggcgacatggagcagaacgacagcgacaacagaagaatcatcagataccccgacagccaccagctgttcgtgggcaacctgccccacgacatcgacgagaacgagctgaaggagttcttcatgagcttcggcaacgtggtggagctgagaatcaacaccaagggcgtgggcggcaagctgcccaacttcggcttcgtggtgttcgacgacagcgagcccgtgcagagaatcctgatcgccaagcccatcatgttcagaggcgaggtgagactgaacgtggaggagaagaagaccagagccgccagagagagagagaccagaggcggcggcgacgacagaagagacatcagaagaaacgacagaggccccggcggccccagaggcatcgtgggcggcggcatgatgagagacagagacggcagaggccccccccccagaggcggcatggcccagaagctgggcagcggcagaggcaccggccagatggagggcagattcaccggccagagaagatag

SEQ ID NO: 10461 - DNA, 333 bp, Artificial Sequence
  Description of Artificial Sequence: Synthetic coding sequence
atggaggagatccccgcccaggaggccgccggcagccccagagtgcagttccagagcctggagacccagagcgagtgcctgagccccgagccccagttcgtgcaggacaccgacatggagcagggcctgaccggcggcatcctgctgagactgcccaccaccagaatccacagcgtgaacagctgccccgccctgagccacacccaggccagcgccttcagcggcgagaccctggccgtgctgaccgccggcatcagcaagagatggcccaagtacagactgcccatcgacatcgccagaccctgcagcgagacccccttccccagactgtag

SEQ ID NO: 10462 - DNA, 822 bp, Artificial Sequence; identical to SEQ ID NO: 10030
  Description of Artificial Sequence: Synthetic coding sequence

SEQ ID NO: 10463 - DNA, 2916 bp, Artificial Sequence
  Description of Artificial Sequence: Synthetic coding sequence
ctgagcagaagagtgccctgcgtgagaagaggctgcagaccccccctgccccccctgcccggcagccagagcagagcctggagcagagacagagaggcccccctggaccccggcagacccgcccagagcggcagaagacccaccagcagaagcgtgagccacgcctgcagctggaacggcggcagcctggaccccctggagggcacccccgccctgctgagaagcgccgagagactgatgagaaaggtgaagaagctgagactggacaaggagaacaccggcagctggagaagcttcagcctgaacagcgagggcgccgagagaatggccaccaccggcacccccaccgccgacagaggcgacgccgccgccaccgacgaccccgccgccagattccaggtgcagaagcacagctgggacggcctgagaagcatcatccacggcagcagaaagtacagcggcctgatcgtgaacaaggccccccacgacttccagttcgtgcagaagaccgacgagagcggcccccacagccacagactgtactacctgggcatgccctacggcagcagagagaacagcctgctgtacagcgagatccccaagaaggtgagaaaggaggccctgctgctgctgagctggaagcagatgctggaccacttccaggccaccccccaccacggcgtgtacagcagagaggaggagctgctgagagagagaaagagactgggcgtgttcggcatcaccagctacgacttccacagcgagagcggcctgttcctgttccaggccagcaacagcctgttccactgcagagacggcggcaagaacggcttcatggtgagccccatgaagcccctggagatcaagacccagtgcagcggccccagaatggaccccaagatctgccccgccgaccccgccttcttcagcttcatcaacaacagcgacctgtgggtggccaacatcgagaccggcgaggagagaagactgaccttctgccaccagggcctgagcaacgtgctggacgaccccaagagcgccggcgtggccaccttcgtgatccaggaggagttcgacagattcaccggctactggtggtgccccaccgccagctgggagggcagcgagggcctgaagaccctgagaatcctgtacgaggaggtggacgagagcgaggtggaggtgatccacgtgcccagccccgccctggaggagagaaagaccgacagctacagataccccagaaccggcagcaagaaccccaagatcgccctgaagctggccgagttccagaccgacagccagggcaagatcgtgagcacccaggagaaggagctggtgcagcccttcagcagcctgttccccaaggtggagtacatcgccagagccggctggaccagagacggcaagtacgcctgggccatgttcctggacagaccccagcagtggctgcagctggtgctgctgccccccgccctgttcatccccagcaccgagaacgaggagcagagactggccagcgccagagccgtgcccagaaacgtgcagccctacgtggtgtacgaggaggtgaccaacgtgtggatcaacgtgcacgacatcttctaccccttcccccagagcgagggcgaggacgagctgtgcttcctgagagccaacgagtgcaagaccggcttctgccacctgtacaaggtgaccgccgtgctgaagagccagggctacgactggagcgagcccttcagccccggcgaggacgagttcaagtgccccatcaaggaggagatcgccctgaccagcggcgagtgggaggtgctggccagacacggcagcaagatctgggtgaacgaggagaccaagctggtgtacttccagggcaccaaggacacccccctggagcaccacctgtacgtggtgagctacgaggccgccggcgagatcgtgagactgaccacccccggcttcagccacagctgcagcatgagccagaacttcgacatgttcgtgagccactacagcagcgtgagcacccccccctgcgtgcacgtgtacaagctgagcggccccgacgacgaccccctgcacaagcagcccagattctgggccagcatgatggaggccgccagctgcccccccgactacgtgccccccgagatcttccacttccacaccagaagcgacgtgagactgtacggcatgatctacaagccccacgccctgcagcccggcaagaagcaccccaccgtgctgttcgtgtacggcggcccccaggtgcagctggtgaacaacagcttcaagggcatcaagtacctgagactgaacaccctggccagcctgggctacgccgtggtggtgatcgacggcagaggcagctgccagagaggcctgagattcgagggcgccctgaagaaccagatgggccaggtggagatcgaggaccaggtggagggcctgcagttcgtggccgagaagtacggcttcatcgacctgagcagagtggccatccacggctggagctacggcggcttcctgagcctgatgggcctgatccacaagccccaggtgttcaaggtggccatcgccggcgcccccgtgaccgtgtggatggcctacgacaccggctacaccgagagatacatggacgtgcccgagaacaaccagcacggctacgaggccggcagcgtggccctgcacgtggagaagctgcccaacgagcccaacagactgctgatcctgcacggcttcctggacgagaacgtgcacttcttccacaccaacttcctggtgagccagctgatcagagccggcaagccctaccagctgcagatctaccccaacgagagacacagcatcagatgccccgagagcggcgagcactacgaggtgaccctgctgcacttcctgcaggagtacctgtag

SEQ ID NO: 10464 - DNA, 2592 bp, Artificial Sequence
  Description of Artificial Sequence: Synthetic coding sequence
atgggcaacagagagatggaggagctgatccccctggtgaacagactgcaggacgccttcagcgccctgggccagagctgcctgctggagctgccccagatcgccgtggtgggcggccagagcgccggcaagagcagcgtgctggagaacttcgtgggcagagacttcctgcccagaggcagcggcatcgtgaccagaagacccctggtgctgcagctggtgaccagcaaggccgagtacgccgagttcctgcactgcaagggcaagaagttcaccgacttcgacgaggtgagactggagatcgaggccgagaccgacagagtgaccggcatgaacaagggcatcagcagcatccccatcaacctgagagtgtacagcccccacgtgctgaacctgaccctgatcgacctgcccggcatcaccaaggtgcccgtgggcgaccagccccccgacatcgagtaccagatcagagagatgatcatgcagttcatcaccagagagaactgcctgatcctggccgtgacccccgccaacaccgacctggccaacagcgacgccctgaagctggccaaggaggtggacccccagggcctgagaaccatcggcgtgatcaccaagctggacctgatggacgagggcaccgacgccagagacgtgctggagaacaagctgctgcccctgagaagaggctacgtgggcgtggtgaacagaagccagaaggacatcgacggcaagaaggacatcaaggccgccatgctggccgagagaaagttcttcctgagccaccccgcctacagacacatcgccgacagaatgggcaccccccacctgcagaaggtgctgaaccagcagctgaccaaccacatcagagacaccctgcccaacttcagaaacaagctgcagggccagctgctgagcatcgagcacgaggtggaggcctacaagaacttcaagcccgaggaccccaccagaaagaccaaggccctgctgcagatggtgcagcagttcgccgtggacttcgagaagagaatcgagggcagcggcgaccaggtggacaccctggagctgagcggcggcgccaagatcaacagaatcttccacgagagattccccttcgagatcgtgaagatggagttcaacgagaaggagctgagaagagagatcagctacgccatcaagaacatccacggcatcagaaccggcctgttcacccccgacatggccttcgaggccatcgtgaagaagcagatcgtgaagctgaagggccccagcctgaagagcgtggacctggtgatccaggagctgatcaacaccgtgaagaagtgcaccaagaagctggccaacttccccagactgtgcgaggagaccgagagaatcgtggccaaccacatcagagagagagagggcaagaccaaggaccaggtgctgctgctgatcgacatccaggtgagctacatcaacaccaaccacgaggacttcatcggcttcgccaacgcccagcagagaagcagccaggtgcacaagaagaccaccgtgggcaaccaggtgatcagaaagggctggctgaccatcagcaacatcggcatcatgaagggcggcagcaagggctactggttcgtgctgaccgccgagagcctgagctggtacaaggacgacgaggagaaggagaagaagtacatgctgcccctggacaacctgaaggtgagagacgtggagaagagcttcatgagcagcaagcacatcttcgccctgttcaacaccgagcagagaaacgtgtacaaggactacagattcctggagctggcctgcgacagccaggaggacgtggacagctggaaggccagcctgctgagagccggcgtgtaccccgacaagagcgtgggcaacaacaaggccgagaacgacgagaacggccaggccgagaacttcagcatggacccccagctggagagacaggtggagaccatcagaaacctggtggacagctacatgagcatcatcaacaagtgcatcagagacctgatccccaagaccatcatgcacctgatgatcaacaacgtgaaggacttcatcaacagcgagctgctggcccagctgtacagcagcgaggaccagaacaccctgatggaggagagcgccgagcaggcccagagaagagacgagatgctgagaatgtaccaggccctgaaggaggccctgggcatcatcggcgacatcagcaccgccaccgtgagcacccccgcccccccccccgtggacgacagctggatccagcacagcagaagaagccccccccccagccccaccacccagagaagacccaccctgagcgcccccctggccagacccaccagcggcagaggccccgcccccgccatccccagccccggcccccacagcggcgccccccccgtgcccttcagacccggccccctgccccccttccccagcagcagcgacagcttcggcgcccccccccaggtgcccagcagacccaccagagccccccccagcgtgcccagcagaagacccccccccagccccaccagacccaccatcatcagacccctggagagcagcctgctggactag

SEQ ID NO: 10465 - DNA, 1263 bp, Artificial Sequence; identical to SEQ ID NO: 9866
  Description of Artificial Sequence: Synthetic coding sequence

SEQ ID NO: 10466 - DNA, 2481 bp, Artificial Sequence
  Description of Artificial Sequence: Synthetic coding sequence
atggtggcccccgtgctggagaccagccacgtgttctgctgccccaacagagtgagaggcgtgctgaactggagcagcggccccagaggcctgctggccttcggcaccagctgcagcgtggtgctgtacgaccccctgaagagagtggtggtgaccaacctgaacggccacaccgccagagtgaactgcatccagtggatctgcaagcaggacggcagccccagcaccgagctggtgagcggcggcagcgacaaccaggtgatccactgggagatcgaggacaaccagctgctgaaggccgtgcacctgcagggccacgagggccccgtgtacgccgtgcacgccgtgtaccagagaagaaccagcgaccccgccctgtgcaccctgatcgtgagcgccgccgccgacagcgccgtgagactgtggagcaagaagggccccgaggtgatgtgcctgcagaccctgaacttcggcaacggcttcgccctggccctgtgcctgagcttcctgcccaacaccgacgtgcccatcctggcctgcggcaacgacgactgcagaatccacatcttcgcccagcagaacgaccagttccagaaggtgctgagcctgtgcggccacgaggactggatcagaggcgtggagtgggccgccttcggcagagacctgttcctggccagctgcagccaggactgcctgatcagaatctggaagctgtacatcaagagcaccagcctggagacccaggacgacgacaacatcagactgaaggagaacaccttcaccatcgagaacgagagcgtgaagatcgccttcgccgtgaccctggagaccgtgctggccggccacgagaactgggtgaacgccgtgcactggcagcccgtgttctacaaggacggcgtgctgcagcagcccgtgagactgctgagcgccagcatggacaagaccatgatcctgtgggcccccgacgaggagagcggcgtgtggctggagcaggtgagagtgggcgaggtgggcggcaacaccctgggcttctacgactgccagttcaacgaggacggcagcatgatcatcgcccacgccttccacggcgccctgcacctgtggaagcagaacaccgtgaaccccagagagtggacccccgagatcgtgatcagcggccacttcgacggcgtgcaggacctggtgtgggaccccgagggcgagttcatcatcaccgtgggcaccgaccagaccaccagactgttcgccccctggaagagaaaggaccagagccaggtgacctggcacgagatcgccagaccccagatccacggctacgacctgaagtgcctggccatgatcaacagattccagttcgtgagcggcgccgacgagaaggtgctgagagtgttcagcgcccccagaaacttcgtggagaacttctgcgccatcaccggccagagcctgaaccacgtgctgtgcaaccaggacagcgacctgcccgagggcgccaccgtgcccgccctgggcctgagcaacaaggccgtgttccagggcgacatcgccagccagcccagcgacgaggaggagctgctgaccagcaccggcttcgagtaccagcaggtggccttccagcccagcatcctgaccgagccccccaccgaggaccacctgctgcagaacaccctgtggcccgaggtgcagaagctgtacggccacggctacgagatcttctgcgtgacctgcaacagcagcaagaccctgctggccagcgcctgcaaggccgccaagaaggagcacgccgccatcatcctgtggaacaccaccagctggaagcaggtgcagaacctggtgttccacagcctgaccgtgacccagatggccttcagccccaacgagaagttcctgctggccgtgagcagagacagaacctggagcctgtggaagaagcaggacaccatcagccccgagttcgagcccgtgttcagcctgttcgccttcaccaacaagatcaccagcgtgcacagcagaatcatctggagctgcgactggagccccgacagcaagtacttcttcaccggcagcagagacaagaaggtggtggtgtggggcgagtgcgacagcaccgacgactgcatcgagcacaacatcggcccctgcagcagcgtgctggacgtgggcggcgccgtgaccgccgtgagcgtgtgccccgtgctgcaccccagccagagatacgtggtggccgtgggcctggagtgcggcaagatctgcctgtacacctggaagaagaccgaccaggtgcccgagatcaacgactggacccactgcgtggagaccagccagagccagagccacaccctggccatcagaaagctgtgctggaagaactgcagcggcaagaccgagcagaaggaggccgagggcgccgagtggctgcacttcgccagctgcggcgaggaccacaccgtgaagatccacagagtgaacaagtgcgccctgtag

SEQ ID NO: 10467 - DNA, 1152 bp, Artificial Sequence
  Description of Artificial Sequence: Synthetic coding sequence
atggacagaacctgcgaggagagacccgccgaggacggcagcgacgaggaggaccccgacagcatggaggcccccaccagaatcagagacacccccgaggacatcgtgctggaggcccccgccagcggcctggccttccaccccgccagagacctgctggccgccggcgacgtggacggcgacgtgttcgtgttcagctacagctgccaggagggcgagaccaaggagctgtggagcagcggccaccacctgaaggcctgcagagccgtggccttcagcgaggacggccagaagctgatcaccgtgagcaaggacaaggccatccacgtgctggacgtggagcagggccagctggagagaagagtgagcaaggcccacggcgcccccatcaacagcctgctgctggtggacgagaacgtgctggccaccggcgacgacaccggcggcatctgcctgtgggaccagagaaaggagggccccctgatggacatgagacagcacgaggagtacatcgccgacatggccctggaccccgccaagaagctgctgctgaccgccagcggcgacggctgcctgggcatcttcaacatcaagagaagaagattcgagctgctgagcgagccccagagcggcgacctgaccagcgtgaccctgatgaagtggggcaagaaggtggcctgcggcagcagcgagggcaccatctacctgttcaactggaacggcttcggcgccaccagcgacagattcgccctgagagccgagagcatcgactgcatggtgcccgtgaccgagagcctgctgtgcaccggcagcaccgacggcgtgatcagagccgtgaacatcctgcccaacagagtggtgggcagcgtgggccagcacaccggcgagcccgtggaggagctggccctgagccactgcggcagattcctggccagcagcggccacgaccagagactgaagttctgggacatggcccagctgagagccgtggtggtggacgactacagaagaagaaagaagaagggcggccccctgagagccctgagcagcaagacctggagcaccgacgacttcttcgccggcctgagagaggagggcgaggacagcatggcccaggaggagaaggaggagaccggcgacgacagcgactag

SEQ ID NO: 10468 - DNA, 999 bp, Artificial Sequence
  Description of Artificial Sequence: Synthetic coding sequence
atgagcgaggccggcgaggagcagcccatggagaccaccggcgccaccgagaacggccacgaggccgtgcccgagggcgagagccccgccggcgccggcaccggcgccgccgccggcgccggcggcgccaccgccgccccccccagcggcaaccagaacggcgccgagggcgaccagatcaacgccagcaagaacgaggaggacgccggcaagatgttcgtgggcggcctgagctgggacaccagcaagaaggacctgaaggactacttcaccaagttcggcgaggtggtggactgcaccatcaagatggaccccaacaccggcagaagcagaggcttcggcttcatcctgttcaaggacgccgccagcgtggagaaggtgctggaccagaaggagcacagactggacggcagagtgatcgaccccaagaaggccatggccatgaagaaggaccccgtgaagaagatcttcgtgggcggcctgaaccccgaggccaccgaggagaagatcagagagtacttcggcgagttcggcgagatcgaggccatcgagctgcccatggaccccaagctgaacaagagaagaggcttcgtgttcatcaccttcaaggaggaggagcccgtgaagaaggtgctggagaagaagttccacaccgtgagcggcagcaagtgcgagatcaaggtggcccagcccaaggaggtgtaccagcagcagcagtacggcagcggcggcagaggcaacagaaacagaggcaacagaggcagcggcggcggcggcggcggcggcggccagagccagagctggaaccagggctacggcaactactggaaccagggctacggctaccagcagggctacggccccggctacggcggctacgactacagcccctacggctactacggctacggccccggctacgactacagccagggcagcaccaactacggcaagagccagagaagaggcggccaccagaacaactacaagccctactag

SEQ ID NO: 10469 - DNA, 2745 bp, Artificial Sequence; identical to SEQ ID NO: 9882
  Description of Artificial Sequence: Synthetic coding sequence

SEQ ID NO: 10470 - DNA, 2772 bp, Artificial Sequence
  Description of Artificial Sequence: Synthetic coding sequence
atggccgccagcaccggctacgtgagactgtggggcgccgccagatgctgggtgctgagaagacccatgctggccgccgccggcggcagagtgcccaccgccgccggcgcctggctgctgagaggccagagaacctgcgacgccagccccccctgggccctgtggggcagaggccccgccatcggcggcagcgccggcgccggcgagggccccgtgatcaccgccctgacccccatgaccatccccgacgtgttcccccacctgcccctgatcgccatcaccagaaaccccgtgttccccagattcatcaagatcatcgaggtgaagaacaagaagctggtggagctgctgagaagaaaggtgagactggcccagccctacgtgggcgtgttcctgaagagagacgacagcaacgagagcgacgtggtggagagcctggacgagatctaccacaccggcaccttcgcccagatccacgagatgcaggacctgggcgacaagctgagaatgatcgtgatgggccacagaagagtgcacatcagcagacagctggaggtggagcccgaggagcccgaggccgagaacaagcacaagcccagaagaaagagcaagagaggcaagaaggaggccgaggacgagctgagcgccagacaccccgccgagctggccatggagcccacccccgagctgcccgccgaggtgctgatggtggaggtggagaacgtggtgcacgaggacttccaggtgaccgaggaggtgaaggccctgaccgccgagatcgtgaagaccatcagagacatcatcgccctgaaccccctgtacagagagagcgtgctgcagatgatgcaggccggccagagagtggtggacaaccccatctacctgagcgacatgggcgccgccctgaccggcgccgagagccacgagctgcaggacgtgctggaggagaccaacatccccaagagactgtacaaggccctgagcctgctgaagaaggagttcgagctgagcaagctgcagcagagactgggcagagaggtggaggagaagatcaagcagacccacagaaagtacctgctgcaggagcagctgaagatcatcaagaaggagctgggcctggagaaggacgacaaggacgccatcgaggagaagttcagagagagactgaaggagctggtggtgcccaagcacgtgatggacgtggtggacgaggagctgagcaagctgggcctgctggacaaccacagcagcgagttcaacgtgaccagaaactacctggactggctgaccagcatcccctggggcaagtacagcaacgagaacctggacctggccagagcccaggccgtgctggaggaggaccactacggcatggaggacgtgaagaagagaatcctggagttcatcgccgtgagccagctgagaggcagcacccagggcaagatcctgtgcttctacggcccccccggcgtgggcaagaccagcatcgccagaagcatcgccagagccctgaacagagagtacttcagattcagcgtgggcggcatgaccgacgtggccgagatcaagggccacagaagaacctacgtgggcgccatgcccggcaagatcatccagtgcctgaagaagaccaagaccgagaaccccctgatcctgatcgacgaggtggacaagatcggcagaggctaccagggcgaccccagcagcgccctgctggagctgctggaccccgagcagaacgccaacttcctggaccactacctggacgtgcccgtggacctgagcaaggtgctgttcatctgcaccgccaacgtgaccgacaccatccccgagcccctgagagacagaatggagatgatcaacgtgagcggctacgtggcccaggagaagctggccatcgccgagagatacctggtgccccaggccagagccctgtgcggcctggacgagagcaaggccaagctgagcagcgacgtgctgaccctgctgatcaagcagtactgcagagagagcggcgtgagaaacctgcagaagcaggtggagaaggtgctgagaaagagcgcctacaagatcgtgagcggcgaggccgagagcgtggaggtgacccccgagaacctgcaggacttcgtgggcaagcccgtgttcaccgtggagagaatgtacgacgtgaccccccccggcgtggtgatgggcctggcctggaccgccatgggcggcagcaccctgttcgtggagaccagcctgagaagaccccaggacaaggacgccaagggcgacaaggacggcagcctggaggtgaccggccagctgggcgaggtgatgaaggagagcgccagaatcgcctacaccttcgccagagccttcctgatgcagcacgcccccgccaacgactacctggtgaccagccacatccacctgcacgtgcccgagggcgccacccccaaggacggccccagcgccggctgcaccatcgtgaccgccctgctgagcctggccatgggcagacccgtgagacagaacctggccatgaccggcgaggtgagcctgaccggcaagatcctgcccgtgggcggcatcaaggagaagaccatcgccgccaagagagccggcgtgacctgcatcgtgctgcccgccgagaacaagaaggacttctacgacctggccgccttcatcaccgagggcctggaggtgcacttcgtggagcactacagagagatcttcgacatcgccttccccgacgagcaggccgaggccctggccgtggagagatag

SEQ ID NO: 10471 - DNA, 681 bp, Artificial Sequence
  Description of Artificial Sequence: Synthetic coding sequence
atgggccccctgcccagaaccgtggagctgttctacgacgtgctgagcccctacagctggctgggcttcgagatcctgtgcagataccagaacatctggaacatcaacctgcagctgagacccagcctgatcaccggcatcatgaaggacagcggcaacaagccccccggcctgctgcccagaaagggcctgtacatggccaacgacctgaagctgctgagacaccacctgcagatccccatccacttccccaaggacttcctgagcgtgatgctggagaagggcagcctgagcgccatgagattcctgaccgccgtgaacctggagcaccccgagatgctggagaaggccagcagagagctgtggatgagagtgtggagcagaaacgaggacatcaccgagccccagagcatcctggccgccgccgagaaggccggcatgagcgccgagcaggcccagggcctgctggagaagatcgccacccccaaggtgaagaaccagctgaaggagaccaccgaggccgcctgcagatacggcgccttcggcctgcccatcaccgtggcccacgtggacggccagacccacatgctgttcggcagcgacagaatggagctgctggcccacctgctgggcgagaagtggatgggccccatcccccccgccgtgaacgccagactgtag

SEQ ID NO: 10472 - DNA, 2055 bp, Artificial Sequence
  Description of Artificial Sequence: Synthetic coding sequence
atggaggccaaccacagcgagcagctgagcgccgagagacagagcaccccccccggcgacagcagcagcctgcccagccacaacggcctggagaaggaggacggccaggacagccccacccccgtgcagccccccgagaaggaggccagcgtgcaccccgacatcagcgaggagctgaacagacagctggaggacatcatcaacacctacggcagcgccgccagcaccgccggcaaggagggcagcgccagagccagcgagcagcccgagaacgccgagagccccgacaacgaggacggcgactgcgaggagaccaccgaggaggccggcagagagcccgtggccagcggcgagccccccaccgtgaaggagcccgtgagcaacaaggagcagaagctggagaagaagatcctgaagggcctgggcaaggaggccaacctgctgatgcagaacctgaacaagctgcagacccccgaggagaagttcgacttcctgttcaagaagtacgccgagctgctggacgagcacagaaccgagcagaagaagctgaagctgctgcagaagaagcaggtgcagatccagaaggagaaggaccagctgcagggcgagcacagcagagccatcctggccagaagcaagctggagagcctgtgcagagagctgcagagacacaacaagaccctgaaggaggaggccctgcagagagccagagaggaggaggagaagagaaaggagatcaccagccacttccagagcaccctgaccgacatccagggccagatcgagcagcagagcgagagaaacatgaagctgtgccaggagaacaccgagctggccgagaagctgaagagcatcatcgaccagtacgagctgagagaggagcacctggacaagatcttcaagcacagagagctgcagcagaagctggtggacgccaagctggagcaggcccaggagatgatgaaggaggccgaggagagacacaagagagagaaggagtacctgctgaaccaggccgccgagtggaagctgcaggccaaggtgctgaaggagcaggagaccgtgctgcaggcccagctgaccctgtacagcggcagattcgaggagttccagagcaccctgaccaagagcaacgaggtgttcgccaccttcaagcaggagatggacaagaccaccaagaagatgaagaagctggagaaggacaccgccacctggaaggccagattcgagaactgcaacaaggccctgctggacatgatcgaggagaaggccctgagagccaaggagtacgagtgcttcgtgatgaagatcggcagactggagaacctgtgcagagccctgcaggaggagagaaacgagctgcacaagaagatcagagacgccgagatcagcgagaaggacgaccagagccagcacaacagcgacgaggagcccgagagcaacgtgagcgtggaccaggagatcgacgccgaggaggtgaacagcgtgcagaccgccgtgaagaacctggccaccgccttcatgatcatccaccaccccgagagcaccccccaccagagcaaggagacccagcccgagatcggcagcagccaggagagcgccgacgccgccctgaaggagcccgagcagccccccctgatccccagcagagacagcgagagccccctgccccccctgaccccccaggccgaggccgagggcggcagcgacgccgagccccccagcaaggccagcaacagccccgccggcctgggcgccgagacccagtgcgagggcctgcccgtgggcgcccaggccgaccaggccagctggaagcccgaggccgaggccagcggccaggccccccaggcccccaccgaggccagcctgcagaagatggaggccgacgtgcccgcccccgcctgcgccgccgaggagcacgtggccgccatggtgcccgcctgcgagcccagcagacagccccccagagccgccgccgaggagctgcccgtgggcgccagcgccggcccccagcccagaaacgtggccgacaccaacctggagggcgtggactag

SEQ ID NO: 10473 - DNA, 1461 bp, Artificial Sequence
  Description of Artificial Sequence: Synthetic coding sequence
atgaacggcaccctggaccaccccgaccagcccgacctggacgccatcaagatgttcgtgggccaggtgcccagaacctggagcgagaaggacctgagagagctgttcgagcagtacggcgccgtgtacgagatcaacgtgctgagagacagaagccagaaccccccccagagcaagggctgctgcttcgtgaccttctacaccagaaaggccgccctggaggcccagaacgccctgcacaacatgaaggtgctgcccggcatgcaccaccccatccagatgaagcccgccgacagcgagaagaacaacgccgtggaggacagaaagctgttcatcggcatgatcagcaagaagtgcaccgagaacgacatcagagtgatgttcagcagcttcggccagatcgaggagtgcagaatcctgagaggccccgacggcctgagcagaggctgcgccttcgtgaccttcaccaccagagccatggcccagaccgccatcaaggccatgcaccaggcccagaccatggagggctgcagcagccccatggtggtgaagttcgccgacacccagaaggacaaggagcagaagagaatggcccagcagctgcagcagcagatgcagcagatcagcgccgccagcgtgtggggcaacctggccggcctgaacaccctgggcccccagtacctggccctgtacctgcagctgctgcagcagaccgccagcagcggcaacctgaacaccctgagcagcctgcaccccatgggcggcctgaacgccatgcagctgcagaacctggccgccctggccgccgccgccagcgccgcccagaacacccccagcggcaccaacgccctgaccaccagcagcagccccctgagcgtgctgaccagcagcggcagcagccccagcagcagcagcagcaacagcgtgaaccccatcgccagcctgggcgccctgcagaccctggccggcgccaccgccggcctgaacgtgggcagcctggccggcatggccgccctgaacggcggcctgggcagcagcggcctgagcaacggcaccggcagcaccatggaggccctgacccaggcctacagcggcatccagcagtacgccgccgccgccctgcccaccctgtacaaccagaacctgctgacccagcagagcatcggcgccgccggcagccagaaggagggccccgagggcgccaacctgttcatctaccacctgccccaggagttcggcgaccaggacctgctgcagatgttcatgcccttcggcaacgtggtgagcgccaaggtgttcatcgacaagcagaccaacctgagcaagtgcttcggcttcgtgagctacgacaaccccgtgagcgcccaggccgccatccagagcatgaacggcttccagatcggcatgaagagactgaaggtgcagctgaagagaagcaagaacgacagcaagccctactag

SEQ ID NO: 10474 - DNA, 7812 bp, Artificial Sequence
  Description of Artificial Sequence: Synthetic coding sequence
atggagaaggccaccgtgcccgtggccgccgccaccgccgccgagggcgagggcagcccccccgccgtggccgccgtggccggcccccccgccgccgccgaggtgggcggcggcgtgggcggcagcagcagagccagaagcgccagcagccccagaggcatggtgagagtgtgcgacctgctgctgaagaagaagcccccccagcagcagcaccacaaggccaagagaaacagaacctgcagaccccccagcagcagcgagagcagcagcgacagcgacaacagcggcggcggcggcggcggcggcggcggcggcggcggcggcggcggcaccagcagcaacaacagcgaggaggaggaggacgacgacgacgaggaggaggaggtgagcgaggtggagagcttcatcctggaccaggacgacctggagaaccccatgctggagaccgccagcaagctgctgctgagcggcaccgccgacggcgccgacctgagaaccgtggaccccgagacccaggccagactggaggccctgctggaggccgccggcatcggcaagctgagcaccgccgacggcaaggccttcgccgaccccgaggtgctgagaagactgaccagcagcgtgagctgcgccctggacgaggccgccgccgccctgaccagaatgagagccgagagcaccgccaacgccggccagagcgacaacagaagcctggccgaggcctgcagcgagggcgacgtgaacgccgtgagaaagctgctgatcgagggcagaagcgtgaacgagcacaccgaggagggcgagagcctgctgtgcctggcctgcagcgccggctactacgagctggcccaggtgctgctggccatgcacgccaacgtggaggacagaggcatcaagggcgacatcacccccctgatggccgccgccaacggcggccacgtgaagatcgtgaagctgctgctggcccacaaggccgacgtgaacgcccagagcagcaccggcaacaccgccctgacctacgcctgcgccggcggctacgtggacgtggtgaaggtgctgctggagagcggcgccagcatcgaggaccacaacgagaacggccacacccccctgatggaggccggcagcgccggccacgtggaggtggccagactgctgctggagaacggcgccggcatcaacacccacagcaacgagttcaaggagagcgccctgaccctggcctgctacaagggccacctggagatggtgagattcctgctggaggccggcgccgaccaggagcacaagaccgacgagatgcacaccgccctgatggaggcctgcatggacggccacgtggaggtggccagactgctgctggacagcggcgcccaggtgaacatgcccgccgacagcttcgagagccccctgaccctggccgcctgcggcggccacgtggagctggccgccctgctgatcgagagaggcgccagcctggaggaggtgaacgacgagggctacacccccctgatggaggccgccagagagggccacgaggagatggtggccctgctgctgggccagggcgccaacatcaacgcccagaccgaggagacccaggagaccgccctgaccctggcctgctgcggcggcttcctggaggtggccgacttcctgatcaaggccggcgccgacatcgagctgggctgcagcacccccctgatggaggccgcccaggagggccacctggagctggtgaagtacctgctggccgccggcgccaacgtgcacgccaccaccgccaccggcgacaccgccctgacctacgcctgcgagaacggccacaccgacgtggccgacgtgctgctgcaggccggcgccgacctggagcacgagagcgagggcggcagaacccccctgatgaaggccgccagagccggccacgtgtgcaccgtgcagttcctgatcagcaagggcgccaacgtgaacagaaccaccgccaacaacgaccacaccgtgctgagcctggcctgcgccggcggccacctggccgtggtggagctgctgctggcccacggcgccgaccccacccacagactgaaggacggcagcaccatgctgatcgaggccgccaagggcggccacaccagcgtggtgtgctacctgctggactaccccaacaacctgctgagcgcccccccccccgacgtgacccagctgaccccccccagccacgacctgaacagagcccccagagtgcccgtgcaggccctgcccatggtggtgcccccccaggagcccgacaagccccccgccaacgtggccaccaccctgcccatcagaaacaaggccgccagcaagcagaagagcagcagccacctgcccgccaacagccaggacgtgcagggctacatcaccaaccagagccccgagagcatcgtggaggaggcccagggcaagctgaccgagctggagcagagaatcaaggaggccatcgagaagaacgcccagctgcagagcctggagctggcccacgccgaccagctgaccaaggagaagatcgaggagctgaacaagaccagagaggagcagatccagaagaagcagaagatcctggaggagctgcagaaggtggagagagagctgcagctgaagacccagcagcagctgaagaagcagtacctggaggtgaaggcccagagaatccagctgcagcagcagcagcagcagagctgccagcacctgggcctgctgacccccgtgggcgtgggcgagcagctgagcgagggcgactacgccagactgcagcaggtggaccccgtgctgctgaaggacgagccccagcagaccgccgcccagatgggcttcgcccccatccagcccctggccatgccccaggccctgcccctggccgccggccccctgccccccggcagcatcgccaacctgaccgagctgcagggcgtgatcgtgggccagcccgtgctgggccaggcccagctggccggcctgggccagggcatcctgaccgagacccagcagggcctgatggtggccagccccgcccagaccctgaacgacaccctggacgacatcatggccgccgtgagcggcagagccagcgccatgagcaacacccccacccacagcatcgccgccagcatcagccagccccagacccccacccccagccccatcatcagccccagcgccatgctgcccatctaccccgccatcgacatcgacgcccagaccgagagcaaccacgacaccgccctgaccctggcctgcgccggcggccacgaggagctggtgcagaccctgctggagagaggcgccagcatcgagcacagagacaagaagggcttcacccccctgatcctggccgccaccgccggccacgtgggcgtggtggagatcctgctggacaacggcgccgacatcgaggcccagagcgagagaaccaaggacacccccctgagcctggcctgcagcggcggcagacaggaggtggtggagctgctgctggccagaggcgccaacaaggagcacagaaacgtgagcgactacacccccctgagcctggccgccagcggcggctacgtgaacatcatcaagatcctgctgaacgccggcgccgagatcaacagcagaaccggcagcaagctgggcatcagccccctgatgctggccgccatgaacggccacaccgccgccgtgaagctgctgctggacatgggcagcgacatcaacgcccagatcgagaccaacagaaacaccgccctgaccctggcctgcttccagggcagaaccgaggtggtgagcctgctgctggacagaaaggccaacgtggagcacagagccaagaccggcctgacccccctgatggaggccgccagcggcggctacgccgaggtgggcagagtgctgctggacaagggcgccgacgtgaacgccccccccgtgcccagcagcagagacaccgccctgaccatcgccgccgacaagggccactacaagttctgcgagctgctgatcggcagaggcgcccacatcgacgtgagaaacaagaagggcaacacccccctgtggctggccgccaacggcggccacctggacgtggtgcagctgctggtgcaggccggcgccgacgtggacgccgccgacaacagaaagatcacccccctgatggccgccttcagaaagggccacgtgaaggtggtgagatacctggtgaaggaggtgaaccagttccccagcgacagcgagtgcatgagatacatcgccaccatcaccgacaaggagatgctgaagaagtgccacctgtgcatggagagcatcgtgcaggccaaggacagacaggccgccgaggccaacaagaacgccagcatcctgctggaggagctggacctggagaagctgagagaggagagcagaagactggccctggccgccaagagagagaagagaaaggagaagagaagaaagaagaaggaggagcagagaagaaagctggaggagatcgaggccaagaacaaggagaacttcgagctgcaggccgcccaggagaaggagaagctgaaggtggaggacgagcccgaggtgctgaccgagccccccagcgccaccaccaccaccaccatcggcatcagcgccacctggaccaccctggccggcagccacggcaagagaaacaacaccatcaccaccaccagcagcaagagaaagaacagaaagaacaagatcacccccgagaacgtgcagatcatcttcgacgaccccctgcccatcagctacagccagcccgagaaggtgaacggcgagagcaagagcagcagcaccagcgagagcggcgacagcgacaacatgagaatcagcagctgcagcgacgagagcagcaacagcaacagcagcagaaagagcgacaaccacagccccgccgtggtgaccaccaccgtgagcagcaagaagcagcccagcgtgctggtgaccttccccaaggaggagagaaagagcgtgagcggcaaggccagcatcaagctgagcgagaccatcagcgagggcaccagcaacagcctgagcacctgcaccaagagcggccccagccccctgagcagccccaacggcaagctgaccgtggccagccccaagagaggccagaagagagaggagggctggaaggaggtggtgagaagaagcaagaaggtgagcgtgcccagcaccgtgatcagcagagtgatcggcagaggcggctgcaacatcaacgccatcagagagttcaccggcgcccacatcgacatcgacaagcagaaggacaagaccggcgacagaatcatcaccatcagaggcggcaccgagagcaccagacaggccacccagctgatcaacgccctgatcaaggaccccgacaaggagatcgacgagctgatccccaagaacagactgaagagcagcagcgccaacagcaagatcggcagcagcgcccccaccaccaccgccgccaacaccagcctgatgggcatcaagatgaccaccgtggccctgagcagcaccagccagaccgccaccgccctgaccgtgcccgccatcagcagcgccagcacccacaagaccatcaagaaccccgtgaacaacgtgagacccggcttccccgtgagcctgcccctggcctacccccccccccagttcgcccacgccctgctggccgcccagaccttccagcagatcagaccccccagactgcccatgacccacttcggcggcaccttcccccccgcccagagcacctggggccccttccccgtgagacccctgagccccgccagagccaccaacagccccaagccccacatggtgcccagacacagcaaccagaacagcagcggcagccaggtgaacagcgccggcagcctgaccagcagccccaccaccaccaccagcagcagcgccagcaccgtgcccggcaccagcaccaacggcagccccagcagccccagcgtgagaagacagctgttcgtgaccgtggtgaagaccagcaacgccaccaccaccaccgtgaccaccaccgccagcaacaacaacaccgcccccaccaacgccacctaccccatgcccaccgccaaggagcactaccccgtgagcagccccagcagccccagcccccccgcccagcccggcggcgtgagcagaaacagccccctggactgcggcagcgccagccccaacaaggtggccagcagcagcgagcaggaggccggcagcccccccgtggtggagaccaccaacaccagaccccccaacagcagcagcagcagcggcagcagcagcgcccacagcaaccagcagcagccccccggcagcgtgagccaggagcccagaccccccctgcagcagagccaggtgcccccccccgaggtgagaatgaccgtgccccccctggccaccagcagcgcccccgtggccgtgcccagcaccgcccccgtgacctaccccatgccccagacccccatgggctgcccccagcccacccccaagatggagacccccgccatcagaccccccccccacggcaccaccgccccccacaagaacagcgccagcgtgcagaacagcagcgtggccgtgctgagcgtgaaccacatcaagagaccccacagcgtgcccagcagcgtgcagctgcccagcaccctgagcacccagagcgcctgccagaacagcgtgcaccccgccaacaagcccatcgcccccaacttcagcgcccccctgcccttcggccccttcagcaccctgttcgagaacagccccaccagcgcccacgccttctggggcggcagcgtggtgagcagccagagcacccccgagagcatgctgagcggcaagagcagctacctgcccaacagcgaccccctgcaccagagcgacaccagcaaggcccccggcttcagaccccccctgcagagacccgcccccagccccagcggcatcgtgaacatggacagcccctacggcagcgtgacccccagcagcacccacctgggcaacttcgccagcaacatcagcggcggccagatgtacggccccggcgcccccctgggcggcgcccccgccgccgccaacttcaacagacagcacttcagccccctgagcctgctgaccccctgcagcagcgccagcaacgacagcagcgcccagagcgtgagcagcggcgtgagagcccccagccccgcccccagcagcgtgcccctgggcagcgagaagcccagcaacgtgagccaggacagaaaggtgcccgtgcccatcggcaccgagagaagcgccagaatcagacagaccggcaccagcgcccccagcgtgatcggcagcaacctgagcaccagcgtgggccacagcggcatctggagcttcgagggcatcggcggcaaccaggacaaggtggactggtgcaaccccggcatgggcaaccccatgatccacagacccatgagcgaccccggcgtgttcagccagcaccaggccatggagagagacagcaccggcatcgtgacccccagcggcaccttccaccagcacgtgcccgccggctacatggacttccccaaggtgggcggcatgcccttcagcgtgtacggcaacgccatgatcccccccgtggcccccatccccgacggcgccggcggccccatcttcaacggcccccacgccgccgaccccagctggaacagcctgatcaagatggtgagcagcagcaccgagaacaacggcccccagaccgtgtggaccggcccctgggccccccacatgaacagcgtgcacatgaaccagctgggctag

SEQ ID NO: 10475 - DNA, 3075 bp, Artificial Sequence
  Description of Artificial Sequence: Synthetic coding sequence
atgaccgagggcagaagatgccaggtgcacctgctggacgacagaaagctggagctgctggtgcagcccaagctgctggccaaggagctgctggacctggtggccagccacttcaacctgaaggagaaggagtacttcggcatcgccttcaccgacgagaccggccacctgaactggctgcagctggacagaagagtgctggagcacgacttccccaagaagagcggccccgtggtgctgtacttctgcgtgagattctacatcgagagcatcagctacctgaaggacaacgccaccatcgagctgttcttcctgaacgccaagagctgcatctacaaggagctgatcgacgtggacagcgaggtggtgttcgagctggccagctacatcctgcaggaggccaagggcgacttcagcagcaacgaggtggtgagaagcgacctgaagaagctgcccgccctgcccacccaggccctgaaggagcaccccagcctggcctactgcgaggacagagtgatcgagcactacaagaagctgaacggccagaccagaggccaggccatcgtgaactacatgagcatcgtggagagcctgcccacctacggcgtgcactactacgccgtgaaggacaagcagggcatcccctggtggctgggcctgagctacaagggcatcttccagtacgactaccacgacaaggtgaagcccagaaagatcttccagtggagacagctggagaacctgtacttcagagagaagaagttcagcgtggaggtgcacgaccccagaagagccagcgtgaccagaagaaccttcggccacagcggcatcgccgtgcacacctggtacgcctgccccgccctgatcaagagcatctgggccatggccatcagccagcaccagttctacctggacagaaagcagagcaagagcaagatccacgccgccagaagcctgagcgagatcgccatcgacctgaccgagaccggcaccctgaagaccagcaagctggccaacatgggcagcaagggcaagatcatcagcggcagcagcggcagcctgctgagcagcggcagccaggagagcgacagcagccagagcgccaagaaggacatgctggccgccctgaagagcagacaggaggccctggaggagaccctgagacagagactggaggagctgaagaagctgtgcctgagagaggccgagctgaccggcaagctgcccgtggagtaccccctggaccccggcgaggagccccccatcgtgagaagaagaatcggcaccgccttcaagctggacgagcagaagatcctgcccaagggcgaggaggccgagctggagagactggagagagagttcgccatccagagccagatcaccgaggccgccagaagactggccagcgaccccaacgtgagcaagaagctgaagaagcagagaaagaccagctacctgaacgccctgaagaagctgcaggagatcgagaacgccatcaacgagaacagaatcaagagcggcaagaagcccacccagagagccagcctgatcatcgacgacggcaacatcgccagcgaggacagcagcctgagcgacgccctggtgctggaggacgaggacagccaggtgaccagcaccatcagccccctgcacagcccccacaagggcctgccccccagaccccccagccacaacagacccccccccccccagagcctggagggcctgagacagatgcactaccacagaaacgactacgacaagagccccatcaagcccaagatgtggagcgagagcagcctggacgagccctacgagaaggtgaagaagagaagcagccacagccacagcagcagccacaagagattccccagcaccggcagctgcgccgaggccggcggcggcagcaacagcctgcagaacagccccatcagaggcctgccccactggaacagccagagcagcatgcccagcacccccgacctgagagtgagaagcccccactacgtgcacagcaccagaagcgtggacatcagccccaccagactgcacagcctggccctgcacttcagacacagaagcagcagcctggagagccagggcaagctgctgggcagcgagaacgacaccggcagccccgacttctacacccccagaaccagaagcagcaacggcagcgaccccatggacgactgcagcagctgcaccagccacagcagcagcgagcactactaccccgcccagatgaacgccaactacagcaccctggccgaggacagccccagcaaggccagacagagacagagacagagacagagagccgccggcgccctgggcagcgccagcagcggcagcatgcccaacctggccgccagaggcggcgccggcggcgccggcggcgccggcggcggcgtgtacctgcacagccagagccagcccagcagccagtacagaatcaaggagtaccccctgtacatcgagggcggcgccacccccgtggtggtgagaagcctggagagcgaccaggagggccactacagcgtgaaggcccagttcaagaccagcaacagctacaccgccggcggcctgttcaaggagagctggagaggcggcggcggcgacgagggcgacaccggcagactgacccccagcagaagccagatcctgagaacccccagcctgggcagagagggcgcccacgacaagggcgccggcagagccgccgtgagcgacgagctgagacagtggtaccagagaagcaccgccagccacaaggagcacagcagactgagccacaccagcagcaccagcagcgacagcggcagccagtacagcaccagcagccagagcaccttcgtggcccacagcagagtgaccagaatgccccagatgtgcaaggccaccagcgccgccctgccccagagccagagaagcagcacccccagcagcgagatcggcgccaccccccccagcagcccccaccacatcctgacctggcagaccggcgaggccaccgagaacagccccatcctggacggcagcgagagccccccccaccagagcaccgacgagtag

SEQ ID NO: 10476 - DNA, 864 bp, Artificial Sequence
  Description of Artificial Sequence: Synthetic coding sequence
atgagccaggcctggtggcacaccagcgtgagccccgccacccaggaggccaaggccggcggcctgctgcagcccagaagacagagactgtggctgaagagatgcagaatcagcagcagcgcctgcgaggacctgagcgccgccctgatcgccaacaagaacctgaccagaatggacctgagcggcaacggcgtgggcttccccggcatgatgctgctgtgcgagggcctgagacacccccagtgcagactgcagatgatccagctgagaaagtgccagctggagagcggcgcctgccaggagatggccagcgtgctgggcaccaacccccacctggtggagctggacctgaccggcaacgccctggaggacctgggcctgagactgctgtgccagggcctgagacaccccgtgtgcagactgagaaccctgtggctgaagatctgcagactgaccgccgccgcctgcgacgagctggccagcaccctgagcgtgaaccagagcctgagagagctggacctgagcctgaacgagctgggcgacctgggcgtgctgctgctgtgcgagggcctgagacaccccacctgcaagctgcagaccctgagactggacagctgcggcctgaccgccaaggcctgcgagaacctgtacttcaccctgggcatcaaccagaccctgaccgacctgtacctgaccaacaacgccctgggcgacaccggcgtgagactgctgtgcaagagactgagccaccccggctgcaagctgagagtgctgtggctgttcggcatggacctgaacaagatgacccacagcagactggccgccctgagagtgaccaagccctacctggacatcggctgctag

SEQ ID NO: 10477 - DNA, 615 bp, Artificial Sequence
  Description of Artificial Sequence: Synthetic coding sequence
atggccggctacctgagcgagagcgacttcgtgatggtggaggagggcttcagcaccagagacctgctgaaggagctgaccctgggcgccagccaggccaccaccgacgaggtggccgccttcttcgtggccgacctgggcgccatcgtgagaaagcacttctgcttcctgaagtgcctgcccagagtgagacccttctacgccgtgaagtgcaacagcagccccggcgtgctgaaggtgctggcccagctgggcctgggcttcagctgcgccaacaagatcgccagcgtgatcaacagcgccctggacctgtacttccccgagggctgcggcgtggacatcttcgccgagctgggcagatactacgtgaccagcgccttcaccgtggccgtgagcatcatcgccaagaaggaggtgctgctggaccagcccggcagagaggaggagaacggcagcaccagcaagaccatcgtgtaccacctggacgagggcgtgtacggcatcttcaacagcgtgctgttcgacaacatctgccccacccccatcctgcagaagagcaagaaccacagcccctgctacatgagcctggagagcatccacttcatcgccgtgtag

SEQ ID NO: 10478 - DNA, 519 bp, Artificial Sequence
  Description of Artificial Sequence: Synthetic coding sequence
atgatgaagctgaagagcaaccagaccagaacctacgacggcgacggctacaagaagagagccgcctgcctgtgcttcagaagcgagagcgaggaggaggtgctgctggtgagcagcagcagacaccccgacagatggatcgtgcccggcggcggcatggagcccgaggaggagcccagcgtggccgccgtgagagaggtgtgcgaggaggccggcgtgaagggcaccctgggcagactggtgggcatcttcgagaaccaggagagaaagcacagaacctacgtgtacgtgctgatcgtgaccgaggtgctggaggactgggaggacagcgtgaacatcggcagaaagagagagtggttcaagatcgaggacgccatcaaggtgctgcagtaccacaagcccgtgcaggccagctacttcgagaccctgagacagggctacagcgccaacaacggcacccccgtggtggccaccacctacagcgtgagcgcccagagcagcatgagcggcatcagatag

SEQ ID NO: 10479 - DNA, 4284 bp, Artificial Sequence; identical to SEQ ID NO: 9740
  Description of Artificial Sequence: Synthetic coding sequence

SEQ ID NO: 10480 - DNA, 1179 bp, Artificial Sequence
  Description of Artificial Sequence: Synthetic coding sequence
atgggcgacagctgccccgccgtgaccttcagaagccagaaggagaacagagccggcctgcaggagaagctgagatacctgcagcagcagctgcaggacgagacccccagaagacaggaggccgagctgcaggagcccgaggagaagcaggagcccgaggagaagcaggagcccgaggagaagcagaagcccgaggccggcctgagctggaacagcctgggccccgccgccaccagccagggctgccccggcccccccggcagccccgacaagcccagcagaccccacggcctggtgcccgccggctggggcatgggccccagagccggcgagggcccctacgtgagcgagcaggagctgcagaagctgttcaccggcatcgaggagctgagaagagaggtgagcagcctgaccgccagatggcaccaggaggagggcgccgtgcaggaggccctgagactgctgggcggcctgggcggcagagtggacggcttcctgggccagtgggagagagcccagagagagcaggcccagaccgccagagacctgcaggagctgagaggcagagccgacgagctgtgcaccatggtggagagaagcgccgtgagcgtggccagcctgagaagcgagctggagggcctgggccccctgaagcccatcctggaggagttcggcagacagttccagaacagcagaagaggccccgacctgagcatgaacctggacagaagccaccagggcaactgcgccagatgcgccagccagggcagccagctgagcaccgagagcctgcagcagctgctggacagagccctgaccagcctggtggacgaggtgaagcagagaggcctgacccccgcctgccccagctgccagagactgcacaagaagatcctggagctggagagacaggccctggccaagcacgtgagagccgaggccctgagcagcaccctgagactggcccaggacgaggccctgagagccaagaacctgctgctgaccgacaagatgaagcccgaggagaagatggccaccctggaccacctgcacctgaagatgtgcagcctgcacgaccacctgagcaacctgcccctggagggcagcaccggcaccatgggcggcggcagcagcgccggcaccccccccaagcagggcggcagcgcccccgagcagtag

SEQ ID NO: 10481 - DNA, 1692 bp, Artificial Sequence
  Description of Artificial Sequence: Synthetic coding sequence
atgagcgacgacgccggcgacaccctggccaccggcgacaaggccgaggtgaccgagatgcccaacagcgacagcctgcccgaggacgccgaggtgcactgcgacagcgccgccgtgagccacgagcccacccccgccgaccccagaggcgagggccacgagaacgccgccgtgcagggcgccggcgccgccgccatcggcccccccgtgcagccccaggacgccaacgccctggagccccccctgaacggcgacgtgaccgaggacaccctggccgagtgcatcgacagcgtgagcctggaggccgagcccagaagcgagatccccctgcaggagcagaactacctggccgtggacagcccccccagcggcggcggctgggccggctggggcagctggggcaagagcctgctgagcagcgccagcgccaccgtgggccacggcctgaccgccgtgaaggagaaggccggcgccaccctgagaatccacggcgtgaacagcggcagcagcgagggcgcccagcccaacaccgagaacggcgtgcccgagatcaccgacgccgccaccgaccagggccccgccgagagcccccccaccagccccagcagcgccagcagaggcatgctgagcgccatcaccaacgtggtgcagaacaccggcaagagcgtgctgaccggcggcctggacgccctggagttcatcggcaagaagaccatgaacgtgctggccgagagcgaccccggcttcaagagaaccaagaccctgatggagagaaccgtgagcctgagccagatgctgagagaggccaaggagaaggagaagcagagactggcccagcagctgaccatggagagaaccgcccactacggcatgctgttcgacgagtaccagggcctgagccacctggaggccctggagatcctgagcaacgagagcgagagcaaggtgcagagcttcctggccagcctggacggcgagaagctggagctgctgaagaacgacctgatcagcatcaaggacatcttcgccgccaaggagctggagaacgaggagaaccaggaggagcagggcctggaggagaagggcgaggagttcgccagaatgctgaccgagctgctgttcgagctgcacgtggccgccacccccgacaagctgaacaaggccatgaagagagcccacgactgggtggaggaggaccagaccgtggtgagcgtggacgtggccaaggtgagcgaggaggagaccaagaaggaggagaaggaggagaagagccaggacccccaggaggacaagaaggaggagaagaagaccaagaccatcgaggaggtgtacatgagcagcatcgagagcctggccgaggtgaccgccagatgcatcgagcagctgcacaaggtggccgagctgatcctgcacggccaggaggaggagaagcccgcccaggaccaggccaaggtgctgatcaagctgaccaccgccatgtgcaacgaggtggccagcctgagcaagaagttcaccaacagcctgaccaccgtgggcagcaacaagaaggccgaggtgctgaaccccatgatcagcagcgtgctgctggagggctgcaacagcaccacctacatccaggacgccttccagctgctgctgcccgtgctgcaggtgagccacatccagaccagctgcctgaaggcccagccctag

SEQ ID NO: 10482 - DNA, 1257 bp, Artificial Sequence
  Description of Artificial Sequence: Synthetic coding sequence
atgttcagccccgaccaggagaaccaccccagcaaggcccccgtgaagtacggcgagctgatcgtgctgggctacaacggcagcctgcccaacggcgacagaggcagaagaaagagcagattcgccctgttcaagagacccaaggccaacggcgtgaagcccagcaccgtgcacatcgcctgcaccccccaggccgccaaggccatcagcaacaaggaccagcacagcatcagctacaccctgagcagagcccagaccgtggtggtggagtacacccacgacagcaacaccgacatgttccagatcggcagaagcaccgagagccccatcgacttcgtggtgaccgacaccgtgcccggcagccagagcaacagcgacacccagagcgtgcagagcaccatcagcagattcgcctgcagaatcatctgcgagagaaacccccccttcaccgccagaatctacgccgccggcttcgacagcagcaagaacatcttcctgggcgagaaggccgccaagtggaagaccagcgacggccagatggacggcctgaccaccaacggcgtgctggtgatgcaccccagaaacggcttcaccgaggacagcaagcccggcatctggagagagatcagcgtgtgcggcaacgtgttcagcctgagagagaccagaagcgcccagcagagaggcaagatggtggagatcgagaccaaccagctgcaggacggcagcctgatcgacctgtgcggcgccaccctgctgtggagaaccgccgagggcctgagccacacccccaccgtgaagcacctggaggccctgagacaggagatcaacgccgccagaccccagtgccccgtgggcttcaacaccctggccttccccagcatgaagagaaaggacgtggtggacgagaagcagccctgggtgtacctgaactgcggccacgtgcacggctaccacaactggggcaacaaggaggagagagacggcaaggacagagagtgccccatgtgcagaagcgtgggcccctacgtgcccctgtggctgggctgcgaggccggcttctacgtggacgccggcccccccacccacgccttcagcccctgcggccacgtgtgcagcgagaagaccaccgcctactggagccagatccccctgccccacggcacccacaccttccacgccgcctgccccttctgcgcccaccagctggccggcgagcagggctacatcagactgatcttccagggccccctggactag

SEQ ID NO: 10483 - DNA, 3963 bp, Artificial Sequence
  Description of Artificial Sequence: Synthetic coding sequence
atgcaggacgacagcatcgaggccagcaccagcatcagccagctgctgagagagagctacctggccgagaccagacacagaggcaacaacgagagaagcagagccgagcccagcagcaacccctgccacttcggcagccccagcggcgccgccgagggcggcggcggccaggacgacctgcccgacctgagcgccttcctgagccaggaggagctggacgagagcgtgaacctggccagactggccatcaactacgaccccctggagaaggccgacgagacccaggccagaaagagactgagccccgaccagatgaagcacagccccaacctgagcttcgagcccaacttctgccaggacaaccccagaagccccaccagcagcaaggagagcccccaggaggccaagagaccccagtactgcagcgagacccagagcaagaaggtgttcctgaacaaggccgccgacttcatcgaggagctgagcagcctgttcaagagccacagcagcaagagaatcagacccagagcctgcaagaaccacaagagcaagctggagagccagaacaaggtgatgcaggagaacagcagcagcttcagcgacctgagcgagagaagagagagaagcagcgtgcccatccccatccccgccgacaccagagacaacgaggtgaaccacgccctggagcagcaggaggccaagagaagagaggccgagcaggccgccagcgaggccgccggcggcgacaccacccccggcagcagccccagcagcctgtactacgaggagcccctgggccagccccccagattcacccagaagctgagaagcagagaggtgcccgagggcaccagagtgcagctggactgcatcgtggtgggcatcccccccccccaggtgagatggtactgcgagggcaaggagctggagaacagccccgacatccacatcgtgcaggccggcaacctgcacagcctgaccatcgccgaggccttcgaggaggacaccggcagatacagctgcttcgccagcaacatctacggcaccgacagcaccagcgccgagatctacatcgagggcgtgagcagcagcgacagcgagggcgaccccaacaaggaggagatgaacagaatccagaagcccaacgaggtgagcagcccccccaccaccagcgccgtgatcccccccgccgtgccccaggcccagcacctggtggcccagcccagagtggccaccatccagcagtgccagagccccaccaactacctgcagggcctggacggcaagcccatcatcgccgcccccgtgttcaccaagatgctgcagaacctgagcgccagcgagggccagctggtggtgttcgagtgcagagtgaagggcgcccccagccccaaggtggagtggtacagagagggcaccctgatcgaggacagccccgacttcagaatcctgcagaagaagcccagaagcatggccgagcccgaggagatctgcaccctggtgatcgccgaggtgttcgccgaggacagcggctgcttcacctgcaccgccagcaacaagtacggcaccgtgagcagcatcgcccagctgcacgtgagaggcaacgaggacctgagcaacaacggcagcctgcacagcgccaacagcaccaccaacctggccgccatcgagccccagcccagccccccccacagcgagccccccagcgtggagcagccccccaagcccaagctggagggcgtgctggtgaaccacaacgagcccagaagcagcagcagaatcggcctgagagtgcacttcaacctgcccgaggacgacaagggcagcgaggccagcagcgaggccggcgtggtgaccaccagacagaccagacccgacagcttccaggagagattcaacggccaggccaccaagacccccgagcccagcagccccgtgaaggagcccccccccgtgctggccaagcccaagctggacagcacccagctgcagcagctgcacaaccaggtgctgctggagcagcaccagctgcagaaccccccccccagcagccccaaggagttccccttcagcatgaccgtgctgaacagcaacgccccccccgccgtgaccaccagcagcaagcaggtgaaggcccccagcagccagaccttcagcctggccagacccaagtacttcttccccagcaccaacaccaccgccgccaccgtggcccccagcagcagccccgtgttcaccctgagcagcaccccccagaccatccagagaaccgtgagcaaggagagcctgctggtgagccaccccagcgtgcagaccaagagccccggcggcctgagcatccagaacgagcccctgccccccggccccaccgagcccacccccccccccttcaccttcagcatccccagcggcaaccagttccagcccagatgcgtgagccccatccccgtgagccccaccagcagaatccagaaccccgtggccttcctgagcagcgtgctgcccagcctgcccgccatcccccccaccaacgccatgggcctgcccagaagcgcccccagcatgcccagccagggcctggccaagaagaacaccaagagcccccagcccgtgaacgacgacaacatcagagagaccaagaacgccgtgatcagagacctgggcaagaagatcaccttcagcgacgtgagacccaaccagcaggagtacaagatcagcagcttcgagcagagactgatgaacgagatcgagttcagactggagagaacccccgtggacgagagcgacgacgagatccagcacgacgagatccccaccggcaagtgcatcgcccccatcttcgacaagagactgaagcacttcagagtgaccgagggcagccccgtgaccttcacctgcaagatcgtgggcatccccgtgcccaaggtgtactggttcaaggacggcaagcagatcagcaagagaaacgagcactgcaagatgagaagagagggcgacggcacctgcagcctgcacatcgagagcaccaccagcgacgacgacggcaactacaccatcatggccgccaacccccagggcagaatcagctgcagcggccacctgatggtgcagagcctgcccatcagaagcagactgaccagcgccggccagagccacagaggcagaagcagagtgcaggagagagacaaggagcccctgcaggagagattcttcagaccccacttcctgcaggcccccggcgacatggtggcccacgagggcagactgtgcagactggactgcaaggtgagcggcctgcccccccccgagctgacctggctgctgaacggccagcccgtgctgcccgacgccagccacaagatgctggtgagagagaccggcgtgcacagcctgctgatcgaccccctgacccagagagacgccggcacctacaagtgcatcgccaccaacaagaccggccagaacagcttcagcctggagctgagcgtggtggccaaggaggtgaagaaggcccccgtgatcctggagaagctgcagaactgcggcgtgcccgagggccaccccgtgagactggagtgcagagtgatcggcatgcccccccccgtgttctactggaagaaggacaacgagaccatcccctgcaccagagagagaatcagcatgcaccaggacaccaccggctacgcctgcctgctgatccagcccgccaagaagagcgacgccggctggtacaccctgagcgccaagaacgaggccggcatcgtgagctgcaccgccagactggacatctacgcccagtggcaccaccagatccccccccccatgagcgtgagacccagcggcagcagatacggcagcctgaccagcaagggcctggacatcttcagcgccttcagcagcatggagagcaccatggtgtacagctgcagcagcagaagcgtggtggagagcgacgagctgtag

SEQ ID NO: 10484 - DNA, 4206 bp, Artificial Sequence
  Description of Artificial Sequence: Synthetic coding sequence
atggccagctgcgccagcatcgacatcgaggacgccacccagcacctgagagacatcctgaagctggacagacccgccggcggccccagcgccgagagccccagacccagcagcgcctacaacggcgacctgaacggcctgctggtgcccgaccccctgtgcagcggcgacagcaccagcgccaacaagaccggcctgagaaccatgccccccatcaacctgcaggagaagcaggtgatctgcctgagcggcgacgacagcagcacctgcatcggcatcctggccaaggaggtggagatcgtggccagcagcgacagcagcatcagcagcaaggccagaggcagcaacaaggtgaagatccagcccgtggccaagtacgactgggagcagaagtactactacggcaacctgatcgccgtgagcaacagcttcctggcctacgccatcagagccgccaacaacggcagcgccatggtgagagtgatcagcgtgagcaccagcgagagaaccctgctgaagggcttcaccggcagcgtggccgacctggccttcgcccacctgaacagcccccagctggcctgcctggacgaggccggcaacctgttcgtgtggagactggccctggtgaacggcaagatccaggaggagatcctggtgcacatcagacagcccgagggcacccccctgaaccacttcagaagaatcatctggtgccccttcatccccgaggagagcgaggactgctgcgaggagagcagccccaccgtggccctgctgcacgaggacagagccgaggtgtgggacctggacatgctgagaagcagccacagcacctggcccgtggacgtgagccagatcaagcagggcttcatcgtggtgaagggccacagcacctgcctgagcgagggcgccctgagccccgacggcaccgtgctggccaccgccagccacgacggctacgtgaagttctggcagatctacatcgagggccaggacgagcccagatgcctgcacgagtggaagccccacgacggcagacccctgagctgcctgctgttctgcgacaaccacaagaagcaggaccccgacgtgcccttctggagattcctgatcaccggcgccgaccagaacagagagctgaagatgtggtgcaccgtgagctggacctgcctgcagaccatcagattcagccccgacatcttcagcagcgtgagcgtgccccccagcctgaaggtgtgcctggacctgagcgccgagtacctgatcctgagcgacgtgcagagaaaggtgctgtacgtgatggagctgctgcagaaccaggaggagggccacgcctgcttcagcagcatcagcgagttcctgctgacccaccccgtgctgagcttcggcatccaggtggtgagcagatgcagactgagacacaccgaggtgctgcccgccgaggaggagaacgacagcctgggcgccgacggcacccacggcgccggcgccatggagagcgccgccggcgtgctgatcaagctgttctgcgtgcacaccaaggccctgcaggacgtgcagatcagattccagccccagctgaaccccgacgtggtggcccccctgcccacccacaccgcccacgaggacttcaccttcggcgagagcagacccgagctgggcagcgagggcctgggcagcgccgcccacggcagccagcccgacctgagaagaatcgtggagctgcccgcccccgccgacttcctgagcctgagcagcgagaccaagcccaagctgatgacccccgacgccttcatgacccccagcgccagcctgcagcagatcaccgccagccccagcagcagcagcagcggcagcagcagcagcagcagcagcagcagcagcagcctgaccgccgtgagcgccatgagcagcaccagcgccgtggaccccagcctgaccagaccccccgaggagctgaccctgagccccaagctgcagctggacggcagcctgaccatgagcagcagcggcagcctgcaggccagccccagaggcctgctgcccggcctgctgcccgcccccgccgacaagctgacccccaagggccccggccaggtgcccaccgccaccagcgccctgagcctggagctgcaggaggtggagcccctgggcctgccccaggccagccccagcagaaccagaagccccgacgtgatcagcagcgccagcaccgccctgagccaggacatccccgagatcgccagcgaggccctgagcagaggcttcggcagcagcgcccccgagggcctggagcccgacagcatggccagcgccgccagcgccctgcacctgctgagccccagacccagacccggccccgagctgggcccccagctgggcctggacggcggccccggcgacggcgacagacacaacacccccagcctgctggaggccgccctgacccaggaggccagcacccccgacagccaggtgtggcccaccgcccccgacatcaccagagagacctgcagcaccctggccgagagccccagaaacggcctgcaggagaagcacaagagcctggccttccacagacccccctaccacctgctgcagcagagagacagccaggacgccagcgccgagcagagcgaccacgacgacgaggtggccagcctggccagcgccagcggcggcttcggcaccaaggtgcccgcccccagactgcccgccaaggactggaagaccaagggcagccccagaaccagccccaagctgaagagaaagagcaagaaggacgacggcgacgccgccatgggcagcagactgaccgagcaccaggtggccgagccccccgaggactggcccgccctgatctggcagcagcagagagagctggccgagctgagacacagccaggaggagctgctgcagagactgtgcacccagctggagggcctgcagagcaccgtgaccggccacgtggagagagccctggagaccagacacgagcaggagcagagaagactggagagagccctggccgagggccagcagagaggcggccagctgcaggagcagctgacccagcagctgagccaggccctgagcagcgccgtggccggcagactggagagaagcatcagagacgagatcaagaagaccgtgcccccctgcgtgagcagaagcctggagcccatggccggccagctgagcaacagcgtggccaccaagctgaccgccgtggagggcagcatgaaggagaacatcagcaagctgctgaagagcaagaacctgaccgacgccatcgccagagccgccgccgacaccctgcagggccccatgcaggccgcctacagagaggccttccagagcgtggtgctgcccgccttcgagaagagctgccaggccatgttccagcagatcaacgacagcttcagactgggcacccaggagtacctgcagcagctggagagccacatgaagagcagaaaggccagagagcaggaggccagagagcccgtgctggcccagctgagaggcctggtgagcaccctgcagagcgccaccgagcagatggccgccaccgtggccggcagcgtgagagccgaggtgcagcaccagctgcacgtggccgtgggcagcctgcaggagagcatcctggcccaggtgcagagaatcgtgaagggcgaggtgagcgtggccctgaaggagcagcaggccgccgtgaccagcagcatcatgcaggccatgagaagcgccgccggcacccccgtgcccagcgcccacctggactgccaggcccagcaggcccacatcctgcagctgctgcagcagggccacctgaaccaggccttccagcaggccctgaccgccgccgacctgaacctggtgctgtacgtgtgcgagaccgtggaccccgcccaggtgttcggccagcccccctgccccctgagccagcccgtgctgctgagcctgatccagcagctggccagcgacctgggcaccagaaccgacctgaagctgagctacctggaggaggccgtgatgcacctggaccacagcgaccccatcaccagagaccacatgggcagcgtgatggcccaggtgagacagaagctgttccagttcctgcaggccgagccccacaacagcctgggcaaggccgccagaagactgagcctgatgctgcacggcctggtgacccccagcctgccctag

SEQ ID NO: 10485 - DNA, 576 bp, Artificial Sequence
  Description of Artificial Sequence: Synthetic coding sequence
atgagcagcggcgccgacggcggcggcggcgccgccgtggccgccagaagcgacaagggcagccccggcgaggacggcttcgtgcccagcgccctgggcaccagagagcactgggacgccgtgtacgagagagagctgcagaccttcagagagtacggcgacaccggcgagatctggttcggcgaggagagcatgaacagactgatcagatggatgcagaagcacaagatccccctggacgccagcgtgctggacatcggcaccggcaacggcgtgttcctggtggagctggccaagttcggcttcagcaacatcaccggcatcgactacagccccagcgccatccagctgagcggcagcatcatcgagaaggagggcctgagcaacatcaagctgaaggtggaggacttcctgaacctgagcacccagctgagcggcttccacatctgcatcgacaagggcaccttcgacgccatcagcctgaaccccgacaacgccatcgagaagagaaagcagtacgtgaagagcctgagcagagtgctgaaggtgaagggcttcttcaacaacgtgatgtag

SEQ ID NO: 10486 - DNA, 2622 bp, Artificial Sequence
  Description of Artificial Sequence: Synthetic coding sequence
atgggcaacagagagatggaggagctgatccccctggtgaacagactgcaggacgccttcagcgccctgggccagagctgcctgctggagctgccccagatcgccgtggtgggcggccagagcgccggcaagagcagcgtgctggagaacttcgtgggcagagacttcctgcccagaggcagcggcatcgtgaccagaagacccctggtgctgcagctggtgaccagcaaggccgagtacgccgagttcctgcactgcaagggcaagaagttcaccgacttcgacgaggtgagactggagatcgaggccgagaccgacagagtgaccggcatgaacaagggcatcagcagcatccccatcaacctgagagtgtacagcccccacgtgctgaacctgaccctgatcgacctgcccggcatcaccaaggtgcccgtgggcgaccagccccccgacatcgagtaccagatcagagagatgatcatgcagttcatcaccagagagaactgcctgatcctggccgtgacccccgccaacaccgacctggccaacagcgacgccctgaagctggccaaggaggtggacccccagggcctgagaaccatcggcgtgatcaccaagctggacctgatggacgagggcaccgacgccagagacgtgctggagaacaagctgctgcccctgagaagaggctacgtgggcgtggtgaacagaagccagaaggacatcgacggcaagaaggacatcaaggccgccatgctggccgagagaaagttcttcctgagccaccccgcctacagacacatcgccgacagaatgggcaccccccacctgcagaaggtgctgaaccagcagctgaccaaccacatcagagacaccctgcccaacttcagaaacaagctgcagggccagctgctgagcatcgagcacgaggtggaggcctacaagaacttcaagcccgaggaccccaccagaaagaccaaggccctgctgcagatggtgcagcagttcgccgtggacttcgagaagagaatcgagggcagcggcgaccaggtggacaccctggagctgagcggcggcgccaagatcaacagaatcttccacgagagattccccttcgagatcgtgaagatggagttcaacgagaaggagctgagaagagagatcagctacgccatcaagaacatccacggcatcagaaccggcctgttcacccccgacatggccttcgaggccatcgtgaagaagcagatcgtgaagctgaagggccccagcctgaagagcgtggacctggtgatccaggagctgatcaacaccgtgaagaagtgcaccaagaagctggccaacttccccagactgtgcgaggagaccgagagaatcgtggccaaccacatcagagagagagagggcaagaccaaggaccaggtgctgctgctgatcgacatccaggtgagctacatcaacaccaaccacgaggacttcatcggcttcgccaacgcccagcagagaagcagccaggtgcacaagaagaccaccgtgggcaaccagggcaccaacctgccccccagcagacagatcgtgatcagaaagggctggctgaccatcagcaacatcggcatcatgaagggcggcagcaagggctactggttcgtgctgaccgccgagagcctgagctggtacaaggacgacgaggagaaggagaagaagtacatgctgcccctggacaacctgaaggtgagagacgtggagaagagcttcatgagcagcaagcacatcttcgccctgttcaacaccgagcagagaaacgtgtacaaggactacagattcctggagctggcctgcgacagccaggaggacgtggacagctggaaggccagcctgctgagagccggcgtgtaccccgacaagagcgtgatgaacaagaaggccgagaacgacgagaacggccaggccgagaacttcagcatggacccccagctggagagacaggtggagaccatcagaaacctggtggacagctacatgagcatcatcaacaagtgcatcagagacctgatccccaagaccatcatgcacctgatgatcaacaacgtgaaggacttcatcaacagcgagctgctggcccagctgtacagcagcgaggaccagaacaccctgatggaggagagcgccgagcaggcccagagaagagacgagatgctgagaatgtaccaggccctgaaggaggccctgggcatcatcggcgacatcagcaccgccaccgtgagcacccccgcccccccccccgtggacgacagctggatccagcacagcagaagaagccccccccccagccccaccacccagagaagacccaccctgagcgcccccctggccagacccaccagcggcagaggccccgcccccgccatccccagccccggcccccacagcggcgccccccccgtgcccttcagacccggccccctgccccccttccccagcagcagcgacagcttcggcgcccccccccaggtgcccagcagacccaccagagccccccccagcgtgcccagcagaagacccccccccagccccaccagacccaccatcatcagacccctggagagcagcctgctggactag

SEQ ID NO: 10487 - DNA, 3111 bp, Artificial Sequence
  Description of Artificial Sequence: Synthetic coding sequence
atgagaaagcaggaggtgagaaccggcagagaggccggccagggccacggcaccggcagccccgccgagcaggtgaaggccctgatggacctgctggccggcaagggcagccagggcagccaggccccccaggccctggacagaacccccgacgcccccctgggcccctgcagcaacgacagcagaatccagagacacagaaaggccctgctgagcaaggtgggcggcggccccgagctgggcggcccctggcacagactggccagcctgctgctggtggagggcctgaccgacctgcagctgagagagcacgacttcacccaggtggaggccaccagaggcggcggccaccccgccagaaccgtggccctggacagactgttcctgcccctgagcagagtgagcgtgccccccagagtgagcatcaccatcggcgtggccggcatgggcaagaccaccctggtgagacacttcgtgagactgtgggcccacggccaggtgggcaaggacttcagcctggtgctgcccctgaccttcagagacctgaacacccacgagaagctgtgcgccgacagactgatctgcagcgtgttcccccacgtgggcgagcccagcctggccgtggccgtgcccgccagagccctgctgatcctggacggcctggacgagtgcagaacccccctggacttcagcaacaccgtggcctgcaccgaccccaagaaggagatccccgtggaccacctgatcaccaacatcatcagaggcaacctgttccccgaggtgagcatctggatcaccagcagacccagcgccagcggccagatccccggcggcctggtggacagaatgaccgagatcagaggcttcaacgaggaggagatcaaggtgtgcctggagcagatgttccccgaggaccaggccctgctgggctggatgctgagccaggtgcaggccgacagagccctgtacctgatgtgcaccgtgcccgccttctgcagactgaccggcatggccctgggccacctgtggagaagcagaaccggcccccaggacgccgagctgtggccccccagaaccctgtgcgagctgtacagctggtacttcagaatggccctgagcggcgagggccaggagaagggcaaggccagccccagaatcgagcaggtggcccacggcggcagaaagatggtgggcaccctgggcagactggccttccacggcctgctgaagaagaagtacgtgttctacgagcaggacatgaaggccttcggcgtggacctggccctgctgcagggcgccccctgcagctgcttcctgcagagagaggagaccctggccagcagcgtggcctactgcttcacccacctgagcctgcaggagttcgtggccgccgcctactactacggcgccagcagaagagccatcttcgacctgttcaccgagagcggcgtgagctggcccagactgggcttcctgacccacttcagaagcgccgcccagagagccatgcaggccgaggacggcagactggacgtgttcctgagattcctgagcggcctgctgagccccagagtgaacgccctgctggccggcagcctgctggcccagggcgagcaccaggcctacagaacccaggtggccgagctgctgcagggctgcctgagacccgacgccgccgtgtgcgccagagccatcaacgtgctgcactgcctgcacgagctgcagcacaccgagctggccagaagcgtggaggaggccatggagagcggcgccctggccagactgaccggccccgcccacagagccgccctggcctacctgctgcaggtgagcgacgcctgcgcccaggaggccaacctgagcctgagcctgagccagggcgtgctgcagagcctgctgccccagctgctgtactgcagaaagctgagactggacaccaaccagttccaggaccccgtgatggagctgctgggcagcgtgctgagcggcaaggactgcagaatccagaagatcagcctggccgagaaccagatcagcaacaagggcgccaaggccctggccagaagcctgctggtgaacagaagcctgaccagcctggacctgagaggcaacagcatcggcccccagggcgccaaggccctggccgacgccctgaagatcaacagaaccctgaccagcctgagcctgcagggcaacaccgtgagagacgacggcgccagaagcatggccgaggccctggccagcaacagaaccctgagcatgctgcacctgcagaagaacagcatcggccccatgggcgcccagagaatggccgacctgaagcagaacagaagcctgaaggagctgatgttcagcagcaacagcatcggcgacggcggcgccaaggccctggccgaggccctgaaggtgaaccagggcctggagagcctggacctgcagagcaacagcatcagcgacgccggcgtggccgccctgatgggcgccctgtgcaccaaccagaccctgctgagcctgagcctgagagagaacagcatcagccccgagggcgcccaggccatcgcccacgccctgtgcgccaacagcaccctgaagaacctggacctgcagtggaacttcatccaggccggcgccgcccaggccctgggccaggccctgcagctgaacagaagcctgaccagcctggacctgcaggagaacgccatcggcgacgacggcgcctgcgccgtggccagagccctgaaggtgaacaccgccctgaccgccctgtacctgcaggtggccagcatcggcgccagcggcgcccaggtgctgggcgaggccctggccgtgaacagaaccctggagatcctggacctgagaggcaacgccatcggcgtggccggcgccaaggccctggccaacgccctgaaggtgaacagcagcctgagaagactgaacctgcaggagaacagcctgggcatggacggcgccatctgcatcgccaccgccctgagcggcaaccacagactgcagcacatcaacctgcagggcaaccacatcggcgacagcggcgccagaatgatcagcgaggccatcaagaccaacgcccccacctgcaccgtggagatgtag

SEQ ID NO: 10488 - DNA, 2784 bp, Artificial Sequence
  Description of Artificial Sequence: Synthetic coding sequence
atgttctggaagttcgacctgaacaccaccagccacgtggacaagctgctggacaaggagcacgtgaccctgcaggagctgatggacgaggacgacatcctgcaggagtgcaaggcccagaaccagaagctgctggacttcctgtgcagacagcagtgcatggaggagctggtgagcctgatcacccaggacccccccctggacatggaggagaaggtgagattcaagtaccccaacaccgcctgcgagctgctgacctgcgacgtgccccagatcagcgacagactgggcggcgacgagagcctgctgagcctgctgtacgacttcctggaccacgagccccccctgaaccccctgctggccagcttcttcagcaagaccatcggcaacctgatcgccagaaagaccgagcaggtgatcaccttcctgaagaagaaggacaagttcatcagcctggtgctgaagcacatcggcaccagcgccctgatggacctgctgctgagactggtgagctgcgtggagcccgccggcctgagacaggacgtgctgcactggctgaacgaggagaaggtgatccagagactggtggagctgatccaccccagccaggacgaggacagacagagcaacgccagccagaccctgtgcgacatcgtgagactgggcagagaccagggcagccagctgcaggaggccctggagcccgaccccctgctgaccgccctggagagccaggactgcgtggagcagctgctgaagaacatgttcgacggcgacagaaccgagagctgcctggtgagcggcacccaggtgctgctgaccctgctggagaccagaagagtgggcaccgagggcctggtggacagcttcagccagggcctggagagaagctacgccgtgagcagcagcgtgctgcacggcatcgagcccagactgaaggacttccaccagctgctgctgaacccccccaagaagaaggccatcctgaccaccatcggcgtgctggaggagcccctgggcaacgccagactgcacggcgccagactgatggccgccctgctgcacaccaacacccccagcatcaaccaggagctgtgcagactgaacaccatggacctgctgctggacctgttcttcaagtacacctggaacaacttcctgcacttccaggtggagctgtgcatcgccgccatcctgagccacgccgccagagaggagagaaccgaggccagcggcagcgagagcagagtggagcccccccacgagaacggcaacagaagcctggagaccccccagcccgccgccagcctgcccgacaacaccatggtgacccacctgttccagaagtgctgcctggtgcagagaatcctggaggcctgggaggccaacgaccacacccaggccgccggcggcatgagaagaggcaacatgggccacctgaccagaatcgccaacgccgtggtgcagaacctggagagaggccccgtgcagacccacatcagcgaggtgatcagaggcctgcccgccgactgcagaggcagatgggagagcttcgtggaggagaccctgaccgagaccaacagaagaaacaccgtggacctggccttcagcgactaccagatccagcagatgaccgccaacttcgtggaccagttcggcttcaacgacgaggagttcgccgaccaggacgacaacatcaacgcccccttcgacagaatcgccgagatcaacttcaacatcgacgccgacgaggacagccccagcgccgccctgttcgaggcctgctgcagcgacagaatccagcccttcgacgacgacgaggacgaggacatctgggaggacagcgacaccagatgcgccgccagagtgatggccagacccagattcggcgccccccacgccagcgagagctgcagcaagaacggccccgagagaggcggccaggacggcaaggccagcctggaggcccacagagacgcccccggcgccggcgccccccccgcccccggcaagaaggaggccccccccgtggagggcgacagcgaggccggcgccatgtggaccgccgtgttcgacgagcccgccaacagcacccccaccgcccccggcgtggtgagagacgtgggcagcagcgtgtgggccgccggcaccagcgcccccgaggagaagggctgggccaagttcaccgacttccagcccttctgctgcagcgagagcggccccagatgcagcagccccgtggacaccgagtgcagccacgccgagggcagcagaagccagggccccgagaaggccttcagccccgccagcccctgcgcctggaacgtgtgcgtgaccagaaaggcccccctgctggccagcgacagcagcagcagcggcggcagccacagcgaggacggcgaccagaaggccgccagcgccatggacgccgtgagcagaggccccggcagagaggccccccccctgcccaccgtggccagaaccgaggaggccgtgggcagagtgggctgcgccgacagcagactgctgagccccgcctgccccgcccccaaggaggtgaccgccgcccccgccgtggccgtgccccccgaggccaccgtggccatcaccaccgccctgagcaaggccggccccgccatccccacccccgccgtgagcagcgccctggccgtggccgtgcccctgggccccatcatggccgtgaccgccgcccccgccatggtggccaccctgggcaccgtgaccaaggacggccagatgcccagacagaaggagctgccctag

SEQ ID NO: 10489 - DNA, 2220 bp, Artificial Sequence
  Description of Artificial Sequence: Synthetic coding sequence
atgggcttcagcaacatggaggacgacggccccgaggaggaggagagagtggccgagccccaggccaacttcaacaccccccaggccctgagattcgaggagctgctggccaacctgctgaacgagcagcaccagatcgccaaggagctgttcgagcagctgaagatgaagaagcccagcgccaagcagcagaaggaggtggagaaggtgaagccccagtgcaaggaggtgcaccagaccctgatcctggaccccgcccagagaaagagactgcagcagcagatgcagcagcacgtgcagctgctgacccagatccacctgctggccacctgcaaccccaacctgaaccccgaggccagcagcaccagaatctgcctgaaggagctgggcaccttcgcccagagcagcatcgccctgcaccaccagtacaaccccaagttccagaccctgttccagccctgcaacctgatgggcgccatgcagctgatcgaggacttcagcacccacgtgagcatcgactgcagcccccacaagaccgtgaagaagaccgccaacgagttcccctgcctgcccaagcaggtggcctggatcctggccaccagcaaggtgttcatgtaccccgagctgctgcccgtgtgcagcctgaaggccaagaacccccaggacaagatcctgttcaccaaggccgaggacaacctgctggccctgggcctgaagcacttcgagggcaccgagttcctgaaccccctgatcagcaagtacctgctgacctgcaagaccgccagacagctgaccgtgagaatcaagaacctgaacatgaacagagcccccgacaacatcatcaagttctacaagaagaccaagcagctgcccgtgctgggcaagtgctgcgaggagatccagccccaccagtggaagccccccatcgagagagaggagcacagactgcccttctggctgaaggccagcctgcccagcatccaggaggagctgagacacatggccgacggcgccagagaggtgggcaacatgaccggcaccaccgagatcaacagcgaccagggcctggagaaggacaacagcgagctgggcagcgagaccagataccccctgctgctgcccaagggcgtggtgctgaagctgaagcccgtggccgacagattccccaagaaggcctggagacagaagagaagcagcgtgctgaagcccctgctgatccagcccagccccagcctgcagcccagcttcaaccccggcaagacccccgcccagagcacccacagcgaggccccccccagcaagatggtgctgagaatcccccaccccatccagcccgccaccgtgctgcagaccgtgcccggcgtgccccccctgggcgtgagcggcggcgagagcttcgagagccccgccgccctgcccgccatgccccccgaggccagaaccagcttccccctgagcgagagccagaccctgctgagcagcgcccccgtgcccaaggtgatgatgcccagccccgccagcagcatgttcagaaagccctacgtgagaagaagacccagcaagagaagaggcgccagagccttcagatgcatcaagcccgcccccgtgatccaccccgccagcgtgatcttcaccgtgcccgccaccaccgtgaagatcgtgagcctgggcggcggctgcaacatgatccagcccgtgaacgccgccgtggcccagagcccccagaccatccccatcgccaccctgctggtgaaccccaccagcttcccctgccccctgaaccagcccctggtggccagcagcgtgagccccctgatcgtgagcggcaacagcgtgaacctgcccatccccagcacccccgaggacaaggcccacatgaacgtggacatcgcctgcgccgtggccgacggcgagaacgccttccagggcctggagcccaagctggagccccaggagctgagccccctgagcgccaccgtgttccccaaggtggagcacagccccggccccccccccgtggacaagcagtgccaggagggcctgagcgagaacagcgcctacagatggaccgtggtgaagaccgaggagggcagacaggccctggagcccctgccccagggcatccaggagagcctgaacaacagcagccccggcgacctggaggaggtggtgaagatggagcccgaggacgccaccgaggagatcagcggcttcctgtag

SEQ ID NO: 10490 - DNA, 1911 bp, Artificial Sequence
  Description of Artificial Sequence: Synthetic coding sequence
atggagaaggccgtgaacgacggcagccacagcgaggagctgttctgccacctgaagaccatcagcgagaaggaggacctgcccagatgcaccagcgagagccacctgagctgcctgaagcaggacatcctgaacgagaagaccgagctggaggccaccctgaaggaggccgagctggtgacccacagcgtggagctgctgctgcccctgttcaaggacaccatcgagaagatcaacttcgagaacgccaacctgagcgccctgaacctgaagatcagcgagcagaaggagatcctgatcaaggagctggacaccttcaagagcgtgaagctggccctggagcacctgctgagaaagagagactacaagcagaccggcgacaacctgagcagcatgctgctggagaacctgaccgacaacgagagcgagaacaccaacctgaagaagaaggtgttcgagaaggaggcccacatccaggagctgagctgcctgttccagagcgagaaggccaacaccctgaaggccaacagattcagccagagcgtgaaggtggtgcacgagagactgcagatccagatccacaagagagaggccgagaacgacaagctgaaggagtacgtgaagagcctggagaccaagatcgccaagtggaacctgcagagcagaatgaacaagaacgaggccatcgtgatgaaggaggccagcagacagaagaccgtggccctgaagaaggccagcaaggtgtacaagcagagactggaccacttcaccggcgccatcgagaagctgaccagccagatcagagaccaggaggccaagctgagcgagaccatcagcgccagcaacgcctggaagagccactacgagaagatcgtgatcgagaagaccgagctggaggtgcagatcgagaccatgaagaagcagatcatcaacctgctggaggacctgaagaagatggaggaccacggcaagaacagctgcgaggagatcctgagaaaggtgcacagcatcgagtacgagaacgagaccctgaacctggagaacaccaagctgaagctgagattcccctgcagaatcaccgagagcaagaacatgaacatcctgatcgtgctggacatgctgtgctacatcagcagcgagaagaccaccctggccgccctgaaggacgaggtggtgagcgtggagaacgagctgagcgagctgcaggaggtggagaagaagcagaagaccctgatcgagatgtacaagacccaggtgcagaagctgcaggaggccgccgagatcgtgaagagcagatgcgagaacctgctgcacaagaacaaccagatcaccaagaccaagaacaagaacgtggagaagatgagaggccagatggagagccacctgaaggagctggagagagtgtgcgacagcctgaccgccgccgagagaagactgcacgagtgccaggagagcctgcagtgctgcaagggcaagtgcgccgaccaggagcacaccatcagagagctgcagggccaggtggacggcaaccacaacctgctgaccaagctgagcctggaggaggagaactgcctgatccagctgaagtgcgagaacctgcagcagaagctggagcagatggacgccgagaacaaggagctggagaagaagctggccaaccaggaggagtgcctgaagcacagcaacctgaagttcaaggagaagagcgccgagtacaccgccctggccagacagctggaggccgccctggaggagggcagacagaaggtggccgaggagatcgagaagatgagcagcagagagagcgccctgcagatcaagatcctggacctggagaccgagctgagaaagaagaacgaggagcagaaccagctggtgtgcaagatgaacagcgaccccgagaccccctag

SEQ ID NO: 10491 - DNA, 873 bp, Artificial Sequence
  Description of Artificial Sequence: Synthetic coding sequence
atggccgccgtggagaagagaagacaggccgtgcccccccccgccggcttcaccgacagcggcagacagagcgtgagcagagccgccggcgccgccgagagcgaggaggacttcctgagacaggtgggcgtgaccgagatgctgagagccgccctgctgaaggtgctggaggccagacccgaggagcccatcgccttcctggcccactacttcgagaacatgggcctgagaagccccgtgaacggcggcgccggcgagccccccggccagctgctgctgcagcagcagagactgggcagagccctgtggcacctgagactggcccaccacagccagagagccgccttcaacaacaacgtgagcgtggcctacgagtgcctgagcgccggcggcagaagaaagagacccggcctggacggcagaacctacagcgagctgctgagaagaatctgcagagacggccaggcccccgaggaggtggtggcccccctgctgagaaaggtgcagtgcagagaccacgaggccgtgcccctgagcgtgttcagagccggcaccctgacctgcttcgtgctgctggagttcgtggccagagccggcgccctgttccagctgctggaggacagcgccgccgccgtggccgacagaagagtgggccaggccgtgctggacaccctggagggcgccctgcaggccagcgacgccgccgcccccgccagattcctggaggccggcagcagactgggccccgacagcctggccctggccctggacagagccgtgggcggcagaagacccagcgcccccatgaccagagaggagttcctggagagagccgccgccctgttcatcgccaaggtgaagcccgtgggctag

SEQ ID NO: 10492 - DNA, 1221 bp, Artificial Sequence
  Description of Artificial Sequence: Synthetic coding sequence
atggccgacagccagctgttctgcgtggccgaggagagaagcggccactgcgccgtggtggacggcaacttcctgtacgtgtggggcggctacgtgagcatcgaggacaacgaggtgtacctgcccaacgacgagatctggacctacgacatcgacagcggcctgtggagaatgcacctgatggagggcgagctgcccgccagcatgagcggcagctgcggcgcctgcatcaacggcaagctgtacatcttcggcggctacgacgacaagggctacagcaacagactgtacttcgtgaacctgagaaccagagacgagacctacatctgggagaagatcaccgacttcgagggccagccccccacccccagagacaagctgagctgctgggtgtacaaggacagactgatctacttcggcggctacggctgcagaagacacagcgagctgcaggactgcttcgacgtgcacgacgccagctgggaggagcagatcttctggggctggcacaacgacgtgcacatcttcgacaccaagacccagacctggttccagcccgagatcaagggcggcgtgcccccccagcccagagccgcccacacctgcgccgtgctgggcaacaagggctacatcttcggcggcagagtgctgcagaccagaatgaacgacctgcactacctgaacctggacacctggacctggagcggcagaatcaccatcaacggcgagagccccaagcacagaagctggcacaccctgacccccatcgccgacgacaagctgttcctgtgcggcggcctgagcgccgacaacatccccctgagcgacggctggatccacaacgtgaccaccaactgctggaagcagctgacccacctgcccaagaccagacccagactgtggcacaccgcctgcctgggcaaggagaacgagatcatggtgttcggcggcagcaaggacgacctgctggccctggacaccggccactgcaacgacctgctgatcttccagacccagccctacagcctgctgagaagctgcctggactgcatcggcaagaacagcatcatgctggagagccagatcagcctgctgccccccaagctgctgcagcaggtgctgaagaagatcaccttctgggccgccgccaaccacagagaggagcagagagtgcagaaggaggagaccgagaacaagtaccagtggatcagcagcaactag

SEQ ID NO: 10493 - DNA, 1113 bp, Artificial Sequence
  Description of Artificial Sequence: Synthetic coding sequence
atggtgcagcccttcaccaccatccccttccccccccccccccagaacggcatccccaccgagtacggcgtgccccacacccaggactacgccggccagaccggcgagcacaacctgaccctgtacggcagcacccaggcccacggcgagcagagcagcaacagccccagcacccagaacggcagcctgaccaccgagggcggcgcccagaccgacggccagcagagccagacccagagcagcgagaacagcgagagcaagagcacccccaagagactgcacgtgagcaacatccccttcagattcagagaccccgacctgagacagatgttcggccagttcggcaagatcctggacgtggagatcatcttcaacgagagaggcagcaagggcttcggcttcgtgaccttcgagaacagcgccgacgccgacagagccagagagaagctgcacggcaccgtggtggagggcagaaagatcgaggtgaacaacgccaccgccagagtgatgaccaacaagaagatggtgaccccctacgccaacggctggaagctgagccccgtggtgggcgccgtgtacggccccgagctgtacgccgccagcagcttccaggccgacgtgagcctgggcaacgacgccgccgtgcccctgagcggcagaggcggcatcaacacctacatccccctgatcatccccggcttcccctaccccaccgccgccaccaccgccgccgccttcagaggcgcccacctgagaggcagaggcagaaccgtgtacggcgccgtgagagccgtgccccccaccgccatccccgcctaccccggcgtggtgtaccaggacggcttctacggcgccgacctgtacatcgagagcgccaactgcttcagaagcaacagagtggacatgcagcccaccgacatgcacagcctgctgctgcagccccagccccccctgctgcagcccctgcagcccctgaccgtgaccgtgatggccggctgcacccagcccacccccaccatgcccctgcccctgcccctggccatggagctggccctgtggagagtgtacaccgaggtggccaccgccgacctgccccccaccgaggtgacctag

SEQ ID NO: 10494 - DNA, 534 bp, Artificial Sequence
  Description of Artificial Sequence: Synthetic coding sequence
atgagcgaggacagcgagaaggaggactacagcgacagaaccatcagcgacgaggacgagagcgacgaggacatgttcatgaagttcgtgagcgaggacctgcacagatgcgccctgctgaccgccgacagcttcggcgaccccttcttccccagaaccacccagatcctgctggagtaccagctgggcagatgggtgcccagactgagagagcccagagacctgtacggcgtgagcagcagcggccccctgagccccaccagatggccctaccactgcgaggtgatcgacgagaaggtgcagcacatcgacggcgtgagctgctggagcgagagccaccaggccggcgcccagtggtgcgacctgggcagcctgcagccccccccccccagattcaagagattcgcctgcttcagcctgctgagcagcagagactacagaagagtgccccccagaagcgccaacttcgtgttcctggtggagaccggcttccaccacgtgggccaggacggcctgagactgctgaccagctag

SEQ ID NO: 10495 - DNA, 1827 bp, Artificial Sequence
  Description of Artificial Sequence: Synthetic coding sequence
atgagcgacaagagcgacctgaaggccgagctggagagaaagaagcagagactggcccagatcagagaggagaagaagagaaaggaggaggagagaaagaagaaggaggccgacatgcagcagaagaaggagcccgtgcaggacgacagcgacctggacagaaagagaagagagaccgaggccctgctgcagagcatcggcatcagccccgagccccccctggtgcccacccccatgagccccagcagcaagagcgtgagcacccccagcgaggccggcagccaggacagcggcgacctgggccccctgaccagaagaagactgcacaagctgggcgtgagcaaggtgacccaggtggacttcctgcccagagaggtggtgagctacagcaaggagacccagacccccctggccacccaccagagcgaggaggacgaggaggacgaggagatggtggagagcaaggtgggccaggacagcgagctggagaaccaggacaagaagcaggaggtgaaggaggccccccccagagagctgaccgaggaggagaagcagcagatcctgcacagcgaggagttcctgatcttcttcgacagaaccatcagagtgatcgagagagccctggccgaggacagcgacatcttcttcgactacagcggcagagagctggaggagaaggacggcgacgtgcaggccggcgccaacctgagcttcaacagacagttctacgacgagcactggagcaagcacagagtggtgacctgcatggactggagcctgcagtaccccgagctgatggtggccagctacaacaacaacgaggacgccccccacgagcccgacggcgtggccctggtgtggaacatgaagttcaagaagaccacccccgagtacgtgttccactgccagagcagcgtgatgagcgtgtgcttcgccagattccaccccaacctggtggtgggcggcacctacagcggccagatcgtgctgtgggacaacagaagccacagaagaacccccgtgcagagaacccccctgagcgccgccgcccacacccaccccgtgtactgcgtgaacgtggtgggcacccagaacgcccacaacctgatcaccgtgagcaccgacggcaagatgtgcagctggagcctggacatgctgagcaccccccaggagagcatggagctggtgtacaacaagagcaagcccgtggccgtgaccggcatggccttccccaccggcgacgtgaacaacttcgtggtgggcagcgaggagggcaccgtgtacaccgcctgcagacacggcagcaaggccggcatcggcgaggtgttcgagggccaccagggccccgtgaccggcatcaactgccacatggccgtgggccccatcgacttcagccacctgttcgtgaccagcagcttcgactggaccgtgaagctgtggaccaccaagcacaacaagcccctgtacagcttcgaggacaacgccgactacgtgtacgacgtgatgtggagccccgtgcaccccgccctgttcgcctgcgtggacggcatgggcagactggacctgtggaacctgaacaacgacaccgaggtgcccaccgccagcgtggccatcgagggcgccagcgccctgaacagagtgagatgggcccaggccggcaaggaggtggccgtgggcgacagcgagggcagaatctgggtgtacgacgtgggcgagctggccgtgccccacaacgacgagtggaccagattcgccagaaccctggtggagatcagagccaacagagccgacagcgaggaggagggcaccgtggagctgagcgcctag

SEQ ID NO: 10496 - DNA, 627 bp, Artificial Sequence
  Description of Artificial Sequence: Synthetic coding sequence
atggagggcgccgccgcccccgtggccggcgacagacccgacctgggcctgggcgcccccggcagccccagagaggccgtggccggcgccaccgccgccctggagcccagaaagccccacggcgtgaagagacaccaccacaagcacaacctgaagcacagatacgagctgcaggagaccctgggcaagggcacctacggcaaggtgaagagagccaccgagagattcagcggcagagtggtggccatcaagagcatcagaaaggacaagatcaaggacgagcaggacatggtgcacatcagaagagagatcgagatcatgagcagcctgaaccacccccacatcatcagcatctacgaggtgttcgagaacaaggacaagatcgtgatcatcatggagtacgccagcaagggcgagctgtacgactacatcagcgagagaagaagactgagcgagagagagaccagacacttcttcagacagatcgtgagcgccgtgcactactgccacaagaacggcgtggtgcacagagacctgaagctgaagagacccagcagagagaaccaggtgaccaccctgccccagagcgccgtgagcctgagaagctgctggaccgtgatgatgtag

SEQ ID NO: 10497 - DNA, 990 bp, Artificial Sequence
  Description of Artificial Sequence: Synthetic coding sequence
atggaggtggccgagcccagcagccccaccgaggaggaggaggaggaggaggagcacagcgccgagcccagacccagaaccagaagcaaccccgagggcgccgaggacagagccgtgggcgcccaggccagcgtgggcagcagaagcgagggcgagggcgaggccgccagcgccgacgacggcagcctgaacaccagcggcgccggccccaagagctggcaggtgcccccccccgcccccgaggtgcagatcagaacccccagagtgaactgccccgagaaggtgatcatctgcctggacctgagcgaggagatgagcctgcccaagctggagagcttcaacggcagcaagaccaacgccctgaacgtgagccagaagatgatcgagatgttcgtgagaaccaagcacaagatcgacaagagccacgagttcgccctggtggtggtgaacgacgacaccgcctggctgagcggcctgaccagcgaccccagagagctgtgcagctgcctgtacgacctggagaccgccagctgcagcaccttcaacctggagggcctgttcagcctgatccagcagaagaccgagctgcccgtgaccgagaacgtgcagaccatcccccccccctacgtggtgagaaccatcctggtgtacagcagacccccctgccagccccagttcagcctgaccgagcccatgaagaagatgttccagtgcccctacttcttcttcgacgtggtgtacatccacaacggcaccgaggagaaggaggaggagatgagctggaaggacatgttcgccttcatgggcagcctggacaccaagggcaccagctacaagtacgaggtggccctggccggccccgccctggagctgcacaactgcatggccaagctgctggcccaccccctgcagagaccctgccagagccacgccagctacagcctgctggaggaggaggacgaggccatcgaggtggaggccaccgtgtag

SEQ ID NO: 10498 - DNA, 885 bp, Artificial Sequence
  Description of Artificial Sequence: Synthetic coding sequence
atgagccagcccgccggcggcagaagaaagcccagaaccctgggcccccccgtgtgcagcatcagacccttcaagagcagcgagcagtacctggaggccatgaaggaggacctggccgagtggctgagagacctgtacggcctggacatcgacgccgccaacttcctgcaggtgctggagaccggcctggtgctgtgccagcacgccaacgtggtgaccgacgccgccctggccttcctggccgaggcccccgcccaggcccagaagatccccatgcccagagtgggcgtgagctgcaacggcgccgcccagcccggcaccttccaggccagagacaacgtgagcaacttcatccagtggtgcagaaaggagatgggcatccaggaggtgctgatgttcgagaccgaggacctggtgctgagaaagaacgtgaagaacgtggtgctgtgcctgctggagctgggcagaagagcctggagattcggcgtggccgcccccaccctggtgcagctggaggaggagatcgaggaggaggtgagaagagagctggccctgccccccctgccccagcccggccccgacggcgccgagccctgcgagcccctgcacgtgcccagcgccgtgctgcacggccagagcgtgtacgtgttcctgggccccgccagacagccccccaaggacagactgctgagagccgtgctgggcagcaagggcggcgaggccagcagagtggacggcgccagcgtgggcgaggaggaggaggagggcaaggaggagaaggagcccgccgcccccctggagagcagcccccagccccccgagggcctgcagccccactggctgaaccaggcccccctgccccccgaggaggagagctgggtgtag

SEQ ID NO: 10499 - DNA, 1554 bp, Artificial Sequence; identical to SEQ ID NO: 9849
  Description of Artificial Sequence: Synthetic coding sequence

SEQ ID NO: 10500 - DNA, 951 bp, Artificial Sequence
  Description of Artificial Sequence: Synthetic coding sequence
atggccaccttcgtggagctgagcaccaaggccaagatgcccatcgtgggcctgggcacctggaagagccccctgggcaaggtgaaggaggccgtgaaggtggccatcgacgccggctacagacacatcgactgcgcctacgtgtaccagaacgagcacgaggtgggcgaggccatccaggagaagatccaggagaaggccgtgaagagagaggacctgttcatcgtgagcaagctgtggcccaccttcttcgagagacccctggtgagaaaggccttcgagaagaccctgaaggacctgaagctgagctacctggacgtgtacctgatccactggccccagggcttcaagagcggcgacgacctgttccccaaggacgacaagggcaacgccatcggcggcaaggccaccttcctggacgcctgggaggccatggaggagctggtggacgagggcctggtgaaggccctgggcgtgagcaacttcagccacttccagatcgagaagctgctgaacaagcccggcctgaagtacaagcccgtgaccaaccaggtggagtgccacccctacctgacccaggagaagctgatccagtactgccacagcaagggcatcaccgtgaccgcctacagccccctgggcagccccgacagaccctgggccaagcccgaggaccccagcctgctggaggaccccaagatcaaggagatcgccgccaagcacaagaagaccgccgcccaggtgctgatcagattccacatccagagaaacgtgatcgtgatccccaagagcgtgacccccgccagaatcgtggagaacatccaggtgttcgacttcaagctgagcgacgaggagatggccaccatcctgagcttcaacagaaactggagagcctgcaacgtgctgcagagcagccacctggaggactaccccttcaacgccgagtactag

SEQ ID NO: 10501 - DNA, 8274 bp, Artificial Sequence
  Description of Artificial Sequence: Synthetic coding sequence
gagcccaaggtggtgttcgccaaggagcagcccgtgcacagagaggtgcaggcccaggccggcgccagcaccaccctgagctgcgaggtggcccaggcccagaccgaggtgatgtggtacaaggacggcaagaagctgagcttcagcagcaaggtgagaatggaggccgtgggctgcaccagaagactggtggtgcagcaggccggccaggccgtggccggcgagtacagctgcgaggccggcagccagagactgagcttccacctgcacgtggccgagcccaaggccgtgttcgccaaggagcagcccgcccacagagaggtgcaggccgaggccggcgccagcgccaccctgagctgcgaggtggcccaggcccagaccgaggtgacctggtacaaggacggcaagaagctgagcagcagcctgaaggtgcacgtggaggccgccggctgcaccagaagactggtggtgcagcaggccggccaggccgacaccggcgagtacagctgcgaggccggcggccagcagctgagcttcagactgcaggtggccgagcccaaggccgtgttcgccaaggagcagcccgccagcagagaggtgcaggccgaggccggcaccagcgccaccctgagctgcgaggtggcccaggcccagaccgaggtgacctggtacaaggacggcaagaagctgagcagcagcagcaaggtgagaatggaggccgtgggctgcaccagaagactggtggtgcaggaggccggccaggccgacgccggcgagtacagctgcaaggccggcgaccagagactgagcttccacctgcacgtggccgagcccaaggtggtgttcgccaaggagcagcccgcccacagagaggtgcaggccgaggccggcgccagcgccaccctgagctgcgaggtggcccaggcccagaccgaggtgacctggtacaaggacggcaagaagctgagcagcagcagcaaggtgagagtggaggccgtgggctgcaccagaagactggtggtgcagcaggccggccaggccgaggccggcgagtacagctgcgaggccggcggccagcagctgagcttcagactgcaggtggccgagcccaaggccgtgttcgccaaggagcaggtggtgttcgccaaggaccagcccgtgcacagagaggtgcaggccgaggccggcaccagcaccatgctgagctgcgaggtggcccaggcccagaccgaggtgatgtggtacaaggacggcaagaagctgagcagcagcagcaagatgagagtggaggccgtgggctgcaccagaagactggtggtgcaggaggccggccaggccgacgccggcgagtacagctgcgaggccggcggccagagactgagcttccacctgcacgtggccgagcccaaggtggtgttcgccaaggagcagcccgcctgcagagaggtgcaggccgaggccggcgccagcgccaccctgagctgcgaggtggcccagggccagatggaggtgacctggtacaaggacggcaagaagctgagcagcagcagcaaggtgcacatggaggccagcggctacaccagaagactggtggtgcagcaggccggccaggccgacgccggcgagtacagctgcgaggccggcggccagagactgagcttcagactgcacgtggccgagctggagccccagatcagcgagagaccctgcagaagagagcccctggtggtgaaggagcacgaggacatcatcctgaccgccaccctggccacccccagcgccgccaccgtgacctggctgaaggacggcgtggagatcagaagaagcaagagacacgagaccgccagccagggcgacacccacaccctgaccgtgcacggcgcccaggtgctggacagcgccatctacagctgcagagtgggcgccgagggccaggacttccccgtgcaggtggaggaggtggccgccaagttctgcagactgctggagcccgtgtgcggcgagctgggcggcaccgtgaccctggcctgcgagctgagccccgcctgcgccgaggtggtgtggagatgcggcaacacccagctgagagtgggcaagagattccagatggtggccgagggccccgtgagaagcctgaccgtgctgggcctgagagccgaggacgccggcgagtacgtgtgcgagagcagagacgaccacaccagcgcccagctgaccgtgagcgtgcccagagtggtgaagttcatgagcggcctgagcaccgtggtggccgaggagggcggcgaggccaccttccagtgcgtggtgagccccagcgacgtggccgtggtgtggttcagagacggcgccctgctgcagcccagcgagaagttcgccatcagccagagcggcgccagccacagcctgaccatcagcgacctggtgctggaggacgccggccagatcaccgtggaggccgagggcgccagcagcagcgccgccctgagagtgagagaggcccccgtgctgttcaagaagaagctggagccccagaccgtggaggagagaagcagcgtgaccctggaggtggagctgaccagaccctggcccgagctgagatggaccagaaacgccaccgccctggcccccggcaagaacgtggagatccacgccgagggcgccagacacagactggtgctgcacaacgtgggcttcgccgacagaggcttcttcggctgcgagacccccgacgacaagacccaggccaagctgaccgtggagatgagacaggtgagactggtgagaggcctgcaggccgtggaggccagagagcagggcaccgccaccatggaggtgcagctgagccacgccgacgtggacggcagctggaccagagacggcctgagattccagcagggccccacctgccacctggccgtgagaggccccatgcacaccctgaccctgagcggcctgagacccgaggacagcggcctgatggtgttcaaggccgagggcgtgcacaccagcgccagactggtggtgaccgagctgcccgtgagcttcagcagacccctgcaggacgtggtgaccaccgagaaggagaaggtgaccctggagtgcgagctgagcagacccaacgtggacgtgagatggctgaaggacggcgtggagctgagagccggcaagaccatggccatcgccgcccagggcgcctgcagaagcctgaccatctacagatgcgagttcgccgaccagggcgtgtacgtgtgcgacgcccacgacgcccagagcagcgccagcgtgaaggtgcagggcagaacctacaccctgatctacagaagagtgctggccgaggacgccggcgagatccagttcgtggccgagaacgccgagagcagagcccagctgagagtgaaggagctgcccgtgaccctggtgagacccctgagagacaagatcgccatggagaagcacagaggcgtgctggagtgccaggtgagcagagccagcgcccaggtgagatggttcaagggcagccaggagctgcagcccggccccaagtacgagctggtgagcgacggcctgtacagaaagctgatcatcagcgacgtgcacgccgaggacgaggacacctacacctgcgacgccggcgacgtgaagaccagcgcccagttcttcgtggaggagcagagcatcaccatcgtgagaggcctgcaggacgtgaccgtgatggagcccgcccccgcctggttcgagtgcgagaccagcatccccagcgtgagaccccccaagtggctgctgggcaagaccgtgctgcaggccggcggcaacgtgggcctggagcaggagggcaccgtgcacagactgatgctgagaagaacctgcagcaccatgaccggccccgtgcacttcaccgtgggcaagagcagaagcagcgccagactggtggtgagcgacatccccgtggtgctgaccagacccctggagcccaagaccggcagagagctgcagagcgtggtgctgagctgcgacttcagacccgcccccaaggccgtgcagtggtacaaggacgacacccccctgagccccagcgagaagttcaagatgagcctggagggccagatggccgagctgagaatcctgagactgatgcccgccgacgccggcgtgtacagatgccaggccggcagcgcccacagcagcaccgaggtgaccgtggaggccagagaggtgaccgtgaccggccccctgcaggacgccgaggccaccgaggagggctgggccagcttcagctgcgagctgagccacgaggacgaggaggtggagtggagcctgaacggcatgcccctgtacaacgacagcttccacgagatcagccacaagggcagaagacacaccctggtgctgaagagcatccagagagccgacgccggcatcgtgagagccagcagcctgaaggtgagcaccagcgccagactggaggtgagagtgaagcccgtggtgttcctgaaggccctggacgacctgagcgccgaggagagaggcaccctggccctgcagtgcgaggtgagcgaccccgaggcccacgtggtgtggagaaaggacggcgtgcagctgggccccagcgacaagtacgacttcctgcacaccgccggcaccagaggcctggtggtgcacgacgtgagccccgaggacgccggcctgtacacctgccacgtgggcagcgaggagaccagagccagagtgagagtgcacgacctgcacgtgggcatcaccaagagactgaagaccatggaggtgctggagggcgagagctgcagcttcgagtgcgtgctgagccacgagagcgccagcgaccccgccatgtggaccgtgggcggcaagaccgtgggcagcagcagcagattccaggccaccagacagggcagaaagtacatcctggtggtgagagaggccgcccccagcgacgccggcgaggtggtgttcagcgtgagaggcctgaccagcaaggccagcctgatcgtgagagagagacccgccgccatcatcaagcccctggaggaccagtgggtggcccccggcgaggacgtggagctgagatgcgagctgagcagagccggcacccccgtgcactggctgaaggacagaaaggccatcagaaagagccagaagtacgacgtggtgtgcgagggcaccatggccatgctggtgatcagaggcgccagcctgaaggacgccggcgagtacacctgcgaggtggaggccagcaagagcaccgccagcctgcacgtggaggagaaggccaactgcttcaccgaggagctgaccaacctgcaggtggaggagaagggcaccgccgtgttcacctgcaagaccgagcaccccgccgccaccgtgacctggagaaagggcctgctggagctgagagccagcggcaagcaccagcccagccaggagggcctgaccctgagactgaccatcagcgccctggagaaggccgacagcgacacctacacctgcgacatcggccaggcccagagcagagcccagctgctggtgcagggcagaagagtgcacatcatcgaggacctggaggacgtggacgtgcaggagggcagcagcgccaccttcagatgcagaatcagccccgccaactacgagcccgtgcactggttcctggacaagacccccctgcacgccaacgagctgaacgagatcgacgcccagcccggcggctaccacgtgctgaccctgagacagctggccctgaaggacagcggcaccatctacttcgaggccggcgaccagagagccagcgccgccctgagagtgaccgagaagcccagcgtgttcagcagagagctgaccgacgccaccatcaccgagggcgaggacctgaccctggtgtgcgagaccagcacctgcgacatccccgtgtgctggaccaaggacggcaagaccctgagaggcagcgccagatgccagctgagccacgagggccacagagcccagctgctgatcaccggcgccaccctgcaggacagcggcagatacaagtgcgaggccggcggcgcctgcagcagcagcatcgtgagagtgcacgccagacccgtgagattccaggaggccctgaaggacctggaggtgctggagggcggcgccgccaccctgagatgcgtgctgagcagcgtggccgcccccgtgaagtggtgctacggcaacaacgtgctgagacccggcgacaagtacagcctgagacaggagggcgccatgctggagctggtggtgagaaacctgagaccccaggacagcggcagatacagctgcagcttcggcgaccagaccaccagcgccaccctgaccgtgaccgccctgcccgcccagttcatcggcaagctgagaaacaaggaggccaccgagggcgccaccgccaccctgagatgcgagctgagcaaggccgcccccgtggagtggagaaagggcagcgagaccctgagagacggcgacagatactgcctgagacaggacggcgccatgtgcgagctgcagatcagaggcctggccatggtggacgccgccgagtacagctgcgtgtgcggcgaggagagaaccagcgccagcctgaccatcagacccatgcccgcccacttcatcggcagactgagacaccaggagagcatcgagggcgccaccgccaccctgagatgcgagctgagcaaggccgcccccgtggagtggagaaagggcagagagagcctgagagacggcgacagacacagcctgagacaggacggcgccgtgtgcgagctgcagatctgcggcctggccgtggccgacgccggcgagtacagctgcgtgtgcggcgaggagagaaccagcgccaccctgaccgtgaaggccctgcccgccaagttcaccgagggcctgagaaacgaggaggccgtggagggcgccaccgccatgctgtggtgcgagctgagcaaggtggcccccgtggagtggagaaagggccccgagaacctgagagacggcgacagatacatcctgagacaggagggcaccagatgcgagctgcagatctgcggcctggccatggccgacgccggcgagtacctgtgcgtgtgcggccaggagagaaccagcgccaccctgaccatcagagccctgcccgccagattcatcgaggacgtgaagaaccaggaggccagagagggcgccaccgccgtgctgcagtgcgagctgaacagcgccgcccccgtggagtggagaaagggcagcgagaccctgagagacggcgacagatacagcctgagacaggacggcaccaagtgcgagctgcagatcagaggcctggccatggccgacaccggcgagtacagctgcgtgtgcggccaggagagaaccagcgccatgctgaccgtgagagccctgcccatcaagttcaccgagggcctgagaaacgaggaggccaccgagggcgccaccgccgtgctgagatgcgagctgagcaagatggcccccgtggagtggtggaagggccacgagaccctgagagacggcgacagacacagcctgagacaggacggcgccagatgcgagctgcagatcagaggcctggtggccgaggacgccggcgagtacctgtgcatgtgcggcaaggagagaaccagcgccatgctgaccgtgagagccatgcccagcaagttcatcgagggcctgagaaacgaggaggccaccgagggcgacaccgccaccctgtggtgcgagctgagcaaggccgcccccgtggagtggagaaagggccacgagaccctgagagacggcgacagacacagcctgagacaggacggcagcagatgcgagctgcagatcagaggcctggccgtggtggacgccggcgagtacagctgcgtgtgcggccaggagagaaccagcgccaccctgaccgtgagagccctgcccgccagattcatcgaggacgtgaagaaccaggaggccagagagggcgccaccgccgtgctgcagtgcgagctgagcaaggccgcccccgtggagtggagaaagggcagcgagaccctgagaggcggcgacagatacagcctgagacaggacggcaccagatgcgagctgcagatccacggcctgagcgtggccgacaccggcgagtacagctgcgtgtgcggccaggagagaaccagcgccaccctgaccgtgagagccctgcccgccagacacagcagaagcgaggaccagggcggcctgagaagaggccacagctacaccgccgtgtag

SEQ ID NO: 10502 - DNA, 1449 bp, Artificial Sequence
  Description of Artificial Sequence: Synthetic coding sequence
atggtgatggagaagcccagccccctgctggtgggcagagagttcgtgagacagtactacaccctgctgaacaaggcccccgagtacctgcacagattctacggcagaaacagcagctacgtgcacggcggcgtggacgccagcggcaagccccaggaggccgtgtacggccagaacgacatccaccacaaggtgctgagcctgaacttcagcgagtgccacaccaagatcagacacgtggacgcccacgccaccctgagcgacggcgtggtggtgcaggtgatgggcctgctgagcaacagcggccagcccgagagaaagttcatgcagaccttcgtgctggcccccgagggcagcgtgcccaacaagttctacgtgcacaacgacatgttcagatacgaggacgaggtgttcggcgacagcgagcccgagctggacgaggagagcgaggacgaggtggaggaggagcaggaggagagacagcccagccccgagcccgtgcaggagaacgccaacagcggctactacgaggcccaccccgtgaccaacggcatcgaggagcccctggaggagagcagccacgagcccgagcccgagcccgagagcgagaccaagaccgaggagctgaagccccaggtggaggagaagaacctggaggagctggaggagaagagcaccacccccccccccgccgagcccgtgagcctgccccaggagccccccaaggccttcagctgggccagcgtgaccagcaagaacctgccccccagcggcaccgtgagcagcagcggcatccccccccacgtgaaggcccccgtgagccagcccagagtggaggccaagcccgaggtgcagagccagccccccagagtgagagagcagagacccagagagagacccggcttcccccccagaggccccagacccggcagaggcgacatggagcagaacgacagcgacaacagaagaatcatcagataccccgacagccaccagctgttcgtgggcaacctgccccacgacatcgacgagaacgagctgaaggagttcttcatgagcttcggcaacgtggtggagctgagaatcaacaccaagggcgtgggcggcaagctgcccaacttcggcttcgtggtgttcgacgacagcgagcccgtgcagagaatcctgatcgccaagcccatcatgttcagaggcgaggtgagactgaacgtggaggagaagaagaccagagccgccagagagagagagaccagaggcggcggcgacgacagaagagacatcagaagaaacgacagaggccccggcggccccagaggcatcgtgggcggcggcatgatgagagacagagacggcagaggccccccccccagaggcggcatggcccagaagctgggcagcggcagaggcaccggccagatggagggcagattcaccggccagagaagatag

SEQ ID NO: 10503 - DNA, 807 bp, Artificial Sequence
  Description of Artificial Sequence: Synthetic coding sequence
atgagcggcagaaagagaagcttcaccttcggcgcctacggcggcgtggacaagagcttcaccagcagaagaagcgtgtggagaagcgacggccagaaccagcacttcccccaggccctggacctgagcagagtgaacctggtgcccagctacacccccagcctgtaccccaagaacaccgacctgttcgagatgatcgagaagatgcagggcagcagaatggacgagcagagatgcagcttccccccccccctgaagaccgaggaggactacatcccctaccccagcgtgcacgaggtgctgggcagagagggccccttccccctgatcctgctgccccagttcggcggctactggatcgagggcaccaaccacgagatcaccagcatccccgagaccgagcccctgcagagccccaccaccaaggtgaagctggagtgcaaccccaccgccagaatctacagaaagcacttcctgggcaaggagcacttcaactactacagcctggacgccgccctgggccacctggtgttcagcctgaagtacgacgtgatcggcgaccaggagcacctgagactgctgctgagaaccaagtgcagaacctaccacgacgtgatccccatcagctgcctgaccgagttccccaacgtggtgcagatggccaagctggtgtgcgaggacgtgaacgtggacagattctaccccgtgctgtaccccaaggccagcagactgatcgtgaccttcgacgagcacgtgatcagcaacaacttcaagttcggcgtgatctaccagaagctgggccagtag

SEQ ID NO: 10504 - DNA, 606 bp, Artificial Sequence; identical to SEQ ID NO: 9982
  Description of Artificial Sequence: Synthetic coding sequence

SEQ ID NO: 10505 - DNA, 1707 bp, Artificial Sequence
  Description of Artificial Sequence: Synthetic coding sequence
atgggcctgctgaccttcagagacgtggccatcgagttcagcctggaggagtggcagtgcctggacaccgcccagagaaacctgtacaagaacgtgatcctggagaactacagaaacctggtgttcctgggcatcgccgtgagcaagcaggacctgatcacctgcctggagcaggagaaggagcccctgaccgtgaagagacacgagatggtgaacgagccccccgtgatgtgcagccacttcgcccaggagttctggcccgagcagaacatcaaggacagcttcgagaaggtgaccctgagaagatacgagaagtgcggcaacgacaacttccagctgaagggctgcaagagcgtggacgagtgcaagctgcacaagggcggctacaacggcctgaaccagtgcctgcccaccatgcagagcaagatgttccagtgcgacaagtacgtgaaggtgttcaacaagttcagccacagcgacagacacaagatcaagcacatggagaacaagcccttcaagtgcaaggagtgcggcagaagcttctgcatgctgagccacctgaccagacacgagagaaactacaccaaggtgaacttctgcaagtgcgaggagtgcgagaaggccgtgaaccagagcagcaagctgaccaagcacaagagaatctacacctgcgagaagctgtacaagtgccaggagtgcgacagaaccttcaaccagttcagcaacctgaccgagtacaagaaggactacgccagagagaagccctacaagtgcgaggagtgcggcaaggccttcaaccagagcagccacctgaccacccacaagatcatccacaccggcgagaagccctacaagtgcgaggagtgcggcaaggccttcaaccagttcagcaacctgaccacccacaagaagatccacaccggcgagcagccctacatctgcgaggagtgcggcaaggccttcacccagagcagcaccctgaccacccacaagagaatccacaccggcgagaagccctacaagtgcgaggagtgcggcaaggccttcaacagaagcagcaagctgaccgagcacaagaacatccacaccggcgagcagccctacaagtgcgaggagtgcggcaaggccttcaacagaagcagcaacctgaccgagcacagaaagatccacaccgaggagaagccctacaagtgcaaggagtgcggcaaggccttcaagcacagcagcgccctgaccacccacaagagaatccacaccggcgagaagccctacaagtgcgaggagtgcggcaaggccttcaacagaagcagcaagctgaccgagcacaagaagctgcacaccggcaagaagccctacaagtgcgaggagtgcggcaaggccttcatccagagcagcaagctgaccgagcacaagaagatccacagcggcgagatcccctacaagtgcgaggagtgcggcaaggccttcaagcacagcagcagcctgaccacccacaagagaatccacaccggcgagaagccctacaagtgcgaggagtgcggcaaggccttcagcagaagcagcaagctgaccgagcacaagatcatccacaccggcgagaagccctacaagtgcgagagatgcgacaaggccttcaaccagagcgccaacctgaccaagcacaagaagatccacaccggcgagaagctgcagaactggaacgtgtag

SEQ ID NO: 10506 - DNA, 1383 bp, Artificial Sequence
  Description of Artificial Sequence: Synthetic coding sequence
atggacagcgagctgatgcacagcatcgtgggcagctaccacaagccccccgagagagtgttcgtgcccagcttcacccagaacgagcccagccagaactgccaccccgccaacctggaggtgaccagccccaagatcctgcacagccccaacagccaggccctgatcctggccctgaagaccctgcaggagaagatccacagactggagctggagagaacccaggccgaggacaacctgaacatcctgagcagagaggccgcccagtacaagaaggccctggagaacgagaccaacgagagaaacctggcccaccaggagctgatcaagcagaagaaggacatcagcatccagctgagcagcgcccagagcagatgcaccctgctggagaagcagctggagtacaccaagagaatggtgctgaacgtggagagagagaagaacatgatcctggagcagcaggcccagctgcagagagagaaggagcaggaccagatgaagctgtacgccaagctggagaagctggacgtgctggagaaggagtgcttcagactgaccaccacccagaagaccgccgaggacaagatcaagcacctggaggagaagctgaaggaggaggagcaccagagaaagctgttccaggacaaggccagcgagctgcagaccggcctggagatcagcaagatcatcatgagcagcgtgagcaacctgaagcacagcaaggagaagaagaagagcagcaagaagaccaagtgcatcaagagaagacccccctggcagatctgcagcaagttcggcgccctgcccttcgtggccgagaagatgagacagcacagagacccccacatcctgcagaagcccttcaacgtgaccgagaccagatgcctgcccaagcccagcagaaccaccagctggtgcaaggccatcccccccgacagcgagaagagcatcagcatctgcgacaacctgagcgagctgctgatggccatgcaggacgagctggaccagatgagcatggagcaccaggagctgctgaagcagatgaaggagaccgagagccacagcgtgtgcgacgacatcgagtgcgagctggagtgcctgctgaagaagatggagatcaagggcgagcagatcagcaagctgaagaagcaccaggacagcgtgtgcaagctgcagcagaaggtgcagaacagcaagatgagcgaggccagcggcatccagcaggaggacagctaccccaagggcagcaagaacatcaagaacagccccagaaagtgcctgaccgacaccaacctgttccagaagaacagcagcttccaccccatcagagtgcacaacctgcagatgaagctgagaagagacgacatcatgtgggagcagtag

SEQ ID NO: 10507 - DNA, 1833 bp, Artificial Sequence
  Description of Artificial Sequence: Synthetic coding sequence
atgagccagaccagcctgaagcagaagaagaacgagcccggcatgagaagcagcaaggagagcctggaggccgagaagagaaaggagagcgacaagaccggcgtgagactgagcaaccagatgagaagagccgtgaaccccaaccacagcctgagatgctgccccttccagggccacagcagctgcagaagatgcctgtgcgccgccgagggcaccgccctgggcccctgccacaccatcagaatctacatccacatgtgcctgctgtgggagcagggccagcagatcaccatgatgagaggcagccaggagagcagcctgagaaagaccgacagcagaggctacctggtgagaagccagtggagcagaatcagcagaagccccagcaccaaggcccccagcatcgacgagcccagaagcagaaacaccagcgccaagctgcccagcagcagcaccagcagcagaacccccagcaccagccccagcctgcacgacagcagccccccccccctgagcggccagcccagcctgcagccccccgccagcccccagctgcccagaagcctggacagcagaccccccaccccccccgagcccgaccccggcagcagaagaagcaccaagatgcaggagaaccccgaggcctgggcccagggcatcgtgagagagatcagacagaccagagacagccagcccctggagtacagcagaaccagccccaccgagtggaagagcagcagccagagaagaggcatctaccccgccagcacccagctggacagaaacagcctgagcgagcagcagcagcagcagagagaggacgaggacgactacgaggccgcctactgggccagcatgagaagcttctacgagaagaaccccagctgcagcagaccctggccccccaagcccaagaacgccatcaccatcgccctgagcagctgcgccctgttcaacatggtggacggcagaaagatctacgagcaggagggcctggagaagtacatggagtaccagctgaccaacgagaacgtgatcctgacccccggccccgccttcagattcgtgaaggccctgcagtacgtgaacgccagactgagagacctgtaccccgacgagcaggacctgttcgacatcgtgctgatgaccaacaaccacgcccaggtgggcgtgagactgatcaacagcgtgaaccactacggcctgctgatcgacagattctgcctgaccggcggcaaggaccccatcggctacctgaaggcctacctgaccaacctgtacatcgccgccgacagcgagaaggtgcaggaggccatccaggagggcatcgccagcgccaccatgttcgacggcgccaaggacatggcctactgcgacacccagctgagagtggccttcgacggcgacgccgtgctgttcagcgacgagagcgagcacttcaccaaggagcacggcctggacaagttcttccagtacgacaccctgtgcgagagcaagcccctggcccagggccccctgaagggcttcctggaggacctgggcagactgcagaagaagttctacgccaagaacgagagactgctgtgccccatcagaacctacctggtgaccgccagaagcgccgccagcagcggcgccagagtgctgaagaccctgagaagatggggcctggagatcgacgaggccctgttcctggccggcgcccccaagagccccatcctggtgaagatcagaccccacatcttcttcgacgaccacatgttccacatcgagggcgcccagagactgggcagcatcgccgcctacggcttcaacaagaagttcagcagctag

SEQ ID NO: 10508 - DNA, 456 bp, Artificial Sequence
  Description of Artificial Sequence: Synthetic coding sequence
atgagcaagaacaccgtgagcagcgccagattcagaaaggtggacgtggacgagtacgacgagaacaagttcgtggacgaggaggacggcggcgacggccaggccggccccgacgagggcgaggtggacagctgcctgagacagggcaacatgaccgccgccctgcaggccgccctgaagaacccccccatcaacaccaagagccaggccgtgaaggacagagccggcagcatcgtgctgaaggtgctgatcagcttcaaggccaacgacatcgagaaggccgtgcagagcctggacaagaacggcgtggacctgctgatgaagtacatctacaagggcttcgagagccccagcgacaacagcagcgccatgctgctgcagtggcacgagaaggccctggccgccggcggcgtgggcagcatcgtgagagtgctgaccgccagaaagaccgtgtag

SEQ ID NO: 10509 - DNA, 3522 bp, Artificial Sequence
  Description of Artificial Sequence: Synthetic coding sequence
atggtgaccgtgggcaccaacatcctgcccagcagacccgccgccagcgccaacaccgccagagaggacgccgccctgttcagcagaagaatcccccccagacacaagaacggcgccgcccagcccggcgccgcccccggccccggcgcccccggcgccaacatgggcaacgcccacagcaagagcggcgacagacacagcgccctgcccggcagacccgagctgagcttctacggcagcttccccagaaagtggagcgagaacgtgttcctggacaacgagctgctgaccagcaagatcctgagcgtgctgagaccccagagcgagagaggcttcagagccggcgacctgagataccccacccacttcctgagcaccaacagcgtgctggccagcgtgaccgccagcctgaaggagcaccccagaggcaccctgctgagcgacggcagccccgccctgagcagaaacgtgggcatgaccgtgagccagaagggcggcccccagcccacccccagccccgccggccccggcacccagctgggccccatcaccggcgagatggacgaggccgacagcgccttcctgaagttcaagcagaccgccgacgacagcctgagcctgaccagccccaacaccgagagcatcttcgtggaggacccctacaccgccagcctgagaagcgagatcgagagcgacggccacgagttcgaggccgagagctggagcctggccgtggacgccgcctacgccaagaagcagaagagagaggtggtgaagagacaggacgtgctgtacgagctgatgcagaccgaggtgcaccacgtgagaaccctgaagatcatgctgaaggtgtacagcagagccctgcaggaggagctgcagttcagcagcaaggccatcggcagactgttcccctgcgccgacgacctgctggagacccacagccacttcctggccagactgaaggagagaagacaggagagcctggaggagggcagcgacagaaactacgtgatccagaagatcggcgacctgctggtgcagcagttcagcggcgagaacggcgagagaatgaaggagaagtacggcgtgttctgcagcggccacaacgaggccgtgagccactacaagctgctgctgcagcagaacaagaagttccagaacctgatcaagaagatcggcaacttcagcatcgtgagaagactgggcgtgcaggagtgcatcctgctggtgacccagagaatcaccaagtaccccgtgctggtggagagaatcatccagaacaccgaggccggcaccgaggactacgaggacctgacccaggccctgaacctgatcaaggacatcatcagccaggtggacgccaaggtgagcgagtgcgagaagggccagagactgagagagatcgccggcaagatggacctgaagagcagcagcaagctgaagaacggcctgaccttcagaaaggaggacatgctgcagagacagctgcacctggagggcatgctgtgctggaagaccaccagcggcagactgaaggacatcctggccatcctgctgaccgacgtgctgctgctgctgcaggagaaggaccagaagtacgtgttcgccagcgtggacagcaagccccccgtgatcagcctgcagaagctgatcgtgagagaggtggccaacgaggagaaggccatgttcctgatcagcgccagcctgcagggccccgagatgtacgagatctacaccagcagcaaggaggacagaaacgcctggatggcccacatccagagagccgtggagagctgccccgacgaggaggagggccccttcagcctgcccgaggaggagagaaaggtggtggaggccagagccaccagactgagagacttccaggagagactgagcatgaaggaccagctgatcgcccagagcctgctggagaagcagcagatctacctggagatggccgagatgggcggcctggaggacctgccccagcccagaggcctgttcagaggcggcgaccccagcgagaccctgcagggcgagctgatcctgaagagcgccatgagcgagatcgagggcatccagagcctgatctgcagacagctgggcagcgccaacggccaggccgaggacggcggcagcagcaccggcccccccagaagagccgagaccttcgccggctacgactgcaccaacagccccaccaagaacggcagcttcaagaagaaggtgagcagcaccgaccccagacccagagactggagaggcccccccaacagccccgacctgaagctgagcgacagcgacatccccggcagcagcgaggagagcccccaggtggtggaggcccccggcaccgagagcgaccccagactgcccaccgtgctggagagcgagctggtgcagagaatccagaccctgagccagctgctgctgaacctgcaggccgtgatcgcccaccaggacagctacgtggagacccagagagccgccatccaggagagagagaagcagttcagactgcagagcaccagaggcaacctgctgctggagcaggagagacagagaaacttcgagaagcagagagaggagagagccgccctggagaagctgcagagccagctgagacacgagcagcagagatgggagagagagagacagtggcagcaccaggagctggagagagccggcgccagactgcaggagagagagggcgaggccagacagctgagagagagactggagcaggagagagccgagctggagagacagagacaggcctaccagcacgacctggagagactgagagaggcccagagagccgtggagagagagagagagagactggagctgctgagaagactgaagaagcagaacaccgcccccggcgccctgccccccgacaccctggccgaggcccagccccccagccacccccccagcttcaacggcgagggcctggagggccccagagtgagcatgctgcccagcggcgtgggccccgagtacgccgagagacccgaggtggccagaagagacagcgcccccaccgagaacagactggccaagagcgacgtgcccatccagctgctgagcgccaccaaccagttccagagacaggccgccgtgcagcagcagatccccaccaagctggccgccagcaccaagggcggcaaggacaagggcggcaagagcagaggcagccagagatgggagagcagcgccagcttcgacctgaagcagcagctgctgctgaacaagctgatgggcaaggacgagagcaccagcagaaacagaagaagcctgagccccatcctgcccggcagacacagccccgcccccccccccgaccccggcttccccgcccccagccccccccccgccgacagccccagcgagggcttcagcctgaaggccggcggcaccgccctgctgcccggcccccccgcccccagccccctgcccgccacccccctgagcgccaaggaggacgccagcaaggaggacgtgatcttcttctag

SEQ ID NO: 10510 - DNA, 1674 bp, Artificial Sequence
  Description of Artificial Sequence: Synthetic coding sequence
atggacagcaccgtgcccagcgccctggagctgccccagagactggccctgaaccccagagagagccccagaagccccgaggaggaggagccccacctgctgagcagcctggccgccgtgcagaccctggccagcgtgatcagaccctgctacggcccccacggcagacagaagttcctggtgaccatgaagggcgagaccgtgtgcaccggctgcgccaccgccatcctgagagccctggagctggagcaccccgccgcctggctgctgagagaggccggccagacccaggccgagaacagcggcgacggcaccgccttcgtggtgctgctgaccgaggccctgctggagcaggccgagcagctgctgaaggccggcctgcccagaccccagctgagagaggcctacgccaccgccaccgccgaggtgctggccaccctgcccagcctggccatccagagcctgggccccctggaggaccccagctgggccctgcacagcgtgatgaacacccacaccctgagccccatggaccacctgaccaagctggtggcccacgcctgctgggccatcaaggagctggacggcagcttcaagcccgagagagtgggcgtgtgcgccctgcccggcggcaccctggaggacagctgcctgctgcccggcctggccatcagcggcaagctgtgcggccagatggccaccgtgctgagcggcgccagagtggccctgttcgcctgccccttcggccccgcccaccccaacgcccccgccaccgccagactgagcagccccgccgacctggcccagttcagcaagggcagcgaccagctgctggagaagcaggtgggccagctggccgccgccggcatcaacgtggccgtggtgctgggcgaggtggacgaggagaccctgaccctggccgacaagtacggcatcgtggtgatccaggccagaagctggatggagatcatctacctgagcgaggtgctggacacccccctgctgcccagactgctgcccccccagagacccggcaagtgccagagagtgtacagacaggagctgggcgacggcctggccgtggtgttcgagtgggagtgcaccggcacccccgccctgaccgtggtgctgagaggcgccaccacccagggcctgagaagcgccgagcaggccgtgtaccacggcatcgacgcctacttccagctgtgccaggaccccagactgatccccggcgccggcgccaccgagatggccctggccaagatgctgagcgacaagggcagcagactggagggccccagcggccccgccttcctggccttcgcctgggccctgaagtacctgcccaagaccctggccgagaacgccggcctggccgtgagcgacgtgatggccgagatgagcggcgtgcaccagggcggcaacctgctgatgggcgtgggcaccgagggcatcatcaacgtggcccaggagggcgtgtgggacaccctgatcgtgaaggcccagggcttcagagccgtggccgaggtggtgctgcagctggtgaccgtggacgagatcgtggtggccaagaagagccccacccaccaggagatctggaaccccgacagcaagaagaccaagaagcaccccccccccgtggagaccaagaagatcctgggcctgaacaactag

SEQ ID NO: 10511 - DNA, 939 bp, Artificial Sequence
  Description of Artificial Sequence: Synthetic coding sequence
atgaccagaagcctgttcaagggcaacttctggagcgccgacatcctgagcaccatcggctacgacaacatcatccagcacctgaacaacggcagaaagaactgcaaggagttcgaggacttcctgaaggagagagccgccatcgaggagagatacggcaaggacctgctgaacctgagcagaaagaagccctgcggccagagcgagatcaacaccctgaagagagccctggaggtgttcaagcagcaggtggacaacgtggcccagtgccacatccagctggcccagagcctgagagaggaggccagaaagatggaggagttcagagagaagcagaagctgcagagaaagaagaccgagctgatcatggacgccatccacaagcagaagagcctgcagttcaagaagaccatggacgccaagaagaactacgagcagaagtgcagagacaaggacgaggccgagcaggccgtgagcagaagcgccaacctggtgaaccccaagcagcaggagaagctgttcgtgaagctggccaccagcaagaccgccgtggaggacagcgacaaggcctacatgctgcacatcggcaccctggacaaggtgagagaggagtggcagagcgagcacatcaaggcctgcgaggccttcgaggcccaggagtgcgagagaatcaacttcttcagaaacgccctgtggctgcacgtgaaccagctgagccagcagtgcgtgaccagcgacgagcaccccagctgcatgagaatcagcaccccccccagaagaatgcagagccagcaggagagactgcagggcctgacctggcagggcgaggaccccagccagttcctgaaggcccaccagatgatccccatcaccctgtggctgatgaccaccgtgtgcagcatcagcaagatcaacgagaccagagccttcagcggctag

SEQ ID NO: 10512 - DNA, 3693 bp, Artificial Sequence
  Description of Artificial Sequence: Synthetic coding sequence
atgcccagaaagggcacccagcccagcaccgccagaagaagagaggagggcccccccccccccagccccgacggcgccagcagcgacgccgagcccgagccccccagcggcagaaccgagagccccgccaccgccgccgagaccgccagcgaggagctggacaacagaagcctggaggagatcctgaacagcatcccccccccccccccccccgccatgaccaacgaggccggcgcccccagactgatgatcacccacatcgtgaaccagaacttcaagagctacgccggcgagaagatcctgggccccttccacaagagattcagctgcatcatcggccccaacggcagcggcaagagcaacgtgatcgacagcatgctgttcgtgttcggctacagagcccagaagatcagaagcaagaagctgagcgtgctgatccacaacagcgacgagcacaaggacatccagagctgcaccgtggaggtgcacttccagaagatcatcgacaaggagggcgacgactacgaggtgatccccaacagcaacttctacgtgagcagaaccgcctgcagagacaacaccagcgtgtaccacatcagcggcaagaagaagaccttcaaggacgtgggcaacctgctgagaagccacggcatcgacctggaccacaacagattcctgatcctgcagggcgaggtggagcagatcgccatgatgaagcccaagggccagaccgagcacgacgagggcatgctggagtacctggaggacatcatcggctgcggcagactgaacgagcccatcaaggtgctgtgcagaagagtggagatcctgaacgagcacagaggcgagaagctgaacagagtgaagatggtggagaaggagaaggacgccctggagggcgagaagaacatcgccatcgagttcctgaccctggagaacgagatcttcagaaagaagaaccacgtgtgccagtactacatctacgagctgcagaagagaatcgccgagatggagacccagaaggagaagatccacgaggacaccaaggagatcaacgagaagagcaacatcctgagcaacgagatgaaggccaagaacaaggacgtgaaggacaccgagaagaagctgaacaagatcaccaagttcatcgaggagaacaaggagaagttcacccagctggacctggaggacgtgcaggtgagagagaagctgaagcacgccaccagcaaggccaagaagctggagaagcagctgcagaaggacaaggagaaggtggaggagttcaagagcatccccgccaagagcaacaacatcatcaacgagaccaccaccagaaacaacgccctggagaaggagaaggagaaggaggagaagaagctgaaggaggtgatggacagcctgaagcaggagacccagggcctgcagaaggagaaggagagcagagagaaggagctgatgggcttcagcaagagcgtgaacgaggccagaagcaagatggacgtggcccagagcgagctggacatctacctgagcagacacaacaccgccgtgagccagctgaccaaggccaaggaggccctgatcgccgccagcgagaccctgaaggagagaaaggccgccatcagagacatcgagggcaagctgccccagaccgagcaggagctgaaggagaaggagaaggagctgcagaagctgacccaggaggagaccaacttcaagagcctggtgcacgacctgttccagaaggtggaggaggccaagagcagcctggccatgaacagaagcagaggcaaggtgctggacgccatcatccaggagaagaagagcggcagaatccccggcatctacggcagactgggcgacctgggcgccatcgacgagaagtacgacgtggccatcagcagctgctgccacgccctggactacatcgtggtggacagcatcgacatcgcccaggagtgcgtgaacttcctgaagagacagaacatcggcgtggccaccttcatcggcctggacaagatggccgtgtgggccaagaagatgaccgagatccagacccccgagaacacccccagactgttcgacctggtgaaggtgaaggacgagaagatcagacaggccttctacttcgccctgagagacaccctggtggccgacaacctggaccaggccaccagagtggcctaccagaaggacagaagatggagagtggtgaccctgcagggccagatcatcgagcagagcggcaccatgaccggcggcggcagcaaggtgatgaagggcagaatgggcagcagcctggtgatcgagatcagcgaggaggaggtgaacaagatggagagccagctgcagaacgacagcaagaaggccatgcagatccaggagcagaaggtgcagctggaggagagagtggtgaagctgagacacagcgagagagagatgagaaacaccctggagaagttcaccgccagcatccagagactgatcgagcaggaggagtacctgaacgtgcaggtgaaggagctggaggccaacgtgctggccaccgcccccgacaagaagaagcagaagctgctggaggagaacgtgagcgccttcaagaccgagtacgacgccgtggccgagaaggccggcaaggtggaggccgaggtgaagagactgcacaacaccatcgtggagatcaacaaccacaagctgaaggcccagcaggacaagctggacaagatcaacaagcagctggacgagtgcgccagcgccatcaccaaggcccaggtggccatcaagaccgccgacagaaacctgcagaaggcccaggacagcgtgctgagaaccgagaaggagatcaaggacaccgagaaggaggtggacgacctgaccgccgagctgaagagcctggaggacaaggccgccgaggtggtgaagaacaccaacgccgccgagatcagcaagatcagcctgcaccccatcgaggacaaccccatcgaggagatcagcgtgctgagccccgaggacctggaggccatcaagaaccccgacagcatcaccaaccagatcgccctgctggaggccagatgccacgagatgaagcccaacctgggcgccatcgccgagtacaagaagaaggaggagctgtacctgcagagagtggccgagctggacaagatcacctacgagagagacagcttcagacaggcctacgaggacctgagaaagcagagactgaacgagttcatggccggcttctacatcatcaccaacaagctgaaggagaactaccagatgctgaccctgggcggcgacgccgagctggagctggtggacagcctggaccccttcagcgagggcatcatgttcagcgtgagaccccccaagaagagctggaagaagatcttcaacctgagcggcggcgagaagaccctgagcagcctggccctggtgttcgccctgcaccactacaagcccacccccctgtacttcatggacgagatcgacgccgccctggacttcaagaacgtgagcatcgtggccttctacatctacgagcagaccaagaacgcccagttcatcatcatcagcctgagaaacaacatgttcgagatcagcgacagactgatcggcatctacaagacctacaacatcaccaagagcgtggccgtgaaccccaaggagatcgccagcaagggcctgtgctag

SEQ ID NO: 10513 - DNA, 2661 bp, Artificial Sequence
  Description of Artificial Sequence: Synthetic coding sequence
atggagctgagatgcggcggcctgctgttcagcagcagattcgacagcggcaacctggcccacgtggagaaggtggagagcctgagcagcgacggcgagggcgtgggcggcggcgccagcgccctgaccagcggcatcgccagcagccccgactacgagttcaacgtgtggaccagacccgactgcgccgagaccgagttcgagaacggcaacagaagctggttctacttcagcgtgagaggcggcatgcccggcaagctgatcaagatcaacatcatgaacatgaacaagcagagcaagctgtacagccagggcatggcccccttcgtgagaaccctgcccaccagacccagatgggagagaatcagagacagacccaccttcgagatgaccgagacccagttcgtgctgagcttcgtgcacagattcgtggagggcagaggcgccaccaccttcttcgccttctgctaccccttcagctacagcgactgccaggagctgctgaaccagctggaccagagattccccgagaaccaccccacccacagcagccccctggacaccatctactaccacagagagctgctgtgctacagcctggacggcctgagagtggacctgctgaccatcaccagctgccacggcctgagagaggacagagagcccagactggagcagctgttccccgacaccagcacccccagacccttcagattcgccggcaagagaatcttcttcctgagcagcagagtgcaccccggcgagacccccagcagcttcgtgttcaacggcttcctggacttcatcctgagacccgacgaccccagagcccagaccctgagaagactgttcgtgttcaagctgatccccatgctgaaccccgacggcgtggtgagaggccactacagaaccgacagcagaggcgtgaacctgaacagacagtacctgaagcccgacgccgtgctgcaccccgccatctacggcgccaaggccgtgctgctgtaccaccacgtgcacagcagactgaacagccagagcagcagcgagcaccagcccagcagctgcctgccccccgacgcccccgtgagcgacctggagaaggccaacaacctgcagaacgaggcccagtgcggccacagcgccgacagacacaacgccgaggcctggaagcagaccgagcccgccgagcagaagctgaacagcgtgtggatcatgccccagcagagcgccggcctggaggagagcgcccccgacaccatcccccccaaggagagcggcgtggcctactacgtggacctgcacggccacgccagcaagagaggctgcttcatgtacggcaacagcttcagcgacgagagcacccaggtggagaacatgctgtaccccaagctgatcagcctgaacagcgcccacttcgacttccagggctgcaacttcagcgagaagaacatgtacgccagagacagaagagacggccagagcaaggagggcagcggcagagtggccatctacaaggccagcggcatcatccacagctacaccctggagtgcaactacaacaccggcagaagcgtgaacagcatccccgccgcctgccacgacaacggcagagccagccccccccccccccccgccttccccagcagatacaccgtggagctgttcgagcaggtgggcagagccatggccatcgccgccctggacatggccgagtgcaacccctggcccagaatcgtgctgagcgagcacagcagcctgaccaacctgagagcctggatgctgaagcacgtgagaaacagcagaggcctgagcagcaccctgaacgtgggcgtgaacaagaagagaggcctgagaaccccccccaagagccacaacggcctgcccgtgagctgcagcgagaacaccctgagcagagccagaagcttcagcaccggcaccagcgccggcggcagcagcagcagccagcagaacagcccccagatgaagaacagccccagcttccccttccacggcagcagacccgccggcctgcccggcctgggcagcagcacccagaaggtgacccacagagtgctgggccccgtgagagagcccagaagccaggacagaagaagacagcagcagcccctgaaccacagacccgccggcagcctggcccccagccccgcccccaccagcagcggccccgccagcagccacaagctgggcagctgcctgctgcccgacagcttcaacatccccggcagcagctgcagcctgctgagcagcggcgacaagcccgaggccgtgatggtgatcggcaagggcctgctgggcaccggcgccagaatgccctgcatcaagaccagactgcaggccagacccagactgggcagaggcagcccccccaccagaagaggcatgaagggcagcagcggccccaccagccccacccccagaaccagagagagcagcgagctggagctgggcagctgcagcgccacccccggcctgccccaggccagaccccccagacccagaagcgcccccgccttcagccccatcagctgcagcctgagcgacagccccagctggaactgctacagcagaggccccctgggccagcccgaggtgtgcttcgtgcccaagagcccccccctgaccgtgagccccagagtgtag

SEQ ID NO: 10514 - DNA, 4221 bp, Artificial Sequence; identical to SEQ ID NO: 10332
  Description of Artificial Sequence: Synthetic coding sequence

SEQ ID NO: 10515 - DNA, 1308 bp, Artificial Sequence
  Description of Artificial Sequence: Synthetic coding sequence
atgggcgacctggagctgctgctgcccggcgaggccgaggtgctggtgagaggcctgagaagcttccccctgagagagatgggcagcgagggctggaaccagcagcacgagaacctggagaagctgaacatgcaggccatcctggacgccaccgtgagccagggcgagcccatccaggagctgctggtgacccacggcaaggtgcccaccctggtggaggagctgatcgccgtggagatgtggaagcagaaggtgttccccgtgttctgcagagtggaggacttcaagccccagaacaccttccccatctacatggtggtgcaccacgaggccagcatcatcaacctgctggagaccgtgttcttccacaaggaggtgtgcgagagcgccgaggacaccgtgctggacctggtggactactgccacagaaagctgaccctgctggtggcccagagcggctgcggcggcccccccgagggcgagggcagccaggacagcaaccccatgcaggagctgcagaagcaggccgagctgatggagttcgagatcgccctgaaggccctgagcgtgctgagatacatcaccgactgcgtggacagacagtggagcgtgagccagcccccccagctggcccacctgaagagaatccagagactgcaccccgtgtgctggttcctgagccccggcaagctgcagcagttcgagggcagcagatggcacaccgtggcccccagcgagcagcagaagctgagcaagctggacggccaggtgtggatcgccctgtacaacctgctgctgagccccgaggcccaggccagatactgcctgaccagcttcgccaagggcagactgctgaagctgagagccttcctgaccgacaccctgctggaccagctgcccaacctggcccacctgcagagcttcctggcccacctgaccctgaccgagacccagccccccaagaaggacctggtgctggagcagatccccgagatctgggagagactggagagagagaacagaggcaagtggcaggccatcgccaagcaccagctgcagcacgtgttcagccccagcgagcaggacctgagactgcaggccagaagatgggccgagacctacagactggacgtgctggaggccgtggcccccgagagacccagatgcgcctactgcagcgccgaggccagcaagagatgcagcagatgccagaacgagtggtactgctgcagagagtgccaggtgaagcactgggagaagcacggcaagacctgcgtgctggccgcccagggcgacagagccaagtag

SEQ ID NO: 10516 - DNA, 1377 bp, Artificial Sequence
  Description of Artificial Sequence: Synthetic coding sequence
atgaacgaggccatggccaccgacagccccagaagacccagcagatgcaccggcggcgtggtggtgagaccccaggccgtgaccgagcagagctacatggagagcgtggtgaccttcctgcaggacgtggtgccccaggtgtactgctgcggcgacaacatccagagctacaccgccaccgtgatcagcgccgccaagaccctgaagagcggcctgaccatggtgggcaaggtggtgacccagctgaccggcaccctgcccagcggcgtgaccgaggacgacgtggccatccacagcaacagcagaagaagccccctggtgcccggcatcatcaccgtgatcgacaccgagaccgtgggcgagggccaggtgctggtgagcgaggacagcgacagcgacggcatcgtggcccacttccccgcccacgagaagcccgtgtgctgcatggccttcaacaccagcggcatgctgctggtgaccaccgacaccctgggccacgacttccacgtgttccagatcctgacccacccctggagcagcagccagtgcgccgtgcaccacctgtacaccctgcacagaggcgagaccgaggccaaggtgcaggacatctgcttcagccacgactgcagatgggtggtggtgagcaccctgagaggcaccagccacgtgttccccatcaacccctacggcggccagccctgcgtgagaacccacatgagccccagagtggtgaacagaatgagcagattccagaagagcgccggcctggaggagatcgagcaggagctgaccagcaagcagggcggcagatgcagccccgtgcccggcctgagcagcagccccagcggcagccccctgcacggcaagctgaacagccaggacagctacaacaacttcaccaacaacaaccccggcaaccccagactgagccccctgcccagcctgatggtggtgatgcccctggcccagatcaagcagcccatgaccctgggcaccatcaccaagagaaccggcaaggtgaagccccccccccagatcagccccagcaagagcatgggcggcgagttctgcgtggccgccatcttcggcaccagcagaagctggttcgccaacaacgccggcctgaagagagagaaggaccagagcaagcaggtggtggtggagagcctgtacatcatcagctgctacggcaccctggtggagcacatgatggagccccagcccctgaacggcatgaactgcagccacagactgatgcagaccaccctgtgcagcagcctgcagatgcagtacagcatcatcagcagctgcctgctggcctggttccccctggaggtgctgggccccctgctggacatgggcctgaccaccgtgtag

SEQ ID NO: 10517 - DNA, 309 bp, Artificial Sequence
  Description of Artificial Sequence: Synthetic coding sequence
atgagagccagcccctgcatcagccagcccgccgccagctggcaccccagacccagcgccctgagacccaccgccggcagcggccccgacaccagaacccccggcaccgtggaggacggcagcgccccctgccccgccttcagaagccccgccgtgagcccctgcggcgaggagccctgctgcttccagatcagccccgccgaggagaccctggagctgggcagactggtgagccccggctgccacaagagcagcgccccccaggagagaagactggaccccagagccagatgcgtggtgcacatctag

SEQ ID NO: 10518 - DNA, 4227 bp, Artificial Sequence; identical to SEQ ID NO: 10132
  Description of Artificial Sequence: Synthetic coding sequence

SEQ ID NO: 10519 - DNA, 2994 bp, Artificial Sequence
  Description of Artificial Sequence: Synthetic coding sequence
agacccccccccgccggcccccaggcccccgagggcgccagagccggcagcagacccgtgcagctgctggccctgctgagcagctggtgcgaggagctgggcagactgctgctgctgagacaccagaagagcagacagagcgacccccccggcaagctgcccatgcagccccccctgagcagcatgagcagcatgaagcccaccctgagccacagcgacggcagcttcccctacgacagcgtgccctggcagcagaacaccaaccagccccccggcagcctgagcgtggtgaccaccgtgtggggcgtgaccaacaccagccagagccaggtgctgggcaaccccatggccaacgccaacaaccccatgaaccccggcggcaaccccatggccagcggcatgaccaccagcaaccccggcctgaacagcccccagttcgccggccagcagcagcagttcagcgccaaggccggccccgcccagccctacatccagcagagcatgtacggcagacccaactaccccggcagcggcggcttcggcgccagctaccccggcggccccaacgcccccgccggcatgggcatccccccccacaccagaccccccgccgacttcacccagcccgccgccgccgccgccgccgccgccgtggccgccgccgccgccaccgccaccgccaccgccaccgccaccgtggccgccctgcaggagacccagaacaaggacatcaaccagtacggccccatgggccccacccaggcctacaacagccagttcatgaaccagcccggccccagaggccccgccagcatgggcggcagcatgaaccccgccagcatggccgccggcatgacccccagcggcatgagcggcccccccatgggcatgaaccagcccagaccccccggcatcagccccttcggcacccacggccagagaatgccccagcagacctaccccggccccagaccccagagcctgcccatccagaacatcaagagaccctaccccggcgagcccaactacggcaaccagcagtacggccccaacagccagttccccacccagcccggccagtaccccgcccccaacccccccagacccctgaccagccccaactaccccggccagagaatgcccagccagcccagcagcggccagtaccccccccccaccgtgaacatgggccagtactacaagcccgagcagttcaacggccagaacaacaccttcagcggcagcagctacagcaactacagccagggcaacgtgaacagaccccccagacccgtgcccgtggccaactacccccacagccccgtgcccggcaaccccaccccccccatgacccccggcagcagcatccccccctacctgagccccagccaggacgtgaagccccccttcccccccgacatcaagcccaacatgagcgccctgccccccccccccgccaaccacaacgacgagctgagactgaccttccccgtgagagacggcgtggtgctggagcccttcagactggagcacaacctggccgtgagcaaccacgtgttccacctgagacccaccgtgcaccagaccctgatgtggagaagcgacctggagctgcagttcaagtgctaccaccacgaggacagacagatgaacaccaactggcccgccagcgtgcaggtgagcgtgaacgccacccccctgaccatcgagagaggcgacaacaagaccagccacaagcccctgcacctgaagcacgtgtgccagcccggcagaaacaccatccagatcaccgtgaccgcctgctgctgcagccacctgttcgtgctgcagctggtgcacagacccagcgtgagaagcgtgctgcagggcctgctgaagaagagactgctgcccgccgagcactgcatcaccaagatcaagagaaacttcagcagcgtggccgccagcagcggcaacaccaccctgaacggcgaggacggcgtggagcagaccgccatcaaggtgagcctgaagtgccccatcaccttcagaagaatccagctgcccgccagaggccacgactgcaagcacgtgcagtgcttcgacctggagagctacctgcagctgaactgcgagagaggcacctggagatgccccgtgtgcaacaagaccgccctgctggagggcctggaggtggaccagtacatgtggggcatcctgaacgccatccagcacagcgagttcgaggaggtgaccatcgaccccacctgcagctggagacccgtgcccatcaagagcgacctgcacatcaaggacgaccccgacggcatccccagcaagagattcaagaccatgagccccagccagatgatcatgcccaacgtgatggagatgatcgccgccctgggccccggccccagcccctaccccctgccccccccccccggcggcaccaacagcaacgactacagcagccagggcaacaactaccagggccacggcaacttcgacttcccccacggcaaccccggcggcaccagcatgaacgacttcatgcacggccccccccagctgagccacccccccgacatgcccaacaacatggccgccctggagaagcccctgagccaccccatgcaggagaccatgccccacgccggcagcagcgaccagccccaccccagcatccagcagggcctgcacgtgccccaccccagcagccagagcggcccccccctgcaccacagcggcgcccccccccccccccccagccagccccccagacagcccccccaggccgcccccagcagccacccccacagcgacctgaccttcaaccccagcagcgccctggagggccaggccggcgcccagggcgccagcgacatgcccgagcccagcctggacctgctgcccgagctgaccaaccccgacgagctgctgagctacctggacccccccgacctgcccagcaacagcaacgacgacctgctgagcctgttcgagaacaactag

SEQ ID NO: 10520 - DNA, 3405 bp, Artificial Sequence
  Description of Artificial Sequence: Synthetic coding sequence
atgggcaaggagcaggagctgctggaggccgccagaaccggccacctgcccgccgtggagaagctgctgagcggcaagagactgagcagcggcttcggcggcggcggcggcggcggcagcggcggcggcggcggcggcagcggcggcggcggcggcggcctgggcagcagcagccaccccctgagcagcctgctgagcatgtggagaggccccaacgtgaactgcgtggacagcaccggctacacccccctgcaccacgccgccctgaacggccacaaggacgtggtggaggtgctgctgagaaacgacgccctgaccaacgtggccgacagcaagggctgctaccccctgcacctggccgcctggaagggcgacgcccagatcgtgagactgctgatccaccagggccccagccacaccagagtgaacgagcagaacaacgacaacgagaccgccctgcactgcgccgcccagtacggccacaccgaggtggtgaaggtgctgctggaggagctgaccgaccccaccatgagaaacaacaagttcgagacccccctggacctggccgccctgtacggcagactggaggtggtgaagatgctgctgaacgcccaccccaacctgctgagctgcaacaccaagaagcacacccccctgcacctggccgccagaaacggccacaaggccgtggtgcaggtgctgctggacgccggcatggacagcaactaccagaccgagatgggcagcgccctgcacgaggccgccctgttcggcaagaccgacgtggtgcagatcctgctggccgccggcaccgacgtgaacatcaaggacaaccacggcctgaccgccctggacaccgtgagagagctgcccagccagaagagccagcagatcgccgccctgatcgaggaccacatgaccggcaagagaagcaccaaggaggtggacaagaccccccccccccagccccccctgatcagcagcatggacagcatcagccagaagagccagggcgacgtggagaaggccgtgaccgagctgatcatcgacttcgacgccaacgccgaggaggagggcccctacgaggccctgtacaacgccatcagctgccacagcctggacagcatggccagcggcagaagcagcgaccaggacagcaccaacaaggaggccgaggccgccggcgtgaagcccgccggcgtgagacccagagagagaccccccccccccgccaagcccccccccgacgaggaggaggaggaccacatcgacaagaagtacttccccctgaccgccagcgaggtgctgagcatgagacccagaatccacggcagcgccgccagagaggaggacgagcacccctacgagctgctgctgaccgccgagaccaagaaggtggtgctggtggacggcaagaccaaggaccacagaagaagcagcagcagcagaagccaggacagcgccgagggccaggacggccaggtgcccgagcagttcagcggcctgctgcacggcagcagccccgtgtgcgaggtgggccaggaccccttccagctgctgtgcaccgccggccagagccaccccgacggcagcccccagcagggcgcctgccacaaggccagcatgcagctggaggagaccggcgtgcacgcccccggcgccagccagcccagcgccctggaccagagcaagagagtgggctacctgaccggcctgcccaccaccaacagcagaagccaccccgagaccctgacccacaccgccagcccccaccccggcggcgccgaggagggcgacagaagcggcgccagaagcagagccccccccaccagcaagcccaaggccgagctgaagctgagcagaagcctgagcaagagcgacagcgacctgctgacctgcagccccaccgaggacgccaccatgggcagcagaagcgagagcctgagcaactgcagcatcggcaagaagagactggagaagagccccagcttcgccagcgagtgggacgagatcgagaagatcatgagcagcatcggcgagggcatcgacttcagccaggagagacagaagatcagcggcctgagaaccctggagcagagcgtgggcgagtggctggagagcatcggcctgcagcagtacgagagcaagctgctgctgaacggcttcgacgacgtgcacttcctgggcagcaacgtgatggaggagcaggacctgagagacatcggcatcagcgacccccagcacagaagaaagctgctgcaggccgccagaagcctgcccaaggtgaaggccctgggctacgacggcaacagcccccccagcgtgcccagctggctggacagcctgggcctgcaggactacgtgcacagcttcctgagcagcggctacagcagcatcgacaccgtgaagaacctgtgggagctggagctggtgaacgtgctgaaggtgcagctgctgggccacagaaagagaatcatcgccagcctggccgacagaccctacgaggagcccccccagaagccccccagattcagccagctgagatgccaggacctgctgagccagaccagcagccccctgagccagaacgacagctgcaccggcagaagcgccgacctgctgctgccccccggcgacaccggcagaagaagacacgacagcctgcacgaccccgccgcccccagcagagccgagagattcagaatccaggaggagcacagagaggccaagctgaccctgagaccccccagcctggccgccccctacgcccccgtgcagagctggcagcaccagcccgagaagctgatcttcgagagctgcggctacgaggccaactacctgggcagcatgctgatcaaggacctgagaggcaccgagagcacccaggacgcctgcgccaagatgagaaagagcaccgagcacatgaagaagatccccaccatcatcctgagcatcacctacaagggcgtgaagttcatcgacgccagcaacaagaacgtgatcgccgagcacgagatcagaaacatcagctgcgccgcccaggaccccgaggacctgtgcaccttcgcctacatcaccaaggacctgcagaccagccaccactactgccacgtgttcagcaccgtggacgtgaacctgacctacgagatcatcctgaccctgggccaggccttcgaggtggcctaccagctggccctgcaggcccagaagagcagagccaccggcgccagcgccgccgagatgatcgagaccaagagcagcaagcccgtgcccaagcccagagtgggcgtgagaaagagcgccctggagccccccgacatggaccaggacgcccagagccacgccagcgtgagctgggtggtggaccccaagcccgacagcaagagaagcctgagcaccaactag

SEQ ID NO: 10521 - DNA, 3099 bp, Artificial Sequence
  Description of Artificial Sequence: Synthetic coding sequence
atggaggccgccgccgccgtggtggccgccgaggccgaggtggagaacgaggacggcgacagcagctgcggcgacgtgtgcttcatggacaagggcctgcagagcatcagcgagctgagcctggacagcaccctgcacgccgtgaacctgcactgcaacaacatcagcaagatcgaggccatcgaccacatctggaacctgcagcacctggacctgagcagcaaccagatcagcagaatcgagggcctgaacaccctgaccaagctgtgcaccctgaacctgagctgcaacctgatcaccaaggtggagggcctggaggagctgatcaacctgaccagactgaacgtgagctacaaccacatcgacgacctgagcggcctgatccccctgcacggcatcaagcacaagctgagatacatcgacctgcacagcaacagaatcgacagcatccaccacctgctgcagtgcatggtgggcctgcacttcctgaccaacctgatcctggagaaggacggcgacgacaaccccgtgtgcagactgcccggctacagagccgtgatcctgcagaccctgccccagctgagaatcctggactgcaagaacatcttcggcgagcccgtgaacctgaccgagatcaacagcagccagctgcagtgcctggagggcctgctggacaacctggtgagcagcgacagccccctgaacatcagcgaggacgagatcatcgacagaatgcccgtgatcaccgcccccatcgacgagctggtgcccctggagcagttcgccagcacccccagcgacgccgtgctgaccagcttcatgagcgtgtgccagagcagcgagcccgagaagaacaaccacgagaacgacctgcagaacgagatcaagctgcagaagctggacgaccagatcctgcagctgctgaacgagaccagcaacagcatcgacaacgtgctggagaaggaccccagacccaagagagacaccgacatcaccagcgagagcgactacggcaacagaaaggagtgcaacagaaaggtgcccagaagaagcaagatcccctacgacgccaagaccatccagaccatcaagcaccacaacaagaactacaacagcttcgtgagctgcaacagaaagatgaagcccccctacctgaaggagctgtacgtgagcagcagcctggccaactgccccatgctgcaggagagcgagaagcccaagaccgagatcatcaaggtggaccagagccacagcgaggacaacacctaccagagcctggtggagcagctggaccaggagagagagaagagatggagagccgagcaggccgagaacaagctgatggactacatcgacgagctgcacaagcacgccaacgagaaggaggacatccacagcctggccctgctgaccaccgacagactgaaggagatcatcttcagagagagaaacagcaagggccagctggaggtgatggtgcacaagctgcagaacgagatcaagaagctgaccgtggagctgatgaaggccaaggaccagcaggaggaccacctgaagcacctgagaaccctggagaagaccctggagaagatggagagacagaagagacagcagcaggccgcccagatcagactgatccaggaggtggagctgaaggccagcgccgccgacagagagatctacctgctgagaaccagcctgcacagagagagagagcaggcccagcagctgcaccagctgctggccctgaaggagcaggagcacagaaaggagctggagaccagagagttcttcaccgacgccgacttccaggacgccctggccaaggagatcgccaaggaggagaagaagcacgagcagatgatcaaggagtaccaggagaagatcgacgtgctgagccagcagtacatggacctggagaacgagttcagaatcgccctgaccgtggaggccagaagattccaggacgtgaaggacggcttcgagaacgtggccaccgagctggccaagagcaagcacgccctgatctgggcccagagaaaggagaacgagagcagcagcctgatcaaggacctgacctgcatggtgaaggagcagaagaccaagctggccgaggtgagcaagctgaagcaggagaccgccgccaacctgcagaaccagatcaacaccctggagatcctgatcgaggacgacaagcagaagagcatccagatcgagctgctgaagcacgagaaggtgcagctgatcagcgagctggccgccaaggagagcctgatcttcggcctgagaaccgagagaaaggtgtggggccacgagctggcccagcagggcagcagcctggcccagaacagaggcaagctggaggcccagatcgagagcctgagcagagagaacgagtgcctgagaaagaccaacgagagcgacagcgacgccctgagaatcaagtgcaagatcatcgacgaccagaccgagaccatcagaaagctgaaggactgcctgcaggagaaggacgagcacatcaagagactgcaggagaagatcaccgagatcgagaagtgcacccaggagcagctggacgagaagagcagccagctggacgaggtgctggagaagctggagagacacaacgagagaaaggagaagctgaagcagcagctgaagggcaaggaggtggagctggaggagatcagaaaggcctacagcaccctgaacagaaagtggcacgacaagggcgagctgctgtgccacctggagacccaggtgaaggaggtgaaggagaagttcgagaacaaggagaagaagctgaaggccgagagagacaagagcatcgagctgcagaagaacgccatggagaagctgcacagcatggacgacgccttcaagagacaggtggacgccatcgtggaggcccaccaggccgagatcgcccagctggccaacgagaagcagaagtgcatcgacagcgccaacctgaaggtgcaccagatcgagaaggagatgagagagctgctggaggagacctgcaagaacaagaagaccatggaggccaagatcaagcagctggccttcgccctgaacgagatccagcaggacatgtag

SEQ ID NO: 10522 - DNA, 219 bp, Artificial Sequence
  Description of Artificial Sequence: Synthetic coding sequence
atgagctaccagcagcagcagtgcaagcagccctgccagcccccccccgtgtgccccacccccaagtgccccgagccctgccccccccccaagtgccccgagccctgccccagccccaagtgcccccagccctgccccccccagcagtgccagcagaagtacccccccgtgacccccagccccccctgccagcccaagtgcccccccaagagcaagtag

SEQ ID NO: 10523 - DNA, 888 bp, Artificial Sequence; identical to SEQ ID NO: 10194
  Description of Artificial Sequence: Synthetic coding sequence

SEQ ID NO: 10524 - DNA, 1491 bp, Artificial Sequence; identical to SEQ ID NO: 10231
  Description of Artificial Sequence: Synthetic coding sequence

SEQ ID NO: 10525 - DNA, 1575 bp, Artificial Sequence
  Description of Artificial Sequence: Synthetic coding sequence
atgagcagctgcgtgagcagccagcccagcagcaacagagccgccccccaggacgagctgggcggcagaggcagcagcagcatccacctgggcatggagagcttcatcgtggtgaccgagtgcgagcccggctgcgccgtggacctgggcctggccagagacagacccctggaggccgacggccaggaggtgcccctggacaccagcggcagccaggccagaccccacctgagcggcagaaagctgagcctgcaggagagaagccagggcggcctggccgccggcggcagcctggacatgaacggcagatgcatctgccccagcctgccctacagccccgtgagcagcccccagagcagccccagactgcccagaagacccaccgtggagagccaccacgtgagcatcaccggcatgcaggactgcgtgcagctgaaccagtacaccctgaaggacgagatcggcaagggcagctacggcgtggtgaagctggcctacaacgagaacgacaacacctactacgccatgaaggtgctgagcaagaagaagctgatcagacaggccggcttccccagaagacccccccccagaggcaccagacccgcccccggcggctgcatccagcccagaggccccatcgagcaggtgtaccaggagatcgccatcctgaagaagctggaccaccccaacgtggtgaagctggtggaggtgctggacgaccccaacgaggaccacctgtacatggtgttcgagctggtgaaccagggccccgtgatggaggtgcccaccctgaagcccctgagcgaggaccaggccagattctacttccaggacctgatcaagggcatcgagtacctgcactaccagaagatcatccacagagacatcaagcccagcaacctgctggtgggcgaggacggccacatcaagatcgccgacttcggcgtgagcaacgagttcaagggcagcgacgccctgctgagcaacaccgtgggcacccccgccttcatggcccccgagagcctgagcgagaccagaaagatcttcagcggcaaggccctggacgtgtgggccatgggcgtgaccctgtactgcttcgtgttcggccagtgccccttcatggacgagagaatcatgtgcctgcacagcaagatcaagagccaggccctggagttccccgaccagcccgacatcgccgaggacctgaaggacctgatcaccagaatgctggacaagaaccccgagagcagaatcgtggtgcccgagatcaagctgcacccctgggtgaccagacacggcgccgagcccctgcccagcgaggacgagaactgcaccctggtggaggtgaccgaggaggaggtggagaacagcgtgaagcacatccccagcctggccaccgtgatcctggtgaagaccatgatcagaaagagaagcttcggcaaccccttcgagggcagcagaagagaggagagaagcctgagcgcccccggcaacctgctgaccaagcagggcagcgaggacaacctgcagggcaccgaccccccccccgtgggcgaggaggaggtgctgctgtag

SEQ ID NO: 10526 - DNA, 1902 bp, Artificial Sequence
  Description of Artificial Sequence: Synthetic coding sequence
atgaaggccatcaagaagagcctgaccgaggaggagtacctgtacctggacttcagccaccagaccgagggctgcatcttccccctgcacaccagcgtgaccctgttcctgctgagctactgcgactgcaagatcttcaagatctgcctggtggtgaccaaggaggtgagcagagacagcagcctgctgagagacgacctgatccaggacgtggagatccagatcatcagcagacaggagctgccccccatcgtgcagaactgctgcctgcccgccgtggtggagagaagcgacaacttctgcagagccggcctggccgtggtgctgagacacatcatccagaagagctacgaggccgaccccctgaagaaggagctgctggagctgctgggcttcaagaagacctgcctgaaggcctgcgccgaggtgagccagtggaccagactgtgcgagctgaccatccccctggccatcgagaacttcctgagagagagcagcgaccagccccccaccatccccgtggagatcctgcagctggagaagaagctgagcgagcccgtgagagtgcacaacgacgacaagctgagaagacagaagctgaagcagcagaaggccgacggcgtgggcccccccctgaccaagggcaaggccaagagcaaggtgcacacccaggagaccagcgagggcctggacagcagcagcaagagcctggagctgaaggtggccttcagcaagctgaccgtgcaggaggagcccgccaccaccaacagagagcccagccacatcagaaaggccaaggccagcgacctgccccccctggagcacgtgttcgccgagggcctgtacttcaccctggccgacatcgtgctgctgccctgcatccaccacttcctggtgatcatcagcagaaagttcagcgagaagctggtggagttccccctgctggccagctggtaccagagaatccaggaggtgcccggcgtgaagaccgccgccagcaagtgcggcatccagttcctgcacctgcccaagctgctgaccaccagcaccgagcagcaccccaacctgtgcgaggtgcccggcgtggaggagcagagcgaccccctgttcatcggcggccccagacccaccatggccaagctgatggagaagggcatcgaggtgatgttcagcccccacccctgccccacctggaccctggactggaacgtgctgcccgccgccgtgagccccaaggagggcaagatgagcagcgacagagccctgagaaagcagcagcagctgaacaacctggtgtacgtggtgaccaaccaggccaagcccggcgacagaatcgtggacttctgcagcggcggcggccacgtgggcatcgtgctggcccacatgctgcccagctgccaggtgaccctgatcgagaacaaggagctgagcctgatcagagccaagaagagaagcgacgagctgggcctgagcaacatctggttcatccaggccaacatggagtacttcaccggcatgttcaacatcggcgtggccctgcacgcctgcggcgtggccaccgacatggtgatcgagcactgcatcaagaccagagccagcttcgtgacctgcccctgctgctacggcttcatccagaacaccagcaagttcaacttccccaagagcgagcagttcaagaagaccctgagctacaaggagcacatgatcctgtgcagattcgccgaccagaccgccgtgcagctgcccccccagagaagactgatcggcaagcagtgcatgtgcctggtggacctggacagagccagagccgccgaggagtgcggctacagcgtgcaggtgatcagcatggagcccgagagctgcagccccaagaacaacatgatcgtgggcgtgcccatctag

SEQ ID NO: 10527 - DNA, 519 bp, Artificial Sequence
  Description of Artificial Sequence: Synthetic coding sequence
atgagcagcggcaactaccagcagagcgaggccctgagcaagcccaccttcagcgaggagcaggccagcgccctggtggagagcgtgttcggcctgaaggtgagcaaggtgagacccctgcccagctacgacgaccagaacttccacgtgtacgtgagcaagaccaaggacggccccaccgagtacgtgctgaagatcagcaacaccaaggccagcaagaaccccgacctgatcgaggtgcagaaccacatcatcatgttcctgaaggccgccggcttccccaccgccagcgtgtgccacaccaagggcgacaacaccgccagcctggtgagcgtggacagcggcagcgagatcaagagctacctggtgagactgctgacctacctgcccggcagacccatcgccgagctgcccgtgagcccccagctgctgtacgagatcggcaagctggccgccaagctggacaagaccctgcaggagggcaagcccagagtgacccccctgctggccaagaactag

SEQ ID NO: 10528 - DNA, 2937 bp, Artificial Sequence
  Description of Artificial Sequence: Synthetic coding sequence
atgggctggaagcccagcgaggccagaggccagagccagagcttccaggccagcggcctgcagcccagaagcctgaaggccgccagaagagccaccggcagacccgacagaagcagagccgccagacccaccatggaccccagcgcccacagaagcagagccgccccccccaacatggaccccgacccccaggccggcgtgcaggtgggcatgagagtggtgagaggcgtggactggaagtggggccagcaggacggcggcgagggcggcgtgggcaccgtggtggagctgggcagacacggcagccccagcacccccgacagaaccgtggtggtgcagtgggaccagggcaccagaaccaactacagagccggctaccagggcgcccacgacctgctgctgtacgacaacgcccagatcggcgtgagacaccccaacatcatctgcgactgctgcaagaagcacggcctgagaggcatgagatggaagtgcagagtgtgcctggactacgacctgtgcacccagtgctacatgcacaacaagcacgagctggcccacgccttcgacagatacgagaccgcccacagcagacccgtgaccctgagccccagacagggcctgcccagaatccccctgagaggcatcttccagggcgccaaggtggtgagaggccccgactgggagtggggcagccaggacggcggcgagggcaagcccggcagagtggtggacatcagaggctgggacgtggagaccggcagaagcgtggccagcgtgacctgggccgacggcaccaccaacgtgtacagagtgggccacaagggcaaggtggacctgaagtgcgtgggcgaggccgccggcggcttctactacaaggaccacctgcccagactgggcaagcccgccgagctgcagagaagagtgagcgccgacagccagcccttccagcacggcgacaaggtgaagtgcctgctggacaccgacgtgctgagagagatgcaggagggccacggcggctggaaccccagaatggccgagttcatcggccagaccggcaccgtgcacagaatcaccgacagaggcgacgtgagagtgcagttcaaccacgagaccagatggaccttccaccccggcgccctgaccaaggccctgggcagagtgggcaaggtggtgaaggtgttcggcgacggcaacctgagagtggccgtggccggccagagatggaccttcagccccagctgcctggtggcctacagacccgaggaggacgccaacctggacgtggccgagagagccagagagaacaagagcagcctgagcgtggccctggacaagctgagagcccagaagagcgaccccgagcaccccggcagactggtggtggaggtggccctgggcaacgccgccagagccctggacctgctgagaagaagacccgagcaggtggacaccaagaaccagggcagaaccgccctgcaggtggccgcctacctgggccaggtggagctgatcagactgctgctgcaggccagagccggcgtggacctgcccgacgacgagggcaacaccgccctgcactacgccgccctgggcaaccagcccgaggccaccagagtgctgctgagcgccggctgcagagccgacgccatcaacagcacccagagcaccgccctgcacgtggccgtgcagagaggcttcctggaggtggtgagagccctgtgcgagagaggctgcgacgtgaacctgcccgacgcccacagcgacacccccctgcacagcgccatcagcgccggcaccggcgccagcggcatcgtggaggtgctgaccgaggtgcccaacatcgacgtgaccgccaccaacagccagggcttcaccctgctgcaccacgccagcctgaagggccacgccctggccgtgagaaagatcctggccagagccagacagctggtggacgccaagaaggaggacggcttcaccgccctgcacctggccgccctgaacaaccacagagaggtggcccagatcctgatcagagagggcagatgcgacgtgaacgtgagaaacagaaagctgcagagccccctgcacctggccgtgcagcaggcccacgtgggcctggtgcccctgctggtggacgccggctgcagcgtgaacgccgaggacgaggagggcgacaccgccctgcacgtggccctgcagagacaccagctgctgcccctggtggccgacggcgccggcggcgaccccggccccctgcagctgctgagcagactgcaggccagcggcctgcccggcagcgccgagctgaccgtgggcgccgccgtggcctgcttcctggccctggagggcgccgacgtgagctacaccaaccacagaggcagaagccccctggacctggccgccgagggcagagtgctgaaggccctgcagggctgcgcccagagattcagagagagacaggccggcggcggcgccgcccccggccccagacagaccctgggcacccccaacaccgtgaccaacctgcacgtgggcgccgcccccggccccgaggccgccgagtgcctggtgtgcagcgagctggccctgctggtgctgttcagcccctgccagcacagaaccgtgtgcgaggagtgcgccagaagaatgaagaagtgcatcagatgccaggtggtggtgagcaagaagctgagacccgacggcagcgaggtggccagcgccgcccccgcccccggcccccccagacagctggtggaggagctgcagagcagatacagacagatggaggagagaatcacctgccccatctgcatcgacagccacatcagactggtgttccagtgcggccacggcgcctgcgccccctgcggcagcgccctgagcgcctgccccatctgcagacagcccatcagagacagaatccagatcttcgtgtag

SEQ ID NO: 10529 - DNA, 1074 bp, Artificial Sequence
  Description of Artificial Sequence: Synthetic coding sequence
atgggcggcgccgtgagcgccggcgaggacaacgacgacctgatcgacaacctgaaggaggcccagtacatcagaaccgagagagtggagcaggccttcagagccatcgacagaggcgactactacctggagggctacagagacaacgcctacaaggacctggcctggaagcacggcaacatccacctgagcgccccctgcatctacagcgaggtgatggaggccctgaagctgcagcccggcctgagcttcctgaacctgggcagcggcaccggctacctgagcaccatggtgggcctgatcctgggccccttcggcatcaaccacggcatcgagctgcacagcgacgtggtggagtacgccaaggagaagctggagagcttcatcaagaacagcgacagcttcgacaagttcgagttctgcgagcccgccttcgtggtgggcaactgcctgcagatcgccagcgacagccaccagtacgacagaatctactgcggcgccggcgtgcagaaggaccacgagaactacatgaagatcctgctgaaggtgggcggcatcctggtgatgcccatcgaggaccagctgacccagatcatgagaaccggccagaacacctgggagagcaagaacatcctggccgtgagcttcgcccccctggtgcagcccagcaagaacgacaacggcaagcccgacagcgtgggcctgcccccctgcgccgtgagaaacctgcaggacctggccagaatctacatcagaagaaccctgagaaacttcatcaacgacgagatgcaggccaagggcatcccccagagagccccccccaagagaaagagaaagagagtgaagcagagaatcaacacctacgtgttcgtgggcaaccagctgatcccccagcccctggacagcgaggaggacgagaagatggaggaggacaacaaggaggaggaggagaaggaccacaacgaggccatgaagcccgaggagcccccccagaacctgctgagagagaagatcatgaagctgcccctgcccgagagcctgaaggcctacctgacctacttcagagacaagtag

SEQ ID NO: 10530 - DNA, 633 bp, Artificial Sequence
  Description of Artificial Sequence: Synthetic coding sequence
atgagctgccccaactactgcagcggcaacagcaacagcggcagcctgagaaccagcagacacatccccctgaccagcatcgacctgtgccccaccagcgtgagctgcggcgacgtgctgtacctgcccaccagcagccaggaccacacctgggtgaccgacaactgccaggagacctgcggcgagcccaccagctgccagcccgtgcactgcgagaccggcaacctggagaccagctgcggcagcagcaccgcctactacgtgcccagaccctgccagggcagcagcttcctgcccgccagcttcttcagcagcagctgcctgcccgtgagctgcagaccccagagatacgtgagcagcggctgcagacccctgagacccctgctgaacagctaccagcccatcggcgactgcgtgcccaacgcctacagaccccagttctgcctgagcaagagctgccagccccagaacctgctgaccagcggctgccagcccagcagctgcctggcctacagaccccagagcctgcacgtggtgagcagcagcctgagacccctgggccccctgttcagcggctgccagcccctgacccacgtgttcagcacctgcagacccagctgcagcggcctgtag

SEQ ID NO: 10531 - DNA, 606 bp, Artificial Sequence
  Description of Artificial Sequence: Synthetic coding sequence
atggccagcggcgacgacagccccatcttcgaggacgacgagagccccccctacagcctggagaagatgaccgacctggtggccgtgtgggacgtggccctgagcgacggcgtgcacaagatcgagttcgagcacggcaccaccagcggcaagagagtggtgtacgtggacggcaaggaggagatcagaaaggagtggatgttcaagctggtgggcaaggagaccttctacgtgggcgccgccaagaccaaggccaccatcaacatcgacgccatcagcggcttcgcctacgagtacaccctggagatcaacggcaagagcctgaagaagtacatggaggacagaagcaagaccaccaacacctgggtgctgcacatggacggcgagaacttcagaatcgtgctggagaaggacgccatggacgtgtggtgcaacggcaagaagctggagaccgccggcgagttcgtggacgacggcaccgagacccacttcagcatcggcaaccacgactgctacatcaaggccgtgagcagcggcaagagaaaggagggcatcatccacaccctgatcgtggacaacagagagatccccgagatcgccagctag

SEQ ID NO: 10532 - DNA, 3390 bp, Artificial Sequence
  Description of Artificial Sequence: Synthetic coding sequence
atgcccgccaccagaaagcccatgagatacggccacaccgagggccacaccgaggtgtgcttcgacgacagcggcagcttcatcgtgacctgcggcagcgacggcgacgtgagaatctgggaggacctggacgacgacgaccccaagttcatcaacgtgggcgagaaggcctacagctgcgccctgaagagcggcaagctggtgaccgccgtgagcaacaacaccatccaggtgcacaccttccccgagggcgtgcccgacggcatcctgaccagattcaccaccaacgccaaccacgtggtgttcaacggcgacggcaccaagatcgccgccggcagcagcgacttcctggtgaagatcgtggacgtgatggacagcagccagcagaagaccttcagaggccacgacgcccccgtgctgagcctgagcttcgaccccaaggacatcttcctggccagcgccagctgcgacggcagcgtgagagtgtggcagatcagcgaccagacctgcgccatcagctggcccctgctgcagaagtgcaacgacgtgatcaacgccaagagcatctgcagactggcctggcagcccaagagcggcaagctgctggccatccccgtggagaagagcgtgaagctgtacagaagagagagctggagccaccagttcgacctgagcgacaacttcatcagccagaccctgaacatcgtgacctggagcccctgcggccagtacctggccgccggcagcatcaacggcctgatcatcgtgtggaacgtggagaccaaggactgcatggagagagtgaagcacgagaagggctacgccatctgcggcctggcctggcaccccacctgcggcagaatcagctacaccgacgccgagggcaacctgggcctgctggagaacgtgtgcgaccccagcggcaagaccagcagcagcaaggtgagcagcagagtggagaaggactacaacgacctgttcgacggcgacgacatgagcaacgccggcgacttcctgaacgacaacgccgtggagatccccagcttcagcaagggcatcatcaacgacgacgaggacgacgaggacctgatgatggccagcggcagacccagacagagaagccacatcctggaggacgacgagaacagcgtggacatcagcatgctgaagaccggcagcagcctgctgaaggaggaggaggaggacggccaggagggcagcatccacaacctgcccctggtgaccagccagagacccttctacgacggccccatgcccacccccagacagaagcccttccagagcggcagcacccccctgcacctgacccacagattcatggtgtggaacagcatcggcatcatcagatgctacaacgacgagcaggacaacgccatcgacgtggagttccacgacaccagcatccaccacgccacccacctgagcaacaccctgaactacaccatcgccgacctgagccacgaggccatcctgctggcctgcgagagcaccgacgagctggccagcaagctgcactgcctgcacttcagcagctgggacagcagcaaggagtggatcatcgacctgccccagaacgaggacatcgaggccatctgcctgggccagggctgggccgccgccgccaccagcgccctgctgctgagactgttcaccatcggcggcgtgcagaaggaggtgttcagcctggccggccccgtggtgagcatggccggccacggcgagcagctgttcatcgtgtaccacagaggcaccggcttcgacggcgaccagtgcctgggcgtgcagctgctggagctgggcaagaagaagaagcagatcctgcacggcgaccccctgcccctgaccagaaagagctacctggcctggatcggcttcagcgccgagggcaccccctgctacgtggacagcgagggcatcgtgagaatgctgaacagaggcctgggcaacacctggacccccatctgcaacaccagagagcactgcaagggcaagagcgaccactactgggtggtgggcatccacgagaacccccagcagctgagatgcatcccctgcaagggcagcagattcccccccaccctgcccagacccgccgtggccatcctgagcttcaagctgccctactgccagatcgccaccgagaagggccagatggaggagcagttctggagaagcgtgatcttccacaaccacctggactacctggccaagaacggctacgagtacgaggagagcaccaagaaccaggccaccaaggagcagcaggagctgctgatgaagatgctggccctgagctgcaagctggagagagagttcagatgcgtggagctggccgacctgatgacccagaacgccgtgaacctggccatcaagtacgccagcagaagcagaaagctgatcctggcccagaagctgagcgagctggccgtggagaaggccgccgagctgaccgccacccaggtggaggaggaggaggaggaggaggacttcagaaagaagctgaacgccggctacagcaacaccgccaccgagtggagccagcccagattcagaaaccaggtggaggaggacgccgaggacagcggcgaggccgacgacgaggagaagcccgagatccacaagcccggccagaacagcttcagcaagagcaccaacagcagcgacgtgagcgccaagagcggcgccgtgaccttcagcagccagggcagagtgaaccccttcaaggtgagcgccagcagcaaggagcccgccatgagcatgaacagcgccagaagcaccaacatcctggacaacatgggcaagagcagcaagaagagcaccgccctgagcagaaccaccaacaacgagaagagccccatcatcaagcccctgatccccaagcccaagcccaagcaggccagcgccgccagctacttccagaagagaaacagccagaccaacaagaccgaggaggtgaaggaggagaacctgaagaacgtgctgagcgagacccccgccatctgccccccccagaacaccgagaaccagagacccaagaccggcttccagatgtggctggaggagaacagaagcaacatcctgagcgacaaccccgacttcagcgacgaggccgacatcatcaaggagggcatgatcagattcagagtgctgagcaccgaggagagaaaggtgtgggccaacaaggccaagggcgagaccgccagcgagggcaccgaggccaagaagagaaagagagtggtggacgagagcgacgagaccgagaaccaggaggagaaggccaaggagaacctgaacctgagcaagaagcagaagcccctggacttcagcaccaaccagaagctgagcgccttcgccttcaagcaggagtag

SEQ ID NO: 10533 - DNA, 1476 bp, Artificial Sequence
  Description of Artificial Sequence: Synthetic coding sequence
agcggcagcagccacagcttccccggcagcctggaggtgaccgccctgatgaccacctggagcagcctgcagggcagccacgtgagcaagagagccctggcctacgccctggtggtgaccaactgccaggagagaatccagcactggaagaaggtggacaacgactacaacgccctgagagagagactgagcaccctgcccgacaagctgagctacaacatcatggtgcccttcggccccttcgccttcatgcccggcaagctggtgcacaccaacgaggtgaccgtgctgctgggcgacaactggttcgccaagtgcagcgccaagcaggccgtgggcctggtggagcacagaaaggagcacgtgagaaagaccatcgacgacctgaagaaggtgatgaagaacttcgagagcagagtggagttcaccgaggacctgcagaagatgagcgacgccgccggcgacatcgtggacatcagagaggagatcaagtgcgacttcgagttcaaggccaagcacagaatcgcccacaagccccacagcaagcccaagaccagcgacatcttcgaggccgacatcgccaacgacgtgaagagcaaggacctgctggccgacaaggagctgtgggccagactggaggagctggagagacaggaggagctgctgggcgagctggacagcaagcccgacaccgtgatcgccaacggcgaggacaccaccagcagcgaggaggagaaggaggacagaaacaccaacgtgaacgccatgcaccaggtgaccgacagccacaccccctgccacaaggacgtggccagcagcgagcccttcagcggccaggtgaacagccagctgaactgcagcgtgaacggcagcagcagctaccacagcgacgacgacgacgacgacgacgacgacgacgacgacgacaacatcgacgacgacgacggcgacaacgaccacgaggccctgggcgtgggcgacaacagcatccccaccatctacttcagccacaccgtggagcccaagagagtgagaatcaacaccggcaagaacaccaccctgaagttcagcgagaagaaggaggaggccaagagaaagagaaagaacagcaccggcagcggccacagcgcccaggagctgcccaccatcagaacccccgccgacatctacagagccttcgtggacgtggtgaacggcgagtacgtgcccagaaagagcatcctgaagagcagaagcagagagaacagcgtgtgcagcgacaccagcgagagcagcgccgccgagttcgacgacagaagaggcgtgctgagaagcatcagctgcgaggaggccacctgcagcgacaccagcgagagcatcctggaggaggagccccaggagaaccagaagaagctgctgcccctgagcgtgacccccgaggtgctgagactggtgggctacagcagaaacctggcccccctgaacgtgatcctgtag

SEQ ID NO: 10534 - DNA, 981 bp, Artificial Sequence
  Description of Artificial Sequence: Synthetic coding sequence
atgctgctgagcaagttcggcagcctggcccacctgtgcggccccggcggcgtggaccacctgcccgtgaagatcctgcagcccgccaaggccgacaaggagagcttcgagaaggcctaccaggtgggcgccgtgctgggcagcggcggcttcggcaccgtgtacgccggcagcagaatcgccgacggcctgcccgtggccgtgaagcacgtggtgaaggagagagtgaccgagtggggcagcctgggcggcgccaccgtgcccctggaggtggtgctgctgagaaaggtgggcgccgccggcggcgccagaggcgtgatcagactgctggactggttcgagagacccgacggcttcctgctggtgctggagagacccgagcccgcccaggacctgttcgacttcatcaccgagagaggcgccctggacgagcccctggccagaagattcttcgcccaggtgctggccgccgtgagacactgccacagctgcggcgtggtgcacagagacatcaaggacgagaacctgctggtggacctgagaagcggcgagctgaagctgatcgacttcggcagcggcgccctgctgaaggacaccgtgtacaccgacttcgacggcaccagagtgtacagcccccccgagtggatcagataccacagataccacggcagaagcgccaccgtgtggagcctgggcgtgctgctgtacgacatggtgtgcggcgacatccccttcgagcaggacgaggagatcctgagaggcagactgctgttcagaagaagagtgagccccgagtgccagcagctgatcagatggtgcctgagcctgagacccagcgagagacccagcctggaccagatcgccgcccacccctggatgctgggcgccgacggcggcgtgcccgagagctgcgacctgagactgtgcaccctggaccccgacgacgtggccagcaccaccagcagcagcgagagcctgtag

SEQ ID NO: 10535 - DNA, 2880 bp, Artificial Sequence
  Description of Artificial Sequence: Synthetic coding sequence
atggccgccagcaccggctacgtgagactgtggggcgccgccagatgctgggtgctgagaagacccatgctggccgccgccggcggcagagtgcccaccgccgccggcgcctggctgctgagaggccagagaacctgcgacgccagccccccctgggccctgtggggcagaggccccgccatcggcggccagtggagaggcttctgggaggccagcagcagaggcggcggcgccttcagcggcggcgaggacgccagcgagggcggcgccgaggagggcgccggcggcgccggcggcagcgccggcgccggcgagggccccgtgatcaccgccctgacccccatgaccatccccgacgtgttcccccacctgcccctgatcgccatcaccagaaaccccgtgttccccagattcatcaagatcatcgaggtgaagaacaagaagctggtggagctgctgagaagaaaggtgagactggcccagccctacgtgggcgtgttcctgaagagagacgacagcaacgagagcgacgtggtggagagcctggacgagatctaccacaccggcaccttcgcccagatccacgagatgcaggacctgggcgacaagctgagaatgatcgtgatgggccacagaagagtgcacatcagcagacagctggaggtggagcccgaggagcccgaggccgagaacaagcacaagcccagaagaaagagcaagagaggcaagaaggaggccgaggacgagctgagcgccagacaccccgccgagctggccatggagcccacccccgagctgcccgccgaggtgctgatggtggaggtggagaacgtggtgcacgaggacttccaggtgaccgaggaggtgaaggccctgaccgccgagatcgtgaagaccatcagagacatcatcgccctgaaccccctgtacagagagagcgtgctgcagatgatgcaggccggccagagagtggtggacaaccccatctacctgagcgacatgggcgccgccctgaccggcgccgagagccacgagctgcaggacgtgctggaggagaccaacatccccaagagactgtacaaggccctgagcctgctgaagaaggagttcgagctgagcaagctgcagcagagactgggcagagaggtggaggagaagatcaagcagacccacagaaagtacctgctgcaggagcagctgaagatcatcaagaaggagctgggcctggagaaggacgacaaggacgccatcgaggagaagttcagagagagactgaaggagctggtggtgcccaagcacgtgatggacgtggtggacgaggagctgagcaagctgggcctgctggacaaccacagcagcgagttcaacgtgaccagaaactacctggactggctgaccagcatcccctggggcaagtacagcaacgagaacctggacctggccagagcccaggccgtgctggaggaggaccactacggcatggaggacgtgaagaagagaatcctggagttcatcgccgtgagccagctgagaggcagcacccagggcaagatcctgtgcttctacggcccccccggcgtgggcaagaccagcatcgccagaagcatcgccagagccctgaacagagagtacttcagattcagcgtgggcggcatgaccgacgtggccgagatcaagggccacagaagaacctacgtgggcgccatgcccggcaagatcatccagtgcctgaagaagaccaagaccgagaaccccctgatcctgatcgacgaggtggacaagatcggcagaggctaccagggcgaccccagcagcgccctgctggagctgctggaccccgagcagaacgccaacttcctggaccactacctggacgtgcccgtggacctgagcaaggtgctgttcatctgcaccgccaacgtgaccgacaccatccccgagcccctgagagacagaatggagatgatcaacgtgagcggctacgtggcccaggagaagctggccatcgccgagagatacctggtgccccaggccagagccctgtgcggcctggacgagagcaaggccaagctgagcagcgacgtgctgaccctgctgatcaagcagtactgcagagagagcggcgtgagaaacctgcagaagcaggtggagaaggtgctgagaaagagcgcctacaagatcgtgagcggcgaggccgagagcgtggaggtgacccccgagaacctgcaggacttcgtgggcaagcccgtgttcaccgtggagagaatgtacgacgtgaccccccccggcgtggtgatgggcctggcctggaccgccatgggcggcagcaccctgttcgtggagaccagcctgagaagaccccaggacaaggacgccaagggcgacaaggacggcagcctggaggtgaccggccagctgggcgaggtgatgaaggagagcgccagaatcgcctacaccttcgccagagccttcctgatgcagcacgcccccgccaacgactacctggtgaccagccacatccacctgcacgtgcccgagggcgccacccccaaggacggccccagcgccggctgcaccatcgtgaccgccctgctgagcctggccatgggcagacccgtgagacagaacctggccatgaccggcgaggtgagcctgaccggcaagatcctgcccgtgggcggcatcaaggagaagaccatcgccgccaagagagccggcgtgacctgcatcgtgctgcccgccgagaacaagaaggacttctacgacctggccgccttcatcaccgagggcctggaggtgcacttcgtggagcactacagagagatcttcgacatcgccttccccgacgagcaggccgaggccctggccgtggagagatag

SEQ ID NO: 10536 - DNA, 1203 bp, Artificial Sequence
  Description of Artificial Sequence: Synthetic coding sequence
atgaaccccgccagcgcccccccccccctgcccccccccggccagcaggtgatccacgtgacccaggacctggacaccgacctggaggccctgttcaacagcgtgatgaaccccaagcccagcagctggagaaagaagatcctgcccgagagcttcttcaaggagcccgacagcggcagccacagcagacagagcagcaccgacagcagcggcggccaccccggccccagactggccggcggcgcccagcacgtgagaagccacagcagccccgccagcctgcagctgggcaccggcgccggcgccgccggcagccccgcccagcagcacgcccacctgagacagcagagctacgacgtgaccgacgagctgcccctgccccccggctgggagatgaccttcaccgccaccggccagagatacttcctgaaccacatcgagaagatcaccacctggcaggaccccagaaaggccatgaaccagcccctgaaccacatgaacctgcaccccgccgtgagcagcacccccgtgccccagagaagcatggccgtgagccagcccaacctggtgatgaaccaccagcaccagcagcagatggcccccagcaccctgagccagcagaaccaccccacccagaacccccccgccggcctgatgagcatgcccaacgccctgaccacccagcagcagcagcagcagaagctgagactgcagagaatccagatggagagagagagaatcagaatgagacaggaggagctgatgagacaggaggccgccctgtgcagacagctgcccatggaggccgagaccctggcccccgtgcaggccgccgtgaacccccccaccatgacccccgacatgagaagcatcaccaacaacagcagcgaccccttcctgaacggcggcccctaccacagcagagagcagagcaccgacagcggcctgggcctgggctgctacagcgtgcccaccacccccgaggacttcctgagcaacgtggacgagatggacaccggcgagaacgccggccagacccccatgaacatcaacccccagcagaccagattccccgacttcctggactgcctgcccggcaccaacgtggacctgggcaccctggagagcgaggacctgatccccctgttcaacgacgtggagagcgccctgaacaagagcgagcccttcctgacctggctgtag

SEQ ID NO: 10537 - DNA, 2625 bp, Artificial Sequence
  Description of Artificial Sequence: Synthetic coding sequence
atggaggtgctgagagagaaggtggaggaggaggaggaggccgagagagaggaggccgccgagtgggccgagtgggccagaatggagaagatgatgagacccgtggaggtgagaaaggaggagatcaccctgaagcaggagaccctgagagacctggagaagaagctgagcgagatccagatcaccgtgagcgccgagctgcccgccttcaccaaggacaccatcgacatcagcaagctgcccatcagctacaagaccaacacccccaaggaggagcacctgctgcaggtggccgacaacttcagcagacagtacagccacctgtgccccgacagagtgcccctgttcctgcaccccctgaacgagtgcgaggtgcccaagttcgtgagcaccaccctgagacccaccctgatgccctaccccgagctgtacaactgggacagctgcgcccagttcgtgagcgacttcctgaccatggtgcccctgcccgaccccctgaagccccccagccacctgtacagcagcaccaccgtgctgaagtaccagaagggcaactgcttcgacttcagcaccctgctgtgcagcatgctgatcggcagcggctacgacgcctactgcgtgaacggctacggcagcctggacctgtgccacatggacctgaccagagaggtgtgccccctgaccgtgaagcccaaggagaccatcaagaaggaggagaaggtgctgcccaagaagtacaccatcaagccccccagagacctgtgcagcagattcgagcaggagcaggaggtgaagaagcagcaggagatcagagcccaggagaagaagagactgagagaggaggaggagagactgatggaggccgagaaggccaagcccgacgccctgcacggcctgagagtgcacagctgggtgctggtgctgagcggcaagagagaggtgcccgagaacttcttcatcgaccccttcaccggccacagctacagcacccaggacgagcacttcctgggcatcgagagcctgtggaaccacaagaactactggatcaacatgcaggactgctggaactgctgcaaggacctgatcttcgacctgggcgaccccgtgagatgggagtacatgctgctgggcaccgacaagagccagctgagcctgaccgaggaggacgacagcggcatcaacgacgaggacgacgtggagaacctgggcaaggaggacgaggacaagagcttcgacatgccccacagctgggtggagcagatcgagatcagccccgaggccttcgagaccagatgccccaacggcaagaaggtgatccagtacaagagagccaagctggagaagtgggccccctacctgaacagcaacggcctggtgagcagactgaccacctacgaggacctgcagtgcaccaacatcctggagatcaaggagtggtaccagaacagagaggacatgctggagctgaagcacatcaacaagaccaccgacctgaagaccgactacttcaagcccggccacccccaggccctgagagtgcacagctacaagagcatgcagcccgagatggacagagtgatcgagttctacgagaccgccagagtggacggcctgatgaagagagaggagacccccagaaccatgaccgagtactaccagggcagacccgacttcctgagctacagacacgccagcttcggccccagagtgaagaagctgaccctgagcagcgccgagagcaaccccagacccatcgtgaagatcaccgagagattcttcagaaaccccgccaagcccgccgaggaggacgtggccgagagagtgttcctggtggccgaggagagaatccagctgagataccactgcagagaggaccacatcaccgccagcaagagagagttcctgagaagaaccgaggtggacagcaagggcaacaagatcatcatgacccccgacatgtgcatcagcttcgaggtggagcccatggagcacaccaagaagctgctgtaccagtacgaggccatgatgcacctgaagagagaggagaagctgagcagacaccaggtgtgggagagcgagctggaggtgctggagatcctgaagctgagagaggaggaggaggccgcccacaccctgaccatcagcatctacgacaccaagagaaacgagaagagcaaggagtacagagaggccatggagagaatgatgcacgaggagcacctgagacaggtggagacccagctggactacctggcccccttcctggcccagctgccccccggcgagaagctgacctgctggcaggccgtgagactgaaggacgagtgcctgagcgacttcaagcagagactgatcaacaaggccaacctgatccaggccagattcgagaaggagacccaggagctgcagaagaagcagcagtggtaccaggagaaccaggtgaccctgacccccgaggacgaggacctgtacctgagctactgcagccaggccatgttcagaatcagaatcctggagcagagactgaacagacacaaggagctggcccccctgaagtacctggccctggaggagaagctgtacaaggaccccagactgggcgagctgcagaagatcttcgcctag

SEQ ID NO: 10538 - DNA, 1851 bp, Artificial Sequence
  Description of Artificial Sequence: Synthetic coding sequence
atggacgtgatgctggagaactactgccacctgatcagcgtgggctgccacatgaccaagcccgacgtgatcctgaagctggagagaggcgaggagccctggaccagcttcgccggccacacctgcctggaggagaactggaaggccgaggacttcctggtgaagttcaaggagcaccaggagaagtacagcagaagcgtggtgagcatcaaccacaagaagctggtgaaggagaagagcaagatctacgagaagaccttcaccctgggcaagaaccccgtgaacagcaagaacctgccccccgagtacgacacccacggcagaatcctgaagaacgtgagcgagctgatcatcagcaacctgaaccccgccagaaagagactgagcgagtacaacggctacggcaagagcctgctgagcaccaagcaggagaccacccaccccgaggtgaagagccacaaccagagcgccagagccttcagccacaacgaggtgctgatgcagtaccagaagaccgagacccccgcccagagcttcggctacaacgactgcgagaagagcttcctgcagagaggcggcctgatcacccacagcagaccctacaagggcgagaaccccagcgtgtacaacaagaagagaagagccaccaacatcgagaagaagcacacctgcaacgagtgcggcaagagcttctgcagaaagagcgtgctgatcctgcaccagggcatccacagcgaggagaagccctaccagtgccaccagtgcggcaacgccttcagaagaaagagctacctgatcgaccaccagagaacccacaccggcgagaagcccttcgtgtgcaacgagtgcggcaagagcttcagactgaagaccgccctgaccgaccaccagagaacccacaccggcgagaagagctacgagtgcctgcagtgcagaaacgccttcagactgaagagccacctgatcagacaccagagaacccacaccggcgagaagccctacgagtgcaacgactgcggcaagagcttcagacagaagaccaccctgagcctgcaccagagaatccacaccggcgagaagccctacatctgcaaggagtgcggcaagagcttccaccagaaggccaacctgaccgtgcaccagagaacccacaccggcgagaagccctacatctgcaacgagtgcggcaagagcttcagccagaagaccaccctggccctgcacgagaagacccacaacgaggagaagccctacatctgcagcgagtgcggcaagagcttcagacagaagaccaccctggtggcccaccagagaacccacaccggcgagaagagctacgagtgcccccactgcggcaaggccttcagaatgaagagctacctgatcgaccaccacagaacccacaccggcgagaagccctacgagtgcaacgagtgcggcaagagcttcagccagaagaccaacctgaacctgcaccagagaatccacaccggcgagaagccctacgtgtgcaacgagtgcggcaagagcttcagacagaaggccaccctgaccgtgcaccagaagatccacaccggccagaagagctacgagtgcccccagtgcggcaaggccttcagcagaaagagctacctgatccaccaccagagaacccacaccggcgagaagccctacaagtgcagcgagtgcggcaagtgcttcagacagaagaccaacctgatcgtgcaccagagaacccacaccggcgagaagccctacgtgtgcaacgagtgcggcaagagcttcagctacaagagaaacctgatcgtgcaccagagaacccacaagggcgagaacatcgagatgcagtag

SEQ ID NO: 10539 - DNA, 441 bp, Artificial Sequence
  Description of Artificial Sequence: Synthetic coding sequence
atgtgccacaccagctgcagcagcggctgccagcccgcctgctgcgcccccagcccctgccagcccgcctgctgcgtgcccagcagctgccaggccagctgctgcgtgcccgtgggctgccagagcagcgtgtgcgtgcccgtgagcttcaagcccgccgtgtgcctgcccgtgagctgccagagcagcgtgtgcgtgcccatgagcttcaagagcgccgtgtgcgtgcccgtgagctgccagagcagcgtgtgcgtgcccgtgagctgcagacccatcgtgtgcgccgcccccagctgccagagcagcctgtgcgtgcccgtgagctgcagacccgtggtgtacgccgcccccagctgccagagcagcggctgctgccagcccagctgcaccagcgtgctgtgcagacccatcagctacagcatcagcagctgctgctag

SEQ ID NO: 10540 - DNA, 1257 bp, Artificial Sequence; identical to SEQ ID NO: 10234
  Description of Artificial Sequence: Synthetic coding sequence

SEQ ID NO: 10541 - DNA, 3351 bp, Artificial Sequence
  Description of Artificial Sequence: Synthetic coding sequence
atgtacggcagcgccagaagcgtgggcaaggtggagcccagcagccagagccccggcagaagccccagactgcccagaagccccagactgggccacagaagaaccaacagcaccggcggcagcagcggcagcagcgtgggcggcggcagcggcaagaccctgagcatggagaacatccagagcctgaacgccgcctacgccaccagcggccccatgtacctgagcgaccacgagaacgtgggcagcgagacccccaagagcaccatgaccctgggcagaagcggcggcagactgccctacggcgtgagaatgaccgccatgggcagcagccccaacatcgccagcagcggcgtggccagcgacaccatcgccttcggcgagcaccacctgccccccgtgagcatggccagcaccgtgccccacagcctgagacaggccagagacaacaccatcatggacctgcagacccagctgaaggaggtgctgagagagaacgacctgctgagaaaggacgtggaggtgaaggagagcaagctgagcagcagcatgaacagcatcaagaccttctggagccccgagctgaagaaggagagagccctgagaaaggacgaggccagcaagatcaccatctggaaggagcagtacagagtggtgcaggaggagaaccagcacatgcagatgaccatccaggccctgcaggacgagctgagaatccagagagacctgaaccagctgttccagcaggacagcagcagcagaaccggcgagccctgcgtggccgagctgaccgaggagaacttccagagactgcacgccgagcacgagagacaggccaaggagctgttcctgctgagaaagaccctggaggagatggagctgagaatcgagacccagaagcagaccctgaacgccagagacgagagcatcaagaagctgctggagatgctgcagagcaagggcctgagcgccaaggccaccgaggaggaccacgagagaaccagaagactggccgaggccgagatgcacgtgcaccacctggagagcctgctggagcagaaggagaaggagaacagcatgctgagagaggagatgcacagaagattcgagaacgcccccgacagcgccaagaccaaggccctgcagaccgtgatcgagatgaaggacagcaagatcagcagcatggagagaggcctgagagacctggaggaggagatccagatgctgaagagcaacggcgccctgagcaccgaggagagagaggaggagatgaagcagatggaggtgtacagaagccacagcaagttcatgaagaacaaggtggagcagctgaaggaggagctgagcagcaaggaggcccagtgggaggagctgaagaagaaggccgccggcctgcaggccgagatcggccaggtgaagcaggagctgagcagaaaggacaccgagctgctggccctgcagaccaagctggagaccctgaccaaccagttcagcgacagcaagcagcacatcgaggtgctgaaggagagcctgaccgccaaggagcagagagccgccatcctgcagaccgaggtggacgccctgagactgagactggaggagaaggagaccatgctgaacaagaagaccaagcagatccaggacatggccgaggagaagggcacccaggccggcgagatccacgacctgaaggacatgctggacgtgaaggagagaaaggtgaacgtgctgcagaagaagatcgagaacctgcaggagcagctgagagacaaggagaagcagatgagcagcctgaaggagagagtgaagagcctgcaggccgacaccaccaacaccgacaccgccctgaccaccctggaggaggccctggccgagaaggagagaaccatcgagagactgaaggagcagagagacagagacgagagagagaagcaggaggagatcgacaactacaagaaggacctgaaggacctgaaggagaaggtgagcctgctgcagggcgacctgagcgagaaggaggccagcctgctggacctgaaggagcacgccagcagcctggccagcagcggcctgaagaaggacagcagactgaagaccctggagatcgccctggagcagaagaaggaggagtgcctgaagatggagagccagctgaagaaggcccacgaggccgccctggaggccagagccagccccgagatgagcgacagaatccagcacctggagagagagatcaccagatacaaggacgagagcagcaaggcccaggccgaggtggacagactgctggagatcctgaaggaggtggagaacgagaagaacgacaaggacaagaagatcgccgagctggagagacaggtgaaggaccagaacaagaaggtggccaacctgaagcacaaggagcaggtggagaagaagaagagcgcccagatgctggaggaggccagaagaagagaggacaacctgaacgacagcagccagcagctgcaggacagcctgagaaagaaggacgacagaatcgaggagctggaggaggccctgagagagagcgtgcagatcaccgccgagagagagatggtgctggcccaggaggagagcgccagaaccaacgccgagaagcaggtggaggagctgctgatggccatggagaaggtgaagcaggagctggagagcatgaaggccaagctgagcagcacccagcagagcctggccgagaaggagacccacctgaccaacctgagagccgagagaagaaagcacctggaggaggtgctggagatgaagcaggaggccctgctggccgccatcagcgagaaggacgccaacatcgccctgctggagctgagcagcagcaagaagaagacccaggaggaggtggccgccctgaagagagagaaggacagactggtgcagcagctgaagcagcagacccagaacagaatgaagctgatggccgacaactacgaggacgaccacttcaagagcagccacagcaaccagaccaaccacaagcccagccccgaccagatcatccagcccctgctggagctggaccagaacagaagcaagctgaagctgtacatcggccacctgaccaccctgtgccacgacagagaccccctgatcctgagaggcctgaccccccccgccagctacaacctggacgacgaccaggccgcctgggagaacgagctgcagaagatgaccagaggccagctgcaggacgagctggagaagggcgagagagacaacgccgagctgcaggagttcgccaacgccatcctgcagcagatcgccgaccactgccccgacatcctggagcaggtggtgaacgccctggaggagagcagctag

SEQ ID NO: 10542 - DNA, 3075 bp, Artificial Sequence
  Description of Artificial Sequence: Synthetic coding sequence
atgaacttcatcaaggacaacagcagagccctgatccagagaatgggcatgaccgtgatcaagcagatcaccgacgacctgttcgtgtggaacgtgctgaacagagaggaggtgaacatcatctgctgcgagaaggtggagcaggacgccgccagaggcatcatccacatgatcctgaagaagggcagcgagagctgcaacctgttcctgaagagcctgaaggagtggaactaccccctgttccaggacctgaacggccagagcctgttccaccagaccagcgagggcgacctggacgacctggcccaggacctgaaggacctgtaccacacccccagcttcctgaacttctaccccctgggcgaggacatcgacatcatcttcaacctgaagagcaccttcaccgagcccgtgctgtggagaaaggaccagcaccaccacagagtggagcagctgaccctgaacggcctgctgcaggccctgcagagcccctgcatcatcgagggcgagagcggcaagggcaagagcaccctgctgcagagaatcgccatgctgtggggcagcggcaagtgcaaggccctgaccaagttcaagttcgtgttcttcctgagactgagcagagcccagggcggcctgttcgagaccctgtgcgaccagctgctggacatccccggcaccatcagaaagcagaccttcatggccatgctgctgaagctgagacagagagtgctgttcctgctggacggctacaacgagttcaagccccagaactgccccgagatcgaggccctgatcaaggagaaccacagattcaagaacatggtgatcgtgaccaccaccaccgagtgcctgagacacatcagacagttcggcgccctgaccgccgaggtgggcgacatgaccgaggacagcgcccaggccctgatcagagaggtgctgatcaaggagctggccgagggcctgctgctgcagatccagaagagcagatgcctgagaaacctgatgaagacccccctgttcgtggtgatcacctgcgccatccagatgggcgagagcgagttccacagccacacccagaccaccctgttccacaccttctacgacctgctgatccagaagaacaagcacaagcacaagggcgtggccgccagcgacttcatcagaagcctggaccactgcggcgacctggccctggagggcgtgttcagccacaagttcgacttcgagctgcaggacgtgagcagcgtgaacgaggacgtgctgctgaccaccggcctgctgtgcaagtacaccgcccagagattcaagcccaagtacaagttcttccacaagagcttccaggagtacaccgccggcagaagactgagcagcctgctgaccagccacgagcccgaggaggtgaccaagggcaacggctacctgcagaagatggtgagcatcagcgacatcaccagcacctacagcagcctgctgagatacacctgcggcagcagcgtggaggccaccagagccgtgatgaagcacctggccgccgtgtaccagcacggctgcctgctgggcctgagcatcgccaagagacccctgtggagacaggagagcctgcagagcgtgaagaacaccaccgagcaggagatcctgaaggccatcaacatcaacagcttcgtggagtgcggcatccacctgtaccaggagagcaccagcaagagcgccctgagccaggagttcgaggccttcttccagggcaagagcctgtacatcaacagcggcaacatccccgactacctgttcgacttcttcgagcacctgcccaactgcgccagcgccctggacttcatcaagctggacttctacggcggcgccatggccagctgggagaaggccgccgaggacaccggcggcatccacatggaggaggcccccgagacctacatccccagcagagccgtgagcctgttcttcaactggaagcaggagttcagaaccctggaggtgaccctgagagacttcagcaagctgaacaagcaggacatcagatacctgggcaagatcttcagcagcgccaccagcctgagactgcagatcaagagatgcgccggcgtggccggcagcctgagcctggtgctgagcacctgcaagaacatctacagcctgatggtggaggccagccccctgaccatcgaggacgagagacacatcaccagcgtgaccaacctgaagaccctgagcatccacgacctgcagaaccagagactgcccggcggcctgaccgacagcctgggcaacctgaagaacctgaccaagctgatcatggacaacatcaagatgaacgaggaggacgccatcaagctggccgagggcctgaagaacctgaagaagatgtgcctgttccacctgacccacctgagcgacatcggcgagggcatggactacatcgtgaagagcctgagcagcgagccctgcgacctggaggagatccagctggtgagctgctgcctgagcgccaacgccgtgaagatcctggcccagaacctgcacaacctggtgaagctgagcatcctggacctgagcgagaactacctggagaaggacggcaacgaggccctgcacgagctgatcgacagaatgaacgtgctggagcagctgaccgccctgatgctgccctggggctgcgacgtgcagggcagcctgagcagcctgctgaagcacctggaggaggtgccccagctggtgaagctgggcctgaagaactggagactgaccgacaccgagatcagaatcctgggcgccttcttcggcaagaaccccctgaagaacttccagcagctgaacctggccggcaacagagtgagcagcgacggctggctggccttcatgggcgtgttcgagaacctgaagcagctggtgttcttcgacttcagcaccaaggagttcctgcccgaccccgccctggtgagaaagctgagccaggtgctgagcaagctgaccttcctgcaggaggccagactggtgggctggcagttcgacgacgacgacctgagcgtgatcaccggcgccttcaagctggtgaccgcctag

SEQ ID NO: 10543 - DNA, 1065 bp, Artificial Sequence
  Description of Artificial Sequence: Synthetic coding sequence
atggccgagagccccaccgaggaggccgccaccgccggcgccggcgccgccggccccggcgccagcagcgtggccggcgtggtgggcgtgagcggcagcggcggcggcttcggcccccccttcctgcccgacgtgtgggccgccgccgccgccgccggcggcgccggcggccccggcagcggcctggcccccctgcccggcctgccccccagcgccgccgcccacggcgccgccctgctgagccactgggaccccaccctgagcagcgactgggacggcgagagaaccgccccccagtgcctgctgagaatcaagagagacatcatgagcatctacaaggagcccccccccggcatgttcgtggtgcccgacaccgtggacatgaccaagatccacgccctgatcaccggccccttcgacaccccctacgagggcggcttcttcctgttcgtgttcagatgcccccccgactaccccatccacccccccagagtgaagctgatgaccaccggcaacaacaccgtgagattcaaccccaacttctacagaaacggcaaggtgtgcctgagcatcctgggcacctggaccggccccgcctggagccccgcccagagcatcagcagcgtgctgatcagcatccagagcctgatgaccgagaacccctaccacaacgagcccggcttcgagcaggagagacaccccggcgacagcaagaactacaacgagtgcatcagacacgagaccatcagagtggccgtgtgcgacatgatggagggcaagtgcccctgccccgagcccctgagaggcgtgatggagaagagcttcctggagtactacgacttctacgaggtggcctgcaaggacagactgcacctgcagggccagaccatgcaggaccccttcggcgagaagagaggccacttcgactaccagagcctgctgatgagactgggcctgatcagacagaaggtgctggagagactgcacaacgagaacgccgagatggacagcgacagcagcagcagcggcaccgagaccgacctgcacggcagcctgagagtgtag

SEQ ID NO: 10544 - DNA, 2487 bp, Artificial Sequence
  Description of Artificial Sequence: Synthetic coding sequence
atggacagcgaggccttccagagcgccagagacttcctggacatgaacttccagagcctggccatgaagcacatggacctgaagcagatggagctggacaccgccgccgccaaggtggacgagctgaccaagcagctggagagcctgtggagcgacagccccgccccccccggcccccaggccggcccccccagcagaccccccagatacagcagcagcagcatccccgagcccttcggcagcagaggcagccccagaaaggccgccaccgacggcgccgacacccccttcggcagaagcgagagcgcccccaccctgcacccctacagccccctgagccccaagggcagacccagcagccccagaacccccctgtacctgcagcccgacgcctacggcagcctggacagagccaccagccccagacccagagccttcgacggcgccggcagcagcctgggcagagcccccagccccagacccggccccggccccctgagacagcagggcccccccacccccttcgacttcctgggcagagccggcagccccagaggcagccccctggccgagggcccccaggccttcttccccgagagaggccccagccccagaccccccgccaccgcctacgacgcccccgccagcgccttcggcagcagcctgctgggcagcggcggcagcgccttcgccccccccctgagagcccaggacgacctgaccctgagaagaagaccccccaaggcctggaacgagagcgacctggacgtggcctacgagaagaagcccagccagaccgccagctacgagagactggacgtgttcgccagacccgccagccccagcctgcagctgctgccctggagagagagcagcctggacggcctgggcggcaccggcaaggacaacctgaccagcgccaccctgcccagaaactacaaggtgagccccctggccagcgacagaagaagcgacgccggcagctacagaagaagcctgggcagcgccggccccagcggcaccctgcccagaagctggcagcccgtgagcagaatccccatgccccccagcagcccccagcccagaggcgcccccagacagagacccatccccctgagcatgatcttcaagctgcagaacgccttctgggagcacggcgccagcagagccatgctgcccggcagccccctgttcaccagagcccccccccccaagctgcagccccagccccagccccagccccagccccagagccagccccagccccagctgcccccccagccccagacccagccccagacccccacccccgccccccagcacccccagcagacctggccccccgtgaacgagggcccccccaagccccccaccgagctggagcccgagcccgagatcgagggcctgctgacccccgtgctggaggccggcgacgtggacgagggccccgtggccagacccctgagccccaccagactgcagcccgccctgccccccgaggcccagagcgtgcccgagctggaggaggtggccagagtgctggccgagatccccagacccctgaagagaagaggcagcatggagcaggcccccgccgtggccctgccccccacccacaagaagcagtaccagcagatcatcagcagactgttccacagacacggcggccccggccccggcggccccgagcccgagctgagccccatcaccgagggcagcgaggccagagccggcccccccgcccccgccccccccgcccccatccccccccccgcccccagccagagcagcccccccgagcagccccagagcatggagatgagaagcgtgctgagaaaggccggcagccccagaaaggccagaagagccagactgaaccccctggtgctgctgctggacgccgccctgaccggcgagctggaggtggtgcagcaggccgtgaaggagatgaacgaccccagccagcccaacgaggagggcatcaccgccctgcacaacgccatctgcggcgccaactacagcatcgtggacttcctgatcaccgccggcgccaacgtgaacagccccgacagccacggctggacccccctgcactgcgccgccagctgcaacgacaccgtgatctgcatggccctggtgcagcacggcgccgccatcttcgccaccaccctgagcgacggcgccaccgccttcgagaagtgcgacccctacagagagggctacgccgactgcgccacctacctggccgacgtggagcagagcatgggcctgatgaacagcggcgccgtgtacgccctgtgggactacagcgccgagttcggcgacgagctgagcttcagagagggcgagagcgtgaccgtgctgagaagagacggccccgaggagaccgactggtggtgggccgccctgcacggccaggagggctacgtgcccagaaactacttcggcctgttccccagagtgaagccccagagaagcaaggtgtag

SEQ ID NO: 10545 - DNA, 1131 bp, Artificial Sequence
  Description of Artificial Sequence: Synthetic coding sequence
atggtggtggaggtggacagcatgcccgccgccagcagcgtgaagaagcccttcggcctgagaagcaagatgggcaagtggtgctgcagatgcttcccctgctgcagagagagcggcaagagcaacgtgggcaccagcggcgaccacgacgacagcgccatgaagaccctgagaagcaagatgggcaagtggtgcagacactgcttcccctgctgcagaggcagcggcaagagcaacgtgggcgccagcggcgaccacgacgacagcgccatgaagaccctgagaaacaagatgggcaagtggtgctgccactgcttcccctgctgcagaggcagcagcaagagcaaggtgggcgcctggggcgactacgacgacagcgccttcatggagcccagataccacgtgagaggcgaggacctggacaagctgcacagagccgcctggtggggcaaggtgcccagaaaggacctgatcgtgatgctgagagacaccgacgtgaacaagcaggacaagcagaagagaaccgccctgcacctggccagcgccaacggcaacagcgaggtggtgaagctgctgctggacagaagatgccagctgaacgtgctggacaacaagaagagaaccgccctgatcaaggccgtgcagtgccaggaggacgagtgcgccctgatgctgctggagcacggcaccgaccccaacatccccgacgagtacggcaacaccaccctgcactacgccatctacaacgaggacaagctgatggccaaggccctgctgctgtacggcgccgacatcgagagcaagaacaagcacggcctgacccccctgctgctgggcgtgcacgagcagaagcagcaggtggtgaagttcctgatcaagaagaaggccaacctgaacgccctggacagatacggcagaaccgccctgatcctggccgtgtgctgcggcagcgccagcatcgtgagcctgctgctggagcagaacatcgacgtgagcagccaggacctgagcggccagaccgccagagagtacgccgtgagcagccaccaccacgtgatctgccagctgctgagcgactacaaggagaagcagatgctgaagatcagcagcgagaacagcaaccccggctag

SEQ ID NO: 10546 - DNA, 765 bp, Artificial Sequence
  Description of Artificial Sequence: Synthetic coding sequence
atgcccgccagcttccccatgctgagatgcgccagaagcccctgctggaccgtgtgctggagcccctggtgcagagccctgcccgacggcagatgcagctgcctgagcagcccccccagccccctgggccccaccagagaccccgtggccaccttcctggagacctgcagagagcccggcagccagcccgccggccccgccagcctgagagccgagtacctgccccccagcgtggccagcatcaaggtgagcgccgagctgctgagagccgccctgaaggacggccacagcggcgtgcccctgtgctgcgccaccctgcagtggctgctggccgagaacgccgccgtggacgtggtgagagccagagccctgagcagcatccagggcgtggcccccgacggcgccaacgtgcacctgatcgtgagagaggtggccatgaccgacctgtgccccgccggccccatccaggccgtggagatccaggtggagagcagcagcctggccgacatctgcagagcccaccacgccgtggtgggcagaatgcagaccatggtgaccgagcaggccacccagggcagcagcgcccccgacctgagagtgcagtacctgagacagatccacgccaaccacgagaccctgctgagagaggtgcagaccctgagagacagactgtgcaccgaggacgaggccagcagctgcgccaccgcccagagactgctgcaggtgtacagacagctgagacaccccagcctgatcctgctgtag

SEQ ID NO: 10547 - DNA, 2046 bp, Artificial Sequence
  Description of Artificial Sequence: Synthetic coding sequence
atgtgcggcatcttcgcctacctgaactaccacgtgcccagaaccagaagagagatcctggagaccctgatcaagggcctgcagagactggagtacagaggctacgacagcgccggcgtgggcttcgacggcggcaacgacaaggactgggaggccaacgcctgcaagatccagctgatcaagaagaagggcaaggtgaaggccctggacgaggaggtgcacaagcagcaggacatggacctggacatcgagttcgacgtgcacctgggcatcgcccacaccagatgggccacccacggcgagcccagccccgtgaacagccacccccagagaagcgacaagaacaacgagttcatcgtgatccacaacggcatcatcaccaactacaaggacctgaagaagttcctggagagcaagggctacgacttcgagagcgagaccgacaccgagaccatcgccaagctggtgaagtacatgtacgacaacagagagagccaggacaccagcttcaccaccctggtggagagagtgatccagcagctggagggcgccttcgccctggtgttcaagagcgtgcacttccccggccaggccgtgggcaccagaagaggcagccccctgctgatcggcgtgagaagcgagcacaagctgagcaccgaccacatccccatcctgtacagaaccggcaaggacaagaagggcagctgcaacctgagcagagtggacagcaccacctgcctgttccccgtggaggagaaggccgtggagtactacttcgccagcgacgccagcgccgtgatcgagcacaccaacagagtgatcttcctggaggacgacgacgtggccgccgtggtggacggcagactgagcatccacagaatcaagagaaccgccggcgaccaccccggcagagccgtgcagaccctgcagatggagctgcagcagatcatgaagggcaacttcagcagcttcatgcagaaggagatcttcgagcagcccgagagcgtggtgaacaccatgagaggcagagtgaacttcgacgactacaccgtgaacctgggcggcctgaaggaccacatcaaggagatccagagatgcagaagactgatcctgatcgcctgcggcaccagctaccacgccggcgtggccaccagacaggtgctggaggagctgaccgagctgcccgtgatggtggagctggccagcgacttcctggacagaaacacccccgtgttcagagacgacgtgtgcttcttcctgagccagagcggcgagaccgccgacaccctgatgggcctgagatactgcaaggagagaggcgccctgaccgtgggcatcaccaacaccgtgggcagcagcatcagcagagagaccgactgcggcgtgcacatcaacgccggccccgagatcggcgtggccagcaccaaggcctacaccagccagttcgtgagcctggtgatgttcgccctgatgatgtgcgacgacagaatcagcatgcaggagagaagaaaggagatcatgctgggcctgaagagactgcccgacctgatcaaggaggtgctgagcatggacgacgagatccagaagctggccaccgagctgtaccaccagaagagcgtgctgatcatgggcagaggctaccactacgccacctgcctggagggcgccctgaagatcaaggagatcacctacatgcacagcgagggcatcctggccggcgagctgaagcacggccccctggccctggtggacaagctgatgcccgtgatcatgatcatcatgagagaccacacctacgccaagtgccagaacgccctgcagcaggtggtggccagacagggcagacccgtggtgatctgcgacaaggaggacaccgagaccatcaagaacaccaagagaaccatcaaggtgccccacagcgtggactgcctgcagggcatcctgagcgtgatccccctgcagctgctggccttccacctggccgtgctgagaggctacgacgtggacttccccagaaacctggccaagagcgtgaccgtggagtag

SEQ ID NO: 10548 - DNA, 498 bp, Artificial Sequence
  Description of Artificial Sequence: Synthetic coding sequence
atggaggacctgttcgagaccttccaggacgagatgggcttcagcaacatggaggacgacggccccgaggaggaggagagagtggccgagccccaggccaacttcaacaccccccaggccctgagattcgaggagctgctggccaacctgctgaacgagcagcaccagatcgccaaggagctgttcgagcagctgaagatgaagaagcccagcgccaagcagcagaaggaggtggagaaggtgaagccccagtgcaaggaggtgcaccagaccctgatcctggaccccgcccagagaaagagactgcagcagcagatgcagcagcacgtgcagctgctgacccagatccacctgctggccacctgcaaccccaacctgaaccccgaggccagcagcaccagaatctgcctgagctgggagcccctgctgaaggcccccagccccttcaccatcagcaccacccccagcttcagaccctgcagcaaccccgtgacctag

SEQ ID NO: 10549 - DNA, 633 bp, Artificial Sequence
  Description of Artificial Sequence: Synthetic coding sequence
atggccgccagcgtggagcagagagagggcaccatccaggtgcagggccaggccctgttcttcagagaggccctgcccggcagcggccaggccagattcagcgtgctgctgctgcacggcatcagattcagcagcgagacctggcagaacctgggcaccctgcacagactggcccaggccggctacagagccgtggccatcgacctgcccggcctgggccacagcaaggaggccgccgcccccgcccccatcggcgagctggcccccggcagcttcctggccgccgtggtggacgccctggagctgggcccccccgtggtgatcagccccagcctgagcggcatgtacagcctgcccttcctgaccgcccccggcagccagctgcccggcttcgtgcccgtggcccccatctgcaccgacaagatcaacgccgccaactacgccagcgtgaagacccccgccctgatcgtgtacggcgaccaggaccccatgggccagaccagcttcgagcacctgaagcagctgcccaaccacagagtgctgatcatgaagggcgccggccacccctgctacctggacaagcccgaggagtggcacaccggcctgctggacttcctgcagggcctgcagtag

SEQ ID NO: 10550 - DNA, 1248 bp, Artificial Sequence
  Description of Artificial Sequence: Synthetic coding sequence
atgagagccgccgacagcggcagctgggagagagtgagacagctggccgcccagggcgagcccgcccccagctgcggcgccggcgccggccccgccagaccccccggccccgccgcctgcgagcagtgcgtggacgccgccggccccggcgacagacccagagccggcgtgcccagagtgagagccgacggcgactgcagccagcccgtgctgctgagagaggaggtgagcagactgcaggaggaggtgcacctgctgagacagatgaaggagatgctggccaaggacctggaggagagccagggcggcaagagcagcgaggtgctgagcgccaccgagctgagagtgcagctggcccagaaggagcaggagctggccagagccaaggaggccctgcaggccatgaaggccgacagaaagagactgaagggcgagaagaccgacctggtgagccagatgcagcagctgtacgccaccctggagagcagagaggagcagctgagagacttcatcagaaactacgagcagcacagaaaggagagcgaggacgccgtgaaggccctggccaaggagaaggacctgctggagagagagaagtgggagctgagaagacaggccaaggaggccaccgaccacgccaccgccctgagaagccagctggacctgaaggacaacagaatgaaggagctggaggccgagctggccatggccaagcagagcctggccaccctgaccaaggacgtgcccaagagacacagcctggccatgcccggcgagaccgtgctgaacggcaaccaggagtgggtggtgcaggccgacctgcccctgaccgccgccatcagacagagccagcagaccctgtaccacagccaccccccccaccccgccgacagacaggccgtgagagtgagcccctgccacagcagacagcccagcgtgatcagcgacgccagcgccgccgagggcgacagaagcagcacccccagcgacatcaacagccccagacacagaacccacagcctgtgcaacggcgacagccccggccccgtgcagaagaacctgcacaaccccatcgtgcagagcctggaggacctggaggaccagaagagaaagaagaagaaggagaagatgggcttcggcagcatcagcagagtgttcgccagaggcaagcagagaaagagcctggaccccggcctgttcgacggcaccgcccccgactactacatcgaggaggacgccgactggtag

SEQ ID NO: 10551 - DNA, 693 bp, Artificial Sequence
  Description of Artificial Sequence: Synthetic coding sequence
atggaggccgccgagaccgaggccgaggccgccgccctggaggtgctggccgaggtggccggcatcctggagcccgtgggcctgcaggaggaggccgagctgcccgccaagatcctggtggagttcgtggtggacagccagaagaaggacaagctgctgtgcagccagctgcaggtggccgacttcctgcagaacatcctggcccaggaggacaccgccaagggcctggaccccctggccagcgaggacaccagcagacagaaggccatcgccgccaaggagcagtggaaggagctgaaggccacctacagagagcacgtggaggccatcaagatcggcctgaccaaggccctgacccagatggaggaggcccagagaaagagaacccagctgagagaggccttcgagcagctgcaggccaagaagcagatggccatggagaagagaagagccgtgcagaaccagtggcagctgcagcaggagaagcacctgcagcacctggccgaggtgagcgccgagggcaagctgctgttccccgaggccgaggccgaggccgagaacctgcccgacgacaagccccagcagcccaccagaccccaggagcagagcaccggcgacaccatgggcagagaccccggcgtgagcttcaaggccgtgggcctgcagcccgccggcgacgtgaacctgccctag

SEQ ID NO: 10552 - DNA, 2547 bp, Artificial Sequence
  Description of Artificial Sequence: Synthetic coding sequence
atgcaggccgaggccgccgactggttcagcagcatgcccttccagaagcacgtgtactaccccctggccagcggccccgagggccccgacgtggccgtggccgccgccgccgccggcgccgccagcatggcctgcgccccccccagcgccgccagcggccccctgcccttcttccagttcagacccagactggagagcgtggactggagaagactgagcgccatcgacgtggacaaggtggccggcgccgtggacgtgctgaccctgcaggagaacatcatgaacatcaccttctgcaagctggaggacgagaagtgcccccactgccagagcggcgtggaccccgtgctgctgaagctgatcagactggcccagttcaccatcgagtacctgctgcacagccaggagttcctgaccagccagctgcacaccctggaggagagactgagactgagccactgcgacggcgagcagagcaagaagctgctgaccaagcaggccggcgagatcaagaccctgaaggaggagtgcaagagaagaaagaagatgatcagcacccagcagctgatgatcgaggccaaggccaactactaccagtgccacttctgcgacaaggccttcatgaaccaggccttcctgcagagccacatccagagaagacacaccgaggagaacagccacttcgagtaccagaagaacgcccagatcgagaagctgagaagcgagatcgtggtgctgaaggaggagctgcagctgaccagaagcgagctggaggccgcccaccacgccagcgccgtgagattcagcaaggagtacgagatgcagaagaccaaggaggaggacttcctgaagctgttcgacagatggaaggaggaggagaaggagaagctggtggacgagatggagaaggtgaaggagatgttcatgaaggagttcaaggagctgaccagcaagaacagcgccctggagtaccagctgagcgagatccagaagagcaacatgcagatcaagagcaacatcggcaccctgaaggacgcccacgagttcaaggaggacagaagcccctacccccaggacttccacaacgtgatgcagctgctggacagccaggagagcaagtggaccgccagagtgcaggccatccaccaggagcacaagaaggagaagggcagactgctgagccacatcgagaagctgagaaccagcatgatcgacgacctgaacgccagcaacgtgttctacaagaagagaatcgaggagctgggccagagactgcaggagcagaacgagctgatcatcacccagagacagcagatcaaggacttcacctgcaaccccctgaacagcatcagcgagcccaaggtgaacgcccccgccctgcacaccctggagaccaagagcagcctgcccatggtgcacgagcaggccttcagcagccacatcctggagcccatcgaggagctgagcgaggaggagaagggcagagagaacgagcagaagctgaacaacaacaagatgcacctgagaaaggccctgaagagcaacagcagcctgaccaagggcctgagaaccatggtggagcagaacctgatggagaagctggagaccctgggcatcaacgccgacatcagaggcatcagcagcgaccagctgcacagagtgctgaagagcgtggagagcgagagacacaagcaggagagagagatccccaacttccaccagatcagagagttcctggagcaccaggtgagctgcaagatcgaggagaaggccctgctgagcagcgaccagtgcagcgtgagccagatggacaccctgagcaccggcgaggtgcccaagatgatccagctgcccagcaagaacagacagctgatcagacagaaggccgtgagcaccgacagaaccagcgtgcccaagatcaagaagaacgtgatggaggaccccttccccagaaagagcagcaccatcaccaccccccccttcagcagcgaggaggagcaggaggacgacgacctgatcagagcctacgccagccccggccccctgcccgtgccccccccccagaacaagggcagcttcggcaagaacaccgtgaagagcgacgccgacggcaccgagggcagcgagatcgaggacaccgacgacagccccaagcccgccggcgtggccgtgaagacccccaccgagaaggtggagaagatgttcccccacagaaagaacgtgaacaagcccgtgggcggcaccaacgtgcccgagatgttcatcaagaaggaggagctgcaggagctgaagtgcgccgacgtggaggacgaggactgggacatcagcagcctggaggaggagatcagcctgggcaagaagagcggcaaggagcagaaggagcccccccccgccaagaacgagccccacttcgcccacgtgctgaacgcctggggcgccttcaaccccaagggccccaagggcgagggcctgcaggagaacgagagcagcaccctgaagagcagcctggtgaccgtgaccgactggagcgacaccagcgacgtgtag

SEQ ID NO: 10553 - DNA, 1185 bp, Artificial Sequence
  Description of Artificial Sequence: Synthetic coding sequence
atggtggtggaggtggacagcatgcccgccgccagcagcgtgaagaagcccttcggcctgagaagcaagatgggcaagtggtgctgcagatgcttcccctgctgcagagagagcggcaagagcaacgtgggcaccagcggcgaccacgacgacagcgccatgaagaccctgagaagcaagatgggcaagtggtgcagacactgcttcccctgctgcagaggcagcggcaagagcaacgtgggcgccagcggcgaccacgacgacagcgccatgaagaccctgagaaacaagatgggcaagtggtgctgccactgcttcccctgctgcagaggcagcagcaagagcaaggtgggcgcctggggcgactacgacgacagcgccttcatggagcccagataccacgtgagaggcgaggacctggacaagctgcacagagccgcctggtggggcaaggtgcccagaaaggacctgatcgtgatgctgagagacaccgacgtgaacaagcaggacaagcagaagagaaccgccctgcacctggccagcgccaacggcaacagcgaggtggtgaagctgctgctggacagaagatgccagctgaacgtgctggacaacaagaagagaaccgccctgatcaaggtgtgcagcagccagctgtaccagcacgaggccgtgcagtgccaggaggacgagtgcgccctgatgctgctggagcacggcaccgaccccaacatccccgacgagtacggcaacaccaccctgcactacgccatctacaacgaggacaagctgatggccaaggccctgctgctgtacggcgccgacatcgagagcaagaacaagcacggcctgacccccctgctgctgggcgtgcacgagcagaagcagcaggtggtgaagttcctgatcaagaagaaggccaacctgaacgccctggacagatacggcagaaccgccctgatcctggccgtgtgctgcggcagcgccagcatcgtgagcctgctgctggagcagaacatcgacgtgagcagccaggacctgagcggccagaccgccagagagtacgccgtgagcagccaccaccacgtgatctgccagctgctgagcgactacaaggagaagcagatgctgaagatcagcagcgagaacagcaaccccgagaacgtgagcagaaccagaaacaagtag

SEQ ID NO: 10554 - DNA, 1308 bp, Artificial Sequence
  Description of Artificial Sequence: Synthetic coding sequence
atggcccccttcggcagaaacctgctgaagaccagacacaagaacagaagccccaccaaggacatggacagcgaggagaaggagatcgtggtgtgggtgtgccaggaggagaagctggtgtgcggcctgaccaagagaaccaccagcgccgacgtgatccaggccctgctggaggagcacgaggccaccttcggcgagaagagattcctgctgggcaagcccagcgactactgcatcatcgagaagtggagaggcagcgagagagtgctgccccccctgaccagaatcctgaagctgtggaaggcctggggcgacgagcagcccaacatgcagttcgtgctggtgaaggccgacgccttcctgcccgtgcccctgtggagaaccgccgaggccaagctggtgcagaacaccgagaagctgtgggagctgagccccgccaactacatgaagaccctgccccccgacaagcagaagagaatcgtgagaaagaccttcagaaagctggccaagatcaagcaggacaccgtgagccacgacagagacaacatggagaccctggtgcacctgatcatcagccaggaccacaccatccaccagcaggtgaagagaatgaaggagctggacctggagatcgagaagtgcgaggccaagttccacctggacagagtggagaacgacggcgagaactacgtgcaggacgcctacctgatgcccagcttcagcgaggtggagcagaacctggacctgcagtacgaggagaaccagaccctggaggacctgagcgagagcgacggcatcgagcagctggaggagagactgaagtactacagaatcctgatcgacaagctgagcgccgagatcgagaaggaggtgaagagcgtgtgcatcgacatcaacgaggacgccgagggcgaggccgccagcgagctggagagcagcaacctggagagcgtgaagtgcgacctggagaagagcatgaaggccggcctgaagatccacagccacctgagcggcatccagaaggagatcaagtacagcgacagcctgctgcagatgaaggccaaggagtacgagctgctggccaaggagttcaacagcctgcacatcagcaacaaggacggctgccagctgaaggagaacagagccaaggagagcgaggtgcccagcagcaacggcgagatcccccccttcacccagagagtgttcagcaactacaccaacgacaccgacagcgacaccggcatcagcagcaaccacagccaggacagcgagaccaccgtgggcgacgtggtgctgctgagcacctag

SEQ ID NO: 10555 - DNA, 1644 bp, Artificial Sequence
  Description of Artificial Sequence: Synthetic coding sequence
atggccggcaccaagaacaagaccagagcccaggccaagaccgagaagaaggccgccatccaggccaaggccggcgccgagagagaggccaccggcgtggtgagacccgtggccaagaccagagccaaggccaaggccaagaccggcagcaagaccgacgccgtggccgagatgaaggccgtgagcaagaacaaggtggtggccgagaccaaggagggcgccctgagcgagcccaagaccctgggcaaggccatgggcgacttcacccccaaggccggcaacgagagcaccagcagcacctgcaagaacgaggccggcaccgacgcctggttctgggccggcgaggaggccaccatcaacagctggttctggaacggcgaggaggccggcaacagcttcagcaccaagaacgacaagcccgagatcggcgcccaggtgtgcgccgaggagctggagcccgccgccggcgccgactgcaagcccagaagcggcgccgaggaggaggaggaggagaacgtgatcggcaactggttctgggagggcgacgacaccagcttcgaccccaaccccaagcccgtgagcagaatcgtgaagccccagcccgtgtacgagatcaacgagaagaacagacccaaggactggagcgaggtgaccatctggcccaacgcccccgccgtgacccccgccgtgctgggcttcagaagccaggcccccagcgaggccagcccccccagctacatcgtgctggccagcgccgaggagaacgcctgcagcctgcccgtggccaccgcctgcagacccagcagaaacaccagaagctgcagccagcccatccccgagtgcagattcgacagcgacccctgcatccagaccatcgacgagatcagaagacagatcagaatcagagaggtgaacggcatcaagcccttcgcctgcccctgcaagatggagtgctacatggacagcgaggagttcgagaagctggtgagcctgctgaagagcaccaccgaccccctgatccacaagatcgccagaatcgccatgggcgtgcacaacgtgcaccccttcgcccaggagttcatcaacgaggtgggcgtggtgaccctgatcgagagcctgctgagcttccccagccccgagatgagaaagaagaccgtgatcaccctgaacccccccagcggcgacgagagacagagaaagatcgagctgcacgtgaagcacatgtgcaaggagaccatgagcttccccctgaacagccccggccagcagagcggcctgaagatcctgggccagctgaccaccgacttcgtgcaccactacatcgtggccaactacttcagcgagctgttccacctgctgagcagcggcaactgcaagaccagaaacctggtgctgaagctgctgctgaacatgagcgagaaccccaccgccgccagagacatgatcaacatgaaggccctggccgccctgaagctgatcttcaaccagaaggaggccaaggccaacctggtgagcggcgtggccatcttcatcaacatcaaggagcacatcagaaagggcagcatcgtggtggtggaccacctgagctacaacaccctgatggccatcttcagagaggtgaaggagatcatcgagaccatgtag

SEQ ID NO: 10556 - DNA, 1362 bp, Artificial Sequence
  Description of Artificial Sequence: Synthetic coding sequence
atggccagaaaggtggtgagcagaaagagaaaggcccccgccagccccggcgccggcagcgacgcccagggcccccagttcggctgggaccacagcctgcacaagagaaagagactgccccccgtgaagagaagcctggtgtactacctgaagaacagagaggtgagactgcagaacgagaccagctacagcagagtgctgcacggctacgccgcccagcagctgcccagcctgctgaaggagagagagttccacctgggcaccctgaacaaggtgttcgccagccagtggctgaaccacagacaggtggtgtgcggcaccaagtgcaacaccctgttcgtggtggacgtgcagaccagccagatcaccaagatccccatcctgaaggacagagagcccggcggcgtgacccagcagggctgcggcatccacgccatcgagctgaaccccagcagaaccctgctggccaccggcggcgacaaccccaacagcctggccatctacagactgcccaccctggaccccgtgtgcgtgggcgacgacggccacaaggactggatcttcagcatcgcctggatcagcgacaccatggccgtgagcggcagcagagacggcagcatgggcctgtgggaggtgaccgacgacgtgctgaccaagagcgacgccagacacaacgtgagcagagtgcccgtgtacgcccacatcacccacaaggccctgaaggacatccccaaggaggacaccaaccccgacaactgcaaggtgagagccctggccttcaacaacaagaacaaggagctgggcgccgtgagcctggacggctacttccacctgtggaaggccgagaacaccctgagcaagctgctgagcaccaagctgccctactgcagagagaacgtgtgcctggcctacggcagcgagtggagcgtgtacgccgtgggcagccaggcccacgtgagcttcctggaccccagacagcccagctacaacgtgaagagcgtgtgcagcagagagagaggcagcggcatcagaagcgtgagcttctacgagcacatcatcaccgtgggcaccggccagggcagcctgctgttctacgacatcagagcccagagattcctggaggagagactgagcgcctgctacggcagcaagcccagactggccggcgagaacctgaagctgaccaccggcaagggctggctgaaccacgacgagacctggagaaactacttcagcgacatcgacttcttccccaacgccgtgtacacccactgctacgacagcagcggcaccaagctgttcgtggccggcggccccctgcccagcggcctgcacggcaactacgccggcctgtggagctag

SEQ ID NO: 10557 - DNA, 2439 bp, Artificial Sequence
  Description of Artificial Sequence: Synthetic coding sequence
atggaggccttccaggagctgagaaagcccagcgccagactggagtgcgaccactgcagcttcagaggcaccgactacgagaacgtgcagatccacatgggcaccatccaccccgagttctgcgacgagatggacgccggcggcctgggcaagatgatcttctaccagaagagcgccaagctgttccactgccacaagtgcttcttcaccagcaagatgtacagcaacgtgtactaccacatcaccagcaagcacgccagccccgacaagtggaacgacaagcccaagaaccagctgaacaaggagaccgaccccgtgaagagcccccccctgcccgagcaccagaagatcccctgcaacagcgccgagcccaagagcatccccgccctgagcatggagacccagaagctgggcagcgtgctgagccccgagagccccaagcccacccccctgacccccctggagccccagaagcccggcagcgtggtgagccccgagctgcagacccccctgcccagccccgagcccagcaagcccgccagcgtgagcagccccgagccccccaagagcgtgcccgtgtgcgagagccagaagctggcccccgtgcccagccccgagccccagaagcccgcccccgtgagccccgagagcgtgaaggccaccctgagcaaccccaagccccagaagcagagccacttccccgagaccctgggcccccccagcgccagcagccccgagagccccgtgctggccgccagccccgagccctggggccccagccccgccgccagccccgagagcagaaagagcgccagaaccaccagccccgagcccagaaagcccagccccagcgagagccccgagccctggaagcccttccccgccgtgagccccgagcccagaagacccgcccccgccgtgagccccggcagctggaagcccggcccccccggcagccccagaccctggaagagcaaccccagcgccagcagcggcccctggaagcccgccaagcccgcccccagcgtgagccccggcccctggaagcccatccccagcgtgagccccggcccctggaagcccacccccagcgtgagcagcgccagctggaagagcagcagcgtgagccccagcagctggaagagcccccccgccagccccgagagctggaagagcggcccccccgagctgagaaagaccgcccccaccctgagccccgagcactggaaggccgtgccccccgtgagccccgagctgagaaagcccggcccccccctgagccccgagatcagaagccccgccggcagccccgagctgagaaagcccagcggcagccccgacctgtggaagctgagccccgaccagagaaagaccagccccgccagcctggacttccccgagagccagaagagcagcagaggcggcagccccgacctgtggaagagcagcttcttcatcgagccccagaagcccgtgttccccgagaccagaaagcccggccccagcggccccagcgagagccccaaggccgccagcgacatctggaagcccgtgctgagcatcgacaccgagcccagaaagcccgccctgttccccgagcccgccaagaccgccccccccgccagccccgaggccagaaagagagccctgttccccgagcccagaaagcacgccctgttccccgagctgcccaagagcgccctgttcagcgagagccagaaggccgtggagctgggcgacgagctgcagatcgacgccatcgacgaccagaagtgcgacatcctggtgcaggaggagctgctggccagccccaagaagctgctggaggacaccctgttccccagcagcaagaagctgaagaaggacaaccaggagagcagcgacgccgagctgagcagcagcgagtacatcaagaccgacctggacgccatggacatcaagggccaggagagcagcagcgaccaggagcaggtggacgtggagagcatcgacttcagcaaggagaacaagatggacatgaccagccccgagcagagcagaaacgtgctgcagttcaccgaggagaaggaggccttcatcagcgaggaggagatcgccaagtacatgaagagaggcaagggcaagtactactgcaagatctgctgctgcagagccatgaagaagggcgccgtgctgcaccacctggtgaacaagcacaacgtgcacagcccctacaagtgcaccatctgcggcaaggccttcctgctggagagcctgctgaagaaccacgtggccgcccacggccagagcctgctgaagtgccccagatgcaacttcgagagcaacttccccagaggcttcaagaagcacctgacccactgccagagcagacacaacgaggaggccaacaagaagctgatggaggccctggagccccccctggaggagcagcagatctag

SEQ ID NO: 10558 - DNA, 1974 bp, Artificial Sequence
  Description of Artificial Sequence: Synthetic coding sequence
atggacgagcaggaggccctgaacagcatcatgaacgacctggtggccctgcagatgaacagaagacacagaatgcccggctacgagaccatgaagaacaaggacaccggccacagcaacagacagaagaagcacaacagcagcagcagcgccctgctgaacagccccaccgtgaccaccagcagctgcgccggcgccagcgagaagaagaagttcctgagcgacgtgagaatcaagttcgagcacaacggcgagagaagaatcatcgccttcagcagacccgtgaagtacgaggacgtggagcacaaggtgaccaccgtgttcggccagcccctggacctgcactacatgaacaacgagctgagcatcctgctgaagaaccaggacgacctggacaaggccatcgacatcctggacagaagcagcagcatgaagagcctgagaatcctgctgctgagccaggacagaaaccacaacagcagcagcccccacagcggcgtgagcagacaggtgagaatcaaggccagccagagcgccggcgacatcaacaccatctaccagccccccgagcccagaagcagacacctgagcgtgagcagccagaaccccggcagaagcagccccccccccggctacgtgcccgagagacagcagcacatcgccagacagggcagctacaccagcatcaacagcgagggcgagttcatccccgagaccagcgagcagtgcatgctggaccccctgagcagcgccgagaacagcctgagcggcagctgccagagcctggacagaagcgccgacagccccagcttcagaaagagcagaatgagcagagcccagagcttccccgacaacagacaggagtacagcgacagagagacccagctgtacgacaagggcgtgaagggcggcacctaccccagaagataccacgtgagcgtgcaccacaaggactacagcgacggcagaagaaccttccccagaatcagaagacaccagggcaacctgttcaccctggtgcccagcagcagaagcctgagcaccaacggcgagaacatgggcctggccgtgcagtacctggaccccagaggcagactgagaagcgccgacagcgagaacgccctgagcgtgcaggagagaaacgtgcccaccaagagccccagcgcccccatcaactggagaagaggcaagctgctgggccagggcgccttcggcagagtgtacctgtgctacgacgtggacaccggcagagagctggccagcaagcaggtgcagttcgaccccgacagccccgagaccagcaaggaggtgagcgccctggagtgcgagatccagctgctgaagaacctgcagcacgagagaatcgtgcagtactacggctgcctgagagacagagccgagaagaccctgaccatcttcatggagtacatgcccggcggcagcgtgaaggaccagctgaaggcctacggcgccctgaccgagagcgtgaccagaaagtacaccagacagatcctggagggcatgagctacctgcacagcaacatgatcgtgcacagagacatcaagggcgccaacatcctgagagacagcgccggcaacgtgaagctgggcgacttcggcgccagcaagagactgcagaccatctgcatgagcggcaccggcatgagaagcgtgaccggcaccccctactggatgagccccgaggtgatcagcggcgagggctacggcagaaaggccgacgtgtggagcctgggctgcaccgtggtggagatgctgaccgagaagcccccctgggccgagtacgaggccatggccgccatcttcaagatcgccacccagcccaccaacccccagctgcccagccacatcagcgagcacggcagagacttcctgagaagaatcttcgtggaggccagacagagacccagcgccgaggagctgctgacccaccacttcgcccagctgatgtactag

SEQ ID NO: 10559 - DNA, 2547 bp, Artificial Sequence; identical to SEQ ID NO: 10552
  Description of Artificial Sequence: Synthetic coding sequence

SEQ ID NO: 10560 - DNA, 4074 bp, Artificial Sequence
  Description of Artificial Sequence: Synthetic coding sequence
atggccgacaccgacctgttcatggagtgcgaggaggaggagctggagccctggcagaagatcagcgacgtgatcgaggacagcgtggtggaggactacaacagcgtggacaagaccaccaccgccggcaaccccctggtgcagcagggcggccagcccctgatcctgacccagaaccccgcccccggcctgggcaccatggtgacccagcccgtgctgagacccgtgcaggtgatgcagaacgccaaccacgtgaccagcagccccgtggccagccagcccatcttcatcaccacccagggcttccccgtgagaaacgtgagacccgtgcagaacgccatgaaccaggtgggcatcgtgctgaacgtgcagcagggccagaccgtgagacccatcaccctggtgcccgcccccggcacccagttcgtgaagcccaccgtgggcgtgccccaggtgttcagccagatgacccccgtgagacccggcagcaccatgcccgtgagacccaccaccaacaccttcaccaccgtgatccccgccaccctgaccatcagaagcaccgtgccccagagccagagccagcagaccaagagcacccccagcaccagcaccacccccaccgccacccagcccaccagcctgggccagctggccgtgcagagccccggccagagcaaccagaccaccaaccccaagctggcccccagcttccccagcccccccgccgtgagcatcgccagcttcgtgaccgtgaagagacccggcgtgaccggcgagaacagcaacgaggtggccaagctggtgaacaccctgaacaccatccccagcctgggccagagccccggccccgtggtggtgagcaacaacagcagcgcccacggcagccagagaaccagcggccccgagagcagcatgaaggtgaccagcagcatccccgtgttcgacctgcaggacggcggcagaaagatctgccccagatgcaacgcccagttcagagtgaccgaggccctgagaggccacatgtgctactgctgccccgagatggtggagtaccagaagaagggcaagagcctggacagcgagcccagcgtgcccagcgccgccaagccccccagccccgagaagaccgcccccgtggccagcacccccagcagcacccccatccccgccctgagcccccccaccaaggtgcccgagcccaacgagaacgtgggcgacgccgtgcagaccaagctgatcatgctggtggacgacttctactacggcagagacggcggcaaggtggcccagctgaccaacttccccaaggtggccaccagcttcagatgcccccactgcaccaagagactgaagaacaacatcagattcatgaaccacatgaagcaccacgtggagctggaccagcagaacggcgaggtggacggccacaccatctgccagcactgctacagacagttcagcacccccttccagctgcagtgccacctggagaacgtgcacagcccctacgagagcaccaccaagtgcaagatctgcgagtgggccttcgagagcgagcccctgttcctgcagcacatgaaggacacccacaagcccggcgagatgccctacgtgtgccaggtgtgccagtacagaagcagcctgtacagcgaggtggacgtgcacttcagaatgatccacgaggacaccagacacctgctgtgcccctactgcctgaaggtgttcaagaacggcaacgccttccagcagcactacatgagacaccagaagagaaacgtgtaccactgcaacaagtgcagactgcagttcctgttcgccaaggacaagatcgagcacaagctgcagcaccacaagaccttcagaaagcccaagcagctggagggcctgaagcccggcaccaaggtgaccatcagagccagcagaggccagcccagaaccgtgcccgtgagcagcaacgacaccccccccagcgccctgcaggaggccgcccccctgaccagcagcatggaccccctgcccgtgttcctgtacccccccgtgcagagaagcatccagaagagagccgtgagaaagatgagcgtgatgggcagacagacctgcctggagtgcagcttcgagatccccgacttccccaaccacttccccacctacgtgcactgcagcctgtgcagatacagcacctgctgcagcagagcctacgccaaccacatgatcaacaaccacgtgcccagaaagagccccaagtacctggccctgttcaagaacagcgtgagcggcatcaagctggcctgcaccagctgcaccttcgtgaccagcgtgggcgacgccatggccaagcacctggtgttcaaccccagccacagaagcagcagcatcctgcccagaggcctgacctggatcgcccacagcagacacggccagaccagagacagagtgcacgacagaaacgtgaagaacatgtaccccccccccagcttccccaccaacaaggccgccaccgtgaagagcgccggcgccacccccgccgagcccgaggagctgctgacccccctggcccccgccctgcccagccccgccagcaccgccacccccccccccacccccacccacccccaggccctggccctgccccccctggccaccgagggcgccgagtgcctgaacgtggacgaccaggacgagggcagccccgtgacccaggagcccgagctggccagcggcggcggcggcagcggcggcgtgggcaagaaggagcagctgagcgtgaagaagctgagagtggtgctgttcgccctgtgctgcaacaccgagcaggccgccgagcacttcagaaacccccagagaagaatcagaagatggctgagaagattccaggccagccagggcgagaacctggagggcaagtacctgagcttcgaggccgaggagaagctggccgagtgggtgctgacccagagagagcagcagctgcccgtgaacgaggagaccctgttccagaaggccaccaagatcggcagaagcctggagggcggcttcaagatcagctacgagtgggccgtgagattcatgctgagacaccacctgaccccccacgccagaagagccgtggcccacaccctgcccaaggacgtggccgagaacgccggcctgttcatcgacttcgtgcagagacagatccacaaccaggacctgcccctgagcatgatcgtggccatcgacgagatcagcctgttcctggacaccgaggtgctgagcagcgacgacagaaaggagaacgccctgcagaccgtgggcaccggcgagccctggtgcgacgtggtgctggccatcctggccgacggcaccgtgctgcccaccctggtgttctacagaggccagatggaccagcccgccaacatgcccgacagcatcctgctggaggccaaggagagcggctacagcgacgacgagatcatggagctgtggagcaccagagtgtggcagaagcacaccgcctgccagagaagcaagggcatgctggtgatggactgccacagaacccacctgagcgaggaggtgctggccatgctgagcgccagcagcaccctgcccgccgtggtgcccgccggctgcagcagcaagatccagcccctggacgtgtgcatcaagagaaccgtgaagaacttcctgcacaagaagtggaaggagcaggccagagagatggccgacaccgcctgcgacagcgacgtgctgctgcagctggtgctggtgtggctgggcgaggtgctgggcgtgatcggcgactgccccgagctggtgcagagaagcttcctggtggccagcgtgctgcccggccccgacggcaacatcaacagccccaccagaaacgccgacatgcaggaggagctgatcgccagcctggaggagcagctgaagctgagcggcgagcacagcgagagcagcacccccagacccagaagcagccccgaggagaccatcgagcccgagagcctgcaccagctgttcgagggcgagagcgagaccgagagcttctacggcttcgaggaggccgacctggacctgatggagatctag

SEQ ID NO: 10561 - DNA, 2904 bp, Artificial Sequence
  Description of Artificial Sequence: Synthetic coding sequence
atgggccccggccagcccgccagcacctgcgtgcacctggcccccagaacccagctggacggcagaagcgaccccaaggtgctgcagacccagaaccagctgcagttcaacagaaacgtgcccacccacagcagcaacctggccatcagatacagctgcccccacgccatcagaatcgagaagctgaagcacagctacaacgagagctaccactgcaaggacgccgactgcagagtgggccccgacctgggcagcagcgtgagcttcagcgtgatcagccaggagagactgagctacgccgtgcacctggccagaagagacgtgaagagaagacagttcgagaagcacatcaaggagcaccacctgagaagccagccccagagcagccagaagtgcggccacaccaagtacaagatccccgaccacagagtggagagaaaggagagcaagagccaggccgcctgccagtgcagccaccagcccagcaaggtggagatcagcagcagcggcgccaaggtgtacctgtacagcagccaccccggccagagcgacctgaccgtgcccaacagcccccccacccacgaccccggcctgcagccccaccccagaatcggcgaccacaagaacatcagcgagcagaagagcctgctggaggtgcagagactgcagaaggagctgagcagctgcatccacaagatcgaggaggtgaccaagaaggacagactggaggaggccctggaccccgacgaggagagaagaatcagaatcagaagacaggagcaggccgccagaagcgccagaatgctgtacgtgctgcagcagcaggtgaaggagatccaggaggagctggacaagctgagcccccacaagatcaagcacaccaagaagagctgggccatgagcaagctggccgccgcccacagaggcgccatcagagccctgcagatgttcgtgacccagttcaccgacagaggcgagcaccccctgcccgccagatgcaaggagctgggcagcctgatcagacagctgagcctgtgcagcgtgaagctggacgccgaccccagcgtgcccgacgtggtgatcgacatcctgcagcagatcgaggccctggagagcctgctggagaagaagctgagccccaagaaggtgaagaagtgcttcagcgagatcagaagcagattccccatcggcagccagaaggccctggagagatggcccagcaccagccccaagggcgagagaagacccctgaccgccaaggacaccttcccccaggagaccagcagacccagcgtggccaagcagctgctggccgacaagtaccagcccgacaccgagctgcccgagacccagagactgcagagcgagctggacgtgctggacgccgacatcgtgctggaggagggccccttcatcctggaccagagcgccagcttcaaggacgaggtgctggccgtggccaagaccaaggccggcaagaagaagcccgtgaccgagaacgtgcccttcagaaagaaggacaccctggcccccgccagacagcagggcctgagaaaggccgagagaggcagacagagccagccccacagcaagagcagagtgcagcagaccaccgtgagcagcagactgaagatgaacagacagcccgtgaaggacagaaaggccccctggatcccccccaaccccaccagcccccccgccagccccaagtgcgccgcctggctgaaggtgaagaccagccccagagacgccaccaaggagcccctgcagcaggaggacccccaggaggagagccacctgaccggcgccgtggagcacgaggccgccagactggcctggctggacgccgagaccagcaagagactgaaggagctggaggagctgaaggccaaggagatcgacagcatgcagaagcagagactggactggctggacgccgagaccagcagaagaaccaaggagctgaacgagctgaaggccgaggagatgtacagactgcagcagctgagcgtgagcgccacccacctggccgacaaggtggaggaggccgtgctggacagactgaagcccctgctggtgaaggcccagagagtgaacagcaccaccgaggccaacatccacctgaaggacggcagcagcgtgaacaccgccaaggcccagcccgcccaggaggtggccgccgtggacttcgagagcaacaacatcagacagctggacgacttcctggaggactgcgccagcgagctgtgggccgtgacccacgccaagatcctgggcagcgagaccctggccaccgtggaggacagcaaggacagccccgacctggagatcatgatgagaagaatggaggagatggagaagtaccaggagagcgtgagacagagatacaacaagatcgcctacgccgaccccagactgtggatgcaggaggagaacaacgaccagaagatcagcgccatcagcgagaagcccctgagcccccaccccatcagaatcaccaagaccgtggacagaaaggaccccgccgtgaacatcatgctggagagaccctgcaacggcaacagcctggacgagagcgtgggcaccgaggagggcagcgagaagagagaggcccccctgctgagcctggccgaggacagccagcagaaggagggcagagcccccctgttcgtgccccccggcatgcagcacagcatcggcgactactgcagcagattcgagcagtacctgagaatcatcagccacgaggccgtgggcagcttcaacccctggctgatcgccgagagcttcagcgaggagctggtggacgaggccctgggcgccgtggccgccgagctgcaggacatgtgcgaggactacgccgaggccgtgttcaccagcgagttcctggaggccgccacctag

SEQ ID NO: 10562 - DNA, 6840 bp, Artificial Sequence
  Description of Artificial Sequence: Synthetic coding sequence
atgtacagaagcagcgccagaagcagcgtgagcagccacagacccaaggacgacggcggcggcggccccagaagcggcagaagcagcggcagcagcagcggccccgccagaagaagcagccccccccccccccccagcggcagcagcagcagaacccccgccagaagacccagaagccccagcggccacagaggcagaagagccagccccagcccccccagaggcagaagagtgagccccagcccccccagagccagaagaggcagccccagcccccccagaggcagaagactgttcccccccggccccgccggcttcagaggcagcagcagaggcgagagcagagccgactacgccagagacggcagaggcgaccaccccggcgacagcggcagcagaagaagaagccccggcctgtgcagcgacagcctggagaagagcctgagaatcaccgtgggcaacgaccacttctgcgtgagcacccccgagagaagaagactgagcgacagactgggcagccccgtggacaacctggaggacatggacagagacgacctgaccgacgacagcgtgttcaccagaagcagccagtgcagcagaggcctggagagatacatcagccaggaggagggccccctgagccccttcctgggccagctggacgaggactacagaaccaaggagaccttcctgcacagaagcgactacagcccccacatcagctgccacgacgagctgctgagaggcaccgagagaaacagagagaagctgaagggctacagcatcagaagcgaggagagaagcagagaggccaagagacccagatacgacgacaccgtgaagatcaacagcatgggcggcgaccaccccagcttcaccagcggcaccagaaactacagacagagaagaagaagccccagccccagattcctggaccccgagttcagagagctggacctggccagaagaaagagagaggaggaggaggagagaagcagaagcctgagccaggagctggtgggcgtggacggcggcggcaccggctgcagcatccccggcctgagcggcgtgctgaccgccagcgagcccggctacagcctgcacagacccgaggaggtgagcgtgatgcccaagaagagcatcctgaagaagagaatcgaggtggacatcatggagcccagcatgcagctggagagcttcagcagcagcaccagcagcagccaggaccaccccctgtacagcggccaccccagcctgcccctgagcggcgccatcgccgccttcgccagcgagatcgagaacaagggcaccatggtggagaccgccctgaaggagccccagggcaacctgtaccagtggggccccctgcccggcatccccaaggacaacagccccctgagagagaagttcggcagcttcctgtgccacaaggacaacctggacctgaaggccgagggccccgagagacacaccgacttcctgctgccccacgagagagccagccaggacggcagcggcttcagcagaatcctgagcatgctggccgacagcaccagcacccaggagaagagaagaagaagcttccccgacatcgaggacgaggagaagttcctgtacggcgacgaggaggaggacctgaaggccgagagcgtgcccaagcccctgggcagcagcgagagcgaggtgatgagacagaaggccagcagcctgcccagcagcgcccccgccgtgaagctggagagcctggaggagaccaaccccgagtacgccaagatccacgacctgctgaagaccatcggcctggacatcggcgtggccgagatcagccagctggccgccagaacccaggagagactgcacggcaagaagcccagcctgagaagcagcgccgacagaagaagcagcgtggacagatacttcagcgccgaccactgcagcagcgtggaccacagattcagcgccgacagatgcagcagcgtggaccactgcttcagcgccgacagaagaagcagcgacccccacagactggagagcagagaggcccaccacagcaacacccacagccccgaggtgagccacccccacccccccagccccgtggacccctacctgctgaccaagaacagcccccccttcctgaagagcgaccaccccgtgggccacatcagcggccccgaggtggtgggcagcggcttccagagcagcgtggccgtgagatgcatgctgcccagcgcccccagcgcccccatcagactgccccacaccgccgccctgagccagttccacatgcccagagccagccagttcgccgccgccagaatcccccccaactaccagggccccgccatcccccccgccagcttcgacgcctacagacactacatggcctacgccgccagcagatggcccatgtaccccaccagccagcccagcaaccaccccgtgcccgagccccacagaatcatgcccatcaccaagcaggccaccagaagcagacccaacctgagagtgatccccaccgtgacccccgacaagcccaagcagaaggagagcctgagaggcagcatccccgccgcccaggtgcccgtgcaggtgagcatccccagcctgatcagatacaaccccgagaagatcagcgacgagaagaacagagccagccagaagcagaaggtgatcgaggagagagagaagctgaagaacgacagagaggccagacagaagaagatgtactacctgagaaccgagctggagagactgcacaagcagcagggcgagatgctgagaaagaagagaagagagaaggacggccacaaggaccccctgctggtggaggtgagcagactgcaggacaacatcatgaaggacatcgccgagctgagacaggaggccgaggaggccgagaagaagcagagcgagctggacaaggtggcccagatcctgggcatcaacatcttcgacaagagccagaagagcctgagcgacagcagagagcccaccgagaagcccggcaaggccgagaagagcaagagccccgagaaggtgagcagcttcagcaacagcagcagcaacaaggagagcaaggtgaacaacgagaagttcagaaccaagagccccaagcccgccgagagcccccagagcgccaccaagcagctggaccagcccaccgccgcctacgagtactacgacgccggcaaccactggtgcaaggactgcaacaccatctgcggcaccatgttcgacttcttcacccacatgcacaacaagaagcacacccagaccctggacccctacaacagaccctgggccagcaagacccagagcgaggccaagcaggacgccatcaagagaaccgacaagatcaccgtgcccgccaagggcagcgagttcctggtgcccatcagcggcttctactgccagctgtgcgaggagttcctgggcgaccccatcagcggcgagcagcacgtgaagggccaccagcacaacgagaagtacaagaagtacgtggacgagaaccccctgtacgaggagagaagaaacctggacagacaggccggcctggccgtggtgctggagaccgagagaagaagacagagcgagctgaagagaaagctgagcgagaagcccaaggaggagaagaaggagaagaaggccaaggccgtgaaggaggtgaaggaggacgacaaggtgagcgagaagctggaggaccagctgagcgagggcagaaacagccccgagaaggccgagaacaagagaaacaccggcatcaagctgcagctgaaggaggaggtgaagaaggagagccccaccagcagcagcttcggcaagttcagctggaagaagcccgagaaggaggaggagaagagcagcctggtgacccccagcatcagcaaggaggagatcctggagagcagcaaggacaaggaggacggcaagaccgaggccggcaaggccaagcccatcaagatcaagctgagcggcaagaccgtggtggcccacaccagcccctggatgcccgtggtgaccaccagcacccagaccaagatcagacccaacctgcccatccccagcaccgtgctgagaaagagctgcagcgccaccatgagcaagcccgcccccctgaacaccttcctgagcatcaagagcagcggcaccaccgccaagcccctgcccgtggtgaaggagagcagcgccgacctgctgctgccccccgacatcatcagcaaggccttcggcggcgaggaggtgatcctgaagggcagccccgaggagaaggtggtgctggccgagaagagcgagcccagccacctgcccgagcagatcctgcccccccccccccccccccccccccccccccccccccccccccccgtgatcccccaccccgccgcccccagcgccgcccaggccaacgccatcctggcccccgtgaagagcaaccccgtggtgagccagaccctgagccccggcttcgtgggccccaacatcctgaaccccgtgctgcccgtggccatcatggccagcgcccagcccgccgccatccccagcgacgagaccgcccccggcgtgagcgagagcgacagagaccagaccctgttcagcgtgctggtgagaccccccccccccctgagcagcgtgttcagcgagcaggccaagaagctggagaagagaaacagctgcctggccaccgccaacgccaaggacctgtacgacatcttctacagcagcggcggcaagggcgcccccgagaccaagggcgcccccgagaccaagctgagcggcggccccctggccaacggcgagaacagcaacctgagcagaaccaagagcagcgacaccagcagcaccagccccctgaacagcagcgccagccaggaggagctgcaccaggacgagggcctggtggccgcccccatcgtgagcaacagcgagaagcccatcgccaagaccctggtggccctgggcaagtggagcgtggtggagcacgtgggccccaagagcaccggcagcacctacggcttcctgcagcccctgaccagactgtgccagagcagaccctacgagaccatcacccccaagaccgacaccctggccatctggaccagcagcagcttccagagcgacaccagcagagacatcagccccgagaagagcgagctggacctgggcgagcccggcccccccggcgtggagccccccccccagctgctggacatccagtgcaaggagagccagaagctggtggagatccacctgagagagagcgtgaaccaggacaaggagagccaggagctgagaaagagcgaggactgcagagagagcgagatcgagaccaacaccgagctgaaggagagagtgaaggagctgagcgagggcatcgtggacgagggcgtgagcaccagcatcggcccccacagcatcgacgacagcaacctgaaccacggcaacagatacatgtgggagggcgaggtgaagcagcccaacctgctgatgatcgacaaggaggccgagcagagcaacaagctgatgaccggcagcgagacccccagcaaggtggtgatcaagctgagcccccaggcctgcagcttcaccaaggccaagctggacagcttcctgagcgaggccagaagcctgctgaacccccaggacacccccgtgaagatcagcgcccccgagctgctgctgcacagccccgccagaagcgccatgtgcctgaccggcagcccccaggagcagggcgtgagcgtggtgagcgaggagggcctggagaacagcgcccccgagagcgccagcagaaccagcagatacagaagcctgaagctgaagagagagagaagcaaggacttccaggtgaagaagatctacgagctggccgtgtgggacgagaacaagaagagacccgagacctgggagagccccgagaagcccaagaccgaggccctggagctgcaggacgtgcaccccgagctgaccgtgaccatcgagagcaaggccctggaggacttcgaggccaccgacctgaaggtggaggagctgaccgccctgggcaacctgggcgacatgcccgtggacttctgcaccaccagagtgagccccgcccacagaagccccaccgtgctgtgccagaaggtgtgcgaggagaacagcgtgagccccatcggctgcaacagcagcgaccccgccgacttcgagcccatccccagcttcagcggcttccccctggacagccccaagaccctggtgctggacttcgagaccgagggcgagagaaacagccccaaccccagaagcgtgagaatccccagccccaacatcctgaagaccggcctgaccgagaacgtggacagaggcctgggcggcctggagggcacccaccaggccctggacctgctggccggcggcatgatgcccgaggaggtgaaggagagcagccagctggacaagcaggagagcctgggcctggagctgaagaccatcaacagcgccggcctgggccccagcccctgcctgcccgacctggtggacttcgtgaccagaaccagcggcgtgcagaaggacaagctgtgcagccccctgagcgagcccggcgaccccagcaagtgcagcagcctggagctgggccccctgcagctggagatcagcaacgccagcaccaccgaggtggccatcctgcaggtggacgacgacagcggcgaccccctgaacctggtgaaggcccccgtgagcagaagcccccccagagagcaggtgatcgaggacaacatggtgccccagggcatgcccgagcaggagaccaccgtgggcgccatccaggaccacaccgagagcagcgtgcacaactag

SEQ ID NO: 10563 - DNA, 1932 bp, Artificial Sequence
  Description of Artificial Sequence: Synthetic coding sequence
atgggccaggagagcagcaagcccgtgtggcccaaccccaccggcggctaccagagcaacaccggcagaagatacggcagaagacacgcctacgtgagcttcagaccccccaccagccagagagagagaatcgccagccagagaaagaccaacagcgaggtgcccatgcacagaagcgcccccagccagaccaccaagagaagcagaagccccttcagcaccaccagaagaagctgggacgacagcgagagcagcggcaccaacctgaacatcgacaacgaggactacagcagatacccccccagagagtacagagccagcggcagcagaagaggcatggcctacggccacatcgacagctacggcgccgacgacagcgaggaggagggcgccggccccgtggagagaccccccgtgagaggcaagaccggcaagttcaaggacgacaagctgtacgaccccgagaagggcgccagaagcctggccggcccccccccccacttcagcagcttcagcagagacgtgagagaggagagagacaagctggaccccgtgcccgccgccagatgcagcgccagcagagccgacttcctgccccagagcagcgtggccagccagagcagcagcgagggcaagctggccaccaagggcgacagcagcgagagagagagaagagagcagaacctgcccgccagacccagcagagcccccgtgagcatctgcggcggcggcgagaacaccagcaagagcgccgaggagcccgtggtgagacccaagatcagaaacctggccagccccaactgcgtgaagcccaagatcttcttcgacaccgacgacgacgacgacatgccccacagcaccagcagatggagagacaccgccaacgacaacgagggccacagcgacggcctggccagaagaggcagaggcgagagcagcagcggctaccccgagcccaagtaccccgaggacaagagagaggccagaagcgaccaggtgaagcccgagaaggtgcccagaagaagaagaaccatggccgaccccgacttctggacccacagcgacgactactacaagtactgcgacgaggacagcgacagcgacaaggagtggatcgccgccctgagaagaaagtacagaagcagagagcagaccctgagcagcagcggcgagagctgggagaccctgcccggcaaggaggagagagagcccccccaggccaaggtgagcgccagcaccggcaccagccccggccccggcgccagcgccagcgccggcgccggcgccggcgccagcgccggcagcaacggcagcaactacctggaggaggtgagagagcccagcctgcaggaggagcaggccagcctggaggagggcgagatcccctggctgcagtaccacgagaacgacagcagcagcgagggcgacaacgacagcggccacgagctgatgcagcccggcgtgttcatgctggacggcaacaacaacctggaggacgacagcagcgtgagcgaggacctggaggtggactggagcctgttcgacggcttcgccgacggcctgggcgtggccgaggccatcagctacgtggacccccagttcctgacctacatggccctggaggagagactggcccaggccatggagaccgccctggcccacctggagagcctggccgtggacgtggaggtggccaacccccccgccagcaaggagagcatcgacgccctgcccgagatcctggtgaccgaggaccacggcgccgtgggccaggagatgtgctgccccatctgctgcagcgagtacgtgaagggcgaggtggccaccgagctgccctgccaccactacttccacaagccctgcgtgagcatctggctgcagaagagcggcacctgccccgtgtgcagatgcatgttccccccccccctgtag

SEQ ID NO: 10564 - DNA, 1113 bp, Artificial Sequence
  Description of Artificial Sequence: Synthetic coding sequence
atgcccaccgagaccctgcagaccggcagcatggtgaagcccgtgagccccgccggcaccttcaccagcgccgtgcccctgagaatcctgaacaagggccccgactacttcagaagacaggccgagcccaaccccaagagactgagcgccgtggagagactggaggccgacaaggccaagtacgtgaagagccaggaggtgatcaacgccaagcaggagcccgtgaagcccgccgtgctggccaagccccccgtgtgccccgccgccaagagagccctgggcagccccaccctgaaggtgttcggcaaccacgccaagaccgagagcggcgtgcagagagagaacctgaagctggagatcctgaagaacatcatcaacagcagcgagggcagcagcagcggcagcggccacaagcacagcagcagaaactggcccccccacagaagcgaggccaccgacctgcacagacacagcttcgccgagagcctgaaggtgtaccccacccagggcagaagaagcccccaggagggcggcagccacgtgggcagaagactgctggagcagagcgccgagagcttcctgcacgtgagccacagcagcagcgacatcagaaaggtgaccagcgtgaagcccctgaaggccatcccctgcagcagcagcgccccccccctgccccccaagcccaagatcgccgccatcgccagcatgaagagccccgaggccgaccccgtggagcccgcctgcggcgtgagcagaagacccagcctgcagagaagcaagagcgacctgagcgacagatacttcagagtggacgccgacgtggagagattcttcaactactgcggcctggaccccgaggagctggagaacctgggcatggagaacttcgccagagccaacagcgacatcatcagcctgaacttcagaagcgccagcatgatcagcagcgactgcgagcagagccaggacagcaacagcgacctgagaaacgacgacagcgccaacgacagagtgccctacggcatcagcgccatcgagagaaacgccagaatcatcaagtggctgtacagcatcaagcaggccagagagagccagaaggtgagccacgtgtag

SEQ ID NO: 10565 - DNA, 3126 bp, Artificial Sequence
  Description of Artificial Sequence: Synthetic coding sequence
atggccgccgccgccgccgccggcgccgccagcggcctgcccggccccgtggcccagggcctgaaggaggccctggtggacaccctgaccggcatcctgagccccgtgcaggaggtgagagccgccgccgaggagcagatcaaggtgctggaggtgaccgaggagttcggcgtgcacctggccgagctgaccgtggacccccagggcgccctggccatcagacagctggccagcgtgatcctgaagcagtacgtggagacccactggtgcgcccagagcgagaagttcagaccccccgagaccaccgagagagccaagatcgtgatcagagagctgctgcccaacggcctgagagagagcatcagcaaggtgagaagcagcgtggcctacgccgtgagcgccatcgcccactgggactggcccgaggcctggccccagctgttcaacctgctgatggagatgctggtgagcggcgacctgaacgccgtgcacggcgccatgagagtgctgaccgagttcaccagagaggtgaccgacacccagatgcccctggtggcccccgtgatcctgcccgagatgtacaagatcttcaccatggccgaggtgtacggcatcagaaccagaagcagagccgtggagatcttcaccacctgcgcccacatgatctgcaacatggaggagctggagaagggcgccgccaaggtgctgatcttccccgtggtgcagcagttcaccgaggccttcgtgcaggccctgcagatccccgacggccccaccagcgacagcggcttcaagatggaggtgctgaaggccgtgaccgccctggtgaagaacttccccaagcacatggtgagcagcatgcagcagatcctgcccatcgtgtggaacaccctgaccgagagcgccgccttctacgtgagaaccgaggtgaactacaccgaggaggtggaggaccccgtggacagcgacggcgaggtgctgggcttcgagaacctggtgttcagcatcttcgagttcgtgcacgccctgctggagaacagcaagttcaagagcaccgtgaagaaggccctgcccgagctgatctactacatcatcctgtacatgcagatcaccgaggagcagatcaaggtgtggaccgccaacccccagcagttcgtggaggacgaggacgacgacaccttcagctacaccgtgagaatcgccgcccaggacctgctgctggccgtggccaccgacttccagaacgagagcgccgccgccctggccgccgccgccaccagacacctgcaggaggccgagcagaccaagaacagcggcaccgagcactggtggaagatccacgaggcctgcatgctggccctgggcagcgtgaaggccatcatcaccgacagcgtgaagaacggcagaatccacttcgacatgcacggcttcctgaccaacgtgatcctggccgacctgaacctgagcgtgagccccttcctgctgggcagagccctgtgggccgccagcagattcaccgtggccatgagccccgagctgatccagcagttcctgcaggccaccgtgagcggcctgcacgagacccagccccccagcgtgagaatcagcgccgtgagagccatctggggctactgcgaccagctgaaggtgagcgagagcacccacgtgctgcagcccttcctgcccagcatcctggacggcctgatccacctggccgcccagttcagcagcgaggtgctgaacctggtgatggagaccctgtgcatcgtgtgcaccgtggaccccgagttcaccgccagcatggagagcaagatctgccccttcaccatcgccatcttcctgaagtacagcaacgaccccgtggtggccagcctggcccaggacatcttcaaggagctgagccagatcgaggcctgccagggccccatgcagatgagactgatccccaccctggtgagcatcatgcaggcccccgccgacaagatccccgccggcctgtgcgccaccgccatcgacatcctgaccaccgtggtgagaaacaccaagccccccctgagccagctgctgatctgccaggccttccccgccgtggcccagtgcaccctgcacaccgacgacaacgccaccatgcagaacggcggcgagtgcctgagagcctacgtgagcgtgaccctggagcaggtggcccagtggcacgacgagcagggccacaacggcctgtggtacgtgatgcaggtggtgagccagctgctggaccccagaaccagcgagttcaccgccgccttcgtgggcagactggtgagcaccctgatcagcaaggccggcagagagctgggcgagaacctggaccagatcctgagagccatcctgagcaagatgcagcaggccgagaccctgagcgtgatgcagagcctgatcatggtgttcgcccacctggtgcacacccagctggagcccctgctggagttcctgtgcagcctgcccggccccaccggcaagcccgccctggagttcgtgatggccgagtggaccagcagacagcacctgttctacggccagtacgagggcaaggtgagcagcgtggccctgtgcaagctgctgcagcacggcatcaacgccgacgacaagagactgcaggacatcagagtgaagggcgaggagatctacagcatggacgagggcatcagaaccagaagcaagagcgccaagaaccccgagagatggaccaacatccccctgctggtgaagatcctgaagctgatcatcaacgagctgagcaacgtgatggaggccaacgccgccagacaggccacccccgccgagtggagccaggacgacagcaacgacatgtgggaggaccaggaggaggaggaggaggaggaggaggacggcctggccggccagctgctgagcgacatcctggccaccagcaagtacgaggaggactactacgaggacgacgaggaggacgaccccgacgccctgaaggaccccctgtaccagatcgacctgcaggcctacctgaccgacttcctgtgccagttcgcccagcagccctgctacatcatgttcagcggccacctgaacgacaacgagagaagagtgctgcagaccatcggcatctag

SEQ ID NO: 10566 - DNA, 156 bp, Artificial Sequence
  Description of Artificial Sequence: Synthetic coding sequence
atgagcagccacaagaccttcagaatcaagagattcctggccaagaagcagaagcagaacagacccatcccccagtggatcagaatgaagaccggcaacaagatcagatacaacagcaagagaagacactggagaagaaccaagctgggcctgtag

SEQ ID NO: 10567 - DNA, 3627 bp, Artificial Sequence
  Description of Artificial Sequence: Synthetic coding sequence
atggacagcctgcccgacgagttcttcgtgagacaccccgccgtggaggaccagagaaaggaggagaccgagaacaagctggagaagagcagcggccagctgaacaagcaggagaacgacatccccaccgacctggtgcccgtgaacctgctgctggaggtgaagaagctgctgaacgccatcaacaccctgcccaagggcgtggtgccccacatcaagaagttcctgcaggaggacttcagcttccagaccatgcagagagaggtggccgccaacagccagaacggcgaggagatcgtgcccgccctgaccctgagattcctgatcacccagctggaggccgccctgagaaacatccaggccggcaactacaccgcccaccagatcaacatcggctactacctgaccctgctgttcctgtacggcgtggccctgaccgagagaggcaagaaggaggactacaccgaggccgagaacaagttcctggtgatgaagatgatgatccaggagaacgagatctgcgagaacttcatgagcctggtgtacttcggcagaggcctgctgagatgcgcccagaagagatacaacggcggcctgctggagttccacaagagcctgcaggagatcggcgacaagaacgaccactggttcgacatcgaccccaccgaggacgaggacctgcccaccaccttcaaggacctgctgaacaacttcatcaagaccaccgagagcaacatcatgaagcagaccatctgcagctacctggactgcgagagaagctgcgaggccgacatcctgaagaacaccagctacaagggcttcttccagctgatgtgcagcaagagctgctgcgtgtacttccacaagatctgctggaagaagttcaagaacctgaagtaccccggcgagaacgaccagagcttcagcggcaagaagtgcctgaaggagggctgcaccggcgacatggtgagaatgctgcagtgcgacgtgcccggcatcgtgaagatcctgttcgaggtggtgagaaaggacgagtacatcaccatcgagaacctgggcgccagctacagaaagctgatcagcctgaagatcaccgacaccgacatcagacccaagatcagcctgaagttcaacaccaaggacgagatgcccatcttcaagctggactacaactacttctaccacctgctgcacatcatcatcatcagcggcaccgacatcgtgagacagatcttcgacgaggccatgcccccccccctgctgaagaaggagctgctgatccacaagaacgtgctggagagctactacaaccacctgtggaccaaccaccccctgggcggcagctggcacctgctgtacccccccaacaaggagctgccccagagcaagcagttcgacctgtgcctgctgctggccctgatcaagcacctgaacgtgttccccgcccccaagaagggctggaacatggagccccccagcagcgacatcagcaagagcgccgacatcctgagactgtgcaagtacagagacatcctgctgagcgagatcctgatgaacggcctgaccgagagccagttcaacagcatctggaagaaggtgagcgacatcctgctgagactgggcatgatgcaggaggacatcgacaaggtgaaggagaaccccatcgagaacatcagcctggactaccaccagctgagcgtgtacctgggcatccccgtgcccgagatcatccagagaatgctgagctgctaccagcagggcatcgccctgcagagcatcaccggcagccagagaatcgagatcgaggagctgcagaacgaggaggaggagctgagcccccccctgatggagtacaacatcaacgtgaagagccaccccgagatccagttcgccgagatcaacaaggacggcaccagcatccccagcgagagcagcaccgagagcctgaaggacctgcaggaggtgaagagcaagcagagaaagaagaagaagaccaagaacaagaagaacaaggacagcaaggaggaccaggtgccctacgtggtggagaaggaggagcagctgagaaaggagcaggccaacccccacagcgtgagcagactgatcaaggacgacgccagcgacgtgcaggaggacagcgccatggaggacaagttctacagcctggacgagctgcacatcctggacatgatcgagcagggcagcgccggcaaggtgaccaccgactacggcgagaccgagaaggagagactggccagacagagacagctgtacaagctgcactaccagtgcgaggacttcaagagacagctgagaaccgtgaccttcagatggcaggagaaccagatgcagatcaagaagaaggacaagatcatcgccagcctgaaccagcaggtggccttcggcatcaacaaggtgagcaagctgcagagacagatccacgccaaggacaacgagatcaagaacctgaaggagcagctgagcatgaagagaagccagtgggagatggagaagcacaacctggagagcaccatgaagacctacgtgagcaagctgaacgccgagaccagcagagccctgaccgccgaggtgtacttcctgcagtgcagaagagacttcggcctgctgcacctggagcagaccgagaaggagtgcctgaaccagctggccagagtgacccacatggccgccagcaacctggagagcctgcagctgaaggccgccgtggacagctggaacgccatcgtggccgacgtgagaaacaagatcgccttcctgagaacccagtacaacgagcagatcaacaaggtgaagcagggcttcgccctgagcaccctgccccccgtgcagctgcccccccccccccccagccccgagatcctgatgcagcagttcctgggcagacccctggtgaaggagagcttcttcagacccatcctgaccgtgccccagatgcccgccgtgtgccccggcgtggtgagcgccaccggccagcccagagcccccctgatgaccggcatcgcctgggccctgcccgcccccgtgggcgacgccgtgccccccagcgccggcctgagaagcgaccccagcatcatgaactgggagagaatcaccgacagactgaagaccgccttcccccagcagaccagaaaggagctgaccgacttcctgagaaagctgaaggacgcctacggcaagagcctgagcgagctgaccttcgacgagatcgtgtgcaagatcagccagttcatcgaccccaagaagagccagagccagggcaagagcgtgagcaacgtgaactgcgtgagccccagccacagccccagccagcccgacgccgcccagccccccaagcccgcctggagacccctgaccagccagggccccgccacctgggagggcgccagcaaccccgacgaggaggaggaggaggaggagccctgcgtgatctgccacgagaacctgagccccgagaacctgagcgtgctgccctgcgcccacaagttccacgcccagtgcatcagaccctggctgatgcagcagggcacctgccccacctgcagactgcacgtgctgctgcccgaggagttccccggccaccccagcagacagctgcccaagatctag

SEQ ID NO: 10568 - DNA, 996 bp, Artificial Sequence
  Description of Artificial Sequence: Synthetic coding sequence
atgagcagacagctgagcagagccagacccgccaccgtgctgggcgccatggagatgggcagaagaatggacgcccccaccagcgccgccgtgaccagagccttcctggagagaggccacaccgagatcgacaccgccttcgtgtacagcgagggccagagcgagaccatcctgggcggcctgggcctgagactgggcggcagcgactgcagagtgaagatcgacaccaaggccatccccctgttcggcaacagcctgaagcccgacagcctgagattccagctggagaccagcctgaagagactgcagtgccccagagtggacctgttctacctgcacatgcccgaccacagcacccccgtggaggagaccctgagagcctgccaccagctgcaccaggagggcaagttcgtggagctgggcctgagcaactacgccgcctgggaggtggccgagatctgcaccctgtgcaagagcaacggctggatcctgcccaccgtgtaccagggcatgtacaacgccatcaccagacaggtggagaccgagctgttcccctgcctgagacacttcggcctgagattctacgccttcaaccccctggccggcggcctgctgaccggcaagtacaagtacgaggacaagaacggcaagcagcccgtgggcagattcttcggcaacacctgggccgagatgtacagaaacagatactggaaggagcaccacttcgagggcatcgccctggtggagaaggccctgcaggccgcctacggcgccagcgcccccagcatgaccagcgccaccctgagatggatgtaccaccacagccagctgcagggcgcccacggcgacgccgtgatcctgggcatgagcagcctggagcagctggagcagaacctggccgccgccgaggagggccccctggagcccgccgtggtggacgccttcaaccaggcctggcacctggtgacccacgagtgccccaactacttcagatag

SEQ ID NO: 10569 - DNA, 1131 bp, Artificial Sequence
  Description of Artificial Sequence: Synthetic coding sequence
atgagccccgaggtggccctgaacagaatcagccccatgctgagccccttcatcagcagcgtggtgagaaacggcaaggtgggcctggacgccaccaactgcctgagaatcaccgacctgaagagcggctgcaccagcctgacccccggccccaactgcgacagattcaagctgcacatcccctacgccggcgagaccctgaagtgggacatcatcttcaacgcccagtaccccgagctgccccccgacttcatcttcggcgaggacgccgagttcctgcccgaccccagcgccctgcagaacctggccagctggaaccccagcaaccccgagtgcctgctgctggtggtgaaggagctggtgcagcagtaccaccagttccagtgcagcagactgagagagagcagcagactgatgttcgagtaccagaccctgctggaggagccccagtacggcgagaacatggagatctacgccggcaagaagaacaactggaccggcgagttcagcgccagattcctgctgaagctgcccgtggacttcagcaacatccccacctacctgctgaaggacgtgaacgaggaccccggcgaggacgtggccctgctgagcgtgagcttcgaggacaccgaggccacccaggtgtaccccaagctgtacctgagccccagaatcgagcacgccctgggcggcagcagcgccctgcacatccccgccttccccggcggcggctgcctgatcgactacgtgccccaggtgtgccacctgctgaccaacaaggtgcagtacgtgatccagggctaccacaagagaagagagtacatcgccgccttcctgagccacttcggcaccggcgtggtggagtacgacgccgagggcttcaccaagctgaccctgctgctgatgtggaaggacttctgcttcctggtgcacatcgacctgcccctgttcttccccagagaccagcccaccctgaccttccagagcgtgtaccacttcaccaacagcggccagctgtacagccaggcccagaagaactacccctacagccccagatgggacggcaacgagatggccaagagagccaagagagagagcaacagagacggcgaggagagcagcagcgcctag

SEQ ID NO: 10570 - DNA, 1881 bp, Artificial Sequence
  Description of Artificial Sequence: Synthetic coding sequence
atggacgagcaggaggccctgaacagcatcatgaacgacctggtggccctgcagatgaacagaagacacagaatgcccggctacgagaccatgaagaacaaggacaccggccacagcaacagacagagcgacgtgagaatcaagttcgagcacaacggcgagagaagaatcatcgccttcagcagacccgtgaagtacgaggacgtggagcacaaggtgaccaccgtgttcggccagcccctggacctgcactacatgaacaacgagctgagcatcctgctgaagaaccaggacgacctggacaaggccatcgacatcctggacagaagcagcagcatgaagagcctgagaatcctgctgctgagccaggacagaaaccacaacagcagcagcccccacagcggcgtgagcagacaggtgagaatcaaggccagccagagcgccggcgacatcaacaccatctaccagccccccgagcccagaagcagacacctgagcgtgagcagccagaaccccggcagaagcagccccccccccggctacgtgcccgagagacagcagcacatcgccagacagggcagctacaccagcatcaacagcgagggcgagttcatccccgagaccagcgagcagtgcatgctggaccccctgagcagcgccgagaacagcctgagcggcagctgccagagcctggacagaagcgccgacagccccagcttcagaaagagcagaatgagcagagcccagagcttccccgacaacagacaggagtacagcgacagagagacccagctgtacgacaagggcgtgaagggcggcacctaccccagaagataccacgtgagcgtgcaccacaaggactacagcgacggcagaagaaccttccccagaatcagaagacaccagggcaacctgttcaccctggtgcccagcagcagaagcctgagcaccaacggcgagaacatgggcctggccgtgcagtacctggaccccagaggcagactgagaagcgccgacagcgagaacgccctgagcgtgcaggagagaaacgtgcccaccaagagccccagcgcccccatcaactggagaagaggcaagctgctgggccagggcgccttcggcagagtgtacctgtgctacgacgtggacaccggcagagagctggccagcaagcaggtgcagttcgaccccgacagccccgagaccagcaaggaggtgagcgccctggagtgcgagatccagctgctgaagaacctgcagcacgagagaatcgtgcagtactacggctgcctgagagacagagccgagaagaccctgaccatcttcatggagtacatgcccggcggcagcgtgaaggaccagctgaaggcctacggcgccctgaccgagagcgtgaccagaaagtacaccagacagatcctggagggcatgagctacctgcacagcaacatgatcgtgcacagagacatcaagggcgccaacatcctgagagacagcgccggcaacgtgaagctgggcgacttcggcgccagcaagagactgcagaccatctgcatgagcggcaccggcatgagaagcgtgaccggcaccccctactggatgagccccgaggtgatcagcggcgagggctacggcagaaaggccgacgtgtggagcctgggctgcaccgtggtggagatgctgaccgagaagcccccctgggccgagtacgaggccatggccgccatcttcaagatcgccacccagcccaccaacccccagctgcccagccacatcagcgagcacggcagagacttcctgagaagaatcttcgtggaggccagacagagacccagcgccgaggagctgctgacccaccacttcgcccagctgatgtactag

SEQ ID NO: 10571 - DNA, 1701 bp, Artificial Sequence; identical to SEQ ID NO: 10391
  Description of Artificial Sequence: Synthetic coding sequence

SEQ ID NO: 10572 - DNA, 456 bp, Artificial Sequence
  Description of Artificial Sequence: Synthetic coding sequence
atggagggctgcgtgagcaacctgatggtgtgcaacctggcctacagcggcaagctggaggagctgaaggagagcatcctggccgacaagagcctggccaccagaaccgaccaggacagcagaaccgccctgcactgggcctgcagcgccggccacaccgagatcgtggagttcctgctgcagctgggcgtgcccgtgaacgacaaggacgacgccggctggagccccctgcacatcgccgccagcgccggcagagacgagatcgtgaaggccctgctgggcaagggcgcccaggtgaacgccgtgaaccagaacggctgcacccccctgcactacgccgccagcaagaacagacacgagatcgccgtgatgctgctggagggcggcgccaaccccgacgccaaggaccactacgaggccaccgccatgcacagagccgccgccaaggacacctag

SEQ ID NO: 10573 - DNA, 2220 bp, Artificial Sequence; identical to SEQ ID NO: 10489
  Description of Artificial Sequence: Synthetic coding sequence

SEQ ID NO: 10574 - DNA, 1692 bp, Artificial Sequence
  Description of Artificial Sequence: Synthetic coding sequence
atgagcagacccagcagcagagccatctacctgcacagaaaggagtacagccagaacctgaccagcgagcccaccctgctgcagcacagagtggagcacctgatgacctgcaagcagggcagccagagagtgcagggccccgaggacgccctgcagaagctgttcgagatggacgcccagggcagagtgtggagccaggacctgatcctgcaggtgagagacggctggctgcagctgctggacatcgagaccaaggaggagctggacagctacagactggacagcatccaggccatgaacgtggccctgaacacctgcagctacaacagcatcctgagcatcaccgtgcaggagcccggcctgcccggcaccagcaccctgctgttccagtgccaggaggtgggcgccgagagactgaagaccagcctgcagaaggccctggaggaggagctggagcagagacccagactgggcggcctgcagcccggccaggacagatggagaggccccgccatggagagacccctgcccatggagcaggccagatacctggagcccggcatcccccccgagcagccccaccagagaaccctggagcacagcctgccccccagccccagacccctgcccagacacaccagcgccagagagcccagcgccttcaccctgcccccccccagaagaagcagcagccccgaggaccccgagagagacgaggaggtgctgaaccacgtgctgagagacatcgagctgttcatgggcaagctggagaaggcccaggccaagaccagcagaaagaagaagttcggcaagaagaacaaggaccagggcggcctgacccaggcccagtacatcgactgcttccagaagatcaagcacagcttcaacctgctgggcagactggccacctggctgaaggagaccagcgcccccgagctggtgcacatcctgttcaagagcctgaacttcatcctggccagatgccccgaggccggcctggccgcccaggtgatcagccccctgctgacccccaaggccatcaacctgctgcagagctgcctgagcccccccgagagcaacctgtggatgggcctgggccccgcctggaccaccagcagagccgactggaccggcgacgagcccctgccctaccagcccaccttcagcgacgactggcagctgcccgagcccagcagccaggcccccctgggctaccaggaccccgtgagcctgagacccagcagccccaagcccgcccagcccgccctgaagatgcaggtgctgtacgagttcgaggccagaaaccccagagagctgaccgtggtgcagggcgagaagctggaggtgctggaccacagcaagagatggtggctggtgaagaacgaggccggcagaagcggctacatccccagcaacatcctggagcccctgcagcccggcacccccggcacccagggccagagccccagcagagtgcccatgctgagactgagcagcagacccgaggaggtgaccgactggctgcaggccgagaacttcagcaccgccaccgtgagaaccctgggcagcctgaccggcagccagctgctgagaatcagacccggcgagctgcagatgctgtgcccccaggaggcccccagaatcctgagcagactggaggccgtgagaagaatgctgggcatcagcccctag

SEQ ID NO: 10575 - DNA, 525 bp, Artificial Sequence
  Description of Artificial Sequence: Synthetic coding sequence
atgacctgctgccagaccagcttctgcggctaccccagcttcagcatcagcggcacctgcggcagcagctgctgccagcccagctgctgcgagaccagctgctgccagcccagaagctgccagaccagcttctgcggcttccccagcttcagcaccagcggcacctgcagcagcagctgctgccagcccagctgctgcgagaccagctgctgccagcccagctgctgcgagaccagctgctgccagcccagctgctgccagatcagcagctgcggcaccggctgcggcatcggcggcggcatcagctacggccaggagggcagcagcggcgccgtgagcaccagaatcagatggtgcagacccgacagcagagtggagggcacctacctgcccccctgctgcgtggtgagctgcaccccccccagctgctgccagctgcaccacgcccaggccagctgctgcagacccagctactgcggccagagctgctgcagacccgtgtgctgctgcgagcccacctgctag

SEQ ID NO: 10576 - DNA, 1173 bp, Artificial Sequence
  Description of Artificial Sequence: Synthetic coding sequence
atgagaggcgacagaggcagaggcagaggcggcagattcggcagcagaggcggccccggcggcggcttcagacccttcgtgccccacatccccttcgacttctacctgtgcgagatggccttccccagagtgaagcccgcccccgacgagaccagcttcagcgaggccctgctgaagagaaaccaggacctggcccccaacagcgccgagcaggccagcatcctgagcctggtgaccaagatcaacaacgtgatcgacaacctgatcgtggcccccggcaccttcgaggtgcagatcgaggaggtgagacaggtgggcagctacaagaagggcaccatgaccaccggccacaacgtggccgacctggtggtgatcctgaagatcctgcccaccctggaggccgtggccgccctgggcaacaaggtggtggagagcctgagagcccaggaccccagcgaggtgctgaccatgctgaccaacgagaccggcttcgagatcagcagcagcgacgccaccgtgaagatcctgatcaccaccgtgccccccaacctgagaaagctggaccccgagctgcacctggacatcaaggtgctgcagagcgccctggccgccatcagacacgccagatggttcgaggagaacgccagccagagcaccgtgaaggtgctgatcagactgctgaaggacctgagaatcagattccccggcttcgagcccctgaccccctggatcctggacctgctgggccactacgccgtgatgaacaaccccaccagacagcccctggccctgaacgtggcctacagaagatgcctgcagatcctggccgccggcctgttcctgcccggcagcgtgggcatcaccgacccctgcgagagcggcaacttcagagtgcacaccgtgatgaccctggagcagcaggacatggtgtgctacaccgcccagaccctggtgagaatcctgagccacggcggcttcagaaagatcctgggccaggagggcgacgccagctacctggccagcgagatcagcacctgggacggcgtgatcgtgacccccagcgagaaggcctacgagaagccccccgagaagaaggagggcgaggaggaggaggagaacaccgaggagcccccccagggcgaggaggaggagagcatggagacccaggagtag

SEQ ID NO: 10577 - DNA, 3606 bp, Artificial Sequence
  Description of Artificial Sequence: Synthetic coding sequence
atgcccagaggcgaggcccccggccccggcagaagaggcgccaaggacgaggccctgggcgaggagagcggcgagagatggagccccgagttccacctgcagagaaagctggccgacagcagccacagcgagcagcaggacagaaacagagtgagcgaggagctgatcatggtggtgcaggagatgaagaagtacttccccagcgagagaagaaacaagcccagcaccctggacgccctgaactacgccctgagatgcgtgcacagcgtgcaggccaacagcgagttcttccagatcctgagccagaacggcgccccccaggccgacgtgagcatgtacagcctggaggagctggccaccatcgccagcgagcacaccagcaagaacaccgacaccttcgtggccgtgttcagcttcctgagcggcagactggtgcacatcagcgagcaggccgccctgatcctgaacagaaagaaggacgtgctggccagcagccacttcgtggacctgctggccccccaggacatgagagtgttctacgcccacaccgccagagcccagctgcccttctggaacaactggacccagagagccgccagatacgagtgcgcccccgtgaagcccttcttctgcagaatcagaggcggcgaggacagaaagcaggagaagtgccacagccccttcagaatcatcccctacctgatccacgtgcaccaccccgcccagcccgagctggagagcgagccctgctgcctgaccgtggtggagaagatccacagcggctacgaggcccccagaatccccgtgaacaagagaatcttcaccaccacccacacccccggctgcgtgttcctggaggtggacgagaaggccgtgcccctgctgggctacctgccccaggacctgatcggcaccagcatcctgagctacctgcaccccgaggacagaagcctgatggtggccatccaccagaaggtgctgaagtacgccggccacccccccttcgagcacagccccatcagattctgcacccagaacggcgactacatcatcctggacagcagctggagcagcttcgtgaacccctggagcagaaagatcagcttcatcatcggcagacacaaggtgagaaccagccccctgaacgaggacgtgttcgccaccaagatcaagaagatgaacgacaacgacaaggacatcaccgagctgcaggagcagatctacaagctgctgctgcagcccgtgcacgtgagcgtgagcagcggctacggcagcctgggcagcagcggcagccaggagcagctggtgagcatcgccagcagcagcgaggccagcggccacagagtggaggagaccaaggccgagcagatgaccctgcagcaggtgtacgccagcgtgaacaagatcaagaacctgggccagcagctgtacatcgagagcatgaccaagagcagcttcaagcccgtgaccggcaccagaaccgagcccaacggcggcggcgagtgcaagaccttcaccagcttccaccagaccctgaagaacaacagcgtgtacaccgagccctgcgaggacctgagaaacgacgagcacagccccagctaccagcagatcaactgcatcgacagcgtgatcagatacctgaagagctacaacatccccgccctgaagagaaagtgcatcagctgcaccaacaccaccagcagcagcagcgaggaggacaagcagaaccacaaggccgacgacgtgcaggccctgcaggccggcctgcagatccccgccatccccaagagcgagatgcccaccaacggcagaagcatcgacaccggcggcggcgccccccagatcctgagcaccgccatgctgagcctgggcagcggcatcagccagtgcggctacagcagcaccatcgtgcacgtgcccccccccgagaccgccagagacgccaccctgttctgcgagccctggaccctgaacatgcagcccgcccccctgaccagcgaggagttcaagcacgtgggcctgaccgccgccgtgctgagcgcccacacccagaaggaggagcagaactacgtggacaagttcagagagaagatcctgagcagcccctacagcagctacctgcagcaggagagcagaagcaaggccaagtacagctacttccagggcgacagcaccagcaagcagaccagaagcgccggctgcagaaagggcaagcacaagagaaagaagctgcccgagccccccgacagcagcagcagcaacaccggcagcggccccagaagaggcgcccaccagaacgcccagccctgctgccccagcgccgccagcagcccccacaccagcagccccaccttcccccccgccgccatggtgcccagccaggccccctacctggtgcccgccttccccctgcccgccgccaccagccccggcagagagtacgccgcccccggcaccgcccccgagggcctgcacggcctgcccctgagcgagggcctgcagccctaccccgccttccccttcccctacctggacaccttcatgaccgtgttcctgcccgacccccccgtgtgccccctgctgagccccagcttcctgccctgccccttcctgggcgccaccgccagcagcgccatcagccccagcatgagcagcgccatgagccccaccctggaccccccccccagcgtgaccagccagagaagagaggaggagaagtgggaggcccagagcgagggccaccccttcatcaccagcagaagcagcagccccctgcagctgaacctgctgcaggaggagatgcccagacccagcgagagccccgaccagatgagaagaaacacctgcccccagaccgagtactgcgtgaccggcaacaacggcagcgagagcagccccgccaccaccggcgccctgagcaccggcagcccccccagagagaaccccagccaccccaccgccagcgccctgagcaccggcagcccccccatgaagaaccccagccaccccaccgccagcgccctgagcaccggcagcccccccatgaagaaccccagccaccccaccgccagcaccctgagcatgggcctgccccccagcagaacccccagccaccccaccgccaccgtgctgagcaccggcagcccccccagcgagagccccagcagaaccggcagcgccgccagcggcagcagcgacagcagcatctacctgaccagcagcgtgtacagcagcaagatcagccagaacggccagcagagccaggacgtgcagaagaaggagaccttccccaacgtggccgaggagcccatctggagaatgatcagacagacccccgagagaatcctgatgacctaccaggtgcccgagagagtgaaggaggtggtgctgaaggaggacctggagaagctggagagcatgagacagcagcagccccagttcagccacggccagaaggaggagctggccaaggtgtacaactggatccagagccagaccgtgacccaggagatcgacatccaggcctgcgtgacctgcgagaacgaggacagcgccgacggcgccgccaccagctgcggccaggtgctggtggaggacagctgctag

SEQ ID NO: 10578 - DNA, 1296 bp, Artificial Sequence
  Description of Artificial Sequence: Synthetic coding sequence
atgagcgaccagatcaagttcatcatggacagcctgaacaaggagcccttcagaaagaactacaacctgatcaccttcgacagcctggagcccatgcagctgctgcaggtgctgagcgacgtgctggccgagatcgaccccaagcagctggtggacatcagagaggagatgcccgagcagaccgccaagagaatgctgagcctgctgggcatcctgaagtacaagcccagcggcaacgccaccgacatgagcaccttcagacagggcctggtgatcggcagcaagcccgtgatctaccccgtgctgcactggctgctgcagagaaccaacgagctgaagaagagagcctacctggccagattcctgatcaagctggaggtgcccagcgagttcctgcaggacgagaccgtggccgacaccaacaagcagtacgaggagctgatggaggccttcaagaccctgcacaaggagtacgagcagctgaagatcagcggcttcagcaccgccgagatcagaaaggacatcagcgccatggaggaggagaaggaccagctgatcaagagagtggagcacctgaagaagagagtggagaccgcccagaaccaccagtggatgctgaagatcgccagacagctgagagtggagaaggagagagaggagtacctggcccagcagaagcaggagcagaagaaccagctgttccacgccgtgcagagactgcagagagtgcagaaccagctgaagagcatgagacaggccgccgccgacgccaagcccgagagcctgatgaagagactggaggaggagatcaagttcaacctgtacatggtgaccgagaagttccccaaggagctggagaacaagaagaaggagctgcacttcctgcagaaggtggtgagcgagcccgccatgggccacagcgacctgctggagctggagagcaagatcaacgagatcaacaccgagatcaaccagctgatcgagaagaagatgatgagaaacgagcccatcgagggcaagctgagcctgtacagacagcaggccagcatcatcagcagaaagaaggaggccaaggccgaggagctgcaggaggccaaggagaagctggccagcctggagagagaggccagcgtgaagagaaaccagaccagagagttcgacggcaccgaggtgctgaagggcgacgagagacaggacctgaccctgagccccagactggagtgcggcggcgtgatcatggcctactgcagcctgaagctgctgggcagcagcgacccccccaccagcgccagctag

SEQ ID NO: 10579 - DNA, 1119 bp, Artificial Sequence
  Description of Artificial Sequence: Synthetic coding sequence
atggccagcagcgccagcgccagaacccccgccggcaagagagtgatcaaccaggaggagctgagaagactgatgaaggagaagcagagactgagcaccagcagaaagagaatcgagagccccttcgccaagtacaacagactgggccagctgagctgcgccctgtgcaacacccccgtgaagagcgagctgctgtggcagacccacgtgctgggcaagcagcacagagagaaggtggccgagctgaagggcgccaaggaggccagccagggcagcagcgccagcagcgccccccacagcgtgaagagaaaggcccccgacgccgacgaccaggacgtgaagagagccaaggccaccctggtgccccaggtgcagcccagcaccagcgcctggaccaccaacttcgacaagatcggcaaggagttcatcagagccacccccagcaagcccagcggcctgagcctgctgcccgactacgaggacgaggaggaggaggaggaggaggaggagggcgacggcgagagaaagagaggcgacgccagcaagcccctgagcgacgcccagggcaaggagcacagcgtgagcagcagcagagaggtgaccagcagcgtgctgcccaacgacttcttcagcaccaacccccccaaggcccccatcatcccccacagcggcagcatcgagaaggccgagatccacgagaaggtggtggagagaagagagaacaccgccgaggccctgcccgagggcttcttcgacgaccccgaggtggacgccagagtgagaaaggtggacgcccccaaggaccagatggacaaggagtgggacgagttccagaaggccatgagacaggtgaacaccatcagcgaggccatcgtggccgaggaggacgaggagggcagactggacagacagatcggcgagatcgacgagcagatcgagtgctacagaagagtggagaagctgagaaacagacaggacgagatcaagaacaagctgaaggagatcctgaccatcaaggagctgcagaagaaggaggaggagaacgccgacagcgacgacgagggcgagctgcaggacctgctgagccaggactggagagtgaagggcgccctgctgtag

SEQ ID NO: 10580 - DNA, 1782 bp, Artificial Sequence
  Description of Artificial Sequence: Synthetic coding sequence
atgagcagacccagcagcagagccatctacctgcacagaaaggagtacagccagaacctgaccagcgagcccaccctgctgcagcacagagtggagcacctgatgacctgcaagcagggcagccagagagtgcagggccccgaggacgccctgcagaagctgttcgagatggacgcccagggcagagtgtggagccaggacctgatcctgcaggtgagagacggctggctgcagctgctggacatcgagaccaaggaggagctggacagctacagactggacagcatccaggccatgaacgtggccctgaacacctgcagctacaacagcatcctgagcatcaccgtgcaggagcccggcctgcccggcaccagcaccctgctgttccagtgccaggaggtgggcgccgagagactgaagaccagcctgcagaaggccctggaggaggagctggagcagagacccagactgggcggcctgcagcccggccaggacagatggagaggccccgccatggagagacccctgcccatggagcaggccagatacctggagcccggcatcccccccgagcagccccaccagagaaccctggagcacagcctgccccccagccccagacccctgcccagacacaccagcgccagagagcccagcgccttcaccctgcccccccccagaagaagcagcagccccgaggaccccgagagagacgaggaggtgctgaaccacgtgctgagagacatcgagctgttcatgggcaagctggagaaggcccaggccaagaccagcagaaagaagaagttcggcaagaagaacaaggaccagggcggcctgacccaggcccagtacatcgactgcttccagaagatcaagcacagcttcaacctgctgggcagactggccacctggctgaaggagaccagcgcccccgagctggtgcacatcctgttcaagagcctgaacttcatcctggccagatgccccgaggccggcctggccgcccaggtgatcagccccctgctgacccccaaggccatcaacctgctgcagagctgcctgagcccccccgagagcaacctgtggatgggcctgggccccgcctggaccaccagcagagccgactggaccggcgacgagcccctgccctaccagcccaccttcagcgacgactggcagctgcccgagcccagcagccaggcccccctgggctaccaggaccccgtgagcctgagaagaggcagccacagactgggcagcaccagccacttcccccaggagaagacccacaaccacgacccccagcccggcgaccccaacagcagacccagcagccccaagcccgcccagcccgccctgaagatgcaggtgctgtacgagttcgaggccagaaaccccagagagctgaccgtggtgcagggcgagaagctggaggtgctggaccacagcaagagatggtggctggtgaagaacgaggccggcagaagcggctacatccccagcaacatcctggagcccctgcagcccggcacccccggcacccagggccagagccccagcagagtgcccatgctgagactgagcagcagacccgaggaggtgaccgactggctgcaggccgagaacttcagcaccgccaccgtgagaaccctgggcagcctgaccggcagccagctgctgagaatcagacccggcgagctgcagatgctgtgcccccaggaggcccccagaatcctgagcagactggaggccgtgagaagaatgctgggcatcagcccctag

SEQ ID NO: 10581 - DNA, 1050 bp, Artificial Sequence
  Description of Artificial Sequence: Synthetic coding sequence
atgaagctgaccagcgagaagctgcccaagaaccccttctacgccagcgtgagccagtacgccgccaagaaccagaagttcttccagtggaagaaggagaagaccgagagcgactacacccacgccaacctggtggacaaggccctgcagctgctgaaggagagaatcctgaagggcgacaccctggcctacttcctgagaggccagctgtacttcgaggagggctggtacgaggaggccctggagcagttcgaggagatcaaggagaaggaccaccaggccacctaccagctgggcgtgatgtactacgacggcctgggcaccaccctggacgccgagaagggcgtggactacatgaagaagatcctggacagcccctgccccaaggccagacacctgaagttcgccgccgcctacaacctgggcagagcctactacgagggcaagggcgtgaagagaagcaacgaggaggccgagagactgtggctgatcgccgccgacaacggcaaccccaaggccagcgtgaaggcccagagcatgctgggcctgtactacagcaccaaggagcccaaggagctggagaaggccttctactggcacagcgaggcctgcggcaacggcaacctggagagccagggcgccctgggcctgatgtacctgtacggccagggcatcagacaggacaccgaggccgccctgcagtgcctgagagaggccgccgagagaggcaacgtgtacgcccagggcaacctggtggagtactactacaagatgaagttcttcaccaagtgcgtggccttcagcaagagaatcgccgactacgacgaggtgcacgacatccccatgatcgcccaggtgaccgactgcctgcccgagttcatcggcagaggcatggccatggccagcttctaccacgccagatgcctgcagctgggcctgggcatcaccagagacgagaccaccgccaagcactactacagcaaggcctgcagactgaaccccgccctggccgacgagctgcacagcctgctgatcagacagagaatctag

SEQ ID NO: 10582 - DNA, 1236 bp, Artificial Sequence
  Description of Artificial Sequence: Synthetic coding sequence
atgggcctgaagaagatgaagggcctgagctacgacgaggccttcgccatggccaacgaccccctggagggcttccacgaggtgaacctggccagccccaccagccccgacctgctgggcgtgtacgagagcggcacccaggagcagaccaccagccccagcgtgatctacagaccccaccccagcgccctgagcagcgtgcccatccaggccaacgccctggacgtgagcgagctgcccacccagcccgtgtacagcagccccagaagactgaactgcgccgagatcagcagcatcagcttccacgtgaccgaccccgccccctgcagcaccagcggcgtgaccgccggcctgaccaagctgaccaccagaaaggacaactacaacgccgagagagagttcctgcagggcgccaccatcaccgaggcctgcgacggcagcgacgacatcttcggcctgagcaccgacagcctgagcagactgagaagccccagcgtgctggaggtgagagagaagggctacgagagactgaaggaggagctggccaaggcccagagagagctgaagctgaaggacgaggagtgcgagagactgagcaaggtgagagaccagctgggccaggagctggaggagctgaccgccagcctgttcgaggaggcccacaagatggtgagagaggccaacatcaagcaggccaccgccgagaagcagctgaaggaggcccagggcaagatcgacgtgctgcaggccgaggtggccgccctgaagaccctggtgctgagcagcagccccaccagccccacccaggagcccctgcccggcggcaagacccccttcaagaagggccacaccagaaacaagagcaccagcagcgccatgagcggcagccaccaggacctgagcgtgatccagcccatcgtgaaggactgcaaggaggccgacctgagcctgtacaacgagttcagactgtggaaggacgagcccaccatggacagaacctgccccttcctggacaagatctaccaggaggacatcttcccctgcctgaccttcagcaagagcgagctggccagcgccgtgctggaggccgtggagaacaacaccctgagcatcgagcccgtgggcctgcagcccatcagattcgtgaaggccagcgccgtggagtgcggcggccccaagagcctgctgtacgtgaccttcctgcacaccttcgacaccttcagcagagacagctag

SEQ ID NO: 10583 - DNA, 2148 bp, Artificial Sequence
  Description of Artificial Sequence: Synthetic coding sequence
atgttcggcagaaagagaagcgtgagcttcggcggcttcggctggatcgacaagaccatgctggccagcctgaaggtgaagaagcaggagctggccaacagcagcgacgccaccctgcccgacagacccctgagcccccccctgaccgccccccccaccatgaagagcagcgagttcttcgagatgctggagaagatgcaggacgactacatcccctaccccagcatcgacgaggtggtggagaagggcggcccctacccccaggtgatcctgccccagttcggcggctactggatcgaggaccccgagaacgtgggcacccccaccagcctgggcagcagcatctgcgaggaggaggaggaggacaacctgagccccaacaccttcggctacaagctggagtgcaagggcgaggccagagcctacagaagacacttcctgggcaaggaccacctgaacttctactgcaccggcagcagcctgggcaacctgatcctgagcgtgaagtgcgaggaggccgagggcatcgagtacctgagagtgatcctgagaagcaagctgaagaccgtgcacgagagaatccccctggccggcctgagcaagctgcccagcgtgccccagatcgccaaggccttctgcgacgacgccgtgggcctgagattcaaccccgtgctgtaccccaaggccagccagatgatcgtgagctacgacgagcacgaggtgaacaacaccttcaagttcggcgtgatctaccagaaggccagacagaccctggaggaggagctgttcggcaacaacgaggagagccccgccttcaaggagttcctggacctgctgggcgacaccatcaccctgcaggacttcaagggcttcagaggcggcctggacgtgacccacggccagaccggcgtggagagcgtgtacaccaccttcagagacagagagatcatgttccacgtgagcaccaagctgcccttcaccgacggcgacgcccagcagctgcagagaaagagacacatcggcaacgacatcgtggccatcatcttccaggaggagaacacccccttcgtgcccgacatgatcgccagcaacttcctgcacgcctacatcgtggtgcaggtggagacccccggcaccgagacccccagctacaaggtgagcgtgaccgccagagaggacgtgcccaccttcggcccccccctgcccagcccccccgtgttccagaagggccccgagttcagagagttcctgctgaccaagctgaccaacgccgagaacgcctgctgcaagagcgacaagttcgccaagctggaggacagaaccagagccgccctgctggacaacctgcacgacgagctgcacgcccacacccaggccatgctgggcctgggccccgaggaggacaagttcgagaacggcggccacggcggcttcctggagagcttcaagagagccatcagagtgagaagccacagcatggagaccatggtgggcggccagaagaagagccacagcggcggcatccccggcagcctgagcggcggcatcagccacaacagcatggaggtgaccaagaccaccttcagcccccccgtggtggccgccaccgtgaagaaccagagcagaagccccatcaagagaagaagcggcctgttccccagactgcacaccggcagcgagggccagggcgacagcagagccagatgcgacagcaccagcagcacccccaagacccccgacggcggccacagcagccaggagatcaagagcgagaccagcagcaaccccagcagccccgagatctgccccaacaaggagaagcccttcatgaagctgaaggagaacggcagagccatcagcagaagcagcagcagcaccagcagcgtgagcagcaccgccggcgagggcgaggccatggaggagggcgacagcggcggcagccagcccagcaccaccagccccttcaagcaggaggtgttcgtgtacagccccagccccagcagcgagagccccagcctgggcgccgccgccacccccatcatcatgagcagaagccccaccgacgccaagagcagaaacagccccagaagcaacctgaagttcagattcgacaagctgagccacgccagcagcggcgccggccactag

SEQ ID NO: 10584 - DNA, 2271 bp, Artificial Sequence
  Description of Artificial Sequence: Synthetic coding sequence
atggaggaggagctgaagtgccccgtgtgcggcagcctgttcagagagcccatcatcctgccctgcagccacaacgtgtgcctgccctgcgccagaaccatcgccgtgcagacccccgacggcgagcagcacctgccccagcccctgctgctgagcagaggcagcggcctgcaggccggcgccgccgccgccgccagcctggagcacgacgccgccgccggccccgcctgcggcggcgccggcggcagcgccgccggcggcctgggcggcggcgccggcggcggcggcgaccacgccgacaagctgagcctgtacagcgagaccgacagcggctacggcagctacacccccagcctgaagagccccaacggcgtgagagtgctgcccatggtgcccgccccccccggcagcagcgccgccgccgccagaggcgccgcctgcagcagcctgagcagcagcagcagcagcatcacctgcccccagtgccacagaagcgccagcctggaccacagaggcctgagaggcttccagagaaacagactgctggaggccatcgtgcagagataccagcagggcagaggcgccgtgcccggcaccagcgccgccgccgccgtggccatctgccagctgtgcgacagaaccccccccgagcccgccgccaccctgtgcgagcagtgcgacgtgctgtactgcagcgcctgccagctgaagtgccaccccagcagaggccccttcgccaagcacagactggtgcagccccccccccccccccccccccccgccgaggccgccagcggccccaccggcaccgcccagggcgcccccagcggcggcggcggctgcaagagccccggcggcgccggcgccggcgccaccggcggcagcaccgccagaaagttccccacctgccccgagcacgagatggagaactacagcatgtactgcgtgagctgcagaacccccgtgtgctacctgtgcctggaggagggcagacacgccaagcacgaggtgaagcccctgggcgccatgtggaagcagcacaaggcccagctgagccaggccctgaacggcgtgagcgacaaggccaaggaggccaaggagttcctggtgcagctgaagaacatcctgcagcagatccaggagaacggcctggactacgaggcctgcctggtggcccagtgcgacgccctggtggacgccctgaccagacagaaggccaagctgctgaccaaggtgaccaaggagagagagcacaagctgaagatggtgtgggaccagatcaaccactgcaccctgaagctgagacagagcaccggcctgatggagtactgcctggaggtgatcaaggagaacgaccccagcggcttcctgcagatcagcgacgccctgatcaagagagtgcaggtgagccaggagcagtgggtgaagggcgccctggagcccaaggtgagcgccgagttcgacctgaccctggacagcgagcccctgctgcaggccatccaccagctggacttcatccagatgaagtgcagagtgccccccgtgcccctgctgcagctggagaagtgctgcaccagaaacaacagcgtgaccctggcctggagaatgccccccttcacccacagccccgtggacggctacatcctggagctggacgacggcgccggcggccagttcagagaggtgtacgtgggcaaggagaccctgtgcaccatcgacggcctgcacttcaacagcacctacaacgccagagtgaaggccttcaacagcagcggcgtgggcccctacagcaagaccgtggtgctgcagaccagcgacgtggcctggttcaccttcgaccccaacagcggccacagagacatcatcctgagcaacgacaaccagaccgccacctgcagcagctacgacgacagagtggtgctgggcaccgccgccttcagcaagggcgtgcactactgggagctgcacgtggacagatacgacaaccaccccgaccccgccttcggcgtggccagagccagcgtggtgaaggacatgatgctgggcaaggacgacaaggcctgggccatgtacgtggacaacaacagaagctggttcatgcactgcaacagccacaccaacagaaccgagggcggcgtgtgcaagggcgccaccgtgggcgtgctgctggacctgaacaagcacaccctgaccttcttcatcaacggccagcagcagggccccaccgccttcagccacgaggtgcagcccagcgtgaccagcctgttctag

SEQ ID NO: 10585 - DNA, 2352 bp, Artificial Sequence
  Description of Artificial Sequence: Synthetic coding sequence
atggaggaggagctgaagtgccccgtgtgcggcagcctgttcagagagcccatcatcctgccctgcagccacaacgtgtgcctgccctgcgccagaaccatcgccgtgcagacccccgacggcgagcagcacctgccccagcccctgctgctgagcagaggcagcggcctgcaggccggcgccgccgccgccgccagcctggagcacgacgccgccgccggccccgcctgcggcggcgccggcggcagcgccgccggcggcctgggcggcggcgccggcggcggcggcgaccacgccgacaagctgagcctgtacagcgagaccgacagcggctacggcagctacacccccagcctgaagagccccaacggcgtgagagtgctgcccatggtgcccgccccccccggcagcagcgccgccgccgccagaggcgccgcctgcagcagcctgagcagcagcagcagcagcatcacctgcccccagtgccacagaagcgccagcctggaccacagaggcctgagaggcttccagagaaacagactgctggaggccatcgtgcagagataccagcagggcagaggcgccgtgcccggcaccagcgccgccgccgccgtggccatctgccagctgtgcgacagaaccccccccgagcccgccgccaccctgtgcgagcagtgcgacgtgctgtactgcagcgcctgccagctgaagtgccaccccagcagaggccccttcgccaagcacagactggtgcagccccccccccccccccccccccccgccgaggccgccagcggccccaccggcaccgcccagggcgcccccagcggcggcggcggctgcaagagccccggcggcgccggcgccggcgccaccggcggcagcaccgccagaaagttccccacctgccccgagcacgagatggagaactacagcatgtactgcgtgagctgcagaacccccgtgtgctacctgtgcctggaggagggcagacacgccaagcacgaggtgaagcccctgggcgccatgtggaagcagcacaaggcccagctgagccaggccctgaacggcgtgagcgacaaggccaaggaggccaaggagttcctggtgcagctgaagaacatcctgcagcagatccaggagaacggcctggactacgaggcctgcctggtggcccagtgcgacgccctggtggacgccctgaccagacagaaggccaagctgctgaccaaggtgaccaaggagagagagcacaagctgaagatggtgtgggaccagatcaaccactgcaccctgaagctgagacagagcaccggcctgatggagtactgcctggaggtgatcaaggagaacgaccccagcggcttcctgcagatcagcgacgccctgatcaagagagtgcaggtgagccaggagcagtgggtgaagggcgccctggagcccaaggtgagcgccgagttcgacctgaccctggacagcgagcccctgctgcaggccatccaccagctggacttcatccagatgaagtgcagagtgccccccgtgcccctgctgcagctggagaagtgctgcaccagaaacaacagcgtgaccctggcctggagaatgccccccttcacccacagccccgtggacggctacatcctggagctggacgacggcgccggcggccagttcagagaggtgtacgtgggcaaggagaccctgtgcaccatcgacggcctgcacttcaacagcacctacaacgccagagtgaaggccttcaacagcagcggcgtgggcccctacagcaagaccgtggtgctgcagaccagcgacgtggcctggttcaccttcgaccccaacagcggccacagagacatcatcctgagcaacgacaaccagaccgccacctgcagcagctacgacgacagagtggtgctgggcaccgccgccttcagcaagggcgtgcactactgggagctgcacgtggacagatacgacaaccaccccgaccccgccttcggcgtggccagagccagcgtggtgaaggacatgatgctgggcaaggacgacaaggcctgggccatgtacgtggacaacaacagaagctggttcatgcactgcaacagccacaccaacagaaccgagggcggcgtgtgcaagggcgccaccgtgggcgtgctgctggacctgaacaagcacaccctgaccttcttcatcaacggccagcagcagggccccaccgccttcagccacgtggacggcgtgttcatgcccgccctgagcctgaacagaaacgtgcaggtgaccctgcacaccggcctggaggtgcccaccaacctgggcagacccaagctgagcggcaactag

SEQ ID NO: 10586 - DNA, 471 bp, Artificial Sequence
  Description of Artificial Sequence: Synthetic coding sequence
atggtgcccgtgttcaccagcagcgccctgcccgtgaaggacgtggaggacaagcccgagcagcagaccagaaccagagagaccgacaagagccccaccagcaccgagcccagacagcagcccagcgccctgttcgccagaggcaacagaaaggccgtgaagagcccccagagaagcagcagcaagatcaaggagaacaagcaccccttcgccctgtacggctggggcgagaagcagaccgacaccggcagccagaagacccacaacgtgtgcgccagcgcccccgtgcacgagatccacgagagcgccctgagagccaagaacagaagacaggtggagaagagaaagctggtggcccagagacagagagcccacagcgtggacgtggagaagaacagaaagatgaaggccagcagcagcgagaacccctggatgaccgagtacatgagatgctacagcgccagagcctag

SEQ ID NO: 10587 - DNA, 813 bp, Artificial Sequence; identical to SEQ ID NO: 9598
  Description of Artificial Sequence: Synthetic coding sequence

SEQ ID NO: 10588 - DNA, 1158 bp, Artificial Sequence
  Description of Artificial Sequence: Synthetic coding sequence
atggccgcccccgacctgagcaccaacctgcaggaggaggccacctgcgccatctgcctggactacttcaccgaccccgtgatgaccgactgcggccacaacttctgcagagagtgcatcagaagatgctggggccagcccgagggcccctacgcctgccccgagtgcagagagctgagcccccagagaaacctgagacccaacagacccctggccaagatggccgagatggccagaagactgcacccccccagccccgtgccccagggcgtgtgccccgcccacagagagcccctggccgccttctgcggcgacgagctgagactgctgtgcgccgcctgcgagagaagcggcgagcactgggcccacagagtgagacccctgcaggacgccgccgaggacctgaaggccaagctggagaagagcctggagcacctgagaaagcagatgcaggacgccctgctgttccaggcccaggccgacgagacctgcgtgctgtggcagaagatggtggagagccagagacagaacgtgctgggcgagttcgagagactgagaagactgctggccgaggaggagcagcagctgctgcagagactggaggaggaggagctggaggtgctgcccagactgagagagggcgccgcccacctgggccagcagagcgcccacctggccgagctgatcgccgagctggagggcagatgccagctgcccgccctgggcctgctgcaggacatcaaggacgccctgagaagagtgcaggacgtgaagctgcagccccccgaggtggtgcccatggagctgagaaccgtgtgcagagtgcccggcctggtggagaccctgagaagattcagaggcagatgcggcggccccagatggggcgacgacagcagaagaggccccgccaaggacctgggcagccagcccagagtgctgtgccccgccaccgccagcagcaagctgaccgtgagctggtggtgggtggtgggcaagaccagcagcgcccacaccagcgacatcagctgcgtgggcatcttcacccccaacaacagcagcaccagcggcaacgagctgggcatccagggcttccacagcgccctgaacagaatcgccagcgccgacaccaccggcgtgagcaccgaccccaccgactag

SEQ ID NO: 10589 - DNA, 1251 bp, Artificial Sequence
  Description of Artificial Sequence: Synthetic coding sequence
atgcccctgtacaacgacagcttccacgagatcagccacaagggcagaagacacaccctggtgctgaagagcatccagagagccgacgccggcatcgtgagagccagcagcctgaaggtgagcaccagcgccagactggaggtgagagtgaagcccgtggtgttcctgaaggccctggacgacctgagcgccgaggagagaggcaccctggccctgcagtgcgaggtgagcgaccccgaggcccacgtggtgtggagaaaggacggcgtgcagctgggccccagcgacaagtacgacttcctgcacaccgccggcaccagaggcctggtggtgcacgacgtgagccccgaggacgccggcctgtacacctgccacgtgggcagcgaggagaccagagccagagtgagagtgcacgacctgcacgtgggcatcaccaagagactgaagaccatggaggtgctggagggcgagagctgcagcttcgagtgcgtgctgagccacgagagcgccagcgaccccgccatgtggaccgtgggcggcaagaccgtgggcagcagcagcagattccaggccaccagacagggcagaaagtacatcctggtggtgagagaggccgcccccagcgacgccggcgaggtggtgttcagcgtgagaggcctgaccagcaaggccagcctgatcgtgagagagagacccgccgccatcatcaagcccctggaggaccagtgggtggcccccggcgaggacgtggagctgagatgcgagctgagcagagccggcacccccgtgcactggctgaaggacagaaaggccatcagaaagagccagaagtacgacgtggtgtgcgagggcaccatggccatgctggtgatcagaggcgccagcctgaaggacgccggcgagtacacctgcgaggtggaggccagcaagagcaccgccagcctgcacgtggaggagaaggccaactgcttcaccgaggagctgaccaacctgcaggtggaggagaagggcaccgccgtgttcacctgcaagaccgagcaccccgccgccaccgtgacctggagaaagggcctgctggagctgagagccagcggcaagcaccagcccagccaggagggcctgaccctgagactgaccatcagcgccctggagaaggccgacagcgacacctacacctgcgacatcggccaggcccagagcagagcccagctgctggtgcagggcgaggccgccaagtgcgccagagcctag

SEQ ID NO: 10590 - DNA, 2130 bp, Artificial Sequence
  Description of Artificial Sequence: Synthetic coding sequence
atggagaagcacagaggcgtgctggagtgccaggtgagcagagccagcgcccaggtgagatggttcaagggcagccaggagctgcagcccggccccaagtacgagctggtgagcgacggcctgtacagaaagctgatcatcagcgacgtgcacgccgaggacgaggacacctacacctgcgacgccggcgacgtgaagaccagcgcccagttcttcgtggaggagcagagcatcaccatcgtgagaggcctgcaggacgtgaccgtgatggagcccgcccccgcctggttcgagtgcgagaccagcatccccagcgtgagaccccccaagtggctgctgggcaagaccgtgctgcaggccggcggcaacgtgggcctggagcaggagggcaccgtgcacagactgatgctgagaagaacctgcagcaccatgaccggccccgtgcacttcaccgtgggcaagagcagaagcagcgccagactggtggtgagcgacatccccgtggtgctgaccagacccctggagcccaagaccggcagagagctgcagagcgtggtgctgagctgcgacttcagacccgcccccaaggccgtgcagtggtacaaggacgacacccccctgagccccagcgagaagttcaagatgagcctggagggccagatggccgagctgagaatcctgagactgatgcccgccgacgccggcgtgtacagatgccaggccggcagcgcccacagcagcaccgaggtgaccgtggaggccagagaggtgaccgtgaccggccccctgcaggacgccgaggccaccgaggagggctgggccagcttcagctgcgagctgagccacgaggacgaggaggtggagtggagcctgaacggcatgcccctgtacaacgacagcttccacgagatcagccacaagggcagaagacacaccctggtgctgaagagcatccagagagccgacgccggcatcgtgagagccagcagcctgaaggtgagcaccagcgccagactggaggtgagagtgaagcccgtggtgttcctgaaggccctggacgacctgagcgccgaggagagaggcaccctggccctgcagtgcgaggtgagcgaccccgaggcccacgtggtgtggagaaaggacggcgtgcagctgggccccagcgacaagtacgacttcctgcacaccgccggcaccagaggcctggtggtgcacgacgtgagccccgaggacgccggcctgtacacctgccacgtgggcagcgaggagaccagagccagagtgagagtgcacgacctgcacgtgggcatcaccaagagactgaagaccatggaggtgctggagggcgagagctgcagcttcgagtgcgtgctgagccacgagagcgccagcgaccccgccatgtggaccgtgggcggcaagaccgtgggcagcagcagcagattccaggccaccagacagggcagaaagtacatcctggtggtgagagaggccgcccccagcgacgccggcgaggtggtgttcagcgtgagaggcctgaccagcaaggccagcctgatcgtgagagagagacccgccgccatcatcaagcccctggaggaccagtgggtggcccccggcgaggacgtggagctgagatgcgagctgagcagagccggcacccccgtgcactggctgaaggacagaaaggccatcagaaagagccagaagtacgacgtggtgtgcgagggcaccatggccatgctggtgatcagaggcgccagcctgaaggacgccggcgagtacacctgcgaggtggaggccagcaagagcaccgccagcctgcacgtggaggagaaggccaactgcttcaccgaggagctgaccaacctgcaggtggaggagaagggcaccgccgtgttcacctgcaagaccgagcaccccgccgccaccgtgacctggagaaagggcctgctggagctgagagccagcggcaagcaccagcccagccaggagggcctgaccctgagactgaccatcagcgccctggagaaggccgacagcgacacctacacctgcgacatcggccaggcccagagcagagcccagctgctggtgcagggcgaggccgccaagtgcgccagagcctag

SEQ ID NO: 10591 - DNA, 16809 bp, Artificial Sequence
  Description of Artificial Sequence: Synthetic coding sequence
atgctggtgatcagaggcgccagcctgaaggacgccggcgagtacacctgcgaggtggaggccagcaagagcaccgccagcctgcacgtggaggagaaggccaactgcttcaccgaggagctgaccaacctgcaggtggaggagaagggcaccgccgtgttcacctgcaagaccgagcaccccgccgccaccgtgacctggagaaagggcctgctggagctgagagccagcggcaagcaccagcccagccaggagggcctgaccctgagactgaccatcagcgccctggagaaggccgacagcgacacctacacctgcgacatcggccaggcccagagcagagcccagctgctggtgcagggcagaagagtgcacatcatcgaggacctggaggacgtggacgtgcaggagggcagcagcgccaccttcagatgcagaatcagccccgccaactacgagcccgtgcactggttcctggacaagacccccctgcacgccaacgagctgaacgagatcgacgcccagcccggcggctaccacgtgctgaccctgagacagctggccctgaaggacagcggcaccatctacttcgaggccggcgaccagagagccagcgccgccctgagagtgaccgagaagcccagcgtgttcagcagagagctgaccgacgccaccatcaccgagggcgaggacctgaccctggtgtgcgagaccagcacctgcgacatccccgtgtgctggaccaaggacggcaagaccctgagaggcagcgccagatgccagctgagccacgagggccacagagcccagctgctgatcaccggcgccaccctgcaggacagcggcagatacaagtgcgaggccggcggcgcctgcagcagcagcatcgtgagagtgcacgccagacccgtgagattccaggaggccctgaaggacctggaggtgctggagggcggcgccgccaccctgagatgcgtgctgagcagcgtggccgcccccgtgaagtggtgctacggcaacaacgtgctgagacccggcgacaagtacagcctgagacaggagggcgccatgctggagctggtggtgagaaacctgagaccccaggacagcggcagatacagctgcagcttcggcgaccagaccaccagcgccaccctgaccgtgaccgccctgcccgcccagttcatcggcaagctgagaaacaaggaggccaccgagggcgccaccgccaccctgagatgcgagctgagcaaggccgcccccgtggagtggagaaagggcagcgagaccctgagagacggcgacagatactgcctgagacaggacggcgccatgtgcgagctgcagatcagaggcctggccatggtggacgccgccgagtacagctgcgtgtgcggcgaggagagaaccagcgccagcctgaccatcagacccatgcccgcccacttcatcggcagactgagacaccaggagagcatcgagggcgccaccgccaccctgagatgcgagctgagcaaggccgcccccgtggagtggagaaagggcagagagagcctgagagacggcgacagacacagcctgagacaggacggcgccgtgtgcgagctgcagatctgcggcctggccgtggccgacgccggcgagtacagctgcgtgtgcggcgaggagagaaccagcgccaccctgaccgtgaaggccctgcccgccaagttcaccgagggcctgagaaacgaggaggccgtggagggcgccaccgccatgctgtggtgcgagctgagcaaggtggcccccgtggagtggagaaagggccccgagaacctgagagacggcgacagatacatcctgagacaggagggcaccagatgcgagctgcagatctgcggcctggccatggccgacgccggcgagtacctgtgcgtgtgcggccaggagagaaccagcgccaccctgaccatcagagccctgcccgccagattcatcgaggacgtgaagaaccaggaggccagagagggcgccaccgccgtgctgcagtgcgagctgaacagcgccgcccccgtggagtggagaaagggcagcgagaccctgagagacggcgacagatacagcctgagacaggacggcaccaagtgcgagctgcagatcagaggcctggccatggccgacaccggcgagtacagctgcgtgtgcggccaggagagaaccagcgccatgctgaccgtgagagccctgcccatcaagttcaccgagggcctgagaaacgaggaggccaccgagggcgccaccgccgtgctgagatgcgagctgagcaagatggcccccgtggagtggtggaagggccacgagaccctgagagacggcgacagacacagcctgagacaggacggcgccagatgcgagctgcagatcagaggcctggtggccgaggacgccggcgagtacctgtgcatgtgcggcaaggagagaaccagcgccatgctgaccgtgagagccatgcccagcaagttcatcgagggcctgagaaacgaggaggccaccgagggcgacaccgccaccctgtggtgcgagctgagcaaggccgcccccgtggagtggagaaagggccacgagaccctgagagacggcgacagacacagcctgagacaggacggcagcagatgcgagctgcagatcagaggcctggccgtggtggacgccggcgagtacagctgcgtgtgcggccaggagagaaccagcgccaccctgaccgtgagagccctgcccgccagattcatcgaggacgtgaagaaccaggaggccagagagggcgccaccgccgtgctgcagtgcgagctgagcaaggccgcccccgtggagtggagaaagggcagcgagaccctgagaggcggcgacagatacagcctgagacaggacggcaccagatgcgagctgcagatccacggcctgagcgtggccgacaccggcgagtacagctgcgtgtgcggccaggagagaaccagcgccaccctgaccgtgagagccctgcccgccagattcacccaggacctgaagaccaaggaggccagcgagggcgccaccgccaccctgcagtgcgagctgagcaaggtggcccccgtggagtggaagaagggccccgagaccctgagagacggcggcagatacagcctgaagcaggacggcaccagatgcgagctgcagatccacgacctgagcgtggccgacgccggcgagtacagctgcatgtgcggccaggagagaaccagcgccaccctgaccgtgagagccctgcccgccagattcaccgagggcctgagaaacgaggaggccatggagggcgccaccgccaccctgcagtgcgagctgagcaaggccgcccccgtggagtggagaaagggcctggaggccctgagagacggcgacaagtacagcctgagacaggacggcgccgtgtgcgagctgcagatccacggcctggccatggccgacaacggcgtgtacagctgcgtgtgcggccaggagagaaccagcgccaccctgaccgtgagagccctgcccgccagattcatcgaggacatgagaaaccagaaggccaccgagggcgccaccgtgaccctgcagtgcaagctgagaaaggccgcccccgtggagtggagaaagggccccaacaccctgaaggacggcgacagatacagcctgaagcaggacggcaccagctgcgagctgcagatcagaggcctggtgatcgccgacgccggcgagtacagctgcatctgcgagcaggagagaaccagcgccaccctgaccgtgagagccctgcccgccagattcatcgaggacgtgagaaaccacgaggccaccgagggcgccaccgccgtgctgcagtgcgagctgagcaaggccgcccccgtggagtggagaaagggcagcgagaccctgagagacggcgacagatacagcctgagacaggacggcaccagatgcgagctgcagatcagaggcctggccgtggaggacaccggcgagtacctgtgcgtgtgcggccaggagagaaccagcgccaccctgaccgtgagagccctgcccgccagattcatcgacaacatgaccaaccaggaggccagagagggcgccaccgccaccctgcactgcgagctgagcaaggtggcccccgtggagtggagaaagggccccgagaccctgagagacggcgacagacacagcctgagacaggacggcaccagatgcgagctgcagatcagaggcctgagcgtggccgacgccggcgagtacagctgcgtgtgcggccaggagagaaccagcgccaccctgaccatcagagaggccaccgagggcgccaccgccatgctgcagtgcgagctgagcaaggtggcccccgtggagtggagaaagggccccgagaccctgagagacggcgacagatacaacctgagacaggacggcaccagatgcgagctgcagatccacggcctgagcgtggccgacaccggcgagtacagctgcgtgtgcggccaggagaagaccagcgccaccctgaccgtgaaggccccccagcccgtgttcagagagcccctgcagagcctgcaggccgaggagggcagcaccgccaccctgcagtgcgagctgagcgagcccaccgccaccgtggtgtggagcaagggcggcctgcagctgcaggccaacggcagaagagagcccagactgcagggctgcaccgccgagctggtgctgcaggacctgcagagagaggacaccggcgagtacacctgcacctgcggcagccaggccaccagcgccaccctgaccgtgaccgccgcccccgtgagattcctgagagagctgcagcaccaggaggtggacgagggcggcaccgcccacctgtgctgcgagctgagcagagccggcgccagcgtggagtggagaaagggcagcctgcagctgttcccctgcgccaagtaccagatggtgcaggacggcgccgccgccgagctgctggtgagaggcgtggagcaggaggacgccggcgactacacctgcgacaccggccacacccagagcatggccagcctgagcgtgagagtgcccagacccaagttcaagaccagactgcagagcctggagcaggagaccggcgacatcgccagactgtgctgccagctgagcgacgccgagagcggcgccgtggtgcagtggctgaaggagggcgtggagctgcacgccggccccaagtacgagatgagaagccagggcgccaccagagagctgctgatccaccagctggaggccaaggacaccggcgagtacgcctgcgtgaccggcggccagaagaccgccgccagcctgagagtgaccgagcccgaggtgaccatcgtgagaggcctggtggacgccgaggtgaccgccgacgaggacgtggagttcagctgcgaggtgagcagagccggcgccaccggcgtgcagtggtgcctgcagggcctgcccctgcagagcaacgaggtgaccgaggtggccgtgagagacggcagaatccacaccctgagactgaagggcgtgacccccgaggacgccggcaccgtgagcttccacctgggcaaccacgccagcagcgcccagctgaccgtgagagcccccgaggtgaccatcctggagcccctgcaggacgtgcagctgagcgagggccaggacgccagcttccagtgcagactgagcagagccagcggccaggaggccagatgggccctgggcggcgtgcccctgcaggccaacgagatgaacgacatcaccgtggagcagggcaccctgcacctgctgaccctgcacaaggtgaccctggaggacgccggcaccgtgagcttccacgtgggcacctgcagcagcgaggcccagctgaaggtgaccgccaagaacaccgtggtgagaggcctggagaacgtggaggccctggagggcggcgaggccctgttcgagtgccagctgagccagcccgaggtggccgcccacacctggctgctggacgacgagcccgtgcacaccagcgagaacgccgaggtggtgttcttcgagaacggcctgagacacctgctgctgctgaagaacctgagaccccaggacagctgcagagtgaccttcctggccggcgacatggtgaccagcgccttcctgaccgtgagaggctggagactggagatcctggagcccctgaagaacgccgccgtgagagccggcgcccaggcctgcttcacctgcaccctgagcgaggccgtgcccgtgggcgaggccagctggtacatcaacggcgccgccgtgcagcccgacgacagcgactggaccgtgaccgccgacggcagccaccacgccctgctgctgagaagcgcccagccccaccacgccggcgaggtgaccttcgcctgcagagacgccgtggccagcgccagactgaccgtgctgggcctgcccgacccccccgaggacgccgaggtggtggccagaagcagccacaccgtgaccctgagctgggccgcccccatgagcgacggcggcggcggcctgtgcggctacagagtggaggtgaaggagggcgccaccggccagtggagactgtgccacgagctggtgcccggccccgagtgcgtggtggacggcctggcccccggcgagacctacagattcagagtggccgccgtgggccccgtgggcgccggcgagcccgtgcacctgccccagaccgtgagactggccgagccccccaagcccgtgcccccccagcccagcgcccccgagagcagacaggtggccgccggcgaggacgtgagcctggagctggaggtggtggccgaggccggcgaggtgatctggcacaagggcatggagagaatccagcccggcggcagattcgaggtggtgagccagggcagacagcagatgctggtgatcaagggcttcaccgccgaggaccagggcgagtaccactgcggcctggcccagggcagcatctgccccgccgccgccaccttccaggtggccctgagccccgccagcgtggacgaggccccccagcccagcctgccccccgaggccgcccaggagggcgacctgcacctgctgtgggaggccctggccagaaagagaagaatgagcagagagcccaccctggacagcatcagcgagctgcccgaggaggacggcagaagccagagactgccccaggaggccgaggaggtggcccccgacctgagcgagggctacagcaccgccgacgagctggccagaaccggcgacgccgacctgagccacaccagcagcgacgacgagagcagagccggcacccccagcctggtgacctacctgaagaaggccggcagacccggcaccagccccctggccagcaaggtgggcgcccccgccgcccccagcgtgaagccccagcagcagcaggagcccctggccgccgtgagaccccccctgggcgacctgagcaccaaggacctgggcgaccccagcatggacaaggccgccgtgaagatccaggccgccttcaagggctacaaggtgagaaaggagatgaagcagcaggagggccccatgttcagccacaccttcggcgacaccgaggcccaggtgggcgacgccctgagactggagtgcgtggtggccagcaaggccgacgtgagagccagatggctgaaggacggcgtggagctgaccgacggcagacaccaccacatcgaccagctgggcgacggcacctgcagcctgctgatcaccggcctggacagagccgacgccggctgctacacctgccaggtgagcaacaagttcggccaggtgacccacagcgcctgcgtggtggtgagcggcagcgagagcgaggccgagagcagcagcggcggcgagctggacgacgccttcagaagagccgccagaagactgcacagactgttcagaaccaagagccccgccgaggtgagcgacgaggagctgttcctgagcgccgacgagggccccgccgagcccgaggagcccgccgactggcagacctacagagaggacgagcacttcatctgcatcagattcgaggccctgaccgaggccagacaggccgtgaccagattccaggagatgttcgccaccctgggcatcggcgtggagatcaagctggtggagcagggccccagaagagtggagatgtgcatcagcaaggagacccccgcccccgtggtgccccccgagcccctgcccagcctgctgaccagcgacgccgcccccgtgttcctgaccgagctgcagaaccaggaggtgcaggacggctaccccgtgagcttcgactgcgtggtgaccggccagcccatgcccagcgtgagatggttcaaggacggcaagctgctggaggaggacgaccactacatgatcaacgaggaccagcagggcggccaccagctgatcatcaccgccgtggtgcccgccgacatgggcgtgtacagatgcctggccgagaacagcatgggcgtgagcagcaccaaggccgagctgagagtggacctgaccagcaccgactacgacaccgccgccgacgccaccgagagcagcagctacttcagcgcccagggctacctgagcagcagagagcaggagggcaccgagagcaccaccgacgagggccagctgccccaggtggtggaggagctgagagacctgcaggtggcccccggcaccagactggccaagttccagctgaaggtgaagggctaccccgcccccagactgtactggttcaaggacggccagcccctgaccgccagcgcccacatcagaatgaccgacaagaagatcctgcacaccctggagatcatcagcgtgaccagagaggacagcggccagtacgccgcctacatcagcaacgccatgggcgccgcctacagcagcgccagactgctggtgagaggccccgacgagcccgaggagaagcccgccagcgacgtgcacgagcagctggtgccccccagaatgctggagagattcacccccaagaaggtgaagaagggcagcagcatcaccttcagcgtgaaggtggagggcagacccgtgcccaccgtgcactggctgagagaggaggccgagagaggcgtgctgtggatcggccccgacacccccggctacaccgtggccagcagcgcccagcagcacagcctggtgctgctggacgtgggcagacagcaccagggcacctacacctgcatcgccagcaacgccgccggccaggccctgtgcagcgccagcctgcacgtgagcggcctgcccaaggtggaggagcaggagaaggtgaaggaggccctgatcagcaccttcctgcagggcaccacccaggccatcagcgcccagggcctggagaccgccagcttcgccgacctgggcggccagagaaaggaggagcccctggccgccaaggaggccctgggccacctgagcctggccgaggtgggcaccgaggagttcctgcagaagctgaccagccagatcaccgagatggtgagcgccaagatcacccaggccaagctgcaggtgcccggcggcgacagcgacgaggacagcaagacccccagcgccagccccagacacggcagaagcagacccagcagcagcatccaggagagcagcagcgagagcgaggacggcgacgccagaggcgagatcttcgacatctacgtggtgaccgccgactacctgcccctgggcgccgagcaggacgccatcaccctgagagagggccagtacgtggaggtgctggacgccgcccaccccctgagatggctggtgagaaccaagcccaccaagagcagccccagcagacagggctgggtgagccccgcctacctggacagaagactgaagctgagccccgagtggggcgccgccgaggcccccgagttccccggcgaggccgtgagcgaggacgagtacaaggccagactgagcagcgtgatccaggagctgctgagcagcgagcaggccttcgtggaggagctgcagttcctgcagagccaccacctgcagcacctggagagatgcccccacgtgcccatcgccgtggccggccagaaggccgtgatcttcagaaacgtgagagacatcggcagattccacagcagcttcctgcaggagctgcagcagtgcgacaccgacgacgacgtggccatgtgcttcatcaagaaccaggccgccttcgagcagtacctggagttcctggtgggcagagtgcaggccgagagcgtggtggtgagcaccgccatccaggagttctacaagaagtacgccgaggaggccctgctggccggcgaccccagccagcccccccccccccccctgcagcactacctggagcagcccgtggagagagtgcagagataccaggccctgctgaaggagctgatcagaaacaaggccagaaacagacagaactgcgccctgctggagcaggcctacgccgtggtgagcgccctgccccagagagccgagaacaagctgcacgtgagcctgatggagaactaccccggcaccctgcaggccctgggcgagcccatcagacagggccacttcatcgtgtgggagggcgcccccggcgccagaatgccctggaagggccacaacagacacgtgttcctgttcagaaaccacctggtgatctgcaagcccagaagagacagcagaaccgacaccgtgagctacgtgttcagaaacatgatgaagctgagcagcatcgacctgaacgaccaggtggagggcgacgacagagccttcgaggtgtggcaggagagagaggacagcgtgagaaagtacctgctgcaggccagaaccgccatcatcaagagcagctgggtgaaggagatctgcggcatccagcagagactggccctgcccgtgtggagaccccccgacttcgaggaggagctggccgactgcaccgccgagctgggcgagaccgtgaagctggcctgcagagtgaccggcacccccaagcccgtgatcagctggtacaaggacggcaaggccgtgcaggtggacccccaccacatcctgatcgaggaccccgacggcagctgcgccctgatcctggacagcctgaccggcgtggacagcggccagtacatgtgcttcgccgccagcgccgccggcaactgcagcaccctgggcaagatcctggtgcaggtgccccccagattcgtgaacaaggtgagagccagccccttcgtggagggcgaggacgcccagttcacctgcaccatcgagggcgccccctacccccagatcagatggtacaaggacggcgccctgctgaccaccggcaacaagttccagaccctgagcgagcccagaagcggcctgctggtgctggtgatcagagccgccagcaaggaggacctgggcctgtacgagtgcgagctggtgaacagactgggcagcgccagagccagcgccgagctgagaatccagagccccatgctgcaggcccaggagcagtgccacagagagcagctggtggccgccgtggaggacaccaccctggagagagccgaccaggaggtgaccagcgtgctgaagagactgctgggccccaaggcccccggccccagcaccggcgacctgaccggccccggcccctgccccagaggcgcccccgccctgcaggagaccggcagccagccccccgtgaccggcaccagcgaggcccccgccgtgccccccagagtgccccagcccctgctgcacgagggccccgagcaggagcccgaggccatcgccagagcccaggagtggaccgtgcccatcagaatggagggcgccgcctggcccggcgccggcaccggcgagctgctgtgggacgtgcacagccacgtggtgagagagaccacccagagaacctacacctaccaggccatcgacacccacaccgccagaccccccagcatgcaggtgaccatcgaggacgtgcaggcccagaccggcggcaccgcccagttcgaggccatcatcgagggcgacccccagcccagcgtgacctggtacaaggacagcgtgcagctggtggacagcaccagactgagccagcagcaggagggcaccacctacagcctggtgctgagacacgtggccagcaaggacgccggcgtgtacacctgcctggcccagaacaccggcggccaggtgctgtgcaaggccgagctgctggtgctgggcggcgacaacgagcccgacagcgagaagcagagccacagaagaaagctgcacagcttctacgaggtgaaggaggagatcggcagaggcgtgttcggcttcgtgaagagagtgcagcacaagggcaacaagatcctgtgcgccgccaagttcatccccctgagaagcagaaccagagcccaggcctacagagagagagacatcctggccgccctgagccaccccctggtgaccggcctgctggaccagttcgagaccagaaagaccctgatcctgatcctggagctgtgcagcagcgaggagctgctggacagactgtacagaaagggcgtggtgaccgaggccgaggtgaaggtgtacatccagcagctggtggagggcctgcactacctgcacagccacggcgtgctgcacctggacatcaagcccagcaacatcctgatggtgcaccccgccagagaggacatcaagatctgcgacttcggcttcgcccagaacatcacccccgccgagctgcagttcagccagtacggcagccccgagttcgtgagccccgagatcatccagcagaaccccgtgagcgaggccagcgacatctgggccatgggcgtgatcagctacctgagcctgacctgcagcagccccttcgccggcgagagcgacagagccaccctgctgaacgtgctggagggcagagtgagctggagcagccccatggccgcccacctgagcgaggacgccaaggacttcatcaaggccaccctgcagagagccccccaggccagacccagcgccgcccagtgcctgagccacccctggttcctgaagagcatgcccgccgaggaggcccacttcatcaacaccaagcagctgaagttcctgctggccagaagcagatggcagagaagcctgatgagctacaagagcatcctggtgatgagaagcatccccgagctgctgagaggcccccccgacagccccagcctgggcgtggccagacacctgtgcagagacaccggcggcagcagcagcagcagcagcagcagcgacaacgagctggcccccttcgccagagccaagagcctgccccccagccccgtgacccacagccccctgctgcaccccagaggcttcctgagacccagcgccagcctgcccgaggaggccgaggccagcgagagaagcaccgaggcccccgccccccccgccagccccgagggcgccggcccccccgccgcccagggctgcgtgcccagacacagcgtgatcagaagcctgttctaccaccaggccggcgagagccccgagcacggcgccctggcccccggcagcagaagacaccccgccagaagaagacacctgctgaagggcggctacatcgccggcgccctgcccggcctgagagagcccctgatggagcacagagtgctggaggaggaggccgccagagaggagcaggccaccctgctggccaaggcccccagcttcgagaccgccctgagactgcccgccagcggcacccacctggcccccggccacagccacagcctggagcacgacagccccagcacccccagacccagcagcgaggcctgcggcgaggcccagagactgcccagcgcccccagcggcggcgcccccatcagagacatgggccacccccagggcagcaagcagctgcccagcaccggcggccaccccggcaccgcccagcccgagagacccagccccgacagcccctggggccagcccgcccccttctgccaccccaagcagggcagcgccccccaggagggctgcagcccccaccccgccgtggccccctgcccccccggcagcttcccccccggcagctgcaaggaggcccccctggtgcccagcagccccttcctgggccagccccaggccccccccgcccccgccaaggccagcccccccctggacagcaagatgggccccggcgacatcagcctgcccggcagacccaagcccggcccctgcagcagccccggcagcgccagccaggccagcagcagccaggtgagcagcctgagagtgggcagcagccaggtgggcaccgagcccggccccagcctggacgccgagggctggacccaggaggccgaggacctgagcgacagcacccccaccctgcagagaccccaggagcaggccaccatgagaaagttcagcctgggcggcagaggcggctacgccggcgtggccggctacggcaccttcgccttcggcggcgacgccggcggcatgctgggccagggccccatgtgggccagaatcgcctgggccgtgagccagagcgaggaggaggagcaggaggaggccagagccgagagccagagcgaggagcagcaggaggccagagccgagagccccctgccccaggtgagcgccagacccgtgcccgaggtgggcagagcccccaccagaagcagccccgagcccaccccctgggaggacatcggccaggtgagcctggtgcagatcagagacctgagcggcgacgccgaggccgccgacaccatcagcctggacatcagcgaggtggaccccgcctacctgaacctgagcgacctgtacgacatcaagtacctgcccttcgagttcatgatcttcagaaaggtgcccaagagcgcccagcccgagccccccagccccatggccgaggaggagctggccgagttccccgagcccacctggccctggcccggcgagctgggcccccacgccggcctggagatcaccgaggagagcgaggacgtggacgccctgctggccgaggccgccgtgggcagaaagagaaagtggagcagccccagcagaagcctgttccacttccccggcagacacctgcccctggacgagcccgccgagctgggcctgagagagagagtgaaggccagcgtggagcacatcagcagaatcctgaagggcagacccgagggcctggagaaggagggcccccccagaaagaagcccggcctggccagcttcagactgagcggcctgaagagctgggacagagcccccaccttcctgagagagctgagcgacgagaccgtggtgctgggccagagcgtgaccctggcctgccaggtgagcgcccagcccgccgcccaggccacctggagcaaggacggcgcccccctggagagcagcagcagagtgctgatcagcgccaccctgaagaacttccagctgctgaccatcctggtggtggtggccgaggacctgggcgtgtacacctgcagcgtgagcaacgccctgggcaccgtgaccaccaccggcgtgctgagaaaggccgagagacccagcagcagcccctgccccgacatcggcgaggtgtacgccgacggcgtgctgctggtgtggaagcccgtggagagctacggccccgtgacctacatcgtgcagtgcagcctggagggcggcagctggaccaccctggccagcgacatcttcgactgctgctacctgaccagcaagctgagcagaggcggcacctacaccttcagaaccgcctgcgtgagcaaggccggcatgggcccctacagcagccccagcgagcaggtgctgctgggcggccccagccacctggccagcgaggaggagagccagggcagaagcgcccagcccctgcccagcaccaagaccttcgccttccagacccagatccagagaggcagattcagcgtggtgagacagtgctgggagaaggccagcggcagagccctggccgccaagatcatcccctaccaccccaaggacaagaccgccgtgctgagagagtacgaggccctgaagggcctgagacacccccacctggcccagctgcacgccgcctacctgagccccagacacctggtgctgatcctggagctgtgcagcggccccgagctgctgccctgcctggccgagagagccagctacagcgagagcgaggtgaaggactacctgtggcagatgctgagcgccacccagtacctgcacaaccagcacatcctgcacctggacctgagaagcgagaacatgatcatcaccgagtacaacctgctgaaggtggtggacctgggcaacgcccagagcctgagccaggagaaggtgctgcccagcgacaagttcaaggactacctggagaccatggcccccgagctgctggagggccagggcgccgtgccccagaccgacatctgggccatcggcgtgaccgccttcatcatgctgagcgccgagtaccccgtgagcagcgagggcgccagagacctgcagagaggcctgagaaagggcctggtgagactgagcagatgctacgccggcctgagcggcggcgccgtggccttcctgagaagcaccctgtgcgcccagccctggggcagaccctgcgccagcagctgcctgcagtgcccctggctgaccgaggagggccccgcctgcagcagacccgcccccgtgaccttccccaccgccagactgagagtgttcgtgagaaacagagagaagagaagagccctgctgtacaagagacacaacctggcccaggtgagatag

SEQ ID NO: 10592 - DNA, 11220 bp, Artificial Sequence
  Description of Artificial Sequence: Synthetic coding sequence
atgctggtgatcagaggcgccagcctgaaggacgccggcgagtacacctgcgaggtggaggccagcaagagcaccgccagcctgcacgtggaggagaaggccaactgcttcaccgaggagctgaccaacctgcaggtggaggagaagggcaccgccgtgttcacctgcaagaccgagcaccccgccgccaccgtgacctggagaaagggcctgctggagctgagagccagcggcaagcaccagcccagccaggagggcctgaccctgagactgaccatcagcgccctggagaaggccgacagcgacacctacacctgcgacatcggccaggcccagagcagagcccagctgctggtgcagggcagaagagtgcacatcatcgaggacctggaggacgtggacgtgcaggagggcagcagcgccaccttcagatgcagaatcagccccgccaactacgagcccgtgcactggttcctggacaagacccccctgcacgccaacgagctgaacgagatcgacgcccagcccggcggctaccacgtgctgaccctgagacagctggccctgaaggacagcggcaccatctacttcgaggccggcgaccagagagccagcgccgccctgagagtgaccgagaagcccagcgtgttcagcagagagctgaccgacgccaccatcaccgagggcgaggacctgaccctggtgtgcgagaccagcacctgcgacatccccgtgtgctggaccaaggacggcaagaccctgagaggcagcgccagatgccagctgagccacgagggccacagagcccagctgctgatcaccggcgccaccctgcaggacagcggcagatacaagtgcgaggccggcggcgcctgcagcagcagcatcgtgagagtgcacgccagacccgtgagattccaggaggccctgaaggacctggaggtgctggagggcggcgccgccaccctgagatgcgtgctgagcagcgtggccgcccccgtgaagtggtgctacggcaacaacgtgctgagacccggcgacaagtacagcctgagacaggagggcgccatgctggagctggtggtgagaaacctgagaccccaggacagcggcagatacagctgcagcttcggcgaccagaccaccagcgccaccctgaccgtgaccgccctgcccgcccagttcatcggcaagctgagaaacaaggaggccaccgagggcgccaccgccaccctgagatgcgagctgagcaaggccgcccccgtggagtggagaaagggcagcgagaccctgagagacggcgacagatactgcctgagacaggacggcgccatgtgcgagctgcagatcagaggcctggccatggtggacgccgccgagtacagctgcgtgtgcggcgaggagagaaccagcgccagcctgaccatcagacccatgcccgcccacttcatcggcagactgagacaccaggagagcatcgagggcgccaccgccaccctgagatgcgagctgagcaaggccgcccccgtggagtggagaaagggcagagagagcctgagagacggcgacagacacagcctgagacaggacggcgccgtgtgcgagctgcagatctgcggcctggccgtggccgacgccggcgagtacagctgcgtgtgcggcgaggagagaaccagcgccaccctgaccgtgaaggccctgcccgccaagttcaccgagggcctgagaaacgaggaggccgtggagggcgccaccgccatgctgtggtgcgagctgagcaaggtggcccccgtggagtggagaaagggccccgagaacctgagagacggcgacagatacatcctgagacaggagggcaccagatgcgagctgcagatctgcggcctggccatggccgacgccggcgagtacctgtgcgtgtgcggccaggagagaaccagcgccaccctgaccatcagagccctgcccgccagattcatcgaggacgtgaagaaccaggaggccagagagggcgccaccgccgtgctgcagtgcgagctgaacagcgccgcccccgtggagtggagaaagggcagcgagaccctgagagacggcgacagatacagcctgagacaggacggcaccaagtgcgagctgcagatcagaggcctggccatggccgacaccggcgagtacagctgcgtgtgcggccaggagagaaccagcgccatgctgaccgtgagagccctgcccatcaagttcaccgagggcctgagaaacgaggaggccaccgagggcgccaccgccgtgctgagatgcgagctgagcaagatggcccccgtggagtggtggaagggccacgagaccctgagagacggcgacagacacagcctgagacaggacggcgccagatgcgagctgcagatcagaggcctggtggccgaggacgccggcgagtacctgtgcatgtgcggcaaggagagaaccagcgccatgctgaccgtgagagccatgcccagcaagttcatcgagggcctgagaaacgaggaggccaccgagggcgacaccgccaccctgtggtgcgagctgagcaaggccgcccccgtggagtggagaaagggccacgagaccctgagagacggcgacagacacagcctgagacaggacggcagcagatgcgagctgcagatcagaggcctggccgtggtggacgccggcgagtacagctgcgtgtgcggccaggagagaaccagcgccaccctgaccgtgagagccctgcccgccagattcatcgaggacgtgaagaaccaggaggccagagagggcgccaccgccgtgctgcagtgcgagctgagcaaggccgcccccgtggagtggagaaagggcagcgagaccctgagaggcggcgacagatacagcctgagacaggacggcaccagatgcgagctgcagatccacggcctgagcgtggccgacaccggcgagtacagctgcgtgtgcggccaggagagaaccagcgccaccctgaccgtgagagccccccagcccgtgttcagagagcccctgcagagcctgcaggccgaggagggcagcaccgccaccctgcagtgcgagctgagcgagcccaccgccaccgtggtgtggagcaagggcggcctgcagctgcaggccaacggcagaagagagcccagactgcagggctgcaccgccgagctggtgctgcaggacctgcagagagaggacaccggcgagtacacctgcacctgcggcagccaggccaccagcgccaccctgaccgtgaccgccgcccccgtgagattcctgagagagctgcagcaccaggaggtggacgagggcggcaccgcccacctgtgctgcgagctgagcagagccggcgccagcgtggagtggagaaagggcagcctgcagctgttcccctgcgccaagtaccagatggtgcaggacggcgccgccgccgagctgctggtgagaggcgtggagcaggaggacgccggcgactacacctgcgacaccggccacacccagagcatggccagcctgagcgtgagagtgcccagacccaagttcaagaccagactgcagagcctggagcaggagaccggcgacatcgccagactgtgctgccagctgagcgacgccgagagcggcgccgtggtgcagtggctgaaggagggcgtggagctgcacgccggccccaagtacgagatgagaagccagggcgccaccagagagctgctgatccaccagctggaggccaaggacaccggcgagtacgcctgcgtgaccggcggccagaagaccgccgccagcctgagagtgaccgagcccgaggtgaccatcgtgagaggcctggtggacgccgaggtgaccgccgacgaggacgtggagttcagctgcgaggtgagcagagccggcgccaccggcgtgcagtggtgcctgcagggcctgcccctgcagagcaacgaggtgaccgaggtggccgtgagagacggcagaatccacaccctgagactgaagggcgtgacccccgaggacgccggcaccgtgagcttccacctgggcaaccacgccagcagcgcccagctgaccgtgagagcccccgaggtgaccatcctggagcccctgcaggacgtgcagctgagcgagggccaggacgccagcttccagtgcagactgagcagagccagcggccaggaggccagatgggccctgggcggcgtgcccctgcaggccaacgagatgaacgacatcaccgtggagcagggcaccctgcacctgctgaccctgcacaaggtgaccctggaggacgccggcaccgtgagcttccacgtgggcacctgcagcagcgaggcccagctgaaggtgaccgccaagaacaccgtggtgagaggcctggagaacgtggaggccctggagggcggcgaggccctgttcgagtgccagctgagccagcccgaggtggccgcccacacctggctgctggacgacgagcccgtgcacaccagcgagaacgccgaggtggtgttcttcgagaacggcctgagacacctgctgctgctgaagaacctgagaccccaggacagctgcagagtgaccttcctggccggcgacatggtgaccagcgccttcctgaccgtgagaggctggagactggagatcctggagcccctgaagaacgccgccgtgagagccggcgcccaggcctgcttcacctgcaccctgagcgaggccgtgcccgtgggcgaggccagctggtacatcaacggcgccgccgtgcagcccgacgacagcgactggaccgtgaccgccgacggcagccaccacgccctgctgctgagaagcgcccagccccaccacgccggcgaggtgaccttcgcctgcagagacgccgtggccagcgccagactgaccgtgctgggcctgcccgacccccccgaggacgccgaggtggtggccagaagcagccacaccgtgaccctgagctgggccgcccccatgagcgacggcggcggcggcctgtgcggctacagagtggaggtgaaggagggcgccaccggccagtggagactgtgccacgagctggtgcccggccccgagtgcgtggtggacggcctggcccccggcgagacctacagattcagagtggccgccgtgggccccgtgggcgccggcgagcccgtgcacctgccccagaccgtgagactggccgagccccccaagcccgtgcccccccagcccagcgcccccgagagcagacaggtggccgccggcgaggacgtgagcctggagctggaggtggtggccgaggccggcgaggtgatctggcacaagggcatggagagaatccagcccggcggcagattcgaggtggtgagccagggcagacagcagatgctggtgatcaagggcttcaccgccgaggaccagggcgagtaccactgcggcctggcccagggcagcatctgccccgccgccgccaccttccaggtggccctgagccccgccagcgtggacgaggccccccagcccagcctgccccccgaggccgcccaggagggcgacctgcacctgctgtgggaggccctggccagaaagagaagaatgagcagagagcccaccctggacagcatcagcgagctgcccgaggaggacggcagaagccagagactgccccaggaggccgaggaggtggcccccgacctgagcgagggctacagcaccgccgacgagctggccagaaccggcgacgccgacctgagccacaccagcagcgacgacgagagcagagccggcacccccagcctggtgacctacctgaagaaggccggcagacccggcaccagccccctggccagcaaggtgggcgcccccgccgcccccagcgtgaagccccagcagcagcaggagcccctggccgccgtgagaccccccctgggcgacctgagcaccaaggacctgggcgaccccagcatggacaaggccgccgtgaagatccaggccgccttcaagggctacaaggtgagaaaggagatgaagcagcaggagggccccatgttcagccacaccttcggcgacaccgaggcccaggtgggcgacgccctgagactggagtgcgtggtggccagcaaggccgacgtgagagccagatggctgaaggacggcgtggagctgaccgacggcagacaccaccacatcgaccagctgggcgacggcacctgcagcctgctgatcaccggcctggacagagccgacgccggctgctacacctgccaggtgagcaacaagttcggccaggtgacccacagcgcctgcgtggtggtgagcggcagcgagagcgaggccgagagcagcagcggcggcgagctggacgacgccttcagaagagccgccagaagactgcacagactgttcagaaccaagagccccgccgaggtgagcgacgaggagctgttcctgagcgccgacgagggccccgccgagcccgaggagcccgccgactggcagacctacagagaggacgagcacttcatctgcatcagattcgaggccctgaccgaggccagacaggccgtgaccagattccaggagatgttcgccaccctgggcatcggcgtggagatcaagctggtggagcagggccccagaagagtggagatgtgcatcagcaaggagacccccgcccccgtggtgccccccgagcccctgcccagcctgctgaccagcgacgccgcccccgtgttcctgaccgagctgcagaaccaggaggtgcaggacggctaccccgtgagcttcgactgcgtggtgaccggccagcccatgcccagcgtgagatggttcaaggacggcaagctgctggaggaggacgaccactacatgatcaacgaggaccagcagggcggccaccagctgatcatcaccgccgtggtgcccgccgacatgggcgtgtacagatgcctggccgagaacagcatgggcgtgagcagcaccaaggccgagctgagagtggacctgaccagcaccgactacgacaccgccgccgacgccaccgagagcagcagctacttcagcgcccagggctacctgagcagcagagagcaggagggcaccgagagcaccaccgacgagggccagctgccccaggtggtggaggagctgagagacctgcaggtggcccccggcaccagactggccaagttccagctgaaggtgaagggctaccccgcccccagactgtactggttcaaggacggccagcccctgaccgccagcgcccacatcagaatgaccgacaagaagatcctgcacaccctggagatcatcagcgtgaccagagaggacagcggccagtacgccgcctacatcagcaacgccatgggcgccgcctacagcagcgccagactgctggtgagaggccccgacgagcccgaggagaagcccgccagcgacgtgcacgagcagctggtgccccccagaatgctggagagattcacccccaagaaggtgaagaagggcagcagcatcaccttcagcgtgaaggtggagggcagacccgtgcccaccgtgcactggctgagagaggaggccgagagaggcgtgctgtggatcggccccgacacccccggctacaccgtggccagcagcgcccagcagcacagcctggtgctgctggacgtgggcagacagcaccagggcacctacacctgcatcgccagcaacgccgccggccaggccctgtgcagcgccagcctgcacgtgagcggcctgcccaaggtggaggagcaggagaaggtgaaggaggccctgatcagcaccttcctgcagggcaccacccaggccatcagcgcccagggcctggagaccgccagcttcgccgacctgggcggccagagaaaggaggagcccctggccgccaaggaggccctgggccacctgagcctggccgaggtgggcaccgaggagttcctgcagaagctgaccagccagatcaccgagatggtgagcgccaagatcacccaggccaagctgcaggtgcccggcggcgacagcgacgaggacagcaagacccccagcgccagccccagacacggcagaagcagacccagcagcagcatccaggagagcagcagcgagagcgaggacggcgacgccagaggcgagatcttcgacatctacgtggtgaccgccgactacctgcccctgggcgccgagcaggacgccatcaccctgagagagggccagtacgtggaggtgctggacgccgcccaccccctgagatggctggtgagaaccaagcccaccaagagcagccccagcagacagggctgggtgagccccgcctacctggacagaagactgaagctgagccccgagtggggcgccgccgaggcccccgagttccccggcgaggccgtgagcgaggacgagtacaaggccagactgagcagcgtgatccaggagctgctgagcagcgagcaggccttcgtggaggagctgcagttcctgcagagccaccacctgcagcacctggagagatgcccccacgtgcccatcgccgtggccggccagaaggccgtgatcttcagaaacgtgagagacatcggcagattccacagcagcttcctgcaggagctgcagcagtgcgacaccgacgacgacgtggccatgtgcttcatcaagaaccaggccgccttcgagcagtacctggagttcctggtgggcagagtgcaggccgagagcgtggtggtgagcaccgccatccaggagttctacaagaagtacgccgaggaggccctgctggccggcgaccccagccagcccccccccccccccctgcagcactacctggagcagcccgtggagagagtgcagagataccaggccctgctgaaggagctgatcagaaacaaggccagaaacagacagaactgcgccctgctggagcaggcctacgccgtggtgagcgccctgccccagagagccgagaacaagctgcacgtgagcctgatggagaactaccccggcaccctgcaggccctgggcgagcccatcagacagggccacttcatcgtgtgggagggcgcccccggcgccagaatgccctggaagggccacaacagacacgtgttcctgttcagaaaccacctggtgatctgcaagcccagaagagacagcagaaccgacaccgtgagctacgtgttcagaaacatgatgaagctgagcagcatcgacctgaacgaccaggtggagggcgacgacagagccttcgaggtgtggcaggagagagaggacagcgtgagaaagtacctgctgcaggccagaaccgccatcatcaagagcagctgggtgaaggagatctgcggcatccagcagagactggccctgcccgtgtggagaccccccgacttcgaggaggagctggccgactgcaccgccgagctgggcgagaccgtgaagctggcctgcagagtgaccggcacccccaagcccgtgatcagctggtacaaggacggcaaggccgtgcaggtggacccccaccacatcctgatcgaggaccccgacggcagctgcgccctgatcctggacagcctgaccggcgtggacagcggccagtacatgtgcttcgccgccagcgccgccggcaactgcagcaccctgggcaagatcctggtgcaggtgccccccagattcgtgaacaaggtgagagccagccccttcgtggagggcgaggacgcccagttcacctgcaccatcgagggcgccccctacccccagatcagatggtacaaggacggcgccctgctgaccaccggcaacaagttccagaccctgagcgagcccagaagcggcctgctggtgctggtgatcagagccgccagcaaggaggacctgggcctgtacgagtgcgagctggtgaacagactgggcagcgccagagccagcgccgagctgagaatccagagccccatgctgcaggcccaggagcagtgccacagagagcagctggtggccgccgtggaggtgaccgagcaggagaccaaggtgcccaagaagaccgtgatcatcgaggagaccatcaccaccgtggtgaagagccccagaggccagagaagaagccccagcaagagccccagcagaagccccagcagatgcagcgccagccccctgagacccggcctgctggcccccgacctgctgtacctgcccggcgccggccagcccagaagacccgaggccgagcccggccagaagcccgtggtgcccaccctgtacgtgaccgaggccgaggcccacagccccgccctgcccggcctgagcggcccccagcccaagtgggtggaggtggaggagaccatcgaggtgagagtgaagaagatgggcccccagggcgtgagccccaccaccgaggtgcccagaagcagcagcggccacctgttcaccctgcccggcgccacccccggcggcgaccccaacagcaacaacagcaacaacaagctgctggcccaggaggcctgggcccagggcaccgccatggtgggcgtgagagagcccctggtgttcagagtggacgccagaggcagcgtggactgggccgccagcggcatgggcagcctggaggaggagggcaccatggaggaggccggcgaggaggagggcgaggacggcgacgccttcgtgaccgaggagagccaggacacccacagcctgggcgacagagaccccaagatcctgacccacaacggcagaatgctgaccctggccgacctggaggactacgtgcccggcgagggcgagaccttccactgcggcggccccggccccggcgcccccgacgaccccccctgcgaggtgagcgtgatccagagagagatcggcgagcccaccgtgggccagcccgtgctgctgagcgtgggccacgccctgggccccagaggccccctgggcctgttcagacccgagcccagaggcgccagcccccccggcccccaggtgagaagcctggagggcaccagcttcctgctgagagaggcccccgccagacccgtgggcagcgccccctggacccagagcttctgcaccagaatcagaagaagcgccgacagcggccagagcagcttcaccaccgagctgagcacccagaccgtgaacttcggcaccgtgggcgagaccgtgaccctgcacatctgccccgacagagacggcgacgaggccgcccagccctag

SEQ ID NO: 10593 - DNA, 1071 bp, Artificial Sequence
  Description of Artificial Sequence: Synthetic coding sequence
atggccaccgccgccctgctgagaggcgccacccccggcagaggcggccccgtgtggagatggagactgagagccgcccccagatgcagactggcccacagcagctgcagccccggcggcgaccccaccgccggcgccgcctgggcctgcttcagactggacggcagaaccctgctgagagtgagaggccccgacgccgcccccttcctgctgggcctgctgaccaacgagctgcccctgcccagccccgccgccgccggcgccccccccgccgccagagccggctacgcccacttcctgaacgtgcagggcagaaccctgtacgacgtgatcctgtacggcctgcaggagcacagcgaggtgagcggcttcctgctggagtgcgacagcagcgtgcagggcgccctgcagaagcacctggccctgtacagaatcagaagaaaggtgaccgtggagccccaccccgagctgagagtgtgggccgtgctgcccagcagccccgaggcctgcggcgccgccagcctgcaggagagagccggcgccgccgccatcctgatcagagaccccagaaccgccagaatgggctggagactgctgacccaggacgagggccccgccctggtgcccggcggcagactgggcgacctgtgggactaccaccagcacagatacctgcagggcgtgcccgagggcgtgagagacctgccccccggcgtggccctgcccctggagagcaacctggccttcatgaacggcgtgagcttcaccaagggctgctacatcggccaggagctgaccgccagaacccaccacatgggcgtgatcagaaagagactgttccccgtgagattcctggaccccctgcccaccagcggcatcacccccggcgccaccgtgctgaccgccagcggccagaccgtgggcaagttcagagccggccagggcaacgtgggcctggccctgctgtggagcgagaagatcaagggccccctgcacatcagagccagcgagggcgcccaggtggccctggccgccagcgtgcccgactggtggcccaccgtgagcaagtag

SEQ ID NO: 10594 - DNA, 1395 bp, Artificial Sequence
  Description of Artificial Sequence: Synthetic coding sequence
atgagagccgccagaagaggcctgcactgcgccggcgccgagagacccagaagaagaggcagactgtgggacagcagcggcgtgccccagagacagaagagacccggcccctggagaacccagacccaggagcagatgagcagagacgtgtgcatccacacctggccctgcacctactacctggagcccaagagaagatgggtgaccggccagctgagcctgaccagcctgagcctgagattcatgaccgacagcaccggcgagatcctggtgagcttccccctgagcagcatcgtggagatcaagaaggaggccagccacttcatcttcagcagcatcaccatcctggagaagggccacgccaagcactggttcagcagcctgagacccagcagaaacgtggtgttcagcatcatcgagcacttctggagagagctgctgctgagccagcccggcgccgtggccgacgccagcgtgcccagaaccagaggcgaggagctgaccggcctgatggccggcagccagaagagactggaggacaccgccagagtgctgcaccaccagggccagcagctggacagcgtgatgagaggcctggacaagatggagagcgacctggaggtggccgacagactgctgaccgagctggagagccccgcctggtggcccttcagcagcaagctgtggaagaccccccccgagaccaagcccagagaggacgtgagcatgaccagctgcgagcccttcggcaaggagggcatcctgatcaagatccccgccgtgatcagccacagaaccgagagccacgtgaagcccggcagactgaccgtgctggtgagcggcctggagatccacgacagcagcagcctgctgatgcacagattcgagagagaggacgtggacgacatcaaggtgcacagcccctacgagatcagcatcagacagagattcatcggcaagcccgacatggcctacagactgatcagcgccaagatgcccgaggtgatccccatcctggaggtgcagttcagcaagaagatggagctgctggaggacgccctggtgctgagaagcgccagaaccagcagccccgccgagaagagctgcagcgtgtggcacgccgccagcggcctgatgggcagaaccctgcacagagagccccccgccggcgaccaggagggcaccgccctgcacctgcagaccagcctgcccgccctgagcgaggccgacacccaggagctgacccagatcctgagaagaatgaagggcctggccctggaggccgagagcgagctggagagacaggacgaggccctggacggcgtggccgccgccgtggacagagccaccctgaccatcgacaagcacaacagaagaatgaagagactgacctag

SEQ ID NO: 10595 - DNA, 669 bp, Artificial Sequence
  Description of Artificial Sequence: Synthetic coding sequence
atgaccagctgcgagcccttcggcaaggagggcatcctgatcaagatccccgccgtgatcagccacagaaccgagagccacgtgaagcccggcagactgaccgtgctggtgagcggcctggagatccacgacagcagcagcctgctgatgcacagattcgagagagaggacgtggacgacatcaaggtgcacagcccctacgagatcagcatcagacagagattcatcggcaagcccgacatggcctacagactgatcagcgccaagatgcccgaggtgatccccatcctggaggtgcagttcagcaagaagatggagctgctggaggacgccctggtgctgagaagcgccagaaccagcagccccgccgagaagagctgcagcgtgtggcacgccgccagcggcctgatgggcagaaccctgcacagagagccccccgccggcgaccaggagggcaccgccctgcacctgcagaccagcctgcccgccctgagcgaggccgacacccaggagctgacccagatcctgagaagaatgaagggcctggccctggaggccgagagcgagctggagagacaggacgaggccctggacggcgtggccgccgccgtggacagagccaccctgaccatcgacaagcacaacagaagaatgaagagactgacctag

SEQ ID NO: 10596 - DNA, 201 bp, Artificial Sequence
  Description of Artificial Sequence: Synthetic coding sequence
atgccccagtaccagacctgggaggagttcagcagagccgccgagaagctgtacctggccgaccccatgaaggccagagtggtgctgaagtacagacacagcgacggcaacctgtgcgtgaaggtgaccgacgacctggtgcagtggcacctgaactactgcaccctgagacacggcatcgccggcggcctggagacctag

SEQ ID NO: 10597 - DNA, 249 bp, Artificial Sequence
  Description of Artificial Sequence: Synthetic coding sequence
atgccccagtaccagacctgggaggagttcagcagagccgccgagaagctgtacctggccgaccccatgaaggccagagtggtgctgaagtacagacacagcgacggcaacctgtgcgtgaaggtgaccgacgacctggtgagacagtgcctggccctgctgctgagactgcagtgcagcggcatgatcatcgcccactgcatcctggacctgctgggcagcagcggccccctggccagcgccagctag

SEQ ID NO: 10598 - DNA, 651 bp, Artificial Sequence
  Description of Artificial Sequence: Synthetic coding sequence
atgcaggccaacggcgccggcggcggcggcggcggcggcggcggcggcggcggcggcggcggcggcggcggcggccagggccagacccccgagctggcctgcctgagcgcccagaacggcgagagcagccccagcagcagcagcagcgccggcgacctggcccacgccaacggcctgctgcccagcgcccccagcgccgccagcaacaacagcaacagcctgaacgtgaacaacggcgtgcccggcggcgccgccgccgccagcagcgccaccgtggccgccgccagcgccaccaccgccgccagcagcagcctggccacccccgagctgggcagcagcctgaagaagaagaagagactgagccagagcgacgaggacgtgatcagactgatcggccagcacctgaacggcctgggcctgaaccagaccgtggacctgctgatgcaggagagcggctgcagactggagcaccccagcgccaccaagttcagaaaccacgtgatggagggcgactgggacaaggccgagaacgacctgaacgagctgaagcccctggtgcacagcccccacgccatcgtggcccagaccttcagcgagaccagcatcaacttcttccccctgaccgccgccttctgccacgtgagaggctag

SEQ ID NO: 10599 - DNA, 2340 bp, Artificial Sequence; identical to SEQ ID NO: 10369
  Description of Artificial Sequence: Synthetic coding sequence

SEQ ID NO: 10600 - DNA, 666 bp, Artificial Sequence
  Description of Artificial Sequence: Synthetic coding sequence
atggccgccgccagcggcagcgtgctgcagagatgcatcgtgagccccgccggcagacacagcgccagcctgatcttcctgcacggcagcggcgacagcggccagggcctgagaatgtggatcaagcaggtgctgaaccaggacctgaccttccagcacatcaagatcatctaccccaccgccccccccagattcaagatcaccaacgactgccccgagcacctggagagcatcgacgtgatgtgccaggtgctgaccgacctgatcgacgaggaggtgaagagcggcatcaagaagaacagaatcctgatcggcggcttcagcatgggcggctgcatggccatccacctggcctacagaaaccaccaggacgtggccggcgtgttcgccctgagcagcttcctgaacaaggccagcgccgtgtaccaggccctgcagaagagcaacggcgtgctgcccgagctgttccagtgccacggcaccgccgacgagctggtgctgcacagctgggccgaggagaccaacagcatgctgaagagcctgggcgtgaccaccaagttccacagcttccccaacgtgtaccacgagctgagcaagaccgagctggacatcctgaagctgtggatcctgaccaagctgcccggcgagatggagaagcagaagtag

SEQ ID NO: 10601 - DNA, 714 bp, Artificial Sequence
  Description of Artificial Sequence: Synthetic coding sequence
atggccgccgccagcggcagcgtgctgcagagatgcatcgtgagccccgccggcagacacagcgccagcctgatcttcctgcacggcagcggcgacagcggccagggcctgagaatgtggatcaagcaggtgctgaaccaggacctgaccttccagcacatcaagatcatctaccccaccgccccccccagaagctacacccccatgaagggcggcatcagcaacgtgtggttcgacagattcaagatcaccaacgactgccccgagcacctggagagcatcgacgtgatgtgccaggtgctgaccgacctgatcgacgaggaggtgaagagcggcatcaagaagaacagaatcctgatcggcggcttcagcatgggcggctgcatggccatccacctggcctacagaaaccaccaggacgtggccggcgtgttcgccctgagcagcttcctgaacaaggccagcgccgtgtaccaggccctgcagaagagcaacggcgtgctgcccgagctgttccagtgccacggcaccgccgacgagctggtgctgcacagctgggccgaggagaccaacagcatgctgaagagcctgggcgtgaccaccaagttccacagcttccccaacgtgtaccacgagctgagcaagaccgagctggacatcctgaagctgtggatcctgaccaagctgcccggcgagatggagaagcagaagtag

SEQ ID NO: 10602 - DNA, 471 bp, Artificial Sequence
  Description of Artificial Sequence: Synthetic coding sequence
atggagaccgccaaggagatgaccagagagagcctgcccatcaagtgcctggaggccgtgatcctgggcatctacctgaccaacggccagcccagcatcgagagattccccatcagcttcaagacctacttcagcggcaactacttccaccacgtggtgctgggcatctactgcaacggcagatacggcagcctgggcatgagcagaagagccgagctgatggacaagcccctgaccttcagaaccctgagcgacctgatcttcgacttcgaggacagctacaagaagtacctgcacaccgtgaagaaggtgaagatcggcctgtacgtgccccacgagccccacagcttccagcccatcgagtggaagcagctggtgctgaacgtgagcaagatgctgagagccgacatcagaaaggagctggagaagtacgccagagacatgagaatgaagggcctgtgcagccactag

SEQ ID NO: 10603 - DNA, 936 bp, Artificial Sequence
  Description of Artificial Sequence: Synthetic coding sequence
atgaccggcagcgccgccgacacccacagatgcccccaccccaagggcgccaagggcaccagaagcagaagcagccacgccagacccgtgagcctggccaccagcggcggcagcgaggaggaggacaaggacggcggcgtgctgttccacgtgaacaagagcggcttccccatcgacagccacacctgggagagaatgtggatgcacgtggccaaggtgcaccccaagggcggcgagatggtgggcgccatcagaaacgccgccttcctggccaagcccagcatcccccaggtgcccaactacagactgagcatgaccatccccgactggctgcaggccatccagaactacatgaagaccctgcactacctgaccaacggccagcccagcatcgagagattccccatcagcttcaagacctacttcagcggcaactacttccaccacgtggtgctgggcatctactgcaacggcagatacggcagcctgggcatgagcagaagagccgagctgatggacaagcccctgaccttcagaaccctgagcgacctgatcttcgacttcgaggacagctacaagaagtacctgcacaccgtgaagaaggtgaagatcggcctgtacgtgccccacgagccccacagcttccagcccatcgagtggaagcagctggtgctgaacgtgagcaagatgctgagagccgacatcagaaaggagctggagaagtacgccagagacatgagaatgaagatcctgaagcccgccagcgcccacagccccacccaggtgagaagcagaggcaagagcctgagccccagaagaagacaggccagcccccccagaagactgggcagaagagagaagagccccgccctgcccgagaagaaggtggccgacctgagcaccctgaacgaggtgggctaccagatcagaatctag

SEQ ID NO: 10604 - DNA, 873 bp, Artificial Sequence
  Description of Artificial Sequence: Synthetic coding sequence
atgtggatgcacgtggccaaggtgcaccccaagggcggcgagatggtgggcgccatcagaaacgccgccttcctggccaagcccagcatcccccaggtgcccaactacagactgagcatgaccatccccgactggctgcaggccatccagaactacatgaagaccctgcagtacaaccacaccggcacccagttcttcgagatcagaaagatgagacccctgagcggcctgatggagaccgccaaggagatgaccagagagagcctgcccatcaagtgcctggaggccgtgatcctgggcatctacctgaccaacggccagcccagcatcgagagattccccatcagcttcaagacctacttcagcggcaactacttccaccacgtggtgctgggcatctactgcaacggcagatacggcagcctgggcatgagcagaagagccgagctgatggacaagcccctgaccttcagaaccctgagcgacctgatcttcgacttcgaggacagctacaagaagtacctgcacaccgtgaagaaggtgaagatcggcctgtacgtgccccacgagccccacagcttccagcccatcgagtggaagcagctggtgctgaacgtgagcaagatgctgagagccgacatcagaaaggagctggagaagtacgccagagacatgagaatgaagatcctgaagcccgccagcgcccacagccccacccaggtgagaagcagaggcaagagcctgagccccagaagaagacaggccagcccccccagaagactgggcagaagagagaagagccccgccctgcccgagaagaaggtggccgacctgagcaccctgaacgaggtgggctaccagatcagaatctag

SEQ ID NO: 10605 - DNA, 756 bp, Artificial Sequence
  Description of Artificial Sequence: Synthetic coding sequence
atgaccatccccgactggctgcaggccatccagaactacatgaagaccctgcagtacaaccacaccggcacccagttcttcgagatcagaaagatgagacccctgagcggcctgatggagaccgccaaggagatgaccagagagagcctgcccatcaagtgcctggaggccgtgatcctgggcatctacctgaccaacggccagcccagcatcgagagattccccatcagcttcaagacctacttcagcggcaactacttccaccacgtggtgctgggcatctactgcaacggcagatacggcagcctgggcatgagcagaagagccgagctgatggacaagcccctgaccttcagaaccctgagcgacctgatcttcgacttcgaggacagctacaagaagtacctgcacaccgtgaagaaggtgaagatcggcctgtacgtgccccacgagccccacagcttccagcccatcgagtggaagcagctggtgctgaacgtgagcaagatgctgagagccgacatcagaaaggagctggagaagtacgccagagacatgagaatgaagatcctgaagcccgccagcgcccacagccccacccaggtgagaagcagaggcaagagcctgagccccagaagaagacaggccagcccccccagaagactgggcagaagagagaagagccccgccctgcccgagaagaaggtggccgacctgagcaccctgaacgaggtgggctaccagatcagaatctag

SEQ ID NO: 10606 - DNA, 873 bp, Artificial Sequence; identical to SEQ ID NO: 10604
  Description of Artificial Sequence: Synthetic coding sequence

SEQ ID NO: 10607 - DNA, 723 bp, Artificial Sequence
  Description of Artificial Sequence: Synthetic coding sequence
atggccggcagccccgagctggtggtgctggaccccccctgggacaaggagctggccgccggcaccgagagccaggccctggtgagcgccacccccagagaggacttcagagtgagatgcaccagcaagagagccgtgaccgagatgctgcagctgtgcggcagattcgtgcagaagctgggcgacgccctgcccgaggagatcagagagcccgccctgagagacgcccagtggaccttcgagagcgccgtgcaggagaacatcagcatcaacggccaggcctggcaggaggccagcgacaactgcttcatggacagcgacatcaaggtgctggaggaccagttcgacgagatcatcgtggacatcgccaccaagagaaagcagtaccccagaaagatcctggagtgcgtgatcaagaccatcaaggccaagcaggagatcctgagcctgcccgccctgatcgagcagggcgagggcttcagccaggtgctgagaatgcagcccgtgatccacctgcagagaatccaccaggaggtgttcagcagctgccacagaaagcccgacgccaagcccgagaacttcatcacccagatcgagaccacccccaccgagaccgccagcagaaagaccagcgacatggtgctgaagagaaagcagaccaaggactgcccccagagaaagtggtaccccctgagacccaagaagatcaacctggacacctag

SEQ ID NO: 10608 - DNA, 519 bp, Artificial Sequence
  Description of Artificial Sequence: Synthetic coding sequence
atggccggcagccccgagctggtggtgctggaccccccctgggacaaggagctggccgccggcaccgagagccaggccctggtgagcgccacccccagagaggacttcagagtgagatgcaccagcaagagagccgtgaccgagatgctgcagctgtgcggcagattcgtgcagaagctgggcgacgccctgcccgaggagatcagagagcccgccctgagagacgcccagtggaccttcgagagcgccgtgcaggagaacatcagcatcaacggccaggcctggcaggaggccagcgacaactgcttcatggacagcgacatcaaggtgctggaggaccagttcgacgagatcatcgtggacatcgccaccaagagaaagcagtaccccagaaagatcctggagtgcgtgatcaagaccatcaaggccaagcaggagatcctgaagcagtaccaccccgtggtgcaccccctggacctgaagtacgaccccgaccccgtgctggcctgcatcaactag

SEQ ID NO: 10609 - DNA, 846 bp, Artificial Sequence
  Description of Artificial Sequence: Synthetic coding sequence
atggccggcagccccgagctggtggtgctggaccccccctgggacaaggagctggccgccggcaccgagagccaggccctggtgagcgccacccccagagaggacttcagagtgagatgcaccagcaagagagccgtgaccgagatgctgcagctgtgcggcagattcgtgcagaagctgggcgacgccctgcccgaggagatcagagagcccgccctgagagacgcccagtggaccttcgagagcgccgtgcaggagaacatcagcatcaacggccaggcctggcaggaggccagcgacaactgcttcatggacagcgacatcaaggtgctggaggaccagttcgacgagatcatcgtggacatcgccaccaagagaaagcagtaccccagaaagatcctggagtgcgtgatcaagaccatcaaggccaagcaggagatcctgaagcagtaccaccccgtggtgcaccccctggacctgaagtacgaccccgaccccgccccccacatggagaacctgaagtgcagaggcgagaccgtggccaaggagatcagcgaggccatgaagagcctgcccgccctgatcgagcagggcgagggcttcagccaggtgctgagaatgcagcccgtgatccacctgcagagaatccaccaggaggtgttcagcagctgccacagaaagcccgacgccaagcccgagaacttcatcacccagatcgagaccacccccaccgagaccgccagcagaaagaccagcgacatggtgctgaagagaaagcagaccaaggactgcccccagagaaagtggtaccccctgagacccaagaagatcaacctggacacctag

SEQ ID NO: 10610 - DNA, 228 bp, Artificial Sequence
  Description of Artificial Sequence: Synthetic coding sequence
atggacagcgacatcaaggtgctggaggaccagttcgacgagatcatcgtggacatcgccaccaagagaaagcagtaccccagaaagatcctggagtgcgtgatcaagaccatcaaggccaagcaggagatcctgaagcagtaccaccccgtggtgcaccccctggacctgaagtacgaccccgaccccggcgccaagcccggcggcctggccctgggcgccgtgtag

SEQ ID NO: 10611 - DNA, 279 bp, Artificial Sequence
  Description of Artificial Sequence: Synthetic coding sequence
atggaggactaccaggccgccgaggagaccgccttcgtggtggacgaggtgagcaacatcgtgaaggaggccatcgagagcgccatcggcggcaacgcctaccagcacagcaaggtgaaccagtggaccaccaacgtggtggagcagaccctgagccagctgaccaagctgggcaagcccttcaagtacatcggcaacggcgtgctgttcctgctgtacctgagagacggcttcctgaccctgatcagaggcgccagcagcaccagaaacaacagctag

SEQ ID NO: 10612 - DNA, 204 bp, Artificial Sequence
  Description of Artificial Sequence: Synthetic coding sequence
atgcagaagaacggcgccggcctgcacaccgccagcagctgcttctgggacagcagcaccgacggcatgatcttcatccacgtgtgcgaggtgctgctgtgcgagatctacgactggaagttccccatcttcgagtgcaacgcctgcctgagccccttcaagaccttcaacaacagactggccaaggtgctgtgcgtggcctag

SEQ ID NO: 10613 - DNA, 342 bp, Artificial Sequence
  Description of Artificial Sequence: Synthetic coding sequence
atggaggactaccaggccgccgaggagaccgccttcgtggtggacgaggtgagcaacatcgtgaaggaggccatcgagagcgccatcggcggcaacgcctaccagcacagcaaggtgaaccagtggaccaccaacgtggtggagcagaccctgagccagctgaccaagctgggcaagcccttcaagtacatcgtgacctgcgtgatcatgcagaagaacggcgccggcctgcacaccgccagcagctgcttctgggacagcagcaccgacggcagctgcaccgtgagatgggagaacaagaccatgtactgcatcgtgagcgccttcggcctgagcatctag

SEQ ID NO: 10614 - DNA, 2037 bp, Artificial Sequence
  Description of Artificial Sequence: Synthetic coding sequence
atgtacgccgccgtggagcacggccccgtgctgtgcagcgacagcaacatcctgtgcctgagctggaagggcagagtgcccaagagcgagaaggagaagcccgtgtgcagaagaagatactacgaggagggctggctggccaccggcaacggcagaggcgtggtgggcgtgaccttcaccagcagccactgcagaagagacagaagcaccccccagagaatcaacttcaacctgagaggccacaacagcgaggtggtgctggtgagatggaacgagccctaccagaagctggccacctgcgacgccgacggcggcatcttcgtgtggatccagtacgagggcagatggagcgtggagctggtgaacgacagaggcgcccaggtgagcgacttcacctggagccacgacggcacccaggccctgatcagctacagagacggcttcgtgctggtgggcagcgtgagcggccagagacactggagcagcgagatcaacctggagagccagatcacctgcggcatctggacccccgacgaccagcaggtgctgttcggcaccgccgacggccaggtgatcgtgatggactgccacggcagaatgctggcccacgtgctgctgcacgagagcgacggcgtgctgggcatgagctggaactaccccatcttcctggtggaggacagcagcgagagcgacaccgacagcgacgactacgcccccccccaggacggccccgccgcctaccccatccccgtgcagaacatcaagcccctgctgaccgtgagcttcaccagcggcgacatcagcctgatgaacaactacgacgacctgagccccaccgtgatcagaagcggcctgaaggaggtggtggcccagtggtgcacccagggcgacctgctggccgtggccggcatggagagacagacccagctgggcgagctgcccaacggccccctgctgaagagcgccatggtgaagttctacaacgtgagaggcgagcacatcttcaccctggacaccctggtgcagagacccatcatcagcatctgctggggccacagagacagcagactgctgatggccagcggccccgccctgtacgtggtgagagtggagcacagagtgagcagcctgcagctgctgtgccagcaggccatcgccagcaccctgagagaggacaaggacgtgagcaagctgaccctgccccccagactgtgcagctacctgagcaccgccttcatccccaccatcaagccccccatccccgaccccaacaacatgagagacttcgtgagctaccccagcgccggcaacgagagactgcactgcaccatgaagagaaccgaggacgaccccgaggtgggcggcccctgctacaccctgtacctggagtacctgggcggcctggtgcccatcctgaagggcagaagaatcagcaagctgagacccgagttcgtgatcatggaccccagaaccgacagcaagcccgacgagatctacggcaacagcctgatcagcaccgtgatcgacagctgcaactgcagcgacagcagcgacatcgagctgagcgacgactgggccgccaagaagagccccaagatcagcagagccagcaagagccccaagctgcccagaatcagcatcgaggccagaaagagccccaagctgcccagagccgcccaggagctgagcagaagccccagactgcccctgagaaagcccagcgtgggcagccccagcctgaccagaagagagttccccttcgaggacatcacccagcacaactacctggcccaggtgaccagcaacatctggggcaccaagttcaagatcgtgggcctggccgccttcctgcccaccaacctgggcgccgtgatctacaagaccagcctgctgcacctgcagcccagacagatgaccatctacctgcccgaggtgagaaagatcagcatggactacatcaacctgcccgtgttcaaccccaacgtgttcagcgaggacgaggacgacctgcccggcgacgccgtgtggaccgactag

SEQ ID NO: 10615 - DNA, 4632 bp, Artificial Sequence
  Description of Artificial Sequence: Synthetic coding sequence
atgtacgccgccgtggagcacggccccgtgctgtgcagcgacagcaacatcctgtgcctgagctggaagggcagagtgcccaagagcgagaaggagaagcccgtgtgcagaagaagatactacgaggagggctggctggccaccggcaacggcagaggcgtggtgggcgtgaccttcaccagcagccactgcagaagagacagaagcaccccccagagaatcaacttcaacctgagaggccacaacagcgaggtggtgctggtgagatggaacgagccctaccagaagctggccacctgcgacgccgacggcggcatcttcgtgtggatccagtacgagggcagatggagcgtggagctggtgaacgacagaggcgcccaggtgagcgacttcacctggagccacgacggcacccaggccctgatcagctacagagacggcttcgtgctggtgggcagcgtgagcggccagagacactggagcagcgagatcaacctggagagccagatcacctgcggcatctggacccccgacgaccagcaggtgctgttcggcaccgccgacggccaggtgatcgtgatggactgccacggcagaatgctggcccacgtgctgctgcacgagagcgacggcgtgctgggcatgagctggaactaccccatcttcctggtggaggacagcagcgagagcgacaccgacagcgacgactacgcccccccccaggacggccccgccgcctaccccatccccgtgcagaacatcaagcccctgctgaccgtgagcttcaccagcggcgacatcagcctgatgaacaactacgacgacctgagccccaccgtgatcagaagcggcctgaaggaggtggtggcccagtggtgcacccagggcgacctgctggccgtggccggcatggagagacagacccagctgggcgagctgcccaacggccccctgctgaagagcgccatggtgaagttctacaacgtgagaggcgagcacatcttcaccctggacaccctggtgcagagacccatcatcagcatctgctggggccacagagacagcagactgctgatggccagcggccccgccctgtacgtggtgagagtggagcacagagtgagcagcctgcagctgctgtgccagcaggccatcgccagcaccctgagagaggacaaggacgtgagcaagctgaccctgccccccagactgtgcagctacctgagcaccgccttcatccccaccatcaagccccccatccccgaccccaacaacatgagagacttcgtgagctaccccagcgccggcaacgagagactgcactgcaccatgaagagaaccgaggacgaccccgaggtgggcggcccctgctacaccctgtacctggagtacctgggcggcctggtgcccatcctgaagggcagaagaatcagcaagctgagacccgagttcgtgatcatggaccccagaaccgacagcaagcccgacgagatctacggcaacagcctgatcagcaccgtgatcgacagctgcaactgcagcgacagcagcgacatcgagctgagcgacgactgggccgccaagaagagccccaagatcagcagagccagcaagagccccaagctgcccagaatcagcatcgaggccagaaagagccccaagctgcccagagccgcccaggagctgagcagaagccccagactgcccctgagaaagcccagcgtgggcagccccagcctgaccagaagagagttccccttcgaggacatcacccagcacaactacctggcccaggtgaccagcaacatctggggcaccaagttcaagatcgtgggcctggccgccttcctgcccaccaacctgggcgccgtgatctacaagaccagcctgctgcacctgcagcccagacagatgaccatctacctgcccgaggtgagaaagatcagcatggactacatcaacctgcccgtgttcaaccccaacgtgttcagcgaggacgaggacgacctgcccgtgaccggcgccagcggcgtgcccgagaacagccccccctgcaccgtgaacatccccatcgcccccatccacagcagcgcccaggccatgagccccacccagagcatcggcctggtgcagagcctgctggccaaccagaacgtgcagctggacgtgctgaccaaccagaccaccgccgtgggcaccgccgagcacgccggcgacagcgccacccagtaccccgtgagcaacagatacagcaaccccggccaggtgatcttcggcagcgtggagatgggcagaatcatccagaaccccccccccctgagcctgcccccccccccccagggccccatgcagctgagcaccgtgggccacggcgacagagaccacgagcacctgcagaagagcgccaaggccctgagacccaccccccagctggccgccgagggcgacgccgtggtgttcagcgccccccaggaggtgcaggtgaccaagatcaaccccccccccccctaccccggcaccatccccgccgcccccaccaccgccgccccccccccccccctgccccccccccagccccccgtggacgtgtgcctgaagaagggcgacttcagcctgtaccccaccagcgtgcactaccagacccccctgggctacgagagaatcaccaccttcgacagcagcggcaacgtggaggaggtgtgcagacccagaaccagaatgctgtgcagccagaacacctacaccctgcccggccccggcagcagcgccaccctgagactgaccgccaccgagaagaaggtgccccagccctgcagcagcgccaccctgaacagactgaccgtgcccagatacagcatccccaccggcgacccccccccctaccccgagatcgccagccagctggcccagggcagaggcgccgcccagagaagcgacaacagcctgatccacgccaccctgagaagaaacaacagagaggccaccctgaagatggcccagctggccgacagccccagagcccccctgcagcccctggccaagagcaagggcggccccggcggcgtggtgacccagctgcccgccagacccccccccgccctgtacacctgcagccagtgcagcggcaccggccccagcagccagcccggcgccagcctggcccacaccgccagcgccagccccctggccagccagagcagctacagcctgctgagcccccccgacagcgccagagacagaaccgactacgtgaacagcgccttcaccgaggacgaggccctgagccagcactgccagctggagaagcccctgagacacccccccctgcccgaggccgccgtgaccctgaagagaccccccccctaccagtgggaccccatgctgggcgaggacgtgtgggtgccccaggagagaaccgcccagaccagcggccccaaccccctgaagctgagcagcctgatgctgagccagggccagcacctggacgtgagcagactgcccttcatcagccccaagagccccgccagccccaccgccaccttccagaccggctacggcatgggcgtgccctaccccggcagctacaacaacccccccctgcccggcgtgcaggccccctgcagccccaaggacgccctgagccccacccagttcgcccagcaggagcccgccgtggtgctgcagcccctgtacccccccagcctgagctactgcaccctgccccccatgtaccccggcagcagcacctgcagcagcctgcagctgccccccgtggccctgcacccctggagcagctacagcgcctgcccccccatgcagaacccccagggcaccctgccccccaagccccacctggtggtggagaagcccctggtgagccccccccccgccgacctgcagagccacctgggcaccgaggtgatggtggagaccgccgacaacttccaggaggtgctgagcctgaccgagagccccgtgccccagagaaccgagaagttcggcaagaagaacagaaagagactggacagcagagccgaggagggcagcgtgcaggccatcaccgagggcaaggtgaagaaggaggccagaaccctgagcgacttcaacagcctgatcagcagcccccacctgggcagagagaagaagaaggtgaagagccagaaggaccagctgaagagcaagaagctgaacaagaccaacgagttccaggacagcagcgagagcgagcccgagctgttcatcagcggcgacgagctgatgaaccagagccagggcagcagaaagggctggaagagcaagagaagccccagagccgccggcgagctggaggaggccaagtgcagaagagccagcgagaaggaggacggcagactgggcagccagggcttcgtgtacgtgatggccaacaagcagcccctgtggaacgaggccacccaggtgtaccagctggacttcggcggcagagtgacccaggagagcgccaagaacttccagatcgagctggagggcagacaggtgatgcagttcggcagaatcgacggcagcgcctacatcctggacttccagtaccccttcagcgccgtgcaggccttcgccgtggccctggccaacgtgacccagagactgaagtag

SEQ ID NO: 10616 - DNA, 3234 bp, Artificial Sequence
  Description of Artificial Sequence: Synthetic coding sequence
atggacagcaagatgaagaagatggccgagctgcagctgagcgtggtgagcgaccccaagaacagaaaggccatcgagaaccagatccagcagtgggagcagaacctggagaagttccacatggacctgttcagaatgagatgctacctggccagcctgcagggcggcgagctgcccaaccccaagagcctgctggccgccgccagcagacccagcaagctggccctgggcagactgggcatcctgagcgtgagcagcttccacgccctggtgtgcagcagagacgacagcgccctgagaaagagaaccctgagcctgacccagagaggcagaaacaagaagggcatcttcagcagcctgaagggcctggacaccctggccagaaagggcaaggagaagagacccagcatcacccagatcttcgacagcagcggcagccacggcttcagcggcacccagctgccccagaacagcagcaacagcagcgaggtggacgagctgctgcacatctacggcagcaccgtggacggcgtgcccagagacaacgcctgggagatccagacctacgtgcacttccaggacaaccacggcgtgaccgtgggcatcaagcccgagcacagagtggaggacatcctgaccctggcctgcaagatgagacagctggagcccagccactacggcctgcagctgagaaagctggtggacgacaacgtggagtactgcatccccgccccctacgagtacatgcagcagcaggtgtacgacgagatcgaggtgttccccctgaacgtgtacgacgtgcagctgaccaagaccggcagcgtgtgcgacttcggcttcgccgtgaccgcccaggtggacgagagacagcacctgagcagaatcttcatcagcgacgtgctgcccgacggcctggcctacggcgagggcctgagaaagggcaacgagatcatgaccctgaacggcgaggccgtgagcgacctggacctgaagcagatggaggccctgttcagcgagaagagcgtgggcctgaccctgatcgccagaccccccgacaccaaggccaccctgtgcaccagctggagcgacagcgacctgttcagcagagaccagaagagcctgctgcccccccccaaccagagccagctgctggaggagttcctggacaacttcaagaagaacaccgccaacgacttcagcaacgtgcccgacatcaccaccggcctgaagagaagccagaccgacggcaccctggaccaggtgagccacagagagaagatggagcagaccttcagaagcgccgagcagatcaccgccctgtgcagaagcttcaacgacagccaggccaacggcatggagggccccagagagaaccaggaccccccccccagaagcctggccagacacctgagcgacgccgacagactgagaaaggtgatccaggagctggtggacaccgagaagagctacgtgaaggacctgagctgcctgttcgagctgtacctggagcccctgcagaacgagaccttcctgacccaggacgagatggagagcctgttcggcagcctgcccgagatgctggagttccagaaggtgttcctggagaccctggaggacggcatcagcgccagcagcgacttcaacaccctggagacccccagccagttcagaaagctgctgttcagcctgggcggcagcttcctgtactacgccgaccacttcaagctgtacagcggcttctgcgccaaccacatcaaggtgcagaaggtgctggagagagccaagaccgacaaggccttcaaggccttcctggacgccagaaaccccaccaagcagcacagcagcaccctggagagctacctgatcaagcccgtgcagagagtgctgaagtaccccctgctgctgaaggagctggtgagcctgaccgaccaggagagcgaggagcactaccacctgaccgaggccctgaaggccatggagaaggtggccagccacatcaacgagatgcagaagatctacgaggactacggcaccgtgttcgaccagctggtggccgagcagagcggcaccgagaaggaggtgaccgagctgagcatgggcgagctgctgatgcacagcaccgtgagctggctgaaccccttcctgagcctgggcaaggccagaaaggacctggagctgaccgtgttcgtgttcaagagagccgtgatcctggtgtacaaggagaactgcaagctgaagaagaagctgcccagcaacagcagacccgcccacaacagcaccgacctggaccccttcaagttcagatggctgatccccatcagcgccctgcaggtgagactgggcaaccccgccggcaccgagaacaacagcatctgggagctgatccacaccaagagcgagatcgagggcagacccgagaccatcttccagctgtgctgcagcgacagcgagagcaagaccaacatcgtgaaggtgatcagaagcatcctgagagagaacttcagaagacacatcaagtgcgagctgcccctggagaagacctgcaaggacagactggtgcccctgaagaacagagtgcccgtgagcgccaagctggccagcagcagaagcctgaaggtgctgaagaacagcagcagcaacgagtggaccggcgagaccggcaagggcaccctgctggacagcgacgagggcagcctgagcagcggcacccagagcagcggctgccccaccgccgagggcagacaggacagcaagagcaccagccccggcaagtacccccaccccggcctggccgacttcgccgacaacctgatcaaggagagcgacatcctgagcgacgaggacgacgaccacagacagaccgtgaagcagggcagccccaccaaggacatcgagatccagttccagagactgagaatcagcgaggaccccgacgtgcaccccgaggccgagcagcagcccggccccgagagcggcgagggccagaagggcggcgagcagcccaagctggtgagaggccacttctgccccatcaagagaaaggccaacagcaccaagagagacagaggcaccctgctgaaggcccagatcagacaccagagcctggacagccagagcgagaacgccaccatcgacctgaacagcgtgctggagagagagttcagcgtgcagagcctgaccagcgtggtgagcgaggagtgcttctacgagaccgagagccacggcaagagctag

SEQ ID NO: 10617 - DNA, 579 bp, Artificial Sequence
  Description of Artificial Sequence: Synthetic coding sequence
atgagccagtgcgcctgcctggaggaggtgcacctgcccaacatcaagcccggcgagggcctgggcatgtacatcaagagcacctacgacggcctgcacgtgatcaccggcaccaccgagaacgtgggctggcagctgaagaacctggtgaagaagctgagagagaaccccaccggcgtggtgctgctgctgaagaagagacccaccggcagcttcaacttcacccccgcccccctgaagaacctgagatggaagccccccctggtgcagaccagccccccccccgccaccacccagagccccgagagcaccatggacaccagcctgaagaaggagaagagcgccatcctggacctgtacatcccccccccccccgccgtgccctacagccccagagacgagaacggcagcttcgtgtacggcggcagcagcaagtgcaagcagcccctgcccggccccaagggcagcgagagccccaacagcttcctggaccaggagagcagaagaagaagattcaccatcgccgacagcgaccagctgcccggctacagcgtggagaccaacatcctgcccacctag

SEQ ID NO: 10618 - DNA, 1668 bp, Artificial Sequence
  Description of Artificial Sequence: Synthetic coding sequence
atggagcccgtgaccaagtggagccccaagcaggtggtggactggaccagaggcctggacgactgcctgcagcagtacgtgcacaagttcgagagagagaagatcaacggcgagcagctgctgcagatcagccaccaggacctggaggagctgggcgtgaccagaatcggccaccaggagctggtgctggaggccgtggacctgctgtgcgccctgaactacggcctggagaccgacaacatgaagaacctggtgctgaagctgagagccagcagccacaacctgcagaactacatcagcagcagaagaaagagccccgcctacgacggcaacaccagcagaaaggcccccaacgagttcctgaccagcgtggtggagctgatcggcgccgccaaggccctgctggcctggctggacagagcccccttcaccggcatcaccgacttcagcgtgaccaagaacaagatcatccagctgtgcctggacctgaccaccaccgtgcagaaggactgcttcgtggccgagatggaggacaaggtgctgaccgtggtgaaggtgctgaacggcatctgcgacaagaccatcagaagcaccaccgaccccgtgatgagccagtgcgcctgcctggaggaggtgcacctgcccaacatcaagcccggcgagggcctgggcatgtacatcaagagcacctacgacggcctgcacgtgatcaccggcaccaccgagaacagccccgccgacagaagccagaagatccacgccggcgacgaggtgatccaggtgaaccagcagaccgtggtgggctggcagctgaagaacctggtgaagaagctgagagagaaccccaccggcgtggtgctgctgctgaagaagagacccaccggcagcttcaacttcacccccgcccccctgaagaacctgagatggaagccccccctggtgcagaccagccccccccccgccaccacccagagccccgagagcaccatggacaccagcctgaagaaggagaagagcgccatcctggacctgtacatcccccccccccccgccgtgccctacagccccagagacgagaacggcagcttcgtgtacggcggcagcagcaagtgcaagcagcccctgcccggccccaagggcagcgagagccccaacagcttcctggaccaggagagcagaagaagaagattcaccatcgccgacagcgaccagctgcccggctacagcgtggagaccaacatcctgcccaccaagatgagagagaagacccccagctacggcaagcccagacccctgagcatgcccgccgacggcaactggatgggcatcgtggaccccttcgccagacccagaggccacggcagaaagggcgaggacgccctgtgcagatacttcagcaacgagagaatcccccccatcatcgaggagagcagcagccccccctacagattcagcagacccaccaccgagagacacctggtgagaggcgccgactacatcagaggcagcagatgctacatcaacagcgacctgcacagcagcgccaccatccccttccaggaggagggcaccaagaagaagagcggcagcagcgccaccaagagcagcagcaccgagcccagcctgctggtgagctggttcaccagactgaagctgctgacccactag

SEQ ID NO: 10619 - DNA, 708 bp, Artificial Sequence
  Description of Artificial Sequence: Synthetic coding sequence
atgagaagcagagtgctgtggggcgccgccagatggctgtggcccagaagagccgtgggccccgccagaagacccctgagcagcggcagcccccccctggaggagctgttcaccagaggcggccccctgagaaccttcctggagagacaggccggcagcgaggcccacctgaaggtgagaagacccgagctgctggccgtgatcaagctgctgaacgagaaggagagagagctgagagagaccgagcacctgctgcacgacgagaacgaggacctgagaaagctggccgagaacgagatcaccctgtgccagaaggagatcacccagctgaagcaccagatcatcctgctgctggtgcccagcgaggagaccgacgagaacgacctgatcctggaggtgaccgccggcgtgggcggcggcctgagacacgccagcgccagcatcggcggcagcgaggcctacagacacatgaagttcgagggcggcgtgcacagagtgcagagagtgcccaagaccgagaagcagggcagagtgcacaccagcaccatgaccgtggccatcctgccccagcccaccgagatcaacctggtgatcaaccccaaggacctgagaatcgacaccaagagagccagcggcgccggcggccagcacgtgaacaccaccgacagcgccgtgagaatcgtgcacctgcccaccgactggaagtag

SEQ ID NO: 10620 - DNA, 816 bp, Artificial Sequence
  Description of Artificial Sequence: Synthetic coding sequence
atgagaagcagagtgctgtggggcgccgccagatggctgtggcccagaagagccgtgggccccgccagaagacccctgagcagcggcagcccccccctggaggagctgttcaccagaggcggccccctgagaaccttcctggagagacaggccggcagcgaggcccacctgaaggtgagaagacccgagctgctggccgtgatcaagctgctgaacgagaaggagagagagctgagagagaccgagcacctgctgcacgacgagaacgaggacctgagaaagctggccgagaacgagatcaccctgtgccagaaggagatcacccagctgaagcaccagatcatcctgctgctggtgcccagcgaggagaccgacgagaacgacctgatcctggaggtgaccgccggcgtgggcggccaggaggccatgctgttcaccagcgagatcttcgacatgtaccagcagtacgccgccttcaagagatggcacttcgagaccctggagtacttccccagcgagctgggcggcctgagacacgccagcgccagcatcggcggcagcgaggcctacagacacatgaagttcgagggcggcgtgcacagagtgcagagagtgcccaagaccgagaagcagggcagagtgcacaccagcaccatgaccgtggccatcctgccccagcccaccgagatcaacctggtgatcaaccccaaggacctgagaatcgacaccaagagagccagcggcgccggcggccagcacgtgaacaccaccgacagcgccgtgagaatcgtgcacctgcccaccgactggaagtag

SEQ ID NO: 10621 - DNA, 1143 bp, Artificial Sequence
  Description of Artificial Sequence: Synthetic coding sequence
atgagaagcagagtgctgtggggcgccgccagatggctgtggcccagaagagccgtgggccccgccagaagacccctgagcagcggcagcccccccctggaggagctgttcaccagaggcggccccctgagaaccttcctggagagacaggccggcagcgaggcccacctgaaggtgagaagacccgagctgctggccgtgatcaagctgctgaacgagaaggagagagagctgagagagaccgagcacctgctgcacgacgagaacgaggacctgagaaagctggccgagaacgagatcaccctgtgccagaaggagatcacccagctgaagcaccagatcatcctgctgctggtgcccagcgaggagaccgacgagaacgacctgatcctggaggtgaccgccggcgtgggcggccaggaggccatgctgttcaccagcgagatcttcgacatgtaccagcagtacgccgccttcaagagatggcacttcgagaccctggagtacttccccagcgagctgggcggcctgagacacgccagcgccagcatcggcggcagcgaggcctacagacacatgaagttcgagggcggcgtgcacagagtgcagagagtgcccaagaccgagaagcagggcagagtgcacaccagcaccatgaccgtggccatcctgccccagcccaccgagatcaacctggtgatcaaccccaaggacctgagaatcgacaccaagagagccagcggcgccggcggccagcacgtgaacaccaccgacagcgccgtgagaatcgtgcacctgcccaccggcgtggtgagcgagtgccagcaggagagaagccagctgaagaacaaggagctggccatgaccaagctgagagccaagctgtacagcatgcacctggaggaggagatcaacaagagacagaacgccagaaagatccagatcggcagcaagggcagaagcgagaagatcagaacctacaacttcccccagaacagagtgaccgaccacagaatcaacaagaccctgcacgacctggagaccttcatgcagggcgactacctgctggacgagctggtgcagagcctgaaggagtacgccgactacgagagcctggtggagatcatcagccagaaggtgtag
